United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 126

SEQ ID NO: 5343579 - DNA, 19 bp, Homo sapiens
aaattttttgatgtcagcc

SEQ ID NO: 5343580 - DNA, 14 bp, Homo sapiens
aaattttttgttga

SEQ ID NO: 5343581 - DNA, 15 bp, Homo sapiens
aaattttttgttgac

SEQ ID NO: 5343582 - DNA, 15 bp, Homo sapiens
aaatttttttagaaa

SEQ ID NO: 5343583 - DNA, 21 bp, Homo sapiens
aaatttttttagaaagcattt

SEQ ID NO: 5343584 - DNA, 16 bp, Homo sapiens
aaatttttttccagaa

SEQ ID NO: 5343585 - DNA, 16 bp, Homo sapiens
aaatttttttcctaag

SEQ ID NO: 5343586 - DNA, 12 bp, Homo sapiens
aaatttttttgt

SEQ ID NO: 5343587 - DNA, 13 bp, Homo sapiens
aaatttttttgta

SEQ ID NO: 5343588 - DNA, 18 bp, Homo sapiens
aaatttttttgtatgaaa

SEQ ID NO: 5343589 - DNA, 20 bp, Homo sapiens
aaatttttttgtatttttag

SEQ ID NO: 5343590 - DNA, 23 bp, Homo sapiens
aaattttttttcatgctttatca

SEQ ID NO: 5343591 - DNA, 23 bp, Homo sapiens
aaattttttttcatgttttaaca

SEQ ID NO: 5343592 - DNA, 20 bp, Homo sapiens
aaattttttttggtcaaatt

SEQ ID NO: 5343593 - DNA, 19 bp, Homo sapiens
aaatttttttttaaagcag

SEQ ID NO: 5343594 - DNA, 17 bp, Homo sapiens
aaatttttttttctctt

SEQ ID NO: 5343595 - DNA, 16 bp, Homo sapiens
aacaaaaaaaaaatga

SEQ ID NO: 5343596 - DNA, 12 bp, Homo sapiens
aacaaaaaaact

SEQ ID NO: 5343597 - DNA, 15 bp, Homo sapiens
aacaaaaaaagacaa

SEQ ID NO: 5343598 - DNA, 21 bp, Homo sapiens
aacaaaaaaagacaagagaga

SEQ ID NO: 5343599 - DNA, 19 bp, Homo sapiens
aacaaaaaaagtttgttac

SEQ ID NO: 5343600 - DNA, 12 bp, Homo sapiens
aacaaaaaacaa

SEQ ID NO: 5343601 - DNA, 13 bp, Homo sapiens
aacaaaaaataaa

SEQ ID NO: 5343602 - DNA, 15 bp, Homo sapiens
aacaaaaaataaaga

SEQ ID NO: 5343603 - DNA, 22 bp, Homo sapiens
aacaaaaaataaattttaaaaa

SEQ ID NO: 5343604 - DNA, 18 bp, Homo sapiens
aacaaaaactttccatga

SEQ ID NO: 5343605 - DNA, 11 bp, Homo sapiens
aacaaaaagaa

SEQ ID NO: 5343606 - DNA, 16 bp, Homo sapiens
aacaaaaagacatgga

SEQ ID NO: 5343607 - DNA, 15 bp, Homo sapiens
aacaaaaagctaaca

SEQ ID NO: 5343608 - DNA, 17 bp, Homo sapiens
aacaaaaagctaacatc

SEQ ID NO: 5343609 - DNA, 15 bp, Homo sapiens
aacaaaaagtaaagt

SEQ ID NO: 5343610 - DNA, 18 bp, Homo sapiens
aacaaaaagtaatgtata

SEQ ID NO: 5343611 - DNA, 21 bp, Homo sapiens
aacaaaaagttttttttttgt

SEQ ID NO: 5343612 - DNA, 14 bp, Homo sapiens
aacaaaaatagaat

SEQ ID NO: 5343613 - DNA, 16 bp, Homo sapiens
aacaaaaatagaatat

SEQ ID NO: 5343614 - DNA, 17 bp, Homo sapiens
aacaaaaatgctgccag

SEQ ID NO: 5343615 - DNA, 14 bp, Homo sapiens
aacaaaaatttgaa

SEQ ID NO: 5343616 - DNA, 13 bp, Homo sapiens
aacaaaacaagaa

SEQ ID NO: 5343617 - DNA, 20 bp, Homo sapiens
aacaaaacagtcctttaaat

SEQ ID NO: 5343618 - DNA, 14 bp, Homo sapiens
aacaaaaccagctg

SEQ ID NO: 5343619 - DNA, 16 bp, Homo sapiens
aacaaaaccagctgct

SEQ ID NO: 5343620 - DNA, 14 bp, Homo sapiens
aacaaaacgaaact

SEQ ID NO: 5343621 - DNA, 9 bp, Homo sapiens
aacaaaact

SEQ ID NO: 5343622 - DNA, 15 bp, Homo sapiens
aacaaaactatggaa

SEQ ID NO: 5343623 - DNA, 16 bp, Homo sapiens
aacaaaactatggaaa

SEQ ID NO: 5343624 - DNA, 17 bp, Homo sapiens
aacaaaactatggaaat

SEQ ID NO: 5343625 - DNA, 14 bp, Homo sapiens
aacaaaactcttaa

SEQ ID NO: 5343626 - DNA, 17 bp, Homo sapiens
aacaaaactgcatttca

SEQ ID NO: 5343627 - DNA, 14 bp, Homo sapiens
aacaaaacttctat

SEQ ID NO: 5343628 - DNA, 22 bp, Homo sapiens
aacaaaagaagcccggctcctg

SEQ ID NO: 5343629 - DNA, 22 bp, Homo sapiens
aacaaaagatttgtttttgtag

SEQ ID NO: 5343630 - DNA, 21 bp, Homo sapiens
aacaaaaggacttcaggaaca

SEQ ID NO: 5343631 - DNA, 12 bp, Homo sapiens
aacaaaagggtc

SEQ ID NO: 5343632 - DNA, 20 bp, Homo sapiens
aacaaaagggtgtatagtgt

SEQ ID NO: 5343633 - DNA, 23 bp, Homo sapiens
aacaaaagggtgtatagtgttca

SEQ ID NO: 5343634 - DNA, 17 bp, Homo sapiens
aacaattcatgcctttc

SEQ ID NO: 5343635 - DNA, 22 bp, Homo sapiens
aacaattcatgcctttcatagt

SEQ ID NO: 5343636 - DNA, 18 bp, Homo sapiens
aacaattcccttcttttt

SEQ ID NO: 5343637 - DNA, 16 bp, Homo sapiens
aacaattgaagtaaac

SEQ ID NO: 5343638 - DNA, 17 bp, Homo sapiens
aacaattgaagtaaact

SEQ ID NO: 5343639 - DNA, 13 bp, Homo sapiens
aacaattgatttt

SEQ ID NO: 5343640 - DNA, 16 bp, Homo sapiens
aacaattggtaaaact

SEQ ID NO: 5343641 - DNA, 17 bp, Homo sapiens
aacaattggtaaaactc

SEQ ID NO: 5343642 - DNA, 24 bp, Homo sapiens
aacaattggtaaaactcactgtga

SEQ ID NO: 5343643 - DNA, 18 bp, Homo sapiens
aacaattggttgtatata

SEQ ID NO: 5343644 - DNA, 19 bp, Homo sapiens
aacaattggttgtatataa

SEQ ID NO: 5343645 - DNA, 17 bp, Homo sapiens
aacaattgtcttaaaac

SEQ ID NO: 5343646 - DNA, 15 bp, Homo sapiens
aacaattgtgacagc

SEQ ID NO: 5343647 - DNA, 16 bp, Homo sapiens
aacaattgtgacagca

SEQ ID NO: 5343648 - DNA, 18 bp, Homo sapiens
aacaattgtgtagccttt

SEQ ID NO: 5343649 - DNA, 20 bp, Homo sapiens
aacaattgtgtagccttttt

SEQ ID NO: 5343650 - DNA, 15 bp, Homo sapiens
aacaattgtgttttc

SEQ ID NO: 5343651 - DNA, 13 bp, Homo sapiens
aacaatttctgtc

SEQ ID NO: 5343652 - DNA, 16 bp, Homo sapiens
aacaattttaaataag

SEQ ID NO: 5343653 - DNA, 13 bp, Homo sapiens
aacaattttaatg

SEQ ID NO: 5343654 - DNA, 22 bp, Homo sapiens
aacaattttcagacctgttggt

SEQ ID NO: 5343655 - DNA, 14 bp, Homo sapiens
aacaattttcagat

SEQ ID NO: 5343656 - DNA, 18 bp, Homo sapiens
aacaattttcagatttgc

SEQ ID NO: 5343657 - DNA, 21 bp, Homo sapiens
aacaattttcagatttgcaca

SEQ ID NO: 5343658 - DNA, 17 bp, Homo sapiens
aacaattttttttaatt

SEQ ID NO: 5343659 - DNA, 17 bp, Homo sapiens
aacacaaaacattcatg

SEQ ID NO: 5343660 - DNA, 21 bp, Homo sapiens
aacacaaaacattcatgtaac

SEQ ID NO: 5343661 - DNA, 14 bp, Homo sapiens
aacacaaaacattt

SEQ ID NO: 5343662 - DNA, 21 bp, Homo sapiens
aacacaaaacatttaaataaa

SEQ ID NO: 5343663 - DNA, 20 bp, Homo sapiens
aacacaaaatgaataaaagt

SEQ ID NO: 5343664 - DNA, 20 bp, Homo sapiens
aacacaaagacacaggaaga

SEQ ID NO: 5343665 - DNA, 19 bp, Homo sapiens
aacacaaagaccaaaatga

SEQ ID NO: 5343666 - DNA, 20 bp, Homo sapiens
aacacaaagaccaaaatgaa

SEQ ID NO: 5343667 - DNA, 14 bp, Homo sapiens
aacacaaagatcaa

SEQ ID NO: 5343668 - DNA, 21 bp, Homo sapiens
aacacaaagcttttgcatatt

SEQ ID NO: 5343669 - DNA, 21 bp, Homo sapiens
aacacaaatgaaaatgaatag

SEQ ID NO: 5343670 - DNA, 23 bp, Homo sapiens
aacacaaatgtctagtttctagt

SEQ ID NO: 5343671 - DNA, 17 bp, Homo sapiens
aacacaacaataacttt

SEQ ID NO: 5343672 - DNA, 16 bp, Homo sapiens
aacacaacatttgtgt

SEQ ID NO: 5343673 - DNA, 22 bp, Homo sapiens
aacacaagaaaaagataagaaa

SEQ ID NO: 5343674 - DNA, 18 bp, Homo sapiens
aacacaagattggtgttt

SEQ ID NO: 5343675 - DNA, 19 bp, Homo sapiens
aacacaagattggtgtttt

SEQ ID NO: 5343676 - DNA, 20 bp, Homo sapiens
aacacaagattggtgttttt

SEQ ID NO: 5343677 - DNA, 17 bp, Homo sapiens
aacacaagcaaaccttc

SEQ ID NO: 5343678 - DNA, 14 bp, Homo sapiens
aacacaagccacag

SEQ ID NO: 5343679 - DNA, 17 bp, Homo sapiens
aacacaagccacagaag

SEQ ID NO: 5343680 - DNA, 15 bp, Homo sapiens
aacacaagctggaag

SEQ ID NO: 5343681 - DNA, 18 bp, Homo sapiens
aacacaagctggaagcac

SEQ ID NO: 5343682 - DNA, 18 bp, Homo sapiens
aacacaagggatataaaa

SEQ ID NO: 5343683 - DNA, 20 bp, Homo sapiens
aacacaagggatataaaatg

SEQ ID NO: 5343684 - DNA, 21 bp, Homo sapiens
aacacaaggtcatggccacac

SEQ ID NO: 5343685 - DNA, 21 bp, Homo sapiens
aacacaatacctacaataaac

SEQ ID NO: 5343686 - DNA, 22 bp, Homo sapiens
aacacaatatgagtaatgttta

SEQ ID NO: 5343687 - DNA, 12 bp, Homo sapiens
aacacaatcaaa

SEQ ID NO: 5343688 - DNA, 22 bp, Homo sapiens
aacacaattttattttttttct

SEQ ID NO: 5343689 - DNA, 17 bp, Homo sapiens
aacacaattttcacttt

SEQ ID NO: 5343690 - DNA, 11 bp, Homo sapiens
aacacacaaaa

SEQ ID NO: 5343691 - DNA, 12 bp, Homo sapiens
aacacacacaca

SEQ ID NO: 5343692 - DNA, 15 bp, Homo sapiens
aacacacacacacac

SEQ ID NO: 5343693 - DNA, 15 bp, Homo sapiens
aacacacacacacgc

SEQ ID NO: 5343694 - DNA, 18 bp, Homo sapiens
aacacacactcccaccct

SEQ ID NO: 5343695 - DNA, 16 bp, Homo sapiens
aacacacagactttct

SEQ ID NO: 5343696 - DNA, 16 bp, Homo sapiens
aacacacagatctgca

SEQ ID NO: 5343697 - DNA, 11 bp, Homo sapiens
aacacacagga

SEQ ID NO: 5343698 - DNA, 19 bp, Homo sapiens
aacacacagtatagataaa

SEQ ID NO: 5343699 - DNA, 23 bp, Homo sapiens
aacacacagtatagataaatcca

SEQ ID NO: 5343700 - DNA, 18 bp, Homo sapiens
aacacacataaaggataa

SEQ ID NO: 5343701 - DNA, 16 bp, Homo sapiens
aacacaccaggctgtg

SEQ ID NO: 5343702 - DNA, 20 bp, Homo sapiens
aacacacgcgcgcacacaca

SEQ ID NO: 5343703 - DNA, 13 bp, Homo sapiens
aacacacgctcct

SEQ ID NO: 5343704 - DNA, 17 bp, Homo sapiens
aacacactaccgaatgt

SEQ ID NO: 5343705 - DNA, 18 bp, Homo sapiens
aacacactcaaaagacaa

SEQ ID NO: 5343706 - DNA, 12 bp, Homo sapiens
aacacactgaaa

SEQ ID NO: 5343707 - DNA, 19 bp, Homo sapiens
aacacactgaggcagggaa

SEQ ID NO: 5343708 - DNA, 14 bp, Homo sapiens
aacacactgagtga

SEQ ID NO: 5343709 - DNA, 13 bp, Homo sapiens
aacacactgtaaa

SEQ ID NO: 5343710 - DNA, 13 bp, Homo sapiens
aacacactgtgtc

SEQ ID NO: 5343711 - DNA, 19 bp, Homo sapiens
aacacactgtgtcctggtg

SEQ ID NO: 5343712 - DNA, 19 bp, Homo sapiens
aacacacttttctttttaa

SEQ ID NO: 5343713 - DNA, 23 bp, Homo sapiens
aacacacttttctttttaaatgt

SEQ ID NO: 5343714 - DNA, 21 bp, Homo sapiens
aacacacttttgcacatatat

SEQ ID NO: 5343715 - DNA, 22 bp, Homo sapiens
aacacacttttgcacatatatt

SEQ ID NO: 5343716 - DNA, 12 bp, Homo sapiens
aacacagagaaa

SEQ ID NO: 5343717 - DNA, 22 bp, Homo sapiens
aacacagagaagcggatttcca

SEQ ID NO: 5343718 - DNA, 22 bp, Homo sapiens
aacacagagtgtgtttttgcac

SEQ ID NO: 5343719 - DNA, 19 bp, Homo sapiens
aacacagataattttttct

SEQ ID NO: 5343720 - DNA, 14 bp, Homo sapiens
aacacagatattgt

SEQ ID NO: 5343721 - DNA, 16 bp, Homo sapiens
aacacagattattcat

SEQ ID NO: 5343722 - DNA, 18 bp, Homo sapiens
aacacagcaattcctcag

SEQ ID NO: 5343723 - DNA, 23 bp, Homo sapiens
aacacagcagttctgcagaggac

SEQ ID NO: 5343724 - DNA, 16 bp, Homo sapiens
aacacagcatgcattt

SEQ ID NO: 5343725 - DNA, 20 bp, Homo sapiens
aacacagcatgcatttagca

SEQ ID NO: 5343726 - DNA, 21 bp, Homo sapiens
aacacagcctccctgagcctg

SEQ ID NO: 5343727 - DNA, 14 bp, Homo sapiens
aacacagccttcct

SEQ ID NO: 5343728 - DNA, 22 bp, Homo sapiens
aacacagctacaaccctaccct

SEQ ID NO: 5343729 - DNA, 14 bp, Homo sapiens
aacacagctgctga

SEQ ID NO: 5343730 - DNA, 17 bp, Homo sapiens
aacacagctgttcttct

SEQ ID NO: 5343731 - DNA, 13 bp, Homo sapiens
aacacaggcagct

SEQ ID NO: 5343732 - DNA, 14 bp, Homo sapiens
aacacaggcagctt

SEQ ID NO: 5343733 - DNA, 18 bp, Homo sapiens
aacacaggcagctttcta

SEQ ID NO: 5343734 - DNA, 16 bp, Homo sapiens
aacacaggccaccctg

SEQ ID NO: 5343735 - DNA, 23 bp, Homo sapiens
aacacaggcttatttttaaaata

SEQ ID NO: 5343736 - DNA, 14 bp, Homo sapiens
aacacagggaaagc

SEQ ID NO: 5343737 - DNA, 15 bp, Homo sapiens
aacacagggttttgt

SEQ ID NO: 5343738 - DNA, 18 bp, Homo sapiens
aacacaggtagcacagat

SEQ ID NO: 5343739 - DNA, 20 bp, Homo sapiens
aacacaggtgttggaagcca

SEQ ID NO: 5343740 - DNA, 14 bp, Homo sapiens
aacacagtgcccca

SEQ ID NO: 5343741 - DNA, 15 bp, Homo sapiens
aacacagtgtttcaa

SEQ ID NO: 5343742 - DNA, 16 bp, Homo sapiens
aacacagtgtttcaat

SEQ ID NO: 5343743 - DNA, 16 bp, Homo sapiens
aacacagtgtttttgt

SEQ ID NO: 5343744 - DNA, 18 bp, Homo sapiens
aacacagtgtttttgtaa

SEQ ID NO: 5343745 - DNA, 19 bp, Homo sapiens
aacacagtgtttttgtaaa

SEQ ID NO: 5343746 - DNA, 14 bp, Homo sapiens
aacacagttctggg

SEQ ID NO: 5343747 - DNA, 17 bp, Homo sapiens
aacacataaatgaaaga

SEQ ID NO: 5343748 - DNA, 15 bp, Homo sapiens
aacacataaattatg

SEQ ID NO: 5343749 - DNA, 16 bp, Homo sapiens
aacacatacaaaagaa

SEQ ID NO: 5343750 - DNA, 17 bp, Homo sapiens
aacacatagattcacct

SEQ ID NO: 5343751 - DNA, 22 bp, Homo sapiens
aacacatagattcacctgtaaa

SEQ ID NO: 5343752 - DNA, 20 bp, Homo sapiens
aacacatagcgccgtgctgt

SEQ ID NO: 5343753 - DNA, 16 bp, Homo sapiens
aacacatcagcttgcc

SEQ ID NO: 5343754 - DNA, 14 bp, Homo sapiens
aacacatgggggag

SEQ ID NO: 5343755 - DNA, 23 bp, Homo sapiens
aacacattaaaagacaaatatgt

SEQ ID NO: 5343756 - DNA, 15 bp, Homo sapiens
aacacattaaaggta

SEQ ID NO: 5343757 - DNA, 21 bp, Homo sapiens
aacacattaagccttccacac

SEQ ID NO: 5343758 - DNA, 22 bp, Homo sapiens
aacacattacttgcacaagctt

SEQ ID NO: 5343759 - DNA, 14 bp, Homo sapiens
aacacattataaag

SEQ ID NO: 5343760 - DNA, 15 bp, Homo sapiens
aacacattatgtatc

SEQ ID NO: 5343761 - DNA, 18 bp, Homo sapiens
aacacattcttattgaca

SEQ ID NO: 5343762 - DNA, 19 bp, Homo sapiens
aacacattcttattgacaa

SEQ ID NO: 5343763 - DNA, 18 bp, Homo sapiens
aacacattgaaactgtat

SEQ ID NO: 5343764 - DNA, 19 bp, Homo sapiens
aacacattgaatgcgcttt

SEQ ID NO: 5343765 - DNA, 23 bp, Homo sapiens
aacacattgagtttaagtctctg

SEQ ID NO: 5343766 - DNA, 18 bp, Homo sapiens
aacacattgtgaatatta

SEQ ID NO: 5343767 - DNA, 12 bp, Homo sapiens
aacacatttcac

SEQ ID NO: 5343768 - DNA, 15 bp, Homo sapiens
aacacatttcttttt

SEQ ID NO: 5343769 - DNA, 22 bp, Homo sapiens
aacacatttgggatgttccttt

SEQ ID NO: 5343770 - DNA, 14 bp, Homo sapiens
aacacattttaaat

SEQ ID NO: 5343771 - DNA, 20 bp, Homo sapiens
aacacattttggttcttctc

SEQ ID NO: 5343772 - DNA, 14 bp, Homo sapiens
aacacattttgtat

SEQ ID NO: 5343773 - DNA, 21 bp, Homo sapiens
aacacattttgtataattgta

SEQ ID NO: 5343774 - DNA, 23 bp, Homo sapiens
aacacattttgtataattgtatc

SEQ ID NO: 5343775 - DNA, 13 bp, Homo sapiens
aacacatttttaa

SEQ ID NO: 5343776 - DNA, 15 bp, Homo sapiens
aacacatttttgtat

SEQ ID NO: 5343777 - DNA, 16 bp, Homo sapiens
aacaccaaaaaatatc

SEQ ID NO: 5343778 - DNA, 15 bp, Homo sapiens
aacaccaacataaaa

SEQ ID NO: 5343779 - DNA, 13 bp, Homo sapiens
aacaccaacccct

SEQ ID NO: 5343780 - DNA, 17 bp, Homo sapiens
aacaccaacccctgacc

SEQ ID NO: 5343781 - DNA, 23 bp, Homo sapiens
aacaccaagtaaatctatctcta

SEQ ID NO: 5343782 - DNA, 17 bp, Homo sapiens
aacaccaatcccagggc

SEQ ID NO: 5343783 - DNA, 22 bp, Homo sapiens
aacaccaatcccagggctggct

SEQ ID NO: 5343784 - DNA, 16 bp, Homo sapiens
aacaccacactgacca

SEQ ID NO: 5343785 - DNA, 18 bp, Homo sapiens
aacaccacactgaccaca

SEQ ID NO: 5343786 - DNA, 23 bp, Homo sapiens
aacaccacagacacacacacgca

SEQ ID NO: 5343787 - DNA, 20 bp, Homo sapiens
aacaccaccgagctctgtgg

SEQ ID NO: 5343788 - DNA, 15 bp, Homo sapiens
aacaccacttaatct

SEQ ID NO: 5343789 - DNA, 16 bp, Homo sapiens
aacaccacttaatctt

SEQ ID NO: 5343790 - DNA, 15 bp, Homo sapiens
aacaccactttgtct

SEQ ID NO: 5343791 - DNA, 18 bp, Homo sapiens
aacaccactttgtctctg

SEQ ID NO: 5343792 - DNA, 23 bp, Homo sapiens
aacaccagaggggaaaaaatcat

SEQ ID NO: 5343793 - DNA, 12 bp, Homo sapiens
aacaccaggact

SEQ ID NO: 5343794 - DNA, 13 bp, Homo sapiens
aacaccaggactt

SEQ ID NO: 5343795 - DNA, 12 bp, Homo sapiens
aacaccagtgag

SEQ ID NO: 5343796 - DNA, 11 bp, Homo sapiens
aacaccagtgt

SEQ ID NO: 5343797 - DNA, 18 bp, Homo sapiens
aacaccatcacagcttgt

SEQ ID NO: 5343798 - DNA, 18 bp, Homo sapiens
aacaccatgattccttta

SEQ ID NO: 5343799 - DNA, 19 bp, Homo sapiens
aacaccattgaaggcttaa

SEQ ID NO: 5343800 - DNA, 20 bp, Homo sapiens
aacacccaaaggtggcctgc

SEQ ID NO: 5343801 - DNA, 15 bp, Homo sapiens
aacacccacaggcat

SEQ ID NO: 5343802 - DNA, 20 bp, Homo sapiens
aacacccagtctgttcccca

SEQ ID NO: 5343803 - DNA, 17 bp, Homo sapiens
aacacccatttttcctt

SEQ ID NO: 5343804 - DNA, 21 bp, Homo sapiens
aacacccatttttccttttgc

SEQ ID NO: 5343805 - DNA, 17 bp, Homo sapiens
aacacccccgacggcct

SEQ ID NO: 5343806 - DNA, 20 bp, Homo sapiens
aacacccccgacggcctcca

SEQ ID NO: 5343807 - DNA, 18 bp, Homo sapiens
aacaccccgcctgcctcc

SEQ ID NO: 5343808 - DNA, 13 bp, Homo sapiens
aacacccctcagt

SEQ ID NO: 5343809 - DNA, 21 bp, Homo sapiens
aacacccctcagttgtgcagc

SEQ ID NO: 5343810 - DNA, 21 bp, Homo sapiens
aacacccgccccccccatgtt

SEQ ID NO: 5343811 - DNA, 15 bp, Homo sapiens
aacagtggaatataa

SEQ ID NO: 5343812 - DNA, 15 bp, Homo sapiens
aacagtggagctgaa

SEQ ID NO: 5343813 - DNA, 14 bp, Homo sapiens
aacagtggatcaca

SEQ ID NO: 5343814 - DNA, 18 bp, Homo sapiens
aacagtggcaagctacca

SEQ ID NO: 5343815 - DNA, 13 bp, Homo sapiens
aacagtggctggg

SEQ ID NO: 5343816 - DNA, 19 bp, Homo sapiens
aacagtggctgggtgggcc

SEQ ID NO: 5343817 - DNA, 22 bp, Homo sapiens
aacagtgggagccctgaccttg

SEQ ID NO: 5343818 - DNA, 17 bp, Homo sapiens
aacagtggttgcctggg

SEQ ID NO: 5343819 - DNA, 19 bp, Homo sapiens
aacagtgtctttctagcca

SEQ ID NO: 5343820 - DNA, 16 bp, Homo sapiens
aacagtgtgcaaggca

SEQ ID NO: 5343821 - DNA, 17 bp, Homo sapiens
aacagtgtggatgtaaa

SEQ ID NO: 5343822 - DNA, 15 bp, Homo sapiens
aacagtgtgtaaaca

SEQ ID NO: 5343823 - DNA, 15 bp, Homo sapiens
aacagtgtgttggtg

SEQ ID NO: 5343824 - DNA, 20 bp, Homo sapiens
aacagtgttaggcctggcac

SEQ ID NO: 5343825 - DNA, 22 bp, Homo sapiens
aacagtgttaggcctggcacag

SEQ ID NO: 5343826 - DNA, 18 bp, Homo sapiens
aacagtgttctcagtttt

SEQ ID NO: 5343827 - DNA, 18 bp, Homo sapiens
aacagtgttgaaattgga

SEQ ID NO: 5343828 - DNA, 13 bp, Homo sapiens
aacagtgtttaaa

SEQ ID NO: 5343829 - DNA, 11 bp, Homo sapiens
aacagtgtttc

SEQ ID NO: 5343830 - DNA, 20 bp, Homo sapiens
aacagttaactttcagaaga

SEQ ID NO: 5343831 - DNA, 19 bp, Homo sapiens
aacagttaagcagccgcca

SEQ ID NO: 5343832 - DNA, 16 bp, Homo sapiens
aacagttagctggagc

SEQ ID NO: 5343833 - DNA, 15 bp, Homo sapiens
aacagttataaagaa

SEQ ID NO: 5343834 - DNA, 14 bp, Homo sapiens
aacagttatacaga

SEQ ID NO: 5343835 - DNA, 15 bp, Homo sapiens
aacagttatattttt

SEQ ID NO: 5343836 - DNA, 11 bp, Homo sapiens
aacagttcaaa

SEQ ID NO: 5343837 - DNA, 13 bp, Homo sapiens
aacagttcaaaga

SEQ ID NO: 5343838 - DNA, 15 bp, Homo sapiens
aacagttcaaagaag

SEQ ID NO: 5343839 - DNA, 17 bp, Homo sapiens
aacagttcaaagaagtc

SEQ ID NO: 5343840 - DNA, 16 bp, Homo sapiens
aacagttcatgtttgc

SEQ ID NO: 5343841 - DNA, 23 bp, Homo sapiens
aacagttcatgtttgcttcataa

SEQ ID NO: 5343842 - DNA, 17 bp, Homo sapiens
aacagttcctttcaaag

SEQ ID NO: 5343843 - DNA, 21 bp, Homo sapiens
aacagttctcccttcaactgt

SEQ ID NO: 5343844 - DNA, 22 bp, Homo sapiens
aacagttctcccttcaactgta

SEQ ID NO: 5343845 - DNA, 13 bp, Homo sapiens
aacagttctgcac

SEQ ID NO: 5343846 - DNA, 22 bp, Homo sapiens
aacagttgaagaaaaaatggca

SEQ ID NO: 5343847 - DNA, 15 bp, Homo sapiens
aacagttgatttccc

SEQ ID NO: 5343848 - DNA, 17 bp, Homo sapiens
aacagttgcacagcatc

SEQ ID NO: 5343849 - DNA, 18 bp, Homo sapiens
aacagttgcatgtagtaa

SEQ ID NO: 5343850 - DNA, 21 bp, Homo sapiens
aacagttgctttggattctct

SEQ ID NO: 5343851 - DNA, 12 bp, Homo sapiens
aacagttggcac

SEQ ID NO: 5343852 - DNA, 17 bp, Homo sapiens
aacagttggcatgcatc

SEQ ID NO: 5343853 - DNA, 22 bp, Homo sapiens
aacagttggtaacttttgtgaa

SEQ ID NO: 5343854 - DNA, 14 bp, Homo sapiens
aacagttgtatgtt

SEQ ID NO: 5343855 - DNA, 14 bp, Homo sapiens
aacagttgtgtcat

SEQ ID NO: 5343856 - DNA, 13 bp, Homo sapiens
aacagtttaaaaa

SEQ ID NO: 5343857 - DNA, 23 bp, Homo sapiens
aacagtttaaaaaaaaagttggt

SEQ ID NO: 5343858 - DNA, 15 bp, Homo sapiens
aacagtttaatgaag

SEQ ID NO: 5343859 - DNA, 18 bp, Homo sapiens
aacagtttaatgaagatc

SEQ ID NO: 5343860 - DNA, 23 bp, Homo sapiens
aacagtttatgcagtgctgcttt

SEQ ID NO: 5343861 - DNA, 14 bp, Homo sapiens
aacagtttcatcta

SEQ ID NO: 5343862 - DNA, 14 bp, Homo sapiens
aacagtttgcctgc

SEQ ID NO: 5343863 - DNA, 16 bp, Homo sapiens
aacagtttgcctgctg

SEQ ID NO: 5343864 - DNA, 22 bp, Homo sapiens
aacagtttgcctgctgtattta

SEQ ID NO: 5343865 - DNA, 13 bp, Homo sapiens
aacagttttaaga

SEQ ID NO: 5343866 - DNA, 13 bp, Homo sapiens
aacagttttcctt

SEQ ID NO: 5343867 - DNA, 19 bp, Homo sapiens
aacagttttggagaaaaat

SEQ ID NO: 5343868 - DNA, 12 bp, Homo sapiens
aacataaaaaaa

SEQ ID NO: 5343869 - DNA, 13 bp, Homo sapiens
aacataaaaagca

SEQ ID NO: 5343870 - DNA, 19 bp, Homo sapiens
aacataaaaaggacatcag

SEQ ID NO: 5343871 - DNA, 22 bp, Homo sapiens
aacataaaaaggacatcagcaa

SEQ ID NO: 5343872 - DNA, 16 bp, Homo sapiens
aacataaaacaatgaa

SEQ ID NO: 5343873 - DNA, 14 bp, Homo sapiens
aacataaaatacaa

SEQ ID NO: 5343874 - DNA, 14 bp, Homo sapiens
aacataaaatctgt

SEQ ID NO: 5343875 - DNA, 16 bp, Homo sapiens
aacataaaatctgtga

SEQ ID NO: 5343876 - DNA, 16 bp, Homo sapiens
aacataaacttgtact

SEQ ID NO: 5343877 - DNA, 13 bp, Homo sapiens
aacataaagaaat

SEQ ID NO: 5343878 - DNA, 21 bp, Homo sapiens
aacataaagaaatcatacttt

SEQ ID NO: 5343879 - DNA, 14 bp, Homo sapiens
aacataaagttgta

SEQ ID NO: 5343880 - DNA, 17 bp, Homo sapiens
aacataaataaaaattc

SEQ ID NO: 5343881 - DNA, 17 bp, Homo sapiens
aacataaataaaatgac

SEQ ID NO: 5343882 - DNA, 18 bp, Homo sapiens
aacataaataaaatgacc

SEQ ID NO: 5343883 - DNA, 14 bp, Homo sapiens
aacataaatctgtg

SEQ ID NO: 5343884 - DNA, 21 bp, Homo sapiens
aacataaattttttgaagtct

SEQ ID NO: 5343885 - DNA, 15 bp, Homo sapiens
aacataactgtaaca

SEQ ID NO: 5343886 - DNA, 16 bp, Homo sapiens
aacataagctaaatca

SEQ ID NO: 5343887 - DNA, 18 bp, Homo sapiens
aacataagctatttttct

SEQ ID NO: 5343888 - DNA, 16 bp, Homo sapiens
aacataaggagaatgt

SEQ ID NO: 5343889 - DNA, 14 bp, Homo sapiens
aacataagttgcat

SEQ ID NO: 5343890 - DNA, 13 bp, Homo sapiens
aacataataaatc

SEQ ID NO: 5343891 - DNA, 23 bp, Homo sapiens
aacataatagaatttcctaatga

SEQ ID NO: 5343892 - DNA, 14 bp, Homo sapiens
aacataatataaga

SEQ ID NO: 5343893 - DNA, 16 bp, Homo sapiens
aacataatatcttgaa

SEQ ID NO: 5343894 - DNA, 14 bp, Homo sapiens
aacataatctagtt

SEQ ID NO: 5343895 - DNA, 20 bp, Homo sapiens
aacataatcttctgccttct

SEQ ID NO: 5343896 - DNA, 12 bp, Homo sapiens
aacataatgaaa

SEQ ID NO: 5343897 - DNA, 17 bp, Homo sapiens
aacataattcttgtata

SEQ ID NO: 5343898 - DNA, 19 bp, Homo sapiens
aacataattgtggattata

SEQ ID NO: 5343899 - DNA, 20 bp, Homo sapiens
aacataatttttatttttgg

SEQ ID NO: 5343900 - DNA, 14 bp, Homo sapiens
aacatacaaatgca

SEQ ID NO: 5343901 - DNA, 15 bp, Homo sapiens
aacatacaaatgcat

SEQ ID NO: 5343902 - DNA, 20 bp, Homo sapiens
aacatacaaatgcatctttg

SEQ ID NO: 5343903 - DNA, 21 bp, Homo sapiens
aacatacaaatgcatctttga

SEQ ID NO: 5343904 - DNA, 18 bp, Homo sapiens
aacatacaagaaaatgta

SEQ ID NO: 5343905 - DNA, 14 bp, Homo sapiens
aacatacaggtgcc

SEQ ID NO: 5343906 - DNA, 23 bp, Homo sapiens
aacatacatctaagtcagtttca

SEQ ID NO: 5343907 - DNA, 17 bp, Homo sapiens
aacatacctaagaagta

SEQ ID NO: 5343908 - DNA, 18 bp, Homo sapiens
aacatacgggaagtttat

SEQ ID NO: 5343909 - DNA, 16 bp, Homo sapiens
aacatactcccatctg

SEQ ID NO: 5343910 - DNA, 17 bp, Homo sapiens
aacatactggctggtga

SEQ ID NO: 5343911 - DNA, 20 bp, Homo sapiens
aacatactgtaatcaaaagg

SEQ ID NO: 5343912 - DNA, 17 bp, Homo sapiens
aacatacttacatttca

SEQ ID NO: 5343913 - DNA, 21 bp, Homo sapiens
aacatacttcaaaaataatgt

SEQ ID NO: 5343914 - DNA, 12 bp, Homo sapiens
aacatagaaaaa

SEQ ID NO: 5343915 - DNA, 22 bp, Homo sapiens
aacatagaaaaatgatgtcttt

SEQ ID NO: 5343916 - DNA, 13 bp, Homo sapiens
aacatagaaacat

SEQ ID NO: 5343917 - DNA, 16 bp, Homo sapiens
aacatagaaactcggg

SEQ ID NO: 5343918 - DNA, 22 bp, Homo sapiens
aacatagaaattgcctgacgaa

SEQ ID NO: 5343919 - DNA, 22 bp, Homo sapiens
aacatagaattgcaatctataa

SEQ ID NO: 5343920 - DNA, 16 bp, Homo sapiens
aacatagactgaagat

SEQ ID NO: 5343921 - DNA, 18 bp, Homo sapiens
aacatagactgaagattt

SEQ ID NO: 5343922 - DNA, 23 bp, Homo sapiens
aacatagagaactgtcaccctga

SEQ ID NO: 5343923 - DNA, 17 bp, Homo sapiens
aacatagatgcctgggc

SEQ ID NO: 5343924 - DNA, 18 bp, Homo sapiens
aacatagatgcctgggcc

SEQ ID NO: 5343925 - DNA, 19 bp, Homo sapiens
aacatagatgcctgggcct

SEQ ID NO: 5343926 - DNA, 15 bp, Homo sapiens
aacatagcacagtat

SEQ ID NO: 5343927 - DNA, 17 bp, Homo sapiens
aacatagcacagtattt

SEQ ID NO: 5343928 - DNA, 21 bp, Homo sapiens
aacatagcagatctgttttgt

SEQ ID NO: 5343929 - DNA, 17 bp, Homo sapiens
aacatagccaaaatgtg

SEQ ID NO: 5343930 - DNA, 17 bp, Homo sapiens
aacatagcccctgcccc

SEQ ID NO: 5343931 - DNA, 17 bp, Homo sapiens
aacataggcaagaggag

SEQ ID NO: 5343932 - DNA, 22 bp, Homo sapiens
aacataggtttttaaagactag

SEQ ID NO: 5343933 - DNA, 20 bp, Homo sapiens
aacatagtaacgtgttactg

SEQ ID NO: 5343934 - DNA, 19 bp, Homo sapiens
aacatagtaagttcagcac

SEQ ID NO: 5343935 - DNA, 21 bp, Homo sapiens
aacatagtaagttcagcactt

SEQ ID NO: 5343936 - DNA, 17 bp, Homo sapiens
aacatagtccagagaac

SEQ ID NO: 5343937 - DNA, 18 bp, Homo sapiens
aacatagtgagacactgt

SEQ ID NO: 5343938 - DNA, 21 bp, Homo sapiens
aacatagtgagacccctgtct

SEQ ID NO: 5343939 - DNA, 23 bp, Homo sapiens
aacatagtgagaccctgtctcta

SEQ ID NO: 5343940 - DNA, 19 bp, Homo sapiens
aacatagtgagattctgtt

SEQ ID NO: 5343941 - DNA, 13 bp, Homo sapiens
aacatagtggtat

SEQ ID NO: 5343942 - DNA, 22 bp, Homo sapiens
aacatagtggtattttaacata

SEQ ID NO: 5343943 - DNA, 13 bp, Homo sapiens
aacatagttttca

SEQ ID NO: 5343944 - DNA, 14 bp, Homo sapiens
aacatagttttcac

SEQ ID NO: 5343945 - DNA, 14 bp, Homo sapiens
aacatagtttttca

SEQ ID NO: 5343946 - DNA, 13 bp, Homo sapiens
aacatataatgtt

SEQ ID NO: 5343947 - DNA, 11 bp, Homo sapiens
aacatatatat

SEQ ID NO: 5343948 - DNA, 14 bp, Homo sapiens
aacatatcaaaata

SEQ ID NO: 5343949 - DNA, 22 bp, Homo sapiens
aacatatcatggtaatgacaga

SEQ ID NO: 5343950 - DNA, 16 bp, Homo sapiens
aacatatctaaagtca

SEQ ID NO: 5343951 - DNA, 17 bp, Homo sapiens
aacatatctaaagtcat

SEQ ID NO: 5343952 - DNA, 15 bp, Homo sapiens
aacatatctctgccg

SEQ ID NO: 5343953 - DNA, 21 bp, Homo sapiens
aacatatctctgccgtctctc

SEQ ID NO: 5343954 - DNA, 17 bp, Homo sapiens
aacatatgaaatataaa

SEQ ID NO: 5343955 - DNA, 22 bp, Homo sapiens
aacatatgaaatataaattatc

SEQ ID NO: 5343956 - DNA, 22 bp, Homo sapiens
aacatatgagtgttttgaaaat

SEQ ID NO: 5343957 - DNA, 12 bp, Homo sapiens
aacatatgattt

SEQ ID NO: 5343958 - DNA, 13 bp, Homo sapiens
aacatatgttgca

SEQ ID NO: 5343959 - DNA, 14 bp, Homo sapiens
aacatattatttca

SEQ ID NO: 5343960 - DNA, 16 bp, Homo sapiens
aacatattcaaagcag

SEQ ID NO: 5343961 - DNA, 14 bp, Homo sapiens
aacatattcaagga

SEQ ID NO: 5343962 - DNA, 15 bp, Homo sapiens
aacatattcaaggag

SEQ ID NO: 5343963 - DNA, 18 bp, Homo sapiens
aacatattcaatgcaagt

SEQ ID NO: 5343964 - DNA, 20 bp, Homo sapiens
aacatattcaatgcaagtaa

SEQ ID NO: 5343965 - DNA, 22 bp, Homo sapiens
aacatattcaatgcaagtaaga

SEQ ID NO: 5343966 - DNA, 13 bp, Homo sapiens
aacatattcatga

SEQ ID NO: 5343967 - DNA, 13 bp, Homo sapiens
aacatattctaaa

SEQ ID NO: 5343968 - DNA, 23 bp, Homo sapiens
aacatattctgtatgaactttat

SEQ ID NO: 5343969 - DNA, 23 bp, Homo sapiens
aacatattcttttgatcacattg

SEQ ID NO: 5343970 - DNA, 13 bp, Homo sapiens
aacatatttttat

SEQ ID NO: 5343971 - DNA, 18 bp, Homo sapiens
aacatatttttatacttt

SEQ ID NO: 5343972 - DNA, 19 bp, Homo sapiens
aacatatttttatacttta

SEQ ID NO: 5343973 - DNA, 22 bp, Homo sapiens
aacatcaaacacggcttctcat

SEQ ID NO: 5343974 - DNA, 12 bp, Homo sapiens
aacatcaaataa

SEQ ID NO: 5343975 - DNA, 17 bp, Homo sapiens
aacatcaaataaatttc

SEQ ID NO: 5343976 - DNA, 17 bp, Homo sapiens
aacatcaacctggcaaa

SEQ ID NO: 5343977 - DNA, 20 bp, Homo sapiens
aacatcactacaaaaagaag

SEQ ID NO: 5343978 - DNA, 23 bp, Homo sapiens
aacatcactacaaaaagaagagt

SEQ ID NO: 5343979 - DNA, 18 bp, Homo sapiens
aacatcactatccatgca

SEQ ID NO: 5343980 - DNA, 14 bp, Homo sapiens
aacatcactccctc

SEQ ID NO: 5343981 - DNA, 15 bp, Homo sapiens
aacatcactccctct

SEQ ID NO: 5343982 - DNA, 19 bp, Homo sapiens
aacatcagaaactgaattc

SEQ ID NO: 5343983 - DNA, 16 bp, Homo sapiens
aacatcagctgaattc

SEQ ID NO: 5343984 - DNA, 17 bp, Homo sapiens
aacatcagctgaattca

SEQ ID NO: 5343985 - DNA, 17 bp, Homo sapiens
aacatcagctttctaat

SEQ ID NO: 5343986 - DNA, 15 bp, Homo sapiens
aacatcagtgtctgt

SEQ ID NO: 5343987 - DNA, 16 bp, Homo sapiens
aacatcagtgtctgtt

SEQ ID NO: 5343988 - DNA, 21 bp, Homo sapiens
aacatcagtgtctgtttcaga

SEQ ID NO: 5343989 - DNA, 16 bp, Homo sapiens
aacatcataattacat

SEQ ID NO: 5343990 - DNA, 19 bp, Homo sapiens
aacatttgctttgttttct

SEQ ID NO: 5343991 - DNA, 21 bp, Homo sapiens
aacatttgggacctggataat

SEQ ID NO: 5343992 - DNA, 19 bp, Homo sapiens
aacatttgggttactattt

SEQ ID NO: 5343993 - DNA, 15 bp, Homo sapiens
aacatttgtaaaaat

SEQ ID NO: 5343994 - DNA, 23 bp, Homo sapiens
aacatttgtaaaaatactgtttc

SEQ ID NO: 5343995 - DNA, 22 bp, Homo sapiens
aacatttgtaatttttttctag

SEQ ID NO: 5343996 - DNA, 12 bp, Homo sapiens
aacatttgtgat

SEQ ID NO: 5343997 - DNA, 22 bp, Homo sapiens
aacatttgtgatatatgtatta

SEQ ID NO: 5343998 - DNA, 11 bp, Homo sapiens
aacatttgttc

SEQ ID NO: 5343999 - DNA, 13 bp, Homo sapiens
aacatttgttcct

SEQ ID NO: 5344000 - DNA, 14 bp, Homo sapiens
aacatttgttcctg

SEQ ID NO: 5344001 - DNA, 22 bp, Homo sapiens
aacattttaagttttactgata

SEQ ID NO: 5344002 - DNA, 19 bp, Homo sapiens
aacattttacagtaaatgt

SEQ ID NO: 5344003 - DNA, 19 bp, Homo sapiens
aacattttactgttgtaca

SEQ ID NO: 5344004 - DNA, 23 bp, Homo sapiens
aacattttagctctattgatact

SEQ ID NO: 5344005 - DNA, 15 bp, Homo sapiens
aacattttatactgt

SEQ ID NO: 5344006 - DNA, 17 bp, Homo sapiens
aacattttatactgtac

SEQ ID NO: 5344007 - DNA, 19 bp, Homo sapiens
aacattttatactgtacat

SEQ ID NO: 5344008 - DNA, 19 bp, Homo sapiens
aacattttatcattaaaaa

SEQ ID NO: 5344009 - DNA, 22 bp, Homo sapiens
aacattttatttttaaaatatt

SEQ ID NO: 5344010 - DNA, 13 bp, Homo sapiens
aacattttcaata

SEQ ID NO: 5344011 - DNA, 22 bp, Homo sapiens
aacattttcatgcacagtagat

SEQ ID NO: 5344012 - DNA, 17 bp, Homo sapiens
aacattttctcttagaa

SEQ ID NO: 5344013 - DNA, 18 bp, Homo sapiens
aacattttctcttagaaa

SEQ ID NO: 5344014 - DNA, 18 bp, Homo sapiens
aacattttcttgaatttt

SEQ ID NO: 5344015 - DNA, 22 bp, Homo sapiens
aacattttctttctttttctgg

SEQ ID NO: 5344016 - DNA, 17 bp, Homo sapiens
aacattttgaaggaaaa

SEQ ID NO: 5344017 - DNA, 19 bp, Homo sapiens
aacattttgaaggaaaatt

SEQ ID NO: 5344018 - DNA, 16 bp, Homo sapiens
aacattttgagaacaa

SEQ ID NO: 5344019 - DNA, 16 bp, Homo sapiens
aacattttgtcatata

SEQ ID NO: 5344020 - DNA, 14 bp, Homo sapiens
aacattttgtggag

SEQ ID NO: 5344021 - DNA, 23 bp, Homo sapiens
aacattttgtggagtttgtattt

SEQ ID NO: 5344022 - DNA, 14 bp, Homo sapiens
aacattttgttctt

SEQ ID NO: 5344023 - DNA, 18 bp, Homo sapiens
aacattttgttcttacac

SEQ ID NO: 5344024 - DNA, 23 bp, Homo sapiens
aacattttgttcttacacataca

SEQ ID NO: 5344025 - DNA, 19 bp, Homo sapiens
aacattttgtttccaaagc

SEQ ID NO: 5344026 - DNA, 19 bp, Homo sapiens
aacatttttaatttaacaa

SEQ ID NO: 5344027 - DNA, 15 bp, Homo sapiens
aacatttttcaacaa

SEQ ID NO: 5344028 - DNA, 19 bp, Homo sapiens
aacattttttaagaaaaca

SEQ ID NO: 5344029 - DNA, 20 bp, Homo sapiens
aacattttttaagaaaacat

SEQ ID NO: 5344030 - DNA, 21 bp, Homo sapiens
aacattttttaagaaaacatt

SEQ ID NO: 5344031 - DNA, 16 bp, Homo sapiens
aacattttttatacat

SEQ ID NO: 5344032 - DNA, 23 bp, Homo sapiens
aacattttttcttctgaagattc

SEQ ID NO: 5344033 - DNA, 20 bp, Homo sapiens
aacattttttgtttcttggt

SEQ ID NO: 5344034 - DNA, 14 bp, Homo sapiens
aacatttttttaag

SEQ ID NO: 5344035 - DNA, 17 bp, Homo sapiens
aacatttttttaagcaa

SEQ ID NO: 5344036 - DNA, 22 bp, Homo sapiens
aacatttttttaagcaacactt

SEQ ID NO: 5344037 - DNA, 23 bp, Homo sapiens
aacattttttttttaaatcaagt

SEQ ID NO: 5344038 - DNA, 21 bp, Homo sapiens
aaccaaaaaaaaaaaaaatca

SEQ ID NO: 5344039 - DNA, 19 bp, Homo sapiens
aaccaaaaaaccccagcta

SEQ ID NO: 5344040 - DNA, 15 bp, Homo sapiens
aaccaaaaacatttg

SEQ ID NO: 5344041 - DNA, 14 bp, Homo sapiens
aaccaaaaagaaaa

SEQ ID NO: 5344042 - DNA, 18 bp, Homo sapiens
aaccaaaaagaccagact

SEQ ID NO: 5344043 - DNA, 12 bp, Homo sapiens
aaccaaaaagag

SEQ ID NO: 5344044 - DNA, 16 bp, Homo sapiens
aaccaaaaatagaaat

SEQ ID NO: 5344045 - DNA, 18 bp, Homo sapiens
aaccaaaaatagaaatta

SEQ ID NO: 5344046 - DNA, 12 bp, Homo sapiens
aaccaaaacata

SEQ ID NO: 5344047 - DNA, 15 bp, Homo sapiens
aaccaaaacttccaa

SEQ ID NO: 5344048 - DNA, 22 bp, Homo sapiens
aaccaaaacttccaaggccctg

SEQ ID NO: 5344049 - DNA, 21 bp, Homo sapiens
aaccaaaagaacaagaatttc

SEQ ID NO: 5344050 - DNA, 18 bp, Homo sapiens
aaccaaaagggaaaaaat

SEQ ID NO: 5344051 - DNA, 19 bp, Homo sapiens
aaccaaaagggaaaaaata

SEQ ID NO: 5344052 - DNA, 17 bp, Homo sapiens
aaccaaaagtgcattca

SEQ ID NO: 5344053 - DNA, 22 bp, Homo sapiens
aaccaaaagttattaaaattgt

SEQ ID NO: 5344054 - DNA, 21 bp, Homo sapiens
aaccaaaatgacatcttttta

SEQ ID NO: 5344055 - DNA, 22 bp, Homo sapiens
aaccaaaatgacatctttttaa

SEQ ID NO: 5344056 - DNA, 16 bp, Homo sapiens
aaccaaacccagccac

SEQ ID NO: 5344057 - DNA, 19 bp, Homo sapiens
aaccaaactcctatttcaa

SEQ ID NO: 5344058 - DNA, 16 bp, Homo sapiens
aaccaaactctgtgtc

SEQ ID NO: 5344059 - DNA, 19 bp, Homo sapiens
aaccaaactgggtcttcag

SEQ ID NO: 5344060 - DNA, 18 bp, Homo sapiens
aaccaaacttgttcattt

SEQ ID NO: 5344061 - DNA, 20 bp, Homo sapiens
aaccaaacttgttcatttag

SEQ ID NO: 5344062 - DNA, 13 bp, Homo sapiens
aaccaaagaaaat

SEQ ID NO: 5344063 - DNA, 16 bp, Homo sapiens
aaccaaagagactgga

SEQ ID NO: 5344064 - DNA, 19 bp, Homo sapiens
aaccaaagagactggagca

SEQ ID NO: 5344065 - DNA, 23 bp, Homo sapiens
aaccaaagagactggagcatctg

SEQ ID NO: 5344066 - DNA, 18 bp, Homo sapiens
aaccaaagagtctctggc

SEQ ID NO: 5344067 - DNA, 19 bp, Homo sapiens
aaccaaagagtctctggct

SEQ ID NO: 5344068 - DNA, 21 bp, Homo sapiens
aaccaaagagtctctggctca

SEQ ID NO: 5344069 - DNA, 19 bp, Homo sapiens
aaccaaagatgcttaaaaa

SEQ ID NO: 5344070 - DNA, 12 bp, Homo sapiens
aaccaaagccag

SEQ ID NO: 5344071 - DNA, 14 bp, Homo sapiens
aaccaaagctgcct

SEQ ID NO: 5344072 - DNA, 21 bp, Homo sapiens
aaccaaagctgcctgtgccat

SEQ ID NO: 5344073 - DNA, 16 bp, Homo sapiens
aaccaaaggacattat

SEQ ID NO: 5344074 - DNA, 23 bp, Homo sapiens
aaccaaaggtgaaggaatatatg

SEQ ID NO: 5344075 - DNA, 23 bp, Homo sapiens
aaccaaagtaaccttttgcacct

SEQ ID NO: 5344076 - DNA, 22 bp, Homo sapiens
aaccaaagtacttttggtgtca

SEQ ID NO: 5344077 - DNA, 23 bp, Homo sapiens
aaccaaatacctcaatttttgtt

SEQ ID NO: 5344078 - DNA, 23 bp, Homo sapiens
aaccaaataggctttagaagaga

SEQ ID NO: 5344079 - DNA, 15 bp, Homo sapiens
aaccaaatctggaag

SEQ ID NO: 5344080 - DNA, 23 bp, Homo sapiens
aaccaaatgcatcaatcctgtgt

SEQ ID NO: 5344081 - DNA, 19 bp, Homo sapiens
aaccaaattaaaaattttt

SEQ ID NO: 5344082 - DNA, 19 bp, Homo sapiens
aaccaaattaacctttcag

SEQ ID NO: 5344083 - DNA, 13 bp, Homo sapiens
aaccaacaatata

SEQ ID NO: 5344084 - DNA, 22 bp, Homo sapiens
aaccaacaattaggtctgcatt

SEQ ID NO: 5344085 - DNA, 13 bp, Homo sapiens
aaccaacatcttt

SEQ ID NO: 5344086 - DNA, 17 bp, Homo sapiens
aaccaaccacaaaccac

SEQ ID NO: 5344087 - DNA, 15 bp, Homo sapiens
aaccaaccctgtggg

SEQ ID NO: 5344088 - DNA, 14 bp, Homo sapiens
aaccaacctccccg

SEQ ID NO: 5344089 - DNA, 14 bp, Homo sapiens
aaccaacctttaaa

SEQ ID NO: 5344090 - DNA, 15 bp, Homo sapiens
aaccaacctttctga

SEQ ID NO: 5344091 - DNA, 20 bp, Homo sapiens
aaccaacctttctgacatca

SEQ ID NO: 5344092 - DNA, 18 bp, Homo sapiens
aaccaactatccaagtgt

SEQ ID NO: 5344093 - DNA, 13 bp, Homo sapiens
aaccaactctaat

SEQ ID NO: 5344094 - DNA, 14 bp, Homo sapiens
aaccaactctaata

SEQ ID NO: 5344095 - DNA, 19 bp, Homo sapiens
aaccaactctaatattgct

SEQ ID NO: 5344096 - DNA, 15 bp, Homo sapiens
aaccaactgccccag

SEQ ID NO: 5344097 - DNA, 17 bp, Homo sapiens
aaccaactgccccaggg

SEQ ID NO: 5344098 - DNA, 14 bp, Homo sapiens
aaccaactgcctta

SEQ ID NO: 5344099 - DNA, 17 bp, Homo sapiens
aaccaactgttgacata

SEQ ID NO: 5344100 - DNA, 16 bp, Homo sapiens
aaccaactttcccccc

SEQ ID NO: 5344101 - DNA, 14 bp, Homo sapiens
aaccaagaagggct

SEQ ID NO: 5344102 - DNA, 16 bp, Homo sapiens
aaccaagagattgcta

SEQ ID NO: 5344103 - DNA, 14 bp, Homo sapiens
aaccaagagctttt

SEQ ID NO: 5344104 - DNA, 18 bp, Homo sapiens
aaccaagaggatttcttc

SEQ ID NO: 5344105 - DNA, 17 bp, Homo sapiens
aaccaagaggctggttt

SEQ ID NO: 5344106 - DNA, 22 bp, Homo sapiens
aaccaagagttaagatatccct

SEQ ID NO: 5344107 - DNA, 17 bp, Homo sapiens
aaccaagatgtaaaaca

SEQ ID NO: 5344108 - DNA, 19 bp, Homo sapiens
aaccaagcaggagacgaca

SEQ ID NO: 5344109 - DNA, 22 bp, Homo sapiens
aaccaagcatcagggggaagaa

SEQ ID NO: 5344110 - DNA, 16 bp, Homo sapiens
aaccaagccgtggctt

SEQ ID NO: 5344111 - DNA, 14 bp, Homo sapiens
aaccaagcctctgg

SEQ ID NO: 5344112 - DNA, 15 bp, Homo sapiens
aaccaagccttggct

SEQ ID NO: 5344113 - DNA, 15 bp, Homo sapiens
aaccaagctctctgc

SEQ ID NO: 5344114 - DNA, 15 bp, Homo sapiens
aaccaagcttcagag

SEQ ID NO: 5344115 - DNA, 16 bp, Homo sapiens
aaccaagcttcagagc

SEQ ID NO: 5344116 - DNA, 20 bp, Homo sapiens
aaccaagcttcagagcctag

SEQ ID NO: 5344117 - DNA, 22 bp, Homo sapiens
aaccaagcttcagagcctagcc

SEQ ID NO: 5344118 - DNA, 13 bp, Homo sapiens
aaccaaggaagga

SEQ ID NO: 5344119 - DNA, 23 bp, Homo sapiens
aaccaagggtacagatccccagc

SEQ ID NO: 5344120 - DNA, 16 bp, Homo sapiens
aaccaagtcaggccag

SEQ ID NO: 5344121 - DNA, 20 bp, Homo sapiens
aaccaagtcatgtgcatttc

SEQ ID NO: 5344122 - DNA, 15 bp, Homo sapiens
aaccaagtgccttga

SEQ ID NO: 5344123 - DNA, 23 bp, Homo sapiens
aaccaagtgtgctctttttttaa

SEQ ID NO: 5344124 - DNA, 20 bp, Homo sapiens
aaccaagttatctgtttcct

SEQ ID NO: 5344125 - DNA, 16 bp, Homo sapiens
aaccaagttatttttc

SEQ ID NO: 5344126 - DNA, 10 bp, Homo sapiens
aaccaagttc

SEQ ID NO: 5344127 - DNA, 14 bp, Homo sapiens
aaccaatcaagata

SEQ ID NO: 5344128 - DNA, 13 bp, Homo sapiens
aaccaatcaataa

SEQ ID NO: 5344129 - DNA, 13 bp, Homo sapiens
aaccaatgaagaa

SEQ ID NO: 5344130 - DNA, 15 bp, Homo sapiens
aaccaatgaagaaga

SEQ ID NO: 5344131 - DNA, 17 bp, Homo sapiens
aaccaatgaagaagaca

SEQ ID NO: 5344132 - DNA, 22 bp, Homo sapiens
aaccaatgattcataacaatgt

SEQ ID NO: 5344133 - DNA, 22 bp, Homo sapiens
aaccaatgcctttttagatgta

SEQ ID NO: 5344134 - DNA, 23 bp, Homo sapiens
aaccaatgcctttttagatgtat

SEQ ID NO: 5344135 - DNA, 24 bp, Homo sapiens
aaccaatgcctttttagatgtatt

SEQ ID NO: 5344136 - DNA, 21 bp, Homo sapiens
aaccaatggtgatcctctatt

SEQ ID NO: 5344137 - DNA, 14 bp, Homo sapiens
aaccaattattttc

SEQ ID NO: 5344138 - DNA, 20 bp, Homo sapiens
aaccaattcaccaacacagt

SEQ ID NO: 5344139 - DNA, 21 bp, Homo sapiens
aaccaattcacccagaaaaaa

SEQ ID NO: 5344140 - DNA, 17 bp, Homo sapiens
aaccaattcctcatcct

SEQ ID NO: 5344141 - DNA, 17 bp, Homo sapiens
aaccaattcctcatttg

SEQ ID NO: 5344142 - DNA, 20 bp, Homo sapiens
aaccaattgaaaagtgttct

SEQ ID NO: 5344143 - DNA, 14 bp, Homo sapiens
aaccacaaaagttg

SEQ ID NO: 5344144 - DNA, 15 bp, Homo sapiens
aaccacaaaagttgt

SEQ ID NO: 5344145 - DNA, 14 bp, Homo sapiens
aaccacaactgaca

SEQ ID NO: 5344146 - DNA, 16 bp, Homo sapiens
aaccacaactgacaca

SEQ ID NO: 5344147 - DNA, 17 bp, Homo sapiens
aaccacaactttgtcgt

SEQ ID NO: 5344148 - DNA, 22 bp, Homo sapiens
aaccacaagagatcagcagtgg

SEQ ID NO: 5344149 - DNA, 13 bp, Homo sapiens
aaccacaagtgaa

SEQ ID NO: 5344150 - DNA, 18 bp, Homo sapiens
aaccacacaattttttct

SEQ ID NO: 5344151 - DNA, 15 bp, Homo sapiens
aaccacacacacctg

SEQ ID NO: 5344152 - DNA, 15 bp, Homo sapiens
aaccacacacctcac

SEQ ID NO: 5344153 - DNA, 21 bp, Homo sapiens
aaccacaccacatctaagcct

SEQ ID NO: 5344154 - DNA, 15 bp, Homo sapiens
aaccacacctaaatt

SEQ ID NO: 5344155 - DNA, 20 bp, Homo sapiens
aaccacactcaccccagcct

SEQ ID NO: 5344156 - DNA, 22 bp, Homo sapiens
aaccacactcaccccagcctca

SEQ ID NO: 5344157 - DNA, 23 bp, Homo sapiens
aaccacactgaaacctcttcggt

SEQ ID NO: 5344158 - DNA, 15 bp, Homo sapiens
aaccacacttcttga

SEQ ID NO: 5344159 - DNA, 19 bp, Homo sapiens
aaccacacttgaaaccttt

SEQ ID NO: 5344160 - DNA, 13 bp, Homo sapiens
aaccacagcagga

SEQ ID NO: 5344161 - DNA, 12 bp, Homo sapiens
aaccacagccct

SEQ ID NO: 5344162 - DNA, 14 bp, Homo sapiens
aaccacagccctgt

SEQ ID NO: 5344163 - DNA, 13 bp, Homo sapiens
aaccacagctgct

SEQ ID NO: 5344164 - DNA, 14 bp, Homo sapiens
aaccacagctgctg

SEQ ID NO: 5344165 - DNA, 15 bp, Homo sapiens
aaccacagctgctgg

SEQ ID NO: 5344166 - DNA, 18 bp, Homo sapiens
aaccccagcctgacctga

SEQ ID NO: 5344167 - DNA, 19 bp, Homo sapiens
aaccccagctactctgatc

SEQ ID NO: 5344168 - DNA, 11 bp, Homo sapiens
aaccccagctg

SEQ ID NO: 5344169 - DNA, 15 bp, Homo sapiens
aaccccagctgccgg

SEQ ID NO: 5344170 - DNA, 16 bp, Homo sapiens
aaccccagctgccggc

SEQ ID NO: 5344171 - DNA, 13 bp, Homo sapiens
aaccccaggcccc

SEQ ID NO: 5344172 - DNA, 15 bp, Homo sapiens
aaccccaggtgagac

SEQ ID NO: 5344173 - DNA, 18 bp, Homo sapiens
aaccccagttctgctcct

SEQ ID NO: 5344174 - DNA, 23 bp, Homo sapiens
aaccccagttctgctcctctcca

SEQ ID NO: 5344175 - DNA, 23 bp, Homo sapiens
aaccccatcatatgacatgccac

SEQ ID NO: 5344176 - DNA, 22 bp, Homo sapiens
aaccccatctctactaaaaaat

SEQ ID NO: 5344177 - DNA, 17 bp, Homo sapiens
aaccccatgtcctcagc

SEQ ID NO: 5344178 - DNA, 20 bp, Homo sapiens
aacccccaaaatccaaaact

SEQ ID NO: 5344179 - DNA, 16 bp, Homo sapiens
aacccccaaatttaat

SEQ ID NO: 5344180 - DNA, 11 bp, Homo sapiens
aacccccacca

SEQ ID NO: 5344181 - DNA, 11 bp, Homo sapiens
aacccccaccc

SEQ ID NO: 5344182 - DNA, 12 bp, Homo sapiens
aacccccacccc

SEQ ID NO: 5344183 - DNA, 13 bp, Homo sapiens
aacccccacccca

SEQ ID NO: 5344184 - DNA, 19 bp, Homo sapiens
aacccccaccccacacttg

SEQ ID NO: 5344185 - DNA, 21 bp, Homo sapiens
aacccccaccgaagagccctg

SEQ ID NO: 5344186 - DNA, 22 bp, Homo sapiens
aacccccaccgaagagccctga

SEQ ID NO: 5344187 - DNA, 12 bp, Homo sapiens
aacccccactgg

SEQ ID NO: 5344188 - DNA, 20 bp, Homo sapiens
aacccccactggactgacct

SEQ ID NO: 5344189 - DNA, 15 bp, Homo sapiens
aacccccagcctgct

SEQ ID NO: 5344190 - DNA, 21 bp, Homo sapiens
aacccccagctaataaaccag

SEQ ID NO: 5344191 - DNA, 16 bp, Homo sapiens
aacccccagtgccaca

SEQ ID NO: 5344192 - DNA, 18 bp, Homo sapiens
aacccccagtgccacaga

SEQ ID NO: 5344193 - DNA, 16 bp, Homo sapiens
aacccccattctcatc

SEQ ID NO: 5344194 - DNA, 17 bp, Homo sapiens
aaccccccaatgtctgt

SEQ ID NO: 5344195 - DNA, 14 bp, Homo sapiens
aaccccccagatat

SEQ ID NO: 5344196 - DNA, 11 bp, Homo sapiens
aaccccccagc

SEQ ID NO: 5344197 - DNA, 19 bp, Homo sapiens
aaccccccagcactgagga

SEQ ID NO: 5344198 - DNA, 17 bp, Homo sapiens
aaccccccatttcttcc

SEQ ID NO: 5344199 - DNA, 12 bp, Homo sapiens
aacccccctccc

SEQ ID NO: 5344200 - DNA, 13 bp, Homo sapiens
aacccccctccca

SEQ ID NO: 5344201 - DNA, 22 bp, Homo sapiens
aacccccctccccaaggaagaa

SEQ ID NO: 5344202 - DNA, 14 bp, Homo sapiens
aacccccctcctgc

SEQ ID NO: 5344203 - DNA, 15 bp, Homo sapiens
aacccccctcctgct

SEQ ID NO: 5344204 - DNA, 16 bp, Homo sapiens
aacccccctcctgctc

SEQ ID NO: 5344205 - DNA, 17 bp, Homo sapiens
aacccccctcctgctcc

SEQ ID NO: 5344206 - DNA, 16 bp, Homo sapiens
aaccccctcaaaagcc

SEQ ID NO: 5344207 - DNA, 15 bp, Homo sapiens
aaccccctccctgtc

SEQ ID NO: 5344208 - DNA, 19 bp, Homo sapiens
aaccccctttgtgctgtgg

SEQ ID NO: 5344209 - DNA, 18 bp, Homo sapiens
aaccccgaggggcttgca

SEQ ID NO: 5344210 - DNA, 16 bp, Homo sapiens
aaccccgcggcccaga

SEQ ID NO: 5344211 - DNA, 17 bp, Homo sapiens
aaccccgcggtgctctg

SEQ ID NO: 5344212 - DNA, 20 bp, Homo sapiens
aaccccgcggtgctctggcg

SEQ ID NO: 5344213 - DNA, 15 bp, Homo sapiens
aaccccgggatgcaa

SEQ ID NO: 5344214 - DNA, 17 bp, Homo sapiens
aaccccgggatgcaagg

SEQ ID NO: 5344215 - DNA, 17 bp, Homo sapiens
aaccccgggcccgggcc

SEQ ID NO: 5344216 - DNA, 20 bp, Homo sapiens
aaccccggggtgcccacagg

SEQ ID NO: 5344217 - DNA, 18 bp, Homo sapiens
aaccccgtcaacaaatct

SEQ ID NO: 5344218 - DNA, 23 bp, Homo sapiens
aaccccgtctctactaaaaatat

SEQ ID NO: 5344219 - DNA, 11 bp, Homo sapiens
aacccctaaga

SEQ ID NO: 5344220 - DNA, 15 bp, Homo sapiens
aacccctccactgct

SEQ ID NO: 5344221 - DNA, 17 bp, Homo sapiens
aacccctccactgctgg

SEQ ID NO: 5344222 - DNA, 20 bp, Homo sapiens
aacccctccctcttctgccc

SEQ ID NO: 5344223 - DNA, 12 bp, Homo sapiens
aacccctcctcc

SEQ ID NO: 5344224 - DNA, 17 bp, Homo sapiens
aacccctcctccctcag

SEQ ID NO: 5344225 - DNA, 18 bp, Homo sapiens
aacccctcctccctcaga

SEQ ID NO: 5344226 - DNA, 22 bp, Homo sapiens
aacccctcctccctcagactca

SEQ ID NO: 5344227 - DNA, 12 bp, Homo sapiens
aacccctcctgg

SEQ ID NO: 5344228 - DNA, 22 bp, Homo sapiens
aacccctccttccccagaccca

SEQ ID NO: 5344229 - DNA, 15 bp, Homo sapiens
aacccctcgcccagt

SEQ ID NO: 5344230 - DNA, 23 bp, Homo sapiens
aacccctcgcccagtcccagcag

SEQ ID NO: 5344231 - DNA, 20 bp, Homo sapiens
aacccctcttggattaagga

SEQ ID NO: 5344232 - DNA, 22 bp, Homo sapiens
aacccctgacctaccccagcca

SEQ ID NO: 5344233 - DNA, 16 bp, Homo sapiens
aacccctggaccccag

SEQ ID NO: 5344234 - DNA, 12 bp, Homo sapiens
aacccctggcca

SEQ ID NO: 5344235 - DNA, 13 bp, Homo sapiens
aacccctggccag

SEQ ID NO: 5344236 - DNA, 18 bp, Homo sapiens
aacccctggctccttcac

SEQ ID NO: 5344237 - DNA, 17 bp, Homo sapiens
aacccctgtaggcctca

SEQ ID NO: 5344238 - DNA, 10 bp, Homo sapiens
aacccctgtg

SEQ ID NO: 5344239 - DNA, 13 bp, Homo sapiens
aacccctgtggag

SEQ ID NO: 5344240 - DNA, 12 bp, Homo sapiens
aacccctgtgtc

SEQ ID NO: 5344241 - DNA, 15 bp, Homo sapiens
aaccccttctctgtg

SEQ ID NO: 5344242 - DNA, 16 bp, Homo sapiens
aaccccttctctgtga

SEQ ID NO: 5344243 - DNA, 11 bp, Homo sapiens
aacccctttcc

SEQ ID NO: 5344244 - DNA, 18 bp, Homo sapiens
aacccctttcccacccca

SEQ ID NO: 5344245 - DNA, 20 bp, Homo sapiens
aacccgacagagggaagaaa

SEQ ID NO: 5344246 - DNA, 16 bp, Homo sapiens
aacccgaggcccgcat

SEQ ID NO: 5344247 - DNA, 23 bp, Homo sapiens
aacccgagtcattcgttctgtgg

SEQ ID NO: 5344248 - DNA, 19 bp, Homo sapiens
aacccgctctcccagacct

SEQ ID NO: 5344249 - DNA, 14 bp, Homo sapiens
aacccgggaggcag

SEQ ID NO: 5344250 - DNA, 16 bp, Homo sapiens
aacccggtcccaggcc

SEQ ID NO: 5344251 - DNA, 19 bp, Homo sapiens
aacccggtcccaggccgca

SEQ ID NO: 5344252 - DNA, 14 bp, Homo sapiens
aacccggtgcatct

SEQ ID NO: 5344253 - DNA, 19 bp, Homo sapiens
aacccggtgcatctggcac

SEQ ID NO: 5344254 - DNA, 14 bp, Homo sapiens
aacccgtgccaagt

SEQ ID NO: 5344255 - DNA, 17 bp, Homo sapiens
aacccgtggaggctgct

SEQ ID NO: 5344256 - DNA, 19 bp, Homo sapiens
aaccctaaagcagtaaaat

SEQ ID NO: 5344257 - DNA, 23 bp, Homo sapiens
aaccctaaataataaaaataaac

SEQ ID NO: 5344258 - DNA, 18 bp, Homo sapiens
aaccctaattttgtacat

SEQ ID NO: 5344259 - DNA, 17 bp, Homo sapiens
aaccctacaaagagcct

SEQ ID NO: 5344260 - DNA, 20 bp, Homo sapiens
aaccctactttgcttccgcc

SEQ ID NO: 5344261 - DNA, 17 bp, Homo sapiens
aaccctaggttccctgt

SEQ ID NO: 5344262 - DNA, 22 bp, Homo sapiens
aaccctagtcaaaactattttt

SEQ ID NO: 5344263 - DNA, 23 bp, Homo sapiens
aaccctatcctaattgtccacat

SEQ ID NO: 5344264 - DNA, 20 bp, Homo sapiens
aaccctcacatcagagtgac

SEQ ID NO: 5344265 - DNA, 16 bp, Homo sapiens
aaccctcagccttgaa

SEQ ID NO: 5344266 - DNA, 12 bp, Homo sapiens
aaccctcagctg

SEQ ID NO: 5344267 - DNA, 22 bp, Homo sapiens
aaccctcaggggaaaactgtta

SEQ ID NO: 5344268 - DNA, 14 bp, Homo sapiens
aaccctccacccct

SEQ ID NO: 5344269 - DNA, 18 bp, Homo sapiens
aaccctccacctcctctc

SEQ ID NO: 5344270 - DNA, 20 bp, Homo sapiens
aaccctcccagaaacatctc

SEQ ID NO: 5344271 - DNA, 13 bp, Homo sapiens
aaccctccctcag

SEQ ID NO: 5344272 - DNA, 14 bp, Homo sapiens
aaccctccctcagc

SEQ ID NO: 5344273 - DNA, 18 bp, Homo sapiens
aaccctccctcagcccct

SEQ ID NO: 5344274 - DNA, 20 bp, Homo sapiens
aaccctccctcagcccctct

SEQ ID NO: 5344275 - DNA, 18 bp, Homo sapiens
aaccctcctcctttttaa

SEQ ID NO: 5344276 - DNA, 16 bp, Homo sapiens
aaccctcctgggaagg

SEQ ID NO: 5344277 - DNA, 17 bp, Homo sapiens
aaccctccttggtgcct

SEQ ID NO: 5344278 - DNA, 17 bp, Homo sapiens
aaccctcgccctgtccc

SEQ ID NO: 5344279 - DNA, 18 bp, Homo sapiens
aaccctcggagcccccca

SEQ ID NO: 5344280 - DNA, 21 bp, Homo sapiens
aaccctcggagccccccactc

SEQ ID NO: 5344281 - DNA, 23 bp, Homo sapiens
aaccctcggagccccccactcag

SEQ ID NO: 5344282 - DNA, 21 bp, Homo sapiens
aaccctctcaggtgaccaaaa

SEQ ID NO: 5344283 - DNA, 15 bp, Homo sapiens
aaccctctcttccct

SEQ ID NO: 5344284 - DNA, 23 bp, Homo sapiens
aaccctctcttccctattatttc

SEQ ID NO: 5344285 - DNA, 12 bp, Homo sapiens
aaccctctggaa

SEQ ID NO: 5344286 - DNA, 18 bp, Homo sapiens
aaccctctgttccttccc

SEQ ID NO: 5344287 - DNA, 21 bp, Homo sapiens
aaccctcttgccatcctgatg

SEQ ID NO: 5344288 - DNA, 17 bp, Homo sapiens
aaccctgagagtctgag

SEQ ID NO: 5344289 - DNA, 20 bp, Homo sapiens
aaccctgattcatactcctt

SEQ ID NO: 5344290 - DNA, 19 bp, Homo sapiens
aaccctgccagtgccaggg

SEQ ID NO: 5344291 - DNA, 21 bp, Homo sapiens
aaccctgccagtgccagggtg

SEQ ID NO: 5344292 - DNA, 21 bp, Homo sapiens
aaccctgccatggaactgttt

SEQ ID NO: 5344293 - DNA, 17 bp, Homo sapiens
aaccctgcccagcctga

SEQ ID NO: 5344294 - DNA, 11 bp, Homo sapiens
aaccctgcccc

SEQ ID NO: 5344295 - DNA, 12 bp, Homo sapiens
aaccctgcccct

SEQ ID NO: 5344296 - DNA, 18 bp, Homo sapiens
aaccctgccctgctctgc

SEQ ID NO: 5344297 - DNA, 19 bp, Homo sapiens
aaccctgccgtcaccacca

SEQ ID NO: 5344298 - DNA, 10 bp, Homo sapiens
aaccctgcct

SEQ ID NO: 5344299 - DNA, 17 bp, Homo sapiens
aaccctgcctctcagag

SEQ ID NO: 5344300 - DNA, 20 bp, Homo sapiens
aaccctgcctgccgctgcac

SEQ ID NO: 5344301 - DNA, 21 bp, Homo sapiens
aaccctgcctgccgctgcacc

SEQ ID NO: 5344302 - DNA, 12 bp, Homo sapiens
aaccctgcctgt

SEQ ID NO: 5344303 - DNA, 13 bp, Homo sapiens
aaccctgcttctg

SEQ ID NO: 5344304 - DNA, 15 bp, Homo sapiens
aaccctgcttctgct

SEQ ID NO: 5344305 - DNA, 20 bp, Homo sapiens
aaccctgcttctgctgccct

SEQ ID NO: 5344306 - DNA, 16 bp, Homo sapiens
aaccctggaaactacc

SEQ ID NO: 5344307 - DNA, 15 bp, Homo sapiens
aaccctggagccatc

SEQ ID NO: 5344308 - DNA, 19 bp, Homo sapiens
aaccctggagccatccctt

SEQ ID NO: 5344309 - DNA, 12 bp, Homo sapiens
aaccctggcctc

SEQ ID NO: 5344310 - DNA, 17 bp, Homo sapiens
aaccctgggctccctgg

SEQ ID NO: 5344311 - DNA, 22 bp, Homo sapiens
aaccctgggctggggaggagga

SEQ ID NO: 5344312 - DNA, 22 bp, Homo sapiens
aaccctgggctgtccagcctta

SEQ ID NO: 5344313 - DNA, 23 bp, Homo sapiens
aaccctgggctgtccagccttaa

SEQ ID NO: 5344314 - DNA, 16 bp, Homo sapiens
aaccctggggaaggag

SEQ ID NO: 5344315 - DNA, 20 bp, Homo sapiens
aaccctggggaaggagccag

SEQ ID NO: 5344316 - DNA, 18 bp, Homo sapiens
aaccctggggactctgct

SEQ ID NO: 5344317 - DNA, 20 bp, Homo sapiens
aaccctggggactctgcttg

SEQ ID NO: 5344318 - DNA, 17 bp, Homo sapiens
aaccctggtgctttcct

SEQ ID NO: 5344319 - DNA, 17 bp, Homo sapiens
aaccctgtaagttacag

SEQ ID NO: 5344320 - DNA, 20 bp, Homo sapiens
aaccctgtatccaattttaa

SEQ ID NO: 5344321 - DNA, 23 bp, Homo sapiens
aaccctgtcaaacattagtactt

SEQ ID NO: 5344322 - DNA, 18 bp, Homo sapiens
aaccctgtcacccacaga

SEQ ID NO: 5344323 - DNA, 12 bp, Homo sapiens
aaccctgtgctg

SEQ ID NO: 5344324 - DNA, 21 bp, Homo sapiens
aaccctgtgctggtgtcctga

SEQ ID NO: 5344325 - DNA, 17 bp, Homo sapiens
aaccctgtgctgtcaga

SEQ ID NO: 5344326 - DNA, 18 bp, Homo sapiens
aaccctgtggaagcatgg

SEQ ID NO: 5344327 - DNA, 23 bp, Homo sapiens
aaccctgtggaagcatggctgtc

SEQ ID NO: 5344328 - DNA, 21 bp, Homo sapiens
aaccctgttgagtatttgctg

SEQ ID NO: 5344329 - DNA, 20 bp, Homo sapiens
aaccctgttttatactgtac

SEQ ID NO: 5344330 - DNA, 23 bp, Homo sapiens
aaccctgttttatactgtactta

SEQ ID NO: 5344331 - DNA, 23 bp, Homo sapiens
aacccttaccccttagcctccct

SEQ ID NO: 5344332 - DNA, 14 bp, Homo sapiens
aacccttagcagcc

SEQ ID NO: 5344333 - DNA, 14 bp, Homo sapiens
aacccttattccat

SEQ ID NO: 5344334 - DNA, 16 bp, Homo sapiens
aacccttcatcttcct

SEQ ID NO: 5344335 - DNA, 14 bp, Homo sapiens
aacccttcccgccc

SEQ ID NO: 5344336 - DNA, 23 bp, Homo sapiens
aacccttccctatagaagttcaa

SEQ ID NO: 5344337 - DNA, 23 bp, Homo sapiens
aacccttctcctcttgtaaataa

SEQ ID NO: 5344338 - DNA, 15 bp, Homo sapiens
aacccttctctgttg

SEQ ID NO: 5344339 - DNA, 16 bp, Homo sapiens
aacccttgctgctgcc

SEQ ID NO: 5344340 - DNA, 21 bp, Homo sapiens
aacccttggagccaatggaga

SEQ ID NO: 5344341 - DNA, 18 bp, Homo sapiens
aacccttgggccagaagt

SEQ ID NO: 5344342 - DNA, 18 bp, Homo sapiens
aaccctttatttgaacaa

SEQ ID NO: 5344343 - DNA, 20 bp, Homo sapiens
aaccctttcttcaatacaaa

SEQ ID NO: 5344344 - DNA, 22 bp, Homo sapiens
aacggggggctcctgcccaggc

SEQ ID NO: 5344345 - DNA, 23 bp, Homo sapiens
aacggggggctcctgcccaggcc

SEQ ID NO: 5344346 - DNA, 15 bp, Homo sapiens
aacggggtccttcaa

SEQ ID NO: 5344347 - DNA, 13 bp, Homo sapiens
aacggggtgggga

SEQ ID NO: 5344348 - DNA, 16 bp, Homo sapiens
aacggggtggggaggg

SEQ ID NO: 5344349 - DNA, 21 bp, Homo sapiens
aacggtatgacttaattttag

SEQ ID NO: 5344350 - DNA, 23 bp, Homo sapiens
aacggtatgacttaattttagaa

SEQ ID NO: 5344351 - DNA, 15 bp, Homo sapiens
aacggtctggcaggg

SEQ ID NO: 5344352 - DNA, 23 bp, Homo sapiens
aacggtgaaatctctagcctctt

SEQ ID NO: 5344353 - DNA, 17 bp, Homo sapiens
aacggtgcaacagaagg

SEQ ID NO: 5344354 - DNA, 23 bp, Homo sapiens
aacggtgcatccacgcacacatg

SEQ ID NO: 5344355 - DNA, 19 bp, Homo sapiens
aacggtgcccatcctgcca

SEQ ID NO: 5344356 - DNA, 14 bp, Homo sapiens
aacggttcctggtg

SEQ ID NO: 5344357 - DNA, 18 bp, Homo sapiens
aacgtaaaaataaaagca

SEQ ID NO: 5344358 - DNA, 14 bp, Homo sapiens
aacgtaaactatga

SEQ ID NO: 5344359 - DNA, 20 bp, Homo sapiens
aacgtaactctttctatgcc

SEQ ID NO: 5344360 - DNA, 15 bp, Homo sapiens
aacgtaatcaaatat

SEQ ID NO: 5344361 - DNA, 21 bp, Homo sapiens
aacgtaatgattatatgacaa

SEQ ID NO: 5344362 - DNA, 19 bp, Homo sapiens
aacgtatggaatgcttctt

SEQ ID NO: 5344363 - DNA, 18 bp, Homo sapiens
aacgtattagttgccaat

SEQ ID NO: 5344364 - DNA, 17 bp, Homo sapiens
aacgtcacccaaaagca

SEQ ID NO: 5344365 - DNA, 17 bp, Homo sapiens
aacgtccacagagtata

SEQ ID NO: 5344366 - DNA, 19 bp, Homo sapiens
aacgtccactagcttactg

SEQ ID NO: 5344367 - DNA, 18 bp, Homo sapiens
aacgtcccacactttgaa

SEQ ID NO: 5344368 - DNA, 19 bp, Homo sapiens
aacgtcccctcaagcccct

SEQ ID NO: 5344369 - DNA, 23 bp, Homo sapiens
aacgtcccctcaagccccttctc

SEQ ID NO: 5344370 - DNA, 16 bp, Homo sapiens
aacgtctattttgtat

SEQ ID NO: 5344371 - DNA, 13 bp, Homo sapiens
aacgtctgtgcca

SEQ ID NO: 5344372 - DNA, 19 bp, Homo sapiens
aacgtctttttaagccttt

SEQ ID NO: 5344373 - DNA, 23 bp, Homo sapiens
aacgtctttttaagcctttgaag

SEQ ID NO: 5344374 - DNA, 12 bp, Homo sapiens
aacgtgaaaatg

SEQ ID NO: 5344375 - DNA, 18 bp, Homo sapiens
aacgtgaaacttatagtt

SEQ ID NO: 5344376 - DNA, 19 bp, Homo sapiens
aacgtgaaattctattgaa

SEQ ID NO: 5344377 - DNA, 16 bp, Homo sapiens
aacgtgagagaaagag

SEQ ID NO: 5344378 - DNA, 20 bp, Homo sapiens
aacgtgagagaaagagagaa

SEQ ID NO: 5344379 - DNA, 20 bp, Homo sapiens
aacgtgagctacatgtgtaa

SEQ ID NO: 5344380 - DNA, 21 bp, Homo sapiens
aacgtgaggaagcaagtgaca

SEQ ID NO: 5344381 - DNA, 17 bp, Homo sapiens
aacgtgaggtttcagta

SEQ ID NO: 5344382 - DNA, 15 bp, Homo sapiens
aacgtgataaatata

SEQ ID NO: 5344383 - DNA, 20 bp, Homo sapiens
aacgtgatgatcagctgttt

SEQ ID NO: 5344384 - DNA, 17 bp, Homo sapiens
aacgtgatgtgccacta

SEQ ID NO: 5344385 - DNA, 23 bp, Homo sapiens
aacgtgatgtgctcatcagaaac

SEQ ID NO: 5344386 - DNA, 22 bp, Homo sapiens
aacgtgattgattcagtatctt

SEQ ID NO: 5344387 - DNA, 12 bp, Homo sapiens
aacgtgcaactg

SEQ ID NO: 5344388 - DNA, 15 bp, Homo sapiens
aacgtgcccccagag

SEQ ID NO: 5344389 - DNA, 18 bp, Homo sapiens
aacgtgccccccagttcc

SEQ ID NO: 5344390 - DNA, 13 bp, Homo sapiens
aacgtgccctctg

SEQ ID NO: 5344391 - DNA, 21 bp, Homo sapiens
aacgtgcgtgtctctgccatg

SEQ ID NO: 5344392 - DNA, 14 bp, Homo sapiens
aacgtgctcactgt

SEQ ID NO: 5344393 - DNA, 23 bp, Homo sapiens
aacgtgctcactgtgtataggaa

SEQ ID NO: 5344394 - DNA, 19 bp, Homo sapiens
aacgtgctctttgttttgt

SEQ ID NO: 5344395 - DNA, 20 bp, Homo sapiens
aacgtgctctttgttttgtg

SEQ ID NO: 5344396 - DNA, 12 bp, Homo sapiens
aacgtgcttctt

SEQ ID NO: 5344397 - DNA, 14 bp, Homo sapiens
aacgtgcttctttg

SEQ ID NO: 5344398 - DNA, 15 bp, Homo sapiens
aacgtgcttctttgt

SEQ ID NO: 5344399 - DNA, 17 bp, Homo sapiens
aacgtgcttctttgtaa

SEQ ID NO: 5344400 - DNA, 20 bp, Homo sapiens
aacgtggagaatcacaggct

SEQ ID NO: 5344401 - DNA, 15 bp, Homo sapiens
aacgtggattgtatt

SEQ ID NO: 5344402 - DNA, 21 bp, Homo sapiens
aacgtggattttaaaaaatca

SEQ ID NO: 5344403 - DNA, 22 bp, Homo sapiens
aacgtggattttaaaaaatcaa

SEQ ID NO: 5344404 - DNA, 19 bp, Homo sapiens
aacgtggcacacactgacc

SEQ ID NO: 5344405 - DNA, 12 bp, Homo sapiens
aacgtggctgct

SEQ ID NO: 5344406 - DNA, 13 bp, Homo sapiens
aacgtggctgctt

SEQ ID NO: 5344407 - DNA, 18 bp, Homo sapiens
aacgtgggagttcagctg

SEQ ID NO: 5344408 - DNA, 23 bp, Homo sapiens
aacgtgggagttcagctgcttct

SEQ ID NO: 5344409 - DNA, 12 bp, Homo sapiens
aacgtgtaaatt

SEQ ID NO: 5344410 - DNA, 22 bp, Homo sapiens
aacgtgtatgtttttcagttca

SEQ ID NO: 5344411 - DNA, 23 bp, Homo sapiens
aacgtgtcagaatcctttacatt

SEQ ID NO: 5344412 - DNA, 13 bp, Homo sapiens
aacgtgtcccgag

SEQ ID NO: 5344413 - DNA, 16 bp, Homo sapiens
aacgtgtgctgtgttt

SEQ ID NO: 5344414 - DNA, 17 bp, Homo sapiens
aacgtgttactggaaaa

SEQ ID NO: 5344415 - DNA, 17 bp, Homo sapiens
aacgtgttcaatatttt

SEQ ID NO: 5344416 - DNA, 19 bp, Homo sapiens
aacgtgttgccttgaacca

SEQ ID NO: 5344417 - DNA, 17 bp, Homo sapiens
aacgttaaaagacagtg

SEQ ID NO: 5344418 - DNA, 16 bp, Homo sapiens
aacgttaaaagtgtac

SEQ ID NO: 5344419 - DNA, 19 bp, Homo sapiens
aacgttaaatgaaaaaaga

SEQ ID NO: 5344420 - DNA, 15 bp, Homo sapiens
aacgttccacaacag

SEQ ID NO: 5344421 - DNA, 17 bp, Homo sapiens
aacgttgatgtaatgaa

SEQ ID NO: 5344422 - DNA, 15 bp, Homo sapiens
aacgttgcgaaaatt

SEQ ID NO: 5344423 - DNA, 19 bp, Homo sapiens
aacgttggtatgataatga

SEQ ID NO: 5344424 - DNA, 18 bp, Homo sapiens
aacgtttagctgacaaaa

SEQ ID NO: 5344425 - DNA, 13 bp, Homo sapiens
aacgttttccttg

SEQ ID NO: 5344426 - DNA, 15 bp, Homo sapiens
aacgttttctaattg

SEQ ID NO: 5344427 - DNA, 23 bp, Homo sapiens
aacgttttctgtttggaggagca

SEQ ID NO: 5344428 - DNA, 17 bp, Homo sapiens
aacgttttcttaaatgt

SEQ ID NO: 5344429 - DNA, 17 bp, Homo sapiens
aacgttttcttctttcc

SEQ ID NO: 5344430 - DNA, 18 bp, Homo sapiens
aacgttttcttctttccc

SEQ ID NO: 5344431 - DNA, 15 bp, Homo sapiens
aacgttttgaactaa

SEQ ID NO: 5344432 - DNA, 20 bp, Homo sapiens
aacgttttgaactaataaaa

SEQ ID NO: 5344433 - DNA, 21 bp, Homo sapiens
aacgttttttcttcttttaaa

SEQ ID NO: 5344434 - DNA, 22 bp, Homo sapiens
aactaaaaattaaaacctcttt

SEQ ID NO: 5344435 - DNA, 13 bp, Homo sapiens
aactaaaacaaag

SEQ ID NO: 5344436 - DNA, 17 bp, Homo sapiens
aactaaaataattttgt

SEQ ID NO: 5344437 - DNA, 19 bp, Homo sapiens
aactaaaataattttgtaa

SEQ ID NO: 5344438 - DNA, 13 bp, Homo sapiens
aactaaaatacaa

SEQ ID NO: 5344439 - DNA, 12 bp, Homo sapiens
aactaaaatagt

SEQ ID NO: 5344440 - DNA, 21 bp, Homo sapiens
aactaaaatagtttaaaaata

SEQ ID NO: 5344441 - DNA, 18 bp, Homo sapiens
aactaaaatcattgtcaa

SEQ ID NO: 5344442 - DNA, 22 bp, Homo sapiens
aactaaaatctgttaccattct

SEQ ID NO: 5344443 - DNA, 16 bp, Homo sapiens
aactaaaattcaacaa

SEQ ID NO: 5344444 - DNA, 17 bp, Homo sapiens
aactaaaattcaacaaa

SEQ ID NO: 5344445 - DNA, 13 bp, Homo sapiens
aactaaaattctg

SEQ ID NO: 5344446 - DNA, 16 bp, Homo sapiens
aactaaactagttttt

SEQ ID NO: 5344447 - DNA, 23 bp, Homo sapiens
aactaaactcttaccatatgttt

SEQ ID NO: 5344448 - DNA, 17 bp, Homo sapiens
aactaaactttcacacc

SEQ ID NO: 5344449 - DNA, 22 bp, Homo sapiens
aactaaagtgtgctttataaaa

SEQ ID NO: 5344450 - DNA, 14 bp, Homo sapiens
aactaaagttgtac

SEQ ID NO: 5344451 - DNA, 16 bp, Homo sapiens
aactaaagttgtacct

SEQ ID NO: 5344452 - DNA, 15 bp, Homo sapiens
aactaaagttgtact

SEQ ID NO: 5344453 - DNA, 16 bp, Homo sapiens
aactaaagttgtactt

SEQ ID NO: 5344454 - DNA, 17 bp, Homo sapiens
aactaaagttgtacttt

SEQ ID NO: 5344455 - DNA, 20 bp, Homo sapiens
aactaaataaacagatgtat

SEQ ID NO: 5344456 - DNA, 16 bp, Homo sapiens
aactaaataatgaata

SEQ ID NO: 5344457 - DNA, 18 bp, Homo sapiens
aactaaataccattcact

SEQ ID NO: 5344458 - DNA, 13 bp, Homo sapiens
aactaaatatatg

SEQ ID NO: 5344459 - DNA, 21 bp, Homo sapiens
aactaaatgtgcaatagaagg

SEQ ID NO: 5344460 - DNA, 13 bp, Homo sapiens
aactaaatgttct

SEQ ID NO: 5344461 - DNA, 18 bp, Homo sapiens
aactaaatgttctatggt

SEQ ID NO: 5344462 - DNA, 22 bp, Homo sapiens
aactaaatttcactactagatt

SEQ ID NO: 5344463 - DNA, 17 bp, Homo sapiens
aactaaatttgtctttc

SEQ ID NO: 5344464 - DNA, 17 bp, Homo sapiens
aactaaatttttcatag

SEQ ID NO: 5344465 - DNA, 16 bp, Homo sapiens
aactaacaatgccttg

SEQ ID NO: 5344466 - DNA, 19 bp, Homo sapiens
aactaacacgtgatgtgat

SEQ ID NO: 5344467 - DNA, 20 bp, Homo sapiens
aactaacacgtgatgtgata

SEQ ID NO: 5344468 - DNA, 15 bp, Homo sapiens
aactaacatgtcctg

SEQ ID NO: 5344469 - DNA, 19 bp, Homo sapiens
aactaagaaacttaaattt

SEQ ID NO: 5344470 - DNA, 18 bp, Homo sapiens
aactaagagattcttcta

SEQ ID NO: 5344471 - DNA, 15 bp, Homo sapiens
aactaagatctgtta

SEQ ID NO: 5344472 - DNA, 15 bp, Homo sapiens
aactaagattctttt

SEQ ID NO: 5344473 - DNA, 21 bp, Homo sapiens
aactaagcaagtatatttatt

SEQ ID NO: 5344474 - DNA, 16 bp, Homo sapiens
aactaagctctttgag

SEQ ID NO: 5344475 - DNA, 14 bp, Homo sapiens
aactaaggacaaat

SEQ ID NO: 5344476 - DNA, 19 bp, Homo sapiens
aactaaggacaaattagca

SEQ ID NO: 5344477 - DNA, 19 bp, Homo sapiens
aactaaggactccaatgtc

SEQ ID NO: 5344478 - DNA, 23 bp, Homo sapiens
aactaagggggtagaagtagttt

SEQ ID NO: 5344479 - DNA, 15 bp, Homo sapiens
aactaaggtcagaag

SEQ ID NO: 5344480 - DNA, 19 bp, Homo sapiens
aactaaggtgaagaatctt

SEQ ID NO: 5344481 - DNA, 18 bp, Homo sapiens
aactaaggtgctaaatct

SEQ ID NO: 5344482 - DNA, 22 bp, Homo sapiens
aactaaggtgctaaatctgcga

SEQ ID NO: 5344483 - DNA, 17 bp, Homo sapiens
aactaagtaagaaacac

SEQ ID NO: 5344484 - DNA, 18 bp, Homo sapiens
aactaagttattgctgca

SEQ ID NO: 5344485 - DNA, 21 bp, Homo sapiens
aactaagttattgctgcataa

SEQ ID NO: 5344486 - DNA, 16 bp, Homo sapiens
aactaagttttgtgtg

SEQ ID NO: 5344487 - DNA, 21 bp, Homo sapiens
aactaagttttttacttccac

SEQ ID NO: 5344488 - DNA, 15 bp, Homo sapiens
aactaataaaagcat

SEQ ID NO: 5344489 - DNA, 14 bp, Homo sapiens
aactaataaaataa

SEQ ID NO: 5344490 - DNA, 14 bp, Homo sapiens
aactaataaaatat

SEQ ID NO: 5344491 - DNA, 15 bp, Homo sapiens
aactaataaaatata

SEQ ID NO: 5344492 - DNA, 16 bp, Homo sapiens
aactaataaaatattt

SEQ ID NO: 5344493 - DNA, 14 bp, Homo sapiens
aactaataattgca

SEQ ID NO: 5344494 - DNA, 18 bp, Homo sapiens
aactaatacgtgccagat

SEQ ID NO: 5344495 - DNA, 13 bp, Homo sapiens
aactaatatatga

SEQ ID NO: 5344496 - DNA, 15 bp, Homo sapiens
aactaatatatgaaa

SEQ ID NO: 5344497 - DNA, 19 bp, Homo sapiens
aactaatatttgtctgtgt

SEQ ID NO: 5344498 - DNA, 20 bp, Homo sapiens
aactaatatttgtctgtgtg

SEQ ID NO: 5344499 - DNA, 20 bp, Homo sapiens
aactaatctattgggttcat

SEQ ID NO: 5344500 - DNA, 15 bp, Homo sapiens
aactaatgagtatga

SEQ ID NO: 5344501 - DNA, 21 bp, Homo sapiens
aactaatgataatcccaccac

SEQ ID NO: 5344502 - DNA, 17 bp, Homo sapiens
aactaatgtaaatattg

SEQ ID NO: 5344503 - DNA, 15 bp, Homo sapiens
aactaatgtactgta

SEQ ID NO: 5344504 - DNA, 20 bp, Homo sapiens
aactaatgtgatatgaaaat

SEQ ID NO: 5344505 - DNA, 20 bp, Homo sapiens
aactaatgtttgaacaaagc

SEQ ID NO: 5344506 - DNA, 14 bp, Homo sapiens
aactaattcattta

SEQ ID NO: 5344507 - DNA, 21 bp, Homo sapiens
aactaattcatttattaagta

SEQ ID NO: 5344508 - DNA, 12 bp, Homo sapiens
aactaattctgt

SEQ ID NO: 5344509 - DNA, 18 bp, Homo sapiens
aactaattgactttagaa

SEQ ID NO: 5344510 - DNA, 20 bp, Homo sapiens
aactaattgactttagaaag

SEQ ID NO: 5344511 - DNA, 12 bp, Homo sapiens
aactaatttaaa

SEQ ID NO: 5344512 - DNA, 21 bp, Homo sapiens
aactaatttaaaccagcagaa

SEQ ID NO: 5344513 - DNA, 19 bp, Homo sapiens
aactaatttgaatgtggtt

SEQ ID NO: 5344514 - DNA, 13 bp, Homo sapiens
aactaatttgtgg

SEQ ID NO: 5344515 - DNA, 19 bp, Homo sapiens
aactacaaacaaaagcagc

SEQ ID NO: 5344516 - DNA, 21 bp, Homo sapiens
aactacaaagctttgctacaa

SEQ ID NO: 5344517 - DNA, 21 bp, Homo sapiens
aactacaaaggtttaaatgaa

SEQ ID NO: 5344518 - DNA, 16 bp, Homo sapiens
aactacaaagtaaaat

SEQ ID NO: 5344519 - DNA, 12 bp, Homo sapiens
aactacaaatat

SEQ ID NO: 5344520 - DNA, 22 bp, Homo sapiens
aactacaaccaagctctctgca

SEQ ID NO: 5344521 - DNA, 19 bp, Homo sapiens
aactcctcgacatcactgt

SEQ ID NO: 5344522 - DNA, 23 bp, Homo sapiens
aactcctcgacatcactgttcat

SEQ ID NO: 5344523 - DNA, 15 bp, Homo sapiens
aactcctgaaattca

SEQ ID NO: 5344524 - DNA, 17 bp, Homo sapiens
aactcctgacctcgtga

SEQ ID NO: 5344525 - DNA, 23 bp, Homo sapiens
aactcctgacgtctgaagcttga

SEQ ID NO: 5344526 - DNA, 17 bp, Homo sapiens
aactcctgattttgtag

SEQ ID NO: 5344527 - DNA, 15 bp, Homo sapiens
aactcctgccattct

SEQ ID NO: 5344528 - DNA, 22 bp, Homo sapiens
aactcctgcctgagaatgttac

SEQ ID NO: 5344529 - DNA, 11 bp, Homo sapiens
aactcctggcc

SEQ ID NO: 5344530 - DNA, 12 bp, Homo sapiens
aactcctggcct

SEQ ID NO: 5344531 - DNA, 13 bp, Homo sapiens
aactcctggcctc

SEQ ID NO: 5344532 - DNA, 13 bp, Homo sapiens
aactcctgggctt

SEQ ID NO: 5344533 - DNA, 12 bp, Homo sapiens
aactcctgtccc

SEQ ID NO: 5344534 - DNA, 14 bp, Homo sapiens
aactcctgtccctt

SEQ ID NO: 5344535 - DNA, 14 bp, Homo sapiens
aactcctgtccttt

SEQ ID NO: 5344536 - DNA, 13 bp, Homo sapiens
aactcctgtgacc

SEQ ID NO: 5344537 - DNA, 12 bp, Homo sapiens
aactcctgttct

SEQ ID NO: 5344538 - DNA, 19 bp, Homo sapiens
aactccttattttgtatta

SEQ ID NO: 5344539 - DNA, 12 bp, Homo sapiens
aactccttcctc

SEQ ID NO: 5344540 - DNA, 17 bp, Homo sapiens
aactccttcctggcctg

SEQ ID NO: 5344541 - DNA, 13 bp, Homo sapiens
aactccttggcct

SEQ ID NO: 5344542 - DNA, 18 bp, Homo sapiens
aactcctttactgcagcc

SEQ ID NO: 5344543 - DNA, 18 bp, Homo sapiens
aactcctttcagccacat

SEQ ID NO: 5344544 - DNA, 17 bp, Homo sapiens
aactcgaagcccttcca

SEQ ID NO: 5344545 - DNA, 23 bp, Homo sapiens
aactcgaagcccttccagtggta

SEQ ID NO: 5344546 - DNA, 21 bp, Homo sapiens
aactcgaatcactcatttatt

SEQ ID NO: 5344547 - DNA, 15 bp, Homo sapiens
aactcgatgcactga

SEQ ID NO: 5344548 - DNA, 17 bp, Homo sapiens
aactcgcacctgtgctg

SEQ ID NO: 5344549 - DNA, 14 bp, Homo sapiens
aactcgcctcagcc

SEQ ID NO: 5344550 - DNA, 16 bp, Homo sapiens
aactcgcgctcagtaa

SEQ ID NO: 5344551 - DNA, 13 bp, Homo sapiens
aactcgggagcat

SEQ ID NO: 5344552 - DNA, 18 bp, Homo sapiens
aactcgggattacagaaa

SEQ ID NO: 5344553 - DNA, 20 bp, Homo sapiens
aactcgggattacagaaaca

SEQ ID NO: 5344554 - DNA, 21 bp, Homo sapiens
aactcggtgtccccaccatct

SEQ ID NO: 5344555 - DNA, 24 bp, Homo sapiens
aactcggtgtccccaccatctgct

SEQ ID NO: 5344556 - DNA, 19 bp, Homo sapiens
aactcgtatagcatgcatc

SEQ ID NO: 5344557 - DNA, 14 bp, Homo sapiens
aactcgtctgatgt

SEQ ID NO: 5344558 - DNA, 21 bp, Homo sapiens
aactcgtctgatgttttgatg

SEQ ID NO: 5344559 - DNA, 20 bp, Homo sapiens
aactcgtgacagcctctgac

SEQ ID NO: 5344560 - DNA, 21 bp, Homo sapiens
aactctaaccaaggctgtgtt

SEQ ID NO: 5344561 - DNA, 17 bp, Homo sapiens
aactctaaccctgtgga

SEQ ID NO: 5344562 - DNA, 16 bp, Homo sapiens
aactctaactgtgaca

SEQ ID NO: 5344563 - DNA, 15 bp, Homo sapiens
aactctaatagtgct

SEQ ID NO: 5344564 - DNA, 22 bp, Homo sapiens
aactctaattcccattttgcaa

SEQ ID NO: 5344565 - DNA, 16 bp, Homo sapiens
aactctacccctgctc

SEQ ID NO: 5344566 - DNA, 18 bp, Homo sapiens
aactctacccctgctccc

SEQ ID NO: 5344567 - DNA, 15 bp, Homo sapiens
aactctactgtgtaa

SEQ ID NO: 5344568 - DNA, 23 bp, Homo sapiens
aactctagctgggggtgggccag

SEQ ID NO: 5344569 - DNA, 14 bp, Homo sapiens
aactctataaagaa

SEQ ID NO: 5344570 - DNA, 17 bp, Homo sapiens
aactctatactcaatca

SEQ ID NO: 5344571 - DNA, 18 bp, Homo sapiens
aactctatactcaatcaa

SEQ ID NO: 5344572 - DNA, 21 bp, Homo sapiens
aactctatcagcattgtttca

SEQ ID NO: 5344573 - DNA, 21 bp, Homo sapiens
aactctatcggagaacatgaa

SEQ ID NO: 5344574 - DNA, 14 bp, Homo sapiens
aactctatctgggc

SEQ ID NO: 5344575 - DNA, 14 bp, Homo sapiens
aactctattaatga

SEQ ID NO: 5344576 - DNA, 22 bp, Homo sapiens
aactctattaatgaggtcttta

SEQ ID NO: 5344577 - DNA, 14 bp, Homo sapiens
aactctatttagat

SEQ ID NO: 5344578 - DNA, 13 bp, Homo sapiens
aactctattttga

SEQ ID NO: 5344579 - DNA, 11 bp, Homo sapiens
aactctcactc

SEQ ID NO: 5344580 - DNA, 15 bp, Homo sapiens
aactctccactccat

SEQ ID NO: 5344581 - DNA, 20 bp, Homo sapiens
aactctccagttatcagtac

SEQ ID NO: 5344582 - DNA, 20 bp, Homo sapiens
aactctccccagtgcctgcc

SEQ ID NO: 5344583 - DNA, 15 bp, Homo sapiens
aactctcctgctcct

SEQ ID NO: 5344584 - DNA, 16 bp, Homo sapiens
aactctctcccaggac

SEQ ID NO: 5344585 - DNA, 22 bp, Homo sapiens
aactctctccctggtctctgcc

SEQ ID NO: 5344586 - DNA, 10 bp, Homo sapiens
aactctctct

SEQ ID NO: 5344587 - DNA, 14 bp, Homo sapiens
aactctctctgccc

SEQ ID NO: 5344588 - DNA, 16 bp, Homo sapiens
aactctctgtcttctc

SEQ ID NO: 5344589 - DNA, 19 bp, Homo sapiens
aactctctgtcttctctcc

SEQ ID NO: 5344590 - DNA, 21 bp, Homo sapiens
aactctctgtcttctctccac

SEQ ID NO: 5344591 - DNA, 18 bp, Homo sapiens
aactctcttattgcctca

SEQ ID NO: 5344592 - DNA, 18 bp, Homo sapiens
aactctgaaatcagcctt

SEQ ID NO: 5344593 - DNA, 14 bp, Homo sapiens
aactctgaactttg

SEQ ID NO: 5344594 - DNA, 17 bp, Homo sapiens
aactctgaactttggag

SEQ ID NO: 5344595 - DNA, 23 bp, Homo sapiens
aactctgaagctaattgtactaa

SEQ ID NO: 5344596 - DNA, 21 bp, Homo sapiens
aactctgaatttatctttgat

SEQ ID NO: 5344597 - DNA, 16 bp, Homo sapiens
aactctgacaacagac

SEQ ID NO: 5344598 - DNA, 20 bp, Homo sapiens
aactctgacaacagacttct

SEQ ID NO: 5344599 - DNA, 17 bp, Homo sapiens
aactctgacaagggctg

SEQ ID NO: 5344600 - DNA, 22 bp, Homo sapiens
aactctgacaagggctgacctg

SEQ ID NO: 5344601 - DNA, 12 bp, Homo sapiens
aactctgagccc

SEQ ID NO: 5344602 - DNA, 14 bp, Homo sapiens
aactctgagcccat

SEQ ID NO: 5344603 - DNA, 18 bp, Homo sapiens
aactctgagcccatactt

SEQ ID NO: 5344604 - DNA, 19 bp, Homo sapiens
aactctgatccctgggcct

SEQ ID NO: 5344605 - DNA, 20 bp, Homo sapiens
aactctgatgtaaatgaagt

SEQ ID NO: 5344606 - DNA, 11 bp, Homo sapiens
aactctgcaaa

SEQ ID NO: 5344607 - DNA, 12 bp, Homo sapiens
aactctgcagga

SEQ ID NO: 5344608 - DNA, 16 bp, Homo sapiens
aactctgcaggaaatc

SEQ ID NO: 5344609 - DNA, 18 bp, Homo sapiens
aactctgcatagacaaag

SEQ ID NO: 5344610 - DNA, 16 bp, Homo sapiens
aactctgcattctagt

SEQ ID NO: 5344611 - DNA, 12 bp, Homo sapiens
aactctgcctgc

SEQ ID NO: 5344612 - DNA, 21 bp, Homo sapiens
aactctggacactctatatgt

SEQ ID NO: 5344613 - DNA, 12 bp, Homo sapiens
aactctggagag

SEQ ID NO: 5344614 - DNA, 13 bp, Homo sapiens
aactctggagagc

SEQ ID NO: 5344615 - DNA, 17 bp, Homo sapiens
aactctggattttgaat

SEQ ID NO: 5344616 - DNA, 17 bp, Homo sapiens
aactctggctcagcctg

SEQ ID NO: 5344617 - DNA, 22 bp, Homo sapiens
aactctggctcagcctgtctcg

SEQ ID NO: 5344618 - DNA, 12 bp, Homo sapiens
aactctgggctc

SEQ ID NO: 5344619 - DNA, 16 bp, Homo sapiens
aactctggggcttgtc

SEQ ID NO: 5344620 - DNA, 12 bp, Homo sapiens
aactctgggtct

SEQ ID NO: 5344621 - DNA, 19 bp, Homo sapiens
aactctggtgataaaaata

SEQ ID NO: 5344622 - DNA, 11 bp, Homo sapiens
aactctggtgc

SEQ ID NO: 5344623 - DNA, 21 bp, Homo sapiens
aactctggttcttttaaaatt

SEQ ID NO: 5344624 - DNA, 16 bp, Homo sapiens
aactctgtagcttaaa

SEQ ID NO: 5344625 - DNA, 13 bp, Homo sapiens
aactctgtataag

SEQ ID NO: 5344626 - DNA, 18 bp, Homo sapiens
aactctgtattacagctt

SEQ ID NO: 5344627 - DNA, 17 bp, Homo sapiens
aactctgtcttcacctg

SEQ ID NO: 5344628 - DNA, 23 bp, Homo sapiens
aactctgtcttcacctgattcaa

SEQ ID NO: 5344629 - DNA, 12 bp, Homo sapiens
aactctgtgagg

SEQ ID NO: 5344630 - DNA, 22 bp, Homo sapiens
aactctgtgcaggtgctgcctt

SEQ ID NO: 5344631 - DNA, 19 bp, Homo sapiens
aactctgtgtcccagcacc

SEQ ID NO: 5344632 - DNA, 16 bp, Homo sapiens
aactctgtgtgagaga

SEQ ID NO: 5344633 - DNA, 18 bp, Homo sapiens
aactctgttcccccaccc

SEQ ID NO: 5344634 - DNA, 19 bp, Homo sapiens
aactctgttgcaagtgcaa

SEQ ID NO: 5344635 - DNA, 15 bp, Homo sapiens
aactctgttgtaagt

SEQ ID NO: 5344636 - DNA, 15 bp, Homo sapiens
aactcttataaattt

SEQ ID NO: 5344637 - DNA, 13 bp, Homo sapiens
aactcttatctca

SEQ ID NO: 5344638 - DNA, 14 bp, Homo sapiens
aactcttcaaggcc

SEQ ID NO: 5344639 - DNA, 19 bp, Homo sapiens
aactcttcaaggtctgctt

SEQ ID NO: 5344640 - DNA, 21 bp, Homo sapiens
aactcttcaatctcttgcact

SEQ ID NO: 5344641 - DNA, 14 bp, Homo sapiens
aactcttcattttg

SEQ ID NO: 5344642 - DNA, 22 bp, Homo sapiens
aactcttcattttgagtctcag

SEQ ID NO: 5344643 - DNA, 18 bp, Homo sapiens
aactcttccacctctggg

SEQ ID NO: 5344644 - DNA, 13 bp, Homo sapiens
aactcttcctccc

SEQ ID NO: 5344645 - DNA, 15 bp, Homo sapiens
aactcttcctcccct

SEQ ID NO: 5344646 - DNA, 22 bp, Homo sapiens
aactcttcctggaatgcattca

SEQ ID NO: 5344647 - DNA, 13 bp, Homo sapiens
aactcttctcatt

SEQ ID NO: 5344648 - DNA, 15 bp, Homo sapiens
aactcttctccaagt

SEQ ID NO: 5344649 - DNA, 16 bp, Homo sapiens
aactcttctgaggatc

SEQ ID NO: 5344650 - DNA, 15 bp, Homo sapiens
aactcttctggaaac

SEQ ID NO: 5344651 - DNA, 16 bp, Homo sapiens
aactcttgaatatgtg

SEQ ID NO: 5344652 - DNA, 11 bp, Homo sapiens
aactcttgatt

SEQ ID NO: 5344653 - DNA, 20 bp, Homo sapiens
aactcttggccagagctgag

SEQ ID NO: 5344654 - DNA, 16 bp, Homo sapiens
aactcttggcctctgc

SEQ ID NO: 5344655 - DNA, 20 bp, Homo sapiens
aactcttggcctctgctttc

SEQ ID NO: 5344656 - DNA, 22 bp, Homo sapiens
aactcttggttcgatacctgga

SEQ ID NO: 5344657 - DNA, 17 bp, Homo sapiens
aactcttggtttcttca

SEQ ID NO: 5344658 - DNA, 18 bp, Homo sapiens
aactctttcattcttctc

SEQ ID NO: 5344659 - DNA, 11 bp, Homo sapiens
aactctttgcc

SEQ ID NO: 5344660 - DNA, 13 bp, Homo sapiens
aactcttttaaca

SEQ ID NO: 5344661 - DNA, 13 bp, Homo sapiens
aactcttttggac

SEQ ID NO: 5344662 - DNA, 23 bp, Homo sapiens
aactctttttgggctcctttttc

SEQ ID NO: 5344663 - DNA, 19 bp, Homo sapiens
aactgaaaacaagccatga

SEQ ID NO: 5344664 - DNA, 15 bp, Homo sapiens
aactgaaaacataaa

SEQ ID NO: 5344665 - DNA, 19 bp, Homo sapiens
aactgaaaacataaaaagt

SEQ ID NO: 5344666 - DNA, 16 bp, Homo sapiens
aactgaaaactgtaaa

SEQ ID NO: 5344667 - DNA, 18 bp, Homo sapiens
aactgaaaactgtaaata

SEQ ID NO: 5344668 - DNA, 12 bp, Homo sapiens
aactgaaaatga

SEQ ID NO: 5344669 - DNA, 14 bp, Homo sapiens
aactgaaaatgtaa

SEQ ID NO: 5344670 - DNA, 20 bp, Homo sapiens
aactgaaacatgcacatttt

SEQ ID NO: 5344671 - DNA, 22 bp, Homo sapiens
aactgaaacatgcacattttgt

SEQ ID NO: 5344672 - DNA, 19 bp, Homo sapiens
aactgaaacctaggaagcc

SEQ ID NO: 5344673 - DNA, 16 bp, Homo sapiens
aactgaaacttttcta

SEQ ID NO: 5344674 - DNA, 20 bp, Homo sapiens
aactgaaagctgaatccttc

SEQ ID NO: 5344675 - DNA, 19 bp, Homo sapiens
aactgaaagctttaatgtt

SEQ ID NO: 5344676 - DNA, 13 bp, Homo sapiens
aactgaaagtgaa

SEQ ID NO: 5344677 - DNA, 13 bp, Homo sapiens
aactgaaatcata

SEQ ID NO: 5344678 - DNA, 16 bp, Homo sapiens
aactgaacaaaaaaat

SEQ ID NO: 5344679 - DNA, 22 bp, Homo sapiens
aactgaacaccattgaaggctt

SEQ ID NO: 5344680 - DNA, 23 bp, Homo sapiens
aactgaacaccattgaaggctta

SEQ ID NO: 5344681 - DNA, 14 bp, Homo sapiens
aactgaaccaaatt

SEQ ID NO: 5344682 - DNA, 14 bp, Homo sapiens
aactgaactctgac

SEQ ID NO: 5344683 - DNA, 20 bp, Homo sapiens
aactgaactctgacaacaga

SEQ ID NO: 5344684 - DNA, 16 bp, Homo sapiens
aactgaagaaaaggtt

SEQ ID NO: 5344685 - DNA, 13 bp, Homo sapiens
aactgaagaagga

SEQ ID NO: 5344686 - DNA, 13 bp, Homo sapiens
aactgaagacaat

SEQ ID NO: 5344687 - DNA, 15 bp, Homo sapiens
aactgaagagacagt

SEQ ID NO: 5344688 - DNA, 15 bp, Homo sapiens
aactgaagatgttga

SEQ ID NO: 5344689 - DNA, 11 bp, Homo sapiens
aactgaagcaa

SEQ ID NO: 5344690 - DNA, 12 bp, Homo sapiens
aactgaagcaaa

SEQ ID NO: 5344691 - DNA, 13 bp, Homo sapiens
aactgaagcagag

SEQ ID NO: 5344692 - DNA, 15 bp, Homo sapiens
aactgaagcagagtc

SEQ ID NO: 5344693 - DNA, 13 bp, Homo sapiens
aactgaagcataa

SEQ ID NO: 5344694 - DNA, 19 bp, Homo sapiens
aactgaagcataaagaatt

SEQ ID NO: 5344695 - DNA, 13 bp, Homo sapiens
aactgaagccaga

SEQ ID NO: 5344696 - DNA, 12 bp, Homo sapiens
aactgaaggaag

SEQ ID NO: 5344697 - DNA, 19 bp, Homo sapiens
aactgaaggcaacctggaa

SEQ ID NO: 5344698 - DNA, 23 bp, Homo sapiens
aactgaaggttttttttttaagt

SEQ ID NO: 5344699 - DNA, 16 bp, Homo sapiens
aactgaagtctgaaat

SEQ ID NO: 5344700 - DNA, 18 bp, Homo sapiens
aactgaagttctatttat

SEQ ID NO: 5344701 - DNA, 13 bp, Homo sapiens
aactgaagttctg

SEQ ID NO: 5344702 - DNA, 23 bp, Homo sapiens
aactgccaccttgggtctgtgtc

SEQ ID NO: 5344703 - DNA, 16 bp, Homo sapiens
aactgccaggctgcct

SEQ ID NO: 5344704 - DNA, 14 bp, Homo sapiens
aactgccagttttg

SEQ ID NO: 5344705 - DNA, 19 bp, Homo sapiens
aactgccagttttgtttcc

SEQ ID NO: 5344706 - DNA, 18 bp, Homo sapiens
aactgccattttttgtct

SEQ ID NO: 5344707 - DNA, 14 bp, Homo sapiens
aactgcccagcccc

SEQ ID NO: 5344708 - DNA, 15 bp, Homo sapiens
aactgcccagcccct

SEQ ID NO: 5344709 - DNA, 21 bp, Homo sapiens
aactgcccccctcctttccaa

SEQ ID NO: 5344710 - DNA, 17 bp, Homo sapiens
aactgccccctctgccc

SEQ ID NO: 5344711 - DNA, 21 bp, Homo sapiens
aactgccccctctgccctgcg

SEQ ID NO: 5344712 - DNA, 16 bp, Homo sapiens
aactgccctactggga

SEQ ID NO: 5344713 - DNA, 14 bp, Homo sapiens
aactgcccttccag

SEQ ID NO: 5344714 - DNA, 21 bp, Homo sapiens
aactgcccttttaaatggcat

SEQ ID NO: 5344715 - DNA, 23 bp, Homo sapiens
aactgcccttttaaatggcatga

SEQ ID NO: 5344716 - DNA, 13 bp, Homo sapiens
aactgcctagaaa

SEQ ID NO: 5344717 - DNA, 14 bp, Homo sapiens
aactgcctagaaac

SEQ ID NO: 5344718 - DNA, 22 bp, Homo sapiens
aactgcctagaaacaacactgt

SEQ ID NO: 5344719 - DNA, 20 bp, Homo sapiens
aactgcctcgaaacacagaa

SEQ ID NO: 5344720 - DNA, 20 bp, Homo sapiens
aactgcctgacaattatgaa

SEQ ID NO: 5344721 - DNA, 13 bp, Homo sapiens
aactgcctgggcc

SEQ ID NO: 5344722 - DNA, 22 bp, Homo sapiens
aactgcctgggccatgcgaggg

SEQ ID NO: 5344723 - DNA, 18 bp, Homo sapiens
aactgcctggggggcagg

SEQ ID NO: 5344724 - DNA, 14 bp, Homo sapiens
aactgcgacaaaac

SEQ ID NO: 5344725 - DNA, 19 bp, Homo sapiens
aactgctaaatactgtaca

SEQ ID NO: 5344726 - DNA, 20 bp, Homo sapiens
aactgctaaatactgtacat

SEQ ID NO: 5344727 - DNA, 21 bp, Homo sapiens
aactgctaaattctatgttaa

SEQ ID NO: 5344728 - DNA, 17 bp, Homo sapiens
aactgctaacttctatt

SEQ ID NO: 5344729 - DNA, 19 bp, Homo sapiens
aactgctaatctactttct

SEQ ID NO: 5344730 - DNA, 16 bp, Homo sapiens
aactgctaatgcaaat

SEQ ID NO: 5344731 - DNA, 18 bp, Homo sapiens
aactgctaatgcaaatta

SEQ ID NO: 5344732 - DNA, 19 bp, Homo sapiens
aactgctaatgcaaattaa

SEQ ID NO: 5344733 - DNA, 19 bp, Homo sapiens
aactgctcagagctttaaa

SEQ ID NO: 5344734 - DNA, 15 bp, Homo sapiens
aactgctccaaattt

SEQ ID NO: 5344735 - DNA, 13 bp, Homo sapiens
aactgctccaagt

SEQ ID NO: 5344736 - DNA, 16 bp, Homo sapiens
aactgctccagcctct

SEQ ID NO: 5344737 - DNA, 18 bp, Homo sapiens
aactgctccagcctctgc

SEQ ID NO: 5344738 - DNA, 17 bp, Homo sapiens
aactgctcccacctcct

SEQ ID NO: 5344739 - DNA, 15 bp, Homo sapiens
aactgctcttacttt

SEQ ID NO: 5344740 - DNA, 15 bp, Homo sapiens
aactgctgactgttt

SEQ ID NO: 5344741 - DNA, 10 bp, Homo sapiens
aactgctgag

SEQ ID NO: 5344742 - DNA, 12 bp, Homo sapiens
aactgctgagcc

SEQ ID NO: 5344743 - DNA, 13 bp, Homo sapiens
aactgctgcagat

SEQ ID NO: 5344744 - DNA, 13 bp, Homo sapiens
aactgctgcaggg

SEQ ID NO: 5344745 - DNA, 11 bp, Homo sapiens
aactgctgcca

SEQ ID NO: 5344746 - DNA, 13 bp, Homo sapiens
aactgctgcccca

SEQ ID NO: 5344747 - DNA, 22 bp, Homo sapiens
aactgctgccccaaaggaagct

SEQ ID NO: 5344748 - DNA, 13 bp, Homo sapiens
aactgctgctgac

SEQ ID NO: 5344749 - DNA, 17 bp, Homo sapiens
aactgctgctgacccct

SEQ ID NO: 5344750 - DNA, 12 bp, Homo sapiens
aactgctgctgg

SEQ ID NO: 5344751 - DNA, 20 bp, Homo sapiens
aactgctggacgtctttctt

SEQ ID NO: 5344752 - DNA, 21 bp, Homo sapiens
aactgctggagtctggcttta

SEQ ID NO: 5344753 - DNA, 12 bp, Homo sapiens
aactgctggggc

SEQ ID NO: 5344754 - DNA, 14 bp, Homo sapiens
aactgctgtaaaca

SEQ ID NO: 5344755 - DNA, 12 bp, Homo sapiens
aactgctgtctc

SEQ ID NO: 5344756 - DNA, 23 bp, Homo sapiens
aactgctgtctcttaaatctctt

SEQ ID NO: 5344757 - DNA, 21 bp, Homo sapiens
aactgctgtggccccctgtcc

SEQ ID NO: 5344758 - DNA, 13 bp, Homo sapiens
aactgctgtttca

SEQ ID NO: 5344759 - DNA, 19 bp, Homo sapiens
aactgctgttttatgtcat

SEQ ID NO: 5344760 - DNA, 22 bp, Homo sapiens
aactgcttacagtttattttct

SEQ ID NO: 5344761 - DNA, 11 bp, Homo sapiens
aactgcttcaa

SEQ ID NO: 5344762 - DNA, 17 bp, Homo sapiens
aactgcttcatctcctt

SEQ ID NO: 5344763 - DNA, 18 bp, Homo sapiens
aactgcttcctataattt

SEQ ID NO: 5344764 - DNA, 20 bp, Homo sapiens
aactgctttatcccacggaa

SEQ ID NO: 5344765 - DNA, 18 bp, Homo sapiens
aactgctttattttccct

SEQ ID NO: 5344766 - DNA, 21 bp, Homo sapiens
aactgctttatttttataaaa

SEQ ID NO: 5344767 - DNA, 13 bp, Homo sapiens
aactgctttcaag

SEQ ID NO: 5344768 - DNA, 15 bp, Homo sapiens
aactgctttcaagtc

SEQ ID NO: 5344769 - DNA, 14 bp, Homo sapiens
aactgctttctgtt

SEQ ID NO: 5344770 - DNA, 15 bp, Homo sapiens
aactgctttctgttc

SEQ ID NO: 5344771 - DNA, 20 bp, Homo sapiens
aactgctttctgttccaaat

SEQ ID NO: 5344772 - DNA, 15 bp, Homo sapiens
aactgctttgtgcat

SEQ ID NO: 5344773 - DNA, 18 bp, Homo sapiens
aactgctttgtgcatatg

SEQ ID NO: 5344774 - DNA, 20 bp, Homo sapiens
aactgcttttcctcaagcaa

SEQ ID NO: 5344775 - DNA, 20 bp, Homo sapiens
aactgcttttttttttccag

SEQ ID NO: 5344776 - DNA, 15 bp, Homo sapiens
aactggaaaacagaa

SEQ ID NO: 5344777 - DNA, 21 bp, Homo sapiens
aactggaaaacagaacactta

SEQ ID NO: 5344778 - DNA, 17 bp, Homo sapiens
aactggaaacaaaacag

SEQ ID NO: 5344779 - DNA, 18 bp, Homo sapiens
aactggaaacaaaacaga

SEQ ID NO: 5344780 - DNA, 12 bp, Homo sapiens
aactggaaagaa

SEQ ID NO: 5344781 - DNA, 21 bp, Homo sapiens
aactggaaaggatctgtgatt

SEQ ID NO: 5344782 - DNA, 14 bp, Homo sapiens
aactggaaatctgg

SEQ ID NO: 5344783 - DNA, 19 bp, Homo sapiens
aactggaacggtgaaggtg

SEQ ID NO: 5344784 - DNA, 20 bp, Homo sapiens
aactggaagcatgtaggaga

SEQ ID NO: 5344785 - DNA, 17 bp, Homo sapiens
aactggaagccttcccc

SEQ ID NO: 5344786 - DNA, 11 bp, Homo sapiens
aactggaagct

SEQ ID NO: 5344787 - DNA, 12 bp, Homo sapiens
aactggaagctt

SEQ ID NO: 5344788 - DNA, 14 bp, Homo sapiens
aactggaaggcctt

SEQ ID NO: 5344789 - DNA, 18 bp, Homo sapiens
aactggaaggctttattc

SEQ ID NO: 5344790 - DNA, 16 bp, Homo sapiens
aactggaagttattta

SEQ ID NO: 5344791 - DNA, 15 bp, Homo sapiens
aactggaataagaag

SEQ ID NO: 5344792 - DNA, 15 bp, Homo sapiens
aactggaataagcct

SEQ ID NO: 5344793 - DNA, 20 bp, Homo sapiens
aactggacatcacagcagaa

SEQ ID NO: 5344794 - DNA, 17 bp, Homo sapiens
aactggacatgaaggaa

SEQ ID NO: 5344795 - DNA, 18 bp, Homo sapiens
aactggaccctgttgcta

SEQ ID NO: 5344796 - DNA, 20 bp, Homo sapiens
aactggaccctgttgctaag

SEQ ID NO: 5344797 - DNA, 21 bp, Homo sapiens
aactggaccctgttgctaagc

SEQ ID NO: 5344798 - DNA, 22 bp, Homo sapiens
aactggactatagcagggctgg

SEQ ID NO: 5344799 - DNA, 13 bp, Homo sapiens
aactggactcagg

SEQ ID NO: 5344800 - DNA, 15 bp, Homo sapiens
aactggactcaggat

SEQ ID NO: 5344801 - DNA, 21 bp, Homo sapiens
aactggactcaggatgcccag

SEQ ID NO: 5344802 - DNA, 18 bp, Homo sapiens
aactggactgaattcaaa

SEQ ID NO: 5344803 - DNA, 22 bp, Homo sapiens
aactggagaccagaaaccttcc

SEQ ID NO: 5344804 - DNA, 19 bp, Homo sapiens
aactggagaggctaacctc

SEQ ID NO: 5344805 - DNA, 14 bp, Homo sapiens
aactggatactgta

SEQ ID NO: 5344806 - DNA, 19 bp, Homo sapiens
aactggatagaaaaatgct

SEQ ID NO: 5344807 - DNA, 22 bp, Homo sapiens
aactggatatttcaatctttta

SEQ ID NO: 5344808 - DNA, 16 bp, Homo sapiens
aactggatggaaatag

SEQ ID NO: 5344809 - DNA, 16 bp, Homo sapiens
aactggattaaaacaa

SEQ ID NO: 5344810 - DNA, 15 bp, Homo sapiens
aactggattaaactt

SEQ ID NO: 5344811 - DNA, 18 bp, Homo sapiens
aactggattatcacctta

SEQ ID NO: 5344812 - DNA, 14 bp, Homo sapiens
aactggattttgaa

SEQ ID NO: 5344813 - DNA, 16 bp, Homo sapiens
aactggattttgaacg

SEQ ID NO: 5344814 - DNA, 13 bp, Homo sapiens
aactggcaaagca

SEQ ID NO: 5344815 - DNA, 22 bp, Homo sapiens
aactggcaggggagacaggagc

SEQ ID NO: 5344816 - DNA, 16 bp, Homo sapiens
aactggcatctgctct

SEQ ID NO: 5344817 - DNA, 21 bp, Homo sapiens
aactggcatgtcatttgcaca

SEQ ID NO: 5344818 - DNA, 17 bp, Homo sapiens
aactggccaagctgagg

SEQ ID NO: 5344819 - DNA, 19 bp, Homo sapiens
aactggccaagctgaggtg

SEQ ID NO: 5344820 - DNA, 11 bp, Homo sapiens
aactggccact

SEQ ID NO: 5344821 - DNA, 18 bp, Homo sapiens
aactggccatggcctgca

SEQ ID NO: 5344822 - DNA, 14 bp, Homo sapiens
aactggccccagct

SEQ ID NO: 5344823 - DNA, 21 bp, Homo sapiens
aactggccccggatcagagca

SEQ ID NO: 5344824 - DNA, 18 bp, Homo sapiens
aactggcccgtggagact

SEQ ID NO: 5344825 - DNA, 15 bp, Homo sapiens
aactggccctcttct

SEQ ID NO: 5344826 - DNA, 21 bp, Homo sapiens
aactggccctcttcttacttg

SEQ ID NO: 5344827 - DNA, 18 bp, Homo sapiens
aactggcgaagcctgagc

SEQ ID NO: 5344828 - DNA, 19 bp, Homo sapiens
aactggcgaagcctgagca

SEQ ID NO: 5344829 - DNA, 14 bp, Homo sapiens
aactggctacagta

SEQ ID NO: 5344830 - DNA, 20 bp, Homo sapiens
aactggctcctttgcctctg

SEQ ID NO: 5344831 - DNA, 22 bp, Homo sapiens
aactggctgctccctgctccca

SEQ ID NO: 5344832 - DNA, 11 bp, Homo sapiens
aactggctggc

SEQ ID NO: 5344833 - DNA, 19 bp, Homo sapiens
aactggctgggcccctggg

SEQ ID NO: 5344834 - DNA, 20 bp, Homo sapiens
aactggctgggcccctgggg

SEQ ID NO: 5344835 - DNA, 22 bp, Homo sapiens
aactggctgtttgatagcagaa

SEQ ID NO: 5344836 - DNA, 13 bp, Homo sapiens
aactggcttcccc

SEQ ID NO: 5344837 - DNA, 18 bp, Homo sapiens
aactggcttctgcttgtc

SEQ ID NO: 5344838 - DNA, 22 bp, Homo sapiens
aactggcttctgcttgtcatcc

SEQ ID NO: 5344839 - DNA, 15 bp, Homo sapiens
aactggcttgtacat

SEQ ID NO: 5344840 - DNA, 21 bp, Homo sapiens
aactggcttgtacatttttaa

SEQ ID NO: 5344841 - DNA, 15 bp, Homo sapiens
aactgggaaaacagt

SEQ ID NO: 5344842 - DNA, 15 bp, Homo sapiens
aactgggaaactggg

SEQ ID NO: 5344843 - DNA, 20 bp, Homo sapiens
aactgggaacccctttccca

SEQ ID NO: 5344844 - DNA, 21 bp, Homo sapiens
aactgggaacccctttcccac

SEQ ID NO: 5344845 - DNA, 17 bp, Homo sapiens
aactgggaagatgctgg

SEQ ID NO: 5344846 - DNA, 16 bp, Homo sapiens
aactgggataactgat

SEQ ID NO: 5344847 - DNA, 20 bp, Homo sapiens
aactgggataactgatttct

SEQ ID NO: 5344848 - DNA, 18 bp, Homo sapiens
aactgggcacagattgaa

SEQ ID NO: 5344849 - DNA, 21 bp, Homo sapiens
aactgggcacagattgaagaa

SEQ ID NO: 5344850 - DNA, 22 bp, Homo sapiens
aactgggcacagattgaagaat

SEQ ID NO: 5344851 - DNA, 19 bp, Homo sapiens
aactgggcatatttctaat

SEQ ID NO: 5344852 - DNA, 13 bp, Homo sapiens
aactgggccagca

SEQ ID NO: 5344853 - DNA, 18 bp, Homo sapiens
aactgggccagcagagca

SEQ ID NO: 5344854 - DNA, 22 bp, Homo sapiens
aactgggctggcgcttggatct

SEQ ID NO: 5344855 - DNA, 22 bp, Homo sapiens
aactggggcttgcaagaggagg

SEQ ID NO: 5344856 - DNA, 16 bp, Homo sapiens
aactggggctttgcct

SEQ ID NO: 5344857 - DNA, 18 bp, Homo sapiens
aactggggctttgccttg

SEQ ID NO: 5344858 - DNA, 20 bp, Homo sapiens
aactggggctttgccttgca

SEQ ID NO: 5344859 - DNA, 21 bp, Homo sapiens
aactgggggagggtgaagtga

SEQ ID NO: 5344860 - DNA, 15 bp, Homo sapiens
aactggggggaccaa

SEQ ID NO: 5344861 - DNA, 18 bp, Homo sapiens
aactggggggaccaaata

SEQ ID NO: 5344862 - DNA, 22 bp, Homo sapiens
aactggggggaccaaatagcca

SEQ ID NO: 5344863 - DNA, 23 bp, Homo sapiens
aactggggtgatgttttactttt

SEQ ID NO: 5344864 - DNA, 22 bp, Homo sapiens
aactgggtacccaaaacacatt

SEQ ID NO: 5344865 - DNA, 16 bp, Homo sapiens
aactgggtcttcagct

SEQ ID NO: 5344866 - DNA, 20 bp, Homo sapiens
aactgggtggtttggttttt

SEQ ID NO: 5344867 - DNA, 17 bp, Homo sapiens
aactgggttaaatattt

SEQ ID NO: 5344868 - DNA, 14 bp, Homo sapiens
aactgggttcctgc

SEQ ID NO: 5344869 - DNA, 20 bp, Homo sapiens
aactggtaagcgatttgaaa

SEQ ID NO: 5344870 - DNA, 14 bp, Homo sapiens
aactggtagaaaaa

SEQ ID NO: 5344871 - DNA, 14 bp, Homo sapiens
aactggtagttcat

SEQ ID NO: 5344872 - DNA, 21 bp, Homo sapiens
aactggtattctgttctggag

SEQ ID NO: 5344873 - DNA, 13 bp, Homo sapiens
aactggtatttta

SEQ ID NO: 5344874 - DNA, 19 bp, Homo sapiens
aactggtcaccatgaaact

SEQ ID NO: 5344875 - DNA, 11 bp, Homo sapiens
aactggtccag

SEQ ID NO: 5344876 - DNA, 17 bp, Homo sapiens
aactggtccaggccagg

SEQ ID NO: 5344877 - DNA, 22 bp, Homo sapiens
aactggtccaggccaggcctca

SEQ ID NO: 5344878 - DNA, 21 bp, Homo sapiens
aactggtctgttaatcttttt

SEQ ID NO: 5344879 - DNA, 14 bp, Homo sapiens
aactggtcttcctt

SEQ ID NO: 5344880 - DNA, 17 bp, Homo sapiens
aactttattaaatacaa

SEQ ID NO: 5344881 - DNA, 23 bp, Homo sapiens
aactttattaaatacaaaacttc

SEQ ID NO: 5344882 - DNA, 13 bp, Homo sapiens
aactttattgcat

SEQ ID NO: 5344883 - DNA, 21 bp, Homo sapiens
aactttattgggtttttattg

SEQ ID NO: 5344884 - DNA, 22 bp, Homo sapiens
aactttatttaaatgcatgtct

SEQ ID NO: 5344885 - DNA, 24 bp, Homo sapiens
aactttatttaaatgcatgtctta

SEQ ID NO: 5344886 - DNA, 13 bp, Homo sapiens
aactttatttcca

SEQ ID NO: 5344887 - DNA, 16 bp, Homo sapiens
aactttatttgtaaac

SEQ ID NO: 5344888 - DNA, 16 bp, Homo sapiens
aactttattttgaatg

SEQ ID NO: 5344889 - DNA, 18 bp, Homo sapiens
aactttattttgaatgta

SEQ ID NO: 5344890 - DNA, 12 bp, Homo sapiens
aactttcaaatc

SEQ ID NO: 5344891 - DNA, 22 bp, Homo sapiens
aactttcactataatgtgaaat

SEQ ID NO: 5344892 - DNA, 17 bp, Homo sapiens
aactttcacttcttcct

SEQ ID NO: 5344893 - DNA, 14 bp, Homo sapiens
aactttcagaactg

SEQ ID NO: 5344894 - DNA, 12 bp, Homo sapiens
aactttcagtgg

SEQ ID NO: 5344895 - DNA, 19 bp, Homo sapiens
aactttcattccttcagat

SEQ ID NO: 5344896 - DNA, 13 bp, Homo sapiens
aactttcatttaa

SEQ ID NO: 5344897 - DNA, 14 bp, Homo sapiens
aactttcatttttt

SEQ ID NO: 5344898 - DNA, 14 bp, Homo sapiens
aactttccactgac

SEQ ID NO: 5344899 - DNA, 18 bp, Homo sapiens
aactttccagtcttagct

SEQ ID NO: 5344900 - DNA, 17 bp, Homo sapiens
aactttccatctgcttg

SEQ ID NO: 5344901 - DNA, 13 bp, Homo sapiens
aactttccatgac

SEQ ID NO: 5344902 - DNA, 15 bp, Homo sapiens
aactttccatgacag

SEQ ID NO: 5344903 - DNA, 21 bp, Homo sapiens
aactttccatgacagtagcat

SEQ ID NO: 5344904 - DNA, 11 bp, Homo sapiens
aactttccccc

SEQ ID NO: 5344905 - DNA, 12 bp, Homo sapiens
aactttcccccc

SEQ ID NO: 5344906 - DNA, 16 bp, Homo sapiens
aactttcctgtactca

SEQ ID NO: 5344907 - DNA, 16 bp, Homo sapiens
aactttcgaccgactt

SEQ ID NO: 5344908 - DNA, 21 bp, Homo sapiens
aactttcgaccgactttcccc

SEQ ID NO: 5344909 - DNA, 17 bp, Homo sapiens
aactttcgttgttatta

SEQ ID NO: 5344910 - DNA, 14 bp, Homo sapiens
aactttctccctca

SEQ ID NO: 5344911 - DNA, 13 bp, Homo sapiens
aactttctctttg

SEQ ID NO: 5344912 - DNA, 21 bp, Homo sapiens
aactttctctttgccatttct

SEQ ID NO: 5344913 - DNA, 22 bp, Homo sapiens
aactttctctttgccatttctt

SEQ ID NO: 5344914 - DNA, 23 bp, Homo sapiens
aactttctgttggattccatgct

SEQ ID NO: 5344915 - DNA, 12 bp, Homo sapiens
aactttcttgct

SEQ ID NO: 5344916 - DNA, 16 bp, Homo sapiens
aactttctttctaaag

SEQ ID NO: 5344917 - DNA, 12 bp, Homo sapiens
aactttgaaagt

SEQ ID NO: 5344918 - DNA, 16 bp, Homo sapiens
aactttgaaatatatg

SEQ ID NO: 5344919 - DNA, 15 bp, Homo sapiens
aactttgaagttagc

SEQ ID NO: 5344920 - DNA, 23 bp, Homo sapiens
aactttgaataaagaatacttga

SEQ ID NO: 5344921 - DNA, 20 bp, Homo sapiens
aactttgacctctgcagcaa

SEQ ID NO: 5344922 - DNA, 20 bp, Homo sapiens
aactttgaggaggaagcaga

SEQ ID NO: 5344923 - DNA, 20 bp, Homo sapiens
aactttgaggataacttttt

SEQ ID NO: 5344924 - DNA, 17 bp, Homo sapiens
aactttgatctctgctt

SEQ ID NO: 5344925 - DNA, 16 bp, Homo sapiens
aactttgcaaattatt

SEQ ID NO: 5344926 - DNA, 21 bp, Homo sapiens
aactttgcagcataccaatta

SEQ ID NO: 5344927 - DNA, 16 bp, Homo sapiens
aactttgccaaaaaaa

SEQ ID NO: 5344928 - DNA, 15 bp, Homo sapiens
aactttgccttaagt

SEQ ID NO: 5344929 - DNA, 15 bp, Homo sapiens
aactttgctccaggc

SEQ ID NO: 5344930 - DNA, 12 bp, Homo sapiens
aactttgcttgc

SEQ ID NO: 5344931 - DNA, 16 bp, Homo sapiens
aactttggaacagggt

SEQ ID NO: 5344932 - DNA, 13 bp, Homo sapiens
aactttggaagtt

SEQ ID NO: 5344933 - DNA, 22 bp, Homo sapiens
aactttgggaaaacatgttaat

SEQ ID NO: 5344934 - DNA, 17 bp, Homo sapiens
aactttggttcctgtga

SEQ ID NO: 5344935 - DNA, 18 bp, Homo sapiens
aactttgtaaaaatcttt

SEQ ID NO: 5344936 - DNA, 21 bp, Homo sapiens
aactttgtaaaaatcttttga

SEQ ID NO: 5344937 - DNA, 15 bp, Homo sapiens
aactttgtaaatatt

SEQ ID NO: 5344938 - DNA, 22 bp, Homo sapiens
aactttgtacagtggagaaata

SEQ ID NO: 5344939 - DNA, 21 bp, Homo sapiens
aactttgtatagttatgtaaa

SEQ ID NO: 5344940 - DNA, 10 bp, Homo sapiens
aactttgtca

SEQ ID NO: 5344941 - DNA, 11 bp, Homo sapiens
aactttgtcac

SEQ ID NO: 5344942 - DNA, 20 bp, Homo sapiens
aactttgtcacttctgctgt

SEQ ID NO: 5344943 - DNA, 16 bp, Homo sapiens
aactttgtgcctttga

SEQ ID NO: 5344944 - DNA, 20 bp, Homo sapiens
aactttgtggatgtcttcct

SEQ ID NO: 5344945 - DNA, 20 bp, Homo sapiens
aactttgttaggccaaagac

SEQ ID NO: 5344946 - DNA, 15 bp, Homo sapiens
aactttgtttctcat

SEQ ID NO: 5344947 - DNA, 19 bp, Homo sapiens
aacttttaaaactttgcca

SEQ ID NO: 5344948 - DNA, 18 bp, Homo sapiens
aacttttaaacatgagaa

SEQ ID NO: 5344949 - DNA, 15 bp, Homo sapiens
aacttttaaagctca

SEQ ID NO: 5344950 - DNA, 11 bp, Homo sapiens
aacttttaatt

SEQ ID NO: 5344951 - DNA, 17 bp, Homo sapiens
aacttttacagaatgca

SEQ ID NO: 5344952 - DNA, 20 bp, Homo sapiens
aacttttacagaatgcatta

SEQ ID NO: 5344953 - DNA, 22 bp, Homo sapiens
aacttttacatttttctgatgg

SEQ ID NO: 5344954 - DNA, 22 bp, Homo sapiens
aacttttagtgggtgagaaatt

SEQ ID NO: 5344955 - DNA, 15 bp, Homo sapiens
aacttttagtggttc

SEQ ID NO: 5344956 - DNA, 23 bp, Homo sapiens
aacttttagtggttctgtgcctc

SEQ ID NO: 5344957 - DNA, 15 bp, Homo sapiens
aacttttataaactt

SEQ ID NO: 5344958 - DNA, 18 bp, Homo sapiens
aacttttataaatgtttt

SEQ ID NO: 5344959 - DNA, 17 bp, Homo sapiens
aacttttataaattaaa

SEQ ID NO: 5344960 - DNA, 20 bp, Homo sapiens
aacttttataaattaaatat

SEQ ID NO: 5344961 - DNA, 22 bp, Homo sapiens
aacttttataaattaaatatat

SEQ ID NO: 5344962 - DNA, 17 bp, Homo sapiens
aacttttatacttgggt

SEQ ID NO: 5344963 - DNA, 22 bp, Homo sapiens
aacttttatgcagcaaatatat

SEQ ID NO: 5344964 - DNA, 15 bp, Homo sapiens
aacttttcaatgtga

SEQ ID NO: 5344965 - DNA, 15 bp, Homo sapiens
aacttttcccctgtc

SEQ ID NO: 5344966 - DNA, 18 bp, Homo sapiens
aacttttcccctgtcctg

SEQ ID NO: 5344967 - DNA, 16 bp, Homo sapiens
aacttttctaacagaa

SEQ ID NO: 5344968 - DNA, 20 bp, Homo sapiens
aacttttctcctgcatgtgt

SEQ ID NO: 5344969 - DNA, 14 bp, Homo sapiens
aacttttctcttat

SEQ ID NO: 5344970 - DNA, 12 bp, Homo sapiens
aacttttctgat

SEQ ID NO: 5344971 - DNA, 21 bp, Homo sapiens
aacttttcttaaaaagttata

SEQ ID NO: 5344972 - DNA, 20 bp, Homo sapiens
aacttttcttttggactttt

SEQ ID NO: 5344973 - DNA, 15 bp, Homo sapiens
aacttttgaaaaagt

SEQ ID NO: 5344974 - DNA, 16 bp, Homo sapiens
aacttttgaaagatgt

SEQ ID NO: 5344975 - DNA, 22 bp, Homo sapiens
aacttttgagaatgtttgaaaa

SEQ ID NO: 5344976 - DNA, 14 bp, Homo sapiens
aacttttgatgact

SEQ ID NO: 5344977 - DNA, 14 bp, Homo sapiens
aacttttggaatca

SEQ ID NO: 5344978 - DNA, 18 bp, Homo sapiens
aacttttgggatttgttg

SEQ ID NO: 5344979 - DNA, 13 bp, Homo sapiens
aacttttgtaaat

SEQ ID NO: 5344980 - DNA, 14 bp, Homo sapiens
aacttttgtaattt

SEQ ID NO: 5344981 - DNA, 16 bp, Homo sapiens
aacttttgtaatttga

SEQ ID NO: 5344982 - DNA, 20 bp, Homo sapiens
aacttttgtaatttgaattg

SEQ ID NO: 5344983 - DNA, 11 bp, Homo sapiens
aacttttgtac

SEQ ID NO: 5344984 - DNA, 20 bp, Homo sapiens
aacttttgtactgaattttt

SEQ ID NO: 5344985 - DNA, 21 bp, Homo sapiens
aacttttgtagtcttatgaat

SEQ ID NO: 5344986 - DNA, 23 bp, Homo sapiens
aacttttgtggactgagcggccg

SEQ ID NO: 5344987 - DNA, 15 bp, Homo sapiens
aacttttgtgtgaaa

SEQ ID NO: 5344988 - DNA, 15 bp, Homo sapiens
aactttttaaagagt

SEQ ID NO: 5344989 - DNA, 19 bp, Homo sapiens
aactttttaataaagtata

SEQ ID NO: 5344990 - DNA, 12 bp, Homo sapiens
aactttttaatt

SEQ ID NO: 5344991 - DNA, 15 bp, Homo sapiens
aactttttaattgtg

SEQ ID NO: 5344992 - DNA, 17 bp, Homo sapiens
aactttttcattccctg

SEQ ID NO: 5344993 - DNA, 21 bp, Homo sapiens
aactttttcttttccctcaat

SEQ ID NO: 5344994 - DNA, 21 bp, Homo sapiens
aactttttgaccagtttcttt

SEQ ID NO: 5344995 - DNA, 20 bp, Homo sapiens
aactttttgtaggatacttg

SEQ ID NO: 5344996 - DNA, 14 bp, Homo sapiens
aactttttgttcat

SEQ ID NO: 5344997 - DNA, 20 bp, Homo sapiens
aactttttgtttttatttct

SEQ ID NO: 5344998 - DNA, 14 bp, Homo sapiens
aacttttttaaata

SEQ ID NO: 5344999 - DNA, 18 bp, Homo sapiens
aacttttttaaataaact

SEQ ID NO: 5345000 - DNA, 19 bp, Homo sapiens
aacttttttcattttgaaa

SEQ ID NO: 5345001 - DNA, 13 bp, Homo sapiens
aacttttttccct

SEQ ID NO: 5345002 - DNA, 19 bp, Homo sapiens
aacttttttgaaataataa

SEQ ID NO: 5345003 - DNA, 20 bp, Homo sapiens
aacttttttgagtcattgac

SEQ ID NO: 5345004 - DNA, 12 bp, Homo sapiens
aacttttttggt

SEQ ID NO: 5345005 - DNA, 16 bp, Homo sapiens
aacttttttgtggcaa

SEQ ID NO: 5345006 - DNA, 13 bp, Homo sapiens
aacttttttgtgt

SEQ ID NO: 5345007 - DNA, 15 bp, Homo sapiens
aacttttttgtgtat

SEQ ID NO: 5345008 - DNA, 13 bp, Homo sapiens
aactttttttcaa

SEQ ID NO: 5345009 - DNA, 14 bp, Homo sapiens
aactttttttcaat

SEQ ID NO: 5345010 - DNA, 17 bp, Homo sapiens
aactttttttcaatgtg

SEQ ID NO: 5345011 - DNA, 14 bp, Homo sapiens
aactttttttcagt

SEQ ID NO: 5345012 - DNA, 16 bp, Homo sapiens
aactttttttcagttc

SEQ ID NO: 5345013 - DNA, 21 bp, Homo sapiens
aactttttttctgtaccagtt

SEQ ID NO: 5345014 - DNA, 21 bp, Homo sapiens
aacttttttttacttatatat

SEQ ID NO: 5345015 - DNA, 14 bp, Homo sapiens
aacttttttttagt

SEQ ID NO: 5345016 - DNA, 16 bp, Homo sapiens
aacttttttttagtat

SEQ ID NO: 5345017 - DNA, 16 bp, Homo sapiens
aacttttttttctttt

SEQ ID NO: 5345018 - DNA, 17 bp, Homo sapiens
aacttttttttcttttt

SEQ ID NO: 5345019 - DNA, 19 bp, Homo sapiens
aacttttttttttttaaca

SEQ ID NO: 5345020 - DNA, 20 bp, Homo sapiens
aacttttttttttttaacat

SEQ ID NO: 5345021 - DNA, 23 bp, Homo sapiens
aacttttttttttttaacatctt

SEQ ID NO: 5345022 - DNA, 15 bp, Homo sapiens
aagaaaaaaaaaaga

SEQ ID NO: 5345023 - DNA, 14 bp, Homo sapiens
aagaaaaaaaaaga

SEQ ID NO: 5345024 - DNA, 15 bp, Homo sapiens
aagaaaaaaaaagca

SEQ ID NO: 5345025 - DNA, 14 bp, Homo sapiens
aagaaaaaaaaata

SEQ ID NO: 5345026 - DNA, 21 bp, Homo sapiens
aagaaaaaaaaatacttaaat

SEQ ID NO: 5345027 - DNA, 15 bp, Homo sapiens
aagaaaaaaaaatgc

SEQ ID NO: 5345028 - DNA, 17 bp, Homo sapiens
aagaaaaaaaagaaagc

SEQ ID NO: 5345029 - DNA, 14 bp, Homo sapiens
aagaaaaaaaattt

SEQ ID NO: 5345030 - DNA, 18 bp, Homo sapiens
aagaaaaaaaccaaagta

SEQ ID NO: 5345031 - DNA, 19 bp, Homo sapiens
aagaaaaaaacgaaaacag

SEQ ID NO: 5345032 - DNA, 20 bp, Homo sapiens
aagaaaaaaactataaatac

SEQ ID NO: 5345033 - DNA, 15 bp, Homo sapiens
aagaaaaaaagaaaa

SEQ ID NO: 5345034 - DNA, 16 bp, Homo sapiens
aagaaaaaaagcaaaa

SEQ ID NO: 5345035 - DNA, 21 bp, Homo sapiens
aagaaaaaaagcacaaagttc

SEQ ID NO: 5345036 - DNA, 15 bp, Homo sapiens
aagaaaaaaatagtt

SEQ ID NO: 5345037 - DNA, 21 bp, Homo sapiens
aagaaaaaaatagttttacat

SEQ ID NO: 5345038 - DNA, 17 bp, Homo sapiens
aagaaaaaaatggaaaa

SEQ ID NO: 5345039 - DNA, 13 bp, Homo sapiens
aagaaaaaaatgt

SEQ ID NO: 5345040 - DNA, 12 bp, Homo sapiens
aagaaaaaacaa

SEQ ID NO: 5345041 - DNA, 16 bp, Homo sapiens
aagaaaaaactgaagg

SEQ ID NO: 5345042 - DNA, 14 bp, Homo sapiens
aagaaaaaagaaaa

SEQ ID NO: 5345043 - DNA, 16 bp, Homo sapiens
aagaaaaaagtacaga

SEQ ID NO: 5345044 - DNA, 14 bp, Homo sapiens
aagaaaaaatcaga

SEQ ID NO: 5345045 - DNA, 21 bp, Homo sapiens
aagaaaaaattttaaaaatct

SEQ ID NO: 5345046 - DNA, 18 bp, Homo sapiens
aagaaaaacaaaatgtta

SEQ ID NO: 5345047 - DNA, 17 bp, Homo sapiens
aagaaaaacaataaaga

SEQ ID NO: 5345048 - DNA, 11 bp, Homo sapiens
aagaaaaactt

SEQ ID NO: 5345049 - DNA, 12 bp, Homo sapiens
aagaaaaacttt

SEQ ID NO: 5345050 - DNA, 15 bp, Homo sapiens
aagaaaaagaagaac

SEQ ID NO: 5345051 - DNA, 15 bp, Homo sapiens
aagaaaaagaagctg

SEQ ID NO: 5345052 - DNA, 16 bp, Homo sapiens
aagaaaaagaagctga

SEQ ID NO: 5345053 - DNA, 12 bp, Homo sapiens
aagaaaaagatt

SEQ ID NO: 5345054 - DNA, 17 bp, Homo sapiens
aagaaaaagcaaaaggc

SEQ ID NO: 5345055 - DNA, 12 bp, Homo sapiens
aagaaaaaggaa

SEQ ID NO: 5345056 - DNA, 13 bp, Homo sapiens
aagaaaaaggaaa

SEQ ID NO: 5345057 - DNA, 18 bp, Homo sapiens
aagaaaaaggatgcacag

SEQ ID NO: 5345058 - DNA, 15 bp, Homo sapiens
aagaaaaagtacaat

SEQ ID NO: 5345059 - DNA, 16 bp, Homo sapiens
aagaaaaagtagaaaa

SEQ ID NO: 5345060 - DNA, 21 bp, Homo sapiens
aagaagaaaattgctgtgcct

SEQ ID NO: 5345061 - DNA, 16 bp, Homo sapiens
aagaagaaacgtctat

SEQ ID NO: 5345062 - DNA, 13 bp, Homo sapiens
aagaagaaactca

SEQ ID NO: 5345063 - DNA, 12 bp, Homo sapiens
aagaagaaactg

SEQ ID NO: 5345064 - DNA, 15 bp, Homo sapiens
aagaagaaagactct

SEQ ID NO: 5345065 - DNA, 21 bp, Homo sapiens
aagaagaaagtctatgcttag

SEQ ID NO: 5345066 - DNA, 14 bp, Homo sapiens
aagaagaaataaat

SEQ ID NO: 5345067 - DNA, 20 bp, Homo sapiens
aagaagaaataaataatcta

SEQ ID NO: 5345068 - DNA, 12 bp, Homo sapiens
aagaagaagaat

SEQ ID NO: 5345069 - DNA, 13 bp, Homo sapiens
aagaagaatgtgt

SEQ ID NO: 5345070 - DNA, 14 bp, Homo sapiens
aagaagaattggcc

SEQ ID NO: 5345071 - DNA, 12 bp, Homo sapiens
aagaagacatga

SEQ ID NO: 5345072 - DNA, 14 bp, Homo sapiens
aagaagacatgttt

SEQ ID NO: 5345073 - DNA, 15 bp, Homo sapiens
aagaagacatgtttt

SEQ ID NO: 5345074 - DNA, 11 bp, Homo sapiens
aagaagacatt

SEQ ID NO: 5345075 - DNA, 21 bp, Homo sapiens
aagaagaccagactgtggaga

SEQ ID NO: 5345076 - DNA, 20 bp, Homo sapiens
aagaagacctgagaatgtat

SEQ ID NO: 5345077 - DNA, 15 bp, Homo sapiens
aagaagactgcatta

SEQ ID NO: 5345078 - DNA, 14 bp, Homo sapiens
aagaagagaagctg

SEQ ID NO: 5345079 - DNA, 16 bp, Homo sapiens
aagaagagaagctgct

SEQ ID NO: 5345080 - DNA, 17 bp, Homo sapiens
aagaagagaagctgctg

SEQ ID NO: 5345081 - DNA, 10 bp, Homo sapiens
aagaagagac

SEQ ID NO: 5345082 - DNA, 19 bp, Homo sapiens
aagaagagcgagagatcaa

SEQ ID NO: 5345083 - DNA, 14 bp, Homo sapiens
aagaagaggagaaa

SEQ ID NO: 5345084 - DNA, 22 bp, Homo sapiens
aagaagaggagaaaaaaacttc

SEQ ID NO: 5345085 - DNA, 15 bp, Homo sapiens
aagaagaggagcctc

SEQ ID NO: 5345086 - DNA, 13 bp, Homo sapiens
aagaagagggaga

SEQ ID NO: 5345087 - DNA, 14 bp, Homo sapiens
aagaagagtaaaca

SEQ ID NO: 5345088 - DNA, 16 bp, Homo sapiens
aagaagagtttgcaaa

SEQ ID NO: 5345089 - DNA, 13 bp, Homo sapiens
aagaagataaatg

SEQ ID NO: 5345090 - DNA, 14 bp, Homo sapiens
aagaagataaatga

SEQ ID NO: 5345091 - DNA, 21 bp, Homo sapiens
aagaagatcacgctccccgcc

SEQ ID NO: 5345092 - DNA, 14 bp, Homo sapiens
aagaagatctgtaa

SEQ ID NO: 5345093 - DNA, 17 bp, Homo sapiens
aagaagattcccacccc

SEQ ID NO: 5345094 - DNA, 14 bp, Homo sapiens
aagaagattctaaa

SEQ ID NO: 5345095 - DNA, 16 bp, Homo sapiens
aagaagcaaataaata

SEQ ID NO: 5345096 - DNA, 14 bp, Homo sapiens
aagaagcaaatttt

SEQ ID NO: 5345097 - DNA, 18 bp, Homo sapiens
aagaagcaatctttgaaa

SEQ ID NO: 5345098 - DNA, 20 bp, Homo sapiens
aagaagcaatctttgaaata

SEQ ID NO: 5345099 - DNA, 21 bp, Homo sapiens
aagaagcaattatttaaagaa

SEQ ID NO: 5345100 - DNA, 22 bp, Homo sapiens
aagaagcaccaatcatgaatta

SEQ ID NO: 5345101 - DNA, 19 bp, Homo sapiens
aagaagcactctgctggcg

SEQ ID NO: 5345102 - DNA, 12 bp, Homo sapiens
aagaagcagaga

SEQ ID NO: 5345103 - DNA, 23 bp, Homo sapiens
aagaagcagcctgttttcactca

SEQ ID NO: 5345104 - DNA, 19 bp, Homo sapiens
aagaagccacagacctagg

SEQ ID NO: 5345105 - DNA, 17 bp, Homo sapiens
aagaagccacagctctt

SEQ ID NO: 5345106 - DNA, 18 bp, Homo sapiens
aagaagccatcaatttta

SEQ ID NO: 5345107 - DNA, 17 bp, Homo sapiens
aagaagcccaggaaagg

SEQ ID NO: 5345108 - DNA, 22 bp, Homo sapiens
aagaagcccagtggtgaggaaa

SEQ ID NO: 5345109 - DNA, 16 bp, Homo sapiens
aagaagcccccagcta

SEQ ID NO: 5345110 - DNA, 16 bp, Homo sapiens
aagaagccccttattt

SEQ ID NO: 5345111 - DNA, 24 bp, Homo sapiens
aagaagcccggctcctggtcacct

SEQ ID NO: 5345112 - DNA, 13 bp, Homo sapiens
aagaagccctcct

SEQ ID NO: 5345113 - DNA, 18 bp, Homo sapiens
aagaagccctgttctcgt

SEQ ID NO: 5345114 - DNA, 17 bp, Homo sapiens
aagaagcctagaaaaga

SEQ ID NO: 5345115 - DNA, 19 bp, Homo sapiens
aagaagccttaatttgcac

SEQ ID NO: 5345116 - DNA, 22 bp, Homo sapiens
aagaagcgccgactccctgagt

SEQ ID NO: 5345117 - DNA, 18 bp, Homo sapiens
aagaagcgcggctaactt

SEQ ID NO: 5345118 - DNA, 19 bp, Homo sapiens
aagaagcgcggctaactta

SEQ ID NO: 5345119 - DNA, 20 bp, Homo sapiens
aagaagcgcggctaacttat

SEQ ID NO: 5345120 - DNA, 16 bp, Homo sapiens
aagaagctacagattg

SEQ ID NO: 5345121 - DNA, 23 bp, Homo sapiens
aagaagctactattttggaaaat

SEQ ID NO: 5345122 - DNA, 19 bp, Homo sapiens
aagaagctcccagatgctg

SEQ ID NO: 5345123 - DNA, 15 bp, Homo sapiens
aagaagctctctcct

SEQ ID NO: 5345124 - DNA, 15 bp, Homo sapiens
aagaagctgcaataa

SEQ ID NO: 5345125 - DNA, 19 bp, Homo sapiens
aagaagctgcttctgccca

SEQ ID NO: 5345126 - DNA, 12 bp, Homo sapiens
aagaagctggga

SEQ ID NO: 5345127 - DNA, 15 bp, Homo sapiens
aagaagctgtgaata

SEQ ID NO: 5345128 - DNA, 14 bp, Homo sapiens
aagaagctgttgta

SEQ ID NO: 5345129 - DNA, 17 bp, Homo sapiens
aagaagctgttgtacat

SEQ ID NO: 5345130 - DNA, 19 bp, Homo sapiens
aagaagctgttgtacattt

SEQ ID NO: 5345131 - DNA, 19 bp, Homo sapiens
aagaagcttctaataaatt

SEQ ID NO: 5345132 - DNA, 21 bp, Homo sapiens
aagaagcttctaataaattat

SEQ ID NO: 5345133 - DNA, 11 bp, Homo sapiens
aagaaggaaaa

SEQ ID NO: 5345134 - DNA, 16 bp, Homo sapiens
aagaaggaaaaaagga

SEQ ID NO: 5345135 - DNA, 17 bp, Homo sapiens
aagaaggaaaaggcagg

SEQ ID NO: 5345136 - DNA, 17 bp, Homo sapiens
aagaaggaaagaaccga

SEQ ID NO: 5345137 - DNA, 19 bp, Homo sapiens
aagaaggaaatgaatttct

SEQ ID NO: 5345138 - DNA, 19 bp, Homo sapiens
aagaaggaaggcctgagcc

SEQ ID NO: 5345139 - DNA, 21 bp, Homo sapiens
aagaaggaaggcctgagcccc

SEQ ID NO: 5345140 - DNA, 18 bp, Homo sapiens
aagaaggaatataccttt

SEQ ID NO: 5345141 - DNA, 22 bp, Homo sapiens
aagaaggaatataccttttttg

SEQ ID NO: 5345142 - DNA, 12 bp, Homo sapiens
aagaaggaatcc

SEQ ID NO: 5345143 - DNA, 16 bp, Homo sapiens
aagaaggacacttgta

SEQ ID NO: 5345144 - DNA, 15 bp, Homo sapiens
aagaaggaccctttt

SEQ ID NO: 5345145 - DNA, 16 bp, Homo sapiens
aagaaggactgaagaa

SEQ ID NO: 5345146 - DNA, 11 bp, Homo sapiens
aagaaggagac

SEQ ID NO: 5345147 - DNA, 14 bp, Homo sapiens
aagaaggagagcaa

SEQ ID NO: 5345148 - DNA, 21 bp, Homo sapiens
aagaaggagagcaagaaggaa

SEQ ID NO: 5345149 - DNA, 19 bp, Homo sapiens
aagaaggagcagaataaat

SEQ ID NO: 5345150 - DNA, 14 bp, Homo sapiens
aagaaggaggaatt

SEQ ID NO: 5345151 - DNA, 13 bp, Homo sapiens
aagaaggcaattt

SEQ ID NO: 5345152 - DNA, 19 bp, Homo sapiens
aagaaggcagcaggtggca

SEQ ID NO: 5345153 - DNA, 20 bp, Homo sapiens
aagaaggccagagagggaaa

SEQ ID NO: 5345154 - DNA, 21 bp, Homo sapiens
aagaaggccagcccactgggc

SEQ ID NO: 5345155 - DNA, 23 bp, Homo sapiens
aagaaggccagcccactgggccc

SEQ ID NO: 5345156 - DNA, 20 bp, Homo sapiens
aagaaggcccgggaggagga

SEQ ID NO: 5345157 - DNA, 12 bp, Homo sapiens
aagaaggctggg

SEQ ID NO: 5345158 - DNA, 15 bp, Homo sapiens
aagaagggagaagaa

SEQ ID NO: 5345159 - DNA, 16 bp, Homo sapiens
aagaagggccaccctg

SEQ ID NO: 5345160 - DNA, 16 bp, Homo sapiens
aagaagggctgcatga

SEQ ID NO: 5345161 - DNA, 22 bp, Homo sapiens
aagaagggctgcatgatgtttg

SEQ ID NO: 5345162 - DNA, 15 bp, Homo sapiens
aagaaggggagaagt

SEQ ID NO: 5345163 - DNA, 17 bp, Homo sapiens
aagaaggggagaagtca

SEQ ID NO: 5345164 - DNA, 21 bp, Homo sapiens
aagaagggggagtgaaacaga

SEQ ID NO: 5345165 - DNA, 19 bp, Homo sapiens
aagaagggggccctgctac

SEQ ID NO: 5345166 - DNA, 22 bp, Homo sapiens
aagaaggggtagggatttggct

SEQ ID NO: 5345167 - DNA, 23 bp, Homo sapiens
aagaagggtgggagtggggcctt

SEQ ID NO: 5345168 - DNA, 18 bp, Homo sapiens
aagaaggtatttttccaa

SEQ ID NO: 5345169 - DNA, 23 bp, Homo sapiens
aagaaggtttcagaaagaagtgg

SEQ ID NO: 5345170 - DNA, 14 bp, Homo sapiens
aagaagtaaaagca

SEQ ID NO: 5345171 - DNA, 23 bp, Homo sapiens
aagaagtaaactggatactgtac

SEQ ID NO: 5345172 - DNA, 22 bp, Homo sapiens
aagaagtaggttctgttttgtt

SEQ ID NO: 5345173 - DNA, 20 bp, Homo sapiens
aagaagtcagagaaaacact

SEQ ID NO: 5345174 - DNA, 15 bp, Homo sapiens
aagaagtcataaaca

SEQ ID NO: 5345175 - DNA, 17 bp, Homo sapiens
aagaagtccccaggtca

SEQ ID NO: 5345176 - DNA, 18 bp, Homo sapiens
aagaagtcggaatgtcat

SEQ ID NO: 5345177 - DNA, 21 bp, Homo sapiens
aagaagtctgtccatatgaaa

SEQ ID NO: 5345178 - DNA, 23 bp, Homo sapiens
aagaagtcttctctgcctgtaag

SEQ ID NO: 5345179 - DNA, 16 bp, Homo sapiens
aagaagtgaaaatcta

SEQ ID NO: 5345180 - DNA, 19 bp, Homo sapiens
aagaagtgaccaaggagga

SEQ ID NO: 5345181 - DNA, 12 bp, Homo sapiens
aagaagtgattc

SEQ ID NO: 5345182 - DNA, 17 bp, Homo sapiens
aagaagtgggagcagct

SEQ ID NO: 5345183 - DNA, 20 bp, Homo sapiens
aagaagtgggagcagcttct

SEQ ID NO: 5345184 - DNA, 23 bp, Homo sapiens
aagaagtgggagtgggagaggaa

SEQ ID NO: 5345185 - DNA, 19 bp, Homo sapiens
aagaagtggtgttccatga

SEQ ID NO: 5345186 - DNA, 18 bp, Homo sapiens
aagaagtgtccgagaact

SEQ ID NO: 5345187 - DNA, 15 bp, Homo sapiens
aagaagttaattctt

SEQ ID NO: 5345188 - DNA, 22 bp, Homo sapiens
aagaagttaattcttaaaacta

SEQ ID NO: 5345189 - DNA, 19 bp, Homo sapiens
aagaagttcaccagccctg

SEQ ID NO: 5345190 - DNA, 14 bp, Homo sapiens
aagaagttctttga

SEQ ID NO: 5345191 - DNA, 20 bp, Homo sapiens
aagaagttctttgattctgt

SEQ ID NO: 5345192 - DNA, 18 bp, Homo sapiens
aagaagtttcatcatttt

SEQ ID NO: 5345193 - DNA, 19 bp, Homo sapiens
aagaagtttgtgtctttgt

SEQ ID NO: 5345194 - DNA, 23 bp, Homo sapiens
aagaagttttaaaaagccagttt

SEQ ID NO: 5345195 - DNA, 21 bp, Homo sapiens
aagaagtttttctttgtgttt

SEQ ID NO: 5345196 - DNA, 17 bp, Homo sapiens
aagaagttttttacttt

SEQ ID NO: 5345197 - DNA, 23 bp, Homo sapiens
aagaagttttttactttggttta

SEQ ID NO: 5345198 - DNA, 15 bp, Homo sapiens
aagaataaaatgttg

SEQ ID NO: 5345199 - DNA, 18 bp, Homo sapiens
aagaataaaatgttgaaa

SEQ ID NO: 5345200 - DNA, 23 bp, Homo sapiens
aagaataaaatgttgaaaagtca

SEQ ID NO: 5345201 - DNA, 22 bp, Homo sapiens
aagaataaacacagtgtttcct

SEQ ID NO: 5345202 - DNA, 14 bp, Homo sapiens
aagaataaacattt

SEQ ID NO: 5345203 - DNA, 16 bp, Homo sapiens
aagaataaaggcagct

SEQ ID NO: 5345204 - DNA, 17 bp, Homo sapiens
aagaataaataaagaag

SEQ ID NO: 5345205 - DNA, 19 bp, Homo sapiens
aagaataaataaagaagaa

SEQ ID NO: 5345206 - DNA, 12 bp, Homo sapiens
aagaataaatga

SEQ ID NO: 5345207 - DNA, 17 bp, Homo sapiens
aagaataacaagaagcc

SEQ ID NO: 5345208 - DNA, 16 bp, Homo sapiens
aagaataataaaatca

SEQ ID NO: 5345209 - DNA, 11 bp, Homo sapiens
aagaataattt

SEQ ID NO: 5345210 - DNA, 16 bp, Homo sapiens
aagaatacaaacatat

SEQ ID NO: 5345211 - DNA, 13 bp, Homo sapiens
aagaatacagtta

SEQ ID NO: 5345212 - DNA, 23 bp, Homo sapiens
aagaatacagttaggcaccagaa

SEQ ID NO: 5345213 - DNA, 13 bp, Homo sapiens
aagaatacatcag

SEQ ID NO: 5345214 - DNA, 17 bp, Homo sapiens
aagaatactagaatggt

SEQ ID NO: 5345215 - DNA, 17 bp, Homo sapiens
aagaatacttctcattt

SEQ ID NO: 5345216 - DNA, 14 bp, Homo sapiens
aagaatacttgaac

SEQ ID NO: 5345217 - DNA, 17 bp, Homo sapiens
aagaatagcattgtaaa

SEQ ID NO: 5345218 - DNA, 23 bp, Homo sapiens
aagaatagcattgtaaaagcatt

SEQ ID NO: 5345219 - DNA, 18 bp, Homo sapiens
aagaatagcctattgtct

SEQ ID NO: 5345220 - DNA, 19 bp, Homo sapiens
aagaataggacttgttttt

SEQ ID NO: 5345221 - DNA, 15 bp, Homo sapiens
aagaatagggcccat

SEQ ID NO: 5345222 - DNA, 12 bp, Homo sapiens
aagaataggtca

SEQ ID NO: 5345223 - DNA, 18 bp, Homo sapiens
aagaataggtcattttct

SEQ ID NO: 5345224 - DNA, 19 bp, Homo sapiens
aagaataggtgcaaacaaa

SEQ ID NO: 5345225 - DNA, 21 bp, Homo sapiens
aagaatagtgcctcagcgctg

SEQ ID NO: 5345226 - DNA, 21 bp, Homo sapiens
aagaatagttgtcagaatatg

SEQ ID NO: 5345227 - DNA, 19 bp, Homo sapiens
aagaatataaagttaaaaa

SEQ ID NO: 5345228 - DNA, 13 bp, Homo sapiens
aagaatatcaaat

SEQ ID NO: 5345229 - DNA, 20 bp, Homo sapiens
aagaatatcctttaaaattt

SEQ ID NO: 5345230 - DNA, 20 bp, Homo sapiens
aagaatatcgatataaattg

SEQ ID NO: 5345231 - DNA, 18 bp, Homo sapiens
aagaatatgtttccttgt

SEQ ID NO: 5345232 - DNA, 15 bp, Homo sapiens
aagaatattcaaatg

SEQ ID NO: 5345233 - DNA, 13 bp, Homo sapiens
aagaatattcagg

SEQ ID NO: 5345234 - DNA, 23 bp, Homo sapiens
aagaatattgcaaaatacatgaa

SEQ ID NO: 5345235 - DNA, 15 bp, Homo sapiens
aagaatattgttcct

SEQ ID NO: 5345236 - DNA, 22 bp, Homo sapiens
aagaatattgttcctaagttct

SEQ ID NO: 5345237 - DNA, 22 bp, Homo sapiens
aagaatatttaagaaaagcact

SEQ ID NO: 5345238 - DNA, 23 bp, Homo sapiens
aagagaagatgcctgttaattta

SEQ ID NO: 5345239 - DNA, 14 bp, Homo sapiens
aagagaagcaattt

SEQ ID NO: 5345240 - DNA, 18 bp, Homo sapiens
aagagaagctactttgtt

SEQ ID NO: 5345241 - DNA, 17 bp, Homo sapiens
aagagaagctgagaaga

SEQ ID NO: 5345242 - DNA, 13 bp, Homo sapiens
aagagaagctgct

SEQ ID NO: 5345243 - DNA, 14 bp, Homo sapiens
aagagaagctgctg

SEQ ID NO: 5345244 - DNA, 16 bp, Homo sapiens
aagagaagctgctgac

SEQ ID NO: 5345245 - DNA, 17 bp, Homo sapiens
aagagaagctgctgacc

SEQ ID NO: 5345246 - DNA, 13 bp, Homo sapiens
aagagaaggagat

SEQ ID NO: 5345247 - DNA, 16 bp, Homo sapiens
aagagaaggcacacag

SEQ ID NO: 5345248 - DNA, 15 bp, Homo sapiens
aagagaagggcttac

SEQ ID NO: 5345249 - DNA, 20 bp, Homo sapiens
aagagaaggtggacctggca

SEQ ID NO: 5345250 - DNA, 21 bp, Homo sapiens
aagagaaggtggacctggcag

SEQ ID NO: 5345251 - DNA, 13 bp, Homo sapiens
aagagaagtagaa

SEQ ID NO: 5345252 - DNA, 17 bp, Homo sapiens
aagagaagtctcattcg

SEQ ID NO: 5345253 - DNA, 17 bp, Homo sapiens
aagagaagtgagtggtg

SEQ ID NO: 5345254 - DNA, 14 bp, Homo sapiens
aagagaagttattt

SEQ ID NO: 5345255 - DNA, 18 bp, Homo sapiens
aagagaatattttaagta

SEQ ID NO: 5345256 - DNA, 22 bp, Homo sapiens
aagagaatattttaagtattgc

SEQ ID NO: 5345257 - DNA, 15 bp, Homo sapiens
aagagaatcaacaga

SEQ ID NO: 5345258 - DNA, 15 bp, Homo sapiens
aagagaatccacata

SEQ ID NO: 5345259 - DNA, 22 bp, Homo sapiens
aagagaatgaactgtggaattt

SEQ ID NO: 5345260 - DNA, 18 bp, Homo sapiens
aagagaatgtattctgta

SEQ ID NO: 5345261 - DNA, 14 bp, Homo sapiens
aagagaatgttata

SEQ ID NO: 5345262 - DNA, 15 bp, Homo sapiens
aagagaatgttccta

SEQ ID NO: 5345263 - DNA, 21 bp, Homo sapiens
aagagaattattacatcttta

SEQ ID NO: 5345264 - DNA, 13 bp, Homo sapiens
aagagacaaactg

SEQ ID NO: 5345265 - DNA, 19 bp, Homo sapiens
aagagacaaagatttcttc

SEQ ID NO: 5345266 - DNA, 23 bp, Homo sapiens
aagagacactcccccctccattc

SEQ ID NO: 5345267 - DNA, 16 bp, Homo sapiens
aagagacactgcttgg

SEQ ID NO: 5345268 - DNA, 17 bp, Homo sapiens
aagagacagagccccca

SEQ ID NO: 5345269 - DNA, 18 bp, Homo sapiens
aagagacagagcccccaa

SEQ ID NO: 5345270 - DNA, 22 bp, Homo sapiens
aagagacaggagggcaagggcc

SEQ ID NO: 5345271 - DNA, 13 bp, Homo sapiens
aagagacagggcc

SEQ ID NO: 5345272 - DNA, 14 bp, Homo sapiens
aagagacagggccc

SEQ ID NO: 5345273 - DNA, 14 bp, Homo sapiens
aagagacagtgata

SEQ ID NO: 5345274 - DNA, 15 bp, Homo sapiens
aagagacatggaaga

SEQ ID NO: 5345275 - DNA, 15 bp, Homo sapiens
aagagacatttcaaa

SEQ ID NO: 5345276 - DNA, 15 bp, Homo sapiens
aagagaccaactttt

SEQ ID NO: 5345277 - DNA, 19 bp, Homo sapiens
aagagaccacttccttaac

SEQ ID NO: 5345278 - DNA, 13 bp, Homo sapiens
aagagaccagcac

SEQ ID NO: 5345279 - DNA, 17 bp, Homo sapiens
aagagaccatcttctat

SEQ ID NO: 5345280 - DNA, 16 bp, Homo sapiens
aagagacctacctcag

SEQ ID NO: 5345281 - DNA, 18 bp, Homo sapiens
aagagacctacctcaggt

SEQ ID NO: 5345282 - DNA, 19 bp, Homo sapiens
aagagacctgttttaaaaa

SEQ ID NO: 5345283 - DNA, 14 bp, Homo sapiens
aagagactcagcct

SEQ ID NO: 5345284 - DNA, 16 bp, Homo sapiens
aagagactcagcctgc

SEQ ID NO: 5345285 - DNA, 16 bp, Homo sapiens
aagagactctggcctc

SEQ ID NO: 5345286 - DNA, 19 bp, Homo sapiens
aagagacttaaaggacagg

SEQ ID NO: 5345287 - DNA, 20 bp, Homo sapiens
aagagactttgtcacttatt

SEQ ID NO: 5345288 - DNA, 12 bp, Homo sapiens
aagagagaaaaa

SEQ ID NO: 5345289 - DNA, 16 bp, Homo sapiens
aagagagaaaataaaa

SEQ ID NO: 5345290 - DNA, 22 bp, Homo sapiens
aagagagaaaataaaaagttaa

SEQ ID NO: 5345291 - DNA, 13 bp, Homo sapiens
aagagagaaacaa

SEQ ID NO: 5345292 - DNA, 14 bp, Homo sapiens
aagagagaaagaaa

SEQ ID NO: 5345293 - DNA, 17 bp, Homo sapiens
aagagagaacaggacta

SEQ ID NO: 5345294 - DNA, 18 bp, Homo sapiens
aagagagaacctaactgt

SEQ ID NO: 5345295 - DNA, 13 bp, Homo sapiens
aagagagaagcca

SEQ ID NO: 5345296 - DNA, 18 bp, Homo sapiens
aagagagaagccagccac

SEQ ID NO: 5345297 - DNA, 14 bp, Homo sapiens
aagagagacaaaat

SEQ ID NO: 5345298 - DNA, 9 bp, Homo sapiens
aagagagag

SEQ ID NO: 5345299 - DNA, 19 bp, Homo sapiens
aagagagagaaacaaactt

SEQ ID NO: 5345300 - DNA, 20 bp, Homo sapiens
aagagagagaaacaaacttt

SEQ ID NO: 5345301 - DNA, 13 bp, Homo sapiens
aagagagagagag

SEQ ID NO: 5345302 - DNA, 14 bp, Homo sapiens
aagagagagagaga

SEQ ID NO: 5345303 - DNA, 20 bp, Homo sapiens
aagagagagagagaaaaaaa

SEQ ID NO: 5345304 - DNA, 14 bp, Homo sapiens
aagagagagctgag

SEQ ID NO: 5345305 - DNA, 16 bp, Homo sapiens
aagagagatatatctg

SEQ ID NO: 5345306 - DNA, 16 bp, Homo sapiens
aagagagattggattt

SEQ ID NO: 5345307 - DNA, 12 bp, Homo sapiens
aagagagcctgc

SEQ ID NO: 5345308 - DNA, 18 bp, Homo sapiens
aagagagcctgcaggatc

SEQ ID NO: 5345309 - DNA, 23 bp, Homo sapiens
aagagagctggagtctgggctcc

SEQ ID NO: 5345310 - DNA, 12 bp, Homo sapiens
aagagaggaagg

SEQ ID NO: 5345311 - DNA, 23 bp, Homo sapiens
aagagaggacccatcctgccaca

SEQ ID NO: 5345312 - DNA, 19 bp, Homo sapiens
aagagaggagaggagagag

SEQ ID NO: 5345313 - DNA, 11 bp, Homo sapiens
aagagaggagt

SEQ ID NO: 5345314 - DNA, 15 bp, Homo sapiens
aagagaggagttcaa

SEQ ID NO: 5345315 - DNA, 19 bp, Homo sapiens
aagagaggagttcaatgat

SEQ ID NO: 5345316 - DNA, 21 bp, Homo sapiens
aagagaggagttcaatgatct

SEQ ID NO: 5345317 - DNA, 15 bp, Homo sapiens
aagagagggacaggc

SEQ ID NO: 5345318 - DNA, 22 bp, Homo sapiens
aagagagggccatgcaattcat

SEQ ID NO: 5345319 - DNA, 16 bp, Homo sapiens
aagagaggtccagccc

SEQ ID NO: 5345320 - DNA, 14 bp, Homo sapiens
aagagaggtttctg

SEQ ID NO: 5345321 - DNA, 22 bp, Homo sapiens
aagagagtatttttatacaaac

SEQ ID NO: 5345322 - DNA, 14 bp, Homo sapiens
aagagagtcataaa

SEQ ID NO: 5345323 - DNA, 20 bp, Homo sapiens
aagagagtcataaaccttaa

SEQ ID NO: 5345324 - DNA, 19 bp, Homo sapiens
aagagagttaatcaactga

SEQ ID NO: 5345325 - DNA, 22 bp, Homo sapiens
aagagagttaatcaactgaaag

SEQ ID NO: 5345326 - DNA, 21 bp, Homo sapiens
aagagagttctggatgtctgg

SEQ ID NO: 5345327 - DNA, 22 bp, Homo sapiens
aagagagttctggatgtctggc

SEQ ID NO: 5345328 - DNA, 16 bp, Homo sapiens
aagagagtttgccact

SEQ ID NO: 5345329 - DNA, 11 bp, Homo sapiens
aagagagtttt

SEQ ID NO: 5345330 - DNA, 19 bp, Homo sapiens
aagagagtttttaatagaa

SEQ ID NO: 5345331 - DNA, 13 bp, Homo sapiens
aagagataataag

SEQ ID NO: 5345332 - DNA, 16 bp, Homo sapiens
aagagataataagatt

SEQ ID NO: 5345333 - DNA, 14 bp, Homo sapiens
aagagatacagagg

SEQ ID NO: 5345334 - DNA, 22 bp, Homo sapiens
aagagatacttacatttccatt

SEQ ID NO: 5345335 - DNA, 13 bp, Homo sapiens
aagagatagagac

SEQ ID NO: 5345336 - DNA, 12 bp, Homo sapiens
aagagatatttt

SEQ ID NO: 5345337 - DNA, 13 bp, Homo sapiens
aagagatattttg

SEQ ID NO: 5345338 - DNA, 21 bp, Homo sapiens
aagagatcacccactcctatg

SEQ ID NO: 5345339 - DNA, 13 bp, Homo sapiens
aagagatcagcag

SEQ ID NO: 5345340 - DNA, 17 bp, Homo sapiens
aagagatcagcagtggc

SEQ ID NO: 5345341 - DNA, 18 bp, Homo sapiens
aagagatcagcagtggca

SEQ ID NO: 5345342 - DNA, 19 bp, Homo sapiens
aagagatcagcagtggcag

SEQ ID NO: 5345343 - DNA, 21 bp, Homo sapiens
aagagatcagcagtggcagga

SEQ ID NO: 5345344 - DNA, 14 bp, Homo sapiens
aagagatccaaaga

SEQ ID NO: 5345345 - DNA, 20 bp, Homo sapiens
aagagatctttctttccaaa

SEQ ID NO: 5345346 - DNA, 13 bp, Homo sapiens
aagagatgaagag

SEQ ID NO: 5345347 - DNA, 20 bp, Homo sapiens
aagagatgatgaaaatattt

SEQ ID NO: 5345348 - DNA, 13 bp, Homo sapiens
aagagatgctcta

SEQ ID NO: 5345349 - DNA, 23 bp, Homo sapiens
aagagatggcttacaaaaagaaa

SEQ ID NO: 5345350 - DNA, 18 bp, Homo sapiens
aagagatgggcttgtttt

SEQ ID NO: 5345351 - DNA, 22 bp, Homo sapiens
aagagatgggggtgtattggaa

SEQ ID NO: 5345352 - DNA, 14 bp, Homo sapiens
aagagatgtttaca

SEQ ID NO: 5345353 - DNA, 19 bp, Homo sapiens
aagagattaagaatattgc

SEQ ID NO: 5345354 - DNA, 11 bp, Homo sapiens
aagagattatg

SEQ ID NO: 5345355 - DNA, 16 bp, Homo sapiens
aagagattatgtaact

SEQ ID NO: 5345356 - DNA, 23 bp, Homo sapiens
aagagattcactcagaagacaca

SEQ ID NO: 5345357 - DNA, 13 bp, Homo sapiens
aagagattcgaat

SEQ ID NO: 5345358 - DNA, 19 bp, Homo sapiens
aagagattctattaaaagc

SEQ ID NO: 5345359 - DNA, 15 bp, Homo sapiens
aagagattgcacagt

SEQ ID NO: 5345360 - DNA, 22 bp, Homo sapiens
aagagattgcacagtcaaaacg

SEQ ID NO: 5345361 - DNA, 14 bp, Homo sapiens
aagagattgctaat

SEQ ID NO: 5345362 - DNA, 15 bp, Homo sapiens
aagagattgctaatt

SEQ ID NO: 5345363 - DNA, 16 bp, Homo sapiens
aagagattgtggtttc

SEQ ID NO: 5345364 - DNA, 21 bp, Homo sapiens
aagagatttaacactaaaatt

SEQ ID NO: 5345365 - DNA, 16 bp, Homo sapiens
aagagatttaattaat

SEQ ID NO: 5345366 - DNA, 16 bp, Homo sapiens
aagagatttcaacata

SEQ ID NO: 5345367 - DNA, 18 bp, Homo sapiens
aagagattttatgtttaa

SEQ ID NO: 5345368 - DNA, 13 bp, Homo sapiens
aagagatttttca

SEQ ID NO: 5345369 - DNA, 14 bp, Homo sapiens
aagagatttttcat

SEQ ID NO: 5345370 - DNA, 17 bp, Homo sapiens
aagagatttttcatgat

SEQ ID NO: 5345371 - DNA, 20 bp, Homo sapiens
aagagcaaaagaatggcaga

SEQ ID NO: 5345372 - DNA, 14 bp, Homo sapiens
aagagcaagggctt

SEQ ID NO: 5345373 - DNA, 17 bp, Homo sapiens
aagagcaattgcagcag

SEQ ID NO: 5345374 - DNA, 13 bp, Homo sapiens
aagagcacacttg

SEQ ID NO: 5345375 - DNA, 12 bp, Homo sapiens
aagagcacagcc

SEQ ID NO: 5345376 - DNA, 21 bp, Homo sapiens
aagagcacattcttaaaggaa

SEQ ID NO: 5345377 - DNA, 22 bp, Homo sapiens
aagagcactgggctaatttgta

SEQ ID NO: 5345378 - DNA, 13 bp, Homo sapiens
aagagcagagtct

SEQ ID NO: 5345379 - DNA, 12 bp, Homo sapiens
aagagcagcctg

SEQ ID NO: 5345380 - DNA, 13 bp, Homo sapiens
aagagcagcctga

SEQ ID NO: 5345381 - DNA, 14 bp, Homo sapiens
aagagcagcctgat

SEQ ID NO: 5345382 - DNA, 20 bp, Homo sapiens
aagagcagcctgatggccaa

SEQ ID NO: 5345383 - DNA, 13 bp, Homo sapiens
aagagcagcctgt

SEQ ID NO: 5345384 - DNA, 21 bp, Homo sapiens
aagagcaggatagctcttcct

SEQ ID NO: 5345385 - DNA, 16 bp, Homo sapiens
aagagcagtcacaaca

SEQ ID NO: 5345386 - DNA, 17 bp, Homo sapiens
aagagcatcatgcctct

SEQ ID NO: 5345387 - DNA, 24 bp, Homo sapiens
aagagcatcatgcctctgaggcca

SEQ ID NO: 5345388 - DNA, 19 bp, Homo sapiens
aagagcatgtaagaaataa

SEQ ID NO: 5345389 - DNA, 17 bp, Homo sapiens
aagagcattattcctgg

SEQ ID NO: 5345390 - DNA, 22 bp, Homo sapiens
aagagccacaggtctttatgtt

SEQ ID NO: 5345391 - DNA, 11 bp, Homo sapiens
aagagccacct

SEQ ID NO: 5345392 - DNA, 13 bp, Homo sapiens
aagagccacctgc

SEQ ID NO: 5345393 - DNA, 14 bp, Homo sapiens
aagagccactgcca

SEQ ID NO: 5345394 - DNA, 18 bp, Homo sapiens
aagagccactttcaagct

SEQ ID NO: 5345395 - DNA, 18 bp, Homo sapiens
aagagcccagtctgttga

SEQ ID NO: 5345396 - DNA, 19 bp, Homo sapiens
aagagccccactctcagag

SEQ ID NO: 5345397 - DNA, 19 bp, Homo sapiens
aagagcccgccgtctgcag

SEQ ID NO: 5345398 - DNA, 20 bp, Homo sapiens
aagagcccgccgtctgcagg

SEQ ID NO: 5345399 - DNA, 15 bp, Homo sapiens
aagagccctgagctc

SEQ ID NO: 5345400 - DNA, 22 bp, Homo sapiens
aagagccctgagctcaggctga

SEQ ID NO: 5345401 - DNA, 23 bp, Homo sapiens
aagagccctggacacccctgctc

SEQ ID NO: 5345402 - DNA, 18 bp, Homo sapiens
aagagccctggctctgcc

SEQ ID NO: 5345403 - DNA, 19 bp, Homo sapiens
aagagccctggctctgccc

SEQ ID NO: 5345404 - DNA, 23 bp, Homo sapiens
aagagccctgtggccgccacctg

SEQ ID NO: 5345405 - DNA, 19 bp, Homo sapiens
aagagccggagcctccagc

SEQ ID NO: 5345406 - DNA, 13 bp, Homo sapiens
aagagcctcccac

SEQ ID NO: 5345407 - DNA, 13 bp, Homo sapiens
aagagcctctgga

SEQ ID NO: 5345408 - DNA, 22 bp, Homo sapiens
aagagcctgaagctggcctgga

SEQ ID NO: 5345409 - DNA, 19 bp, Homo sapiens
aagagcctgatctcttcct

SEQ ID NO: 5345410 - DNA, 20 bp, Homo sapiens
aagagcctgatctcttcctg

SEQ ID NO: 5345411 - DNA, 21 bp, Homo sapiens
aagagcctgatctcttcctgt

SEQ ID NO: 5345412 - DNA, 17 bp, Homo sapiens
aagagcctgattttttg

SEQ ID NO: 5345413 - DNA, 11 bp, Homo sapiens
aagagcctgca

SEQ ID NO: 5345414 - DNA, 20 bp, Homo sapiens
aagagcctgcaggtgctgct

SEQ ID NO: 5345415 - DNA, 14 bp, Homo sapiens
aagagcctggagaa

SEQ ID NO: 5345416 - DNA, 21 bp, Homo sapiens
aagagcctgtcgatgagactg

SEQ ID NO: 5345417 - DNA, 17 bp, Homo sapiens
aagagccttcacatgaa

SEQ ID NO: 5345418 - DNA, 23 bp, Homo sapiens
aagatacttttaaagttttgtca

SEQ ID NO: 5345419 - DNA, 15 bp, Homo sapiens
aagatagaacacaaa

SEQ ID NO: 5345420 - DNA, 18 bp, Homo sapiens
aagatagaacaggctggt

SEQ ID NO: 5345421 - DNA, 21 bp, Homo sapiens
aagatagaacaggctggttct

SEQ ID NO: 5345422 - DNA, 13 bp, Homo sapiens
aagatagaagaaa

SEQ ID NO: 5345423 - DNA, 17 bp, Homo sapiens
aagatagacaggtcctg

SEQ ID NO: 5345424 - DNA, 19 bp, Homo sapiens
aagatagacaggtcctgat

SEQ ID NO: 5345425 - DNA, 15 bp, Homo sapiens
aagatagcagaagag

SEQ ID NO: 5345426 - DNA, 21 bp, Homo sapiens
aagatagctccttcatgcttt

SEQ ID NO: 5345427 - DNA, 14 bp, Homo sapiens
aagatagctgtgac

SEQ ID NO: 5345428 - DNA, 19 bp, Homo sapiens
aagataggactaaagttgt

SEQ ID NO: 5345429 - DNA, 17 bp, Homo sapiens
aagataggtttgagttc

SEQ ID NO: 5345430 - DNA, 14 bp, Homo sapiens
aagatagtgtaact

SEQ ID NO: 5345431 - DNA, 20 bp, Homo sapiens
aagatagttacatttatgtg

SEQ ID NO: 5345432 - DNA, 16 bp, Homo sapiens
aagatataagtgctgt

SEQ ID NO: 5345433 - DNA, 14 bp, Homo sapiens
aagatatacatgaa

SEQ ID NO: 5345434 - DNA, 16 bp, Homo sapiens
aagatatatatatata

SEQ ID NO: 5345435 - DNA, 21 bp, Homo sapiens
aagatatatattcaccaatgt

SEQ ID NO: 5345436 - DNA, 20 bp, Homo sapiens
aagatatatgtgtatacata

SEQ ID NO: 5345437 - DNA, 11 bp, Homo sapiens
aagatatatta

SEQ ID NO: 5345438 - DNA, 19 bp, Homo sapiens
aagatatattaaaaatata

SEQ ID NO: 5345439 - DNA, 20 bp, Homo sapiens
aagatatattaaaaatataa

SEQ ID NO: 5345440 - DNA, 15 bp, Homo sapiens
aagatatattttgag

SEQ ID NO: 5345441 - DNA, 17 bp, Homo sapiens
aagatatcagagctctt

SEQ ID NO: 5345442 - DNA, 18 bp, Homo sapiens
aagatatcagagctctta

SEQ ID NO: 5345443 - DNA, 20 bp, Homo sapiens
aagatatccatctttttctt

SEQ ID NO: 5345444 - DNA, 13 bp, Homo sapiens
aagatatcttttc

SEQ ID NO: 5345445 - DNA, 12 bp, Homo sapiens
aagatatggaca

SEQ ID NO: 5345446 - DNA, 15 bp, Homo sapiens
aagatatggagaatt

SEQ ID NO: 5345447 - DNA, 23 bp, Homo sapiens
aagatatgtaacaacaattattt

SEQ ID NO: 5345448 - DNA, 13 bp, Homo sapiens
aagatatgtatat

SEQ ID NO: 5345449 - DNA, 17 bp, Homo sapiens
aagatattaccctcaga

SEQ ID NO: 5345450 - DNA, 13 bp, Homo sapiens
aagatattatgta

SEQ ID NO: 5345451 - DNA, 21 bp, Homo sapiens
aagatattatgtataaaatgt

SEQ ID NO: 5345452 - DNA, 22 bp, Homo sapiens
aagatattatgtataaaatgta

SEQ ID NO: 5345453 - DNA, 19 bp, Homo sapiens
aagatattgatcaaatata

SEQ ID NO: 5345454 - DNA, 13 bp, Homo sapiens
aagatattgtaca

SEQ ID NO: 5345455 - DNA, 17 bp, Homo sapiens
aagatattgtacataaa

SEQ ID NO: 5345456 - DNA, 17 bp, Homo sapiens
aagatattgtatctcct

SEQ ID NO: 5345457 - DNA, 17 bp, Homo sapiens
aagatattgtattatca

SEQ ID NO: 5345458 - DNA, 18 bp, Homo sapiens
aagatattgtattatcat

SEQ ID NO: 5345459 - DNA, 19 bp, Homo sapiens
aagatattgtattatcata

SEQ ID NO: 5345460 - DNA, 21 bp, Homo sapiens
aagatattgtattatcatata

SEQ ID NO: 5345461 - DNA, 22 bp, Homo sapiens
aagatattgtattatcatatat

SEQ ID NO: 5345462 - DNA, 14 bp, Homo sapiens
aagatattgttcaa

SEQ ID NO: 5345463 - DNA, 20 bp, Homo sapiens
aagatattgttgttttccat

SEQ ID NO: 5345464 - DNA, 15 bp, Homo sapiens
aagatatttatatgt

SEQ ID NO: 5345465 - DNA, 13 bp, Homo sapiens
aagatatttccaa

SEQ ID NO: 5345466 - DNA, 18 bp, Homo sapiens
aagatatttctttaaatt

SEQ ID NO: 5345467 - DNA, 19 bp, Homo sapiens
aagatattttatttctgat

SEQ ID NO: 5345468 - DNA, 15 bp, Homo sapiens
aagatattttgcttt

SEQ ID NO: 5345469 - DNA, 22 bp, Homo sapiens
aagatattttgctttgtgattt

SEQ ID NO: 5345470 - DNA, 15 bp, Homo sapiens
aagatatttttcatg

SEQ ID NO: 5345471 - DNA, 13 bp, Homo sapiens
aagatatttttcc

SEQ ID NO: 5345472 - DNA, 17 bp, Homo sapiens
aagatcaaaataaaaag

SEQ ID NO: 5345473 - DNA, 13 bp, Homo sapiens
aagatcaaatgaa

SEQ ID NO: 5345474 - DNA, 20 bp, Homo sapiens
aagatcaagaaatgtctctg

SEQ ID NO: 5345475 - DNA, 22 bp, Homo sapiens
aagatcacaccaatttagaatg

SEQ ID NO: 5345476 - DNA, 15 bp, Homo sapiens
aagatcaccttgtat

SEQ ID NO: 5345477 - DNA, 22 bp, Homo sapiens
aagatcacgccactgcactcca

SEQ ID NO: 5345478 - DNA, 24 bp, Homo sapiens
aagatcactgtagtttagttctgt

SEQ ID NO: 5345479 - DNA, 19 bp, Homo sapiens
aagatcacttgttgtttta

SEQ ID NO: 5345480 - DNA, 23 bp, Homo sapiens
aagatcactttctcagttttcat

SEQ ID NO: 5345481 - DNA, 18 bp, Homo sapiens
aagatcactttgctctga

SEQ ID NO: 5345482 - DNA, 22 bp, Homo sapiens
aagatcagaacattcagctctg

SEQ ID NO: 5345483 - DNA, 17 bp, Homo sapiens
aagatcatagttgcaaa

SEQ ID NO: 5345484 - DNA, 20 bp, Homo sapiens
aagatcattgaagaccagct

SEQ ID NO: 5345485 - DNA, 14 bp, Homo sapiens
aagatcattggagt

SEQ ID NO: 5345486 - DNA, 13 bp, Homo sapiens
aagatcatttata

SEQ ID NO: 5345487 - DNA, 20 bp, Homo sapiens
aagatccaaatgctgtgcaa

SEQ ID NO: 5345488 - DNA, 17 bp, Homo sapiens
aagatccaagcaaaact

SEQ ID NO: 5345489 - DNA, 18 bp, Homo sapiens
aagatccaattcatcttt

SEQ ID NO: 5345490 - DNA, 20 bp, Homo sapiens
aagatccaccccctgcccac

SEQ ID NO: 5345491 - DNA, 15 bp, Homo sapiens
aagatccaccctcaa

SEQ ID NO: 5345492 - DNA, 23 bp, Homo sapiens
aagatccaccctcaaatgtcaga

SEQ ID NO: 5345493 - DNA, 14 bp, Homo sapiens
aagatccagctgcc

SEQ ID NO: 5345494 - DNA, 15 bp, Homo sapiens
aagatccatttgcct

SEQ ID NO: 5345495 - DNA, 16 bp, Homo sapiens
aagatccccaactgct

SEQ ID NO: 5345496 - DNA, 20 bp, Homo sapiens
aagatccccaactgctccag

SEQ ID NO: 5345497 - DNA, 15 bp, Homo sapiens
aagatcccctcagga

SEQ ID NO: 5345498 - DNA, 23 bp, Homo sapiens
aagatccgagtgtgatttgaatt

SEQ ID NO: 5345499 - DNA, 15 bp, Homo sapiens
aagatccgtggtttg

SEQ ID NO: 5345500 - DNA, 16 bp, Homo sapiens
aagatcctaaactctc

SEQ ID NO: 5345501 - DNA, 19 bp, Homo sapiens
aagatcctccttccaggcc

SEQ ID NO: 5345502 - DNA, 14 bp, Homo sapiens
aagatcctgaagca

SEQ ID NO: 5345503 - DNA, 21 bp, Homo sapiens
aagatcctgtctttaaggaaa

SEQ ID NO: 5345504 - DNA, 15 bp, Homo sapiens
aagatcgctgtgcta

SEQ ID NO: 5345505 - DNA, 22 bp, Homo sapiens
aagatcgctgtgctaggtctga

SEQ ID NO: 5345506 - DNA, 20 bp, Homo sapiens
aagatcggctttcatgtaat

SEQ ID NO: 5345507 - DNA, 16 bp, Homo sapiens
aagatcgttctctgcc

SEQ ID NO: 5345508 - DNA, 11 bp, Homo sapiens
aagatctacag

SEQ ID NO: 5345509 - DNA, 13 bp, Homo sapiens
aagatctacatga

SEQ ID NO: 5345510 - DNA, 17 bp, Homo sapiens
aagatctacctgcaaca

SEQ ID NO: 5345511 - DNA, 18 bp, Homo sapiens
aagatctcagataaagtg

SEQ ID NO: 5345512 - DNA, 22 bp, Homo sapiens
aagatctctagagtttagtcct

SEQ ID NO: 5345513 - DNA, 15 bp, Homo sapiens
aagatctctgtcaca

SEQ ID NO: 5345514 - DNA, 19 bp, Homo sapiens
aagatctctgtcacatcca

SEQ ID NO: 5345515 - DNA, 12 bp, Homo sapiens
aagatctgattt

SEQ ID NO: 5345516 - DNA, 23 bp, Homo sapiens
aagatctgcagggggtgtgtctg

SEQ ID NO: 5345517 - DNA, 16 bp, Homo sapiens
aagatctgccagacct

SEQ ID NO: 5345518 - DNA, 17 bp, Homo sapiens
aagatctgccagacctg

SEQ ID NO: 5345519 - DNA, 16 bp, Homo sapiens
aagatctgctcctcgc

SEQ ID NO: 5345520 - DNA, 17 bp, Homo sapiens
aagatctgtcctcagcc

SEQ ID NO: 5345521 - DNA, 19 bp, Homo sapiens
aagatctgtcctcagcctt

SEQ ID NO: 5345522 - DNA, 20 bp, Homo sapiens
aagatctgttttgaaggcaa

SEQ ID NO: 5345523 - DNA, 13 bp, Homo sapiens
aagatcttagatt

SEQ ID NO: 5345524 - DNA, 15 bp, Homo sapiens
aagatcttagattct

SEQ ID NO: 5345525 - DNA, 23 bp, Homo sapiens
aagatcttagattctctgtgtct

SEQ ID NO: 5345526 - DNA, 17 bp, Homo sapiens
aagatcttcaaaagtaa

SEQ ID NO: 5345527 - DNA, 18 bp, Homo sapiens
aagatcttgagagctgct

SEQ ID NO: 5345528 - DNA, 20 bp, Homo sapiens
aagatcttgagagctgctga

SEQ ID NO: 5345529 - DNA, 21 bp, Homo sapiens
aagatcttgagagctgctgag

SEQ ID NO: 5345530 - DNA, 19 bp, Homo sapiens
aagatcttgcagaagttct

SEQ ID NO: 5345531 - DNA, 15 bp, Homo sapiens
aagatcttgttaaag

SEQ ID NO: 5345532 - DNA, 20 bp, Homo sapiens
aagatctttatatttcaata

SEQ ID NO: 5345533 - DNA, 22 bp, Homo sapiens
aagatctttcattttgcacctg

SEQ ID NO: 5345534 - DNA, 21 bp, Homo sapiens
aagatcttttaaaaaggcagt

SEQ ID NO: 5345535 - DNA, 17 bp, Homo sapiens
aagatcttttattttgc

SEQ ID NO: 5345536 - DNA, 14 bp, Homo sapiens
aagatgaaaaaaat

SEQ ID NO: 5345537 - DNA, 20 bp, Homo sapiens
aagatgaaaaatggtccctt

SEQ ID NO: 5345538 - DNA, 14 bp, Homo sapiens
aagatgaaaatatt

SEQ ID NO: 5345539 - DNA, 14 bp, Homo sapiens
aagatgaaacatca

SEQ ID NO: 5345540 - DNA, 19 bp, Homo sapiens
aagatgaaaccgtccctga

SEQ ID NO: 5345541 - DNA, 16 bp, Homo sapiens
aagatgaaagagcagt

SEQ ID NO: 5345542 - DNA, 21 bp, Homo sapiens
aagatgaaaggcaggcctatt

SEQ ID NO: 5345543 - DNA, 13 bp, Homo sapiens
aagatgaaatata

SEQ ID NO: 5345544 - DNA, 13 bp, Homo sapiens
aagatgaaattgc

SEQ ID NO: 5345545 - DNA, 16 bp, Homo sapiens
aagatgaaattgccaa

SEQ ID NO: 5345546 - DNA, 23 bp, Homo sapiens
aagatgaacccgaggctgagaat

SEQ ID NO: 5345547 - DNA, 19 bp, Homo sapiens
aagatgaagaagaaaacat

SEQ ID NO: 5345548 - DNA, 13 bp, Homo sapiens
aagatgaagagaa

SEQ ID NO: 5345549 - DNA, 16 bp, Homo sapiens
aagatgaatcagtatg

SEQ ID NO: 5345550 - DNA, 16 bp, Homo sapiens
aagatgaatgtcagtt

SEQ ID NO: 5345551 - DNA, 22 bp, Homo sapiens
aagatgaatttgtccaattgtg

SEQ ID NO: 5345552 - DNA, 17 bp, Homo sapiens
aagatgacattgctaag

SEQ ID NO: 5345553 - DNA, 16 bp, Homo sapiens
aagatgacctgcccca

SEQ ID NO: 5345554 - DNA, 17 bp, Homo sapiens
aagatgacctgccccaa

SEQ ID NO: 5345555 - DNA, 13 bp, Homo sapiens
aagatgactctga

SEQ ID NO: 5345556 - DNA, 15 bp, Homo sapiens
aagatgactctgaga

SEQ ID NO: 5345557 - DNA, 17 bp, Homo sapiens
aagatgactgtgttgta

SEQ ID NO: 5345558 - DNA, 22 bp, Homo sapiens
aagatgagaacagataaagatt

SEQ ID NO: 5345559 - DNA, 17 bp, Homo sapiens
aagatgagagaactgga

SEQ ID NO: 5345560 - DNA, 20 bp, Homo sapiens
aagatgagattggcatggct

SEQ ID NO: 5345561 - DNA, 22 bp, Homo sapiens
aagatgagattggcatggcttt

SEQ ID NO: 5345562 - DNA, 18 bp, Homo sapiens
aagatgagcctgggctca

SEQ ID NO: 5345563 - DNA, 22 bp, Homo sapiens
aagatgagccttgcagatatct

SEQ ID NO: 5345564 - DNA, 22 bp, Homo sapiens
aagatgagctctgaacaaacac

SEQ ID NO: 5345565 - DNA, 16 bp, Homo sapiens
aagatgagtaggagtt

SEQ ID NO: 5345566 - DNA, 14 bp, Homo sapiens
aagatgatggaaac

SEQ ID NO: 5345567 - DNA, 22 bp, Homo sapiens
aagatgatggaaacgcacttac

SEQ ID NO: 5345568 - DNA, 22 bp, Homo sapiens
aagatgattcaaagtagtttta

SEQ ID NO: 5345569 - DNA, 15 bp, Homo sapiens
aagatgattgttctt

SEQ ID NO: 5345570 - DNA, 14 bp, Homo sapiens
aagatgcaaatgca

SEQ ID NO: 5345571 - DNA, 15 bp, Homo sapiens
aagatgcaaggacca

SEQ ID NO: 5345572 - DNA, 20 bp, Homo sapiens
aagatgcaaggaccaggact

SEQ ID NO: 5345573 - DNA, 12 bp, Homo sapiens
aagatgcactga

SEQ ID NO: 5345574 - DNA, 23 bp, Homo sapiens
aagatgcactgaaaacttagcca

SEQ ID NO: 5345575 - DNA, 23 bp, Homo sapiens
aagatgcactttgctttaatata

SEQ ID NO: 5345576 - DNA, 23 bp, Homo sapiens
aagatgcatcatctcttcctcac

SEQ ID NO: 5345577 - DNA, 18 bp, Homo sapiens
aagatgcattgtagttta

SEQ ID NO: 5345578 - DNA, 12 bp, Homo sapiens
aagatgccaagg

SEQ ID NO: 5345579 - DNA, 18 bp, Homo sapiens
aagatgccaattattgtt

SEQ ID NO: 5345580 - DNA, 15 bp, Homo sapiens
aagatgccacattca

SEQ ID NO: 5345581 - DNA, 22 bp, Homo sapiens
aagatgccacattcaaaatagg

SEQ ID NO: 5345582 - DNA, 15 bp, Homo sapiens
aagatgccagcttct

SEQ ID NO: 5345583 - DNA, 24 bp, Homo sapiens
aagatgcccactgaggaatgatga

SEQ ID NO: 5345584 - DNA, 16 bp, Homo sapiens
aagatgccccagggat

SEQ ID NO: 5345585 - DNA, 22 bp, Homo sapiens
aagatgccccagggatgggagg

SEQ ID NO: 5345586 - DNA, 18 bp, Homo sapiens
aagatgcctgttaattta

SEQ ID NO: 5345587 - DNA, 16 bp, Homo sapiens
aagatgcgtttgcctc

SEQ ID NO: 5345588 - DNA, 18 bp, Homo sapiens
aagatgcgtttgcctcct

SEQ ID NO: 5345589 - DNA, 20 bp, Homo sapiens
aagatgctaatagaaaactg

SEQ ID NO: 5345590 - DNA, 20 bp, Homo sapiens
aagatgctacaatggaaacc

SEQ ID NO: 5345591 - DNA, 22 bp, Homo sapiens
aagatgctctatcttgctctgt

SEQ ID NO: 5345592 - DNA, 17 bp, Homo sapiens
aagatgctcttctgtgg

SEQ ID NO: 5345593 - DNA, 18 bp, Homo sapiens
aagatgctgctgagcaca

SEQ ID NO: 5345594 - DNA, 16 bp, Homo sapiens
aagatgcttctcactg

SEQ ID NO: 5345595 - DNA, 11 bp, Homo sapiens
aagcacttttt

SEQ ID NO: 5345596 - DNA, 16 bp, Homo sapiens
aagcactttttaaaaa

SEQ ID NO: 5345597 - DNA, 13 bp, Homo sapiens
aagcagaaaaatt

SEQ ID NO: 5345598 - DNA, 17 bp, Homo sapiens
aagcagaaaacaagaga

SEQ ID NO: 5345599 - DNA, 20 bp, Homo sapiens
aagcagaaaataaaggaagc

SEQ ID NO: 5345600 - DNA, 20 bp, Homo sapiens
aagcagaaaatacagctgga

SEQ ID NO: 5345601 - DNA, 23 bp, Homo sapiens
aagcagaaagtgcctttcaggat

SEQ ID NO: 5345602 - DNA, 16 bp, Homo sapiens
aagcagaaatccaagc

SEQ ID NO: 5345603 - DNA, 17 bp, Homo sapiens
aagcagaacaaatgtgt

SEQ ID NO: 5345604 - DNA, 19 bp, Homo sapiens
aagcagaacaaatgtgttt

SEQ ID NO: 5345605 - DNA, 11 bp, Homo sapiens
aagcagaagga

SEQ ID NO: 5345606 - DNA, 17 bp, Homo sapiens
aagcagaagggcagatg

SEQ ID NO: 5345607 - DNA, 17 bp, Homo sapiens
aagcagaagtctggctt

SEQ ID NO: 5345608 - DNA, 18 bp, Homo sapiens
aagcagaataaagcaatt

SEQ ID NO: 5345609 - DNA, 19 bp, Homo sapiens
aagcagaataaagcaattt

SEQ ID NO: 5345610 - DNA, 20 bp, Homo sapiens
aagcagaataaagcaatttt

SEQ ID NO: 5345611 - DNA, 23 bp, Homo sapiens
aagcagaataaagcaattttcct

SEQ ID NO: 5345612 - DNA, 17 bp, Homo sapiens
aagcagaatcctcagtt

SEQ ID NO: 5345613 - DNA, 12 bp, Homo sapiens
aagcagaatgag

SEQ ID NO: 5345614 - DNA, 16 bp, Homo sapiens
aagcagaatgagatga

SEQ ID NO: 5345615 - DNA, 14 bp, Homo sapiens
aagcagaatgtgat

SEQ ID NO: 5345616 - DNA, 15 bp, Homo sapiens
aagcagaattgcttg

SEQ ID NO: 5345617 - DNA, 21 bp, Homo sapiens
aagcagaattggaaaagacta

SEQ ID NO: 5345618 - DNA, 16 bp, Homo sapiens
aagcagaattttaatg

SEQ ID NO: 5345619 - DNA, 15 bp, Homo sapiens
aagcagacagctcca

SEQ ID NO: 5345620 - DNA, 21 bp, Homo sapiens
aagcagacattttcctcacac

SEQ ID NO: 5345621 - DNA, 17 bp, Homo sapiens
aagcagacgcagcagct

SEQ ID NO: 5345622 - DNA, 23 bp, Homo sapiens
aagcagacgtgagtgtgactttt

SEQ ID NO: 5345623 - DNA, 19 bp, Homo sapiens
aagcagactccagcccctg

SEQ ID NO: 5345624 - DNA, 23 bp, Homo sapiens
aagcagactccagcccctggacc

SEQ ID NO: 5345625 - DNA, 16 bp, Homo sapiens
aagcagagaagctctc

SEQ ID NO: 5345626 - DNA, 19 bp, Homo sapiens
aagcagagagtccaattta

SEQ ID NO: 5345627 - DNA, 22 bp, Homo sapiens
aagcagagcattttttatgata

SEQ ID NO: 5345628 - DNA, 14 bp, Homo sapiens
aagcagagcctcct

SEQ ID NO: 5345629 - DNA, 18 bp, Homo sapiens
aagcagagcctcctggga

SEQ ID NO: 5345630 - DNA, 15 bp, Homo sapiens
aagcagagcctgggg

SEQ ID NO: 5345631 - DNA, 16 bp, Homo sapiens
aagcagagcctggggt

SEQ ID NO: 5345632 - DNA, 15 bp, Homo sapiens
aagcagaggaaggaa

SEQ ID NO: 5345633 - DNA, 21 bp, Homo sapiens
aagcagaggaaggagaggaga

SEQ ID NO: 5345634 - DNA, 13 bp, Homo sapiens
aagcagaggacca

SEQ ID NO: 5345635 - DNA, 12 bp, Homo sapiens
aagcagaggagg

SEQ ID NO: 5345636 - DNA, 15 bp, Homo sapiens
aagcagaggccctgc

SEQ ID NO: 5345637 - DNA, 17 bp, Homo sapiens
aagcagaggccctgccc

SEQ ID NO: 5345638 - DNA, 22 bp, Homo sapiens
aagcagaggccctgcccccacc

SEQ ID NO: 5345639 - DNA, 18 bp, Homo sapiens
aagcagaggctggcctca

SEQ ID NO: 5345640 - DNA, 20 bp, Homo sapiens
aagcagaggctggcctcaga

SEQ ID NO: 5345641 - DNA, 21 bp, Homo sapiens
aagcagaggctttggggtcct

SEQ ID NO: 5345642 - DNA, 19 bp, Homo sapiens
aagcagagtaacaggatca

SEQ ID NO: 5345643 - DNA, 19 bp, Homo sapiens
aagcagagtcaagctgatg

SEQ ID NO: 5345644 - DNA, 15 bp, Homo sapiens
aagcagagtggactg

SEQ ID NO: 5345645 - DNA, 21 bp, Homo sapiens
aagcagagtggactgcattta

SEQ ID NO: 5345646 - DNA, 14 bp, Homo sapiens
aagcagagtggcag

SEQ ID NO: 5345647 - DNA, 17 bp, Homo sapiens
aagcagagttctttgca

SEQ ID NO: 5345648 - DNA, 21 bp, Homo sapiens
aagcagatgcaaagaggcaag

SEQ ID NO: 5345649 - DNA, 18 bp, Homo sapiens
aagcagatggacttgaaa

SEQ ID NO: 5345650 - DNA, 15 bp, Homo sapiens
aagcagattttccta

SEQ ID NO: 5345651 - DNA, 14 bp, Homo sapiens
aagcagcaacagcc

SEQ ID NO: 5345652 - DNA, 16 bp, Homo sapiens
aagcagcaactattca

SEQ ID NO: 5345653 - DNA, 19 bp, Homo sapiens
aagcagcaaggtgggggtc

SEQ ID NO: 5345654 - DNA, 18 bp, Homo sapiens
aagcagcacacattgtgt

SEQ ID NO: 5345655 - DNA, 23 bp, Homo sapiens
aagcagcactcaaacctggagct

SEQ ID NO: 5345656 - DNA, 15 bp, Homo sapiens
aagcagcactgtgag

SEQ ID NO: 5345657 - DNA, 12 bp, Homo sapiens
aagcagcagcct

SEQ ID NO: 5345658 - DNA, 16 bp, Homo sapiens
aagcagcagcctcgcc

SEQ ID NO: 5345659 - DNA, 13 bp, Homo sapiens
aagcagcagctag

SEQ ID NO: 5345660 - DNA, 18 bp, Homo sapiens
aagcagcagctagaaaga

SEQ ID NO: 5345661 - DNA, 19 bp, Homo sapiens
aagcagcagctagaaagag

SEQ ID NO: 5345662 - DNA, 14 bp, Homo sapiens
aagcagcagtgtcc

SEQ ID NO: 5345663 - DNA, 19 bp, Homo sapiens
aagcagcatggaaaaatgg

SEQ ID NO: 5345664 - DNA, 20 bp, Homo sapiens
aagcagcatggaaaaatggt

SEQ ID NO: 5345665 - DNA, 14 bp, Homo sapiens
aagcagcattcagc

SEQ ID NO: 5345666 - DNA, 13 bp, Homo sapiens
aagcagccagcca

SEQ ID NO: 5345667 - DNA, 16 bp, Homo sapiens
aagcagccagccgtga

SEQ ID NO: 5345668 - DNA, 11 bp, Homo sapiens
aagcagccagg

SEQ ID NO: 5345669 - DNA, 14 bp, Homo sapiens
aagcagcccctcga

SEQ ID NO: 5345670 - DNA, 20 bp, Homo sapiens
aagcagcccctcgaggccta

SEQ ID NO: 5345671 - DNA, 17 bp, Homo sapiens
aagcagcccttggccag

SEQ ID NO: 5345672 - DNA, 11 bp, Homo sapiens
aagcagcctga

SEQ ID NO: 5345673 - DNA, 18 bp, Homo sapiens
aagcagcctgattgaaaa

SEQ ID NO: 5345674 - DNA, 17 bp, Homo sapiens
aagcagccttgatatgt

SEQ ID NO: 5345675 - DNA, 14 bp, Homo sapiens
aagcagcctttctg

SEQ ID NO: 5345676 - DNA, 19 bp, Homo sapiens
aagcagcctttctgtggag

SEQ ID NO: 5345677 - DNA, 14 bp, Homo sapiens
aagcagcgtttcta

SEQ ID NO: 5345678 - DNA, 19 bp, Homo sapiens
aagcagctaaatgtaactt

SEQ ID NO: 5345679 - DNA, 22 bp, Homo sapiens
aagcagctaaatgtaacttatt

SEQ ID NO: 5345680 - DNA, 24 bp, Homo sapiens
aagcagctaaatgtaacttattcc

SEQ ID NO: 5345681 - DNA, 20 bp, Homo sapiens
aagcagctaacaatgtctgg

SEQ ID NO: 5345682 - DNA, 17 bp, Homo sapiens
aagcagctctcccctca

SEQ ID NO: 5345683 - DNA, 22 bp, Homo sapiens
aagcagctgattcagcagtgcc

SEQ ID NO: 5345684 - DNA, 21 bp, Homo sapiens
aagcagctttaaacaaattca

SEQ ID NO: 5345685 - DNA, 20 bp, Homo sapiens
aagcaggaaagatcccaagt

SEQ ID NO: 5345686 - DNA, 12 bp, Homo sapiens
aagcaggaagct

SEQ ID NO: 5345687 - DNA, 16 bp, Homo sapiens
aagcaggaaggatggc

SEQ ID NO: 5345688 - DNA, 13 bp, Homo sapiens
aagcaggacccag

SEQ ID NO: 5345689 - DNA, 23 bp, Homo sapiens
aagcaggactttgaggcaagtgt

SEQ ID NO: 5345690 - DNA, 18 bp, Homo sapiens
aagcaggagacgacaggc

SEQ ID NO: 5345691 - DNA, 13 bp, Homo sapiens
aagcaggagcagc

SEQ ID NO: 5345692 - DNA, 11 bp, Homo sapiens
aagcaggaggc

SEQ ID NO: 5345693 - DNA, 17 bp, Homo sapiens
aagcaggaggcccttgt

SEQ ID NO: 5345694 - DNA, 19 bp, Homo sapiens
aagcaggatgaattttctg

SEQ ID NO: 5345695 - DNA, 15 bp, Homo sapiens
aagcaggatggctgg

SEQ ID NO: 5345696 - DNA, 16 bp, Homo sapiens
aagcaggcaggcagcc

SEQ ID NO: 5345697 - DNA, 23 bp, Homo sapiens
aagcaggccttagtacggctgct

SEQ ID NO: 5345698 - DNA, 16 bp, Homo sapiens
aagcaggctcaacata

SEQ ID NO: 5345699 - DNA, 11 bp, Homo sapiens
aagcaggctgg

SEQ ID NO: 5345700 - DNA, 15 bp, Homo sapiens
aagcaggctggaggt

SEQ ID NO: 5345701 - DNA, 18 bp, Homo sapiens
aagcaggcttctatgaaa

SEQ ID NO: 5345702 - DNA, 21 bp, Homo sapiens
aagcaggcttgcccagtacat

SEQ ID NO: 5345703 - DNA, 18 bp, Homo sapiens
aagcagggaaagctccac

SEQ ID NO: 5345704 - DNA, 22 bp, Homo sapiens
aagcagggacaccccccgcccc

SEQ ID NO: 5345705 - DNA, 22 bp, Homo sapiens
aagcagggcagcagggaacaaa

SEQ ID NO: 5345706 - DNA, 18 bp, Homo sapiens
aagcaggggagtatgcaa

SEQ ID NO: 5345707 - DNA, 22 bp, Homo sapiens
aagcaggggctacaagagggaa

SEQ ID NO: 5345708 - DNA, 17 bp, Homo sapiens
aagcagggtctgggcag

SEQ ID NO: 5345709 - DNA, 18 bp, Homo sapiens
aagcaggtgcaacactca

SEQ ID NO: 5345710 - DNA, 17 bp, Homo sapiens
aagcaggtgctacaaca

SEQ ID NO: 5345711 - DNA, 22 bp, Homo sapiens
aagcaggtggatctatttcatg

SEQ ID NO: 5345712 - DNA, 18 bp, Homo sapiens
aagcaggtgtcctttccc

SEQ ID NO: 5345713 - DNA, 16 bp, Homo sapiens
aagcaggttaaatgtt

SEQ ID NO: 5345714 - DNA, 15 bp, Homo sapiens
aagcaggttagagaa

SEQ ID NO: 5345715 - DNA, 15 bp, Homo sapiens
aagcaggttgataaa

SEQ ID NO: 5345716 - DNA, 17 bp, Homo sapiens
aagcaggtttcaaggaa

SEQ ID NO: 5345717 - DNA, 19 bp, Homo sapiens
aagcaggtttcaaggaagt

SEQ ID NO: 5345718 - DNA, 17 bp, Homo sapiens
aagcaggtttgttttca

SEQ ID NO: 5345719 - DNA, 22 bp, Homo sapiens
aagcagtaaaaactgttctcta

SEQ ID NO: 5345720 - DNA, 15 bp, Homo sapiens
aagcagtaaaataaa

SEQ ID NO: 5345721 - DNA, 18 bp, Homo sapiens
aagcagtaaaataaaaaa

SEQ ID NO: 5345722 - DNA, 15 bp, Homo sapiens
aagcagtacatcttg

SEQ ID NO: 5345723 - DNA, 14 bp, Homo sapiens
aagcagtagacaag

SEQ ID NO: 5345724 - DNA, 22 bp, Homo sapiens
aagcagtatataataactttat

SEQ ID NO: 5345725 - DNA, 20 bp, Homo sapiens
aagcagtatattagtattat

SEQ ID NO: 5345726 - DNA, 16 bp, Homo sapiens
aagcagtcacttttcc

SEQ ID NO: 5345727 - DNA, 17 bp, Homo sapiens
aagcagtcacttttcct

SEQ ID NO: 5345728 - DNA, 17 bp, Homo sapiens
aagcagtcagcggagag

SEQ ID NO: 5345729 - DNA, 16 bp, Homo sapiens
aagcagtcccattcat

SEQ ID NO: 5345730 - DNA, 20 bp, Homo sapiens
aagcagtcctcttattccta

SEQ ID NO: 5345731 - DNA, 14 bp, Homo sapiens
aagcagtcctgttc

SEQ ID NO: 5345732 - DNA, 17 bp, Homo sapiens
aagcagtctaccctgtc

SEQ ID NO: 5345733 - DNA, 12 bp, Homo sapiens
aagcagtgcatg

SEQ ID NO: 5345734 - DNA, 15 bp, Homo sapiens
aagcagtgcatgctg

SEQ ID NO: 5345735 - DNA, 17 bp, Homo sapiens
aagcagtgccctctgga

SEQ ID NO: 5345736 - DNA, 12 bp, Homo sapiens
aagcagtgcctc

SEQ ID NO: 5345737 - DNA, 17 bp, Homo sapiens
aagcagtgcctcgaggc

SEQ ID NO: 5345738 - DNA, 21 bp, Homo sapiens
aagcagtggggtaggctgctg

SEQ ID NO: 5345739 - DNA, 18 bp, Homo sapiens
aagcagtgtcgccgtccc

SEQ ID NO: 5345740 - DNA, 18 bp, Homo sapiens
aagcagtgtgtccttggg

SEQ ID NO: 5345741 - DNA, 14 bp, Homo sapiens
aagcagtgtttgct

SEQ ID NO: 5345742 - DNA, 14 bp, Homo sapiens
aagcagtgttttca

SEQ ID NO: 5345743 - DNA, 16 bp, Homo sapiens
aagcagttaatttata

SEQ ID NO: 5345744 - DNA, 19 bp, Homo sapiens
aagcagttctcccaccagc

SEQ ID NO: 5345745 - DNA, 19 bp, Homo sapiens
aagcagttctgatgcttac

SEQ ID NO: 5345746 - DNA, 22 bp, Homo sapiens
aagcagttggggccctcttgcc

SEQ ID NO: 5345747 - DNA, 23 bp, Homo sapiens
aagcagttggggccctcttgcca

SEQ ID NO: 5345748 - DNA, 14 bp, Homo sapiens
aagcagtttcaata

SEQ ID NO: 5345749 - DNA, 19 bp, Homo sapiens
aagcagtttcaataaagtt

SEQ ID NO: 5345750 - DNA, 20 bp, Homo sapiens
aagcagtttcaataaagttt

SEQ ID NO: 5345751 - DNA, 22 bp, Homo sapiens
aagcagtttcaataaagtttga

SEQ ID NO: 5345752 - DNA, 13 bp, Homo sapiens
aagcagtttttaa

SEQ ID NO: 5345753 - DNA, 12 bp, Homo sapiens
aagcataaacat

SEQ ID NO: 5345754 - DNA, 15 bp, Homo sapiens
aagcataaacatcac

SEQ ID NO: 5345755 - DNA, 20 bp, Homo sapiens
aagcataaagttacctacat

SEQ ID NO: 5345756 - DNA, 22 bp, Homo sapiens
aagcataaatgcaaacacacaa

SEQ ID NO: 5345757 - DNA, 19 bp, Homo sapiens
aagcataagcttaagcatt

SEQ ID NO: 5345758 - DNA, 20 bp, Homo sapiens
aagcataatttgtttaaaat

SEQ ID NO: 5345759 - DNA, 21 bp, Homo sapiens
aagcatagataatattgtttg

SEQ ID NO: 5345760 - DNA, 16 bp, Homo sapiens
aagcataggaattgga

SEQ ID NO: 5345761 - DNA, 22 bp, Homo sapiens
aagcatataaaatggcaacaaa

SEQ ID NO: 5345762 - DNA, 17 bp, Homo sapiens
aagcatatataaaacaa

SEQ ID NO: 5345763 - DNA, 21 bp, Homo sapiens
aagcatatataactattttaa

SEQ ID NO: 5345764 - DNA, 23 bp, Homo sapiens
aagcatatatttttatatttact

SEQ ID NO: 5345765 - DNA, 18 bp, Homo sapiens
aagcatatcccaccaacc

SEQ ID NO: 5345766 - DNA, 23 bp, Homo sapiens
aagcatatgcctacttgtaattt

SEQ ID NO: 5345767 - DNA, 19 bp, Homo sapiens
aagcatatgggttagatgt

SEQ ID NO: 5345768 - DNA, 21 bp, Homo sapiens
aagcatatgggttagatgttg

SEQ ID NO: 5345769 - DNA, 17 bp, Homo sapiens
aagcatatgtgttactt

SEQ ID NO: 5345770 - DNA, 17 bp, Homo sapiens
aagcatattgttattat

SEQ ID NO: 5345771 - DNA, 23 bp, Homo sapiens
aagcatattgttattatataatt

SEQ ID NO: 5345772 - DNA, 16 bp, Homo sapiens
aagcccacctgggctg

SEQ ID NO: 5345773 - DNA, 17 bp, Homo sapiens
aagcccactgcctcctc

SEQ ID NO: 5345774 - DNA, 14 bp, Homo sapiens
aagcccagacctcc

SEQ ID NO: 5345775 - DNA, 11 bp, Homo sapiens
aagcccagact

SEQ ID NO: 5345776 - DNA, 16 bp, Homo sapiens
aagcccagactttagt

SEQ ID NO: 5345777 - DNA, 22 bp, Homo sapiens
aagcccagactttagtgccctg

SEQ ID NO: 5345778 - DNA, 16 bp, Homo sapiens
aagcccagagggtctg

SEQ ID NO: 5345779 - DNA, 17 bp, Homo sapiens
aagcccagagggtctgg

SEQ ID NO: 5345780 - DNA, 23 bp, Homo sapiens
aagcccagcactgcttgaggaaa

SEQ ID NO: 5345781 - DNA, 11 bp, Homo sapiens
aagcccagccc

SEQ ID NO: 5345782 - DNA, 13 bp, Homo sapiens
aagcccagcccgg

SEQ ID NO: 5345783 - DNA, 13 bp, Homo sapiens
aagcccagcctgc

SEQ ID NO: 5345784 - DNA, 11 bp, Homo sapiens
aagcccagctc

SEQ ID NO: 5345785 - DNA, 19 bp, Homo sapiens
aagcccaggaaaggctcca

SEQ ID NO: 5345786 - DNA, 11 bp, Homo sapiens
aagcccaggac

SEQ ID NO: 5345787 - DNA, 12 bp, Homo sapiens
aagcccaggagg

SEQ ID NO: 5345788 - DNA, 13 bp, Homo sapiens
aagcccaggagga

SEQ ID NO: 5345789 - DNA, 15 bp, Homo sapiens
aagcccaggaggacc

SEQ ID NO: 5345790 - DNA, 20 bp, Homo sapiens
aagcccaggagtctgagacc

SEQ ID NO: 5345791 - DNA, 14 bp, Homo sapiens
aagcccaggctgga

SEQ ID NO: 5345792 - DNA, 20 bp, Homo sapiens
aagcccagggcaccatccag

SEQ ID NO: 5345793 - DNA, 17 bp, Homo sapiens
aagcccagtagccattt

SEQ ID NO: 5345794 - DNA, 18 bp, Homo sapiens
aagcccagtgacctgacc

SEQ ID NO: 5345795 - DNA, 17 bp, Homo sapiens
aagcccagtgctgctgt

SEQ ID NO: 5345796 - DNA, 17 bp, Homo sapiens
aagcccagtttcccttc

SEQ ID NO: 5345797 - DNA, 22 bp, Homo sapiens
aagcccatgagtccttgaaaat

SEQ ID NO: 5345798 - DNA, 21 bp, Homo sapiens
aagcccatggagcagggatgt

SEQ ID NO: 5345799 - DNA, 17 bp, Homo sapiens
aagcccatgtcttctgc

SEQ ID NO: 5345800 - DNA, 22 bp, Homo sapiens
aagccccacccaggccaggcat

SEQ ID NO: 5345801 - DNA, 17 bp, Homo sapiens
aagccccagcttggctc

SEQ ID NO: 5345802 - DNA, 12 bp, Homo sapiens
aagccccaggca

SEQ ID NO: 5345803 - DNA, 14 bp, Homo sapiens
aagccccagggcct

SEQ ID NO: 5345804 - DNA, 17 bp, Homo sapiens
aagccccatctcatcct

SEQ ID NO: 5345805 - DNA, 17 bp, Homo sapiens
aagccccatgctggagc

SEQ ID NO: 5345806 - DNA, 20 bp, Homo sapiens
aagccccatgggctgccttg

SEQ ID NO: 5345807 - DNA, 23 bp, Homo sapiens
aagccccatgtgccttgtccagg

SEQ ID NO: 5345808 - DNA, 15 bp, Homo sapiens
aagccccattaactg

SEQ ID NO: 5345809 - DNA, 24 bp, Homo sapiens
aagccccattcacggcctggcatg

SEQ ID NO: 5345810 - DNA, 12 bp, Homo sapiens
aagcccccagag

SEQ ID NO: 5345811 - DNA, 14 bp, Homo sapiens
aagcccccagagcc

SEQ ID NO: 5345812 - DNA, 12 bp, Homo sapiens
aagcccccaggg

SEQ ID NO: 5345813 - DNA, 21 bp, Homo sapiens
aagcccccagggcctccaggg

SEQ ID NO: 5345814 - DNA, 13 bp, Homo sapiens
aagccccccagct

SEQ ID NO: 5345815 - DNA, 14 bp, Homo sapiens
aagcccccctttgg

SEQ ID NO: 5345816 - DNA, 13 bp, Homo sapiens
aagccccctgccc

SEQ ID NO: 5345817 - DNA, 16 bp, Homo sapiens
aagccccctggcagct

SEQ ID NO: 5345818 - DNA, 18 bp, Homo sapiens
aagcccccttctccatgg

SEQ ID NO: 5345819 - DNA, 18 bp, Homo sapiens
aagccccctttgattgag

SEQ ID NO: 5345820 - DNA, 13 bp, Homo sapiens
aagccccgaggcc

SEQ ID NO: 5345821 - DNA, 13 bp, Homo sapiens
aagccccgtctga

SEQ ID NO: 5345822 - DNA, 16 bp, Homo sapiens
aagcccctcacactgc

SEQ ID NO: 5345823 - DNA, 15 bp, Homo sapiens
aagcccctcacctca

SEQ ID NO: 5345824 - DNA, 18 bp, Homo sapiens
aagcccctcacctcagga

SEQ ID NO: 5345825 - DNA, 12 bp, Homo sapiens
aagcccctcagc

SEQ ID NO: 5345826 - DNA, 13 bp, Homo sapiens
aagcccctcagcc

SEQ ID NO: 5345827 - DNA, 16 bp, Homo sapiens
aagcccctcagccctt

SEQ ID NO: 5345828 - DNA, 18 bp, Homo sapiens
aagcccctgagtcctgag

SEQ ID NO: 5345829 - DNA, 17 bp, Homo sapiens
aagcccctgcccatctg

SEQ ID NO: 5345830 - DNA, 20 bp, Homo sapiens
aagcccctgggggctccctg

SEQ ID NO: 5345831 - DNA, 13 bp, Homo sapiens
aagcccctgtcta

SEQ ID NO: 5345832 - DNA, 19 bp, Homo sapiens
aagcccctgtgaccctctc

SEQ ID NO: 5345833 - DNA, 18 bp, Homo sapiens
aagccccttatttttagc

SEQ ID NO: 5345834 - DNA, 12 bp, Homo sapiens
aagccccttctc

SEQ ID NO: 5345835 - DNA, 17 bp, Homo sapiens
aagcccgacttgctgtt

SEQ ID NO: 5345836 - DNA, 14 bp, Homo sapiens
aagcccgcttgctc

SEQ ID NO: 5345837 - DNA, 15 bp, Homo sapiens
aagcccggctcctgg

SEQ ID NO: 5345838 - DNA, 18 bp, Homo sapiens
aagcccggctcctggtca

SEQ ID NO: 5345839 - DNA, 22 bp, Homo sapiens
aagcccgtcatcttccctttcc

SEQ ID NO: 5345840 - DNA, 17 bp, Homo sapiens
aagccctacagagctgt

SEQ ID NO: 5345841 - DNA, 18 bp, Homo sapiens
aagccctacgatgggatc

SEQ ID NO: 5345842 - DNA, 22 bp, Homo sapiens
aagccctactcggatggggcac

SEQ ID NO: 5345843 - DNA, 15 bp, Homo sapiens
aagccctatgtgaaa

SEQ ID NO: 5345844 - DNA, 18 bp, Homo sapiens
aagccctcagatcccagg

SEQ ID NO: 5345845 - DNA, 19 bp, Homo sapiens
aagccctcagatcccaggg

SEQ ID NO: 5345846 - DNA, 11 bp, Homo sapiens
aagccctcagc

SEQ ID NO: 5345847 - DNA, 15 bp, Homo sapiens
aagccctcattttta

SEQ ID NO: 5345848 - DNA, 17 bp, Homo sapiens
aagccctccacattttc

SEQ ID NO: 5345849 - DNA, 21 bp, Homo sapiens
aagccctcctccccagagctg

SEQ ID NO: 5345850 - DNA, 14 bp, Homo sapiens
aagccctccttcca

SEQ ID NO: 5345851 - DNA, 15 bp, Homo sapiens
aagccctgcctctgt

SEQ ID NO: 5345852 - DNA, 13 bp, Homo sapiens
aagccctgctctt

SEQ ID NO: 5345853 - DNA, 14 bp, Homo sapiens
aagccctgctcttt

SEQ ID NO: 5345854 - DNA, 19 bp, Homo sapiens
aagccctgctctttctctg

SEQ ID NO: 5345855 - DNA, 21 bp, Homo sapiens
aagccctggaattttaggaaa

SEQ ID NO: 5345856 - DNA, 13 bp, Homo sapiens
aagccctggagac

SEQ ID NO: 5345857 - DNA, 12 bp, Homo sapiens
aagccctggccc

SEQ ID NO: 5345858 - DNA, 17 bp, Homo sapiens
aagccctggcccccaca

SEQ ID NO: 5345859 - DNA, 23 bp, Homo sapiens
aagccctggcccccacagcgctc

SEQ ID NO: 5345860 - DNA, 19 bp, Homo sapiens
aagccctgggatcactgtg

SEQ ID NO: 5345861 - DNA, 19 bp, Homo sapiens
aagccctgtcgagacactt

SEQ ID NO: 5345862 - DNA, 12 bp, Homo sapiens
aagccctgttct

SEQ ID NO: 5345863 - DNA, 13 bp, Homo sapiens
aagccctgttctc

SEQ ID NO: 5345864 - DNA, 18 bp, Homo sapiens
aagccctgttctcctgtc

SEQ ID NO: 5345865 - DNA, 14 bp, Homo sapiens
aagccctgttctcg

SEQ ID NO: 5345866 - DNA, 18 bp, Homo sapiens
aagcccttcggtcacctg

SEQ ID NO: 5345867 - DNA, 15 bp, Homo sapiens
aagccctttgcctgt

SEQ ID NO: 5345868 - DNA, 16 bp, Homo sapiens
aagccctttttatcag

SEQ ID NO: 5345869 - DNA, 19 bp, Homo sapiens
aagccgactctggccctgg

SEQ ID NO: 5345870 - DNA, 14 bp, Homo sapiens
aagccgcagacctg

SEQ ID NO: 5345871 - DNA, 19 bp, Homo sapiens
aagccgcagacctggagct

SEQ ID NO: 5345872 - DNA, 19 bp, Homo sapiens
aagccgccagttcatcttt

SEQ ID NO: 5345873 - DNA, 13 bp, Homo sapiens
aagccgctcccgg

SEQ ID NO: 5345874 - DNA, 16 bp, Homo sapiens
aagccggacagctgcc

SEQ ID NO: 5345875 - DNA, 23 bp, Homo sapiens
aagccggccccccctcttttggc

SEQ ID NO: 5345876 - DNA, 21 bp, Homo sapiens
aagccggcctgagaaacacta

SEQ ID NO: 5345877 - DNA, 21 bp, Homo sapiens
aagccggcggagctctggctt

SEQ ID NO: 5345878 - DNA, 19 bp, Homo sapiens
aagccggcggcccaagccc

SEQ ID NO: 5345879 - DNA, 14 bp, Homo sapiens
aagccgggggaggg

SEQ ID NO: 5345880 - DNA, 18 bp, Homo sapiens
aagccggtggggggatga

SEQ ID NO: 5345881 - DNA, 17 bp, Homo sapiens
aagccggtgtccctgga

SEQ ID NO: 5345882 - DNA, 16 bp, Homo sapiens
aagccgtactgtctat

SEQ ID NO: 5345883 - DNA, 21 bp, Homo sapiens
aagccgtgattttcattgctg

SEQ ID NO: 5345884 - DNA, 16 bp, Homo sapiens
aagccgtgcctgtagc

SEQ ID NO: 5345885 - DNA, 13 bp, Homo sapiens
aagccgtggcttc

SEQ ID NO: 5345886 - DNA, 15 bp, Homo sapiens
aagccgtggcttccc

SEQ ID NO: 5345887 - DNA, 14 bp, Homo sapiens
aagcctaaaattga

SEQ ID NO: 5345888 - DNA, 12 bp, Homo sapiens
aagcctaaagat

SEQ ID NO: 5345889 - DNA, 17 bp, Homo sapiens
aagcctaagaaaaagga

SEQ ID NO: 5345890 - DNA, 14 bp, Homo sapiens
aagcctaagaatct

SEQ ID NO: 5345891 - DNA, 22 bp, Homo sapiens
aagcctaagggatcctgcctgc

SEQ ID NO: 5345892 - DNA, 20 bp, Homo sapiens
aagcctaattgtcacatcaa

SEQ ID NO: 5345893 - DNA, 23 bp, Homo sapiens
aagcctacattctccagttgatt

SEQ ID NO: 5345894 - DNA, 16 bp, Homo sapiens
aagcctacctaagcat

SEQ ID NO: 5345895 - DNA, 19 bp, Homo sapiens
aagcctacctgctctccaa

SEQ ID NO: 5345896 - DNA, 20 bp, Homo sapiens
aagcctagaagagcttctga

SEQ ID NO: 5345897 - DNA, 20 bp, Homo sapiens
aagcctagacaacctttctg

SEQ ID NO: 5345898 - DNA, 23 bp, Homo sapiens
aagcctaggtgttgtcagcaggc

SEQ ID NO: 5345899 - DNA, 22 bp, Homo sapiens
aagcctagtgaaggcttctctc

SEQ ID NO: 5345900 - DNA, 20 bp, Homo sapiens
aagcctatacgtttctgtgg

SEQ ID NO: 5345901 - DNA, 21 bp, Homo sapiens
aagcctatcaaagaccttgtg

SEQ ID NO: 5345902 - DNA, 21 bp, Homo sapiens
aagcctatcaaaggaaatgag

SEQ ID NO: 5345903 - DNA, 16 bp, Homo sapiens
aagcctcaaaacaaag

SEQ ID NO: 5345904 - DNA, 18 bp, Homo sapiens
aagcctcaaaacaaaggc

SEQ ID NO: 5345905 - DNA, 17 bp, Homo sapiens
aagcctcaaatttgaac

SEQ ID NO: 5345906 - DNA, 22 bp, Homo sapiens
aagcctcaactagtcatttttt

SEQ ID NO: 5345907 - DNA, 21 bp, Homo sapiens
aagcctcaaggttttaggttc

SEQ ID NO: 5345908 - DNA, 23 bp, Homo sapiens
aagcctcaaggttttaggttcta

SEQ ID NO: 5345909 - DNA, 23 bp, Homo sapiens
aagcctcacgtatttcacagagc

SEQ ID NO: 5345910 - DNA, 13 bp, Homo sapiens
aagcctcagagaa

SEQ ID NO: 5345911 - DNA, 19 bp, Homo sapiens
aagcctcagattccttccc

SEQ ID NO: 5345912 - DNA, 14 bp, Homo sapiens
aagcctcagctcat

SEQ ID NO: 5345913 - DNA, 15 bp, Homo sapiens
aagcctcaggcctgg

SEQ ID NO: 5345914 - DNA, 19 bp, Homo sapiens
aagcctcaggcctggccct

SEQ ID NO: 5345915 - DNA, 11 bp, Homo sapiens
aagcctcagtg

SEQ ID NO: 5345916 - DNA, 17 bp, Homo sapiens
aagcctcagtgaaacag

SEQ ID NO: 5345917 - DNA, 14 bp, Homo sapiens
aagcctcatattta

SEQ ID NO: 5345918 - DNA, 21 bp, Homo sapiens
aagcctcatcatcagagcctt

SEQ ID NO: 5345919 - DNA, 16 bp, Homo sapiens
aagcctcatgccaacc

SEQ ID NO: 5345920 - DNA, 13 bp, Homo sapiens
aagcctccaaggg

SEQ ID NO: 5345921 - DNA, 22 bp, Homo sapiens
aagcctccacaccagctgctgc

SEQ ID NO: 5345922 - DNA, 23 bp, Homo sapiens
aagcctccacagcgagggcagct

SEQ ID NO: 5345923 - DNA, 17 bp, Homo sapiens
aagcctccacctgcagc

SEQ ID NO: 5345924 - DNA, 18 bp, Homo sapiens
aagcctccacctgcagcc

SEQ ID NO: 5345925 - DNA, 14 bp, Homo sapiens
aagcctccccagct

SEQ ID NO: 5345926 - DNA, 14 bp, Homo sapiens
aagcctccctcctc

SEQ ID NO: 5345927 - DNA, 17 bp, Homo sapiens
aagcctccgctgggctt

SEQ ID NO: 5345928 - DNA, 18 bp, Homo sapiens
aagcctccgctgggcttc

SEQ ID NO: 5345929 - DNA, 20 bp, Homo sapiens
aagcctccggtttccactac

SEQ ID NO: 5345930 - DNA, 18 bp, Homo sapiens
aagcctccgtcaggagag

SEQ ID NO: 5345931 - DNA, 14 bp, Homo sapiens
aagcctcctgctga

SEQ ID NO: 5345932 - DNA, 15 bp, Homo sapiens
aagcctcctgctgag

SEQ ID NO: 5345933 - DNA, 15 bp, Homo sapiens
aagcctcctgttggc

SEQ ID NO: 5345934 - DNA, 14 bp, Homo sapiens
aagcctccttacat

SEQ ID NO: 5345935 - DNA, 12 bp, Homo sapiens
aagcctccttgt

SEQ ID NO: 5345936 - DNA, 11 bp, Homo sapiens
aagcctctaac

SEQ ID NO: 5345937 - DNA, 18 bp, Homo sapiens
aagcctctaacaaatgat

SEQ ID NO: 5345938 - DNA, 23 bp, Homo sapiens
aagcctctcgtcccgtccctccc

SEQ ID NO: 5345939 - DNA, 14 bp, Homo sapiens
aagcctctctcctt

SEQ ID NO: 5345940 - DNA, 14 bp, Homo sapiens
aagcctctctctcc

SEQ ID NO: 5345941 - DNA, 16 bp, Homo sapiens
aagcctctctctccct

SEQ ID NO: 5345942 - DNA, 15 bp, Homo sapiens
aagcctctgcccagg

SEQ ID NO: 5345943 - DNA, 19 bp, Homo sapiens
aagcctctgccccaagggg

SEQ ID NO: 5345944 - DNA, 19 bp, Homo sapiens
aagcctctgccctgcctcc

SEQ ID NO: 5345945 - DNA, 21 bp, Homo sapiens
aagcctctgccctgcctccct

SEQ ID NO: 5345946 - DNA, 14 bp, Homo sapiens
aagcctctgctgcc

SEQ ID NO: 5345947 - DNA, 12 bp, Homo sapiens
aagcctctggaa

SEQ ID NO: 5345948 - DNA, 13 bp, Homo sapiens
aagcctctggaaa

SEQ ID NO: 5345949 - DNA, 23 bp, Homo sapiens
aagcctctggctagaggccagcc

SEQ ID NO: 5345950 - DNA, 21 bp, Homo sapiens
aagcctctgtcttttctggga

SEQ ID NO: 5345951 - DNA, 21 bp, Homo sapiens
aagcctcttattccaggagaa

SEQ ID NO: 5345952 - DNA, 17 bp, Homo sapiens
aagctctgcatgtgtgt

SEQ ID NO: 5345953 - DNA, 23 bp, Homo sapiens
aagctctggccccaggcttgtca

SEQ ID NO: 5345954 - DNA, 21 bp, Homo sapiens
aagctctggctgaaccctgtg

SEQ ID NO: 5345955 - DNA, 23 bp, Homo sapiens
aagctctggctgaaccctgtgct

SEQ ID NO: 5345956 - DNA, 20 bp, Homo sapiens
aagctctggggatgggtggg

SEQ ID NO: 5345957 - DNA, 23 bp, Homo sapiens
aagctctgttccatgcaactgga

SEQ ID NO: 5345958 - DNA, 19 bp, Homo sapiens
aagctcttcattgcactgc

SEQ ID NO: 5345959 - DNA, 15 bp, Homo sapiens
aagctcttcatttct

SEQ ID NO: 5345960 - DNA, 21 bp, Homo sapiens
aagctcttcccttgctcatga

SEQ ID NO: 5345961 - DNA, 14 bp, Homo sapiens
aagctcttggacaa

SEQ ID NO: 5345962 - DNA, 19 bp, Homo sapiens
aagctcttggagctgtgag

SEQ ID NO: 5345963 - DNA, 15 bp, Homo sapiens
aagctcttgtttctg

SEQ ID NO: 5345964 - DNA, 19 bp, Homo sapiens
aagctcttgtttctgttta

SEQ ID NO: 5345965 - DNA, 15 bp, Homo sapiens
aagctctttgagaac

SEQ ID NO: 5345966 - DNA, 16 bp, Homo sapiens
aagctctttgagaact

SEQ ID NO: 5345967 - DNA, 21 bp, Homo sapiens
aagctgaaaaattgtagagtg

SEQ ID NO: 5345968 - DNA, 15 bp, Homo sapiens
aagctgaaaatgtgt

SEQ ID NO: 5345969 - DNA, 14 bp, Homo sapiens
aagctgaagaaaat

SEQ ID NO: 5345970 - DNA, 23 bp, Homo sapiens
aagctgaagaggttgaagctaaa

SEQ ID NO: 5345971 - DNA, 19 bp, Homo sapiens
aagctgaagatccccaact

SEQ ID NO: 5345972 - DNA, 22 bp, Homo sapiens
aagctgaagatccccaactgct

SEQ ID NO: 5345973 - DNA, 15 bp, Homo sapiens
aagctgaagcccccc

SEQ ID NO: 5345974 - DNA, 12 bp, Homo sapiens
aagctgaagcta

SEQ ID NO: 5345975 - DNA, 14 bp, Homo sapiens
aagctgaagtgcat

SEQ ID NO: 5345976 - DNA, 14 bp, Homo sapiens
aagctgaatatttt

SEQ ID NO: 5345977 - DNA, 18 bp, Homo sapiens
aagctgaatattttttat

SEQ ID NO: 5345978 - DNA, 13 bp, Homo sapiens
aagctgaatcccg

SEQ ID NO: 5345979 - DNA, 23 bp, Homo sapiens
aagctgaatgtcaaacagtgcca

SEQ ID NO: 5345980 - DNA, 13 bp, Homo sapiens
aagctgacataat

SEQ ID NO: 5345981 - DNA, 17 bp, Homo sapiens
aagctgacattgccaaa

SEQ ID NO: 5345982 - DNA, 17 bp, Homo sapiens
aagctgacgaacttcca

SEQ ID NO: 5345983 - DNA, 19 bp, Homo sapiens
aagctgacgaacttccatg

SEQ ID NO: 5345984 - DNA, 14 bp, Homo sapiens
aagctgactgtttt

SEQ ID NO: 5345985 - DNA, 22 bp, Homo sapiens
aagctgactgttttttttgcag

SEQ ID NO: 5345986 - DNA, 18 bp, Homo sapiens
aagctgacttggctggtg

SEQ ID NO: 5345987 - DNA, 19 bp, Homo sapiens
aagctgacttggctggtgt

SEQ ID NO: 5345988 - DNA, 17 bp, Homo sapiens
aagctgagaactcctga

SEQ ID NO: 5345989 - DNA, 14 bp, Homo sapiens
aagctgagaagaag

SEQ ID NO: 5345990 - DNA, 16 bp, Homo sapiens
aagctgagaagaagct

SEQ ID NO: 5345991 - DNA, 20 bp, Homo sapiens
aagctgagaagaatgaaaat

SEQ ID NO: 5345992 - DNA, 22 bp, Homo sapiens
aagctgagagaccctggcctca

SEQ ID NO: 5345993 - DNA, 18 bp, Homo sapiens
aagctgagagtgctatga

SEQ ID NO: 5345994 - DNA, 23 bp, Homo sapiens
aagctgagcaacctcttcagctg

SEQ ID NO: 5345995 - DNA, 20 bp, Homo sapiens
aagctgagcgggtctagtgg

SEQ ID NO: 5345996 - DNA, 22 bp, Homo sapiens
aagctgaggatcctcacaggag

SEQ ID NO: 5345997 - DNA, 14 bp, Homo sapiens
aagctgaggctgct

SEQ ID NO: 5345998 - DNA, 19 bp, Homo sapiens
aagctgaggctgctgccag

SEQ ID NO: 5345999 - DNA, 20 bp, Homo sapiens
aagctgaggctgctgccagg

SEQ ID NO: 5346000 - DNA, 18 bp, Homo sapiens
aagctgaggtgcccagga

SEQ ID NO: 5346001 - DNA, 20 bp, Homo sapiens
aagctgaggtgcccaggaga

SEQ ID NO: 5346002 - DNA, 13 bp, Homo sapiens
aagctgagtatta

SEQ ID NO: 5346003 - DNA, 21 bp, Homo sapiens
aagctgagttacttgtctgag

SEQ ID NO: 5346004 - DNA, 23 bp, Homo sapiens
aagctgagttaggtgtctgtcct

SEQ ID NO: 5346005 - DNA, 19 bp, Homo sapiens
aagctgatattatttcttc

SEQ ID NO: 5346006 - DNA, 23 bp, Homo sapiens
aagctgatattatttcttctctt

SEQ ID NO: 5346007 - DNA, 23 bp, Homo sapiens
aagctgatgaagttaagcacaac

SEQ ID NO: 5346008 - DNA, 17 bp, Homo sapiens
aagctgatggacatgag

SEQ ID NO: 5346009 - DNA, 16 bp, Homo sapiens
aagctgattaaaacac

SEQ ID NO: 5346010 - DNA, 22 bp, Homo sapiens
aagctgattactgtcaataaac

SEQ ID NO: 5346011 - DNA, 15 bp, Homo sapiens
aagctgattcccaga

SEQ ID NO: 5346012 - DNA, 17 bp, Homo sapiens
aagctgattcccagagc

SEQ ID NO: 5346013 - DNA, 20 bp, Homo sapiens
aagctgattcccagagcaga

SEQ ID NO: 5346014 - DNA, 11 bp, Homo sapiens
aagctgatttc

SEQ ID NO: 5346015 - DNA, 14 bp, Homo sapiens
aagctgattttatt

SEQ ID NO: 5346016 - DNA, 18 bp, Homo sapiens
aagctgatttttgtcttt

SEQ ID NO: 5346017 - DNA, 21 bp, Homo sapiens
aagctgcaaaaattatatatt

SEQ ID NO: 5346018 - DNA, 20 bp, Homo sapiens
aagctgcaaaaggcctgtga

SEQ ID NO: 5346019 - DNA, 19 bp, Homo sapiens
aagctgcaaatctgatggc

SEQ ID NO: 5346020 - DNA, 13 bp, Homo sapiens
aagctgcaccctc

SEQ ID NO: 5346021 - DNA, 19 bp, Homo sapiens
aagctgcaccctcaggcag

SEQ ID NO: 5346022 - DNA, 13 bp, Homo sapiens
aagctgcagcttc

SEQ ID NO: 5346023 - DNA, 15 bp, Homo sapiens
aagctgcagcttcct

SEQ ID NO: 5346024 - DNA, 18 bp, Homo sapiens
aagctgcagcttcctgtc

SEQ ID NO: 5346025 - DNA, 21 bp, Homo sapiens
aagctgcaggcacacacgcct

SEQ ID NO: 5346026 - DNA, 23 bp, Homo sapiens
aagctgcaggcacacacgccttc

SEQ ID NO: 5346027 - DNA, 16 bp, Homo sapiens
aagctgcatatgccta

SEQ ID NO: 5346028 - DNA, 18 bp, Homo sapiens
aagctgccacccctcttc

SEQ ID NO: 5346029 - DNA, 21 bp, Homo sapiens
aagctgccacccctcttctgc

SEQ ID NO: 5346030 - DNA, 18 bp, Homo sapiens
aagctgccagcccagaac

SEQ ID NO: 5346031 - DNA, 19 bp, Homo sapiens
aagctgccagcccagaaca

SEQ ID NO: 5346032 - DNA, 20 bp, Homo sapiens
aagctgccagcccagaacac

SEQ ID NO: 5346033 - DNA, 21 bp, Homo sapiens
aagctgccatttcccttctgg

SEQ ID NO: 5346034 - DNA, 18 bp, Homo sapiens
aagctgcccagccctggc

SEQ ID NO: 5346035 - DNA, 13 bp, Homo sapiens
aagctgccctgag

SEQ ID NO: 5346036 - DNA, 18 bp, Homo sapiens
aagctgccgtagcttcag

SEQ ID NO: 5346037 - DNA, 14 bp, Homo sapiens
aagctgcctccctg

SEQ ID NO: 5346038 - DNA, 15 bp, Homo sapiens
aagctgcctccctgt

SEQ ID NO: 5346039 - DNA, 18 bp, Homo sapiens
aagctgcctccctgtcca

SEQ ID NO: 5346040 - DNA, 19 bp, Homo sapiens
aagctgcctccctgtccac

SEQ ID NO: 5346041 - DNA, 22 bp, Homo sapiens
aagctgcctccctgtccacccc

SEQ ID NO: 5346042 - DNA, 13 bp, Homo sapiens
aagctgcctctga

SEQ ID NO: 5346043 - DNA, 19 bp, Homo sapiens
aagctgcctctgacagcag

SEQ ID NO: 5346044 - DNA, 12 bp, Homo sapiens
aagctgcctgct

SEQ ID NO: 5346045 - DNA, 16 bp, Homo sapiens
aagctgcctgtagtta

SEQ ID NO: 5346046 - DNA, 21 bp, Homo sapiens
aagctgcctgtagttaggaaa

SEQ ID NO: 5346047 - DNA, 15 bp, Homo sapiens
aagctgctaaatctc

SEQ ID NO: 5346048 - DNA, 23 bp, Homo sapiens
aagctgctcaacttgcaaaatca

SEQ ID NO: 5346049 - DNA, 12 bp, Homo sapiens
aagctgctctga

SEQ ID NO: 5346050 - DNA, 13 bp, Homo sapiens
aagctgctctgag

SEQ ID NO: 5346051 - DNA, 16 bp, Homo sapiens
aagctgctctgagcca

SEQ ID NO: 5346052 - DNA, 19 bp, Homo sapiens
aagctgctctgagccacag

SEQ ID NO: 5346053 - DNA, 13 bp, Homo sapiens
aagctgctgacca

SEQ ID NO: 5346054 - DNA, 17 bp, Homo sapiens
aagctgctgcagccctg

SEQ ID NO: 5346055 - DNA, 22 bp, Homo sapiens
aagctgctgcagctccctcctc

SEQ ID NO: 5346056 - DNA, 19 bp, Homo sapiens
aagctgctgggccagtggc

SEQ ID NO: 5346057 - DNA, 21 bp, Homo sapiens
aagctgctgggccagtggcac

SEQ ID NO: 5346058 - DNA, 11 bp, Homo sapiens
aagctgctgta

SEQ ID NO: 5346059 - DNA, 20 bp, Homo sapiens
aagctgcttgactatcacat

SEQ ID NO: 5346060 - DNA, 23 bp, Homo sapiens
aagctgcttgactatcacataca

SEQ ID NO: 5346061 - DNA, 14 bp, Homo sapiens
aagctgctttcttc

SEQ ID NO: 5346062 - DNA, 18 bp, Homo sapiens
aagctgctttcttctctg

SEQ ID NO: 5346063 - DNA, 11 bp, Homo sapiens
aagctgctttt

SEQ ID NO: 5346064 - DNA, 11 bp, Homo sapiens
aagctggaaga

SEQ ID NO: 5346065 - DNA, 22 bp, Homo sapiens
aagctggaccttttcccttgct

SEQ ID NO: 5346066 - DNA, 18 bp, Homo sapiens
aagctggagctcttggaa

SEQ ID NO: 5346067 - DNA, 19 bp, Homo sapiens
aagctggaggctccaggac

SEQ ID NO: 5346068 - DNA, 20 bp, Homo sapiens
aagctggaggctccaggact

SEQ ID NO: 5346069 - DNA, 21 bp, Homo sapiens
aagctggaggctccaggactc

SEQ ID NO: 5346070 - DNA, 20 bp, Homo sapiens
aagctggagggaggtggggc

SEQ ID NO: 5346071 - DNA, 17 bp, Homo sapiens
aagctggagtgctgctt

SEQ ID NO: 5346072 - DNA, 15 bp, Homo sapiens
aagctggcagaacgg

SEQ ID NO: 5346073 - DNA, 12 bp, Homo sapiens
aagctggcagga

SEQ ID NO: 5346074 - DNA, 12 bp, Homo sapiens
aagctggccctg

SEQ ID NO: 5346075 - DNA, 14 bp, Homo sapiens
aagctggccctgcc

SEQ ID NO: 5346076 - DNA, 17 bp, Homo sapiens
aagctggccctgcctcc

SEQ ID NO: 5346077 - DNA, 22 bp, Homo sapiens
aagctggccgagggtcctggct

SEQ ID NO: 5346078 - DNA, 23 bp, Homo sapiens
aagctggcggctggggtcccagc

SEQ ID NO: 5346079 - DNA, 16 bp, Homo sapiens
aagctggctctgtttg

SEQ ID NO: 5346080 - DNA, 19 bp, Homo sapiens
aagctggctgggctggctg

SEQ ID NO: 5346081 - DNA, 15 bp, Homo sapiens
aagctggctggggtg

SEQ ID NO: 5346082 - DNA, 21 bp, Homo sapiens
aagctggctgtacctgttcct

SEQ ID NO: 5346083 - DNA, 22 bp, Homo sapiens
aagctggctttgaaacctcagg

SEQ ID NO: 5346084 - DNA, 20 bp, Homo sapiens
aagctgggaagaccctttca

SEQ ID NO: 5346085 - DNA, 22 bp, Homo sapiens
aagctgggaagaccctttcaga

SEQ ID NO: 5346086 - DNA, 18 bp, Homo sapiens
aagctgggcccaaaggcc

SEQ ID NO: 5346087 - DNA, 17 bp, Homo sapiens
aagctgggccccagccc

SEQ ID NO: 5346088 - DNA, 19 bp, Homo sapiens
aagctgggccccagcccac

SEQ ID NO: 5346089 - DNA, 12 bp, Homo sapiens
aagctgggtgag

SEQ ID NO: 5346090 - DNA, 17 bp, Homo sapiens
aagctggtaaactattt

SEQ ID NO: 5346091 - DNA, 19 bp, Homo sapiens
aagctggtcttaaactcct

SEQ ID NO: 5346092 - DNA, 19 bp, Homo sapiens
aagctggtggcagagtcct

SEQ ID NO: 5346093 - DNA, 18 bp, Homo sapiens
aagctggtggcctctgca

SEQ ID NO: 5346094 - DNA, 17 bp, Homo sapiens
aagctgtaaaaagagag

SEQ ID NO: 5346095 - DNA, 11 bp, Homo sapiens
aagctgtaccc

SEQ ID NO: 5346096 - DNA, 16 bp, Homo sapiens
aagctgtacccttgag

SEQ ID NO: 5346097 - DNA, 19 bp, Homo sapiens
aagctgtactcagagcaga

SEQ ID NO: 5346098 - DNA, 13 bp, Homo sapiens
aagctgtactttt

SEQ ID NO: 5346099 - DNA, 21 bp, Homo sapiens
aagctgtagaactctgcaggc

SEQ ID NO: 5346100 - DNA, 20 bp, Homo sapiens
aagctgtagaggaccaggac

SEQ ID NO: 5346101 - DNA, 15 bp, Homo sapiens
aagctgtatcactgc

SEQ ID NO: 5346102 - DNA, 18 bp, Homo sapiens
aagctgtatcactgcctt

SEQ ID NO: 5346103 - DNA, 15 bp, Homo sapiens
aagctgtatgtactt

SEQ ID NO: 5346104 - DNA, 17 bp, Homo sapiens
aagctgtcaggctggga

SEQ ID NO: 5346105 - DNA, 12 bp, Homo sapiens
aagctgtcccct

SEQ ID NO: 5346106 - DNA, 16 bp, Homo sapiens
aagctgtccctgcagg

SEQ ID NO: 5346107 - DNA, 14 bp, Homo sapiens
aagctgtgaaattg

SEQ ID NO: 5346108 - DNA, 19 bp, Homo sapiens
aagctgtgacttctccagg

SEQ ID NO: 5346109 - DNA, 22 bp, Homo sapiens
aagctgtgagacagtgggaaat

SEQ ID NO: 5346110 - DNA, 10 bp, Homo sapiens
aagctgtgca

SEQ ID NO: 5346111 - DNA, 22 bp, Homo sapiens
aagctgtgcaattactgcctgc

SEQ ID NO: 5346112 - DNA, 23 bp, Homo sapiens
aagctgtgccttcagctgttgca

SEQ ID NO: 5346113 - DNA, 20 bp, Homo sapiens
aagctgtggaatgaagcttt

SEQ ID NO: 5346114 - DNA, 22 bp, Homo sapiens
aagctgtggcagccgtcccagg

SEQ ID NO: 5346115 - DNA, 12 bp, Homo sapiens
aagctgtgtcct

SEQ ID NO: 5346116 - DNA, 20 bp, Homo sapiens
aagctgtgtctctgtatata

SEQ ID NO: 5346117 - DNA, 14 bp, Homo sapiens
aagctgtgttactt

SEQ ID NO: 5346118 - DNA, 19 bp, Homo sapiens
aagctgtgttacttgaagt

SEQ ID NO: 5346119 - DNA, 17 bp, Homo sapiens
aagctgttaaaatacat

SEQ ID NO: 5346120 - DNA, 16 bp, Homo sapiens
aagctgttaaactgtt

SEQ ID NO: 5346121 - DNA, 16 bp, Homo sapiens
aagctgttaaagatat

SEQ ID NO: 5346122 - DNA, 14 bp, Homo sapiens
aagctgttattctt

SEQ ID NO: 5346123 - DNA, 17 bp, Homo sapiens
aagctgttattcttgtt

SEQ ID NO: 5346124 - DNA, 17 bp, Homo sapiens
aagctgttatttcttcc

SEQ ID NO: 5346125 - DNA, 21 bp, Homo sapiens
aagctgttatttcttccctgc

SEQ ID NO: 5346126 - DNA, 15 bp, Homo sapiens
aagctgttctctgct

SEQ ID NO: 5346127 - DNA, 15 bp, Homo sapiens
aagctgttcttgaaa

SEQ ID NO: 5346128 - DNA, 18 bp, Homo sapiens
aagctgttgaccaggcac

SEQ ID NO: 5346129 - DNA, 22 bp, Homo sapiens
aaggactcaagtgtagaagaaa

SEQ ID NO: 5346130 - DNA, 18 bp, Homo sapiens
aaggactcccggagcctg

SEQ ID NO: 5346131 - DNA, 22 bp, Homo sapiens
aaggactcccggagcctgtgca

SEQ ID NO: 5346132 - DNA, 22 bp, Homo sapiens
aaggactcctcctttttccatg

SEQ ID NO: 5346133 - DNA, 15 bp, Homo sapiens
aaggactctaaaagg

SEQ ID NO: 5346134 - DNA, 22 bp, Homo sapiens
aaggactctggaagattttcat

SEQ ID NO: 5346135 - DNA, 23 bp, Homo sapiens
aaggactgaagaaaatccttcag

SEQ ID NO: 5346136 - DNA, 12 bp, Homo sapiens
aaggactgactg

SEQ ID NO: 5346137 - DNA, 20 bp, Homo sapiens
aaggactgagcaccctctgg

SEQ ID NO: 5346138 - DNA, 15 bp, Homo sapiens
aaggactgcatggta

SEQ ID NO: 5346139 - DNA, 23 bp, Homo sapiens
aaggactgcgggacttgggtctc

SEQ ID NO: 5346140 - DNA, 21 bp, Homo sapiens
aaggactggaaaaatgaactg

SEQ ID NO: 5346141 - DNA, 22 bp, Homo sapiens
aaggactggtgcgaccccccac

SEQ ID NO: 5346142 - DNA, 23 bp, Homo sapiens
aaggactggtgcgaccccccacc

SEQ ID NO: 5346143 - DNA, 14 bp, Homo sapiens
aaggactgtgcttt

SEQ ID NO: 5346144 - DNA, 13 bp, Homo sapiens
aaggactgtggct

SEQ ID NO: 5346145 - DNA, 23 bp, Homo sapiens
aaggacttacccagtattactgc

SEQ ID NO: 5346146 - DNA, 16 bp, Homo sapiens
aaggacttccacattt

SEQ ID NO: 5346147 - DNA, 16 bp, Homo sapiens
aaggacttcctgctac

SEQ ID NO: 5346148 - DNA, 24 bp, Homo sapiens
aaggacttcctgctacagtagctg

SEQ ID NO: 5346149 - DNA, 21 bp, Homo sapiens
aaggacttcctgtccagctcc

SEQ ID NO: 5346150 - DNA, 17 bp, Homo sapiens
aaggacttgaaagcatc

SEQ ID NO: 5346151 - DNA, 21 bp, Homo sapiens
aaggacttgttagatctagtt

SEQ ID NO: 5346152 - DNA, 23 bp, Homo sapiens
aaggacttgttagatctagttca

SEQ ID NO: 5346153 - DNA, 14 bp, Homo sapiens
aaggactttgtaca

SEQ ID NO: 5346154 - DNA, 15 bp, Homo sapiens
aaggagaaaaaaaac

SEQ ID NO: 5346155 - DNA, 16 bp, Homo sapiens
aaggagaaaaaaaacc

SEQ ID NO: 5346156 - DNA, 20 bp, Homo sapiens
aaggagaaaaaaaaccttgt

SEQ ID NO: 5346157 - DNA, 21 bp, Homo sapiens
aaggagaaaaaaaaccttgta

SEQ ID NO: 5346158 - DNA, 18 bp, Homo sapiens
aaggagaaaagtgggctg

SEQ ID NO: 5346159 - DNA, 19 bp, Homo sapiens
aaggagaaacagagacagg

SEQ ID NO: 5346160 - DNA, 17 bp, Homo sapiens
aaggagaaagaaagtac

SEQ ID NO: 5346161 - DNA, 22 bp, Homo sapiens
aaggagaaagaaagtacccagc

SEQ ID NO: 5346162 - DNA, 14 bp, Homo sapiens
aaggagaacaaata

SEQ ID NO: 5346163 - DNA, 17 bp, Homo sapiens
aaggagaacccaatttt

SEQ ID NO: 5346164 - DNA, 16 bp, Homo sapiens
aaggagaactgtgctc

SEQ ID NO: 5346165 - DNA, 23 bp, Homo sapiens
aaggagaagactgggctagggag

SEQ ID NO: 5346166 - DNA, 12 bp, Homo sapiens
aaggagaagaga

SEQ ID NO: 5346167 - DNA, 15 bp, Homo sapiens
aaggagaaggaagga

SEQ ID NO: 5346168 - DNA, 16 bp, Homo sapiens
aaggagaatatgataa

SEQ ID NO: 5346169 - DNA, 18 bp, Homo sapiens
aaggagaatcatcaggac

SEQ ID NO: 5346170 - DNA, 20 bp, Homo sapiens
aaggagaatggcatggcagg

SEQ ID NO: 5346171 - DNA, 12 bp, Homo sapiens
aaggagacacaa

SEQ ID NO: 5346172 - DNA, 13 bp, Homo sapiens
aaggagacacaga

SEQ ID NO: 5346173 - DNA, 13 bp, Homo sapiens
aaggagacagaat

SEQ ID NO: 5346174 - DNA, 15 bp, Homo sapiens
aaggagacaggatga

SEQ ID NO: 5346175 - DNA, 16 bp, Homo sapiens
aaggagacaggatgag

SEQ ID NO: 5346176 - DNA, 16 bp, Homo sapiens
aaggagacaggcagag

SEQ ID NO: 5346177 - DNA, 16 bp, Homo sapiens
aaggagactcacctct

SEQ ID NO: 5346178 - DNA, 20 bp, Homo sapiens
aaggagactcacctctgcct

SEQ ID NO: 5346179 - DNA, 22 bp, Homo sapiens
aaggagactcacctctgcctca

SEQ ID NO: 5346180 - DNA, 18 bp, Homo sapiens
aaggagactggtaggagg

SEQ ID NO: 5346181 - DNA, 23 bp, Homo sapiens
aaggagactggtaggaggaggca

SEQ ID NO: 5346182 - DNA, 18 bp, Homo sapiens
aaggagacttaatttcaa

SEQ ID NO: 5346183 - DNA, 14 bp, Homo sapiens
aaggagagaaagtg

SEQ ID NO: 5346184 - DNA, 16 bp, Homo sapiens
aaggagagaaagtggg

SEQ ID NO: 5346185 - DNA, 22 bp, Homo sapiens
aaggagagactcccatgaagcc

SEQ ID NO: 5346186 - DNA, 19 bp, Homo sapiens
aaggagagagcaaagggtg

SEQ ID NO: 5346187 - DNA, 14 bp, Homo sapiens
aaggagagatgacc

SEQ ID NO: 5346188 - DNA, 13 bp, Homo sapiens
aaggagagcctgc

SEQ ID NO: 5346189 - DNA, 14 bp, Homo sapiens
aaggagagcctgct

SEQ ID NO: 5346190 - DNA, 22 bp, Homo sapiens
aaggagaggaaaatgtttcctt

SEQ ID NO: 5346191 - DNA, 11 bp, Homo sapiens
aaggagaggag

SEQ ID NO: 5346192 - DNA, 13 bp, Homo sapiens
aaggagaggagtg

SEQ ID NO: 5346193 - DNA, 23 bp, Homo sapiens
aaggagaggcaaagaaaggagat

SEQ ID NO: 5346194 - DNA, 21 bp, Homo sapiens
aaggagaggctctgaaagctg

SEQ ID NO: 5346195 - DNA, 12 bp, Homo sapiens
aaggagagggag

SEQ ID NO: 5346196 - DNA, 17 bp, Homo sapiens
aaggagaggttaaagca

SEQ ID NO: 5346197 - DNA, 15 bp, Homo sapiens
aaggagagtcttgca

SEQ ID NO: 5346198 - DNA, 15 bp, Homo sapiens
aaggagagtggccat

SEQ ID NO: 5346199 - DNA, 17 bp, Homo sapiens
aaggagagttcaagcct

SEQ ID NO: 5346200 - DNA, 19 bp, Homo sapiens
aaggagataagaaagcagg

SEQ ID NO: 5346201 - DNA, 22 bp, Homo sapiens
aaggagatgaatagaagaaaga

SEQ ID NO: 5346202 - DNA, 15 bp, Homo sapiens
aaggagatgtaagag

SEQ ID NO: 5346203 - DNA, 20 bp, Homo sapiens
aaggagatgtaatgacagag

SEQ ID NO: 5346204 - DNA, 18 bp, Homo sapiens
aaggagatgtcttggaac

SEQ ID NO: 5346205 - DNA, 15 bp, Homo sapiens
aaggagattgggaga

SEQ ID NO: 5346206 - DNA, 21 bp, Homo sapiens
aaggagattgggagacaatta

SEQ ID NO: 5346207 - DNA, 14 bp, Homo sapiens
aaggagatttacaa

SEQ ID NO: 5346208 - DNA, 15 bp, Homo sapiens
aaggagatttcttag

SEQ ID NO: 5346209 - DNA, 21 bp, Homo sapiens
aaggagcaaataccttagctc

SEQ ID NO: 5346210 - DNA, 23 bp, Homo sapiens
aaggagcacatactacctagaag

SEQ ID NO: 5346211 - DNA, 20 bp, Homo sapiens
aaggagcagagaggtggcca

SEQ ID NO: 5346212 - DNA, 21 bp, Homo sapiens
aaggagcagctagctgctttt

SEQ ID NO: 5346213 - DNA, 14 bp, Homo sapiens
aaggagcagtgtga

SEQ ID NO: 5346214 - DNA, 17 bp, Homo sapiens
aaggagcagtgtgacct

SEQ ID NO: 5346215 - DNA, 14 bp, Homo sapiens
aaggagcatcagcc

SEQ ID NO: 5346216 - DNA, 12 bp, Homo sapiens
aaggagcatcta

SEQ ID NO: 5346217 - DNA, 16 bp, Homo sapiens
aaggagccagccagga

SEQ ID NO: 5346218 - DNA, 16 bp, Homo sapiens
aaggagcccagccaga

SEQ ID NO: 5346219 - DNA, 18 bp, Homo sapiens
aaggagcctaggccaggt

SEQ ID NO: 5346220 - DNA, 19 bp, Homo sapiens
aaggagcctaggccaggtg

SEQ ID NO: 5346221 - DNA, 19 bp, Homo sapiens
aaggagcctgcggctgctg

SEQ ID NO: 5346222 - DNA, 21 bp, Homo sapiens
aaggagcctgcggctgctggc

SEQ ID NO: 5346223 - DNA, 12 bp, Homo sapiens
aaggagccttga

SEQ ID NO: 5346224 - DNA, 22 bp, Homo sapiens
aaggagccttgataatacttga

SEQ ID NO: 5346225 - DNA, 23 bp, Homo sapiens
aaggagccttgataatacttgac

SEQ ID NO: 5346226 - DNA, 13 bp, Homo sapiens
aaggagcgggcag

SEQ ID NO: 5346227 - DNA, 14 bp, Homo sapiens
aaggagcgggcagg

SEQ ID NO: 5346228 - DNA, 21 bp, Homo sapiens
aaggagctactgacattccta

SEQ ID NO: 5346229 - DNA, 13 bp, Homo sapiens
aaggagctcaccc

SEQ ID NO: 5346230 - DNA, 22 bp, Homo sapiens
aaggagctgagaatagaaggaa

SEQ ID NO: 5346231 - DNA, 24 bp, Homo sapiens
aaggagctgatttccaggcccctg

SEQ ID NO: 5346232 - DNA, 11 bp, Homo sapiens
aaggagctgcc

SEQ ID NO: 5346233 - DNA, 13 bp, Homo sapiens
aaggagctgcctg

SEQ ID NO: 5346234 - DNA, 17 bp, Homo sapiens
aaggagctgcctggacc

SEQ ID NO: 5346235 - DNA, 14 bp, Homo sapiens
aaggagctgctata

SEQ ID NO: 5346236 - DNA, 18 bp, Homo sapiens
aaggagctgctatagcct

SEQ ID NO: 5346237 - DNA, 20 bp, Homo sapiens
aaggagctgctatagcctgg

SEQ ID NO: 5346238 - DNA, 17 bp, Homo sapiens
aaggagcttacccaagc

SEQ ID NO: 5346239 - DNA, 19 bp, Homo sapiens
aaggagcttacccaagctg

SEQ ID NO: 5346240 - DNA, 16 bp, Homo sapiens
aaggagctttctcaat

SEQ ID NO: 5346241 - DNA, 21 bp, Homo sapiens
aaggaggaaataactaagaga

SEQ ID NO: 5346242 - DNA, 20 bp, Homo sapiens
aaggaggaagagaaaaaata

SEQ ID NO: 5346243 - DNA, 17 bp, Homo sapiens
aaggaggaagggactgg

SEQ ID NO: 5346244 - DNA, 12 bp, Homo sapiens
aaggaggacaag

SEQ ID NO: 5346245 - DNA, 19 bp, Homo sapiens
aaggaggacaagaccctct

SEQ ID NO: 5346246 - DNA, 18 bp, Homo sapiens
aaggaggaccagtcagga

SEQ ID NO: 5346247 - DNA, 15 bp, Homo sapiens
aaggaggacccagga

SEQ ID NO: 5346248 - DNA, 18 bp, Homo sapiens
aaggaggacccaggacag

SEQ ID NO: 5346249 - DNA, 15 bp, Homo sapiens
aaggaggagcctgtc

SEQ ID NO: 5346250 - DNA, 17 bp, Homo sapiens
aaggaggagcctgtcct

SEQ ID NO: 5346251 - DNA, 24 bp, Homo sapiens
aaggaggatggcttgagcccagga

SEQ ID NO: 5346252 - DNA, 23 bp, Homo sapiens
aaggaggattccatttggcagag

SEQ ID NO: 5346253 - DNA, 14 bp, Homo sapiens
aaggaggccacctc

SEQ ID NO: 5346254 - DNA, 14 bp, Homo sapiens
aaggaggcccactg

SEQ ID NO: 5346255 - DNA, 17 bp, Homo sapiens
aaggaggcccactgtgt

SEQ ID NO: 5346256 - DNA, 20 bp, Homo sapiens
aaggaggccctgttccctgg

SEQ ID NO: 5346257 - DNA, 15 bp, Homo sapiens
aaggaggctggctgg

SEQ ID NO: 5346258 - DNA, 15 bp, Homo sapiens
aaggagggagatgga

SEQ ID NO: 5346259 - DNA, 15 bp, Homo sapiens
aaggagggagctgct

SEQ ID NO: 5346260 - DNA, 18 bp, Homo sapiens
aaggagggagctgctcag

SEQ ID NO: 5346261 - DNA, 18 bp, Homo sapiens
aaggagggcacattaact

SEQ ID NO: 5346262 - DNA, 16 bp, Homo sapiens
aaggagggcagagcca

SEQ ID NO: 5346263 - DNA, 14 bp, Homo sapiens
aaggagggcctcag

SEQ ID NO: 5346264 - DNA, 16 bp, Homo sapiens
aaggagggcctcagag

SEQ ID NO: 5346265 - DNA, 22 bp, Homo sapiens
aaggaggggaaaaaaatgttgt

SEQ ID NO: 5346266 - DNA, 16 bp, Homo sapiens
aaggaggggaaacaat

SEQ ID NO: 5346267 - DNA, 20 bp, Homo sapiens
aaggaggggaaacaatgaaa

SEQ ID NO: 5346268 - DNA, 17 bp, Homo sapiens
aaggaggggctgtaaaa

SEQ ID NO: 5346269 - DNA, 21 bp, Homo sapiens
aaggagggggcctcattgtgt

SEQ ID NO: 5346270 - DNA, 19 bp, Homo sapiens
aaggagggtacagctgggc

SEQ ID NO: 5346271 - DNA, 17 bp, Homo sapiens
aaggagggtcaggaagg

SEQ ID NO: 5346272 - DNA, 15 bp, Homo sapiens
aaggaggtgagggat

SEQ ID NO: 5346273 - DNA, 20 bp, Homo sapiens
aaggaggttaggtcttagga

SEQ ID NO: 5346274 - DNA, 17 bp, Homo sapiens
aaggagtaagtacaaat

SEQ ID NO: 5346275 - DNA, 16 bp, Homo sapiens
aaggagtacaaaacaa

SEQ ID NO: 5346276 - DNA, 17 bp, Homo sapiens
aaggagtacaaaacaat

SEQ ID NO: 5346277 - DNA, 16 bp, Homo sapiens
aaggagtagttttcta

SEQ ID NO: 5346278 - DNA, 17 bp, Homo sapiens
aaggagtcaaaactaca

SEQ ID NO: 5346279 - DNA, 23 bp, Homo sapiens
aaggagtctgatgctcaacatcc

SEQ ID NO: 5346280 - DNA, 19 bp, Homo sapiens
aaggagtcttctaatgtaa

SEQ ID NO: 5346281 - DNA, 19 bp, Homo sapiens
aaggagtgagatcattttc

SEQ ID NO: 5346282 - DNA, 20 bp, Homo sapiens
aaggagtgccataccttctc

SEQ ID NO: 5346283 - DNA, 22 bp, Homo sapiens
aaggagtgtatgagtgtgagtg

SEQ ID NO: 5346284 - DNA, 15 bp, Homo sapiens
aaggagttaatattt

SEQ ID NO: 5346285 - DNA, 21 bp, Homo sapiens
aaggagttagaaccacagcag

SEQ ID NO: 5346286 - DNA, 20 bp, Homo sapiens
aaggagttccatgaagacca

SEQ ID NO: 5346287 - DNA, 20 bp, Homo sapiens
aaggagtttaaatgagacta

SEQ ID NO: 5346288 - DNA, 20 bp, Homo sapiens
aaggagttttgttgtatttt

SEQ ID NO: 5346289 - DNA, 19 bp, Homo sapiens
aaggataaatcataaagtc

SEQ ID NO: 5346290 - DNA, 22 bp, Homo sapiens
aaggataaatcataaagtcagt

SEQ ID NO: 5346291 - DNA, 21 bp, Homo sapiens
aaggatacacttatttgtcaa

SEQ ID NO: 5346292 - DNA, 15 bp, Homo sapiens
aaggatacaggctgg

SEQ ID NO: 5346293 - DNA, 14 bp, Homo sapiens
aaggatacataatg

SEQ ID NO: 5346294 - DNA, 16 bp, Homo sapiens
aaggatacttatttaa

SEQ ID NO: 5346295 - DNA, 17 bp, Homo sapiens
aaggatagaagctgcag

SEQ ID NO: 5346296 - DNA, 13 bp, Homo sapiens
aaggataggaaaa

SEQ ID NO: 5346297 - DNA, 22 bp, Homo sapiens
aaggataggccttcattaacaa

SEQ ID NO: 5346298 - DNA, 14 bp, Homo sapiens
aaggatagtaagca

SEQ ID NO: 5346299 - DNA, 22 bp, Homo sapiens
aaggatataaaaggatgttaca

SEQ ID NO: 5346300 - DNA, 23 bp, Homo sapiens
aaggatataaaaggatgttacaa

SEQ ID NO: 5346301 - DNA, 14 bp, Homo sapiens
aaggatatgattaa

SEQ ID NO: 5346302 - DNA, 23 bp, Homo sapiens
aaggatatgattaatattattaa

SEQ ID NO: 5346303 - DNA, 17 bp, Homo sapiens
aaggatatttaagaaaa

SEQ ID NO: 5346304 - DNA, 18 bp, Homo sapiens
aaggatatttaagaaaat

SEQ ID NO: 5346305 - DNA, 16 bp, Homo sapiens
aaggcagtcccgggag

SEQ ID NO: 5346306 - DNA, 23 bp, Homo sapiens
aaggcagtgaacacactcagcag

SEQ ID NO: 5346307 - DNA, 12 bp, Homo sapiens
aaggcagtgcat

SEQ ID NO: 5346308 - DNA, 13 bp, Homo sapiens
aaggcagtgcatg

SEQ ID NO: 5346309 - DNA, 16 bp, Homo sapiens
aaggcatacctgtcct

SEQ ID NO: 5346310 - DNA, 17 bp, Homo sapiens
aaggcatacgagagcag

SEQ ID NO: 5346311 - DNA, 18 bp, Homo sapiens
aaggcatatactttgtct

SEQ ID NO: 5346312 - DNA, 14 bp, Homo sapiens
aaggcatatttcca

SEQ ID NO: 5346313 - DNA, 16 bp, Homo sapiens
aaggcatatttccaat

SEQ ID NO: 5346314 - DNA, 16 bp, Homo sapiens
aaggcatcattttcac

SEQ ID NO: 5346315 - DNA, 17 bp, Homo sapiens
aaggcatccttgtcttt

SEQ ID NO: 5346316 - DNA, 17 bp, Homo sapiens
aaggcatctatctgtgc

SEQ ID NO: 5346317 - DNA, 18 bp, Homo sapiens
aaggcatctatctgtgct

SEQ ID NO: 5346318 - DNA, 21 bp, Homo sapiens
aaggcatgatgttaaccagaa

SEQ ID NO: 5346319 - DNA, 23 bp, Homo sapiens
aaggcatgcctggacaaaccctt

SEQ ID NO: 5346320 - DNA, 16 bp, Homo sapiens
aaggcatgctcccagc

SEQ ID NO: 5346321 - DNA, 18 bp, Homo sapiens
aaggcatgctcccagcat

SEQ ID NO: 5346322 - DNA, 20 bp, Homo sapiens
aaggcatgctcccagcattt

SEQ ID NO: 5346323 - DNA, 13 bp, Homo sapiens
aaggcatgctgga

SEQ ID NO: 5346324 - DNA, 22 bp, Homo sapiens
aaggcatgctggagtacccagc

SEQ ID NO: 5346325 - DNA, 17 bp, Homo sapiens
aaggcatggacttctgg

SEQ ID NO: 5346326 - DNA, 17 bp, Homo sapiens
aaggcatggcggccccc

SEQ ID NO: 5346327 - DNA, 19 bp, Homo sapiens
aaggcatgtgtgaaacata

SEQ ID NO: 5346328 - DNA, 16 bp, Homo sapiens
aaggcatgttcctctg

SEQ ID NO: 5346329 - DNA, 13 bp, Homo sapiens
aaggcatgtttta

SEQ ID NO: 5346330 - DNA, 17 bp, Homo sapiens
aaggcatgttttaaaat

SEQ ID NO: 5346331 - DNA, 21 bp, Homo sapiens
aaggcatgttttaaaatctat

SEQ ID NO: 5346332 - DNA, 12 bp, Homo sapiens
aaggcattcagc

SEQ ID NO: 5346333 - DNA, 15 bp, Homo sapiens
aaggcattccacagg

SEQ ID NO: 5346334 - DNA, 19 bp, Homo sapiens
aaggcattctcccagctct

SEQ ID NO: 5346335 - DNA, 19 bp, Homo sapiens
aaggcattgcacagagtga

SEQ ID NO: 5346336 - DNA, 22 bp, Homo sapiens
aaggcatttgattaaattatga

SEQ ID NO: 5346337 - DNA, 21 bp, Homo sapiens
aaggcatttgtttaatttata

SEQ ID NO: 5346338 - DNA, 17 bp, Homo sapiens
aaggccaaaatcaagag

SEQ ID NO: 5346339 - DNA, 18 bp, Homo sapiens
aaggccaaaatcaagagt

SEQ ID NO: 5346340 - DNA, 19 bp, Homo sapiens
aaggccaagaggctgttcc

SEQ ID NO: 5346341 - DNA, 14 bp, Homo sapiens
aaggccaaggcctc

SEQ ID NO: 5346342 - DNA, 15 bp, Homo sapiens
aaggccaaggcctca

SEQ ID NO: 5346343 - DNA, 15 bp, Homo sapiens
aaggccaaggtgctg

SEQ ID NO: 5346344 - DNA, 15 bp, Homo sapiens
aaggccaatatacct

SEQ ID NO: 5346345 - DNA, 17 bp, Homo sapiens
aaggccaatgggctaga

SEQ ID NO: 5346346 - DNA, 20 bp, Homo sapiens
aaggccaatgggctagaggg

SEQ ID NO: 5346347 - DNA, 15 bp, Homo sapiens
aaggccacaggcagt

SEQ ID NO: 5346348 - DNA, 13 bp, Homo sapiens
aaggccacaggcc

SEQ ID NO: 5346349 - DNA, 18 bp, Homo sapiens
aaggccacctctgcctct

SEQ ID NO: 5346350 - DNA, 14 bp, Homo sapiens
aaggccagaaaaag

SEQ ID NO: 5346351 - DNA, 22 bp, Homo sapiens
aaggccagaaaaagaagaagga

SEQ ID NO: 5346352 - DNA, 18 bp, Homo sapiens
aaggccagaaaaggcagc

SEQ ID NO: 5346353 - DNA, 18 bp, Homo sapiens
aaggccagaaggaggggg

SEQ ID NO: 5346354 - DNA, 17 bp, Homo sapiens
aaggccagacctgcaga

SEQ ID NO: 5346355 - DNA, 16 bp, Homo sapiens
aaggccagagagggaa

SEQ ID NO: 5346356 - DNA, 23 bp, Homo sapiens
aaggccagagagggaaaaggcag

SEQ ID NO: 5346357 - DNA, 17 bp, Homo sapiens
aaggccagagtggcctg

SEQ ID NO: 5346358 - DNA, 23 bp, Homo sapiens
aaggccagagtggcctggccagg

SEQ ID NO: 5346359 - DNA, 21 bp, Homo sapiens
aaggccagcacccaaagggtt

SEQ ID NO: 5346360 - DNA, 13 bp, Homo sapiens
aaggccagcactc

SEQ ID NO: 5346361 - DNA, 13 bp, Homo sapiens
aaggccagcagct

SEQ ID NO: 5346362 - DNA, 14 bp, Homo sapiens
aaggccagccattt

SEQ ID NO: 5346363 - DNA, 22 bp, Homo sapiens
aaggccagccatttttcagtag

SEQ ID NO: 5346364 - DNA, 19 bp, Homo sapiens
aaggccagctgactagatc

SEQ ID NO: 5346365 - DNA, 19 bp, Homo sapiens
aaggccagctggcagcaga

SEQ ID NO: 5346366 - DNA, 11 bp, Homo sapiens
aaggccagggc

SEQ ID NO: 5346367 - DNA, 21 bp, Homo sapiens
aaggccagtccccatttctgc

SEQ ID NO: 5346368 - DNA, 21 bp, Homo sapiens
aaggccatggagagctggagc

SEQ ID NO: 5346369 - DNA, 22 bp, Homo sapiens
aaggccatggagagctggagcc

SEQ ID NO: 5346370 - DNA, 18 bp, Homo sapiens
aaggccatggggcagcct

SEQ ID NO: 5346371 - DNA, 14 bp, Homo sapiens
aaggcccagaagcc

SEQ ID NO: 5346372 - DNA, 23 bp, Homo sapiens
aaggcccagacctggcctctgcc

SEQ ID NO: 5346373 - DNA, 18 bp, Homo sapiens
aaggcccagcccctagaa

SEQ ID NO: 5346374 - DNA, 14 bp, Homo sapiens
aaggcccagccctg

SEQ ID NO: 5346375 - DNA, 16 bp, Homo sapiens
aaggcccagccctggg

SEQ ID NO: 5346376 - DNA, 13 bp, Homo sapiens
aaggcccagctgc

SEQ ID NO: 5346377 - DNA, 13 bp, Homo sapiens
aaggcccatgccc

SEQ ID NO: 5346378 - DNA, 18 bp, Homo sapiens
aaggccccaaggtttaca

SEQ ID NO: 5346379 - DNA, 15 bp, Homo sapiens
aaggccccagagact

SEQ ID NO: 5346380 - DNA, 23 bp, Homo sapiens
aaggccccagggacagaggccaa

SEQ ID NO: 5346381 - DNA, 14 bp, Homo sapiens
aaggccccctacgc

SEQ ID NO: 5346382 - DNA, 14 bp, Homo sapiens
aaggccccctgcct

SEQ ID NO: 5346383 - DNA, 19 bp, Homo sapiens
aaggccccgcccaggctta

SEQ ID NO: 5346384 - DNA, 12 bp, Homo sapiens
aaggcccctccc

SEQ ID NO: 5346385 - DNA, 13 bp, Homo sapiens
aaggccccttccc

SEQ ID NO: 5346386 - DNA, 15 bp, Homo sapiens
aaggccccttccctg

SEQ ID NO: 5346387 - DNA, 16 bp, Homo sapiens
aaggccccttccctgg

SEQ ID NO: 5346388 - DNA, 16 bp, Homo sapiens
aaggcccgagcagctg

SEQ ID NO: 5346389 - DNA, 20 bp, Homo sapiens
aaggcccgagcagctgagca

SEQ ID NO: 5346390 - DNA, 14 bp, Homo sapiens
aaggcccgaggagg

SEQ ID NO: 5346391 - DNA, 18 bp, Homo sapiens
aaggcccgaggaggccga

SEQ ID NO: 5346392 - DNA, 23 bp, Homo sapiens
aaggcccggccccatcagaggct

SEQ ID NO: 5346393 - DNA, 14 bp, Homo sapiens
aaggcccggctgag

SEQ ID NO: 5346394 - DNA, 14 bp, Homo sapiens
aaggccctcattct

SEQ ID NO: 5346395 - DNA, 19 bp, Homo sapiens
aaggccctgcatctgtctg

SEQ ID NO: 5346396 - DNA, 15 bp, Homo sapiens
aaggccctgctgccc

SEQ ID NO: 5346397 - DNA, 22 bp, Homo sapiens
aaggccctgctttttttcttaa

SEQ ID NO: 5346398 - DNA, 21 bp, Homo sapiens
aaggccctgtcccagcagaag

SEQ ID NO: 5346399 - DNA, 23 bp, Homo sapiens
aaggccctgttagtgcactgatt

SEQ ID NO: 5346400 - DNA, 23 bp, Homo sapiens
aaggcccttaactatcaccagtg

SEQ ID NO: 5346401 - DNA, 16 bp, Homo sapiens
aaggcccttagaggga

SEQ ID NO: 5346402 - DNA, 18 bp, Homo sapiens
aaggccgaagctctggct

SEQ ID NO: 5346403 - DNA, 19 bp, Homo sapiens
aaggccgacaccactcctg

SEQ ID NO: 5346404 - DNA, 14 bp, Homo sapiens
aaggccgagaagca

SEQ ID NO: 5346405 - DNA, 18 bp, Homo sapiens
aaggccgagaagcaagaa

SEQ ID NO: 5346406 - DNA, 23 bp, Homo sapiens
aaggccgagcgttcccagcaggg

SEQ ID NO: 5346407 - DNA, 17 bp, Homo sapiens
aaggccgagggccaggc

SEQ ID NO: 5346408 - DNA, 18 bp, Homo sapiens
aaggccgagggccaggca

SEQ ID NO: 5346409 - DNA, 19 bp, Homo sapiens
aaggccgagggccaggcag

SEQ ID NO: 5346410 - DNA, 15 bp, Homo sapiens
aaggccgccagcgtg

SEQ ID NO: 5346411 - DNA, 15 bp, Homo sapiens
aaggccgcccacctg

SEQ ID NO: 5346412 - DNA, 16 bp, Homo sapiens
aaggccgcccacctgc

SEQ ID NO: 5346413 - DNA, 20 bp, Homo sapiens
aaggccgctgccccagcccc

SEQ ID NO: 5346414 - DNA, 22 bp, Homo sapiens
aaggccgctgttcacccacagg

SEQ ID NO: 5346415 - DNA, 21 bp, Homo sapiens
aaggccggagacccacagccc

SEQ ID NO: 5346416 - DNA, 22 bp, Homo sapiens
aaggccggagacccacagccct

SEQ ID NO: 5346417 - DNA, 22 bp, Homo sapiens
aaggccggcagcgggcggaggg

SEQ ID NO: 5346418 - DNA, 15 bp, Homo sapiens
aaggccggtgggaag

SEQ ID NO: 5346419 - DNA, 15 bp, Homo sapiens
aaggccgtcatttca

SEQ ID NO: 5346420 - DNA, 14 bp, Homo sapiens
aaggccgtgtgttt

SEQ ID NO: 5346421 - DNA, 23 bp, Homo sapiens
aaggccgtgtgtttagaagccta

SEQ ID NO: 5346422 - DNA, 19 bp, Homo sapiens
aaggcctaccccagttcct

SEQ ID NO: 5346423 - DNA, 16 bp, Homo sapiens
aaggcctactatacat

SEQ ID NO: 5346424 - DNA, 15 bp, Homo sapiens
aaggcctaggattct

SEQ ID NO: 5346425 - DNA, 22 bp, Homo sapiens
aaggcctaggctaggacgttgg

SEQ ID NO: 5346426 - DNA, 21 bp, Homo sapiens
aaggcctatgccacctgcagc

SEQ ID NO: 5346427 - DNA, 21 bp, Homo sapiens
aaggcctcactcaagcctgag

SEQ ID NO: 5346428 - DNA, 14 bp, Homo sapiens
aaggcctcaggaga

SEQ ID NO: 5346429 - DNA, 15 bp, Homo sapiens
aaggcctcaggagag

SEQ ID NO: 5346430 - DNA, 10 bp, Homo sapiens
aaggcctccc

SEQ ID NO: 5346431 - DNA, 12 bp, Homo sapiens
aaggcctcctcc

SEQ ID NO: 5346432 - DNA, 13 bp, Homo sapiens
aaggcctcctccc

SEQ ID NO: 5346433 - DNA, 16 bp, Homo sapiens
aaggcctcctccccca

SEQ ID NO: 5346434 - DNA, 15 bp, Homo sapiens
aaggcctcgcaggaa

SEQ ID NO: 5346435 - DNA, 18 bp, Homo sapiens
aaggcctcgcaggaagac

SEQ ID NO: 5346436 - DNA, 15 bp, Homo sapiens
aaggcctctctctgc

SEQ ID NO: 5346437 - DNA, 14 bp, Homo sapiens
aaggcctcttgctg

SEQ ID NO: 5346438 - DNA, 19 bp, Homo sapiens
aaggcctcttgctggtgca

SEQ ID NO: 5346439 - DNA, 13 bp, Homo sapiens
aaggcctcttgta

SEQ ID NO: 5346440 - DNA, 21 bp, Homo sapiens
aaggcctcttgtaaagactgg

SEQ ID NO: 5346441 - DNA, 15 bp, Homo sapiens
aaggcctcttgtgct

SEQ ID NO: 5346442 - DNA, 16 bp, Homo sapiens
aaggcctcttgtgctc

SEQ ID NO: 5346443 - DNA, 19 bp, Homo sapiens
aaggcctgagggaagccca

SEQ ID NO: 5346444 - DNA, 23 bp, Homo sapiens
aaggcctgagggaagcccacccg

SEQ ID NO: 5346445 - DNA, 14 bp, Homo sapiens
aaggcctgcacaca

SEQ ID NO: 5346446 - DNA, 15 bp, Homo sapiens
aaggcctggctggaa

SEQ ID NO: 5346447 - DNA, 17 bp, Homo sapiens
aaggcctggggtgaccc

SEQ ID NO: 5346448 - DNA, 13 bp, Homo sapiens
aaggcctggtctg

SEQ ID NO: 5346449 - DNA, 14 bp, Homo sapiens
aaggcctggtctgg

SEQ ID NO: 5346450 - DNA, 14 bp, Homo sapiens
aaggccttagccat

SEQ ID NO: 5346451 - DNA, 12 bp, Homo sapiens
aaggccttctcc

SEQ ID NO: 5346452 - DNA, 12 bp, Homo sapiens
aaggccttgaag

SEQ ID NO: 5346453 - DNA, 19 bp, Homo sapiens
aaggccttgcctggcctga

SEQ ID NO: 5346454 - DNA, 13 bp, Homo sapiens
aaggccttgctgt

SEQ ID NO: 5346455 - DNA, 16 bp, Homo sapiens
aaggcctttaaaattt

SEQ ID NO: 5346456 - DNA, 16 bp, Homo sapiens
aaggcctttaataaat

SEQ ID NO: 5346457 - DNA, 12 bp, Homo sapiens
aaggcctttctt

SEQ ID NO: 5346458 - DNA, 16 bp, Homo sapiens
aaggcctttcttctgt

SEQ ID NO: 5346459 - DNA, 14 bp, Homo sapiens
aaggcgatagctga

SEQ ID NO: 5346460 - DNA, 23 bp, Homo sapiens
aaggcgatcccatcttgataaga

SEQ ID NO: 5346461 - DNA, 15 bp, Homo sapiens
aaggcgcccccgccc

SEQ ID NO: 5346462 - DNA, 17 bp, Homo sapiens
aaggcgctgggtgcctg

SEQ ID NO: 5346463 - DNA, 20 bp, Homo sapiens
aaggcggagggtctccctgg

SEQ ID NO: 5346464 - DNA, 22 bp, Homo sapiens
aaggcggagggtctccctgggc

SEQ ID NO: 5346465 - DNA, 21 bp, Homo sapiens
aaggcggtggacttgaacttt

SEQ ID NO: 5346466 - DNA, 20 bp, Homo sapiens
aaggcgtgcaaggggctcag

SEQ ID NO: 5346467 - DNA, 19 bp, Homo sapiens
aaggcgtggcttctgcagg

SEQ ID NO: 5346468 - DNA, 21 bp, Homo sapiens
aaggctaaagaagacacacag

SEQ ID NO: 5346469 - DNA, 22 bp, Homo sapiens
aaggctaaagaagacacacagc

SEQ ID NO: 5346470 - DNA, 18 bp, Homo sapiens
aaggctaacatcccactt

SEQ ID NO: 5346471 - DNA, 15 bp, Homo sapiens
aaggctaagaaaaag

SEQ ID NO: 5346472 - DNA, 17 bp, Homo sapiens
aaggctaagcatggcct

SEQ ID NO: 5346473 - DNA, 20 bp, Homo sapiens
aaggctaagcatggcctgga

SEQ ID NO: 5346474 - DNA, 14 bp, Homo sapiens
aaggctacaggctc

SEQ ID NO: 5346475 - DNA, 13 bp, Homo sapiens
aaggctacctttg

SEQ ID NO: 5346476 - DNA, 21 bp, Homo sapiens
aaggctactacagagaaggct

SEQ ID NO: 5346477 - DNA, 23 bp, Homo sapiens
aaggctacttcggggctgggaag

SEQ ID NO: 5346478 - DNA, 15 bp, Homo sapiens
aaggctatgtgatta

SEQ ID NO: 5346479 - DNA, 14 bp, Homo sapiens
aaggctcagaagga

SEQ ID NO: 5346480 - DNA, 16 bp, Homo sapiens
aaggctcagtctcagg

SEQ ID NO: 5346481 - DNA, 17 bp, Homo sapiens
aaggctcagtctcagga

SEQ ID NO: 5346482 - DNA, 15 bp, Homo sapiens
aaggctccaagacct

SEQ ID NO: 5346483 - DNA, 14 bp, Homo sapiens
aaggctccaggagc

SEQ ID NO: 5346484 - DNA, 21 bp, Homo sapiens
aaggtagaacaaagaaaatgt

SEQ ID NO: 5346485 - DNA, 14 bp, Homo sapiens
aaggtagactttta

SEQ ID NO: 5346486 - DNA, 15 bp, Homo sapiens
aaggtagagatgtgt

SEQ ID NO: 5346487 - DNA, 16 bp, Homo sapiens
aaggtagagatgtgtg

SEQ ID NO: 5346488 - DNA, 13 bp, Homo sapiens
aaggtagagccca

SEQ ID NO: 5346489 - DNA, 20 bp, Homo sapiens
aaggtagcccagcactgtga

SEQ ID NO: 5346490 - DNA, 18 bp, Homo sapiens
aaggtagcttacctgaca

SEQ ID NO: 5346491 - DNA, 17 bp, Homo sapiens
aaggtaggaagagaggt

SEQ ID NO: 5346492 - DNA, 19 bp, Homo sapiens
aaggtaggttttaaaaata

SEQ ID NO: 5346493 - DNA, 12 bp, Homo sapiens
aaggtagttttt

SEQ ID NO: 5346494 - DNA, 16 bp, Homo sapiens
aaggtatatcattcta

SEQ ID NO: 5346495 - DNA, 22 bp, Homo sapiens
aaggtatatcattctaaagata

SEQ ID NO: 5346496 - DNA, 23 bp, Homo sapiens
aaggtatatctaggtttatgaca

SEQ ID NO: 5346497 - DNA, 15 bp, Homo sapiens
aaggtatattgtgaa

SEQ ID NO: 5346498 - DNA, 14 bp, Homo sapiens
aaggtatcacacac

SEQ ID NO: 5346499 - DNA, 15 bp, Homo sapiens
aaggtatcacacact

SEQ ID NO: 5346500 - DNA, 20 bp, Homo sapiens
aaggtatcagttatatgata

SEQ ID NO: 5346501 - DNA, 22 bp, Homo sapiens
aaggtatcagttatatgatatt

SEQ ID NO: 5346502 - DNA, 20 bp, Homo sapiens
aaggtatcagttgcaataat

SEQ ID NO: 5346503 - DNA, 13 bp, Homo sapiens
aaggtatctggta

SEQ ID NO: 5346504 - DNA, 14 bp, Homo sapiens
aaggtatctggtat

SEQ ID NO: 5346505 - DNA, 22 bp, Homo sapiens
aaggtattaaattgatgttgct

SEQ ID NO: 5346506 - DNA, 22 bp, Homo sapiens
aaggtattccttttgtgtacag

SEQ ID NO: 5346507 - DNA, 16 bp, Homo sapiens
aaggtattggcctgtt

SEQ ID NO: 5346508 - DNA, 18 bp, Homo sapiens
aaggtatttaataggttt

SEQ ID NO: 5346509 - DNA, 15 bp, Homo sapiens
aaggtatttacacat

SEQ ID NO: 5346510 - DNA, 20 bp, Homo sapiens
aaggtatttagaatatatta

SEQ ID NO: 5346511 - DNA, 20 bp, Homo sapiens
aaggtatttcgaaactgcca

SEQ ID NO: 5346512 - DNA, 19 bp, Homo sapiens
aaggtatttgggaaacttg

SEQ ID NO: 5346513 - DNA, 22 bp, Homo sapiens
aaggtatttgggaaacttgtca

SEQ ID NO: 5346514 - DNA, 19 bp, Homo sapiens
aaggtattttgaataccat

SEQ ID NO: 5346515 - DNA, 18 bp, Homo sapiens
aaggtcaaaaacaaacta

SEQ ID NO: 5346516 - DNA, 15 bp, Homo sapiens
aaggtcaacaataaa

SEQ ID NO: 5346517 - DNA, 23 bp, Homo sapiens
aaggtcacaacccttctctgttg

SEQ ID NO: 5346518 - DNA, 14 bp, Homo sapiens
aaggtcacctcact

SEQ ID NO: 5346519 - DNA, 17 bp, Homo sapiens
aaggtcacctcactcag

SEQ ID NO: 5346520 - DNA, 18 bp, Homo sapiens
aaggtcacctcactcagc

SEQ ID NO: 5346521 - DNA, 20 bp, Homo sapiens
aaggtcactcttggtccctg

SEQ ID NO: 5346522 - DNA, 15 bp, Homo sapiens
aaggtcactgtttcc

SEQ ID NO: 5346523 - DNA, 16 bp, Homo sapiens
aaggtcagcgagaagg

SEQ ID NO: 5346524 - DNA, 10 bp, Homo sapiens
aaggtcagga

SEQ ID NO: 5346525 - DNA, 18 bp, Homo sapiens
aaggtcagtgttataaaa

SEQ ID NO: 5346526 - DNA, 15 bp, Homo sapiens
aaggtcataagtttc

SEQ ID NO: 5346527 - DNA, 17 bp, Homo sapiens
aaggtcatctttttccc

SEQ ID NO: 5346528 - DNA, 14 bp, Homo sapiens
aaggtcatggtctg

SEQ ID NO: 5346529 - DNA, 12 bp, Homo sapiens
aaggtcattttt

SEQ ID NO: 5346530 - DNA, 18 bp, Homo sapiens
aaggtcattttttttaag

SEQ ID NO: 5346531 - DNA, 22 bp, Homo sapiens
aaggtccatggagtacggctgg

SEQ ID NO: 5346532 - DNA, 12 bp, Homo sapiens
aaggtccctgct

SEQ ID NO: 5346533 - DNA, 18 bp, Homo sapiens
aaggtccgagctctgtcc

SEQ ID NO: 5346534 - DNA, 19 bp, Homo sapiens
aaggtccgcaccctgtcct

SEQ ID NO: 5346535 - DNA, 19 bp, Homo sapiens
aaggtccggtgttctaaga

SEQ ID NO: 5346536 - DNA, 20 bp, Homo sapiens
aaggtcctctgtcagtcaca

SEQ ID NO: 5346537 - DNA, 14 bp, Homo sapiens
aaggtcctcttgaa

SEQ ID NO: 5346538 - DNA, 18 bp, Homo sapiens
aaggtcctgaaagtaact

SEQ ID NO: 5346539 - DNA, 13 bp, Homo sapiens
aaggtcctgccct

SEQ ID NO: 5346540 - DNA, 23 bp, Homo sapiens
aaggtcctgcttgaactgctgcc

SEQ ID NO: 5346541 - DNA, 23 bp, Homo sapiens
aaggtccttgcctgaactccaga

SEQ ID NO: 5346542 - DNA, 18 bp, Homo sapiens
aaggtcggaggcttggga

SEQ ID NO: 5346543 - DNA, 20 bp, Homo sapiens
aaggtcgggacagctgtgcc

SEQ ID NO: 5346544 - DNA, 19 bp, Homo sapiens
aaggtctataaacatgaag

SEQ ID NO: 5346545 - DNA, 13 bp, Homo sapiens
aaggtctatgcag

SEQ ID NO: 5346546 - DNA, 19 bp, Homo sapiens
aaggtctcacactcctcct

SEQ ID NO: 5346547 - DNA, 13 bp, Homo sapiens
aaggtctcatgcc

SEQ ID NO: 5346548 - DNA, 18 bp, Homo sapiens
aaggtctcatgcctgaga

SEQ ID NO: 5346549 - DNA, 19 bp, Homo sapiens
aaggtctcatgcctgagaa

SEQ ID NO: 5346550 - DNA, 20 bp, Homo sapiens
aaggtctcatttgatattgt

SEQ ID NO: 5346551 - DNA, 17 bp, Homo sapiens
aaggtctccaagggagg

SEQ ID NO: 5346552 - DNA, 19 bp, Homo sapiens
aaggtctcctaaaactggg

SEQ ID NO: 5346553 - DNA, 18 bp, Homo sapiens
aaggtctctctggctcta

SEQ ID NO: 5346554 - DNA, 16 bp, Homo sapiens
aaggtctctctttgga

SEQ ID NO: 5346555 - DNA, 13 bp, Homo sapiens
aaggtctgagcca

SEQ ID NO: 5346556 - DNA, 18 bp, Homo sapiens
aaggtctgatttgcagga

SEQ ID NO: 5346557 - DNA, 17 bp, Homo sapiens
aaggtctgtttgctgtt

SEQ ID NO: 5346558 - DNA, 13 bp, Homo sapiens
aaggtcttcttgt

SEQ ID NO: 5346559 - DNA, 13 bp, Homo sapiens
aaggtctttggtt

SEQ ID NO: 5346560 - DNA, 19 bp, Homo sapiens
aaggtctttggttcagcta

SEQ ID NO: 5346561 - DNA, 14 bp, Homo sapiens
aaggtctttgtaaa

SEQ ID NO: 5346562 - DNA, 18 bp, Homo sapiens
aaggtcttttgagggcta

SEQ ID NO: 5346563 - DNA, 14 bp, Homo sapiens
aaggtgaaaattgt

SEQ ID NO: 5346564 - DNA, 19 bp, Homo sapiens
aaggtgaaaggcatgtctt

SEQ ID NO: 5346565 - DNA, 12 bp, Homo sapiens
aaggtgaacttt

SEQ ID NO: 5346566 - DNA, 13 bp, Homo sapiens
aaggtgaactttg

SEQ ID NO: 5346567 - DNA, 11 bp, Homo sapiens
aaggtgaagga

SEQ ID NO: 5346568 - DNA, 15 bp, Homo sapiens
aaggtgaatgaaaga

SEQ ID NO: 5346569 - DNA, 19 bp, Homo sapiens
aaggtgacatcggaaaaat

SEQ ID NO: 5346570 - DNA, 17 bp, Homo sapiens
aaggtgaccgcccagct

SEQ ID NO: 5346571 - DNA, 14 bp, Homo sapiens
aaggtgactgtgtg

SEQ ID NO: 5346572 - DNA, 22 bp, Homo sapiens
aaggtgacttcctctggtgttt

SEQ ID NO: 5346573 - DNA, 15 bp, Homo sapiens
aaggtgactttctga

SEQ ID NO: 5346574 - DNA, 16 bp, Homo sapiens
aaggtgagaattaagt

SEQ ID NO: 5346575 - DNA, 23 bp, Homo sapiens
aaggtgagaggtgtaggttgaaa

SEQ ID NO: 5346576 - DNA, 13 bp, Homo sapiens
aaggtgaggcctg

SEQ ID NO: 5346577 - DNA, 14 bp, Homo sapiens
aaggtgaggcctgt

SEQ ID NO: 5346578 - DNA, 17 bp, Homo sapiens
aaggtgaggcctgtctg

SEQ ID NO: 5346579 - DNA, 21 bp, Homo sapiens
aaggtgaggtgaactccaggc

SEQ ID NO: 5346580 - DNA, 22 bp, Homo sapiens
aaggtgataaaatcataagtat

SEQ ID NO: 5346581 - DNA, 23 bp, Homo sapiens
aaggtgcacattttccacggaaa

SEQ ID NO: 5346582 - DNA, 18 bp, Homo sapiens
aaggtgcacctgccccag

SEQ ID NO: 5346583 - DNA, 21 bp, Homo sapiens
aaggtgcacctgccccaggct

SEQ ID NO: 5346584 - DNA, 17 bp, Homo sapiens
aaggtgcactccagact

SEQ ID NO: 5346585 - DNA, 18 bp, Homo sapiens
aaggtgcactccagactc

SEQ ID NO: 5346586 - DNA, 12 bp, Homo sapiens
aaggtgcagctg

SEQ ID NO: 5346587 - DNA, 14 bp, Homo sapiens
aaggtgcagttccc

SEQ ID NO: 5346588 - DNA, 17 bp, Homo sapiens
aaggtgcatctttccct

SEQ ID NO: 5346589 - DNA, 18 bp, Homo sapiens
aaggtgcatctttccctg

SEQ ID NO: 5346590 - DNA, 17 bp, Homo sapiens
aaggtgccagaaggaag

SEQ ID NO: 5346591 - DNA, 18 bp, Homo sapiens
aaggtgccatggaagagg

SEQ ID NO: 5346592 - DNA, 16 bp, Homo sapiens
aaggtgccgtgagcag

SEQ ID NO: 5346593 - DNA, 19 bp, Homo sapiens
aaggtgcctcagttttcct

SEQ ID NO: 5346594 - DNA, 21 bp, Homo sapiens
aaggtgcctcagttttccttc

SEQ ID NO: 5346595 - DNA, 18 bp, Homo sapiens
aaggtgcctgccatagcc

SEQ ID NO: 5346596 - DNA, 14 bp, Homo sapiens
aaggtgcctggcca

SEQ ID NO: 5346597 - DNA, 15 bp, Homo sapiens
aaggtgcggggagaa

SEQ ID NO: 5346598 - DNA, 19 bp, Homo sapiens
aaggtgctaaatctgcgat

SEQ ID NO: 5346599 - DNA, 13 bp, Homo sapiens
aaggtgctaacat

SEQ ID NO: 5346600 - DNA, 14 bp, Homo sapiens
aaggtgctaacata

SEQ ID NO: 5346601 - DNA, 13 bp, Homo sapiens
aaggtgctaggat

SEQ ID NO: 5346602 - DNA, 17 bp, Homo sapiens
aaggtgctatttaacat

SEQ ID NO: 5346603 - DNA, 19 bp, Homo sapiens
aaggtgctctctttctgtc

SEQ ID NO: 5346604 - DNA, 13 bp, Homo sapiens
aaggtgctctgtg

SEQ ID NO: 5346605 - DNA, 18 bp, Homo sapiens
aaggtgctgacggccagg

SEQ ID NO: 5346606 - DNA, 15 bp, Homo sapiens
aaggtgctggaggtg

SEQ ID NO: 5346607 - DNA, 21 bp, Homo sapiens
aaggtgctgttgtcattgctt

SEQ ID NO: 5346608 - DNA, 23 bp, Homo sapiens
aaggtgctgttgtcattgcttta

SEQ ID NO: 5346609 - DNA, 12 bp, Homo sapiens
aaggtggaataa

SEQ ID NO: 5346610 - DNA, 18 bp, Homo sapiens
aaggtggaccagaatgaa

SEQ ID NO: 5346611 - DNA, 20 bp, Homo sapiens
aaggtggactggaaggggcc

SEQ ID NO: 5346612 - DNA, 19 bp, Homo sapiens
aaggtggacttgtctccca

SEQ ID NO: 5346613 - DNA, 21 bp, Homo sapiens
aaggtggacttgtctcccagt

SEQ ID NO: 5346614 - DNA, 13 bp, Homo sapiens
aaggtggagggaa

SEQ ID NO: 5346615 - DNA, 18 bp, Homo sapiens
aaggtggagtttctctgt

SEQ ID NO: 5346616 - DNA, 19 bp, Homo sapiens
aaggtggatggccccagca

SEQ ID NO: 5346617 - DNA, 14 bp, Homo sapiens
aaggtggattttgt

SEQ ID NO: 5346618 - DNA, 21 bp, Homo sapiens
aaggtggcagatgtcttccct

SEQ ID NO: 5346619 - DNA, 16 bp, Homo sapiens
aaggtggcagcaagca

SEQ ID NO: 5346620 - DNA, 20 bp, Homo sapiens
aaggtggcagcttgtgaaga

SEQ ID NO: 5346621 - DNA, 15 bp, Homo sapiens
aaggtggccacagca

SEQ ID NO: 5346622 - DNA, 17 bp, Homo sapiens
aaggtggcctctgcctg

SEQ ID NO: 5346623 - DNA, 21 bp, Homo sapiens
aaggtggcctctgcctggggc

SEQ ID NO: 5346624 - DNA, 23 bp, Homo sapiens
aaggtggcctgcggggagccatc

SEQ ID NO: 5346625 - DNA, 23 bp, Homo sapiens
aaggtggctggagatggctgctg

SEQ ID NO: 5346626 - DNA, 11 bp, Homo sapiens
aaggtgggagg

SEQ ID NO: 5346627 - DNA, 16 bp, Homo sapiens
aaggtggggacaggga

SEQ ID NO: 5346628 - DNA, 22 bp, Homo sapiens
aaggtggggacctggggggagg

SEQ ID NO: 5346629 - DNA, 17 bp, Homo sapiens
aaggtggggagaagctg

SEQ ID NO: 5346630 - DNA, 16 bp, Homo sapiens
aaggtggggccctgcc

SEQ ID NO: 5346631 - DNA, 23 bp, Homo sapiens
aaggtggggtatttaccacagca

SEQ ID NO: 5346632 - DNA, 13 bp, Homo sapiens
aaggtggggtgga

SEQ ID NO: 5346633 - DNA, 21 bp, Homo sapiens
aaggtgggtccaggaaggcag

SEQ ID NO: 5346634 - DNA, 15 bp, Homo sapiens
aaggtgggtgaggct

SEQ ID NO: 5346635 - DNA, 15 bp, Homo sapiens
aaggtggtaaattca

SEQ ID NO: 5346636 - DNA, 22 bp, Homo sapiens
aaggtggtatgtaatttatgca

SEQ ID NO: 5346637 - DNA, 23 bp, Homo sapiens
aaggtggtggggctgccggatct

SEQ ID NO: 5346638 - DNA, 20 bp, Homo sapiens
aaggtggtgggggtgcagat

SEQ ID NO: 5346639 - DNA, 23 bp, Homo sapiens
aaggtgtaaaatatctacctgcc

SEQ ID NO: 5346640 - DNA, 16 bp, Homo sapiens
aaggtgtagaaaaggt

SEQ ID NO: 5346641 - DNA, 13 bp, Homo sapiens
aaggtgtcatttg

SEQ ID NO: 5346642 - DNA, 14 bp, Homo sapiens
aaggtgtcatttga

SEQ ID NO: 5346643 - DNA, 13 bp, Homo sapiens
aaggtgtccaggg

SEQ ID NO: 5346644 - DNA, 15 bp, Homo sapiens
aaggtgtccctgcct

SEQ ID NO: 5346645 - DNA, 18 bp, Homo sapiens
aaggtgtcctacagaaaa

SEQ ID NO: 5346646 - DNA, 15 bp, Homo sapiens
aaggtgtcttcctcc

SEQ ID NO: 5346647 - DNA, 15 bp, Homo sapiens
aaggtgtgaggagag

SEQ ID NO: 5346648 - DNA, 13 bp, Homo sapiens
aaggtgtgcaaag

SEQ ID NO: 5346649 - DNA, 17 bp, Homo sapiens
aaggtgtgcctggcagc

SEQ ID NO: 5346650 - DNA, 14 bp, Homo sapiens
aaggtgtgctacag

SEQ ID NO: 5346651 - DNA, 14 bp, Homo sapiens
aaggtgtgctattt

SEQ ID NO: 5346652 - DNA, 21 bp, Homo sapiens
aaggtgtggaggctcctgtgg

SEQ ID NO: 5346653 - DNA, 22 bp, Homo sapiens
aaggtgtggaggctcctgtggt

SEQ ID NO: 5346654 - DNA, 18 bp, Homo sapiens
aaggtgtgtactcagggc

SEQ ID NO: 5346655 - DNA, 22 bp, Homo sapiens
aaggtgtgtcctcaagaagaaa

SEQ ID NO: 5346656 - DNA, 21 bp, Homo sapiens
aaggtgtgtccttgaactgag

SEQ ID NO: 5346657 - DNA, 22 bp, Homo sapiens
aaggtgtgtccttgaactgagg

SEQ ID NO: 5346658 - DNA, 23 bp, Homo sapiens
aaggtgtgtccttgaactgaggc

SEQ ID NO: 5346659 - DNA, 18 bp, Homo sapiens
aaggtgtttatttttaac

SEQ ID NO: 5346660 - DNA, 16 bp, Homo sapiens
aaggtgtttctctgta

SEQ ID NO: 5346661 - DNA, 12 bp, Homo sapiens
aaggtgtttgaa

SEQ ID NO: 5346662 - DNA, 18 bp, Homo sapiens
aagtatataaattggctt

SEQ ID NO: 5346663 - DNA, 17 bp, Homo sapiens
aagtatatacagagcct

SEQ ID NO: 5346664 - DNA, 18 bp, Homo sapiens
aagtatatacttttaaat

SEQ ID NO: 5346665 - DNA, 22 bp, Homo sapiens
aagtatatacttttaaattatg

SEQ ID NO: 5346666 - DNA, 18 bp, Homo sapiens
aagtatatatatatatta

SEQ ID NO: 5346667 - DNA, 13 bp, Homo sapiens
aagtatatattta

SEQ ID NO: 5346668 - DNA, 18 bp, Homo sapiens
aagtatatgtcatttact

SEQ ID NO: 5346669 - DNA, 21 bp, Homo sapiens
aagtatatgtgaaaaaaatga

SEQ ID NO: 5346670 - DNA, 16 bp, Homo sapiens
aagtatatgtgcagtc

SEQ ID NO: 5346671 - DNA, 19 bp, Homo sapiens
aagtatatgttctgattat

SEQ ID NO: 5346672 - DNA, 19 bp, Homo sapiens
aagtatattatatggcagg

SEQ ID NO: 5346673 - DNA, 18 bp, Homo sapiens
aagtatattcaaaaatta

SEQ ID NO: 5346674 - DNA, 18 bp, Homo sapiens
aagtatatttatttctag

SEQ ID NO: 5346675 - DNA, 13 bp, Homo sapiens
aagtatatttgta

SEQ ID NO: 5346676 - DNA, 14 bp, Homo sapiens
aagtatatttgtaa

SEQ ID NO: 5346677 - DNA, 18 bp, Homo sapiens
aagtatcaagtatagaaa

SEQ ID NO: 5346678 - DNA, 13 bp, Homo sapiens
aagtatcactcta

SEQ ID NO: 5346679 - DNA, 21 bp, Homo sapiens
aagtatcactctaaaaaacat

SEQ ID NO: 5346680 - DNA, 22 bp, Homo sapiens
aagtatcactctaaaaaacatt

SEQ ID NO: 5346681 - DNA, 20 bp, Homo sapiens
aagtatcagctacaattgta

SEQ ID NO: 5346682 - DNA, 19 bp, Homo sapiens
aagtatcatcagtgtagaa

SEQ ID NO: 5346683 - DNA, 13 bp, Homo sapiens
aagtatccaatta

SEQ ID NO: 5346684 - DNA, 20 bp, Homo sapiens
aagtatccaattatgtgaca

SEQ ID NO: 5346685 - DNA, 22 bp, Homo sapiens
aagtatccacagaaaatgtaaa

SEQ ID NO: 5346686 - DNA, 16 bp, Homo sapiens
aagtatccctactgta

SEQ ID NO: 5346687 - DNA, 23 bp, Homo sapiens
aagtatccctactgtaatttgtg

SEQ ID NO: 5346688 - DNA, 21 bp, Homo sapiens
aagtatcctgagagcccagaa

SEQ ID NO: 5346689 - DNA, 18 bp, Homo sapiens
aagtatcctgcttctgat

SEQ ID NO: 5346690 - DNA, 17 bp, Homo sapiens
aagtatctaactcttct

SEQ ID NO: 5346691 - DNA, 20 bp, Homo sapiens
aagtatctcaacaacatgtc

SEQ ID NO: 5346692 - DNA, 22 bp, Homo sapiens
aagtatctctactttcctgatg

SEQ ID NO: 5346693 - DNA, 19 bp, Homo sapiens
aagtatcttctatttttat

SEQ ID NO: 5346694 - DNA, 22 bp, Homo sapiens
aagtatctttaacaattgtctt

SEQ ID NO: 5346695 - DNA, 18 bp, Homo sapiens
aagtatcttttttcaaaa

SEQ ID NO: 5346696 - DNA, 21 bp, Homo sapiens
aagtatgagggaaaatgagta

SEQ ID NO: 5346697 - DNA, 15 bp, Homo sapiens
aagtatgcaaaataa

SEQ ID NO: 5346698 - DNA, 22 bp, Homo sapiens
aagtatgcactaatcaatactt

SEQ ID NO: 5346699 - DNA, 21 bp, Homo sapiens
aagtatgcagattatttgccc

SEQ ID NO: 5346700 - DNA, 22 bp, Homo sapiens
aagtatgcattattaaattgta

SEQ ID NO: 5346701 - DNA, 19 bp, Homo sapiens
aagtatgccttaagcagaa

SEQ ID NO: 5346702 - DNA, 16 bp, Homo sapiens
aagtatggaatattca

SEQ ID NO: 5346703 - DNA, 18 bp, Homo sapiens
aagtatggaatattcatt

SEQ ID NO: 5346704 - DNA, 21 bp, Homo sapiens
aagtatggaatattcatttta

SEQ ID NO: 5346705 - DNA, 22 bp, Homo sapiens
aagtatggaatattcattttac

SEQ ID NO: 5346706 - DNA, 15 bp, Homo sapiens
aagtatgggaaatga

SEQ ID NO: 5346707 - DNA, 13 bp, Homo sapiens
aagtatggtgtgt

SEQ ID NO: 5346708 - DNA, 21 bp, Homo sapiens
aagtatgtaaacaggagacag

SEQ ID NO: 5346709 - DNA, 18 bp, Homo sapiens
aagtatgtcttcaaaata

SEQ ID NO: 5346710 - DNA, 19 bp, Homo sapiens
aagtatgttagtgcaaatt

SEQ ID NO: 5346711 - DNA, 21 bp, Homo sapiens
aagtatgttagtgcaaattgt

SEQ ID NO: 5346712 - DNA, 23 bp, Homo sapiens
aagtatgttagtgcaaattgtca

SEQ ID NO: 5346713 - DNA, 13 bp, Homo sapiens
aagtatgttctaa

SEQ ID NO: 5346714 - DNA, 15 bp, Homo sapiens
aagtatgttttactt

SEQ ID NO: 5346715 - DNA, 16 bp, Homo sapiens
aagtatgtttttacat

SEQ ID NO: 5346716 - DNA, 19 bp, Homo sapiens
aagtatgtttttacattat

SEQ ID NO: 5346717 - DNA, 22 bp, Homo sapiens
aagtatgtttttacattatgca

SEQ ID NO: 5346718 - DNA, 14 bp, Homo sapiens
aagtattaaaatgc

SEQ ID NO: 5346719 - DNA, 16 bp, Homo sapiens
aagtattaaaatgcat

SEQ ID NO: 5346720 - DNA, 23 bp, Homo sapiens
aagtattaaaatgcatatttcta

SEQ ID NO: 5346721 - DNA, 13 bp, Homo sapiens
aagtattaaactg

SEQ ID NO: 5346722 - DNA, 20 bp, Homo sapiens
aagtattaaactgtaaatca

SEQ ID NO: 5346723 - DNA, 16 bp, Homo sapiens
aagtattaagcagttc

SEQ ID NO: 5346724 - DNA, 21 bp, Homo sapiens
aagtattaagcagttcattct

SEQ ID NO: 5346725 - DNA, 16 bp, Homo sapiens
aagtattaagcatata

SEQ ID NO: 5346726 - DNA, 15 bp, Homo sapiens
aagtattaagcctac

SEQ ID NO: 5346727 - DNA, 17 bp, Homo sapiens
aagtattaattctcttt

SEQ ID NO: 5346728 - DNA, 14 bp, Homo sapiens
aagtattagcatga

SEQ ID NO: 5346729 - DNA, 23 bp, Homo sapiens
aagtattagcatgagctttccag

SEQ ID NO: 5346730 - DNA, 20 bp, Homo sapiens
aagtattaggggtaatatat

SEQ ID NO: 5346731 - DNA, 22 bp, Homo sapiens
aagtattaggggtaatatattg

SEQ ID NO: 5346732 - DNA, 16 bp, Homo sapiens
aagtattatacctttt

SEQ ID NO: 5346733 - DNA, 22 bp, Homo sapiens
aagtattatattttatttatct

SEQ ID NO: 5346734 - DNA, 17 bp, Homo sapiens
aagtattatctgtaaaa

SEQ ID NO: 5346735 - DNA, 20 bp, Homo sapiens
aagtattatctgtaaaaatt

SEQ ID NO: 5346736 - DNA, 17 bp, Homo sapiens
aagtattcaacaatttc

SEQ ID NO: 5346737 - DNA, 19 bp, Homo sapiens
aagtattcaacaatttcaa

SEQ ID NO: 5346738 - DNA, 11 bp, Homo sapiens
aagtattcaca

SEQ ID NO: 5346739 - DNA, 20 bp, Homo sapiens
aagtattcacatcatttggg

SEQ ID NO: 5346740 - DNA, 20 bp, Homo sapiens
aagtattcagaaattaaaat

SEQ ID NO: 5346741 - DNA, 23 bp, Homo sapiens
aagtattcagaaattaaaatatt

SEQ ID NO: 5346742 - DNA, 13 bp, Homo sapiens
aagtattcataca

SEQ ID NO: 5346743 - DNA, 17 bp, Homo sapiens
aagtattccaccttaaa

SEQ ID NO: 5346744 - DNA, 14 bp, Homo sapiens
aagtattcctgttg

SEQ ID NO: 5346745 - DNA, 16 bp, Homo sapiens
aagtattcctgttgct

SEQ ID NO: 5346746 - DNA, 20 bp, Homo sapiens
aagtattccttggcccagca

SEQ ID NO: 5346747 - DNA, 22 bp, Homo sapiens
aagtattccttggcccagcagc

SEQ ID NO: 5346748 - DNA, 21 bp, Homo sapiens
aagtattctgtactcttagat

SEQ ID NO: 5346749 - DNA, 18 bp, Homo sapiens
aagtattgcatctgtata

SEQ ID NO: 5346750 - DNA, 19 bp, Homo sapiens
aagtattgcatctgtataa

SEQ ID NO: 5346751 - DNA, 22 bp, Homo sapiens
aagtattgggacgtagagcaca

SEQ ID NO: 5346752 - DNA, 13 bp, Homo sapiens
aagtattgtaaat

SEQ ID NO: 5346753 - DNA, 15 bp, Homo sapiens
aagtattgtaaatta

SEQ ID NO: 5346754 - DNA, 17 bp, Homo sapiens
aagtattgtaaattata

SEQ ID NO: 5346755 - DNA, 15 bp, Homo sapiens
aagtattgtttacat

SEQ ID NO: 5346756 - DNA, 17 bp, Homo sapiens
aagtattgtttacatta

SEQ ID NO: 5346757 - DNA, 15 bp, Homo sapiens
aagtattgtttcctg

SEQ ID NO: 5346758 - DNA, 15 bp, Homo sapiens
aagtatttaaatgtt

SEQ ID NO: 5346759 - DNA, 21 bp, Homo sapiens
aagtatttaaatgttctaaca

SEQ ID NO: 5346760 - DNA, 19 bp, Homo sapiens
aagtatttaattagtgcta

SEQ ID NO: 5346761 - DNA, 20 bp, Homo sapiens
aagtatttaattagtgctaa

SEQ ID NO: 5346762 - DNA, 16 bp, Homo sapiens
aagtatttactgactg

SEQ ID NO: 5346763 - DNA, 20 bp, Homo sapiens
aagtatttactttttaaaaa

SEQ ID NO: 5346764 - DNA, 10 bp, Homo sapiens
aagtatttag

SEQ ID NO: 5346765 - DNA, 12 bp, Homo sapiens
aagtatttataa

SEQ ID NO: 5346766 - DNA, 15 bp, Homo sapiens
aagtatttataaaaa

SEQ ID NO: 5346767 - DNA, 21 bp, Homo sapiens
aagtatttataaaaatataaa

SEQ ID NO: 5346768 - DNA, 17 bp, Homo sapiens
aagtatttatatattta

SEQ ID NO: 5346769 - DNA, 18 bp, Homo sapiens
aagtatttatatatttat

SEQ ID NO: 5346770 - DNA, 21 bp, Homo sapiens
aagtatttatatatttataac

SEQ ID NO: 5346771 - DNA, 21 bp, Homo sapiens
aagtatttcaaattggagctt

SEQ ID NO: 5346772 - DNA, 22 bp, Homo sapiens
aagtatttcaaattggagcttc

SEQ ID NO: 5346773 - DNA, 12 bp, Homo sapiens
aagtatttctga

SEQ ID NO: 5346774 - DNA, 13 bp, Homo sapiens
aagtatttgggaa

SEQ ID NO: 5346775 - DNA, 12 bp, Homo sapiens
aagtatttgtgg

SEQ ID NO: 5346776 - DNA, 19 bp, Homo sapiens
aagtatttgttaatttaga

SEQ ID NO: 5346777 - DNA, 18 bp, Homo sapiens
aagtattttaattttaaa

SEQ ID NO: 5346778 - DNA, 19 bp, Homo sapiens
aagtattttaattttaaag

SEQ ID NO: 5346779 - DNA, 18 bp, Homo sapiens
aagtattttatctgtgtt

SEQ ID NO: 5346780 - DNA, 14 bp, Homo sapiens
aagtattttattct

SEQ ID NO: 5346781 - DNA, 15 bp, Homo sapiens
aagtattttatttgt

SEQ ID NO: 5346782 - DNA, 16 bp, Homo sapiens
aagtattttatttgtc

SEQ ID NO: 5346783 - DNA, 11 bp, Homo sapiens
aagtattttct

SEQ ID NO: 5346784 - DNA, 22 bp, Homo sapiens
aagtattttgaagtttacattt

SEQ ID NO: 5346785 - DNA, 23 bp, Homo sapiens
aagtattttgaagtttacatttt

SEQ ID NO: 5346786 - DNA, 18 bp, Homo sapiens
aagtattttgtgtttgga

SEQ ID NO: 5346787 - DNA, 18 bp, Homo sapiens
aagtatttttaattaatt

SEQ ID NO: 5346788 - DNA, 17 bp, Homo sapiens
aagtatttttagaataa

SEQ ID NO: 5346789 - DNA, 20 bp, Homo sapiens
aagtatttttataatgactg

SEQ ID NO: 5346790 - DNA, 22 bp, Homo sapiens
aagtatttttatttaaattatt

SEQ ID NO: 5346791 - DNA, 14 bp, Homo sapiens
aagtatttttgtct

SEQ ID NO: 5346792 - DNA, 14 bp, Homo sapiens
aagtattttttcaa

SEQ ID NO: 5346793 - DNA, 15 bp, Homo sapiens
aagtattttttcagt

SEQ ID NO: 5346794 - DNA, 16 bp, Homo sapiens
aagtatttttttaatt

SEQ ID NO: 5346795 - DNA, 14 bp, Homo sapiens
aagtcaaaaaatta

SEQ ID NO: 5346796 - DNA, 15 bp, Homo sapiens
aagtcaaaaggaaca

SEQ ID NO: 5346797 - DNA, 17 bp, Homo sapiens
aagtcaaaaggaacaaa

SEQ ID NO: 5346798 - DNA, 19 bp, Homo sapiens
aagtcaaaaggtgcctgtg

SEQ ID NO: 5346799 - DNA, 17 bp, Homo sapiens
aagtcaaaatatgtaag

SEQ ID NO: 5346800 - DNA, 20 bp, Homo sapiens
aagtcaaagcaaggaaacta

SEQ ID NO: 5346801 - DNA, 18 bp, Homo sapiens
aagtcaaataaatgtttc

SEQ ID NO: 5346802 - DNA, 19 bp, Homo sapiens
aagtcaaataaatgtttcc

SEQ ID NO: 5346803 - DNA, 18 bp, Homo sapiens
aagtcaaatttactttaa

SEQ ID NO: 5346804 - DNA, 19 bp, Homo sapiens
aagtcaacactcttcttga

SEQ ID NO: 5346805 - DNA, 19 bp, Homo sapiens
aagtcaacagtaaaccact

SEQ ID NO: 5346806 - DNA, 15 bp, Homo sapiens
aagtcaacttagcat

SEQ ID NO: 5346807 - DNA, 18 bp, Homo sapiens
aagtcaagatcaacattc

SEQ ID NO: 5346808 - DNA, 14 bp, Homo sapiens
aagtcaagcacatg

SEQ ID NO: 5346809 - DNA, 16 bp, Homo sapiens
aagtcaagcacatgta

SEQ ID NO: 5346810 - DNA, 17 bp, Homo sapiens
aagtcaagcacatgtaa

SEQ ID NO: 5346811 - DNA, 19 bp, Homo sapiens
aagtcaataaaagagctgt

SEQ ID NO: 5346812 - DNA, 20 bp, Homo sapiens
aagtcaatatgtggaagcaa

SEQ ID NO: 5346813 - DNA, 14 bp, Homo sapiens
aagtcaatattgat

SEQ ID NO: 5346814 - DNA, 21 bp, Homo sapiens
aagtcaatattgattttaaat

SEQ ID NO: 5346815 - DNA, 14 bp, Homo sapiens
aagtcaattctgtg

SEQ ID NO: 5346816 - DNA, 15 bp, Homo sapiens
aagtcaattctgtgt

SEQ ID NO: 5346817 - DNA, 17 bp, Homo sapiens
aagtcaattctgtgtgg

SEQ ID NO: 5346818 - DNA, 20 bp, Homo sapiens
aagtcaattctgtgtggtat

SEQ ID NO: 5346819 - DNA, 15 bp, Homo sapiens
aagtcacaatgttct

SEQ ID NO: 5346820 - DNA, 15 bp, Homo sapiens
aagtcacacagacac

SEQ ID NO: 5346821 - DNA, 23 bp, Homo sapiens
aagtcacacagctagtgaagacc

SEQ ID NO: 5346822 - DNA, 21 bp, Homo sapiens
aagtcacacattacaaagtta

SEQ ID NO: 5346823 - DNA, 15 bp, Homo sapiens
aagtcacactgtaac

SEQ ID NO: 5346824 - DNA, 14 bp, Homo sapiens
aagtcacagaaaat

SEQ ID NO: 5346825 - DNA, 13 bp, Homo sapiens
aagtcacagctgc

SEQ ID NO: 5346826 - DNA, 14 bp, Homo sapiens
aagtcacagctgca

SEQ ID NO: 5346827 - DNA, 16 bp, Homo sapiens
aagtcacagctgcagc

SEQ ID NO: 5346828 - DNA, 14 bp, Homo sapiens
aagtcacagggcag

SEQ ID NO: 5346829 - DNA, 19 bp, Homo sapiens
aagtcacagggcagtacct

SEQ ID NO: 5346830 - DNA, 22 bp, Homo sapiens
aagtcacagtcgtatctctaga

SEQ ID NO: 5346831 - DNA, 20 bp, Homo sapiens
aagtcacattccacatctgt

SEQ ID NO: 5346832 - DNA, 23 bp, Homo sapiens
aagtcaccaggacttggggtcag

SEQ ID NO: 5346833 - DNA, 18 bp, Homo sapiens
aagtcacccaaacacttc

SEQ ID NO: 5346834 - DNA, 16 bp, Homo sapiens
aagtcacccctttctg

SEQ ID NO: 5346835 - DNA, 22 bp, Homo sapiens
aagtcactaaatttctcagttt

SEQ ID NO: 5346836 - DNA, 18 bp, Homo sapiens
aagtcactagtgaacaat

SEQ ID NO: 5346837 - DNA, 16 bp, Homo sapiens
aagtcactcacactgg

SEQ ID NO: 5346838 - DNA, 16 bp, Homo sapiens
aagtgatatatgtatt

SEQ ID NO: 5346839 - DNA, 18 bp, Homo sapiens
aagtgatatatgtattta

SEQ ID NO: 5346840 - DNA, 21 bp, Homo sapiens
aagtgatatatgtatttattg

SEQ ID NO: 5346841 - DNA, 21 bp, Homo sapiens
aagtgatcaaactacatattg

SEQ ID NO: 5346842 - DNA, 13 bp, Homo sapiens
aagtgatcctccc

SEQ ID NO: 5346843 - DNA, 22 bp, Homo sapiens
aagtgatctaaaatttgtaata

SEQ ID NO: 5346844 - DNA, 23 bp, Homo sapiens
aagtgatctaaaatttgtaatat

SEQ ID NO: 5346845 - DNA, 20 bp, Homo sapiens
aagtgatctgtcccctctcc

SEQ ID NO: 5346846 - DNA, 15 bp, Homo sapiens
aagtgatctttcaat

SEQ ID NO: 5346847 - DNA, 20 bp, Homo sapiens
aagtgatctttcaatatcat

SEQ ID NO: 5346848 - DNA, 13 bp, Homo sapiens
aagtgatgctgtg

SEQ ID NO: 5346849 - DNA, 18 bp, Homo sapiens
aagtgatggagcagagca

SEQ ID NO: 5346850 - DNA, 19 bp, Homo sapiens
aagtgatggagcagagcaa

SEQ ID NO: 5346851 - DNA, 19 bp, Homo sapiens
aagtgatgtattttcatag

SEQ ID NO: 5346852 - DNA, 19 bp, Homo sapiens
aagtgatgtcatttgagca

SEQ ID NO: 5346853 - DNA, 14 bp, Homo sapiens
aagtgatgtgattt

SEQ ID NO: 5346854 - DNA, 15 bp, Homo sapiens
aagtgatgtgattta

SEQ ID NO: 5346855 - DNA, 14 bp, Homo sapiens
aagtgatgttggaa

SEQ ID NO: 5346856 - DNA, 16 bp, Homo sapiens
aagtgatgttgtttaa

SEQ ID NO: 5346857 - DNA, 17 bp, Homo sapiens
aagtgattatctctttg

SEQ ID NO: 5346858 - DNA, 17 bp, Homo sapiens
aagtgattctaagattt

SEQ ID NO: 5346859 - DNA, 16 bp, Homo sapiens
aagtgattctcatgcc

SEQ ID NO: 5346860 - DNA, 15 bp, Homo sapiens
aagtgattctcctgc

SEQ ID NO: 5346861 - DNA, 19 bp, Homo sapiens
aagtgattctcctgcctca

SEQ ID NO: 5346862 - DNA, 23 bp, Homo sapiens
aagtgattcttccacctcagcct

SEQ ID NO: 5346863 - DNA, 15 bp, Homo sapiens
aagtgattgacattt

SEQ ID NO: 5346864 - DNA, 17 bp, Homo sapiens
aagtgatttccacaggt

SEQ ID NO: 5346865 - DNA, 14 bp, Homo sapiens
aagtgatttgtaat

SEQ ID NO: 5346866 - DNA, 19 bp, Homo sapiens
aagtgattttatttttgca

SEQ ID NO: 5346867 - DNA, 21 bp, Homo sapiens
aagtgattttatttttgcaaa

SEQ ID NO: 5346868 - DNA, 22 bp, Homo sapiens
aagtgattttatttttgcaaaa

SEQ ID NO: 5346869 - DNA, 23 bp, Homo sapiens
aagtgattttcattgtaaatatt

SEQ ID NO: 5346870 - DNA, 17 bp, Homo sapiens
aagtgatttttttgtcc

SEQ ID NO: 5346871 - DNA, 11 bp, Homo sapiens
aagtgcaaagc

SEQ ID NO: 5346872 - DNA, 13 bp, Homo sapiens
aagtgcaaagctg

SEQ ID NO: 5346873 - DNA, 22 bp, Homo sapiens
aagtgcaaagctgcttgaatca

SEQ ID NO: 5346874 - DNA, 18 bp, Homo sapiens
aagtgcaaagtgccctca

SEQ ID NO: 5346875 - DNA, 16 bp, Homo sapiens
aagtgcaacatttctg

SEQ ID NO: 5346876 - DNA, 20 bp, Homo sapiens
aagtgcaacatttctgtata

SEQ ID NO: 5346877 - DNA, 21 bp, Homo sapiens
aagtgcaatgccccctcccct

SEQ ID NO: 5346878 - DNA, 20 bp, Homo sapiens
aagtgcaatgcgtgttgtac

SEQ ID NO: 5346879 - DNA, 21 bp, Homo sapiens
aagtgcaattgcacaaataca

SEQ ID NO: 5346880 - DNA, 13 bp, Homo sapiens
aagtgcacacaca

SEQ ID NO: 5346881 - DNA, 17 bp, Homo sapiens
aagtgcacacagaaata

SEQ ID NO: 5346882 - DNA, 19 bp, Homo sapiens
aagtgcacacctttattca

SEQ ID NO: 5346883 - DNA, 18 bp, Homo sapiens
aagtgcacttttttatga

SEQ ID NO: 5346884 - DNA, 19 bp, Homo sapiens
aagtgcagaactgcagtca

SEQ ID NO: 5346885 - DNA, 17 bp, Homo sapiens
aagtgcagatgagtgtg

SEQ ID NO: 5346886 - DNA, 13 bp, Homo sapiens
aagtgcagcatgg

SEQ ID NO: 5346887 - DNA, 21 bp, Homo sapiens
aagtgcagcccttcctcctga

SEQ ID NO: 5346888 - DNA, 14 bp, Homo sapiens
aagtgcagctcagg

SEQ ID NO: 5346889 - DNA, 17 bp, Homo sapiens
aagtgcaggctggcacc

SEQ ID NO: 5346890 - DNA, 13 bp, Homo sapiens
aagtgcagtcaca

SEQ ID NO: 5346891 - DNA, 18 bp, Homo sapiens
aagtgcagtcagcagatg

SEQ ID NO: 5346892 - DNA, 16 bp, Homo sapiens
aagtgcatccaaaggt

SEQ ID NO: 5346893 - DNA, 21 bp, Homo sapiens
aagtgcatctggagagaacag

SEQ ID NO: 5346894 - DNA, 15 bp, Homo sapiens
aagtgcatgcattga

SEQ ID NO: 5346895 - DNA, 19 bp, Homo sapiens
aagtgcatgcattgagctg

SEQ ID NO: 5346896 - DNA, 22 bp, Homo sapiens
aagtgcatgtcacatgccacaa

SEQ ID NO: 5346897 - DNA, 23 bp, Homo sapiens
aagtgcattattttattgagcaa

SEQ ID NO: 5346898 - DNA, 17 bp, Homo sapiens
aagtgcattcaacctta

SEQ ID NO: 5346899 - DNA, 18 bp, Homo sapiens
aagtgcattcaaccttac

SEQ ID NO: 5346900 - DNA, 21 bp, Homo sapiens
aagtgcattcaaccttaccaa

SEQ ID NO: 5346901 - DNA, 14 bp, Homo sapiens
aagtgcatttaagg

SEQ ID NO: 5346902 - DNA, 13 bp, Homo sapiens
aagtgcatttctg

SEQ ID NO: 5346903 - DNA, 18 bp, Homo sapiens
aagtgcatttctgggcct

SEQ ID NO: 5346904 - DNA, 17 bp, Homo sapiens
aagtgcatttttcttat

SEQ ID NO: 5346905 - DNA, 14 bp, Homo sapiens
aagtgccaaaataa

SEQ ID NO: 5346906 - DNA, 11 bp, Homo sapiens
aagtgccaaac

SEQ ID NO: 5346907 - DNA, 14 bp, Homo sapiens
aagtgccaaacaga

SEQ ID NO: 5346908 - DNA, 14 bp, Homo sapiens
aagtgccaaagaaa

SEQ ID NO: 5346909 - DNA, 19 bp, Homo sapiens
aagtgccaaagaaagtggt

SEQ ID NO: 5346910 - DNA, 22 bp, Homo sapiens
aagtgccactgcccgagctggt

SEQ ID NO: 5346911 - DNA, 14 bp, Homo sapiens
aagtgccagaggtg

SEQ ID NO: 5346912 - DNA, 20 bp, Homo sapiens
aagtgccagaggtgggcagg

SEQ ID NO: 5346913 - DNA, 19 bp, Homo sapiens
aagtgccagatcaaaattg

SEQ ID NO: 5346914 - DNA, 18 bp, Homo sapiens
aagtgccagatgttgtct

SEQ ID NO: 5346915 - DNA, 10 bp, Homo sapiens
aagtgccatc

SEQ ID NO: 5346916 - DNA, 12 bp, Homo sapiens
aagtgccatccc

SEQ ID NO: 5346917 - DNA, 14 bp, Homo sapiens
aagtgccatcccac

SEQ ID NO: 5346918 - DNA, 16 bp, Homo sapiens
aagtgcccaaagtggg

SEQ ID NO: 5346919 - DNA, 17 bp, Homo sapiens
aagtgcccaaagtgggg

SEQ ID NO: 5346920 - DNA, 18 bp, Homo sapiens
aagtgcccaaagtgggga

SEQ ID NO: 5346921 - DNA, 18 bp, Homo sapiens
aagtgcccacatttgatg

SEQ ID NO: 5346922 - DNA, 13 bp, Homo sapiens
aagtgcccagccc

SEQ ID NO: 5346923 - DNA, 14 bp, Homo sapiens
aagtgccccagggt

SEQ ID NO: 5346924 - DNA, 15 bp, Homo sapiens
aagtgccccctcacc

SEQ ID NO: 5346925 - DNA, 13 bp, Homo sapiens
aagtgcccctgct

SEQ ID NO: 5346926 - DNA, 22 bp, Homo sapiens
aagtgcccctgctgcctcccca

SEQ ID NO: 5346927 - DNA, 23 bp, Homo sapiens
aagtgcccctgctgcctccccaa

SEQ ID NO: 5346928 - DNA, 17 bp, Homo sapiens
aagtgcccgccctgccc

SEQ ID NO: 5346929 - DNA, 15 bp, Homo sapiens
aagtgccgcaaattg

SEQ ID NO: 5346930 - DNA, 17 bp, Homo sapiens
aagtgcctactgggggg

SEQ ID NO: 5346931 - DNA, 18 bp, Homo sapiens
aagtgcctagactgttac

SEQ ID NO: 5346932 - DNA, 19 bp, Homo sapiens
aagtgcctagactgttact

SEQ ID NO: 5346933 - DNA, 16 bp, Homo sapiens
aagtgcctataaagga

SEQ ID NO: 5346934 - DNA, 19 bp, Homo sapiens
aagtgcctcaagaggaatg

SEQ ID NO: 5346935 - DNA, 22 bp, Homo sapiens
aagtgcctctgattctatgtaa

SEQ ID NO: 5346936 - DNA, 17 bp, Homo sapiens
aagtgcctcttgttgca

SEQ ID NO: 5346937 - DNA, 13 bp, Homo sapiens
aagtgcctgagct

SEQ ID NO: 5346938 - DNA, 11 bp, Homo sapiens
aagtgcctgct

SEQ ID NO: 5346939 - DNA, 22 bp, Homo sapiens
aagtgcctgcttttaggtcatc

SEQ ID NO: 5346940 - DNA, 21 bp, Homo sapiens
aagtgccttctccttccccag

SEQ ID NO: 5346941 - DNA, 12 bp, Homo sapiens
aagtgccttgag

SEQ ID NO: 5346942 - DNA, 17 bp, Homo sapiens
aagtgccttgagctgcc

SEQ ID NO: 5346943 - DNA, 24 bp, Homo sapiens
aagtgccttgctcatttgaaaatg

SEQ ID NO: 5346944 - DNA, 18 bp, Homo sapiens
aagtgcctttatctcagc

SEQ ID NO: 5346945 - DNA, 19 bp, Homo sapiens
aagtgcctttatctcagcc

SEQ ID NO: 5346946 - DNA, 20 bp, Homo sapiens
aagtgcctttatctcagcca

SEQ ID NO: 5346947 - DNA, 16 bp, Homo sapiens
aagtgcctttgcagct

SEQ ID NO: 5346948 - DNA, 14 bp, Homo sapiens
aagtgcctttttcc

SEQ ID NO: 5346949 - DNA, 15 bp, Homo sapiens
aagtgcgtgtgtaga

SEQ ID NO: 5346950 - DNA, 16 bp, Homo sapiens
aagtgcgtgtgtagag

SEQ ID NO: 5346951 - DNA, 17 bp, Homo sapiens
aagtgcgtgtgtagagt

SEQ ID NO: 5346952 - DNA, 18 bp, Homo sapiens
aagtgcgtgtgtagagtt

SEQ ID NO: 5346953 - DNA, 19 bp, Homo sapiens
aagtgcgtgtgtagagtta

SEQ ID NO: 5346954 - DNA, 18 bp, Homo sapiens
aagtgcgttctcccagca

SEQ ID NO: 5346955 - DNA, 18 bp, Homo sapiens
aagtgctaaagttttctt

SEQ ID NO: 5346956 - DNA, 18 bp, Homo sapiens
aagtgctaaggttctaag

SEQ ID NO: 5346957 - DNA, 21 bp, Homo sapiens
aagtgctaaggttctaaggcc

SEQ ID NO: 5346958 - DNA, 18 bp, Homo sapiens
aagtgctacagaaagcac

SEQ ID NO: 5346959 - DNA, 19 bp, Homo sapiens
aagtgctacagaaagcaca

SEQ ID NO: 5346960 - DNA, 14 bp, Homo sapiens
aagtgctacataaa

SEQ ID NO: 5346961 - DNA, 15 bp, Homo sapiens
aagtgctcagggaaa

SEQ ID NO: 5346962 - DNA, 21 bp, Homo sapiens
aagtgctcagggaaatggcct

SEQ ID NO: 5346963 - DNA, 23 bp, Homo sapiens
aagtgctcagggaaatggccttc

SEQ ID NO: 5346964 - DNA, 12 bp, Homo sapiens
aagtgctcagta

SEQ ID NO: 5346965 - DNA, 14 bp, Homo sapiens
aagtgctcagtgaa

SEQ ID NO: 5346966 - DNA, 18 bp, Homo sapiens
aagtgctcagtgaagtac

SEQ ID NO: 5346967 - DNA, 17 bp, Homo sapiens
aagtgctcagttccaat

SEQ ID NO: 5346968 - DNA, 12 bp, Homo sapiens
aagtgctcccca

SEQ ID NO: 5346969 - DNA, 14 bp, Homo sapiens
aagtgctccccaca

SEQ ID NO: 5346970 - DNA, 17 bp, Homo sapiens
aagtgctccccacacgt

SEQ ID NO: 5346971 - DNA, 22 bp, Homo sapiens
aagtgctctgtcaaaagcacaa

SEQ ID NO: 5346972 - DNA, 22 bp, Homo sapiens
aagtgctcttggctgacccctc

SEQ ID NO: 5346973 - DNA, 21 bp, Homo sapiens
aagtgctgagattgcagatgt

SEQ ID NO: 5346974 - DNA, 14 bp, Homo sapiens
aagtgctgcacaaa

SEQ ID NO: 5346975 - DNA, 19 bp, Homo sapiens
aagtgctgcactcaaatga

SEQ ID NO: 5346976 - DNA, 13 bp, Homo sapiens
aagtgctgcggag

SEQ ID NO: 5346977 - DNA, 19 bp, Homo sapiens
aagtgctgcggagcaagag

SEQ ID NO: 5346978 - DNA, 22 bp, Homo sapiens
aagtgctggaactttagtgaaa

SEQ ID NO: 5346979 - DNA, 22 bp, Homo sapiens
aagtgctgggaattacaggcgt

SEQ ID NO: 5346980 - DNA, 20 bp, Homo sapiens
aagtgctgggatgacaggtg

SEQ ID NO: 5346981 - DNA, 14 bp, Homo sapiens
aagtgctgggatta

SEQ ID NO: 5346982 - DNA, 18 bp, Homo sapiens
aagtgctgggattacaga

SEQ ID NO: 5346983 - DNA, 21 bp, Homo sapiens
aagtgctgggattacagacat

SEQ ID NO: 5346984 - DNA, 21 bp, Homo sapiens
aagtgctgggattgtgggcat

SEQ ID NO: 5346985 - DNA, 22 bp, Homo sapiens
aagtgctggggaccttaagtga

SEQ ID NO: 5346986 - DNA, 13 bp, Homo sapiens
aagtgctgtataa

SEQ ID NO: 5346987 - DNA, 19 bp, Homo sapiens
aagtgctgtataaaatcag

SEQ ID NO: 5346988 - DNA, 17 bp, Homo sapiens
aagtgctgtttagattt

SEQ ID NO: 5346989 - DNA, 18 bp, Homo sapiens
aagtgctgtttattaatc

SEQ ID NO: 5346990 - DNA, 20 bp, Homo sapiens
aagtgctgtttattaatctt

SEQ ID NO: 5346991 - DNA, 13 bp, Homo sapiens
aagtgctgtttga

SEQ ID NO: 5346992 - DNA, 12 bp, Homo sapiens
aagtgctgtttt

SEQ ID NO: 5346993 - DNA, 16 bp, Homo sapiens
aagtgcttaaaaatac

SEQ ID NO: 5346994 - DNA, 19 bp, Homo sapiens
aagtgcttaacgttttctt

SEQ ID NO: 5346995 - DNA, 21 bp, Homo sapiens
aagtgcttagaggttctgcct

SEQ ID NO: 5346996 - DNA, 17 bp, Homo sapiens
aagtgcttataatgtgt

SEQ ID NO: 5346997 - DNA, 16 bp, Homo sapiens
aagtgcttcacatttg

SEQ ID NO: 5346998 - DNA, 17 bp, Homo sapiens
aagtgcttcacatttgt

SEQ ID NO: 5346999 - DNA, 19 bp, Homo sapiens
aagtgcttcattctttgca

SEQ ID NO: 5347000 - DNA, 23 bp, Homo sapiens
aagtgcttgcagatcatctgggg

SEQ ID NO: 5347001 - DNA, 18 bp, Homo sapiens
aagtgcttgctttttgcc

SEQ ID NO: 5347002 - DNA, 23 bp, Homo sapiens
aagtgcttggaacatactgttca

SEQ ID NO: 5347003 - DNA, 20 bp, Homo sapiens
aagtgcttggttgaaaagat

SEQ ID NO: 5347004 - DNA, 20 bp, Homo sapiens
aagtgcttgtatagctttta

SEQ ID NO: 5347005 - DNA, 16 bp, Homo sapiens
aagtggaaaaagaaat

SEQ ID NO: 5347006 - DNA, 19 bp, Homo sapiens
aagtggaaaaagaaattct

SEQ ID NO: 5347007 - DNA, 19 bp, Homo sapiens
aagtggaaaaatagcctgc

SEQ ID NO: 5347008 - DNA, 21 bp, Homo sapiens
aagtggaaaaatagcctgcct

SEQ ID NO: 5347009 - DNA, 16 bp, Homo sapiens
aagtggaaaatgcaat

SEQ ID NO: 5347010 - DNA, 14 bp, Homo sapiens
aagtggaaatttat

SEQ ID NO: 5347011 - DNA, 16 bp, Homo sapiens
aagtggaacgttctct

SEQ ID NO: 5347012 - DNA, 21 bp, Homo sapiens
aagtggaaggataatgagatg

SEQ ID NO: 5347013 - DNA, 16 bp, Homo sapiens
aagtggaagtatgtat

SEQ ID NO: 5347014 - DNA, 12 bp, Homo sapiens
aagtggacccag

SEQ ID NO: 5347015 - DNA, 19 bp, Homo sapiens
aagtttaatattaaagcca

SEQ ID NO: 5347016 - DNA, 21 bp, Homo sapiens
aagtttaatattaaagccatg

SEQ ID NO: 5347017 - DNA, 23 bp, Homo sapiens
aagtttacaacttgattttttca

SEQ ID NO: 5347018 - DNA, 15 bp, Homo sapiens
aagtttacaagcgag

SEQ ID NO: 5347019 - DNA, 16 bp, Homo sapiens
aagtttacaagcgaga

SEQ ID NO: 5347020 - DNA, 19 bp, Homo sapiens
aagtttacaatcaaaggaa

SEQ ID NO: 5347021 - DNA, 20 bp, Homo sapiens
aagtttacagtaaataaatt

SEQ ID NO: 5347022 - DNA, 19 bp, Homo sapiens
aagtttacattgtaaatag

SEQ ID NO: 5347023 - DNA, 21 bp, Homo sapiens
aagtttacattgtcctgtagc

SEQ ID NO: 5347024 - DNA, 18 bp, Homo sapiens
aagtttacttgtctttga

SEQ ID NO: 5347025 - DNA, 13 bp, Homo sapiens
aagtttagaaatt

SEQ ID NO: 5347026 - DNA, 20 bp, Homo sapiens
aagtttagaaattacaagtt

SEQ ID NO: 5347027 - DNA, 13 bp, Homo sapiens
aagtttagaactt

SEQ ID NO: 5347028 - DNA, 17 bp, Homo sapiens
aagtttagattttaatc

SEQ ID NO: 5347029 - DNA, 16 bp, Homo sapiens
aagtttagctctgaga

SEQ ID NO: 5347030 - DNA, 22 bp, Homo sapiens
aagtttagtttgaggaattctt

SEQ ID NO: 5347031 - DNA, 23 bp, Homo sapiens
aagtttataagaggatgaagtga

SEQ ID NO: 5347032 - DNA, 13 bp, Homo sapiens
aagtttatatgcc

SEQ ID NO: 5347033 - DNA, 19 bp, Homo sapiens
aagtttatcagatattttc

SEQ ID NO: 5347034 - DNA, 18 bp, Homo sapiens
aagtttatcagtaaataa

SEQ ID NO: 5347035 - DNA, 21 bp, Homo sapiens
aagtttatggccttgaagtgt

SEQ ID NO: 5347036 - DNA, 17 bp, Homo sapiens
aagtttatgtctaaaga

SEQ ID NO: 5347037 - DNA, 16 bp, Homo sapiens
aagtttattattttca

SEQ ID NO: 5347038 - DNA, 17 bp, Homo sapiens
aagtttattcagtaaac

SEQ ID NO: 5347039 - DNA, 15 bp, Homo sapiens
aagtttatttattta

SEQ ID NO: 5347040 - DNA, 15 bp, Homo sapiens
aagtttatttcctga

SEQ ID NO: 5347041 - DNA, 17 bp, Homo sapiens
aagtttattttctattt

SEQ ID NO: 5347042 - DNA, 17 bp, Homo sapiens
aagtttattttttctac

SEQ ID NO: 5347043 - DNA, 19 bp, Homo sapiens
aagtttattttttctacac

SEQ ID NO: 5347044 - DNA, 15 bp, Homo sapiens
aagtttcaaaaatct

SEQ ID NO: 5347045 - DNA, 16 bp, Homo sapiens
aagtttcaaaaatctg

SEQ ID NO: 5347046 - DNA, 21 bp, Homo sapiens
aagtttcaaaaatctgaagat

SEQ ID NO: 5347047 - DNA, 21 bp, Homo sapiens
aagtttcacaacagatttcta

SEQ ID NO: 5347048 - DNA, 22 bp, Homo sapiens
aagtttcacaacagatttctaa

SEQ ID NO: 5347049 - DNA, 23 bp, Homo sapiens
aagtttcacaacagatttctaag

SEQ ID NO: 5347050 - DNA, 21 bp, Homo sapiens
aagtttcagagaccattgcaa

SEQ ID NO: 5347051 - DNA, 16 bp, Homo sapiens
aagtttcagagtatat

SEQ ID NO: 5347052 - DNA, 18 bp, Homo sapiens
aagtttcagagtatattg

SEQ ID NO: 5347053 - DNA, 19 bp, Homo sapiens
aagtttcaggatacatgtg

SEQ ID NO: 5347054 - DNA, 14 bp, Homo sapiens
aagtttcaggtgac

SEQ ID NO: 5347055 - DNA, 15 bp, Homo sapiens
aagtttcaggtgaca

SEQ ID NO: 5347056 - DNA, 16 bp, Homo sapiens
aagtttcagtaatagc

SEQ ID NO: 5347057 - DNA, 21 bp, Homo sapiens
aagtttcagtaatagctgaac

SEQ ID NO: 5347058 - DNA, 19 bp, Homo sapiens
aagtttcagtattagatgc

SEQ ID NO: 5347059 - DNA, 12 bp, Homo sapiens
aagtttcagttg

SEQ ID NO: 5347060 - DNA, 15 bp, Homo sapiens
aagtttcatcatttt

SEQ ID NO: 5347061 - DNA, 13 bp, Homo sapiens
aagtttcatttat

SEQ ID NO: 5347062 - DNA, 13 bp, Homo sapiens
aagtttccaagca

SEQ ID NO: 5347063 - DNA, 18 bp, Homo sapiens
aagtttccatatgttata

SEQ ID NO: 5347064 - DNA, 12 bp, Homo sapiens
aagtttcccttc

SEQ ID NO: 5347065 - DNA, 19 bp, Homo sapiens
aagtttccttccagcccag

SEQ ID NO: 5347066 - DNA, 21 bp, Homo sapiens
aagtttccttccagcccagaa

SEQ ID NO: 5347067 - DNA, 17 bp, Homo sapiens
aagtttccttggctggt

SEQ ID NO: 5347068 - DNA, 12 bp, Homo sapiens
aagtttcctttt

SEQ ID NO: 5347069 - DNA, 21 bp, Homo sapiens
aagtttcgacttatttcttaa

SEQ ID NO: 5347070 - DNA, 22 bp, Homo sapiens
aagtttcgagagaaaggagggc

SEQ ID NO: 5347071 - DNA, 11 bp, Homo sapiens
aagtttctaag

SEQ ID NO: 5347072 - DNA, 12 bp, Homo sapiens
aagtttctaaga

SEQ ID NO: 5347073 - DNA, 21 bp, Homo sapiens
aagtttctaagattctaaagg

SEQ ID NO: 5347074 - DNA, 23 bp, Homo sapiens
aagtttctagctagaaatatgat

SEQ ID NO: 5347075 - DNA, 14 bp, Homo sapiens
aagtttctattctg

SEQ ID NO: 5347076 - DNA, 13 bp, Homo sapiens
aagtttctattta

SEQ ID NO: 5347077 - DNA, 22 bp, Homo sapiens
aagtttctcagatccttgtttc

SEQ ID NO: 5347078 - DNA, 20 bp, Homo sapiens
aagtttctggtgccatttct

SEQ ID NO: 5347079 - DNA, 22 bp, Homo sapiens
aagtttctggtgccatttctga

SEQ ID NO: 5347080 - DNA, 10 bp, Homo sapiens
aagtttcttt

SEQ ID NO: 5347081 - DNA, 13 bp, Homo sapiens
aagtttctttgag

SEQ ID NO: 5347082 - DNA, 18 bp, Homo sapiens
aagtttgaaaagcaatat

SEQ ID NO: 5347083 - DNA, 13 bp, Homo sapiens
aagtttgaacagg

SEQ ID NO: 5347084 - DNA, 13 bp, Homo sapiens
aagtttgaatgtt

SEQ ID NO: 5347085 - DNA, 12 bp, Homo sapiens
aagtttgataaa

SEQ ID NO: 5347086 - DNA, 20 bp, Homo sapiens
aagtttgataaatagtgtta

SEQ ID NO: 5347087 - DNA, 19 bp, Homo sapiens
aagtttgatagatccttta

SEQ ID NO: 5347088 - DNA, 15 bp, Homo sapiens
aagtttgatcaaatc

SEQ ID NO: 5347089 - DNA, 15 bp, Homo sapiens
aagtttgatcttcct

SEQ ID NO: 5347090 - DNA, 23 bp, Homo sapiens
aagtttgattaaaattcaggaag

SEQ ID NO: 5347091 - DNA, 15 bp, Homo sapiens
aagtttgatttcatt

SEQ ID NO: 5347092 - DNA, 20 bp, Homo sapiens
aagtttgcactatctttcag

SEQ ID NO: 5347093 - DNA, 14 bp, Homo sapiens
aagtttgcagattt

SEQ ID NO: 5347094 - DNA, 13 bp, Homo sapiens
aagtttgctgtgc

SEQ ID NO: 5347095 - DNA, 20 bp, Homo sapiens
aagtttgctgtgctttggaa

SEQ ID NO: 5347096 - DNA, 19 bp, Homo sapiens
aagtttggcaatagtttgc

SEQ ID NO: 5347097 - DNA, 22 bp, Homo sapiens
aagtttgggtgtattttcttta

SEQ ID NO: 5347098 - DNA, 16 bp, Homo sapiens
aagtttgtaaaaatat

SEQ ID NO: 5347099 - DNA, 17 bp, Homo sapiens
aagtttgtaaaaatata

SEQ ID NO: 5347100 - DNA, 12 bp, Homo sapiens
aagtttgtagcc

SEQ ID NO: 5347101 - DNA, 22 bp, Homo sapiens
aagtttgtagtttttgctgaag

SEQ ID NO: 5347102 - DNA, 23 bp, Homo sapiens
aagtttgtagtttttgctgaagg

SEQ ID NO: 5347103 - DNA, 20 bp, Homo sapiens
aagtttgtcaggcacagtaa

SEQ ID NO: 5347104 - DNA, 17 bp, Homo sapiens
aagtttgtgctatctat

SEQ ID NO: 5347105 - DNA, 15 bp, Homo sapiens
aagtttgtggtataa

SEQ ID NO: 5347106 - DNA, 22 bp, Homo sapiens
aagtttgtgttagaaaagtttc

SEQ ID NO: 5347107 - DNA, 15 bp, Homo sapiens
aagtttgtgttctgt

SEQ ID NO: 5347108 - DNA, 14 bp, Homo sapiens
aagtttgttacttt

SEQ ID NO: 5347109 - DNA, 16 bp, Homo sapiens
aagtttgttactttga

SEQ ID NO: 5347110 - DNA, 18 bp, Homo sapiens
aagtttgttcacttaaat

SEQ ID NO: 5347111 - DNA, 16 bp, Homo sapiens
aagtttgttgaaaaca

SEQ ID NO: 5347112 - DNA, 17 bp, Homo sapiens
aagttttaaaaagccag

SEQ ID NO: 5347113 - DNA, 16 bp, Homo sapiens
aagttttaacttccag

SEQ ID NO: 5347114 - DNA, 14 bp, Homo sapiens
aagttttaacttta

SEQ ID NO: 5347115 - DNA, 16 bp, Homo sapiens
aagttttacttgatta

SEQ ID NO: 5347116 - DNA, 15 bp, Homo sapiens
aagttttatacataa

SEQ ID NO: 5347117 - DNA, 17 bp, Homo sapiens
aagttttatacataaac

SEQ ID NO: 5347118 - DNA, 16 bp, Homo sapiens
aagttttatgtacttt

SEQ ID NO: 5347119 - DNA, 16 bp, Homo sapiens
aagttttatttaactt

SEQ ID NO: 5347120 - DNA, 23 bp, Homo sapiens
aagttttcaaactgctgcatact

SEQ ID NO: 5347121 - DNA, 15 bp, Homo sapiens
aagttttcaatgatg

SEQ ID NO: 5347122 - DNA, 23 bp, Homo sapiens
aagttttccctgaagttatgtgt

SEQ ID NO: 5347123 - DNA, 21 bp, Homo sapiens
aagttttcccttgaggaaaca

SEQ ID NO: 5347124 - DNA, 20 bp, Homo sapiens
aagttttcctacacttgaga

SEQ ID NO: 5347125 - DNA, 13 bp, Homo sapiens
aagttttcctgag

SEQ ID NO: 5347126 - DNA, 11 bp, Homo sapiens
aagttttcctt

SEQ ID NO: 5347127 - DNA, 21 bp, Homo sapiens
aagttttctcaacagagagca

SEQ ID NO: 5347128 - DNA, 13 bp, Homo sapiens
aagttttctgtag

SEQ ID NO: 5347129 - DNA, 23 bp, Homo sapiens
aagttttcttgtttctgcatctt

SEQ ID NO: 5347130 - DNA, 12 bp, Homo sapiens
aagttttgaaaa

SEQ ID NO: 5347131 - DNA, 15 bp, Homo sapiens
aagttttgacaagct

SEQ ID NO: 5347132 - DNA, 15 bp, Homo sapiens
aagttttgagtttct

SEQ ID NO: 5347133 - DNA, 13 bp, Homo sapiens
aagttttgatgaa

SEQ ID NO: 5347134 - DNA, 19 bp, Homo sapiens
aagttttgatgaaattctt

SEQ ID NO: 5347135 - DNA, 15 bp, Homo sapiens
aagttttgcatttat

SEQ ID NO: 5347136 - DNA, 12 bp, Homo sapiens
aagttttgctgt

SEQ ID NO: 5347137 - DNA, 17 bp, Homo sapiens
aagttttggagagggaa

SEQ ID NO: 5347138 - DNA, 23 bp, Homo sapiens
aagttttggcagccatgataata

SEQ ID NO: 5347139 - DNA, 13 bp, Homo sapiens
aagttttgtaaaa

SEQ ID NO: 5347140 - DNA, 16 bp, Homo sapiens
aagttttgtaaaagaa

SEQ ID NO: 5347141 - DNA, 23 bp, Homo sapiens
aagttttgtacaaagttttcctt

SEQ ID NO: 5347142 - DNA, 13 bp, Homo sapiens
aagttttgtacag

SEQ ID NO: 5347143 - DNA, 22 bp, Homo sapiens
aagttttgtataaataataaag

SEQ ID NO: 5347144 - DNA, 12 bp, Homo sapiens
aagttttgtcat

SEQ ID NO: 5347145 - DNA, 12 bp, Homo sapiens
aagttttgtgaa

SEQ ID NO: 5347146 - DNA, 15 bp, Homo sapiens
aagttttgtgaaatt

SEQ ID NO: 5347147 - DNA, 16 bp, Homo sapiens
aagttttgtgaaattt

SEQ ID NO: 5347148 - DNA, 18 bp, Homo sapiens
aagttttgtgtgtatata

SEQ ID NO: 5347149 - DNA, 17 bp, Homo sapiens
aagttttgttctgtata

SEQ ID NO: 5347150 - DNA, 14 bp, Homo sapiens
aagttttgttcttt

SEQ ID NO: 5347151 - DNA, 21 bp, Homo sapiens
aagtttttaaaaataaaggaa

SEQ ID NO: 5347152 - DNA, 13 bp, Homo sapiens
aagtttttacaaa

SEQ ID NO: 5347153 - DNA, 14 bp, Homo sapiens
aagtttttatacct

SEQ ID NO: 5347154 - DNA, 23 bp, Homo sapiens
aagtttttatacctgtacacaca

SEQ ID NO: 5347155 - DNA, 20 bp, Homo sapiens
aagtttttatagttattaaa

SEQ ID NO: 5347156 - DNA, 19 bp, Homo sapiens
aagtttttatatcttttct

SEQ ID NO: 5347157 - DNA, 19 bp, Homo sapiens
aagtttttattcaaagcag

SEQ ID NO: 5347158 - DNA, 22 bp, Homo sapiens
aagtttttattttaaacatttt

SEQ ID NO: 5347159 - DNA, 23 bp, Homo sapiens
aagtttttattttaaacattttt

SEQ ID NO: 5347160 - DNA, 17 bp, Homo sapiens
aagtttttctctttttc

SEQ ID NO: 5347161 - DNA, 20 bp, Homo sapiens
aagtttttctttaatatgat

SEQ ID NO: 5347162 - DNA, 17 bp, Homo sapiens
aagtttttgaaatacct

SEQ ID NO: 5347163 - DNA, 18 bp, Homo sapiens
aagtttttgccattataa

SEQ ID NO: 5347164 - DNA, 12 bp, Homo sapiens
aagtttttgtac

SEQ ID NO: 5347165 - DNA, 14 bp, Homo sapiens
aagtttttgtactg

SEQ ID NO: 5347166 - DNA, 15 bp, Homo sapiens
aagtttttgtttgga

SEQ ID NO: 5347167 - DNA, 13 bp, Homo sapiens
aagttttttatat

SEQ ID NO: 5347168 - DNA, 17 bp, Homo sapiens
aagttttttatatatga

SEQ ID NO: 5347169 - DNA, 21 bp, Homo sapiens
aagttttttatatatgaatat

SEQ ID NO: 5347170 - DNA, 12 bp, Homo sapiens
aagtttttttgc

SEQ ID NO: 5347171 - DNA, 16 bp, Homo sapiens
aagtttttttgttcat

SEQ ID NO: 5347172 - DNA, 17 bp, Homo sapiens
aagtttttttttcctct

SEQ ID NO: 5347173 - DNA, 14 bp, Homo sapiens
aataaaaaaaagaa

SEQ ID NO: 5347174 - DNA, 17 bp, Homo sapiens
aataaaaaaaagaaaaa

SEQ ID NO: 5347175 - DNA, 17 bp, Homo sapiens
aataaaaaaatacagta

SEQ ID NO: 5347176 - DNA, 15 bp, Homo sapiens
aataaaaaacaagaa

SEQ ID NO: 5347177 - DNA, 19 bp, Homo sapiens
aataaaaaacaagaaacca

SEQ ID NO: 5347178 - DNA, 22 bp, Homo sapiens
aataaaaaacatttattttcat

SEQ ID NO: 5347179 - DNA, 18 bp, Homo sapiens
aataaaaaagattctact

SEQ ID NO: 5347180 - DNA, 21 bp, Homo sapiens
aataaaaaagattctactaac

SEQ ID NO: 5347181 - DNA, 15 bp, Homo sapiens
aataaaaaagcaaaa

SEQ ID NO: 5347182 - DNA, 23 bp, Homo sapiens
aataaaaaagtgagcttttatat

SEQ ID NO: 5347183 - DNA, 13 bp, Homo sapiens
aataaaaaataaa

SEQ ID NO: 5347184 - DNA, 14 bp, Homo sapiens
aataaaaaatctga

SEQ ID NO: 5347185 - DNA, 13 bp, Homo sapiens
aataaaaaatgga

SEQ ID NO: 5347186 - DNA, 15 bp, Homo sapiens
aataaaaaattatga

SEQ ID NO: 5347187 - DNA, 17 bp, Homo sapiens
aataaaaacacacctta

SEQ ID NO: 5347188 - DNA, 14 bp, Homo sapiens
aataaaaaccaaga

SEQ ID NO: 5347189 - DNA, 12 bp, Homo sapiens
aataaaaaccat

SEQ ID NO: 5347190 - DNA, 17 bp, Homo sapiens
aataaaaactaatttca

SEQ ID NO: 5347191 - DNA, 12 bp, Homo sapiens
aataaaaactat

SEQ ID NO: 5347192 - DNA, 19 bp, Homo sapiens
aataaaaactattcgaatg

SEQ ID NO: 5347193 - DNA, 21 bp, Homo sapiens
aataaaaactgactccttaga

SEQ ID NO: 5347194 - DNA, 15 bp, Homo sapiens
aataaatgtttctag

SEQ ID NO: 5347195 - DNA, 16 bp, Homo sapiens
aataaatgttttacaa

SEQ ID NO: 5347196 - DNA, 18 bp, Homo sapiens
aataaattaaaacatgca

SEQ ID NO: 5347197 - DNA, 16 bp, Homo sapiens
aataaattaagatcct

SEQ ID NO: 5347198 - DNA, 22 bp, Homo sapiens
aataaattaagatcctaaactc

SEQ ID NO: 5347199 - DNA, 21 bp, Homo sapiens
aataaattaatatattgtttt

SEQ ID NO: 5347200 - DNA, 16 bp, Homo sapiens
aataaattaatttttc

SEQ ID NO: 5347201 - DNA, 12 bp, Homo sapiens
aataaattacac

SEQ ID NO: 5347202 - DNA, 16 bp, Homo sapiens
aataaattatgaatat

SEQ ID NO: 5347203 - DNA, 21 bp, Homo sapiens
aataaattattagagattttc

SEQ ID NO: 5347204 - DNA, 12 bp, Homo sapiens
aataaattattt

SEQ ID NO: 5347205 - DNA, 16 bp, Homo sapiens
aataaattcaaaacct

SEQ ID NO: 5347206 - DNA, 20 bp, Homo sapiens
aataaattcaataaaaacct

SEQ ID NO: 5347207 - DNA, 16 bp, Homo sapiens
aataaattcatcagaa

SEQ ID NO: 5347208 - DNA, 21 bp, Homo sapiens
aataaattcccaacttctctt

SEQ ID NO: 5347209 - DNA, 11 bp, Homo sapiens
aataaattcta

SEQ ID NO: 5347210 - DNA, 12 bp, Homo sapiens
aataaattctaa

SEQ ID NO: 5347211 - DNA, 21 bp, Homo sapiens
aataaattctgacttatgaat

SEQ ID NO: 5347212 - DNA, 15 bp, Homo sapiens
aataaattgatttgt

SEQ ID NO: 5347213 - DNA, 17 bp, Homo sapiens
aataaattgcaacatat

SEQ ID NO: 5347214 - DNA, 20 bp, Homo sapiens
aataaattgctccttgacat

SEQ ID NO: 5347215 - DNA, 19 bp, Homo sapiens
aataaattggagttttaaa

SEQ ID NO: 5347216 - DNA, 20 bp, Homo sapiens
aataaattggattattttct

SEQ ID NO: 5347217 - DNA, 21 bp, Homo sapiens
aataaattggtgataagtgga

SEQ ID NO: 5347218 - DNA, 13 bp, Homo sapiens
aataaattgtata

SEQ ID NO: 5347219 - DNA, 16 bp, Homo sapiens
aataaattgtatattc

SEQ ID NO: 5347220 - DNA, 16 bp, Homo sapiens
aataaattgtcatcag

SEQ ID NO: 5347221 - DNA, 16 bp, Homo sapiens
aataaattgtgaaaaa

SEQ ID NO: 5347222 - DNA, 22 bp, Homo sapiens
aataaattgtgaaaaaaatgaa

SEQ ID NO: 5347223 - DNA, 13 bp, Homo sapiens
aataaatttaact

SEQ ID NO: 5347224 - DNA, 15 bp, Homo sapiens
aataaatttactgaa

SEQ ID NO: 5347225 - DNA, 22 bp, Homo sapiens
aataaatttcccagttaaagat

SEQ ID NO: 5347226 - DNA, 22 bp, Homo sapiens
aataaatttctgggatatttaa

SEQ ID NO: 5347227 - DNA, 23 bp, Homo sapiens
aataaatttctgggatatttaac

SEQ ID NO: 5347228 - DNA, 20 bp, Homo sapiens
aataaatttgacttttctgt

SEQ ID NO: 5347229 - DNA, 21 bp, Homo sapiens
aataaatttgacttttctgta

SEQ ID NO: 5347230 - DNA, 18 bp, Homo sapiens
aataaatttggttctaat

SEQ ID NO: 5347231 - DNA, 15 bp, Homo sapiens
aataaattttaaaaa

SEQ ID NO: 5347232 - DNA, 13 bp, Homo sapiens
aataaattttaat

SEQ ID NO: 5347233 - DNA, 13 bp, Homo sapiens
aataaattttcta

SEQ ID NO: 5347234 - DNA, 16 bp, Homo sapiens
aataaattttctaaaa

SEQ ID NO: 5347235 - DNA, 15 bp, Homo sapiens
aataaattttgaaaa

SEQ ID NO: 5347236 - DNA, 16 bp, Homo sapiens
aataaattttgaaaag

SEQ ID NO: 5347237 - DNA, 15 bp, Homo sapiens
aataaattttgtgca

SEQ ID NO: 5347238 - DNA, 13 bp, Homo sapiens
aataaattttgtt

SEQ ID NO: 5347239 - DNA, 18 bp, Homo sapiens
aataaatttttaaaaaga

SEQ ID NO: 5347240 - DNA, 15 bp, Homo sapiens
aataacaaaatggac

SEQ ID NO: 5347241 - DNA, 20 bp, Homo sapiens
aataacaaagcacataactg

SEQ ID NO: 5347242 - DNA, 20 bp, Homo sapiens
aataacaacaacttaatgtg

SEQ ID NO: 5347243 - DNA, 23 bp, Homo sapiens
aataacaacaatggtttacatga

SEQ ID NO: 5347244 - DNA, 23 bp, Homo sapiens
aataacaactgagatgttaaaat

SEQ ID NO: 5347245 - DNA, 18 bp, Homo sapiens
aataacaactttcagtgg

SEQ ID NO: 5347246 - DNA, 21 bp, Homo sapiens
aataacaatgaaagttgataa

SEQ ID NO: 5347247 - DNA, 20 bp, Homo sapiens
aataacaatgttaaggaaac

SEQ ID NO: 5347248 - DNA, 24 bp, Homo sapiens
aataacaatgttaaggaaactctt

SEQ ID NO: 5347249 - DNA, 19 bp, Homo sapiens
aataacactaaaattttag

SEQ ID NO: 5347250 - DNA, 20 bp, Homo sapiens
aataacactgttggcactta

SEQ ID NO: 5347251 - DNA, 22 bp, Homo sapiens
aataacactgttggcacttata

SEQ ID NO: 5347252 - DNA, 10 bp, Homo sapiens
aataacagaa

SEQ ID NO: 5347253 - DNA, 22 bp, Homo sapiens
aataacagaagaaaatagaatt

SEQ ID NO: 5347254 - DNA, 19 bp, Homo sapiens
aataacagagctggatgct

SEQ ID NO: 5347255 - DNA, 13 bp, Homo sapiens
aataacagctcct

SEQ ID NO: 5347256 - DNA, 13 bp, Homo sapiens
aataacagctgca

SEQ ID NO: 5347257 - DNA, 14 bp, Homo sapiens
aataacagctgcaa

SEQ ID NO: 5347258 - DNA, 17 bp, Homo sapiens
aataacagctttcttat

SEQ ID NO: 5347259 - DNA, 16 bp, Homo sapiens
aataacatatcaaatg

SEQ ID NO: 5347260 - DNA, 18 bp, Homo sapiens
aataacatatctaaagtc

SEQ ID NO: 5347261 - DNA, 15 bp, Homo sapiens
aataacatctgaaaa

SEQ ID NO: 5347262 - DNA, 16 bp, Homo sapiens
aataacatctgaaaag

SEQ ID NO: 5347263 - DNA, 22 bp, Homo sapiens
aataacatgtaattaagtacta

SEQ ID NO: 5347264 - DNA, 14 bp, Homo sapiens
aataacattacctt

SEQ ID NO: 5347265 - DNA, 20 bp, Homo sapiens
aataacattaccttactgtg

SEQ ID NO: 5347266 - DNA, 21 bp, Homo sapiens
aataacattctgaatcaagca

SEQ ID NO: 5347267 - DNA, 15 bp, Homo sapiens
aataacatttaattt

SEQ ID NO: 5347268 - DNA, 15 bp, Homo sapiens
aataacattttatac

SEQ ID NO: 5347269 - DNA, 16 bp, Homo sapiens
aataaccaagtttatt

SEQ ID NO: 5347270 - DNA, 23 bp, Homo sapiens
aataaccaagtttattcagtaaa

SEQ ID NO: 5347271 - DNA, 16 bp, Homo sapiens
aataaccacactgaaa

SEQ ID NO: 5347272 - DNA, 22 bp, Homo sapiens
aataaccacttaaaaaatgtcc

SEQ ID NO: 5347273 - DNA, 12 bp, Homo sapiens
aataacccagtt

SEQ ID NO: 5347274 - DNA, 16 bp, Homo sapiens
aataaccccaaaatga

SEQ ID NO: 5347275 - DNA, 17 bp, Homo sapiens
aataaccccaaaatgaa

SEQ ID NO: 5347276 - DNA, 15 bp, Homo sapiens
aataaccctgaatca

SEQ ID NO: 5347277 - DNA, 20 bp, Homo sapiens
aataaccctgggctgtccag

SEQ ID NO: 5347278 - DNA, 24 bp, Homo sapiens
aataacctataaagtgtttatgac

SEQ ID NO: 5347279 - DNA, 12 bp, Homo sapiens
aataacctctgg

SEQ ID NO: 5347280 - DNA, 13 bp, Homo sapiens
aataacctctggc

SEQ ID NO: 5347281 - DNA, 16 bp, Homo sapiens
aataacctctggccct

SEQ ID NO: 5347282 - DNA, 20 bp, Homo sapiens
aataacctctggcccttgga

SEQ ID NO: 5347283 - DNA, 17 bp, Homo sapiens
aataacctgcacaggct

SEQ ID NO: 5347284 - DNA, 23 bp, Homo sapiens
aataacctgcacaggcttgctgt

SEQ ID NO: 5347285 - DNA, 14 bp, Homo sapiens
aataacctgtgaat

SEQ ID NO: 5347286 - DNA, 19 bp, Homo sapiens
aataaccttccatacattt

SEQ ID NO: 5347287 - DNA, 13 bp, Homo sapiens
aataacctttctg

SEQ ID NO: 5347288 - DNA, 15 bp, Homo sapiens
aataactagaacaaa

SEQ ID NO: 5347289 - DNA, 18 bp, Homo sapiens
aataactagatctcctgt

SEQ ID NO: 5347290 - DNA, 19 bp, Homo sapiens
aataactagatctcctgta

SEQ ID NO: 5347291 - DNA, 22 bp, Homo sapiens
aataactagatctcctgtaatt

SEQ ID NO: 5347292 - DNA, 19 bp, Homo sapiens
aataactatctcacttcca

SEQ ID NO: 5347293 - DNA, 14 bp, Homo sapiens
aataactatgccag

SEQ ID NO: 5347294 - DNA, 13 bp, Homo sapiens
aataactattgct

SEQ ID NO: 5347295 - DNA, 15 bp, Homo sapiens
aataactccaagcag

SEQ ID NO: 5347296 - DNA, 16 bp, Homo sapiens
aataactccaagcaga

SEQ ID NO: 5347297 - DNA, 19 bp, Homo sapiens
aataactcctcattgtaaa

SEQ ID NO: 5347298 - DNA, 14 bp, Homo sapiens
aataactccttctt

SEQ ID NO: 5347299 - DNA, 13 bp, Homo sapiens
aataactctggga

SEQ ID NO: 5347300 - DNA, 12 bp, Homo sapiens
aataactgaaaa

SEQ ID NO: 5347301 - DNA, 16 bp, Homo sapiens
aataactgaaaatgaa

SEQ ID NO: 5347302 - DNA, 11 bp, Homo sapiens
aataactgaac

SEQ ID NO: 5347303 - DNA, 13 bp, Homo sapiens
aataactgaacca

SEQ ID NO: 5347304 - DNA, 17 bp, Homo sapiens
aataactgaaccaaatt

SEQ ID NO: 5347305 - DNA, 17 bp, Homo sapiens
aataactgaactgtttg

SEQ ID NO: 5347306 - DNA, 20 bp, Homo sapiens
aataactgatctcaagtata

SEQ ID NO: 5347307 - DNA, 15 bp, Homo sapiens
aataactgtaattat

SEQ ID NO: 5347308 - DNA, 15 bp, Homo sapiens
aataactgtcttctg

SEQ ID NO: 5347309 - DNA, 13 bp, Homo sapiens
aataactgtgaag

SEQ ID NO: 5347310 - DNA, 14 bp, Homo sapiens
aataactgtgaagt

SEQ ID NO: 5347311 - DNA, 13 bp, Homo sapiens
aataactgtgact

SEQ ID NO: 5347312 - DNA, 18 bp, Homo sapiens
aataactgtgactgtggg

SEQ ID NO: 5347313 - DNA, 14 bp, Homo sapiens
aataactgttagaa

SEQ ID NO: 5347314 - DNA, 16 bp, Homo sapiens
aataacttcagagaag

SEQ ID NO: 5347315 - DNA, 15 bp, Homo sapiens
aataacttcagtcct

SEQ ID NO: 5347316 - DNA, 11 bp, Homo sapiens
aataacttcta

SEQ ID NO: 5347317 - DNA, 13 bp, Homo sapiens
aataacttctata

SEQ ID NO: 5347318 - DNA, 18 bp, Homo sapiens
aataacttctatatttta

SEQ ID NO: 5347319 - DNA, 14 bp, Homo sapiens
aataacttgccatt

SEQ ID NO: 5347320 - DNA, 18 bp, Homo sapiens
aataacttgccatttctt

SEQ ID NO: 5347321 - DNA, 20 bp, Homo sapiens
aataacttgtgttactaatt

SEQ ID NO: 5347322 - DNA, 14 bp, Homo sapiens
aataactttattgc

SEQ ID NO: 5347323 - DNA, 17 bp, Homo sapiens
aataactttattgcata

SEQ ID NO: 5347324 - DNA, 19 bp, Homo sapiens
aataactttctctgtgaaa

SEQ ID NO: 5347325 - DNA, 14 bp, Homo sapiens
aataactttcttac

SEQ ID NO: 5347326 - DNA, 12 bp, Homo sapiens
aataagaaaaga

SEQ ID NO: 5347327 - DNA, 22 bp, Homo sapiens
aataagaaacttttttttccta

SEQ ID NO: 5347328 - DNA, 15 bp, Homo sapiens
aataagaaagtataa

SEQ ID NO: 5347329 - DNA, 12 bp, Homo sapiens
aataagaaatga

SEQ ID NO: 5347330 - DNA, 14 bp, Homo sapiens
aataagaacagatc

SEQ ID NO: 5347331 - DNA, 13 bp, Homo sapiens
aataagaatagaa

SEQ ID NO: 5347332 - DNA, 18 bp, Homo sapiens
aataagaatagaaataaa

SEQ ID NO: 5347333 - DNA, 20 bp, Homo sapiens
aataagaatagaacaacata

SEQ ID NO: 5347334 - DNA, 12 bp, Homo sapiens
aataagaatttg

SEQ ID NO: 5347335 - DNA, 16 bp, Homo sapiens
aataagaatttgcata

SEQ ID NO: 5347336 - DNA, 13 bp, Homo sapiens
aataagacaaaaa

SEQ ID NO: 5347337 - DNA, 17 bp, Homo sapiens
aataagacataacgttt

SEQ ID NO: 5347338 - DNA, 15 bp, Homo sapiens
aataagagaaagaaa

SEQ ID NO: 5347339 - DNA, 18 bp, Homo sapiens
aataagagaatgttccta

SEQ ID NO: 5347340 - DNA, 16 bp, Homo sapiens
aataagagagcaggat

SEQ ID NO: 5347341 - DNA, 14 bp, Homo sapiens
aataagaggacaga

SEQ ID NO: 5347342 - DNA, 14 bp, Homo sapiens
aataagatcttttt

SEQ ID NO: 5347343 - DNA, 15 bp, Homo sapiens
aataagatggctgtg

SEQ ID NO: 5347344 - DNA, 14 bp, Homo sapiens
aataagattatatg

SEQ ID NO: 5347345 - DNA, 15 bp, Homo sapiens
aataagattttctgg

SEQ ID NO: 5347346 - DNA, 15 bp, Homo sapiens
aataagcaaataaac

SEQ ID NO: 5347347 - DNA, 17 bp, Homo sapiens
aataagcaactaaatga

SEQ ID NO: 5347348 - DNA, 13 bp, Homo sapiens
aataagcacttgc

SEQ ID NO: 5347349 - DNA, 17 bp, Homo sapiens
aataagcactttttaaa

SEQ ID NO: 5347350 - DNA, 21 bp, Homo sapiens
aataagcagaggtggaaaatg

SEQ ID NO: 5347351 - DNA, 17 bp, Homo sapiens
aataagcataagaccaa

SEQ ID NO: 5347352 - DNA, 15 bp, Homo sapiens
aataagcattgtttt

SEQ ID NO: 5347353 - DNA, 20 bp, Homo sapiens
aataagccaaaataagacta

SEQ ID NO: 5347354 - DNA, 21 bp, Homo sapiens
aataagccttcgaaaagaaat

SEQ ID NO: 5347355 - DNA, 22 bp, Homo sapiens
aataagccttcgaaaagaaatt

SEQ ID NO: 5347356 - DNA, 13 bp, Homo sapiens
aataagctaaaga

SEQ ID NO: 5347357 - DNA, 20 bp, Homo sapiens
aataagctactagcaaaata

SEQ ID NO: 5347358 - DNA, 18 bp, Homo sapiens
aataagctagttgaatac

SEQ ID NO: 5347359 - DNA, 20 bp, Homo sapiens
aataagctagttgaatactt

SEQ ID NO: 5347360 - DNA, 22 bp, Homo sapiens
aataagctagttgaatacttga

SEQ ID NO: 5347361 - DNA, 14 bp, Homo sapiens
aataagctctagtt

SEQ ID NO: 5347362 - DNA, 15 bp, Homo sapiens
aataagctctagttc

SEQ ID NO: 5347363 - DNA, 20 bp, Homo sapiens
aataagctttctcagaatgt

SEQ ID NO: 5347364 - DNA, 13 bp, Homo sapiens
aataaggaaaagt

SEQ ID NO: 5347365 - DNA, 21 bp, Homo sapiens
aataaggaatagctttgtatt

SEQ ID NO: 5347366 - DNA, 20 bp, Homo sapiens
aataaggacacaaactttca

SEQ ID NO: 5347367 - DNA, 16 bp, Homo sapiens
aataaggacagcagct

SEQ ID NO: 5347368 - DNA, 14 bp, Homo sapiens
aataaggaggagga

SEQ ID NO: 5347369 - DNA, 14 bp, Homo sapiens
aataaggatttatt

SEQ ID NO: 5347370 - DNA, 20 bp, Homo sapiens
aataaggatttattctcaga

SEQ ID NO: 5347371 - DNA, 21 bp, Homo sapiens
aataaggatttattctcagaa

SEQ ID NO: 5347372 - DNA, 17 bp, Homo sapiens
aataaggatttgttcac

SEQ ID NO: 5347373 - DNA, 14 bp, Homo sapiens
aataaggatttttc

SEQ ID NO: 5347374 - DNA, 11 bp, Homo sapiens
aatacttttgc

SEQ ID NO: 5347375 - DNA, 21 bp, Homo sapiens
aatacttttgcatttttcctt

SEQ ID NO: 5347376 - DNA, 20 bp, Homo sapiens
aatacttttgctttcaggga

SEQ ID NO: 5347377 - DNA, 15 bp, Homo sapiens
aatactttttacaat

SEQ ID NO: 5347378 - DNA, 17 bp, Homo sapiens
aatactttttgtggaat

SEQ ID NO: 5347379 - DNA, 14 bp, Homo sapiens
aatagaaaaaaaga

SEQ ID NO: 5347380 - DNA, 17 bp, Homo sapiens
aatagaaaaaaagaaaa

SEQ ID NO: 5347381 - DNA, 12 bp, Homo sapiens
aatagaaaaagt

SEQ ID NO: 5347382 - DNA, 22 bp, Homo sapiens
aatagaaaactgtggttaaaga

SEQ ID NO: 5347383 - DNA, 12 bp, Homo sapiens
aatagaaaagtc

SEQ ID NO: 5347384 - DNA, 12 bp, Homo sapiens
aatagaaaatat

SEQ ID NO: 5347385 - DNA, 15 bp, Homo sapiens
aatagaaaatatatt

SEQ ID NO: 5347386 - DNA, 13 bp, Homo sapiens
aatagaaaatggt

SEQ ID NO: 5347387 - DNA, 13 bp, Homo sapiens
aatagaaaattaa

SEQ ID NO: 5347388 - DNA, 17 bp, Homo sapiens
aatagaaacttttagta

SEQ ID NO: 5347389 - DNA, 11 bp, Homo sapiens
aatagaaagaa

SEQ ID NO: 5347390 - DNA, 14 bp, Homo sapiens
aatagaaagaaagt

SEQ ID NO: 5347391 - DNA, 20 bp, Homo sapiens
aatagaaattagatttgtgc

SEQ ID NO: 5347392 - DNA, 16 bp, Homo sapiens
aatagaaatttccaga

SEQ ID NO: 5347393 - DNA, 15 bp, Homo sapiens
aatagaaattttgtt

SEQ ID NO: 5347394 - DNA, 17 bp, Homo sapiens
aatagaaattttgttaa

SEQ ID NO: 5347395 - DNA, 23 bp, Homo sapiens
aatagaacacagaacaggaacta

SEQ ID NO: 5347396 - DNA, 13 bp, Homo sapiens
aatagaacacagt

SEQ ID NO: 5347397 - DNA, 16 bp, Homo sapiens
aatagaacactgcctc

SEQ ID NO: 5347398 - DNA, 20 bp, Homo sapiens
aatagaacactgcctctgag

SEQ ID NO: 5347399 - DNA, 14 bp, Homo sapiens
aatagaactatctg

SEQ ID NO: 5347400 - DNA, 16 bp, Homo sapiens
aatagaacttgccttt

SEQ ID NO: 5347401 - DNA, 13 bp, Homo sapiens
aatagaagaaaga

SEQ ID NO: 5347402 - DNA, 12 bp, Homo sapiens
aatagaagaaga

SEQ ID NO: 5347403 - DNA, 19 bp, Homo sapiens
aatagaaggatgtacattt

SEQ ID NO: 5347404 - DNA, 17 bp, Homo sapiens
aatagaagttttcctga

SEQ ID NO: 5347405 - DNA, 15 bp, Homo sapiens
aatagaataaaggca

SEQ ID NO: 5347406 - DNA, 16 bp, Homo sapiens
aatagaataaaggcag

SEQ ID NO: 5347407 - DNA, 18 bp, Homo sapiens
aatagaataaatacaata

SEQ ID NO: 5347408 - DNA, 17 bp, Homo sapiens
aatagaataatctatta

SEQ ID NO: 5347409 - DNA, 20 bp, Homo sapiens
aatagaatataattatcgga

SEQ ID NO: 5347410 - DNA, 13 bp, Homo sapiens
aatagaatatata

SEQ ID NO: 5347411 - DNA, 14 bp, Homo sapiens
aatagaatgaaaag

SEQ ID NO: 5347412 - DNA, 16 bp, Homo sapiens
aatagaatgaaaagtt

SEQ ID NO: 5347413 - DNA, 17 bp, Homo sapiens
aatagaatgaaaagttt

SEQ ID NO: 5347414 - DNA, 14 bp, Homo sapiens
aatagaatgtaaat

SEQ ID NO: 5347415 - DNA, 16 bp, Homo sapiens
aatagaattataactg

SEQ ID NO: 5347416 - DNA, 16 bp, Homo sapiens
aatagaatttcctaat

SEQ ID NO: 5347417 - DNA, 15 bp, Homo sapiens
aatagacaaaaagta

SEQ ID NO: 5347418 - DNA, 14 bp, Homo sapiens
aatagacaaataga

SEQ ID NO: 5347419 - DNA, 12 bp, Homo sapiens
aatagacaagtt

SEQ ID NO: 5347420 - DNA, 13 bp, Homo sapiens
aatagacaagttt

SEQ ID NO: 5347421 - DNA, 14 bp, Homo sapiens
aatagacaagtttt

SEQ ID NO: 5347422 - DNA, 18 bp, Homo sapiens
aatagacaatttattatg

SEQ ID NO: 5347423 - DNA, 23 bp, Homo sapiens
aatagacaatttattatggcaca

SEQ ID NO: 5347424 - DNA, 21 bp, Homo sapiens
aatagacagaggtttcatttt

SEQ ID NO: 5347425 - DNA, 13 bp, Homo sapiens
aatagacataaat

SEQ ID NO: 5347426 - DNA, 12 bp, Homo sapiens
aatagacatttt

SEQ ID NO: 5347427 - DNA, 15 bp, Homo sapiens
aatagactaaatgaa

SEQ ID NO: 5347428 - DNA, 23 bp, Homo sapiens
aatagactgtacttattttccaa

SEQ ID NO: 5347429 - DNA, 14 bp, Homo sapiens
aatagacttctctt

SEQ ID NO: 5347430 - DNA, 16 bp, Homo sapiens
aatagacttctcttac

SEQ ID NO: 5347431 - DNA, 18 bp, Homo sapiens
aatagacttctcttacat

SEQ ID NO: 5347432 - DNA, 20 bp, Homo sapiens
aatagacttctcttacattt

SEQ ID NO: 5347433 - DNA, 17 bp, Homo sapiens
aatagagaaaattcagg

SEQ ID NO: 5347434 - DNA, 15 bp, Homo sapiens
aatagagaatatttt

SEQ ID NO: 5347435 - DNA, 14 bp, Homo sapiens
aatagagactgtag

SEQ ID NO: 5347436 - DNA, 15 bp, Homo sapiens
aatagagagagaggt

SEQ ID NO: 5347437 - DNA, 14 bp, Homo sapiens
aatagagagtctcc

SEQ ID NO: 5347438 - DNA, 13 bp, Homo sapiens
aatagagataaaa

SEQ ID NO: 5347439 - DNA, 21 bp, Homo sapiens
aatagaggctttgagcaacta

SEQ ID NO: 5347440 - DNA, 13 bp, Homo sapiens
aatagagtactta

SEQ ID NO: 5347441 - DNA, 15 bp, Homo sapiens
aatagagtacttaat

SEQ ID NO: 5347442 - DNA, 18 bp, Homo sapiens
aatagagtgcataaataa

SEQ ID NO: 5347443 - DNA, 13 bp, Homo sapiens
aatagagtgtttt

SEQ ID NO: 5347444 - DNA, 22 bp, Homo sapiens
aatagagtttttatatttgtta

SEQ ID NO: 5347445 - DNA, 22 bp, Homo sapiens
aatagataaagtgcctataaag

SEQ ID NO: 5347446 - DNA, 19 bp, Homo sapiens
aatagataaccaattttca

SEQ ID NO: 5347447 - DNA, 18 bp, Homo sapiens
aatagatacagcagaggc

SEQ ID NO: 5347448 - DNA, 22 bp, Homo sapiens
aatagatataaatttttaagag

SEQ ID NO: 5347449 - DNA, 15 bp, Homo sapiens
aatagatcagtattt

SEQ ID NO: 5347450 - DNA, 20 bp, Homo sapiens
aatagatcctaggtgctgga

SEQ ID NO: 5347451 - DNA, 14 bp, Homo sapiens
aatagatctgaata

SEQ ID NO: 5347452 - DNA, 22 bp, Homo sapiens
aatagatcttaggcaaaatacc

SEQ ID NO: 5347453 - DNA, 15 bp, Homo sapiens
aatagatcttagggt

SEQ ID NO: 5347454 - DNA, 22 bp, Homo sapiens
aatagatgacattgactatttt

SEQ ID NO: 5347455 - DNA, 23 bp, Homo sapiens
aatagatggacagtttgtttcct

SEQ ID NO: 5347456 - DNA, 17 bp, Homo sapiens
aatagatgtaaataaaa

SEQ ID NO: 5347457 - DNA, 19 bp, Homo sapiens
aatagatgtaaataaaatt

SEQ ID NO: 5347458 - DNA, 14 bp, Homo sapiens
aatagatgttttaa

SEQ ID NO: 5347459 - DNA, 20 bp, Homo sapiens
aatagattaaaggaattaaa

SEQ ID NO: 5347460 - DNA, 14 bp, Homo sapiens
aatagattaggttt

SEQ ID NO: 5347461 - DNA, 15 bp, Homo sapiens
aatagattatagttg

SEQ ID NO: 5347462 - DNA, 19 bp, Homo sapiens
aatagattatttcatatac

SEQ ID NO: 5347463 - DNA, 16 bp, Homo sapiens
aatagattcagagaaa

SEQ ID NO: 5347464 - DNA, 14 bp, Homo sapiens
aatagattcttaaa

SEQ ID NO: 5347465 - DNA, 18 bp, Homo sapiens
aatagattgagttattaa

SEQ ID NO: 5347466 - DNA, 19 bp, Homo sapiens
aatagattgtaatacacat

SEQ ID NO: 5347467 - DNA, 22 bp, Homo sapiens
aatagatttcagctatgcagaa

SEQ ID NO: 5347468 - DNA, 21 bp, Homo sapiens
aatagattttataagatgact

SEQ ID NO: 5347469 - DNA, 18 bp, Homo sapiens
aatagatttttagattcc

SEQ ID NO: 5347470 - DNA, 14 bp, Homo sapiens
aatagattttttca

SEQ ID NO: 5347471 - DNA, 18 bp, Homo sapiens
aatagattttttttaaag

SEQ ID NO: 5347472 - DNA, 18 bp, Homo sapiens
aatagatttttttttcca

SEQ ID NO: 5347473 - DNA, 13 bp, Homo sapiens
aatagcaaaagaa

SEQ ID NO: 5347474 - DNA, 19 bp, Homo sapiens
aatagcaaaatattatctg

SEQ ID NO: 5347475 - DNA, 15 bp, Homo sapiens
aatagcaaagaattg

SEQ ID NO: 5347476 - DNA, 21 bp, Homo sapiens
aatagcaagtggcataaagca

SEQ ID NO: 5347477 - DNA, 11 bp, Homo sapiens
aatagcacagg

SEQ ID NO: 5347478 - DNA, 14 bp, Homo sapiens
aatagcacatgatt

SEQ ID NO: 5347479 - DNA, 21 bp, Homo sapiens
aatagcaccaatacaaattga

SEQ ID NO: 5347480 - DNA, 19 bp, Homo sapiens
aatagcactttcattgcca

SEQ ID NO: 5347481 - DNA, 22 bp, Homo sapiens
aatagcagagagccaaatctga

SEQ ID NO: 5347482 - DNA, 22 bp, Homo sapiens
aatagcagccctcaattgtgaa

SEQ ID NO: 5347483 - DNA, 15 bp, Homo sapiens
aatagcagttataac

SEQ ID NO: 5347484 - DNA, 17 bp, Homo sapiens
aatagcagttataacag

SEQ ID NO: 5347485 - DNA, 23 bp, Homo sapiens
aatagcagttataacagatgtga

SEQ ID NO: 5347486 - DNA, 23 bp, Homo sapiens
aatagcatacaccaaacatttct

SEQ ID NO: 5347487 - DNA, 19 bp, Homo sapiens
aatagcatctgtacaaagg

SEQ ID NO: 5347488 - DNA, 19 bp, Homo sapiens
aatagcatgacaggctgtt

SEQ ID NO: 5347489 - DNA, 18 bp, Homo sapiens
aatagcatgtattgtgtc

SEQ ID NO: 5347490 - DNA, 20 bp, Homo sapiens
aatagcatgtcactaaagca

SEQ ID NO: 5347491 - DNA, 13 bp, Homo sapiens
aatagcatgttgt

SEQ ID NO: 5347492 - DNA, 16 bp, Homo sapiens
aatagcatttttgtaa

SEQ ID NO: 5347493 - DNA, 21 bp, Homo sapiens
aatagccaaaaaggcaaataa

SEQ ID NO: 5347494 - DNA, 23 bp, Homo sapiens
aatagccacatttggaatacttt

SEQ ID NO: 5347495 - DNA, 12 bp, Homo sapiens
aatagccagaga

SEQ ID NO: 5347496 - DNA, 21 bp, Homo sapiens
aatagccatatttgtaaaatg

SEQ ID NO: 5347497 - DNA, 23 bp, Homo sapiens
aatagcccagccttttgagagta

SEQ ID NO: 5347498 - DNA, 12 bp, Homo sapiens
aatagccccaga

SEQ ID NO: 5347499 - DNA, 14 bp, Homo sapiens
aatagccccatctc

SEQ ID NO: 5347500 - DNA, 20 bp, Homo sapiens
aatagccgaactccaggctg

SEQ ID NO: 5347501 - DNA, 11 bp, Homo sapiens
aatagcctaaa

SEQ ID NO: 5347502 - DNA, 13 bp, Homo sapiens
aatagcctgaatt

SEQ ID NO: 5347503 - DNA, 14 bp, Homo sapiens
aatagccttcaaaa

SEQ ID NO: 5347504 - DNA, 23 bp, Homo sapiens
aatagcgacaggaatagatgtgg

SEQ ID NO: 5347505 - DNA, 22 bp, Homo sapiens
aatagcgctgtttttgttgtgt

SEQ ID NO: 5347506 - DNA, 14 bp, Homo sapiens
aatagcgttcttgt

SEQ ID NO: 5347507 - DNA, 15 bp, Homo sapiens
aatagcgttcttgta

SEQ ID NO: 5347508 - DNA, 16 bp, Homo sapiens
aatagcgttcttgtaa

SEQ ID NO: 5347509 - DNA, 18 bp, Homo sapiens
aatagcgttcttgtaatt

SEQ ID NO: 5347510 - DNA, 19 bp, Homo sapiens
aatagcgttcttgtaattt

SEQ ID NO: 5347511 - DNA, 21 bp, Homo sapiens
aatagctaaatacctcaatca

SEQ ID NO: 5347512 - DNA, 19 bp, Homo sapiens
aatagctaatttatttccc

SEQ ID NO: 5347513 - DNA, 16 bp, Homo sapiens
aatagctacagtgcat

SEQ ID NO: 5347514 - DNA, 17 bp, Homo sapiens
aatagctatatccatgt

SEQ ID NO: 5347515 - DNA, 22 bp, Homo sapiens
aatagctatatccatgtactgt

SEQ ID NO: 5347516 - DNA, 23 bp, Homo sapiens
aatagctatatccatgtactgta

SEQ ID NO: 5347517 - DNA, 13 bp, Homo sapiens
aatagctattgca

SEQ ID NO: 5347518 - DNA, 19 bp, Homo sapiens
aatagctattgcatgtaaa

SEQ ID NO: 5347519 - DNA, 18 bp, Homo sapiens
aatagctatttttttcct

SEQ ID NO: 5347520 - DNA, 16 bp, Homo sapiens
aatagctccaagctgt

SEQ ID NO: 5347521 - DNA, 20 bp, Homo sapiens
aatagctccaagctgttaaa

SEQ ID NO: 5347522 - DNA, 13 bp, Homo sapiens
aatagctctgtgt

SEQ ID NO: 5347523 - DNA, 20 bp, Homo sapiens
aatagctgaaaactaatgta

SEQ ID NO: 5347524 - DNA, 15 bp, Homo sapiens
aatagctgaaaaggg

SEQ ID NO: 5347525 - DNA, 13 bp, Homo sapiens
aatagctgggact

SEQ ID NO: 5347526 - DNA, 18 bp, Homo sapiens
aatagctgtaaacttcca

SEQ ID NO: 5347527 - DNA, 23 bp, Homo sapiens
aatagctgtgatcagtgattttc

SEQ ID NO: 5347528 - DNA, 23 bp, Homo sapiens
aatagcttagcggcaagaagccg

SEQ ID NO: 5347529 - DNA, 18 bp, Homo sapiens
aatagcttatgaaaagaa

SEQ ID NO: 5347530 - DNA, 19 bp, Homo sapiens
aatagcttatgaaaagaat

SEQ ID NO: 5347531 - DNA, 13 bp, Homo sapiens
aatagcttctgtg

SEQ ID NO: 5347532 - DNA, 14 bp, Homo sapiens
aatagcttctgtgt

SEQ ID NO: 5347533 - DNA, 15 bp, Homo sapiens
aatagcttctgtgtg

SEQ ID NO: 5347534 - DNA, 19 bp, Homo sapiens
aatagcttgtatagtgtaa

SEQ ID NO: 5347535 - DNA, 19 bp, Homo sapiens
aatagctttaaaagggaaa

SEQ ID NO: 5347536 - DNA, 21 bp, Homo sapiens
aatagctttaccctcaggcat

SEQ ID NO: 5347537 - DNA, 17 bp, Homo sapiens
aatagctttactgtttc

SEQ ID NO: 5347538 - DNA, 14 bp, Homo sapiens
aatagctttagtga

SEQ ID NO: 5347539 - DNA, 22 bp, Homo sapiens
aatagctttagtgaattaaatt

SEQ ID NO: 5347540 - DNA, 15 bp, Homo sapiens
aatagctttgtagtt

SEQ ID NO: 5347541 - DNA, 21 bp, Homo sapiens
aatagcttttcatcaattctt

SEQ ID NO: 5347542 - DNA, 17 bp, Homo sapiens
aataggaaaaactgatt

SEQ ID NO: 5347543 - DNA, 18 bp, Homo sapiens
aataggaaaaactgattt

SEQ ID NO: 5347544 - DNA, 19 bp, Homo sapiens
aataggaaaaactgatttt

SEQ ID NO: 5347545 - DNA, 11 bp, Homo sapiens
aataggaaaac

SEQ ID NO: 5347546 - DNA, 17 bp, Homo sapiens
aataggaaaatgtacat

SEQ ID NO: 5347547 - DNA, 13 bp, Homo sapiens
aataggaaacaag

SEQ ID NO: 5347548 - DNA, 14 bp, Homo sapiens
aataggaagaacag

SEQ ID NO: 5347549 - DNA, 22 bp, Homo sapiens
aataggacaaaacgggttacta

SEQ ID NO: 5347550 - DNA, 17 bp, Homo sapiens
aataggagaaaatgaaa

SEQ ID NO: 5347551 - DNA, 13 bp, Homo sapiens
aataggagaggat

SEQ ID NO: 5347552 - DNA, 15 bp, Homo sapiens
aataggagaggatga

SEQ ID NO: 5347553 - DNA, 18 bp, Homo sapiens
aatatattaaaaatataa

SEQ ID NO: 5347554 - DNA, 18 bp, Homo sapiens
aatatattacttaactgt

SEQ ID NO: 5347555 - DNA, 12 bp, Homo sapiens
aatatattatga

SEQ ID NO: 5347556 - DNA, 15 bp, Homo sapiens
aatatattatgaaaa

SEQ ID NO: 5347557 - DNA, 18 bp, Homo sapiens
aatatattatgaaaatta

SEQ ID NO: 5347558 - DNA, 13 bp, Homo sapiens
aatatattattac

SEQ ID NO: 5347559 - DNA, 15 bp, Homo sapiens
aatatattattactt

SEQ ID NO: 5347560 - DNA, 21 bp, Homo sapiens
aatatattattacttgtaaat

SEQ ID NO: 5347561 - DNA, 22 bp, Homo sapiens
aatatattattcatcttttcat

SEQ ID NO: 5347562 - DNA, 16 bp, Homo sapiens
aatatattcaggagtt

SEQ ID NO: 5347563 - DNA, 13 bp, Homo sapiens
aatatattcataa

SEQ ID NO: 5347564 - DNA, 22 bp, Homo sapiens
aatatattcataatatataaaa

SEQ ID NO: 5347565 - DNA, 14 bp, Homo sapiens
aatatattgaacac

SEQ ID NO: 5347566 - DNA, 16 bp, Homo sapiens
aatatattgaataaaa

SEQ ID NO: 5347567 - DNA, 19 bp, Homo sapiens
aatatattgaataggcatt

SEQ ID NO: 5347568 - DNA, 18 bp, Homo sapiens
aatatattgccaaatatt

SEQ ID NO: 5347569 - DNA, 20 bp, Homo sapiens
aatatattgccagtatataa

SEQ ID NO: 5347570 - DNA, 11 bp, Homo sapiens
aatatattgta

SEQ ID NO: 5347571 - DNA, 13 bp, Homo sapiens
aatatattgtaca

SEQ ID NO: 5347572 - DNA, 16 bp, Homo sapiens
aatatattgtacaaat

SEQ ID NO: 5347573 - DNA, 13 bp, Homo sapiens
aatatattgtgtt

SEQ ID NO: 5347574 - DNA, 17 bp, Homo sapiens
aatatattgtgttttaa

SEQ ID NO: 5347575 - DNA, 13 bp, Homo sapiens
aatatattgttaa

SEQ ID NO: 5347576 - DNA, 15 bp, Homo sapiens
aatatattgttttcc

SEQ ID NO: 5347577 - DNA, 14 bp, Homo sapiens
aatatatttaaagg

SEQ ID NO: 5347578 - DNA, 22 bp, Homo sapiens
aatatatttaactatttagaga

SEQ ID NO: 5347579 - DNA, 15 bp, Homo sapiens
aatatatttaagata

SEQ ID NO: 5347580 - DNA, 19 bp, Homo sapiens
aatatatttaagataatta

SEQ ID NO: 5347581 - DNA, 15 bp, Homo sapiens
aatatatttaatata

SEQ ID NO: 5347582 - DNA, 13 bp, Homo sapiens
aatatatttatga

SEQ ID NO: 5347583 - DNA, 19 bp, Homo sapiens
aatatatttatttaaagca

SEQ ID NO: 5347584 - DNA, 22 bp, Homo sapiens
aatatatttcagacattttcac

SEQ ID NO: 5347585 - DNA, 13 bp, Homo sapiens
aatatatttcttc

SEQ ID NO: 5347586 - DNA, 14 bp, Homo sapiens
aatatatttcttct

SEQ ID NO: 5347587 - DNA, 14 bp, Homo sapiens
aatatatttgcaga

SEQ ID NO: 5347588 - DNA, 24 bp, Homo sapiens
aatatatttgcataatatgcatat

SEQ ID NO: 5347589 - DNA, 15 bp, Homo sapiens
aatatatttgtaaaa

SEQ ID NO: 5347590 - DNA, 13 bp, Homo sapiens
aatatatttgtgt

SEQ ID NO: 5347591 - DNA, 21 bp, Homo sapiens
aatatatttgtgtatttaaca

SEQ ID NO: 5347592 - DNA, 24 bp, Homo sapiens
aatatatttgtgtatttaacaggg

SEQ ID NO: 5347593 - DNA, 21 bp, Homo sapiens
aatatattttaagacgaaaca

SEQ ID NO: 5347594 - DNA, 16 bp, Homo sapiens
aatatattttaccata

SEQ ID NO: 5347595 - DNA, 12 bp, Homo sapiens
aatatattttct

SEQ ID NO: 5347596 - DNA, 13 bp, Homo sapiens
aatatattttgta

SEQ ID NO: 5347597 - DNA, 17 bp, Homo sapiens
aatatattttgtatgca

SEQ ID NO: 5347598 - DNA, 18 bp, Homo sapiens
aatatattttgtatgcaa

SEQ ID NO: 5347599 - DNA, 19 bp, Homo sapiens
aatatatttttaaagcaaa

SEQ ID NO: 5347600 - DNA, 14 bp, Homo sapiens
aatatatttttaga

SEQ ID NO: 5347601 - DNA, 18 bp, Homo sapiens
aatatatttttagactca

SEQ ID NO: 5347602 - DNA, 14 bp, Homo sapiens
aatatattttttga

SEQ ID NO: 5347603 - DNA, 17 bp, Homo sapiens
aatatcaaaagaaaatt

SEQ ID NO: 5347604 - DNA, 23 bp, Homo sapiens
aatatcaaaagaaaattgatatt

SEQ ID NO: 5347605 - DNA, 15 bp, Homo sapiens
aatatcaaaaggaag

SEQ ID NO: 5347606 - DNA, 14 bp, Homo sapiens
aatatcaaagcatt

SEQ ID NO: 5347607 - DNA, 17 bp, Homo sapiens
aatatcaaataaaatat

SEQ ID NO: 5347608 - DNA, 19 bp, Homo sapiens
aatatcaaataaaattatt

SEQ ID NO: 5347609 - DNA, 18 bp, Homo sapiens
aatatcaaataataaagt

SEQ ID NO: 5347610 - DNA, 13 bp, Homo sapiens
aatatcaaattaa

SEQ ID NO: 5347611 - DNA, 19 bp, Homo sapiens
aatatcaaattaattgtgt

SEQ ID NO: 5347612 - DNA, 21 bp, Homo sapiens
aatatcaaattaattgtgtga

SEQ ID NO: 5347613 - DNA, 15 bp, Homo sapiens
aatatcaactctgaa

SEQ ID NO: 5347614 - DNA, 18 bp, Homo sapiens
aatatcaagtactacatt

SEQ ID NO: 5347615 - DNA, 14 bp, Homo sapiens
aatatcaatcaagc

SEQ ID NO: 5347616 - DNA, 15 bp, Homo sapiens
aatatcaatcacatt

SEQ ID NO: 5347617 - DNA, 16 bp, Homo sapiens
aatatcaatcattttc

SEQ ID NO: 5347618 - DNA, 16 bp, Homo sapiens
aatatcaatgaagatt

SEQ ID NO: 5347619 - DNA, 20 bp, Homo sapiens
aatatcacactgaataagag

SEQ ID NO: 5347620 - DNA, 15 bp, Homo sapiens
aatatcacagtatta

SEQ ID NO: 5347621 - DNA, 12 bp, Homo sapiens
aatatcacctag

SEQ ID NO: 5347622 - DNA, 13 bp, Homo sapiens
aatatcactcatt

SEQ ID NO: 5347623 - DNA, 15 bp, Homo sapiens
aatatcactcattaa

SEQ ID NO: 5347624 - DNA, 17 bp, Homo sapiens
aatatcactgtaatgag

SEQ ID NO: 5347625 - DNA, 13 bp, Homo sapiens
aatatcagacttt

SEQ ID NO: 5347626 - DNA, 16 bp, Homo sapiens
aatatcagctttgata

SEQ ID NO: 5347627 - DNA, 23 bp, Homo sapiens
aatatcagctttgataattgtgt

SEQ ID NO: 5347628 - DNA, 23 bp, Homo sapiens
aatatcagtattctgacatgtaa

SEQ ID NO: 5347629 - DNA, 16 bp, Homo sapiens
aatatcagttacagtg

SEQ ID NO: 5347630 - DNA, 21 bp, Homo sapiens
aatatcagttactcagccctg

SEQ ID NO: 5347631 - DNA, 14 bp, Homo sapiens
aatatcataaagca

SEQ ID NO: 5347632 - DNA, 15 bp, Homo sapiens
aatatcataaagcat

SEQ ID NO: 5347633 - DNA, 18 bp, Homo sapiens
aatatcataatgtaatga

SEQ ID NO: 5347634 - DNA, 13 bp, Homo sapiens
aatatcatataaa

SEQ ID NO: 5347635 - DNA, 14 bp, Homo sapiens
aatatcatatgtat

SEQ ID NO: 5347636 - DNA, 16 bp, Homo sapiens
aatatcatctgtcatt

SEQ ID NO: 5347637 - DNA, 20 bp, Homo sapiens
aatatcatctgtcattatat

SEQ ID NO: 5347638 - DNA, 13 bp, Homo sapiens
aatatcatctttt

SEQ ID NO: 5347639 - DNA, 19 bp, Homo sapiens
aatatcattactaacttct

SEQ ID NO: 5347640 - DNA, 16 bp, Homo sapiens
aatatcattatagcat

SEQ ID NO: 5347641 - DNA, 18 bp, Homo sapiens
aatatcattatagcatgt

SEQ ID NO: 5347642 - DNA, 20 bp, Homo sapiens
aatatcattctttgtatctt

SEQ ID NO: 5347643 - DNA, 13 bp, Homo sapiens
aatatcattgatt

SEQ ID NO: 5347644 - DNA, 19 bp, Homo sapiens
aatatcatttataaaggga

SEQ ID NO: 5347645 - DNA, 13 bp, Homo sapiens
aatatcatttatt

SEQ ID NO: 5347646 - DNA, 23 bp, Homo sapiens
aatatcatttattttttacatta

SEQ ID NO: 5347647 - DNA, 17 bp, Homo sapiens
aatatcatttcataaaa

SEQ ID NO: 5347648 - DNA, 19 bp, Homo sapiens
aatatcatttcataaaaat

SEQ ID NO: 5347649 - DNA, 20 bp, Homo sapiens
aatatcattttatagaaaat

SEQ ID NO: 5347650 - DNA, 23 bp, Homo sapiens
aatatcattttatagaaaatgca

SEQ ID NO: 5347651 - DNA, 14 bp, Homo sapiens
aatatcattttatt

SEQ ID NO: 5347652 - DNA, 18 bp, Homo sapiens
aatatcattttcctggga

SEQ ID NO: 5347653 - DNA, 14 bp, Homo sapiens
aatatccaaagact

SEQ ID NO: 5347654 - DNA, 16 bp, Homo sapiens
aatatccaagcccagc

SEQ ID NO: 5347655 - DNA, 17 bp, Homo sapiens
aatatccaggtcaacag

SEQ ID NO: 5347656 - DNA, 22 bp, Homo sapiens
aatatccaggtcaacagaatga

SEQ ID NO: 5347657 - DNA, 23 bp, Homo sapiens
aatatccaggtcaacagaatgaa

SEQ ID NO: 5347658 - DNA, 23 bp, Homo sapiens
aatatccattctcgttttaggac

SEQ ID NO: 5347659 - DNA, 15 bp, Homo sapiens
aatatccatttatct

SEQ ID NO: 5347660 - DNA, 17 bp, Homo sapiens
aatatccatttatcttt

SEQ ID NO: 5347661 - DNA, 18 bp, Homo sapiens
aatatcccaacattctgc

SEQ ID NO: 5347662 - DNA, 14 bp, Homo sapiens
aatatccctcattt

SEQ ID NO: 5347663 - DNA, 16 bp, Homo sapiens
aatatccctcatttca

SEQ ID NO: 5347664 - DNA, 19 bp, Homo sapiens
aatatccctcctgttggga

SEQ ID NO: 5347665 - DNA, 23 bp, Homo sapiens
aatatccctttttcacatattaa

SEQ ID NO: 5347666 - DNA, 13 bp, Homo sapiens
aatatcctaataa

SEQ ID NO: 5347667 - DNA, 21 bp, Homo sapiens
aatatcctaataaaaaggtga

SEQ ID NO: 5347668 - DNA, 23 bp, Homo sapiens
aatatcctatactggttatagtt

SEQ ID NO: 5347669 - DNA, 22 bp, Homo sapiens
aatatcctgccttttaccttca

SEQ ID NO: 5347670 - DNA, 21 bp, Homo sapiens
aatatcctgtaactacaatga

SEQ ID NO: 5347671 - DNA, 19 bp, Homo sapiens
aatatccttgatgtacaga

SEQ ID NO: 5347672 - DNA, 24 bp, Homo sapiens
aatatccttgatgtacagatttta

SEQ ID NO: 5347673 - DNA, 12 bp, Homo sapiens
aatatcctttgc

SEQ ID NO: 5347674 - DNA, 14 bp, Homo sapiens
aatatcctttggaa

SEQ ID NO: 5347675 - DNA, 15 bp, Homo sapiens
aatatcgctgatatt

SEQ ID NO: 5347676 - DNA, 17 bp, Homo sapiens
aatatcgctgatgcaga

SEQ ID NO: 5347677 - DNA, 14 bp, Homo sapiens
aatatcgtgtgtgt

SEQ ID NO: 5347678 - DNA, 23 bp, Homo sapiens
aatatcgttagggtgaagcatta

SEQ ID NO: 5347679 - DNA, 14 bp, Homo sapiens
aatatctaatatat

SEQ ID NO: 5347680 - DNA, 20 bp, Homo sapiens
aatatctaatatatatgaat

SEQ ID NO: 5347681 - DNA, 14 bp, Homo sapiens
aatatctacctgcc

SEQ ID NO: 5347682 - DNA, 19 bp, Homo sapiens
aatatctacctgccctctc

SEQ ID NO: 5347683 - DNA, 22 bp, Homo sapiens
aatatctacctgccctctctca

SEQ ID NO: 5347684 - DNA, 16 bp, Homo sapiens
aatatctagtaatata

SEQ ID NO: 5347685 - DNA, 18 bp, Homo sapiens
aatatctagtaatatatt

SEQ ID NO: 5347686 - DNA, 16 bp, Homo sapiens
aatatctagtgctaaa

SEQ ID NO: 5347687 - DNA, 18 bp, Homo sapiens
aatatctagtgctaaacc

SEQ ID NO: 5347688 - DNA, 16 bp, Homo sapiens
aatatctatattctat

SEQ ID NO: 5347689 - DNA, 14 bp, Homo sapiens
aatatctatttgaa

SEQ ID NO: 5347690 - DNA, 14 bp, Homo sapiens
aatatctcctggaa

SEQ ID NO: 5347691 - DNA, 18 bp, Homo sapiens
aatatctctgagttctgt

SEQ ID NO: 5347692 - DNA, 17 bp, Homo sapiens
aatatctcttgtgcttt

SEQ ID NO: 5347693 - DNA, 16 bp, Homo sapiens
aatatctgaaaatgta

SEQ ID NO: 5347694 - DNA, 18 bp, Homo sapiens
aatatctgaaaatgtatg

SEQ ID NO: 5347695 - DNA, 12 bp, Homo sapiens
aatatctgaata

SEQ ID NO: 5347696 - DNA, 20 bp, Homo sapiens
aatatctgagaagtgtatat

SEQ ID NO: 5347697 - DNA, 14 bp, Homo sapiens
aatatctgctgtat

SEQ ID NO: 5347698 - DNA, 14 bp, Homo sapiens
aatatctggcactg

SEQ ID NO: 5347699 - DNA, 22 bp, Homo sapiens
aatatctggcactgttaataca

SEQ ID NO: 5347700 - DNA, 13 bp, Homo sapiens
aatatctgggatt

SEQ ID NO: 5347701 - DNA, 21 bp, Homo sapiens
aatatctgggattctacttta

SEQ ID NO: 5347702 - DNA, 20 bp, Homo sapiens
aatatctgtatttaattttg

SEQ ID NO: 5347703 - DNA, 22 bp, Homo sapiens
aatatctgtatttaattttgac

SEQ ID NO: 5347704 - DNA, 19 bp, Homo sapiens
aatatctgtgaaatatcat

SEQ ID NO: 5347705 - DNA, 20 bp, Homo sapiens
aatatctgtgaggtgctgat

SEQ ID NO: 5347706 - DNA, 21 bp, Homo sapiens
aatatctgtgaggtgctgatg

SEQ ID NO: 5347707 - DNA, 22 bp, Homo sapiens
aatatctgttattcaaatttga

SEQ ID NO: 5347708 - DNA, 18 bp, Homo sapiens
aatatctgttcccagccc

SEQ ID NO: 5347709 - DNA, 18 bp, Homo sapiens
aatatcttaattctttgt

SEQ ID NO: 5347710 - DNA, 16 bp, Homo sapiens
aatatcttactaaggc

SEQ ID NO: 5347711 - DNA, 13 bp, Homo sapiens
aatatcttgaaga

SEQ ID NO: 5347712 - DNA, 21 bp, Homo sapiens
aatatcttgctggattaatgt

SEQ ID NO: 5347713 - DNA, 15 bp, Homo sapiens
aatatcttgcttgaa

SEQ ID NO: 5347714 - DNA, 14 bp, Homo sapiens
aatatcttgtgttg

SEQ ID NO: 5347715 - DNA, 14 bp, Homo sapiens
aatatctttcagtt

SEQ ID NO: 5347716 - DNA, 12 bp, Homo sapiens
aatatctttctg

SEQ ID NO: 5347717 - DNA, 19 bp, Homo sapiens
aatatctttgtgataattt

SEQ ID NO: 5347718 - DNA, 15 bp, Homo sapiens
aatatcttttatgtt

SEQ ID NO: 5347719 - DNA, 15 bp, Homo sapiens
aatatgaaaaatgta

SEQ ID NO: 5347720 - DNA, 21 bp, Homo sapiens
aatatgaaagcctagtccaga

SEQ ID NO: 5347721 - DNA, 23 bp, Homo sapiens
aatatgaaattttttttcatgct

SEQ ID NO: 5347722 - DNA, 14 bp, Homo sapiens
aatatgaacaaact

SEQ ID NO: 5347723 - DNA, 20 bp, Homo sapiens
aatatgaaccctttgtttct

SEQ ID NO: 5347724 - DNA, 17 bp, Homo sapiens
aatatgaagagtttttt

SEQ ID NO: 5347725 - DNA, 12 bp, Homo sapiens
aatatgaagtta

SEQ ID NO: 5347726 - DNA, 19 bp, Homo sapiens
aatatgaagttactttctt

SEQ ID NO: 5347727 - DNA, 18 bp, Homo sapiens
aatatgaatacagggcat

SEQ ID NO: 5347728 - DNA, 18 bp, Homo sapiens
aatatgaatatatacata

SEQ ID NO: 5347729 - DNA, 13 bp, Homo sapiens
aatatgaatctat

SEQ ID NO: 5347730 - DNA, 17 bp, Homo sapiens
aatatgaatgagaatgt

SEQ ID NO: 5347731 - DNA, 23 bp, Homo sapiens
aatatgaatgagaatgtgccatg

SEQ ID NO: 5347732 - DNA, 14 bp, Homo sapiens
aatatttcaaatga

SEQ ID NO: 5347733 - DNA, 14 bp, Homo sapiens
aatatttcaagaca

SEQ ID NO: 5347734 - DNA, 13 bp, Homo sapiens
aatatttcaagtg

SEQ ID NO: 5347735 - DNA, 23 bp, Homo sapiens
aatatttcaagtgcctagactgt

SEQ ID NO: 5347736 - DNA, 20 bp, Homo sapiens
aatatttcaataacttagaa

SEQ ID NO: 5347737 - DNA, 20 bp, Homo sapiens
aatatttcaggttcttcaga

SEQ ID NO: 5347738 - DNA, 13 bp, Homo sapiens
aatatttcataaa

SEQ ID NO: 5347739 - DNA, 12 bp, Homo sapiens
aatatttcatga

SEQ ID NO: 5347740 - DNA, 11 bp, Homo sapiens
aatatttcatt

SEQ ID NO: 5347741 - DNA, 19 bp, Homo sapiens
aatatttcattttgagaac

SEQ ID NO: 5347742 - DNA, 22 bp, Homo sapiens
aatatttcattttgagaacatt

SEQ ID NO: 5347743 - DNA, 19 bp, Homo sapiens
aatatttccagaaggattt

SEQ ID NO: 5347744 - DNA, 16 bp, Homo sapiens
aatatttccatatgga

SEQ ID NO: 5347745 - DNA, 17 bp, Homo sapiens
aatatttcccctagttt

SEQ ID NO: 5347746 - DNA, 22 bp, Homo sapiens
aatatttcctgacttgagtgtt

SEQ ID NO: 5347747 - DNA, 22 bp, Homo sapiens
aatatttctaagcttatttcta

SEQ ID NO: 5347748 - DNA, 12 bp, Homo sapiens
aatatttctagt

SEQ ID NO: 5347749 - DNA, 13 bp, Homo sapiens
aatatttctatgt

SEQ ID NO: 5347750 - DNA, 18 bp, Homo sapiens
aatatttctatgtaaatt

SEQ ID NO: 5347751 - DNA, 13 bp, Homo sapiens
aatatttctattg

SEQ ID NO: 5347752 - DNA, 14 bp, Homo sapiens
aatatttctattga

SEQ ID NO: 5347753 - DNA, 12 bp, Homo sapiens
aatatttctgaa

SEQ ID NO: 5347754 - DNA, 20 bp, Homo sapiens
aatatttcttgctgcttcta

SEQ ID NO: 5347755 - DNA, 16 bp, Homo sapiens
aatatttcttttttca

SEQ ID NO: 5347756 - DNA, 16 bp, Homo sapiens
aatatttgaagcagct

SEQ ID NO: 5347757 - DNA, 20 bp, Homo sapiens
aatatttgaataatgacaga

SEQ ID NO: 5347758 - DNA, 14 bp, Homo sapiens
aatatttgaatctt

SEQ ID NO: 5347759 - DNA, 14 bp, Homo sapiens
aatatttgaatgta

SEQ ID NO: 5347760 - DNA, 21 bp, Homo sapiens
aatatttgaatgtatgcttca

SEQ ID NO: 5347761 - DNA, 16 bp, Homo sapiens
aatatttgaattttta

SEQ ID NO: 5347762 - DNA, 16 bp, Homo sapiens
aatatttgacttgcat

SEQ ID NO: 5347763 - DNA, 18 bp, Homo sapiens
aatatttgcacatgggat

SEQ ID NO: 5347764 - DNA, 13 bp, Homo sapiens
aatatttgcttta

SEQ ID NO: 5347765 - DNA, 15 bp, Homo sapiens
aatatttgctttata

SEQ ID NO: 5347766 - DNA, 19 bp, Homo sapiens
aatatttgtcgatatttcc

SEQ ID NO: 5347767 - DNA, 21 bp, Homo sapiens
aatatttgtctgtgtgctact

SEQ ID NO: 5347768 - DNA, 13 bp, Homo sapiens
aatatttgtgaaa

SEQ ID NO: 5347769 - DNA, 19 bp, Homo sapiens
aatatttgtgaaagtgcca

SEQ ID NO: 5347770 - DNA, 17 bp, Homo sapiens
aatatttgtgtgctaaa

SEQ ID NO: 5347771 - DNA, 23 bp, Homo sapiens
aatatttgttctggtttagtgtt

SEQ ID NO: 5347772 - DNA, 16 bp, Homo sapiens
aatattttaaagaatt

SEQ ID NO: 5347773 - DNA, 14 bp, Homo sapiens
aatattttaagaaa

SEQ ID NO: 5347774 - DNA, 23 bp, Homo sapiens
aatattttaagcattactcttgt

SEQ ID NO: 5347775 - DNA, 17 bp, Homo sapiens
aatattttaagtattgc

SEQ ID NO: 5347776 - DNA, 18 bp, Homo sapiens
aatattttaagtattgca

SEQ ID NO: 5347777 - DNA, 15 bp, Homo sapiens
aatattttagaagct

SEQ ID NO: 5347778 - DNA, 17 bp, Homo sapiens
aatattttagccttaaa

SEQ ID NO: 5347779 - DNA, 22 bp, Homo sapiens
aatattttagccttaaattttt

SEQ ID NO: 5347780 - DNA, 21 bp, Homo sapiens
aatattttaggaaactctcca

SEQ ID NO: 5347781 - DNA, 16 bp, Homo sapiens
aatattttatatgaaa

SEQ ID NO: 5347782 - DNA, 23 bp, Homo sapiens
aatattttatatgaaatgtttca

SEQ ID NO: 5347783 - DNA, 15 bp, Homo sapiens
aatattttatcctgt

SEQ ID NO: 5347784 - DNA, 16 bp, Homo sapiens
aatattttatcctgta

SEQ ID NO: 5347785 - DNA, 19 bp, Homo sapiens
aatattttatcctgtattc

SEQ ID NO: 5347786 - DNA, 14 bp, Homo sapiens
aatattttatcttt

SEQ ID NO: 5347787 - DNA, 17 bp, Homo sapiens
aatattttatctttcct

SEQ ID NO: 5347788 - DNA, 16 bp, Homo sapiens
aatattttatctttta

SEQ ID NO: 5347789 - DNA, 16 bp, Homo sapiens
aatattttatgtgtaa

SEQ ID NO: 5347790 - DNA, 16 bp, Homo sapiens
aatattttatttgaaa

SEQ ID NO: 5347791 - DNA, 17 bp, Homo sapiens
aatattttatttgaaaa

SEQ ID NO: 5347792 - DNA, 21 bp, Homo sapiens
aatattttcaactatgtaggt

SEQ ID NO: 5347793 - DNA, 13 bp, Homo sapiens
aatattttcaaga

SEQ ID NO: 5347794 - DNA, 20 bp, Homo sapiens
aatattttcaagtttttcat

SEQ ID NO: 5347795 - DNA, 21 bp, Homo sapiens
aatattttccatgaaaatgca

SEQ ID NO: 5347796 - DNA, 12 bp, Homo sapiens
aatattttcctc

SEQ ID NO: 5347797 - DNA, 16 bp, Homo sapiens
aatattttctacttta

SEQ ID NO: 5347798 - DNA, 21 bp, Homo sapiens
aatattttctactttaaattg

SEQ ID NO: 5347799 - DNA, 23 bp, Homo sapiens
aatattttctctgtacttttcat

SEQ ID NO: 5347800 - DNA, 16 bp, Homo sapiens
aatattttctgtgtgt

SEQ ID NO: 5347801 - DNA, 18 bp, Homo sapiens
aatattttctgtgtgttc

SEQ ID NO: 5347802 - DNA, 19 bp, Homo sapiens
aatattttcttaattatgg

SEQ ID NO: 5347803 - DNA, 22 bp, Homo sapiens
aatattttcttccttctcagca

SEQ ID NO: 5347804 - DNA, 23 bp, Homo sapiens
aatattttcttccttctcagcac

SEQ ID NO: 5347805 - DNA, 21 bp, Homo sapiens
aatattttctttaatgctttt

SEQ ID NO: 5347806 - DNA, 14 bp, Homo sapiens
aatattttgaatca

SEQ ID NO: 5347807 - DNA, 15 bp, Homo sapiens
aatattttgaatcaa

SEQ ID NO: 5347808 - DNA, 18 bp, Homo sapiens
aatattttgaatcaataa

SEQ ID NO: 5347809 - DNA, 15 bp, Homo sapiens
aatattttgataata

SEQ ID NO: 5347810 - DNA, 18 bp, Homo sapiens
aatattttgataataata

SEQ ID NO: 5347811 - DNA, 21 bp, Homo sapiens
aatattttgatcttcaacaaa

SEQ ID NO: 5347812 - DNA, 12 bp, Homo sapiens
aatattttgcta

SEQ ID NO: 5347813 - DNA, 21 bp, Homo sapiens
aatattttgctaactggttaa

SEQ ID NO: 5347814 - DNA, 10 bp, Homo sapiens
aatattttgg

SEQ ID NO: 5347815 - DNA, 16 bp, Homo sapiens
aatattttggaaactg

SEQ ID NO: 5347816 - DNA, 10 bp, Homo sapiens
aatattttgt

SEQ ID NO: 5347817 - DNA, 13 bp, Homo sapiens
aatattttgtaat

SEQ ID NO: 5347818 - DNA, 22 bp, Homo sapiens
aatattttgtaatattctgttt

SEQ ID NO: 5347819 - DNA, 12 bp, Homo sapiens
aatattttgtat

SEQ ID NO: 5347820 - DNA, 13 bp, Homo sapiens
aatattttgtcac

SEQ ID NO: 5347821 - DNA, 21 bp, Homo sapiens
aatattttgtctaaaatgcct

SEQ ID NO: 5347822 - DNA, 18 bp, Homo sapiens
aatatttttagactattt

SEQ ID NO: 5347823 - DNA, 22 bp, Homo sapiens
aatatttttagctctgttcttt

SEQ ID NO: 5347824 - DNA, 15 bp, Homo sapiens
aatatttttatatca

SEQ ID NO: 5347825 - DNA, 19 bp, Homo sapiens
aatatttttatatttcctt

SEQ ID NO: 5347826 - DNA, 22 bp, Homo sapiens
aatatttttatatttcctttat

SEQ ID NO: 5347827 - DNA, 13 bp, Homo sapiens
aatatttttatgt

SEQ ID NO: 5347828 - DNA, 18 bp, Homo sapiens
aatatttttcaaaatcaa

SEQ ID NO: 5347829 - DNA, 13 bp, Homo sapiens
aatatttttcaac

SEQ ID NO: 5347830 - DNA, 15 bp, Homo sapiens
aatatttttccctcc

SEQ ID NO: 5347831 - DNA, 22 bp, Homo sapiens
aatatttttccctccgggcagg

SEQ ID NO: 5347832 - DNA, 19 bp, Homo sapiens
aatatttttggcattcctc

SEQ ID NO: 5347833 - DNA, 20 bp, Homo sapiens
aatatttttggcattcctct

SEQ ID NO: 5347834 - DNA, 22 bp, Homo sapiens
aatatttttggggcatcctgga

SEQ ID NO: 5347835 - DNA, 20 bp, Homo sapiens
aatatttttgtattttacat

SEQ ID NO: 5347836 - DNA, 21 bp, Homo sapiens
aatattttttatatatacagt

SEQ ID NO: 5347837 - DNA, 20 bp, Homo sapiens
aatattttttatttctaagt

SEQ ID NO: 5347838 - DNA, 14 bp, Homo sapiens
aatattttttctgt

SEQ ID NO: 5347839 - DNA, 22 bp, Homo sapiens
aatattttttgaggctaaagaa

SEQ ID NO: 5347840 - DNA, 14 bp, Homo sapiens
aatattttttgcaa

SEQ ID NO: 5347841 - DNA, 15 bp, Homo sapiens
aatattttttgcaag

SEQ ID NO: 5347842 - DNA, 20 bp, Homo sapiens
aatattttttgctctaatct

SEQ ID NO: 5347843 - DNA, 22 bp, Homo sapiens
aatattttttgctctaatctct

SEQ ID NO: 5347844 - DNA, 14 bp, Homo sapiens
aatatttttttaac

SEQ ID NO: 5347845 - DNA, 18 bp, Homo sapiens
aatatttttttcctttgc

SEQ ID NO: 5347846 - DNA, 19 bp, Homo sapiens
aatatttttttcctttgca

SEQ ID NO: 5347847 - DNA, 23 bp, Homo sapiens
aatatttttttcctttgcattca

SEQ ID NO: 5347848 - DNA, 15 bp, Homo sapiens
aatatttttttctag

SEQ ID NO: 5347849 - DNA, 18 bp, Homo sapiens
aatatttttttctagcta

SEQ ID NO: 5347850 - DNA, 14 bp, Homo sapiens
aatcaaaacacact

SEQ ID NO: 5347851 - DNA, 20 bp, Homo sapiens
aatcaaaaccagtgaacttt

SEQ ID NO: 5347852 - DNA, 10 bp, Homo sapiens
aatcaaaact

SEQ ID NO: 5347853 - DNA, 16 bp, Homo sapiens
aatcaaaagctgcttg

SEQ ID NO: 5347854 - DNA, 19 bp, Homo sapiens
aatcaaaaggcactgtgaa

SEQ ID NO: 5347855 - DNA, 23 bp, Homo sapiens
aatcaaaagggccaaagaaccaa

SEQ ID NO: 5347856 - DNA, 13 bp, Homo sapiens
aatcaaaatatgt

SEQ ID NO: 5347857 - DNA, 16 bp, Homo sapiens
aatcaaaatctctcca

SEQ ID NO: 5347858 - DNA, 13 bp, Homo sapiens
aatcaaaattgtc

SEQ ID NO: 5347859 - DNA, 20 bp, Homo sapiens
aatcaaacaaccttcagctt

SEQ ID NO: 5347860 - DNA, 21 bp, Homo sapiens
aatcaaacacaacacaagaaa

SEQ ID NO: 5347861 - DNA, 13 bp, Homo sapiens
aatcaaacatttt

SEQ ID NO: 5347862 - DNA, 13 bp, Homo sapiens
aatcaaaccaaag

SEQ ID NO: 5347863 - DNA, 14 bp, Homo sapiens
aatcaaaccaaaga

SEQ ID NO: 5347864 - DNA, 14 bp, Homo sapiens
aatcaaactctggt

SEQ ID NO: 5347865 - DNA, 13 bp, Homo sapiens
aatcaaactgctt

SEQ ID NO: 5347866 - DNA, 14 bp, Homo sapiens
aatcaaactttaca

SEQ ID NO: 5347867 - DNA, 13 bp, Homo sapiens
aatcaaagaaaag

SEQ ID NO: 5347868 - DNA, 14 bp, Homo sapiens
aatcaaagaaaaga

SEQ ID NO: 5347869 - DNA, 16 bp, Homo sapiens
aatcaaagaacagatg

SEQ ID NO: 5347870 - DNA, 14 bp, Homo sapiens
aatcaaagaattac

SEQ ID NO: 5347871 - DNA, 15 bp, Homo sapiens
aatcaaagacatttc

SEQ ID NO: 5347872 - DNA, 17 bp, Homo sapiens
aatcaaagacatttcat

SEQ ID NO: 5347873 - DNA, 18 bp, Homo sapiens
aatcaaagcaatgcattt

SEQ ID NO: 5347874 - DNA, 17 bp, Homo sapiens
aatcaaagccagggtct

SEQ ID NO: 5347875 - DNA, 13 bp, Homo sapiens
aatcaaatatatt

SEQ ID NO: 5347876 - DNA, 16 bp, Homo sapiens
aatcaaatatattatt

SEQ ID NO: 5347877 - DNA, 15 bp, Homo sapiens
aatcaaatatgcaaa

SEQ ID NO: 5347878 - DNA, 16 bp, Homo sapiens
aatcaaatatgcaaag

SEQ ID NO: 5347879 - DNA, 14 bp, Homo sapiens
aatcaaatatgtgg

SEQ ID NO: 5347880 - DNA, 22 bp, Homo sapiens
aatcaaatcatgtacatttgaa

SEQ ID NO: 5347881 - DNA, 18 bp, Homo sapiens
aatcaaatctcctgctga

SEQ ID NO: 5347882 - DNA, 23 bp, Homo sapiens
aatcaaatctggtattgaactgc

SEQ ID NO: 5347883 - DNA, 21 bp, Homo sapiens
aatcaaatgaatgattaaatt

SEQ ID NO: 5347884 - DNA, 22 bp, Homo sapiens
aatcaaatgaatgattaaatta

SEQ ID NO: 5347885 - DNA, 13 bp, Homo sapiens
aatcaaatgattt

SEQ ID NO: 5347886 - DNA, 14 bp, Homo sapiens
aatcaaatgatttc

SEQ ID NO: 5347887 - DNA, 18 bp, Homo sapiens
aatcaaatgatttcatat

SEQ ID NO: 5347888 - DNA, 21 bp, Homo sapiens
aatcaaatgatttcatattga

SEQ ID NO: 5347889 - DNA, 13 bp, Homo sapiens
aatcaaatgtaaa

SEQ ID NO: 5347890 - DNA, 15 bp, Homo sapiens
aatcaaatgtaaagt

SEQ ID NO: 5347891 - DNA, 16 bp, Homo sapiens
aatcaaatgtaaatca

SEQ ID NO: 5347892 - DNA, 18 bp, Homo sapiens
aatcaaatgtatgtatca

SEQ ID NO: 5347893 - DNA, 13 bp, Homo sapiens
aatcaaattctgt

SEQ ID NO: 5347894 - DNA, 14 bp, Homo sapiens
aatcaaattgctta

SEQ ID NO: 5347895 - DNA, 22 bp, Homo sapiens
aatcaacaccaccgagctctgt

SEQ ID NO: 5347896 - DNA, 23 bp, Homo sapiens
aatcaacaccaccgagctctgtg

SEQ ID NO: 5347897 - DNA, 16 bp, Homo sapiens
aatcaacagaagcatt

SEQ ID NO: 5347898 - DNA, 15 bp, Homo sapiens
aatcaacagatgata

SEQ ID NO: 5347899 - DNA, 17 bp, Homo sapiens
aatcaacagcagtgagt

SEQ ID NO: 5347900 - DNA, 19 bp, Homo sapiens
aatcaacagtgaacagctt

SEQ ID NO: 5347901 - DNA, 17 bp, Homo sapiens
aatcaaccaaagttagt

SEQ ID NO: 5347902 - DNA, 23 bp, Homo sapiens
aatcaaccccagactcaaactca

SEQ ID NO: 5347903 - DNA, 19 bp, Homo sapiens
aatcaactgggctgaacac

SEQ ID NO: 5347904 - DNA, 13 bp, Homo sapiens
aatcaacttgctt

SEQ ID NO: 5347905 - DNA, 15 bp, Homo sapiens
aatcaacttgcttat

SEQ ID NO: 5347906 - DNA, 13 bp, Homo sapiens
aatcaacttgtca

SEQ ID NO: 5347907 - DNA, 13 bp, Homo sapiens
aatcaactttact

SEQ ID NO: 5347908 - DNA, 14 bp, Homo sapiens
aatcaactttactg

SEQ ID NO: 5347909 - DNA, 13 bp, Homo sapiens
aatcaacttttta

SEQ ID NO: 5347910 - DNA, 24 bp, Homo sapiens
aatcaagaaaagaattacagactc

SEQ ID NO: 5347911 - DNA, 22 bp, Homo sapiens
aatcatgtccatcccttttcct

SEQ ID NO: 5347912 - DNA, 13 bp, Homo sapiens
aatcatgtctgta

SEQ ID NO: 5347913 - DNA, 15 bp, Homo sapiens
aatcatgtctgtatc

SEQ ID NO: 5347914 - DNA, 16 bp, Homo sapiens
aatcatgtgaacccgg

SEQ ID NO: 5347915 - DNA, 23 bp, Homo sapiens
aatcatgtgggtgagccagtgga

SEQ ID NO: 5347916 - DNA, 20 bp, Homo sapiens
aatcatgtgtttaaattatt

SEQ ID NO: 5347917 - DNA, 22 bp, Homo sapiens
aatcatgttatgataaaaaatt

SEQ ID NO: 5347918 - DNA, 21 bp, Homo sapiens
aatcatgttctggtggtttga

SEQ ID NO: 5347919 - DNA, 23 bp, Homo sapiens
aatcatgttgatcatgtactttt

SEQ ID NO: 5347920 - DNA, 18 bp, Homo sapiens
aatcatgtttctttgatc

SEQ ID NO: 5347921 - DNA, 23 bp, Homo sapiens
aatcatgttttgatgagaaaaaa

SEQ ID NO: 5347922 - DNA, 20 bp, Homo sapiens
aatcatgttttttctgcaat

SEQ ID NO: 5347923 - DNA, 20 bp, Homo sapiens
aatcattaatttcaaaattt

SEQ ID NO: 5347924 - DNA, 15 bp, Homo sapiens
aatcattaggtgtga

SEQ ID NO: 5347925 - DNA, 20 bp, Homo sapiens
aatcattagttttagaggca

SEQ ID NO: 5347926 - DNA, 20 bp, Homo sapiens
aatcattatctcactttgta

SEQ ID NO: 5347927 - DNA, 12 bp, Homo sapiens
aatcattattta

SEQ ID NO: 5347928 - DNA, 19 bp, Homo sapiens
aatcattatttattaaatt

SEQ ID NO: 5347929 - DNA, 13 bp, Homo sapiens
aatcattcagaaa

SEQ ID NO: 5347930 - DNA, 15 bp, Homo sapiens
aatcattcagaaatg

SEQ ID NO: 5347931 - DNA, 19 bp, Homo sapiens
aatcattcagaaatgttga

SEQ ID NO: 5347932 - DNA, 23 bp, Homo sapiens
aatcattcagaaatgttgagtct

SEQ ID NO: 5347933 - DNA, 18 bp, Homo sapiens
aatcattccagtgctaga

SEQ ID NO: 5347934 - DNA, 20 bp, Homo sapiens
aatcattccagtgctagaaa

SEQ ID NO: 5347935 - DNA, 15 bp, Homo sapiens
aatcattctgtaaag

SEQ ID NO: 5347936 - DNA, 16 bp, Homo sapiens
aatcattctttcccct

SEQ ID NO: 5347937 - DNA, 22 bp, Homo sapiens
aatcattgcaaacaactgaaat

SEQ ID NO: 5347938 - DNA, 12 bp, Homo sapiens
aatcattgctta

SEQ ID NO: 5347939 - DNA, 19 bp, Homo sapiens
aatcattgctttgaagcag

SEQ ID NO: 5347940 - DNA, 22 bp, Homo sapiens
aatcattgctttgaagcagttg

SEQ ID NO: 5347941 - DNA, 21 bp, Homo sapiens
aatcattggcctggcaaaata

SEQ ID NO: 5347942 - DNA, 23 bp, Homo sapiens
aatcattggcctggcaaaataaa

SEQ ID NO: 5347943 - DNA, 12 bp, Homo sapiens
aatcattgtaca

SEQ ID NO: 5347944 - DNA, 18 bp, Homo sapiens
aatcattgtacagtttgt

SEQ ID NO: 5347945 - DNA, 21 bp, Homo sapiens
aatcattgtcagagatgtttt

SEQ ID NO: 5347946 - DNA, 19 bp, Homo sapiens
aatcattgtgcttaataat

SEQ ID NO: 5347947 - DNA, 16 bp, Homo sapiens
aatcattgtgtgtctt

SEQ ID NO: 5347948 - DNA, 17 bp, Homo sapiens
aatcattgtgtgtcttc

SEQ ID NO: 5347949 - DNA, 14 bp, Homo sapiens
aatcattgttttga

SEQ ID NO: 5347950 - DNA, 16 bp, Homo sapiens
aatcattgttttgaat

SEQ ID NO: 5347951 - DNA, 22 bp, Homo sapiens
aatcattgttttgaatattact

SEQ ID NO: 5347952 - DNA, 16 bp, Homo sapiens
aatcatttagatgcac

SEQ ID NO: 5347953 - DNA, 14 bp, Homo sapiens
aatcatttattcat

SEQ ID NO: 5347954 - DNA, 20 bp, Homo sapiens
aatcatttccccataactca

SEQ ID NO: 5347955 - DNA, 13 bp, Homo sapiens
aatcatttgagat

SEQ ID NO: 5347956 - DNA, 13 bp, Homo sapiens
aatcatttggtta

SEQ ID NO: 5347957 - DNA, 15 bp, Homo sapiens
aatcatttgtttaaa

SEQ ID NO: 5347958 - DNA, 22 bp, Homo sapiens
aatcatttgtttacatttgatg

SEQ ID NO: 5347959 - DNA, 11 bp, Homo sapiens
aatcattttaa

SEQ ID NO: 5347960 - DNA, 13 bp, Homo sapiens
aatcattttaaga

SEQ ID NO: 5347961 - DNA, 19 bp, Homo sapiens
aatcattttaattattatt

SEQ ID NO: 5347962 - DNA, 21 bp, Homo sapiens
aatcattttagaattaaaatt

SEQ ID NO: 5347963 - DNA, 17 bp, Homo sapiens
aatcattttaggaaagg

SEQ ID NO: 5347964 - DNA, 20 bp, Homo sapiens
aatcattttatatgtcaaag

SEQ ID NO: 5347965 - DNA, 21 bp, Homo sapiens
aatcattttatgctgtttatg

SEQ ID NO: 5347966 - DNA, 22 bp, Homo sapiens
aatcattttatggcacctattt

SEQ ID NO: 5347967 - DNA, 14 bp, Homo sapiens
aatcattttcatta

SEQ ID NO: 5347968 - DNA, 15 bp, Homo sapiens
aatcattttcattaa

SEQ ID NO: 5347969 - DNA, 13 bp, Homo sapiens
aatcattttgcaa

SEQ ID NO: 5347970 - DNA, 23 bp, Homo sapiens
aatcattttttatatatatgcat

SEQ ID NO: 5347971 - DNA, 24 bp, Homo sapiens
aatcattttttatatatatgcata

SEQ ID NO: 5347972 - DNA, 19 bp, Homo sapiens
aatccaaaaagctctgaaa

SEQ ID NO: 5347973 - DNA, 20 bp, Homo sapiens
aatccaaaaagctctgaaaa

SEQ ID NO: 5347974 - DNA, 13 bp, Homo sapiens
aatccaaacccac

SEQ ID NO: 5347975 - DNA, 19 bp, Homo sapiens
aatccaaacccactcttca

SEQ ID NO: 5347976 - DNA, 17 bp, Homo sapiens
aatccaaactgctgtct

SEQ ID NO: 5347977 - DNA, 19 bp, Homo sapiens
aatccaaactgctgtctct

SEQ ID NO: 5347978 - DNA, 16 bp, Homo sapiens
aatccaaatctgtcct

SEQ ID NO: 5347979 - DNA, 16 bp, Homo sapiens
aatccaaatgtgaaag

SEQ ID NO: 5347980 - DNA, 13 bp, Homo sapiens
aatccaaatttct

SEQ ID NO: 5347981 - DNA, 14 bp, Homo sapiens
aatccaacacaagt

SEQ ID NO: 5347982 - DNA, 14 bp, Homo sapiens
aatccaactccagg

SEQ ID NO: 5347983 - DNA, 13 bp, Homo sapiens
aatccaactgtca

SEQ ID NO: 5347984 - DNA, 19 bp, Homo sapiens
aatccaactttcacagtga

SEQ ID NO: 5347985 - DNA, 22 bp, Homo sapiens
aatccaagacaaactaaacttt

SEQ ID NO: 5347986 - DNA, 15 bp, Homo sapiens
aatccaagactgtca

SEQ ID NO: 5347987 - DNA, 17 bp, Homo sapiens
aatccaagcaaatgtga

SEQ ID NO: 5347988 - DNA, 18 bp, Homo sapiens
aatccaagcaaatgtgaa

SEQ ID NO: 5347989 - DNA, 18 bp, Homo sapiens
aatccaagctccctgccc

SEQ ID NO: 5347990 - DNA, 22 bp, Homo sapiens
aatccaagctccctgccccaaa

SEQ ID NO: 5347991 - DNA, 15 bp, Homo sapiens
aatccaatacctctt

SEQ ID NO: 5347992 - DNA, 18 bp, Homo sapiens
aatccaatactgcccaag

SEQ ID NO: 5347993 - DNA, 15 bp, Homo sapiens
aatccaatagtctgc

SEQ ID NO: 5347994 - DNA, 23 bp, Homo sapiens
aatccaatcagagaccaggccct

SEQ ID NO: 5347995 - DNA, 20 bp, Homo sapiens
aatccaatctgtaatttcac

SEQ ID NO: 5347996 - DNA, 14 bp, Homo sapiens
aatccaatgcactg

SEQ ID NO: 5347997 - DNA, 16 bp, Homo sapiens
aatccacaaatatgct

SEQ ID NO: 5347998 - DNA, 18 bp, Homo sapiens
aatccacaatctgacatt

SEQ ID NO: 5347999 - DNA, 19 bp, Homo sapiens
aatccacaatgagatgcat

SEQ ID NO: 5348000 - DNA, 15 bp, Homo sapiens
aatccacagtattgt

SEQ ID NO: 5348001 - DNA, 16 bp, Homo sapiens
aatccacataaaagaa

SEQ ID NO: 5348002 - DNA, 21 bp, Homo sapiens
aatccacatctttactcaggc

SEQ ID NO: 5348003 - DNA, 18 bp, Homo sapiens
aatccacatgtttcagag

SEQ ID NO: 5348004 - DNA, 15 bp, Homo sapiens
aatccacatttctaa

SEQ ID NO: 5348005 - DNA, 12 bp, Homo sapiens
aatccaccccca

SEQ ID NO: 5348006 - DNA, 14 bp, Homo sapiens
aatccacccccagg

SEQ ID NO: 5348007 - DNA, 20 bp, Homo sapiens
aatccacctcggagcatggt

SEQ ID NO: 5348008 - DNA, 14 bp, Homo sapiens
aatccacctggtgg

SEQ ID NO: 5348009 - DNA, 15 bp, Homo sapiens
aatccactaacactt

SEQ ID NO: 5348010 - DNA, 17 bp, Homo sapiens
aatccactcccaggcag

SEQ ID NO: 5348011 - DNA, 19 bp, Homo sapiens
aatccagaaacttgttctt

SEQ ID NO: 5348012 - DNA, 15 bp, Homo sapiens
aatccagaaggaagc

SEQ ID NO: 5348013 - DNA, 23 bp, Homo sapiens
aatccagaagttttaacttccag

SEQ ID NO: 5348014 - DNA, 16 bp, Homo sapiens
aatccagagagcttaa

SEQ ID NO: 5348015 - DNA, 13 bp, Homo sapiens
aatccagaggaac

SEQ ID NO: 5348016 - DNA, 19 bp, Homo sapiens
aatccagaggaacaagcat

SEQ ID NO: 5348017 - DNA, 21 bp, Homo sapiens
aatccagatggtgggatgtgg

SEQ ID NO: 5348018 - DNA, 18 bp, Homo sapiens
aatccagccccatagaaa

SEQ ID NO: 5348019 - DNA, 12 bp, Homo sapiens
aatccagccttc

SEQ ID NO: 5348020 - DNA, 16 bp, Homo sapiens
aatccagcggttctca

SEQ ID NO: 5348021 - DNA, 22 bp, Homo sapiens
aatccagctccctagactgcat

SEQ ID NO: 5348022 - DNA, 23 bp, Homo sapiens
aatccaggaccctgccaggcaca

SEQ ID NO: 5348023 - DNA, 16 bp, Homo sapiens
aatccaggactttgtt

SEQ ID NO: 5348024 - DNA, 17 bp, Homo sapiens
aatccaggcacagctga

SEQ ID NO: 5348025 - DNA, 18 bp, Homo sapiens
aatccaggcacagctgag

SEQ ID NO: 5348026 - DNA, 21 bp, Homo sapiens
aatccaggcagatccaggact

SEQ ID NO: 5348027 - DNA, 17 bp, Homo sapiens
aatccaggccaaagccc

SEQ ID NO: 5348028 - DNA, 13 bp, Homo sapiens
aatccaggctgtt

SEQ ID NO: 5348029 - DNA, 16 bp, Homo sapiens
aatccaggctgttctc

SEQ ID NO: 5348030 - DNA, 20 bp, Homo sapiens
aatccaggctgttctcagcg

SEQ ID NO: 5348031 - DNA, 19 bp, Homo sapiens
aatccaggtaactttgaag

SEQ ID NO: 5348032 - DNA, 19 bp, Homo sapiens
aatccaggtacgcacagac

SEQ ID NO: 5348033 - DNA, 22 bp, Homo sapiens
aatccaggtacgcacagacagg

SEQ ID NO: 5348034 - DNA, 19 bp, Homo sapiens
aatccaggtgggagagaca

SEQ ID NO: 5348035 - DNA, 21 bp, Homo sapiens
aatccaggtgggagagacact

SEQ ID NO: 5348036 - DNA, 14 bp, Homo sapiens
aatccagtattatc

SEQ ID NO: 5348037 - DNA, 21 bp, Homo sapiens
aatccagtattgctgatttta

SEQ ID NO: 5348038 - DNA, 19 bp, Homo sapiens
aatccagtggggaaaaaaa

SEQ ID NO: 5348039 - DNA, 16 bp, Homo sapiens
aatccagttataagaa

SEQ ID NO: 5348040 - DNA, 19 bp, Homo sapiens
aatccagttataagaagaa

SEQ ID NO: 5348041 - DNA, 20 bp, Homo sapiens
aatccataaactaagagaaa

SEQ ID NO: 5348042 - DNA, 14 bp, Homo sapiens
aatccataaatgtg

SEQ ID NO: 5348043 - DNA, 18 bp, Homo sapiens
aatccataaatgtgttcc

SEQ ID NO: 5348044 - DNA, 14 bp, Homo sapiens
aatccatacatttg

SEQ ID NO: 5348045 - DNA, 16 bp, Homo sapiens
aatccatacatttgtg

SEQ ID NO: 5348046 - DNA, 17 bp, Homo sapiens
aatccatacatttgtgt

SEQ ID NO: 5348047 - DNA, 21 bp, Homo sapiens
aatccatagatttattttaca

SEQ ID NO: 5348048 - DNA, 13 bp, Homo sapiens
aatccatatctta

SEQ ID NO: 5348049 - DNA, 17 bp, Homo sapiens
aatccatatttcaacag

SEQ ID NO: 5348050 - DNA, 12 bp, Homo sapiens
aatccatcagca

SEQ ID NO: 5348051 - DNA, 19 bp, Homo sapiens
aatccatcagtgccaaact

SEQ ID NO: 5348052 - DNA, 22 bp, Homo sapiens
aatccatcctgcaaaggccctt

SEQ ID NO: 5348053 - DNA, 14 bp, Homo sapiens
aatccatcttgctt

SEQ ID NO: 5348054 - DNA, 19 bp, Homo sapiens
aatccatcttgctttttcc

SEQ ID NO: 5348055 - DNA, 13 bp, Homo sapiens
aatccatgatcaa

SEQ ID NO: 5348056 - DNA, 12 bp, Homo sapiens
aatccatgtaag

SEQ ID NO: 5348057 - DNA, 16 bp, Homo sapiens
aatccatgtatctgta

SEQ ID NO: 5348058 - DNA, 18 bp, Homo sapiens
aatccatgtgaccattct

SEQ ID NO: 5348059 - DNA, 23 bp, Homo sapiens
aatccatgtgattaatgttttca

SEQ ID NO: 5348060 - DNA, 15 bp, Homo sapiens
aatccatgtgtcccc

SEQ ID NO: 5348061 - DNA, 18 bp, Homo sapiens
aatccattatcctttatt

SEQ ID NO: 5348062 - DNA, 14 bp, Homo sapiens
aatccattccaaaa

SEQ ID NO: 5348063 - DNA, 13 bp, Homo sapiens
aatccattccagg

SEQ ID NO: 5348064 - DNA, 19 bp, Homo sapiens
aatccattgtttaaagatg

SEQ ID NO: 5348065 - DNA, 14 bp, Homo sapiens
aatccatttaatca

SEQ ID NO: 5348066 - DNA, 18 bp, Homo sapiens
aatccatttcaggactct

SEQ ID NO: 5348067 - DNA, 23 bp, Homo sapiens
aatccatttggcagaactgctgg

SEQ ID NO: 5348068 - DNA, 18 bp, Homo sapiens
aatccattttctaaactg

SEQ ID NO: 5348069 - DNA, 22 bp, Homo sapiens
aatccatttttaaggctgtgtg

SEQ ID NO: 5348070 - DNA, 21 bp, Homo sapiens
aatcccaaagtgccttctgag

SEQ ID NO: 5348071 - DNA, 11 bp, Homo sapiens
aatcccaaatt

SEQ ID NO: 5348072 - DNA, 20 bp, Homo sapiens
aatcccaatctttctatata

SEQ ID NO: 5348073 - DNA, 16 bp, Homo sapiens
aatcccaccaaatcat

SEQ ID NO: 5348074 - DNA, 13 bp, Homo sapiens
aatcccaccaccc

SEQ ID NO: 5348075 - DNA, 16 bp, Homo sapiens
aatcccacccacctca

SEQ ID NO: 5348076 - DNA, 17 bp, Homo sapiens
aatcccacctagcccag

SEQ ID NO: 5348077 - DNA, 18 bp, Homo sapiens
aatcccacctagcccagg

SEQ ID NO: 5348078 - DNA, 21 bp, Homo sapiens
aatcccacctagcccaggaga

SEQ ID NO: 5348079 - DNA, 15 bp, Homo sapiens
aatcccaccttccca

SEQ ID NO: 5348080 - DNA, 16 bp, Homo sapiens
aatcccaccttcccac

SEQ ID NO: 5348081 - DNA, 19 bp, Homo sapiens
aatcccacttatcaaatca

SEQ ID NO: 5348082 - DNA, 15 bp, Homo sapiens
aatcccagcaatttg

SEQ ID NO: 5348083 - DNA, 23 bp, Homo sapiens
aatcccagccggccaatggaaac

SEQ ID NO: 5348084 - DNA, 14 bp, Homo sapiens
aatcccagctactg

SEQ ID NO: 5348085 - DNA, 12 bp, Homo sapiens
aatcccaggatg

SEQ ID NO: 5348086 - DNA, 17 bp, Homo sapiens
aatcccagggctggctc

SEQ ID NO: 5348087 - DNA, 14 bp, Homo sapiens
aatcccagtgactt

SEQ ID NO: 5348088 - DNA, 16 bp, Homo sapiens
aatctctctgcagctg

SEQ ID NO: 5348089 - DNA, 19 bp, Homo sapiens
aatctctctgcagctgccg

SEQ ID NO: 5348090 - DNA, 11 bp, Homo sapiens
aatctctgagc

SEQ ID NO: 5348091 - DNA, 17 bp, Homo sapiens
aatctctgattaaattt

SEQ ID NO: 5348092 - DNA, 14 bp, Homo sapiens
aatctctgcccctc

SEQ ID NO: 5348093 - DNA, 11 bp, Homo sapiens
aatctctgcct

SEQ ID NO: 5348094 - DNA, 22 bp, Homo sapiens
aatctctgcctagaatctttat

SEQ ID NO: 5348095 - DNA, 22 bp, Homo sapiens
aatctctgtcaaggtaaatgta

SEQ ID NO: 5348096 - DNA, 13 bp, Homo sapiens
aatctctgtgcct

SEQ ID NO: 5348097 - DNA, 14 bp, Homo sapiens
aatctctgttatgt

SEQ ID NO: 5348098 - DNA, 21 bp, Homo sapiens
aatctctgttatgtactgtac

SEQ ID NO: 5348099 - DNA, 23 bp, Homo sapiens
aatctcttaatattgagaatcag

SEQ ID NO: 5348100 - DNA, 18 bp, Homo sapiens
aatctcttcattattctc

SEQ ID NO: 5348101 - DNA, 13 bp, Homo sapiens
aatctcttccttc

SEQ ID NO: 5348102 - DNA, 12 bp, Homo sapiens
aatctcttctgt

SEQ ID NO: 5348103 - DNA, 19 bp, Homo sapiens
aatctcttcttatacagat

SEQ ID NO: 5348104 - DNA, 23 bp, Homo sapiens
aatctcttgattataaatgtttg

SEQ ID NO: 5348105 - DNA, 15 bp, Homo sapiens
aatctcttgcttgtc

SEQ ID NO: 5348106 - DNA, 18 bp, Homo sapiens
aatctcttgcttgtcatt

SEQ ID NO: 5348107 - DNA, 12 bp, Homo sapiens
aatctcttgtca

SEQ ID NO: 5348108 - DNA, 19 bp, Homo sapiens
aatctcttgtcattctcat

SEQ ID NO: 5348109 - DNA, 21 bp, Homo sapiens
aatctcttgtcattctcatcc

SEQ ID NO: 5348110 - DNA, 13 bp, Homo sapiens
aatctctttccat

SEQ ID NO: 5348111 - DNA, 14 bp, Homo sapiens
aatctcttttctgg

SEQ ID NO: 5348112 - DNA, 23 bp, Homo sapiens
aatctctttttaaaaaactcttt

SEQ ID NO: 5348113 - DNA, 22 bp, Homo sapiens
aatctcttttttcaactggctg

SEQ ID NO: 5348114 - DNA, 21 bp, Homo sapiens
aatctgaaaaactaaactaca

SEQ ID NO: 5348115 - DNA, 15 bp, Homo sapiens
aatctgaaacacagt

SEQ ID NO: 5348116 - DNA, 18 bp, Homo sapiens
aatctgaaacacagtcat

SEQ ID NO: 5348117 - DNA, 17 bp, Homo sapiens
aatctgaaagacttgaa

SEQ ID NO: 5348118 - DNA, 12 bp, Homo sapiens
aatctgaactct

SEQ ID NO: 5348119 - DNA, 14 bp, Homo sapiens
aatctgaactctca

SEQ ID NO: 5348120 - DNA, 12 bp, Homo sapiens
aatctgaagaaa

SEQ ID NO: 5348121 - DNA, 21 bp, Homo sapiens
aatctgaagaggcttctcctg

SEQ ID NO: 5348122 - DNA, 12 bp, Homo sapiens
aatctgaagata

SEQ ID NO: 5348123 - DNA, 14 bp, Homo sapiens
aatctgaagattgt

SEQ ID NO: 5348124 - DNA, 18 bp, Homo sapiens
aatctgaagattgtttat

SEQ ID NO: 5348125 - DNA, 21 bp, Homo sapiens
aatctgaagtggttcagtcta

SEQ ID NO: 5348126 - DNA, 14 bp, Homo sapiens
aatctgaattttaa

SEQ ID NO: 5348127 - DNA, 18 bp, Homo sapiens
aatctgaattttgcaatg

SEQ ID NO: 5348128 - DNA, 23 bp, Homo sapiens
aatctgaattttgcaatgtattt

SEQ ID NO: 5348129 - DNA, 23 bp, Homo sapiens
aatctgacaaagtcatgaagctc

SEQ ID NO: 5348130 - DNA, 13 bp, Homo sapiens
aatctgaccacag

SEQ ID NO: 5348131 - DNA, 16 bp, Homo sapiens
aatctgaccacagaca

SEQ ID NO: 5348132 - DNA, 12 bp, Homo sapiens
aatctgacccag

SEQ ID NO: 5348133 - DNA, 14 bp, Homo sapiens
aatctgacccagtg

SEQ ID NO: 5348134 - DNA, 23 bp, Homo sapiens
aatctgacctaaaagttgaaaag

SEQ ID NO: 5348135 - DNA, 16 bp, Homo sapiens
aatctgacttctcact

SEQ ID NO: 5348136 - DNA, 18 bp, Homo sapiens
aatctgagcaaacaccag

SEQ ID NO: 5348137 - DNA, 22 bp, Homo sapiens
aatctgagcaggtacatttctg

SEQ ID NO: 5348138 - DNA, 20 bp, Homo sapiens
aatctgagcctaaatctaat

SEQ ID NO: 5348139 - DNA, 13 bp, Homo sapiens
aatctgagcctta

SEQ ID NO: 5348140 - DNA, 19 bp, Homo sapiens
aatctgagctgcagcctgg

SEQ ID NO: 5348141 - DNA, 23 bp, Homo sapiens
aatctgaggaatggacatttcta

SEQ ID NO: 5348142 - DNA, 21 bp, Homo sapiens
aatctgaggcatcctctgact

SEQ ID NO: 5348143 - DNA, 19 bp, Homo sapiens
aatctgagggaaatgtttt

SEQ ID NO: 5348144 - DNA, 20 bp, Homo sapiens
aatctgagggaaatgttttg

SEQ ID NO: 5348145 - DNA, 21 bp, Homo sapiens
aatctgagggcactctctgcc

SEQ ID NO: 5348146 - DNA, 19 bp, Homo sapiens
aatctgagggttaatttct

SEQ ID NO: 5348147 - DNA, 15 bp, Homo sapiens
aatctgataggaaaa

SEQ ID NO: 5348148 - DNA, 19 bp, Homo sapiens
aatctgatcccataaagaa

SEQ ID NO: 5348149 - DNA, 15 bp, Homo sapiens
aatctgatctgagtg

SEQ ID NO: 5348150 - DNA, 13 bp, Homo sapiens
aatctgatgcctt

SEQ ID NO: 5348151 - DNA, 19 bp, Homo sapiens
aatctgatggccttaattt

SEQ ID NO: 5348152 - DNA, 23 bp, Homo sapiens
aatctgatggccttaatttcctt

SEQ ID NO: 5348153 - DNA, 18 bp, Homo sapiens
aatctgatgtaacaaggt

SEQ ID NO: 5348154 - DNA, 16 bp, Homo sapiens
aatctgatgtataatg

SEQ ID NO: 5348155 - DNA, 18 bp, Homo sapiens
aatctgatgtataatgta

SEQ ID NO: 5348156 - DNA, 19 bp, Homo sapiens
aatctgatgtataatgtaa

SEQ ID NO: 5348157 - DNA, 23 bp, Homo sapiens
aatctgattcagcatcactaaac

SEQ ID NO: 5348158 - DNA, 19 bp, Homo sapiens
aatctgattggacattttc

SEQ ID NO: 5348159 - DNA, 12 bp, Homo sapiens
aatctgatttaa

SEQ ID NO: 5348160 - DNA, 17 bp, Homo sapiens
aatctgattttcaaaaa

SEQ ID NO: 5348161 - DNA, 13 bp, Homo sapiens
aatctgattttta

SEQ ID NO: 5348162 - DNA, 21 bp, Homo sapiens
aatctgcaaagcatgttttgc

SEQ ID NO: 5348163 - DNA, 19 bp, Homo sapiens
aatctgcaattcaaaagtt

SEQ ID NO: 5348164 - DNA, 19 bp, Homo sapiens
aatctgcaatttctactac

SEQ ID NO: 5348165 - DNA, 12 bp, Homo sapiens
aatctgcagcca

SEQ ID NO: 5348166 - DNA, 13 bp, Homo sapiens
aatctgcagtgat

SEQ ID NO: 5348167 - DNA, 17 bp, Homo sapiens
aatctgcagtgatgcaa

SEQ ID NO: 5348168 - DNA, 16 bp, Homo sapiens
aatctgcagtttgtga

SEQ ID NO: 5348169 - DNA, 17 bp, Homo sapiens
aatctgcattattggaa

SEQ ID NO: 5348170 - DNA, 18 bp, Homo sapiens
aatctgcattattggaat

SEQ ID NO: 5348171 - DNA, 23 bp, Homo sapiens
aatctgcccaccgaccccctttc

SEQ ID NO: 5348172 - DNA, 19 bp, Homo sapiens
aatctgcctattgcagctg

SEQ ID NO: 5348173 - DNA, 18 bp, Homo sapiens
aatctgcctgtatctctc

SEQ ID NO: 5348174 - DNA, 17 bp, Homo sapiens
aatctgccttccagccc

SEQ ID NO: 5348175 - DNA, 22 bp, Homo sapiens
aatctgccttccagcccagacc

SEQ ID NO: 5348176 - DNA, 17 bp, Homo sapiens
aatctgctagaaagtta

SEQ ID NO: 5348177 - DNA, 16 bp, Homo sapiens
aatctgctcagcaggc

SEQ ID NO: 5348178 - DNA, 19 bp, Homo sapiens
aatctgctcagcaggccct

SEQ ID NO: 5348179 - DNA, 16 bp, Homo sapiens
aatctgcttcatccaa

SEQ ID NO: 5348180 - DNA, 20 bp, Homo sapiens
aatctgcttggcaatagtta

SEQ ID NO: 5348181 - DNA, 19 bp, Homo sapiens
aatctgcttgtattccaag

SEQ ID NO: 5348182 - DNA, 22 bp, Homo sapiens
aatctgctttcatccagccact

SEQ ID NO: 5348183 - DNA, 21 bp, Homo sapiens
aatctgcttttcctctgcctt

SEQ ID NO: 5348184 - DNA, 24 bp, Homo sapiens
aatctggaacgctctaggcagaag

SEQ ID NO: 5348185 - DNA, 21 bp, Homo sapiens
aatctggaaggcccctcccag

SEQ ID NO: 5348186 - DNA, 19 bp, Homo sapiens
aatctggacatttgttcca

SEQ ID NO: 5348187 - DNA, 21 bp, Homo sapiens
aatctggaccccatctgtgaa

SEQ ID NO: 5348188 - DNA, 15 bp, Homo sapiens
aatctggactcctct

SEQ ID NO: 5348189 - DNA, 16 bp, Homo sapiens
aatctggactcctctg

SEQ ID NO: 5348190 - DNA, 18 bp, Homo sapiens
aatctggactcctctgtc

SEQ ID NO: 5348191 - DNA, 22 bp, Homo sapiens
aatctggatgttaagaatgaag

SEQ ID NO: 5348192 - DNA, 18 bp, Homo sapiens
aatctggattcatattta

SEQ ID NO: 5348193 - DNA, 19 bp, Homo sapiens
aatctggattcatatttaa

SEQ ID NO: 5348194 - DNA, 16 bp, Homo sapiens
aatctggatttcacgg

SEQ ID NO: 5348195 - DNA, 19 bp, Homo sapiens
aatctggcaaagttatatt

SEQ ID NO: 5348196 - DNA, 15 bp, Homo sapiens
aatctggcccagggt

SEQ ID NO: 5348197 - DNA, 11 bp, Homo sapiens
aatctggccct

SEQ ID NO: 5348198 - DNA, 19 bp, Homo sapiens
aatctggcccttacacact

SEQ ID NO: 5348199 - DNA, 20 bp, Homo sapiens
aatctggcccttacacactc

SEQ ID NO: 5348200 - DNA, 21 bp, Homo sapiens
aatctggctcctgtttccatg

SEQ ID NO: 5348201 - DNA, 15 bp, Homo sapiens
aatctggctgtcctt

SEQ ID NO: 5348202 - DNA, 18 bp, Homo sapiens
aatctggcttagtgccac

SEQ ID NO: 5348203 - DNA, 16 bp, Homo sapiens
aatctgggaagggaag

SEQ ID NO: 5348204 - DNA, 13 bp, Homo sapiens
aatctgggaggga

SEQ ID NO: 5348205 - DNA, 14 bp, Homo sapiens
aatctgggagggaa

SEQ ID NO: 5348206 - DNA, 16 bp, Homo sapiens
aatctgggagggaagt

SEQ ID NO: 5348207 - DNA, 18 bp, Homo sapiens
aatctgggcagacattat

SEQ ID NO: 5348208 - DNA, 19 bp, Homo sapiens
aatctgggcagacattatg

SEQ ID NO: 5348209 - DNA, 18 bp, Homo sapiens
aatctgggccagaatttc

SEQ ID NO: 5348210 - DNA, 22 bp, Homo sapiens
aatctggggaagaggttttatt

SEQ ID NO: 5348211 - DNA, 14 bp, Homo sapiens
aatctgggggtgag

SEQ ID NO: 5348212 - DNA, 18 bp, Homo sapiens
aatctgggtaattaaaaa

SEQ ID NO: 5348213 - DNA, 20 bp, Homo sapiens
aatctggtattgaactgcag

SEQ ID NO: 5348214 - DNA, 16 bp, Homo sapiens
aatctggtccatattt

SEQ ID NO: 5348215 - DNA, 14 bp, Homo sapiens
aatctggtcttgtt

SEQ ID NO: 5348216 - DNA, 20 bp, Homo sapiens
aatctggtcttgttagaaaa

SEQ ID NO: 5348217 - DNA, 22 bp, Homo sapiens
aatctggtgacaaatattctct

SEQ ID NO: 5348218 - DNA, 15 bp, Homo sapiens
aatctggttgtgatt

SEQ ID NO: 5348219 - DNA, 17 bp, Homo sapiens
aatctgtaaaaaagaaa

SEQ ID NO: 5348220 - DNA, 15 bp, Homo sapiens
aatctgtaaagccag

SEQ ID NO: 5348221 - DNA, 22 bp, Homo sapiens
aatctgtaacccccaaggagga

SEQ ID NO: 5348222 - DNA, 11 bp, Homo sapiens
aatctgtacat

SEQ ID NO: 5348223 - DNA, 14 bp, Homo sapiens
aatctgtacatttt

SEQ ID NO: 5348224 - DNA, 15 bp, Homo sapiens
aatctgtagaggagc

SEQ ID NO: 5348225 - DNA, 19 bp, Homo sapiens
aatctgtagaggagcctgg

SEQ ID NO: 5348226 - DNA, 22 bp, Homo sapiens
aatctgtagcataggctagtgg

SEQ ID NO: 5348227 - DNA, 15 bp, Homo sapiens
aatctgtagggctgg

SEQ ID NO: 5348228 - DNA, 22 bp, Homo sapiens
aatctgtagggctggacctatg

SEQ ID NO: 5348229 - DNA, 16 bp, Homo sapiens
aatctgtataaatgtc

SEQ ID NO: 5348230 - DNA, 17 bp, Homo sapiens
aatctgtataaatgtct

SEQ ID NO: 5348231 - DNA, 17 bp, Homo sapiens
aatctgtataaatgtga

SEQ ID NO: 5348232 - DNA, 21 bp, Homo sapiens
aatctgtataaatgtgaaatt

SEQ ID NO: 5348233 - DNA, 20 bp, Homo sapiens
aatctgtataatactttgta

SEQ ID NO: 5348234 - DNA, 21 bp, Homo sapiens
aatctgtataatactttgtat

SEQ ID NO: 5348235 - DNA, 16 bp, Homo sapiens
aatctgtatatgttgt

SEQ ID NO: 5348236 - DNA, 18 bp, Homo sapiens
aatctgtatatgttgtaa

SEQ ID NO: 5348237 - DNA, 22 bp, Homo sapiens
aatctgtatatgttgtaataaa

SEQ ID NO: 5348238 - DNA, 23 bp, Homo sapiens
aatctgtatatgttgtaataaaa

SEQ ID NO: 5348239 - DNA, 19 bp, Homo sapiens
aatctgtcaaaacactgtg

SEQ ID NO: 5348240 - DNA, 23 bp, Homo sapiens
aatctgtcaaaacactgtggaac

SEQ ID NO: 5348241 - DNA, 19 bp, Homo sapiens
aatctgtcagtgtttgtat

SEQ ID NO: 5348242 - DNA, 12 bp, Homo sapiens
aatctgtcataa

SEQ ID NO: 5348243 - DNA, 18 bp, Homo sapiens
aatctgtcctctgtagta

SEQ ID NO: 5348244 - DNA, 15 bp, Homo sapiens
aatctgtcctgtggc

SEQ ID NO: 5348245 - DNA, 20 bp, Homo sapiens
aatctgtcgcatttcatcaa

SEQ ID NO: 5348246 - DNA, 21 bp, Homo sapiens
aatctgtctagaatcctgctt

SEQ ID NO: 5348247 - DNA, 22 bp, Homo sapiens
aatctgtctagaatcctgcttt

SEQ ID NO: 5348248 - DNA, 16 bp, Homo sapiens
aatctgtctgattcta

SEQ ID NO: 5348249 - DNA, 19 bp, Homo sapiens
aatctgtctgattctatgc

SEQ ID NO: 5348250 - DNA, 14 bp, Homo sapiens
aatctgtctgctgg

SEQ ID NO: 5348251 - DNA, 15 bp, Homo sapiens
aatctgtgaacttga

SEQ ID NO: 5348252 - DNA, 17 bp, Homo sapiens
aatctgtgaacttgaaa

SEQ ID NO: 5348253 - DNA, 16 bp, Homo sapiens
aatctgtgcaaacagt

SEQ ID NO: 5348254 - DNA, 16 bp, Homo sapiens
aatctgtgctgtttca

SEQ ID NO: 5348255 - DNA, 19 bp, Homo sapiens
aatctgtgctgtttcaaag

SEQ ID NO: 5348256 - DNA, 19 bp, Homo sapiens
aatctgtgtacaaagaaat

SEQ ID NO: 5348257 - DNA, 18 bp, Homo sapiens
aatctgtgtatattattt

SEQ ID NO: 5348258 - DNA, 21 bp, Homo sapiens
aatctgtgtatattatttggc

SEQ ID NO: 5348259 - DNA, 14 bp, Homo sapiens
aatctgtgtgaagt

SEQ ID NO: 5348260 - DNA, 18 bp, Homo sapiens
aatctgtgtgcatatttg

SEQ ID NO: 5348261 - DNA, 16 bp, Homo sapiens
aatctgtgtgtatatt

SEQ ID NO: 5348262 - DNA, 17 bp, Homo sapiens
aatctgtgtgtgccctg

SEQ ID NO: 5348263 - DNA, 15 bp, Homo sapiens
aatctgttactgaaa

SEQ ID NO: 5348264 - DNA, 16 bp, Homo sapiens
aatctgttagcattat

SEQ ID NO: 5348265 - DNA, 22 bp, Homo sapiens
aatctgttctactcttaatgat

SEQ ID NO: 5348266 - DNA, 19 bp, Homo sapiens
aatctgttgataaatccat

SEQ ID NO: 5348267 - DNA, 17 bp, Homo sapiens
aatctgttgatggagat

SEQ ID NO: 5348268 - DNA, 22 bp, Homo sapiens
aatctgttgttccaaatgtgta

SEQ ID NO: 5348269 - DNA, 15 bp, Homo sapiens
aatctgttgtttgaa

SEQ ID NO: 5348270 - DNA, 14 bp, Homo sapiens
aatctgtttctctg

SEQ ID NO: 5348271 - DNA, 15 bp, Homo sapiens
aatctgtttctctgc

SEQ ID NO: 5348272 - DNA, 20 bp, Homo sapiens
aatctgtttctctgctgtca

SEQ ID NO: 5348273 - DNA, 17 bp, Homo sapiens
aatctgtttgatccctg

SEQ ID NO: 5348274 - DNA, 12 bp, Homo sapiens
aatctgtttgtg

SEQ ID NO: 5348275 - DNA, 18 bp, Homo sapiens
aatctgtttgtgcaaaca

SEQ ID NO: 5348276 - DNA, 19 bp, Homo sapiens
aatctgttttgtatatgat

SEQ ID NO: 5348277 - DNA, 19 bp, Homo sapiens
aatctgtttttacgtatgt

SEQ ID NO: 5348278 - DNA, 16 bp, Homo sapiens
aatctgtttttctaac

SEQ ID NO: 5348279 - DNA, 15 bp, Homo sapiens
aatcttaaaaagttg

SEQ ID NO: 5348280 - DNA, 17 bp, Homo sapiens
aatcttaaaaagttgtt

SEQ ID NO: 5348281 - DNA, 21 bp, Homo sapiens
aatcttaaaaagttgttcaac

SEQ ID NO: 5348282 - DNA, 16 bp, Homo sapiens
aatcttaaacaatgta

SEQ ID NO: 5348283 - DNA, 18 bp, Homo sapiens
aatcttaaacaatgtata

SEQ ID NO: 5348284 - DNA, 15 bp, Homo sapiens
aatcttaaacataat

SEQ ID NO: 5348285 - DNA, 15 bp, Homo sapiens
aatcttaaatcagaa

SEQ ID NO: 5348286 - DNA, 19 bp, Homo sapiens
aatcttaaatcagaataaa

SEQ ID NO: 5348287 - DNA, 19 bp, Homo sapiens
aatcttaaccctgtgctgt

SEQ ID NO: 5348288 - DNA, 13 bp, Homo sapiens
aatcttaagaaat

SEQ ID NO: 5348289 - DNA, 22 bp, Homo sapiens
aatcttaagagaatccacataa

SEQ ID NO: 5348290 - DNA, 20 bp, Homo sapiens
aatcttaaggtctaactgtg

SEQ ID NO: 5348291 - DNA, 17 bp, Homo sapiens
aatcttaatactgttat

SEQ ID NO: 5348292 - DNA, 18 bp, Homo sapiens
aatcttaatacttgaact

SEQ ID NO: 5348293 - DNA, 12 bp, Homo sapiens
aatcttaatcat

SEQ ID NO: 5348294 - DNA, 22 bp, Homo sapiens
aatcttaatgtctggtgtttgt

SEQ ID NO: 5348295 - DNA, 18 bp, Homo sapiens
aatcttaattttgtattt

SEQ ID NO: 5348296 - DNA, 23 bp, Homo sapiens
aatcttaattttgtattttttcc

SEQ ID NO: 5348297 - DNA, 13 bp, Homo sapiens
aatcttacaaaag

SEQ ID NO: 5348298 - DNA, 24 bp, Homo sapiens
aatcttacaaaatcctggaagatt

SEQ ID NO: 5348299 - DNA, 18 bp, Homo sapiens
aatcttacagctgggtgg

SEQ ID NO: 5348300 - DNA, 20 bp, Homo sapiens
aatcttacccttcaatgtta

SEQ ID NO: 5348301 - DNA, 22 bp, Homo sapiens
aatcttacccttcaatgttaaa

SEQ ID NO: 5348302 - DNA, 23 bp, Homo sapiens
aatcttacccttcaatgttaaat

SEQ ID NO: 5348303 - DNA, 20 bp, Homo sapiens
aatcttactttgtaaattct

SEQ ID NO: 5348304 - DNA, 14 bp, Homo sapiens
aatcttagaacaga

SEQ ID NO: 5348305 - DNA, 16 bp, Homo sapiens
aatcttagctgccaag

SEQ ID NO: 5348306 - DNA, 19 bp, Homo sapiens
aatcttagtatagtagaaa

SEQ ID NO: 5348307 - DNA, 18 bp, Homo sapiens
aatcttagtgtatgatta

SEQ ID NO: 5348308 - DNA, 21 bp, Homo sapiens
aatcttagtgtatgattactg

SEQ ID NO: 5348309 - DNA, 14 bp, Homo sapiens
aatcttataattgt

SEQ ID NO: 5348310 - DNA, 22 bp, Homo sapiens
aatcttatcaagagttgtgaca

SEQ ID NO: 5348311 - DNA, 15 bp, Homo sapiens
aatcttatcatggtc

SEQ ID NO: 5348312 - DNA, 21 bp, Homo sapiens
aatcttatcatggtctcagtc

SEQ ID NO: 5348313 - DNA, 14 bp, Homo sapiens
aatcttattaaagt

SEQ ID NO: 5348314 - DNA, 20 bp, Homo sapiens
aatcttattagggagaaaat

SEQ ID NO: 5348315 - DNA, 22 bp, Homo sapiens
aatcttattgtttaatcttttt

SEQ ID NO: 5348316 - DNA, 14 bp, Homo sapiens
aatcttatttttcc

SEQ ID NO: 5348317 - DNA, 16 bp, Homo sapiens
aatcttcaaagccttc

SEQ ID NO: 5348318 - DNA, 21 bp, Homo sapiens
aatcttcaaggtgtaaaatat

SEQ ID NO: 5348319 - DNA, 15 bp, Homo sapiens
aatcttcacctcaga

SEQ ID NO: 5348320 - DNA, 17 bp, Homo sapiens
aatcttcactgaatatc

SEQ ID NO: 5348321 - DNA, 11 bp, Homo sapiens
aatcttcagct

SEQ ID NO: 5348322 - DNA, 20 bp, Homo sapiens
aatcttcagttttatcttta

SEQ ID NO: 5348323 - DNA, 22 bp, Homo sapiens
aatcttcagttttatctttaat

SEQ ID NO: 5348324 - DNA, 13 bp, Homo sapiens
aatcttccaaaga

SEQ ID NO: 5348325 - DNA, 15 bp, Homo sapiens
aatcttccaatttag

SEQ ID NO: 5348326 - DNA, 23 bp, Homo sapiens
aatcttccaatttagttgttgta

SEQ ID NO: 5348327 - DNA, 22 bp, Homo sapiens
aatcttccaggtattttccact

SEQ ID NO: 5348328 - DNA, 12 bp, Homo sapiens
aatcttcctggc

SEQ ID NO: 5348329 - DNA, 21 bp, Homo sapiens
aatcttcctggtcgaaagtta

SEQ ID NO: 5348330 - DNA, 15 bp, Homo sapiens
aatcttccttgtgag

SEQ ID NO: 5348331 - DNA, 12 bp, Homo sapiens
aatcttctactt

SEQ ID NO: 5348332 - DNA, 19 bp, Homo sapiens
aatcttctacttttaacta

SEQ ID NO: 5348333 - DNA, 19 bp, Homo sapiens
aatcttctctcttgattga

SEQ ID NO: 5348334 - DNA, 23 bp, Homo sapiens
aatcttctgaacttggcgctgcc

SEQ ID NO: 5348335 - DNA, 14 bp, Homo sapiens
aatcttctttttca

SEQ ID NO: 5348336 - DNA, 20 bp, Homo sapiens
aatcttgaaagcgaaatact

SEQ ID NO: 5348337 - DNA, 14 bp, Homo sapiens
aatcttgaatttct

SEQ ID NO: 5348338 - DNA, 16 bp, Homo sapiens
aatcttgatcattccg

SEQ ID NO: 5348339 - DNA, 18 bp, Homo sapiens
aatcttgatcattccggt

SEQ ID NO: 5348340 - DNA, 13 bp, Homo sapiens
aatcttgcatgta

SEQ ID NO: 5348341 - DNA, 13 bp, Homo sapiens
aatcttgcccact

SEQ ID NO: 5348342 - DNA, 19 bp, Homo sapiens
aatcttgcccactggccgc

SEQ ID NO: 5348343 - DNA, 23 bp, Homo sapiens
aatcttgccttctggtttcttcc

SEQ ID NO: 5348344 - DNA, 16 bp, Homo sapiens
aatcttgctgcttatg

SEQ ID NO: 5348345 - DNA, 16 bp, Homo sapiens
aatcttgctgtgaaac

SEQ ID NO: 5348346 - DNA, 18 bp, Homo sapiens
aatcttgctgtgaaacag

SEQ ID NO: 5348347 - DNA, 14 bp, Homo sapiens
aatcttgcttcaga

SEQ ID NO: 5348348 - DNA, 14 bp, Homo sapiens
aatcttgctttctt

SEQ ID NO: 5348349 - DNA, 12 bp, Homo sapiens
aatcttgctttg

SEQ ID NO: 5348350 - DNA, 21 bp, Homo sapiens
aatcttggaacacctggcatg

SEQ ID NO: 5348351 - DNA, 23 bp, Homo sapiens
aatcttggaagtacatgaataca

SEQ ID NO: 5348352 - DNA, 17 bp, Homo sapiens
aatcttggagctgcttg

SEQ ID NO: 5348353 - DNA, 13 bp, Homo sapiens
aatcttggattaa

SEQ ID NO: 5348354 - DNA, 18 bp, Homo sapiens
aatcttggccctattcat

SEQ ID NO: 5348355 - DNA, 17 bp, Homo sapiens
aatcttggcttcttaaa

SEQ ID NO: 5348356 - DNA, 21 bp, Homo sapiens
aatcttggcttcttaaaaact

SEQ ID NO: 5348357 - DNA, 23 bp, Homo sapiens
aatcttggcttcttaaaaactgt

SEQ ID NO: 5348358 - DNA, 17 bp, Homo sapiens
aatcttgggtgggtgaa

SEQ ID NO: 5348359 - DNA, 21 bp, Homo sapiens
aatcttggtcatgtcctgagg

SEQ ID NO: 5348360 - DNA, 22 bp, Homo sapiens
aatcttggtttggtacagttca

SEQ ID NO: 5348361 - DNA, 17 bp, Homo sapiens
aatcttgtaagtattta

SEQ ID NO: 5348362 - DNA, 16 bp, Homo sapiens
aatcttgtagacactt

SEQ ID NO: 5348363 - DNA, 15 bp, Homo sapiens
aatcttgtcatgtgt

SEQ ID NO: 5348364 - DNA, 17 bp, Homo sapiens
aatcttgtcatgtgtat

SEQ ID NO: 5348365 - DNA, 13 bp, Homo sapiens
aatcttgtctcaa

SEQ ID NO: 5348366 - DNA, 15 bp, Homo sapiens
aatcttgtctcaatg

SEQ ID NO: 5348367 - DNA, 18 bp, Homo sapiens
aatcttgtctcaatgctc

SEQ ID NO: 5348368 - DNA, 19 bp, Homo sapiens
aatcttgtgctagaatact

SEQ ID NO: 5348369 - DNA, 22 bp, Homo sapiens
aatcttgtgctagaatactttt

SEQ ID NO: 5348370 - DNA, 22 bp, Homo sapiens
aatcttgtgttaacttgcctcc

SEQ ID NO: 5348371 - DNA, 12 bp, Homo sapiens
aatcttgttact

SEQ ID NO: 5348372 - DNA, 21 bp, Homo sapiens
aatcttgttattgaagtgttc

SEQ ID NO: 5348373 - DNA, 15 bp, Homo sapiens
aatcttgttcaaaat

SEQ ID NO: 5348374 - DNA, 13 bp, Homo sapiens
aatcttgtttata

SEQ ID NO: 5348375 - DNA, 23 bp, Homo sapiens
aatcttgttttaagcaaatgcat

SEQ ID NO: 5348376 - DNA, 13 bp, Homo sapiens
aatcttgttttgt

SEQ ID NO: 5348377 - DNA, 17 bp, Homo sapiens
aatctttaaaagatgct

SEQ ID NO: 5348378 - DNA, 16 bp, Homo sapiens
aatctttaagaatagt

SEQ ID NO: 5348379 - DNA, 14 bp, Homo sapiens
aatctttaataaca

SEQ ID NO: 5348380 - DNA, 14 bp, Homo sapiens
aatctttaatggtt

SEQ ID NO: 5348381 - DNA, 14 bp, Homo sapiens
aatctttaattaaa

SEQ ID NO: 5348382 - DNA, 22 bp, Homo sapiens
aatctttacctgtatacagtgc

SEQ ID NO: 5348383 - DNA, 16 bp, Homo sapiens
aatctttatagtaaaa

SEQ ID NO: 5348384 - DNA, 21 bp, Homo sapiens
aatctttattcaaacttttat

SEQ ID NO: 5348385 - DNA, 18 bp, Homo sapiens
aatctttattttattatt

SEQ ID NO: 5348386 - DNA, 20 bp, Homo sapiens
aatctttattttattattca

SEQ ID NO: 5348387 - DNA, 21 bp, Homo sapiens
aatctttattttattattcag

SEQ ID NO: 5348388 - DNA, 21 bp, Homo sapiens
aatctttcaaaccagcttcat

SEQ ID NO: 5348389 - DNA, 20 bp, Homo sapiens
aatctttcaacttatttctg

SEQ ID NO: 5348390 - DNA, 23 bp, Homo sapiens
aatctttcaacttatttctgaaa

SEQ ID NO: 5348391 - DNA, 13 bp, Homo sapiens
aatctttcagaat

SEQ ID NO: 5348392 - DNA, 21 bp, Homo sapiens
aatctttcagcactcagaaaa

SEQ ID NO: 5348393 - DNA, 13 bp, Homo sapiens
aatctttcataca

SEQ ID NO: 5348394 - DNA, 14 bp, Homo sapiens
aatctttcatacat

SEQ ID NO: 5348395 - DNA, 20 bp, Homo sapiens
aatctttctacctctttttt

SEQ ID NO: 5348396 - DNA, 15 bp, Homo sapiens
aatctttctatattt

SEQ ID NO: 5348397 - DNA, 16 bp, Homo sapiens
aatctttctcctggtg

SEQ ID NO: 5348398 - DNA, 19 bp, Homo sapiens
aatctttctcctggtgact

SEQ ID NO: 5348399 - DNA, 16 bp, Homo sapiens
aatctttctgtaaaca

SEQ ID NO: 5348400 - DNA, 18 bp, Homo sapiens
aatctttctgtaaacaga

SEQ ID NO: 5348401 - DNA, 22 bp, Homo sapiens
aatctttctttacctgagacca

SEQ ID NO: 5348402 - DNA, 18 bp, Homo sapiens
aatctttctttcttagaa

SEQ ID NO: 5348403 - DNA, 22 bp, Homo sapiens
aatctttcttttgattcttcct

SEQ ID NO: 5348404 - DNA, 14 bp, Homo sapiens
aatctttgaaataa

SEQ ID NO: 5348405 - DNA, 19 bp, Homo sapiens
aatctttgtgaacattctg

SEQ ID NO: 5348406 - DNA, 21 bp, Homo sapiens
aatctttgtgaacattctgta

SEQ ID NO: 5348407 - DNA, 16 bp, Homo sapiens
aatctttgtgacagga

SEQ ID NO: 5348408 - DNA, 17 bp, Homo sapiens
aatctttgttaaaatat

SEQ ID NO: 5348409 - DNA, 18 bp, Homo sapiens
aatctttgttaaaatata

SEQ ID NO: 5348410 - DNA, 19 bp, Homo sapiens
aatctttgttaaaatatag

SEQ ID NO: 5348411 - DNA, 12 bp, Homo sapiens
aatcttttacaa

SEQ ID NO: 5348412 - DNA, 23 bp, Homo sapiens
aatcttttacaactgcctcgaaa

SEQ ID NO: 5348413 - DNA, 23 bp, Homo sapiens
aatcttttactgtggaggtggct

SEQ ID NO: 5348414 - DNA, 16 bp, Homo sapiens
aatcttttataggatt

SEQ ID NO: 5348415 - DNA, 19 bp, Homo sapiens
aatcttttatgattgcctt

SEQ ID NO: 5348416 - DNA, 23 bp, Homo sapiens
aatcttttccaggaaaaagaact

SEQ ID NO: 5348417 - DNA, 12 bp, Homo sapiens
aatcttttctga

SEQ ID NO: 5348418 - DNA, 13 bp, Homo sapiens
aatcttttgaagc

SEQ ID NO: 5348419 - DNA, 16 bp, Homo sapiens
aatcttttgtgaaatt

SEQ ID NO: 5348420 - DNA, 17 bp, Homo sapiens
aatctttttaaaaatga

SEQ ID NO: 5348421 - DNA, 18 bp, Homo sapiens
aatctttttaaaaatgat

SEQ ID NO: 5348422 - DNA, 23 bp, Homo sapiens
aatctttttataaatacataaat

SEQ ID NO: 5348423 - DNA, 17 bp, Homo sapiens
aatctttttatcccatt

SEQ ID NO: 5348424 - DNA, 21 bp, Homo sapiens
aatctttttatcccatttagt

SEQ ID NO: 5348425 - DNA, 14 bp, Homo sapiens
aatctttttcatca

SEQ ID NO: 5348426 - DNA, 22 bp, Homo sapiens
aatctttttgcttctactttca

SEQ ID NO: 5348427 - DNA, 21 bp, Homo sapiens
aatcttttttagcataaaatt

SEQ ID NO: 5348428 - DNA, 23 bp, Homo sapiens
aatgaaaaaaaaaggggggtggg

SEQ ID NO: 5348429 - DNA, 13 bp, Homo sapiens
aatgaaaaaagca

SEQ ID NO: 5348430 - DNA, 17 bp, Homo sapiens
aatgaaaaatacatatt

SEQ ID NO: 5348431 - DNA, 13 bp, Homo sapiens
aatgaaaaatata

SEQ ID NO: 5348432 - DNA, 22 bp, Homo sapiens
aatgaaaaatcaggcagaaata

SEQ ID NO: 5348433 - DNA, 17 bp, Homo sapiens
aatgaaaaatctgaatt

SEQ ID NO: 5348434 - DNA, 13 bp, Homo sapiens
aatgaaaaatgaa

SEQ ID NO: 5348435 - DNA, 18 bp, Homo sapiens
aatgaaaaatgaaagatg

SEQ ID NO: 5348436 - DNA, 14 bp, Homo sapiens
aatgaaaaattctc

SEQ ID NO: 5348437 - DNA, 17 bp, Homo sapiens
aatgaaaaatttaagca

SEQ ID NO: 5348438 - DNA, 18 bp, Homo sapiens
aatgaaaaatttaagcat

SEQ ID NO: 5348439 - DNA, 19 bp, Homo sapiens
aatgaaaaatttaagcatt

SEQ ID NO: 5348440 - DNA, 15 bp, Homo sapiens
aatgaaaacaaaatt

SEQ ID NO: 5348441 - DNA, 16 bp, Homo sapiens
aatgaaaacaatgcag

SEQ ID NO: 5348442 - DNA, 18 bp, Homo sapiens
aatgagctttcaggaagt

SEQ ID NO: 5348443 - DNA, 21 bp, Homo sapiens
aatgagctttctgaacagctg

SEQ ID NO: 5348444 - DNA, 21 bp, Homo sapiens
aatgaggaaaccaagataaat

SEQ ID NO: 5348445 - DNA, 22 bp, Homo sapiens
aatgaggaacaatcacaaaagc

SEQ ID NO: 5348446 - DNA, 14 bp, Homo sapiens
aatgaggaatccaa

SEQ ID NO: 5348447 - DNA, 13 bp, Homo sapiens
aatgaggaatgta

SEQ ID NO: 5348448 - DNA, 22 bp, Homo sapiens
aatgaggagagaaaatatatgt

SEQ ID NO: 5348449 - DNA, 18 bp, Homo sapiens
aatgaggatccagggcag

SEQ ID NO: 5348450 - DNA, 22 bp, Homo sapiens
aatgaggatccagggcagcagg

SEQ ID NO: 5348451 - DNA, 17 bp, Homo sapiens
aatgaggcattacaaat

SEQ ID NO: 5348452 - DNA, 22 bp, Homo sapiens
aatgaggccatggactctgtcc

SEQ ID NO: 5348453 - DNA, 18 bp, Homo sapiens
aatgaggcttgctgagag

SEQ ID NO: 5348454 - DNA, 14 bp, Homo sapiens
aatgagggaaacaa

SEQ ID NO: 5348455 - DNA, 19 bp, Homo sapiens
aatgagggaaacaaaatat

SEQ ID NO: 5348456 - DNA, 14 bp, Homo sapiens
aatgagggactgga

SEQ ID NO: 5348457 - DNA, 11 bp, Homo sapiens
aatgagggagg

SEQ ID NO: 5348458 - DNA, 14 bp, Homo sapiens
aatgagggccaaga

SEQ ID NO: 5348459 - DNA, 18 bp, Homo sapiens
aatgagggcgtgaaacac

SEQ ID NO: 5348460 - DNA, 19 bp, Homo sapiens
aatgaggtcagcatgtcta

SEQ ID NO: 5348461 - DNA, 16 bp, Homo sapiens
aatgaggtcccaggca

SEQ ID NO: 5348462 - DNA, 18 bp, Homo sapiens
aatgaggtccctctagct

SEQ ID NO: 5348463 - DNA, 16 bp, Homo sapiens
aatgaggtctgaaatg

SEQ ID NO: 5348464 - DNA, 19 bp, Homo sapiens
aatgaggtctgaaatggag

SEQ ID NO: 5348465 - DNA, 16 bp, Homo sapiens
aatgaggtctgtttaa

SEQ ID NO: 5348466 - DNA, 20 bp, Homo sapiens
aatgaggttatgagaaaaaa

SEQ ID NO: 5348467 - DNA, 23 bp, Homo sapiens
aatgaggttatgagaaaaaaaca

SEQ ID NO: 5348468 - DNA, 14 bp, Homo sapiens
aatgagtaaataaa

SEQ ID NO: 5348469 - DNA, 17 bp, Homo sapiens
aatgagtaaataaactc

SEQ ID NO: 5348470 - DNA, 23 bp, Homo sapiens
aatgagtaaataaactcttcaag

SEQ ID NO: 5348471 - DNA, 14 bp, Homo sapiens
aatgagtaaatggt

SEQ ID NO: 5348472 - DNA, 21 bp, Homo sapiens
aatgagtaatgtgatcgcttg

SEQ ID NO: 5348473 - DNA, 16 bp, Homo sapiens
aatgagtatatgtaac

SEQ ID NO: 5348474 - DNA, 14 bp, Homo sapiens
aatgagtatttggt

SEQ ID NO: 5348475 - DNA, 16 bp, Homo sapiens
aatgagtatttggtaa

SEQ ID NO: 5348476 - DNA, 20 bp, Homo sapiens
aatgagtcaatcagccttta

SEQ ID NO: 5348477 - DNA, 17 bp, Homo sapiens
aatgagtcatttgttta

SEQ ID NO: 5348478 - DNA, 19 bp, Homo sapiens
aatgagtcatttgtttaaa

SEQ ID NO: 5348479 - DNA, 18 bp, Homo sapiens
aatgagtccaaactggaa

SEQ ID NO: 5348480 - DNA, 20 bp, Homo sapiens
aatgagtctgcataaacttc

SEQ ID NO: 5348481 - DNA, 23 bp, Homo sapiens
aatgagtctgcataaacttcatc

SEQ ID NO: 5348482 - DNA, 16 bp, Homo sapiens
aatgagtctgtaattt

SEQ ID NO: 5348483 - DNA, 19 bp, Homo sapiens
aatgagtctgtaattttac

SEQ ID NO: 5348484 - DNA, 19 bp, Homo sapiens
aatgagtctgttgtgtgtc

SEQ ID NO: 5348485 - DNA, 16 bp, Homo sapiens
aatgagtgaattgaat

SEQ ID NO: 5348486 - DNA, 16 bp, Homo sapiens
aatgagtgcacctgcc

SEQ ID NO: 5348487 - DNA, 15 bp, Homo sapiens
aatgagtggccagcg

SEQ ID NO: 5348488 - DNA, 13 bp, Homo sapiens
aatgagtgggaat

SEQ ID NO: 5348489 - DNA, 13 bp, Homo sapiens
aatgagtgtgcat

SEQ ID NO: 5348490 - DNA, 18 bp, Homo sapiens
aatgagttaaataaaaca

SEQ ID NO: 5348491 - DNA, 23 bp, Homo sapiens
aatgagttaaataaaacattgac

SEQ ID NO: 5348492 - DNA, 21 bp, Homo sapiens
aatgagttcaactttgaggga

SEQ ID NO: 5348493 - DNA, 18 bp, Homo sapiens
aatgagttgctggaaaat

SEQ ID NO: 5348494 - DNA, 20 bp, Homo sapiens
aatgagttgctggaaaatca

SEQ ID NO: 5348495 - DNA, 23 bp, Homo sapiens
aatgagttgtcacagaaattatg

SEQ ID NO: 5348496 - DNA, 17 bp, Homo sapiens
aatgagtttaaaaatca

SEQ ID NO: 5348497 - DNA, 21 bp, Homo sapiens
aatgagtttaaaaatcaactt

SEQ ID NO: 5348498 - DNA, 14 bp, Homo sapiens
aatgagtttcttag

SEQ ID NO: 5348499 - DNA, 15 bp, Homo sapiens
aatgagtttctttta

SEQ ID NO: 5348500 - DNA, 22 bp, Homo sapiens
aatgataaaataaataatttta

SEQ ID NO: 5348501 - DNA, 23 bp, Homo sapiens
aatgataaaataaataattttaa

SEQ ID NO: 5348502 - DNA, 19 bp, Homo sapiens
aatgataaactcagatctg

SEQ ID NO: 5348503 - DNA, 22 bp, Homo sapiens
aatgataaactcagatctgatc

SEQ ID NO: 5348504 - DNA, 15 bp, Homo sapiens
aatgataaactctct

SEQ ID NO: 5348505 - DNA, 15 bp, Homo sapiens
aatgataactggaaa

SEQ ID NO: 5348506 - DNA, 17 bp, Homo sapiens
aatgataactggaaact

SEQ ID NO: 5348507 - DNA, 18 bp, Homo sapiens
aatgataagtaaatgcta

SEQ ID NO: 5348508 - DNA, 13 bp, Homo sapiens
aatgataagtact

SEQ ID NO: 5348509 - DNA, 12 bp, Homo sapiens
aatgataatgct

SEQ ID NO: 5348510 - DNA, 15 bp, Homo sapiens
aatgatacagtcagg

SEQ ID NO: 5348511 - DNA, 16 bp, Homo sapiens
aatgatactgatggtg

SEQ ID NO: 5348512 - DNA, 16 bp, Homo sapiens
aatgatactgtctaag

SEQ ID NO: 5348513 - DNA, 13 bp, Homo sapiens
aatgatactgtgt

SEQ ID NO: 5348514 - DNA, 21 bp, Homo sapiens
aatgatacttacaagtttcta

SEQ ID NO: 5348515 - DNA, 14 bp, Homo sapiens
aatgatagacatat

SEQ ID NO: 5348516 - DNA, 18 bp, Homo sapiens
aatgatagatttgacctc

SEQ ID NO: 5348517 - DNA, 15 bp, Homo sapiens
aatgatagctactgt

SEQ ID NO: 5348518 - DNA, 19 bp, Homo sapiens
aatgatagttgattttcaa

SEQ ID NO: 5348519 - DNA, 21 bp, Homo sapiens
aatgatatataatttaaagtt

SEQ ID NO: 5348520 - DNA, 19 bp, Homo sapiens
aatgatatattaaaccttc

SEQ ID NO: 5348521 - DNA, 18 bp, Homo sapiens
aatgatatctatattcta

SEQ ID NO: 5348522 - DNA, 15 bp, Homo sapiens
aatgatatgcttgta

SEQ ID NO: 5348523 - DNA, 17 bp, Homo sapiens
aatgatatgtctttaaa

SEQ ID NO: 5348524 - DNA, 21 bp, Homo sapiens
aatgatattgacactgtccct

SEQ ID NO: 5348525 - DNA, 21 bp, Homo sapiens
aatgatattgctctatatgta

SEQ ID NO: 5348526 - DNA, 14 bp, Homo sapiens
aatgatattgctga

SEQ ID NO: 5348527 - DNA, 21 bp, Homo sapiens
aatgatatttaggtttttggc

SEQ ID NO: 5348528 - DNA, 20 bp, Homo sapiens
aatgatcacatctaaagctt

SEQ ID NO: 5348529 - DNA, 22 bp, Homo sapiens
aatgatcacatctaaagcttta

SEQ ID NO: 5348530 - DNA, 15 bp, Homo sapiens
aatgatcagaacaaa

SEQ ID NO: 5348531 - DNA, 21 bp, Homo sapiens
aatgatcagacttgatttaca

SEQ ID NO: 5348532 - DNA, 17 bp, Homo sapiens
aatgatcagcaaaaaga

SEQ ID NO: 5348533 - DNA, 19 bp, Homo sapiens
aatgatcagcaaaaagact

SEQ ID NO: 5348534 - DNA, 20 bp, Homo sapiens
aatgatcagcaaaaagactg

SEQ ID NO: 5348535 - DNA, 20 bp, Homo sapiens
aatgatccccaagtgtgaac

SEQ ID NO: 5348536 - DNA, 20 bp, Homo sapiens
aatgatccctcagtctgaga

SEQ ID NO: 5348537 - DNA, 22 bp, Homo sapiens
aatgatcctgtctctaaaaaga

SEQ ID NO: 5348538 - DNA, 22 bp, Homo sapiens
aatgatcgttctgggtcagctt

SEQ ID NO: 5348539 - DNA, 16 bp, Homo sapiens
aatgatctaggtttaa

SEQ ID NO: 5348540 - DNA, 23 bp, Homo sapiens
aatgatctaggtttaactcagat

SEQ ID NO: 5348541 - DNA, 19 bp, Homo sapiens
aatgatctcggatgaccaa

SEQ ID NO: 5348542 - DNA, 15 bp, Homo sapiens
aatgatctgaatctg

SEQ ID NO: 5348543 - DNA, 16 bp, Homo sapiens
aatgatgacccactaa

SEQ ID NO: 5348544 - DNA, 21 bp, Homo sapiens
aatgatgacccactaaagagt

SEQ ID NO: 5348545 - DNA, 13 bp, Homo sapiens
aatgatgagcatt

SEQ ID NO: 5348546 - DNA, 18 bp, Homo sapiens
aatgatgagtaacttaac

SEQ ID NO: 5348547 - DNA, 17 bp, Homo sapiens
aatgatgagtttttatg

SEQ ID NO: 5348548 - DNA, 12 bp, Homo sapiens
aatgatgataat

SEQ ID NO: 5348549 - DNA, 23 bp, Homo sapiens
aatgatgatgacgacgacaacga

SEQ ID NO: 5348550 - DNA, 15 bp, Homo sapiens
aatgatgattaaaca

SEQ ID NO: 5348551 - DNA, 17 bp, Homo sapiens
aatgatgattaaacacc

SEQ ID NO: 5348552 - DNA, 16 bp, Homo sapiens
aatgatgattcaatca

SEQ ID NO: 5348553 - DNA, 16 bp, Homo sapiens
aatgatgcaaccaaaa

SEQ ID NO: 5348554 - DNA, 22 bp, Homo sapiens
aatgatgcaaccaaaagggaaa

SEQ ID NO: 5348555 - DNA, 18 bp, Homo sapiens
aatgatgcacatttcatg

SEQ ID NO: 5348556 - DNA, 20 bp, Homo sapiens
aatgatgcagctgttgagaa

SEQ ID NO: 5348557 - DNA, 20 bp, Homo sapiens
aatgatgccaaaatattgct

SEQ ID NO: 5348558 - DNA, 20 bp, Homo sapiens
aatgatgccatgaggaacaa

SEQ ID NO: 5348559 - DNA, 23 bp, Homo sapiens
aatgatgccgaacattaggaatt

SEQ ID NO: 5348560 - DNA, 22 bp, Homo sapiens
aatgatgcttcagtggaaatca

SEQ ID NO: 5348561 - DNA, 17 bp, Homo sapiens
aatgatggcaattttgt

SEQ ID NO: 5348562 - DNA, 19 bp, Homo sapiens
aatgatggcaattttgtaa

SEQ ID NO: 5348563 - DNA, 22 bp, Homo sapiens
aatgatggtaggaagaagctct

SEQ ID NO: 5348564 - DNA, 15 bp, Homo sapiens
aatgatgtagacatt

SEQ ID NO: 5348565 - DNA, 17 bp, Homo sapiens
aatgatgtatataaaat

SEQ ID NO: 5348566 - DNA, 19 bp, Homo sapiens
aatgatgtatgatttgttg

SEQ ID NO: 5348567 - DNA, 15 bp, Homo sapiens
aatgatgtccagaag

SEQ ID NO: 5348568 - DNA, 21 bp, Homo sapiens
aatgatgtgaaagataaatga

SEQ ID NO: 5348569 - DNA, 17 bp, Homo sapiens
aatgatgtgcaaaacct

SEQ ID NO: 5348570 - DNA, 19 bp, Homo sapiens
aatgatgtgcctgcttcag

SEQ ID NO: 5348571 - DNA, 14 bp, Homo sapiens
aatgatgttataca

SEQ ID NO: 5348572 - DNA, 14 bp, Homo sapiens
aatgatgttgaata

SEQ ID NO: 5348573 - DNA, 20 bp, Homo sapiens
aatgatgttgataatttcag

SEQ ID NO: 5348574 - DNA, 19 bp, Homo sapiens
aatgattaagggacatttc

SEQ ID NO: 5348575 - DNA, 21 bp, Homo sapiens
aatgattaagggacatttcta

SEQ ID NO: 5348576 - DNA, 22 bp, Homo sapiens
aatgattaagggacatttctat

SEQ ID NO: 5348577 - DNA, 16 bp, Homo sapiens
aatgattaatacctga

SEQ ID NO: 5348578 - DNA, 15 bp, Homo sapiens
aatgattaatcaaag

SEQ ID NO: 5348579 - DNA, 17 bp, Homo sapiens
aatgattaatcagctgt

SEQ ID NO: 5348580 - DNA, 19 bp, Homo sapiens
aatgattaatcataaagaa

SEQ ID NO: 5348581 - DNA, 16 bp, Homo sapiens
aatgattaattaaaac

SEQ ID NO: 5348582 - DNA, 16 bp, Homo sapiens
aatgattataatcata

SEQ ID NO: 5348583 - DNA, 16 bp, Homo sapiens
aatgattatatgacaa

SEQ ID NO: 5348584 - DNA, 16 bp, Homo sapiens
aatgattatcttgaaa

SEQ ID NO: 5348585 - DNA, 15 bp, Homo sapiens
aatgattatgaatta

SEQ ID NO: 5348586 - DNA, 21 bp, Homo sapiens
aatgattattttcattacaat

SEQ ID NO: 5348587 - DNA, 19 bp, Homo sapiens
aatgattcaaattgctgct

SEQ ID NO: 5348588 - DNA, 20 bp, Homo sapiens
aatgattcaattaacatata

SEQ ID NO: 5348589 - DNA, 18 bp, Homo sapiens
aatgattcatctttcaga

SEQ ID NO: 5348590 - DNA, 20 bp, Homo sapiens
aatgattgaaaataatgctg

SEQ ID NO: 5348591 - DNA, 12 bp, Homo sapiens
aatgattgcttt

SEQ ID NO: 5348592 - DNA, 16 bp, Homo sapiens
aatgattggtagcaaa

SEQ ID NO: 5348593 - DNA, 17 bp, Homo sapiens
aatgattggttaaaatg

SEQ ID NO: 5348594 - DNA, 20 bp, Homo sapiens
aatgattggttaaaatgtga

SEQ ID NO: 5348595 - DNA, 13 bp, Homo sapiens
aatgattgtaaaa

SEQ ID NO: 5348596 - DNA, 21 bp, Homo sapiens
aatgattgtctaaccaattgt

SEQ ID NO: 5348597 - DNA, 18 bp, Homo sapiens
aatgattgtttaattgta

SEQ ID NO: 5348598 - DNA, 16 bp, Homo sapiens
aatgattgttttagaa

SEQ ID NO: 5348599 - DNA, 21 bp, Homo sapiens
aatgattgttttagaagttaa

SEQ ID NO: 5348600 - DNA, 14 bp, Homo sapiens
aatgatttacatag

SEQ ID NO: 5348601 - DNA, 14 bp, Homo sapiens
aatgatttagtgtt

SEQ ID NO: 5348602 - DNA, 11 bp, Homo sapiens
aatgatttcag

SEQ ID NO: 5348603 - DNA, 20 bp, Homo sapiens
aatgatttcatattgatctt

SEQ ID NO: 5348604 - DNA, 13 bp, Homo sapiens
aatgatttcatgc

SEQ ID NO: 5348605 - DNA, 20 bp, Homo sapiens
aatgatttccaaagagaaaa

SEQ ID NO: 5348606 - DNA, 23 bp, Homo sapiens
aatgatttcctctgtaatctatt

SEQ ID NO: 5348607 - DNA, 18 bp, Homo sapiens
aatgatttggccaggcct

SEQ ID NO: 5348608 - DNA, 14 bp, Homo sapiens
aatgatttgtaaag

SEQ ID NO: 5348609 - DNA, 15 bp, Homo sapiens
aatgatttgtaaagg

SEQ ID NO: 5348610 - DNA, 23 bp, Homo sapiens
aatgatttgtaaaggactattta

SEQ ID NO: 5348611 - DNA, 12 bp, Homo sapiens
aatgatttgtca

SEQ ID NO: 5348612 - DNA, 12 bp, Homo sapiens
aatgatttgtgt

SEQ ID NO: 5348613 - DNA, 22 bp, Homo sapiens
aatgatttgtgtccatttcaag

SEQ ID NO: 5348614 - DNA, 21 bp, Homo sapiens
aatgattttacttagcaatgt

SEQ ID NO: 5348615 - DNA, 16 bp, Homo sapiens
aatgattttcatcaat

SEQ ID NO: 5348616 - DNA, 15 bp, Homo sapiens
aatgatttttgtgta

SEQ ID NO: 5348617 - DNA, 17 bp, Homo sapiens
aatgatttttgtgtatc

SEQ ID NO: 5348618 - DNA, 20 bp, Homo sapiens
aatggcaacaaactgcacat

SEQ ID NO: 5348619 - DNA, 23 bp, Homo sapiens
aatggcaaggcagccctgtctga

SEQ ID NO: 5348620 - DNA, 14 bp, Homo sapiens
aatggcaagttttc

SEQ ID NO: 5348621 - DNA, 17 bp, Homo sapiens
aatggcaagttttccat

SEQ ID NO: 5348622 - DNA, 19 bp, Homo sapiens
aatggcacagcccaaagaa

SEQ ID NO: 5348623 - DNA, 20 bp, Homo sapiens
aatggcacagcccaaagaag

SEQ ID NO: 5348624 - DNA, 13 bp, Homo sapiens
aatggcacctctg

SEQ ID NO: 5348625 - DNA, 21 bp, Homo sapiens
aatggcacctctgcccttccc

SEQ ID NO: 5348626 - DNA, 13 bp, Homo sapiens
aatggcacctgta

SEQ ID NO: 5348627 - DNA, 14 bp, Homo sapiens
aatggcacctgtat

SEQ ID NO: 5348628 - DNA, 19 bp, Homo sapiens
aatggcactgttgcaaact

SEQ ID NO: 5348629 - DNA, 19 bp, Homo sapiens
aatggcagcaggggttggg

SEQ ID NO: 5348630 - DNA, 22 bp, Homo sapiens
aatggcagcattcccaccaaca

SEQ ID NO: 5348631 - DNA, 16 bp, Homo sapiens
aatggcagccttggca

SEQ ID NO: 5348632 - DNA, 17 bp, Homo sapiens
aatggcaggttttacac

SEQ ID NO: 5348633 - DNA, 13 bp, Homo sapiens
aatggcagtattt

SEQ ID NO: 5348634 - DNA, 15 bp, Homo sapiens
aatggcagtatttca

SEQ ID NO: 5348635 - DNA, 21 bp, Homo sapiens
aatggcagtgactccccagcc

SEQ ID NO: 5348636 - DNA, 20 bp, Homo sapiens
aatggcagttatattttgca

SEQ ID NO: 5348637 - DNA, 21 bp, Homo sapiens
aatggcagtttgaagtcaaat

SEQ ID NO: 5348638 - DNA, 21 bp, Homo sapiens
aatggcataacaaaggcaaga

SEQ ID NO: 5348639 - DNA, 22 bp, Homo sapiens
aatggcatcattataagctatg

SEQ ID NO: 5348640 - DNA, 19 bp, Homo sapiens
aatggcatgaaccccaggc

SEQ ID NO: 5348641 - DNA, 16 bp, Homo sapiens
aatggcatggcaggag

SEQ ID NO: 5348642 - DNA, 22 bp, Homo sapiens
aatggcatggcaggagtctctg

SEQ ID NO: 5348643 - DNA, 14 bp, Homo sapiens
aatggcatgtaata

SEQ ID NO: 5348644 - DNA, 13 bp, Homo sapiens
aatggcatttctc

SEQ ID NO: 5348645 - DNA, 22 bp, Homo sapiens
aatggccaaatggtttttgcaa

SEQ ID NO: 5348646 - DNA, 18 bp, Homo sapiens
aatggccagagcctctgg

SEQ ID NO: 5348647 - DNA, 20 bp, Homo sapiens
aatggccagagcctctggcc

SEQ ID NO: 5348648 - DNA, 18 bp, Homo sapiens
aatggccagtgctgcttc

SEQ ID NO: 5348649 - DNA, 19 bp, Homo sapiens
aatggccagtgctgcttct

SEQ ID NO: 5348650 - DNA, 20 bp, Homo sapiens
aatggccagtgctgcttctt

SEQ ID NO: 5348651 - DNA, 15 bp, Homo sapiens
aatggccagttttct

SEQ ID NO: 5348652 - DNA, 10 bp, Homo sapiens
aatggccatg

SEQ ID NO: 5348653 - DNA, 12 bp, Homo sapiens
aatggccatgca

SEQ ID NO: 5348654 - DNA, 14 bp, Homo sapiens
aatggccattttaa

SEQ ID NO: 5348655 - DNA, 21 bp, Homo sapiens
aatggcccggcccctcctgac

SEQ ID NO: 5348656 - DNA, 21 bp, Homo sapiens
aatggccctagaactgtgcct

SEQ ID NO: 5348657 - DNA, 21 bp, Homo sapiens
aatggccctgggtcccaggac

SEQ ID NO: 5348658 - DNA, 15 bp, Homo sapiens
aatggcctcatgtgg

SEQ ID NO: 5348659 - DNA, 13 bp, Homo sapiens
aatggcctcttaa

SEQ ID NO: 5348660 - DNA, 19 bp, Homo sapiens
aatggcctcttaaaaatta

SEQ ID NO: 5348661 - DNA, 14 bp, Homo sapiens
aatggcctgccttg

SEQ ID NO: 5348662 - DNA, 20 bp, Homo sapiens
aatggcctgccttgaagcca

SEQ ID NO: 5348663 - DNA, 14 bp, Homo sapiens
aatggcctggagca

SEQ ID NO: 5348664 - DNA, 18 bp, Homo sapiens
aatggcctggtaggtctg

SEQ ID NO: 5348665 - DNA, 19 bp, Homo sapiens
aatggcctgtccctagggc

SEQ ID NO: 5348666 - DNA, 21 bp, Homo sapiens
aatggcctgtccctagggctc

SEQ ID NO: 5348667 - DNA, 19 bp, Homo sapiens
aatggccttcccgccggag

SEQ ID NO: 5348668 - DNA, 20 bp, Homo sapiens
aatggccttcccgccggagg

SEQ ID NO: 5348669 - DNA, 20 bp, Homo sapiens
aatggcgcagtgcctctggt

SEQ ID NO: 5348670 - DNA, 22 bp, Homo sapiens
aatggcgcctgctccctccaga

SEQ ID NO: 5348671 - DNA, 19 bp, Homo sapiens
aatggcgtgaacccgggag

SEQ ID NO: 5348672 - DNA, 23 bp, Homo sapiens
aatggcgtgaacccgggaggtgg

SEQ ID NO: 5348673 - DNA, 14 bp, Homo sapiens
aatggctaataaac

SEQ ID NO: 5348674 - DNA, 15 bp, Homo sapiens
aatggctaataaact

SEQ ID NO: 5348675 - DNA, 19 bp, Homo sapiens
aatggctaataaactgtat

SEQ ID NO: 5348676 - DNA, 23 bp, Homo sapiens
aatggctaataaactgtattaaa

SEQ ID NO: 5348677 - DNA, 16 bp, Homo sapiens
aatggctaattcccag

SEQ ID NO: 5348678 - DNA, 19 bp, Homo sapiens
aatggctagtactgtattg

SEQ ID NO: 5348679 - DNA, 14 bp, Homo sapiens
aatggctatgtttt

SEQ ID NO: 5348680 - DNA, 20 bp, Homo sapiens
aatggctatttttgaagcaa

SEQ ID NO: 5348681 - DNA, 20 bp, Homo sapiens
aatggctcaagtagaaaagc

SEQ ID NO: 5348682 - DNA, 21 bp, Homo sapiens
aatggctctgggctatatgcc

SEQ ID NO: 5348683 - DNA, 13 bp, Homo sapiens
aatggctgaagaa

SEQ ID NO: 5348684 - DNA, 15 bp, Homo sapiens
aatggctgataattt

SEQ ID NO: 5348685 - DNA, 20 bp, Homo sapiens
aatggctgcacctttttgca

SEQ ID NO: 5348686 - DNA, 13 bp, Homo sapiens
aatggctgcacgt

SEQ ID NO: 5348687 - DNA, 10 bp, Homo sapiens
aatggctgct

SEQ ID NO: 5348688 - DNA, 15 bp, Homo sapiens
aatggctgctttgac

SEQ ID NO: 5348689 - DNA, 15 bp, Homo sapiens
aatggctgggagggg

SEQ ID NO: 5348690 - DNA, 13 bp, Homo sapiens
aatggctgggtca

SEQ ID NO: 5348691 - DNA, 16 bp, Homo sapiens
aatggctgggtttggg

SEQ ID NO: 5348692 - DNA, 22 bp, Homo sapiens
aatggctgggtttgggcagtgg

SEQ ID NO: 5348693 - DNA, 18 bp, Homo sapiens
aatggctgtgccccacct

SEQ ID NO: 5348694 - DNA, 20 bp, Homo sapiens
aatggctgtgccccacctgt

SEQ ID NO: 5348695 - DNA, 17 bp, Homo sapiens
aatggcttagctacttg

SEQ ID NO: 5348696 - DNA, 13 bp, Homo sapiens
aatggcttcagtg

SEQ ID NO: 5348697 - DNA, 23 bp, Homo sapiens
aatggcttcgttaattaatgtca

SEQ ID NO: 5348698 - DNA, 13 bp, Homo sapiens
aatggcttctatg

SEQ ID NO: 5348699 - DNA, 15 bp, Homo sapiens
aatggcttgtctttg

SEQ ID NO: 5348700 - DNA, 18 bp, Homo sapiens
aatggctttggtctcttg

SEQ ID NO: 5348701 - DNA, 13 bp, Homo sapiens
aatggctttgtat

SEQ ID NO: 5348702 - DNA, 14 bp, Homo sapiens
aatggctttgtctt

SEQ ID NO: 5348703 - DNA, 19 bp, Homo sapiens
aatggcttttcccaacccc

SEQ ID NO: 5348704 - DNA, 15 bp, Homo sapiens
aatgggaaaaaactt

SEQ ID NO: 5348705 - DNA, 13 bp, Homo sapiens
aatgggaaaactt

SEQ ID NO: 5348706 - DNA, 14 bp, Homo sapiens
aatgggaaaagaga

SEQ ID NO: 5348707 - DNA, 15 bp, Homo sapiens
aatgggaacatttat

SEQ ID NO: 5348708 - DNA, 12 bp, Homo sapiens
aatgggaagcag

SEQ ID NO: 5348709 - DNA, 21 bp, Homo sapiens
aatgggactgatgtcatcttg

SEQ ID NO: 5348710 - DNA, 22 bp, Homo sapiens
aatgggactggagtcagatgag

SEQ ID NO: 5348711 - DNA, 18 bp, Homo sapiens
aatgggacttcttttcac

SEQ ID NO: 5348712 - DNA, 20 bp, Homo sapiens
aatgggacttcttttcacat

SEQ ID NO: 5348713 - DNA, 23 bp, Homo sapiens
aatgggagaaaacgccagtgtgt

SEQ ID NO: 5348714 - DNA, 17 bp, Homo sapiens
aatgggagaatcagcag

SEQ ID NO: 5348715 - DNA, 19 bp, Homo sapiens
aatgggagacaatttcaca

SEQ ID NO: 5348716 - DNA, 14 bp, Homo sapiens
aatgggagctcatg

SEQ ID NO: 5348717 - DNA, 14 bp, Homo sapiens
aatgggagggggct

SEQ ID NO: 5348718 - DNA, 16 bp, Homo sapiens
aatgggagtctgaaat

SEQ ID NO: 5348719 - DNA, 19 bp, Homo sapiens
aatgggagtgaacatttct

SEQ ID NO: 5348720 - DNA, 17 bp, Homo sapiens
aatgggatattttgaaa

SEQ ID NO: 5348721 - DNA, 15 bp, Homo sapiens
aatgggattgtgtta

SEQ ID NO: 5348722 - DNA, 22 bp, Homo sapiens
aatgggattttctagtttcctg

SEQ ID NO: 5348723 - DNA, 19 bp, Homo sapiens
aatgggcagctccatcctc

SEQ ID NO: 5348724 - DNA, 11 bp, Homo sapiens
aatgggcaggt

SEQ ID NO: 5348725 - DNA, 17 bp, Homo sapiens
aatgggcagttctccca

SEQ ID NO: 5348726 - DNA, 19 bp, Homo sapiens
aatgggcagttctcccagg

SEQ ID NO: 5348727 - DNA, 23 bp, Homo sapiens
aatgggccactgtaggggttggg

SEQ ID NO: 5348728 - DNA, 16 bp, Homo sapiens
aatgggcctcagcccc

SEQ ID NO: 5348729 - DNA, 15 bp, Homo sapiens
aatgggcctgcctgc

SEQ ID NO: 5348730 - DNA, 22 bp, Homo sapiens
aatgggcctgcctgcctccacc

SEQ ID NO: 5348731 - DNA, 21 bp, Homo sapiens
aatgggcgcccccccctcccc

SEQ ID NO: 5348732 - DNA, 14 bp, Homo sapiens
aatgggctcaaact

SEQ ID NO: 5348733 - DNA, 16 bp, Homo sapiens
aatgggctcaaccaga

SEQ ID NO: 5348734 - DNA, 21 bp, Homo sapiens
aatgggctgcaaaatgaagac

SEQ ID NO: 5348735 - DNA, 18 bp, Homo sapiens
aatgggctgctgtcattt

SEQ ID NO: 5348736 - DNA, 18 bp, Homo sapiens
aatggggaactctccctc

SEQ ID NO: 5348737 - DNA, 22 bp, Homo sapiens
aatggggaagggagtctctctt

SEQ ID NO: 5348738 - DNA, 17 bp, Homo sapiens
aatggggactctccagg

SEQ ID NO: 5348739 - DNA, 15 bp, Homo sapiens
aatggggagaggcaa

SEQ ID NO: 5348740 - DNA, 13 bp, Homo sapiens
aatggggagctgg

SEQ ID NO: 5348741 - DNA, 20 bp, Homo sapiens
aatggggataataatactga

SEQ ID NO: 5348742 - DNA, 15 bp, Homo sapiens
aatggggattattat

SEQ ID NO: 5348743 - DNA, 13 bp, Homo sapiens
aatggggccagat

SEQ ID NO: 5348744 - DNA, 21 bp, Homo sapiens
aatggggcttgccctgggtca

SEQ ID NO: 5348745 - DNA, 13 bp, Homo sapiens
aatgggggaggcc

SEQ ID NO: 5348746 - DNA, 22 bp, Homo sapiens
aatgggggcaggaaagccacat

SEQ ID NO: 5348747 - DNA, 22 bp, Homo sapiens
aatgggggcagtctccccttcc

SEQ ID NO: 5348748 - DNA, 23 bp, Homo sapiens
aatgggggcagtctccccttcct

SEQ ID NO: 5348749 - DNA, 21 bp, Homo sapiens
aatggggggcgggccagggtg

SEQ ID NO: 5348750 - DNA, 23 bp, Homo sapiens
aatggggggcgggccagggtggg

SEQ ID NO: 5348751 - DNA, 19 bp, Homo sapiens
aatgggggtatcctgtgca

SEQ ID NO: 5348752 - DNA, 14 bp, Homo sapiens
aatgggggtcagaa

SEQ ID NO: 5348753 - DNA, 18 bp, Homo sapiens
aatgggtaaataaatgct

SEQ ID NO: 5348754 - DNA, 22 bp, Homo sapiens
aatgggtaaataaatgctgctt

SEQ ID NO: 5348755 - DNA, 12 bp, Homo sapiens
aatgggtaatat

SEQ ID NO: 5348756 - DNA, 22 bp, Homo sapiens
aatgggtatacctctaactgtg

SEQ ID NO: 5348757 - DNA, 24 bp, Homo sapiens
aatgggtatacctctaactgtgca

SEQ ID NO: 5348758 - DNA, 16 bp, Homo sapiens
aatgggtatattgata

SEQ ID NO: 5348759 - DNA, 16 bp, Homo sapiens
aatgggtatctatatt

SEQ ID NO: 5348760 - DNA, 13 bp, Homo sapiens
aatgggtctttta

SEQ ID NO: 5348761 - DNA, 13 bp, Homo sapiens
aatgggtgatatg

SEQ ID NO: 5348762 - DNA, 18 bp, Homo sapiens
aatgggtgtatataattt

SEQ ID NO: 5348763 - DNA, 20 bp, Homo sapiens
aatgggtgtatataatttta

SEQ ID NO: 5348764 - DNA, 21 bp, Homo sapiens
aatgggttatctcaaatttta

SEQ ID NO: 5348765 - DNA, 22 bp, Homo sapiens
aatgggttatctcaaattttaa

SEQ ID NO: 5348766 - DNA, 13 bp, Homo sapiens
aatgggtttactc

SEQ ID NO: 5348767 - DNA, 20 bp, Homo sapiens
aatggtaaaataaaatgcct

SEQ ID NO: 5348768 - DNA, 13 bp, Homo sapiens
aatggtaaatctt

SEQ ID NO: 5348769 - DNA, 22 bp, Homo sapiens
aatggtaactgcacctgggcag

SEQ ID NO: 5348770 - DNA, 17 bp, Homo sapiens
aatggtaacttttgtag

SEQ ID NO: 5348771 - DNA, 22 bp, Homo sapiens
aatggtaacttttgtagtctta

SEQ ID NO: 5348772 - DNA, 13 bp, Homo sapiens
aatggtaatagaa

SEQ ID NO: 5348773 - DNA, 14 bp, Homo sapiens
aatggtaatagaat

SEQ ID NO: 5348774 - DNA, 17 bp, Homo sapiens
aatggtaatagaatagc

SEQ ID NO: 5348775 - DNA, 21 bp, Homo sapiens
aatggtaatagaatagcacag

SEQ ID NO: 5348776 - DNA, 19 bp, Homo sapiens
aatggtaatttagtgtata

SEQ ID NO: 5348777 - DNA, 22 bp, Homo sapiens
aatggtacaaaaccacagtgta

SEQ ID NO: 5348778 - DNA, 20 bp, Homo sapiens
aatggtactccacatatttc

SEQ ID NO: 5348779 - DNA, 18 bp, Homo sapiens
aatggtactcccaaactg

SEQ ID NO: 5348780 - DNA, 21 bp, Homo sapiens
aatggtagattcgctgtcccc

SEQ ID NO: 5348781 - DNA, 14 bp, Homo sapiens
aatggtagcatttt

SEQ ID NO: 5348782 - DNA, 19 bp, Homo sapiens
aatggtagcattttaaaca

SEQ ID NO: 5348783 - DNA, 21 bp, Homo sapiens
aatggtagcattttaaacaaa

SEQ ID NO: 5348784 - DNA, 20 bp, Homo sapiens
aatggtagctctgaagggag

SEQ ID NO: 5348785 - DNA, 16 bp, Homo sapiens
aatggtagctgaaaaa

SEQ ID NO: 5348786 - DNA, 20 bp, Homo sapiens
aatggtaggtcaagtaataa

SEQ ID NO: 5348787 - DNA, 13 bp, Homo sapiens
aatggtagtttct

SEQ ID NO: 5348788 - DNA, 12 bp, Homo sapiens
aatggtataaaa

SEQ ID NO: 5348789 - DNA, 17 bp, Homo sapiens
aatggtataaaaggttg

SEQ ID NO: 5348790 - DNA, 20 bp, Homo sapiens
aatggtataaaaggttgcca

SEQ ID NO: 5348791 - DNA, 17 bp, Homo sapiens
aatggtatcatttggaa

SEQ ID NO: 5348792 - DNA, 14 bp, Homo sapiens
aatggtatctgtta

SEQ ID NO: 5348793 - DNA, 16 bp, Homo sapiens
aatggtatggaactct

SEQ ID NO: 5348794 - DNA, 16 bp, Homo sapiens
aatggtattttctaga

SEQ ID NO: 5348795 - DNA, 17 bp, Homo sapiens
aatgtcagtgtgactga

SEQ ID NO: 5348796 - DNA, 21 bp, Homo sapiens
aatgtcagtgtgactgatctc

SEQ ID NO: 5348797 - DNA, 12 bp, Homo sapiens
aatgtcagtgtt

SEQ ID NO: 5348798 - DNA, 18 bp, Homo sapiens
aatgtcagttctgatatg

SEQ ID NO: 5348799 - DNA, 19 bp, Homo sapiens
aatgtcagttgttatttat

SEQ ID NO: 5348800 - DNA, 20 bp, Homo sapiens
aatgtcagttgttatttatt

SEQ ID NO: 5348801 - DNA, 13 bp, Homo sapiens
aatgtcataaatt

SEQ ID NO: 5348802 - DNA, 15 bp, Homo sapiens
aatgtcataacaggc

SEQ ID NO: 5348803 - DNA, 18 bp, Homo sapiens
aatgtcatatactgccat

SEQ ID NO: 5348804 - DNA, 19 bp, Homo sapiens
aatgtcatatactgccatg

SEQ ID NO: 5348805 - DNA, 14 bp, Homo sapiens
aatgtcatcaaata

SEQ ID NO: 5348806 - DNA, 12 bp, Homo sapiens
aatgtcatctct

SEQ ID NO: 5348807 - DNA, 15 bp, Homo sapiens
aatgtcatgctgcct

SEQ ID NO: 5348808 - DNA, 19 bp, Homo sapiens
aatgtcatgctgccttatt

SEQ ID NO: 5348809 - DNA, 17 bp, Homo sapiens
aatgtcattatgtagaa

SEQ ID NO: 5348810 - DNA, 18 bp, Homo sapiens
aatgtcattatgtagaaa

SEQ ID NO: 5348811 - DNA, 20 bp, Homo sapiens
aatgtcattatttgataaca

SEQ ID NO: 5348812 - DNA, 22 bp, Homo sapiens
aatgtcattatttgataacatt

SEQ ID NO: 5348813 - DNA, 14 bp, Homo sapiens
aatgtcattgaaaa

SEQ ID NO: 5348814 - DNA, 14 bp, Homo sapiens
aatgtcattgctaa

SEQ ID NO: 5348815 - DNA, 15 bp, Homo sapiens
aatgtcattgctaaa

SEQ ID NO: 5348816 - DNA, 16 bp, Homo sapiens
aatgtcattgctaaaa

SEQ ID NO: 5348817 - DNA, 14 bp, Homo sapiens
aatgtcattgtcta

SEQ ID NO: 5348818 - DNA, 14 bp, Homo sapiens
aatgtcatttgcta

SEQ ID NO: 5348819 - DNA, 15 bp, Homo sapiens
aatgtcatttgctaa

SEQ ID NO: 5348820 - DNA, 21 bp, Homo sapiens
aatgtcatttgctaatgaatt

SEQ ID NO: 5348821 - DNA, 23 bp, Homo sapiens
aatgtcatttgctaatgaatttt

SEQ ID NO: 5348822 - DNA, 19 bp, Homo sapiens
aatgtcattttggtacttt

SEQ ID NO: 5348823 - DNA, 14 bp, Homo sapiens
aatgtccaaaatgt

SEQ ID NO: 5348824 - DNA, 20 bp, Homo sapiens
aatgtccacttaaaatacat

SEQ ID NO: 5348825 - DNA, 16 bp, Homo sapiens
aatgtccagccacccc

SEQ ID NO: 5348826 - DNA, 12 bp, Homo sapiens
aatgtccagctt

SEQ ID NO: 5348827 - DNA, 17 bp, Homo sapiens
aatgtccagtaagatca

SEQ ID NO: 5348828 - DNA, 19 bp, Homo sapiens
aatgtccagtaagatcact

SEQ ID NO: 5348829 - DNA, 21 bp, Homo sapiens
aatgtcccaaataaatttata

SEQ ID NO: 5348830 - DNA, 14 bp, Homo sapiens
aatgtccccactcc

SEQ ID NO: 5348831 - DNA, 16 bp, Homo sapiens
aatgtccccactcccg

SEQ ID NO: 5348832 - DNA, 16 bp, Homo sapiens
aatgtccccattctat

SEQ ID NO: 5348833 - DNA, 19 bp, Homo sapiens
aatgtccccattctataaa

SEQ ID NO: 5348834 - DNA, 23 bp, Homo sapiens
aatgtcccccacctcttttccta

SEQ ID NO: 5348835 - DNA, 15 bp, Homo sapiens
aatgtccccctcacc

SEQ ID NO: 5348836 - DNA, 20 bp, Homo sapiens
aatgtcccctcaaactcatt

SEQ ID NO: 5348837 - DNA, 23 bp, Homo sapiens
aatgtcctcagagggtccctagg

SEQ ID NO: 5348838 - DNA, 21 bp, Homo sapiens
aatgtcctccagaagcctctg

SEQ ID NO: 5348839 - DNA, 14 bp, Homo sapiens
aatgtcctgtagag

SEQ ID NO: 5348840 - DNA, 17 bp, Homo sapiens
aatgtcgaaacctacaa

SEQ ID NO: 5348841 - DNA, 17 bp, Homo sapiens
aatgtcgaactcttctt

SEQ ID NO: 5348842 - DNA, 18 bp, Homo sapiens
aatgtcgagtatattatt

SEQ ID NO: 5348843 - DNA, 20 bp, Homo sapiens
aatgtcgagtatattattat

SEQ ID NO: 5348844 - DNA, 21 bp, Homo sapiens
aatgtcgatcaagagaatcaa

SEQ ID NO: 5348845 - DNA, 19 bp, Homo sapiens
aatgtcgcagactcctcca

SEQ ID NO: 5348846 - DNA, 12 bp, Homo sapiens
aatgtctaaatg

SEQ ID NO: 5348847 - DNA, 18 bp, Homo sapiens
aatgtctaaatgctgaaa

SEQ ID NO: 5348848 - DNA, 17 bp, Homo sapiens
aatgtctaacttaaata

SEQ ID NO: 5348849 - DNA, 19 bp, Homo sapiens
aatgtctaatgtattttat

SEQ ID NO: 5348850 - DNA, 16 bp, Homo sapiens
aatgtctagattttga

SEQ ID NO: 5348851 - DNA, 19 bp, Homo sapiens
aatgtctagattttgaaaa

SEQ ID NO: 5348852 - DNA, 18 bp, Homo sapiens
aatgtctaggataatttt

SEQ ID NO: 5348853 - DNA, 16 bp, Homo sapiens
aatgtctataaatggt

SEQ ID NO: 5348854 - DNA, 16 bp, Homo sapiens
aatgtctatagagaaa

SEQ ID NO: 5348855 - DNA, 14 bp, Homo sapiens
aatgtctattttct

SEQ ID NO: 5348856 - DNA, 15 bp, Homo sapiens
aatgtctcaaaataa

SEQ ID NO: 5348857 - DNA, 21 bp, Homo sapiens
aatgtctcaagtgcaatgccc

SEQ ID NO: 5348858 - DNA, 19 bp, Homo sapiens
aatgtctcaatggtgctat

SEQ ID NO: 5348859 - DNA, 15 bp, Homo sapiens
aatgtctcactgttc

SEQ ID NO: 5348860 - DNA, 21 bp, Homo sapiens
aatgtctcactttactttcaa

SEQ ID NO: 5348861 - DNA, 20 bp, Homo sapiens
aatgtctcagcgaggtgtaa

SEQ ID NO: 5348862 - DNA, 22 bp, Homo sapiens
aatgtctccattgttaaatgtt

SEQ ID NO: 5348863 - DNA, 19 bp, Homo sapiens
aatgtctcccacacccacc

SEQ ID NO: 5348864 - DNA, 21 bp, Homo sapiens
aatgtctcccacacccaccct

SEQ ID NO: 5348865 - DNA, 13 bp, Homo sapiens
aatgtctcctccc

SEQ ID NO: 5348866 - DNA, 12 bp, Homo sapiens
aatgtctctgct

SEQ ID NO: 5348867 - DNA, 15 bp, Homo sapiens
aatgtctctgctcct

SEQ ID NO: 5348868 - DNA, 20 bp, Homo sapiens
aatgtctcttcctctgttct

SEQ ID NO: 5348869 - DNA, 20 bp, Homo sapiens
aatgtctgaagtacaaacat

SEQ ID NO: 5348870 - DNA, 22 bp, Homo sapiens
aatgtctgaagtacaaacatga

SEQ ID NO: 5348871 - DNA, 18 bp, Homo sapiens
aatgtctgacacattaat

SEQ ID NO: 5348872 - DNA, 12 bp, Homo sapiens
aatgtctgctgg

SEQ ID NO: 5348873 - DNA, 22 bp, Homo sapiens
aatgtctgctggtatttctaat

SEQ ID NO: 5348874 - DNA, 13 bp, Homo sapiens
aatgtctggagac

SEQ ID NO: 5348875 - DNA, 13 bp, Homo sapiens
aatgtctggagtg

SEQ ID NO: 5348876 - DNA, 19 bp, Homo sapiens
aatgtctggagtggtaaca

SEQ ID NO: 5348877 - DNA, 16 bp, Homo sapiens
aatgtctggtgtttgt

SEQ ID NO: 5348878 - DNA, 14 bp, Homo sapiens
aatgtctgtaaata

SEQ ID NO: 5348879 - DNA, 19 bp, Homo sapiens
aatgtctgtaataatagac

SEQ ID NO: 5348880 - DNA, 23 bp, Homo sapiens
aatgtctgtagctcctcaactca

SEQ ID NO: 5348881 - DNA, 17 bp, Homo sapiens
aatgtctgttaacttaa

SEQ ID NO: 5348882 - DNA, 13 bp, Homo sapiens
aatgtctgttgaa

SEQ ID NO: 5348883 - DNA, 13 bp, Homo sapiens
aatgtctgttttc

SEQ ID NO: 5348884 - DNA, 14 bp, Homo sapiens
aatgtctgttttcc

SEQ ID NO: 5348885 - DNA, 18 bp, Homo sapiens
aatgtcttaaataaaact

SEQ ID NO: 5348886 - DNA, 23 bp, Homo sapiens
aatgtcttaaataaaactattta

SEQ ID NO: 5348887 - DNA, 18 bp, Homo sapiens
aatgtcttaatttttgaa

SEQ ID NO: 5348888 - DNA, 19 bp, Homo sapiens
aatgtcttaggtcaggagt

SEQ ID NO: 5348889 - DNA, 15 bp, Homo sapiens
aatgtcttcaaggct

SEQ ID NO: 5348890 - DNA, 18 bp, Homo sapiens
aatgtcttcaaggcttca

SEQ ID NO: 5348891 - DNA, 15 bp, Homo sapiens
aatgtcttcttgaaa

SEQ ID NO: 5348892 - DNA, 14 bp, Homo sapiens
aatgtcttgagctc

SEQ ID NO: 5348893 - DNA, 20 bp, Homo sapiens
aatgtcttgatgcatgcact

SEQ ID NO: 5348894 - DNA, 17 bp, Homo sapiens
aatgtcttgctgttgac

SEQ ID NO: 5348895 - DNA, 19 bp, Homo sapiens
aatgtcttgctgttgacat

SEQ ID NO: 5348896 - DNA, 12 bp, Homo sapiens
aatgtcttgtgt

SEQ ID NO: 5348897 - DNA, 21 bp, Homo sapiens
aatgtcttgtgtatttctctg

SEQ ID NO: 5348898 - DNA, 17 bp, Homo sapiens
aatgtcttgttaatatt

SEQ ID NO: 5348899 - DNA, 21 bp, Homo sapiens
aatgtctttaatgcaatatac

SEQ ID NO: 5348900 - DNA, 15 bp, Homo sapiens
aatgtctttccaaat

SEQ ID NO: 5348901 - DNA, 23 bp, Homo sapiens
aatgtctttccaaattatttctt

SEQ ID NO: 5348902 - DNA, 15 bp, Homo sapiens
aatgtctttgtgttt

SEQ ID NO: 5348903 - DNA, 18 bp, Homo sapiens
aatgtcttttcaaaagga

SEQ ID NO: 5348904 - DNA, 15 bp, Homo sapiens
aatgtcttttgaata

SEQ ID NO: 5348905 - DNA, 18 bp, Homo sapiens
aatgtgaaaaaaattatt

SEQ ID NO: 5348906 - DNA, 19 bp, Homo sapiens
aatgtgaaaaaaattattc

SEQ ID NO: 5348907 - DNA, 14 bp, Homo sapiens
aatgtgaaaagtat

SEQ ID NO: 5348908 - DNA, 15 bp, Homo sapiens
aatgtgaaaagtatc

SEQ ID NO: 5348909 - DNA, 17 bp, Homo sapiens
aatgtgaaacacatgcc

SEQ ID NO: 5348910 - DNA, 15 bp, Homo sapiens
aatgtgaaactggat

SEQ ID NO: 5348911 - DNA, 13 bp, Homo sapiens
aatgtgaaagcac

SEQ ID NO: 5348912 - DNA, 17 bp, Homo sapiens
aatgtgaaatctcagaa

SEQ ID NO: 5348913 - DNA, 13 bp, Homo sapiens
aatgtgaaatgct

SEQ ID NO: 5348914 - DNA, 19 bp, Homo sapiens
aatgtgaaatttaaataat

SEQ ID NO: 5348915 - DNA, 20 bp, Homo sapiens
aatgtgaaatttaaataata

SEQ ID NO: 5348916 - DNA, 19 bp, Homo sapiens
aatgtgaactagctggaat

SEQ ID NO: 5348917 - DNA, 21 bp, Homo sapiens
aatgtgaactctcccctcccc

SEQ ID NO: 5348918 - DNA, 13 bp, Homo sapiens
aatgtgaactgtg

SEQ ID NO: 5348919 - DNA, 15 bp, Homo sapiens
aatgtgaacttgtag

SEQ ID NO: 5348920 - DNA, 20 bp, Homo sapiens
aatgtgaataatggcactga

SEQ ID NO: 5348921 - DNA, 23 bp, Homo sapiens
aatgtgaatcagaccctacccca

SEQ ID NO: 5348922 - DNA, 19 bp, Homo sapiens
aatgtgaatcgcagctgtg

SEQ ID NO: 5348923 - DNA, 12 bp, Homo sapiens
aatgtgaatttt

SEQ ID NO: 5348924 - DNA, 13 bp, Homo sapiens
aatgtgacaacat

SEQ ID NO: 5348925 - DNA, 17 bp, Homo sapiens
aatgtgaccaggggtga

SEQ ID NO: 5348926 - DNA, 15 bp, Homo sapiens
aatgtgaccctccaa

SEQ ID NO: 5348927 - DNA, 18 bp, Homo sapiens
aatgtgactaccgtgcca

SEQ ID NO: 5348928 - DNA, 22 bp, Homo sapiens
aatgtgactaccgtgccagcag

SEQ ID NO: 5348929 - DNA, 18 bp, Homo sapiens
aatgtgagacagcaagtt

SEQ ID NO: 5348930 - DNA, 18 bp, Homo sapiens
aatgtgaggcaataagaa

SEQ ID NO: 5348931 - DNA, 19 bp, Homo sapiens
aatgtgagggtttgtaatg

SEQ ID NO: 5348932 - DNA, 21 bp, Homo sapiens
aatgtgagggtttgtaatggt

SEQ ID NO: 5348933 - DNA, 22 bp, Homo sapiens
aatgtgagggtttgtaatggtg

SEQ ID NO: 5348934 - DNA, 22 bp, Homo sapiens
aatgtgagtagttactaaaatt

SEQ ID NO: 5348935 - DNA, 23 bp, Homo sapiens
aatgtgagtggttgaatatgatt

SEQ ID NO: 5348936 - DNA, 17 bp, Homo sapiens
aatgtgagtgtgtttgt

SEQ ID NO: 5348937 - DNA, 11 bp, Homo sapiens
aatgtgatatg

SEQ ID NO: 5348938 - DNA, 19 bp, Homo sapiens
aatgtgatatgtgtaatat

SEQ ID NO: 5348939 - DNA, 21 bp, Homo sapiens
aatgtgatatgtgtaatatca

SEQ ID NO: 5348940 - DNA, 16 bp, Homo sapiens
aatgtgatattataca

SEQ ID NO: 5348941 - DNA, 20 bp, Homo sapiens
aatgtgatcctaaaattgtt

SEQ ID NO: 5348942 - DNA, 23 bp, Homo sapiens
aatgtgatcctgccttgctgtga

SEQ ID NO: 5348943 - DNA, 18 bp, Homo sapiens
aatgtgatgatgtaattg

SEQ ID NO: 5348944 - DNA, 20 bp, Homo sapiens
aatgtgatgatgtaattgac

SEQ ID NO: 5348945 - DNA, 22 bp, Homo sapiens
aatgtgatggatggcacaatga

SEQ ID NO: 5348946 - DNA, 17 bp, Homo sapiens
aatgtgattactgctct

SEQ ID NO: 5348947 - DNA, 17 bp, Homo sapiens
aatgtgattccttttga

SEQ ID NO: 5348948 - DNA, 17 bp, Homo sapiens
aatgtgattcttctaaa

SEQ ID NO: 5348949 - DNA, 21 bp, Homo sapiens
aatgtgatttataacgcacaa

SEQ ID NO: 5348950 - DNA, 14 bp, Homo sapiens
aatgtgcaataact

SEQ ID NO: 5348951 - DNA, 17 bp, Homo sapiens
aatgtgcaatagaaggt

SEQ ID NO: 5348952 - DNA, 20 bp, Homo sapiens
aatgtgcagaaaatatttaa

SEQ ID NO: 5348953 - DNA, 16 bp, Homo sapiens
aatgtgcagggatatt

SEQ ID NO: 5348954 - DNA, 22 bp, Homo sapiens
aatgtgcaggtttgttacatag

SEQ ID NO: 5348955 - DNA, 10 bp, Homo sapiens
aatgtgcagt

SEQ ID NO: 5348956 - DNA, 17 bp, Homo sapiens
aatgtgcagtgtcttgt

SEQ ID NO: 5348957 - DNA, 24 bp, Homo sapiens
aatgtgcattcttttaaaagacaa

SEQ ID NO: 5348958 - DNA, 12 bp, Homo sapiens
aatgtgccaaaa

SEQ ID NO: 5348959 - DNA, 17 bp, Homo sapiens
aatgtgccacagaggcc

SEQ ID NO: 5348960 - DNA, 23 bp, Homo sapiens
aatgtgccacagaggccccacct

SEQ ID NO: 5348961 - DNA, 13 bp, Homo sapiens
aatgtgccacctg

SEQ ID NO: 5348962 - DNA, 18 bp, Homo sapiens
aatgtgccacctgtccgg

SEQ ID NO: 5348963 - DNA, 21 bp, Homo sapiens
aatgtgcccttttggccgggc

SEQ ID NO: 5348964 - DNA, 22 bp, Homo sapiens
aatgtgccgtctttggttcctc

SEQ ID NO: 5348965 - DNA, 20 bp, Homo sapiens
aatgtgcctaatggagaaga

SEQ ID NO: 5348966 - DNA, 17 bp, Homo sapiens
aatgtgcctagttcttt

SEQ ID NO: 5348967 - DNA, 19 bp, Homo sapiens
aatgtgcctctcagtatct

SEQ ID NO: 5348968 - DNA, 15 bp, Homo sapiens
aatgtgccttgattg

SEQ ID NO: 5348969 - DNA, 19 bp, Homo sapiens
aatgtgctactgattgttt

SEQ ID NO: 5348970 - DNA, 23 bp, Homo sapiens
aatgtgctagagttaaaagttag

SEQ ID NO: 5348971 - DNA, 21 bp, Homo sapiens
aatgtgctcaaattactaatg

SEQ ID NO: 5348972 - DNA, 19 bp, Homo sapiens
aattaaaattgtgcataat

SEQ ID NO: 5348973 - DNA, 16 bp, Homo sapiens
aattaaaatttaacat

SEQ ID NO: 5348974 - DNA, 18 bp, Homo sapiens
aattaaaatttaacatct

SEQ ID NO: 5348975 - DNA, 13 bp, Homo sapiens
aattaaaatttat

SEQ ID NO: 5348976 - DNA, 14 bp, Homo sapiens
aattaaacattttt

SEQ ID NO: 5348977 - DNA, 13 bp, Homo sapiens
aattaaacggatt

SEQ ID NO: 5348978 - DNA, 16 bp, Homo sapiens
aattaaacggattatt

SEQ ID NO: 5348979 - DNA, 22 bp, Homo sapiens
aattaaacggattattttttca

SEQ ID NO: 5348980 - DNA, 14 bp, Homo sapiens
aattaaactaaaga

SEQ ID NO: 5348981 - DNA, 19 bp, Homo sapiens
aattaaactacagaatatt

SEQ ID NO: 5348982 - DNA, 21 bp, Homo sapiens
aattaaacttccaaagaaagt

SEQ ID NO: 5348983 - DNA, 14 bp, Homo sapiens
aattaaagaaaata

SEQ ID NO: 5348984 - DNA, 18 bp, Homo sapiens
aattaaagaaaataaaat

SEQ ID NO: 5348985 - DNA, 12 bp, Homo sapiens
aattaaagaaat

SEQ ID NO: 5348986 - DNA, 15 bp, Homo sapiens
aattaaagatgccat

SEQ ID NO: 5348987 - DNA, 17 bp, Homo sapiens
aattaaagatgccatag

SEQ ID NO: 5348988 - DNA, 21 bp, Homo sapiens
aattaaagatgccatagcata

SEQ ID NO: 5348989 - DNA, 23 bp, Homo sapiens
aattaaagatgccatagcataat

SEQ ID NO: 5348990 - DNA, 12 bp, Homo sapiens
aattaaagcaaa

SEQ ID NO: 5348991 - DNA, 13 bp, Homo sapiens
aattaaagcagca

SEQ ID NO: 5348992 - DNA, 14 bp, Homo sapiens
aattaaagcagcaa

SEQ ID NO: 5348993 - DNA, 22 bp, Homo sapiens
aattaaagccttaagcacaatt

SEQ ID NO: 5348994 - DNA, 13 bp, Homo sapiens
aattaaagctgcc

SEQ ID NO: 5348995 - DNA, 19 bp, Homo sapiens
aattaaagcttaaactgaa

SEQ ID NO: 5348996 - DNA, 17 bp, Homo sapiens
aattaaagtatgcaaaa

SEQ ID NO: 5348997 - DNA, 13 bp, Homo sapiens
aattaaagtctac

SEQ ID NO: 5348998 - DNA, 22 bp, Homo sapiens
aattaaagtctacactgccttt

SEQ ID NO: 5348999 - DNA, 18 bp, Homo sapiens
aattaaagtctattcaaa

SEQ ID NO: 5349000 - DNA, 16 bp, Homo sapiens
aattaaagtgctgttt

SEQ ID NO: 5349001 - DNA, 20 bp, Homo sapiens
aattaaagtgtccattgaca

SEQ ID NO: 5349002 - DNA, 17 bp, Homo sapiens
aattaaataaaataacc

SEQ ID NO: 5349003 - DNA, 16 bp, Homo sapiens
aattaaataaactgtt

SEQ ID NO: 5349004 - DNA, 15 bp, Homo sapiens
aattaaataaatgaa

SEQ ID NO: 5349005 - DNA, 17 bp, Homo sapiens
aattaaataaatgaata

SEQ ID NO: 5349006 - DNA, 14 bp, Homo sapiens
aattaaataaattt

SEQ ID NO: 5349007 - DNA, 16 bp, Homo sapiens
aattaaataaatttta

SEQ ID NO: 5349008 - DNA, 13 bp, Homo sapiens
aattaaataatac

SEQ ID NO: 5349009 - DNA, 22 bp, Homo sapiens
aattaaataattttacatgtct

SEQ ID NO: 5349010 - DNA, 15 bp, Homo sapiens
aattaaatatatata

SEQ ID NO: 5349011 - DNA, 20 bp, Homo sapiens
aattaaatccaactttcaca

SEQ ID NO: 5349012 - DNA, 16 bp, Homo sapiens
aattaaatctctttaa

SEQ ID NO: 5349013 - DNA, 18 bp, Homo sapiens
aattaaatctctttaaga

SEQ ID NO: 5349014 - DNA, 17 bp, Homo sapiens
aattaaatgccttgtat

SEQ ID NO: 5349015 - DNA, 12 bp, Homo sapiens
aattaaatgtag

SEQ ID NO: 5349016 - DNA, 14 bp, Homo sapiens
aattaaatgtattt

SEQ ID NO: 5349017 - DNA, 20 bp, Homo sapiens
aattaaattcttattggcca

SEQ ID NO: 5349018 - DNA, 11 bp, Homo sapiens
aattaaatttt

SEQ ID NO: 5349019 - DNA, 14 bp, Homo sapiens
aattaaattttgag

SEQ ID NO: 5349020 - DNA, 18 bp, Homo sapiens
aattaaattttgtgtctc

SEQ ID NO: 5349021 - DNA, 12 bp, Homo sapiens
aattaaattttt

SEQ ID NO: 5349022 - DNA, 23 bp, Homo sapiens
aattaacaaagtgtcactccata

SEQ ID NO: 5349023 - DNA, 17 bp, Homo sapiens
aattaacacagtgtttc

SEQ ID NO: 5349024 - DNA, 18 bp, Homo sapiens
aattaacacagtgtttca

SEQ ID NO: 5349025 - DNA, 19 bp, Homo sapiens
aattaacacagtgtttcaa

SEQ ID NO: 5349026 - DNA, 15 bp, Homo sapiens
aattaacatataata

SEQ ID NO: 5349027 - DNA, 21 bp, Homo sapiens
aattaacatataatatatgtt

SEQ ID NO: 5349028 - DNA, 14 bp, Homo sapiens
aattaacatatcaa

SEQ ID NO: 5349029 - DNA, 19 bp, Homo sapiens
aattaacatgaatatttag

SEQ ID NO: 5349030 - DNA, 12 bp, Homo sapiens
aattaacattat

SEQ ID NO: 5349031 - DNA, 16 bp, Homo sapiens
aattaaccattgctaa

SEQ ID NO: 5349032 - DNA, 19 bp, Homo sapiens
aattaaccattgctaattt

SEQ ID NO: 5349033 - DNA, 15 bp, Homo sapiens
aattaacctggtgct

SEQ ID NO: 5349034 - DNA, 18 bp, Homo sapiens
aattaacctggtgctgga

SEQ ID NO: 5349035 - DNA, 23 bp, Homo sapiens
aattaacctttcaggaaagtatc

SEQ ID NO: 5349036 - DNA, 19 bp, Homo sapiens
aattaactatcatcagtcc

SEQ ID NO: 5349037 - DNA, 20 bp, Homo sapiens
aattaactatgtgatgttaa

SEQ ID NO: 5349038 - DNA, 21 bp, Homo sapiens
aattaactgctaacttctatt

SEQ ID NO: 5349039 - DNA, 20 bp, Homo sapiens
aattaactgctccaaattta

SEQ ID NO: 5349040 - DNA, 22 bp, Homo sapiens
aattaactgggtaatgaaacaa

SEQ ID NO: 5349041 - DNA, 11 bp, Homo sapiens
aattaactgta

SEQ ID NO: 5349042 - DNA, 18 bp, Homo sapiens
aattaacttaactgaaga

SEQ ID NO: 5349043 - DNA, 17 bp, Homo sapiens
aattaacttacttccaa

SEQ ID NO: 5349044 - DNA, 15 bp, Homo sapiens
aattaacttgagttt

SEQ ID NO: 5349045 - DNA, 15 bp, Homo sapiens
aattaacttttaaat

SEQ ID NO: 5349046 - DNA, 16 bp, Homo sapiens
aattaacttttataaa

SEQ ID NO: 5349047 - DNA, 20 bp, Homo sapiens
aattaacttttataaacttt

SEQ ID NO: 5349048 - DNA, 22 bp, Homo sapiens
aattaacttttataaactttac

SEQ ID NO: 5349049 - DNA, 12 bp, Homo sapiens
aattaagaaaga

SEQ ID NO: 5349050 - DNA, 19 bp, Homo sapiens
aattaagaaagattaaata

SEQ ID NO: 5349051 - DNA, 20 bp, Homo sapiens
aattaagaaaggataaagtt

SEQ ID NO: 5349052 - DNA, 16 bp, Homo sapiens
aattaagaaattccat

SEQ ID NO: 5349053 - DNA, 13 bp, Homo sapiens
aattaagaaggca

SEQ ID NO: 5349054 - DNA, 16 bp, Homo sapiens
aattaagaaggcaaaa

SEQ ID NO: 5349055 - DNA, 23 bp, Homo sapiens
aattaagaaggcaaaaatgtaaa

SEQ ID NO: 5349056 - DNA, 13 bp, Homo sapiens
aattaagaatctc

SEQ ID NO: 5349057 - DNA, 16 bp, Homo sapiens
aattaagaatgttctc

SEQ ID NO: 5349058 - DNA, 12 bp, Homo sapiens
aattaagacttt

SEQ ID NO: 5349059 - DNA, 15 bp, Homo sapiens
aattaagagagtcta

SEQ ID NO: 5349060 - DNA, 22 bp, Homo sapiens
aattaagatacaaattaatttt

SEQ ID NO: 5349061 - DNA, 20 bp, Homo sapiens
aattaagatcctaaactctc

SEQ ID NO: 5349062 - DNA, 15 bp, Homo sapiens
aattaagattattgt

SEQ ID NO: 5349063 - DNA, 18 bp, Homo sapiens
aattaagcaaatgttaaa

SEQ ID NO: 5349064 - DNA, 19 bp, Homo sapiens
aattaaggaacataaatct

SEQ ID NO: 5349065 - DNA, 12 bp, Homo sapiens
aattaaggaagt

SEQ ID NO: 5349066 - DNA, 22 bp, Homo sapiens
aattaaggattttatgctttaa

SEQ ID NO: 5349067 - DNA, 22 bp, Homo sapiens
aattaaggcaactgaacaaaaa

SEQ ID NO: 5349068 - DNA, 17 bp, Homo sapiens
aattaagggacatgtat

SEQ ID NO: 5349069 - DNA, 16 bp, Homo sapiens
aattaaggtgtttgaa

SEQ ID NO: 5349070 - DNA, 18 bp, Homo sapiens
aattaaggtgtttgaaaa

SEQ ID NO: 5349071 - DNA, 20 bp, Homo sapiens
aattaaggtgtttgaaaata

SEQ ID NO: 5349072 - DNA, 13 bp, Homo sapiens
aattaagtactat

SEQ ID NO: 5349073 - DNA, 14 bp, Homo sapiens
aattaagtagaaca

SEQ ID NO: 5349074 - DNA, 20 bp, Homo sapiens
aattaagtcattttgtaata

SEQ ID NO: 5349075 - DNA, 22 bp, Homo sapiens
aattaagtcctacttttaaaga

SEQ ID NO: 5349076 - DNA, 13 bp, Homo sapiens
aattaagtgcaat

SEQ ID NO: 5349077 - DNA, 18 bp, Homo sapiens
aattaagtgcaatttccc

SEQ ID NO: 5349078 - DNA, 12 bp, Homo sapiens
aattaagtgttg

SEQ ID NO: 5349079 - DNA, 23 bp, Homo sapiens
aattaagtgttgttcattatact

SEQ ID NO: 5349080 - DNA, 13 bp, Homo sapiens
aattaagttactg

SEQ ID NO: 5349081 - DNA, 18 bp, Homo sapiens
aattaagttgaaaaagga

SEQ ID NO: 5349082 - DNA, 18 bp, Homo sapiens
aattaagtttgtgaatgt

SEQ ID NO: 5349083 - DNA, 14 bp, Homo sapiens
aattaataatatgt

SEQ ID NO: 5349084 - DNA, 12 bp, Homo sapiens
aattaatacaat

SEQ ID NO: 5349085 - DNA, 14 bp, Homo sapiens
aattaatacataag

SEQ ID NO: 5349086 - DNA, 12 bp, Homo sapiens
aattaatacatt

SEQ ID NO: 5349087 - DNA, 14 bp, Homo sapiens
aattaatagctttt

SEQ ID NO: 5349088 - DNA, 19 bp, Homo sapiens
aattaatagcttttgatta

SEQ ID NO: 5349089 - DNA, 20 bp, Homo sapiens
aattaatagtttgtctattt

SEQ ID NO: 5349090 - DNA, 22 bp, Homo sapiens
aattaatagtttgtctatttta

SEQ ID NO: 5349091 - DNA, 19 bp, Homo sapiens
aattaatatattaaaattc

SEQ ID NO: 5349092 - DNA, 19 bp, Homo sapiens
aattaatatattgttttcc

SEQ ID NO: 5349093 - DNA, 18 bp, Homo sapiens
aattaatatctcctggaa

SEQ ID NO: 5349094 - DNA, 23 bp, Homo sapiens
aattaatatggcttcaccaagaa

SEQ ID NO: 5349095 - DNA, 20 bp, Homo sapiens
aattaatatgttcattaaat

SEQ ID NO: 5349096 - DNA, 13 bp, Homo sapiens
aattaatattgta

SEQ ID NO: 5349097 - DNA, 22 bp, Homo sapiens
aattaatctgggccagaatttc

SEQ ID NO: 5349098 - DNA, 16 bp, Homo sapiens
aattaatcttgcttca

SEQ ID NO: 5349099 - DNA, 13 bp, Homo sapiens
aattaatctttta

SEQ ID NO: 5349100 - DNA, 19 bp, Homo sapiens
aattaatgaaatatctgta

SEQ ID NO: 5349101 - DNA, 16 bp, Homo sapiens
aattaatgaaatgata

SEQ ID NO: 5349102 - DNA, 21 bp, Homo sapiens
aattaatgaaatgataaagac

SEQ ID NO: 5349103 - DNA, 13 bp, Homo sapiens
aattaatgacaga

SEQ ID NO: 5349104 - DNA, 19 bp, Homo sapiens
aattaatgcagatttctct

SEQ ID NO: 5349105 - DNA, 18 bp, Homo sapiens
aattaatggaaaactgtt

SEQ ID NO: 5349106 - DNA, 16 bp, Homo sapiens
aattaatggaatcttc

SEQ ID NO: 5349107 - DNA, 14 bp, Homo sapiens
aattaatggacagt

SEQ ID NO: 5349108 - DNA, 13 bp, Homo sapiens
aattaatgtaata

SEQ ID NO: 5349109 - DNA, 15 bp, Homo sapiens
aattaatgtaataaa

SEQ ID NO: 5349110 - DNA, 17 bp, Homo sapiens
aattaatgtaataaagt

SEQ ID NO: 5349111 - DNA, 18 bp, Homo sapiens
aattaatgtaataaagtg

SEQ ID NO: 5349112 - DNA, 18 bp, Homo sapiens
aattaatgtgtaaaattg

SEQ ID NO: 5349113 - DNA, 15 bp, Homo sapiens
aattaattaaaataa

SEQ ID NO: 5349114 - DNA, 14 bp, Homo sapiens
aattaattaaatga

SEQ ID NO: 5349115 - DNA, 12 bp, Homo sapiens
aattaattatca

SEQ ID NO: 5349116 - DNA, 22 bp, Homo sapiens
aattaattatcttttcaaaggt

SEQ ID NO: 5349117 - DNA, 23 bp, Homo sapiens
aattaattatgtgtagttataaa

SEQ ID NO: 5349118 - DNA, 14 bp, Homo sapiens
aattaattctaaac

SEQ ID NO: 5349119 - DNA, 17 bp, Homo sapiens
aattaattctaaactta

SEQ ID NO: 5349120 - DNA, 16 bp, Homo sapiens
aattaattgctattgt

SEQ ID NO: 5349121 - DNA, 22 bp, Homo sapiens
aattaattgtgtgaacttggaa

SEQ ID NO: 5349122 - DNA, 12 bp, Homo sapiens
aattaatttcag

SEQ ID NO: 5349123 - DNA, 13 bp, Homo sapiens
aattaatttgatt

SEQ ID NO: 5349124 - DNA, 14 bp, Homo sapiens
aattaatttgatta

SEQ ID NO: 5349125 - DNA, 16 bp, Homo sapiens
aattaatttgattaac

SEQ ID NO: 5349126 - DNA, 21 bp, Homo sapiens
aattaatttgattaacaaata

SEQ ID NO: 5349127 - DNA, 17 bp, Homo sapiens
aattaatttgtgaattt

SEQ ID NO: 5349128 - DNA, 17 bp, Homo sapiens
aattaatttgttaatta

SEQ ID NO: 5349129 - DNA, 19 bp, Homo sapiens
aattaatttgttaattaaa

SEQ ID NO: 5349130 - DNA, 13 bp, Homo sapiens
aattaattttact

SEQ ID NO: 5349131 - DNA, 19 bp, Homo sapiens
aattaattttcagccatgt

SEQ ID NO: 5349132 - DNA, 21 bp, Homo sapiens
aattaattttctctttaggag

SEQ ID NO: 5349133 - DNA, 21 bp, Homo sapiens
aattaatttttttattgttta

SEQ ID NO: 5349134 - DNA, 21 bp, Homo sapiens
aattacaaaacctatttttcc

SEQ ID NO: 5349135 - DNA, 22 bp, Homo sapiens
aattacaaaacctatttttcct

SEQ ID NO: 5349136 - DNA, 15 bp, Homo sapiens
aattacaaaaggctc

SEQ ID NO: 5349137 - DNA, 13 bp, Homo sapiens
aattacaaacaat

SEQ ID NO: 5349138 - DNA, 21 bp, Homo sapiens
aattacaaacaataagaacaa

SEQ ID NO: 5349139 - DNA, 14 bp, Homo sapiens
aattacaaagaacc

SEQ ID NO: 5349140 - DNA, 20 bp, Homo sapiens
aattacaaagttcactgttt

SEQ ID NO: 5349141 - DNA, 19 bp, Homo sapiens
aattacaaccggttatcag

SEQ ID NO: 5349142 - DNA, 18 bp, Homo sapiens
aattacaacggagtcaaa

SEQ ID NO: 5349143 - DNA, 16 bp, Homo sapiens
aattacaactaagtga

SEQ ID NO: 5349144 - DNA, 19 bp, Homo sapiens
aattacaagtattcagttc

SEQ ID NO: 5349145 - DNA, 22 bp, Homo sapiens
aattacaagtattcagttccaa

SEQ ID NO: 5349146 - DNA, 11 bp, Homo sapiens
aattacaagtt

SEQ ID NO: 5349147 - DNA, 12 bp, Homo sapiens
aattacaagttt

SEQ ID NO: 5349148 - DNA, 19 bp, Homo sapiens
aattacaagtttcagtaat

SEQ ID NO: 5349149 - DNA, 21 bp, Homo sapiens
aattacaatatgtatttatgt

SEQ ID NO: 5349150 - DNA, 16 bp, Homo sapiens
aattacaatatttctg

SEQ ID NO: 5349151 - DNA, 14 bp, Homo sapiens
aattattttaacaa

SEQ ID NO: 5349152 - DNA, 15 bp, Homo sapiens
aattattttaataat

SEQ ID NO: 5349153 - DNA, 17 bp, Homo sapiens
aattattttaattaggt

SEQ ID NO: 5349154 - DNA, 13 bp, Homo sapiens
aattattttatgt

SEQ ID NO: 5349155 - DNA, 17 bp, Homo sapiens
aattattttatgtcata

SEQ ID NO: 5349156 - DNA, 17 bp, Homo sapiens
aattattttattgtcta

SEQ ID NO: 5349157 - DNA, 18 bp, Homo sapiens
aattattttattgtctaa

SEQ ID NO: 5349158 - DNA, 18 bp, Homo sapiens
aattattttccaaaatct

SEQ ID NO: 5349159 - DNA, 19 bp, Homo sapiens
aattattttccaaaatcta

SEQ ID NO: 5349160 - DNA, 15 bp, Homo sapiens
aattattttctgaga

SEQ ID NO: 5349161 - DNA, 16 bp, Homo sapiens
aattattttgaatgtc

SEQ ID NO: 5349162 - DNA, 20 bp, Homo sapiens
aattattttgaatgtcacaa

SEQ ID NO: 5349163 - DNA, 14 bp, Homo sapiens
aattattttgacat

SEQ ID NO: 5349164 - DNA, 18 bp, Homo sapiens
aattattttggattttgt

SEQ ID NO: 5349165 - DNA, 20 bp, Homo sapiens
aattattttggtacttttat

SEQ ID NO: 5349166 - DNA, 15 bp, Homo sapiens
aattattttgttact

SEQ ID NO: 5349167 - DNA, 21 bp, Homo sapiens
aattattttgttagtggaaaa

SEQ ID NO: 5349168 - DNA, 16 bp, Homo sapiens
aattattttgttcata

SEQ ID NO: 5349169 - DNA, 19 bp, Homo sapiens
aattattttgttcatacat

SEQ ID NO: 5349170 - DNA, 21 bp, Homo sapiens
aattattttgttcatacatat

SEQ ID NO: 5349171 - DNA, 17 bp, Homo sapiens
aattatttttaaagatc

SEQ ID NO: 5349172 - DNA, 17 bp, Homo sapiens
aattatttttaatatgt

SEQ ID NO: 5349173 - DNA, 16 bp, Homo sapiens
aattatttttaattta

SEQ ID NO: 5349174 - DNA, 15 bp, Homo sapiens
aattatttttataca

SEQ ID NO: 5349175 - DNA, 17 bp, Homo sapiens
aattattttttctatga

SEQ ID NO: 5349176 - DNA, 15 bp, Homo sapiens
aattattttttgcat

SEQ ID NO: 5349177 - DNA, 19 bp, Homo sapiens
aattattttttttctttta

SEQ ID NO: 5349178 - DNA, 13 bp, Homo sapiens
aattcaaaaacaa

SEQ ID NO: 5349179 - DNA, 20 bp, Homo sapiens
aattcaaaaataaattagaa

SEQ ID NO: 5349180 - DNA, 14 bp, Homo sapiens
aattcaaaaatgta

SEQ ID NO: 5349181 - DNA, 16 bp, Homo sapiens
aattcaaaaatgtaca

SEQ ID NO: 5349182 - DNA, 22 bp, Homo sapiens
aattcaaaagctctctttggaa

SEQ ID NO: 5349183 - DNA, 17 bp, Homo sapiens
aattcaaacaattcaat

SEQ ID NO: 5349184 - DNA, 22 bp, Homo sapiens
aattcaaacaattcaatcaaag

SEQ ID NO: 5349185 - DNA, 18 bp, Homo sapiens
aattcaaacatattcttt

SEQ ID NO: 5349186 - DNA, 20 bp, Homo sapiens
aattcaaaccaattcaccca

SEQ ID NO: 5349187 - DNA, 19 bp, Homo sapiens
aattcaaagcataaaactt

SEQ ID NO: 5349188 - DNA, 14 bp, Homo sapiens
aattcaaagctcta

SEQ ID NO: 5349189 - DNA, 22 bp, Homo sapiens
aattcaaagctgtgtgtttgga

SEQ ID NO: 5349190 - DNA, 17 bp, Homo sapiens
aattcaaataaaaatcc

SEQ ID NO: 5349191 - DNA, 13 bp, Homo sapiens
aattcaaatgctt

SEQ ID NO: 5349192 - DNA, 21 bp, Homo sapiens
aattcaaatggcttaagcaat

SEQ ID NO: 5349193 - DNA, 15 bp, Homo sapiens
aattcaacaaacatt

SEQ ID NO: 5349194 - DNA, 15 bp, Homo sapiens
aattcaacaaatgat

SEQ ID NO: 5349195 - DNA, 19 bp, Homo sapiens
aattcaacaaatgatgttg

SEQ ID NO: 5349196 - DNA, 17 bp, Homo sapiens
aattcaacacattactt

SEQ ID NO: 5349197 - DNA, 16 bp, Homo sapiens
aattcaacacttattt

SEQ ID NO: 5349198 - DNA, 17 bp, Homo sapiens
aattcaacctgtgtctt

SEQ ID NO: 5349199 - DNA, 18 bp, Homo sapiens
aattcaacgttaataatt

SEQ ID NO: 5349200 - DNA, 14 bp, Homo sapiens
aattcaactggaaa

SEQ ID NO: 5349201 - DNA, 15 bp, Homo sapiens
aattcaactttgtaa

SEQ ID NO: 5349202 - DNA, 22 bp, Homo sapiens
aattcaactttgtaaaaatctt

SEQ ID NO: 5349203 - DNA, 22 bp, Homo sapiens
aattcaagaagtatttttttaa

SEQ ID NO: 5349204 - DNA, 18 bp, Homo sapiens
aattcaagcctctaaaca

SEQ ID NO: 5349205 - DNA, 17 bp, Homo sapiens
aattcaaggaatttctt

SEQ ID NO: 5349206 - DNA, 21 bp, Homo sapiens
aattcaaggagatataaaatc

SEQ ID NO: 5349207 - DNA, 21 bp, Homo sapiens
aattcaaggccacaaaaacaa

SEQ ID NO: 5349208 - DNA, 22 bp, Homo sapiens
aattcaaggccacaaaaacaat

SEQ ID NO: 5349209 - DNA, 23 bp, Homo sapiens
aattcaagtgcttaaaaatactt

SEQ ID NO: 5349210 - DNA, 20 bp, Homo sapiens
aattcaatagtaatataata

SEQ ID NO: 5349211 - DNA, 13 bp, Homo sapiens
aattcaatcaaag

SEQ ID NO: 5349212 - DNA, 15 bp, Homo sapiens
aattcaatcaaagct

SEQ ID NO: 5349213 - DNA, 17 bp, Homo sapiens
aattcaatgaaatggat

SEQ ID NO: 5349214 - DNA, 12 bp, Homo sapiens
aattcaatgatt

SEQ ID NO: 5349215 - DNA, 13 bp, Homo sapiens
aattcaattcaaa

SEQ ID NO: 5349216 - DNA, 17 bp, Homo sapiens
aattcaatttggattta

SEQ ID NO: 5349217 - DNA, 17 bp, Homo sapiens
aattcaattttaaagac

SEQ ID NO: 5349218 - DNA, 19 bp, Homo sapiens
aattcacaaacttttatac

SEQ ID NO: 5349219 - DNA, 18 bp, Homo sapiens
aattcacaagctaacttc

SEQ ID NO: 5349220 - DNA, 15 bp, Homo sapiens
aattcacaagctgcc

SEQ ID NO: 5349221 - DNA, 18 bp, Homo sapiens
aattcacaagctgcctcc

SEQ ID NO: 5349222 - DNA, 18 bp, Homo sapiens
aattcacagatatttaaa

SEQ ID NO: 5349223 - DNA, 20 bp, Homo sapiens
aattcacagtgctcttttct

SEQ ID NO: 5349224 - DNA, 16 bp, Homo sapiens
aattcaccaaaagttc

SEQ ID NO: 5349225 - DNA, 16 bp, Homo sapiens
aattcaccagtgttcc

SEQ ID NO: 5349226 - DNA, 14 bp, Homo sapiens
aattcacccactcc

SEQ ID NO: 5349227 - DNA, 17 bp, Homo sapiens
aattcacctatgttatt

SEQ ID NO: 5349228 - DNA, 17 bp, Homo sapiens
aattcacctcagcctgg

SEQ ID NO: 5349229 - DNA, 13 bp, Homo sapiens
aattcaccttccc

SEQ ID NO: 5349230 - DNA, 19 bp, Homo sapiens
aattcacgccccccttaag

SEQ ID NO: 5349231 - DNA, 15 bp, Homo sapiens
aattcacgtgctttg

SEQ ID NO: 5349232 - DNA, 14 bp, Homo sapiens
aattcactccagtc

SEQ ID NO: 5349233 - DNA, 16 bp, Homo sapiens
aattcactccagtcaa

SEQ ID NO: 5349234 - DNA, 21 bp, Homo sapiens
aattcactccagtcaacagat

SEQ ID NO: 5349235 - DNA, 24 bp, Homo sapiens
aattcactccagtcaacagattca

SEQ ID NO: 5349236 - DNA, 13 bp, Homo sapiens
aattcactgtact

SEQ ID NO: 5349237 - DNA, 15 bp, Homo sapiens
aattcactgttgaat

SEQ ID NO: 5349238 - DNA, 23 bp, Homo sapiens
aattcacttagggtcgagcatcc

SEQ ID NO: 5349239 - DNA, 14 bp, Homo sapiens
aattcacttcagtt

SEQ ID NO: 5349240 - DNA, 12 bp, Homo sapiens
aattcactttag

SEQ ID NO: 5349241 - DNA, 15 bp, Homo sapiens
aattcactttattat

SEQ ID NO: 5349242 - DNA, 23 bp, Homo sapiens
aattcagaaaacataatataaga

SEQ ID NO: 5349243 - DNA, 16 bp, Homo sapiens
aattcagaagcatcac

SEQ ID NO: 5349244 - DNA, 15 bp, Homo sapiens
aattcagacaacatt

SEQ ID NO: 5349245 - DNA, 16 bp, Homo sapiens
aattcagacatctgag

SEQ ID NO: 5349246 - DNA, 22 bp, Homo sapiens
aattcagacatctgaggtttta

SEQ ID NO: 5349247 - DNA, 15 bp, Homo sapiens
aattcagataatggt

SEQ ID NO: 5349248 - DNA, 17 bp, Homo sapiens
aattcagataatggtaa

SEQ ID NO: 5349249 - DNA, 18 bp, Homo sapiens
aattcagatccagtgtaa

SEQ ID NO: 5349250 - DNA, 15 bp, Homo sapiens
aattcagcaaaccat

SEQ ID NO: 5349251 - DNA, 15 bp, Homo sapiens
aattcagcaccctgg

SEQ ID NO: 5349252 - DNA, 17 bp, Homo sapiens
aattcagcaccctgggt

SEQ ID NO: 5349253 - DNA, 23 bp, Homo sapiens
aattcagcactgatttcacaaca

SEQ ID NO: 5349254 - DNA, 13 bp, Homo sapiens
aattcagcagttt

SEQ ID NO: 5349255 - DNA, 15 bp, Homo sapiens
aattcaggtctgtat

SEQ ID NO: 5349256 - DNA, 21 bp, Homo sapiens
aattcaggtgaaaatgttcat

SEQ ID NO: 5349257 - DNA, 19 bp, Homo sapiens
aattcaggtttttcctttt

SEQ ID NO: 5349258 - DNA, 17 bp, Homo sapiens
aattcagtagcatttta

SEQ ID NO: 5349259 - DNA, 18 bp, Homo sapiens
aattcagtagcattttaa

SEQ ID NO: 5349260 - DNA, 19 bp, Homo sapiens
aattcagtagcattttaat

SEQ ID NO: 5349261 - DNA, 22 bp, Homo sapiens
aattcagtagttactgctgttt

SEQ ID NO: 5349262 - DNA, 14 bp, Homo sapiens
aattcagtctgctc

SEQ ID NO: 5349263 - DNA, 13 bp, Homo sapiens
aattcagtgagat

SEQ ID NO: 5349264 - DNA, 18 bp, Homo sapiens
aattcagtggacatttgt

SEQ ID NO: 5349265 - DNA, 19 bp, Homo sapiens
aattcagtggacatttgtt

SEQ ID NO: 5349266 - DNA, 22 bp, Homo sapiens
aattcagttgttagtgtgtctt

SEQ ID NO: 5349267 - DNA, 13 bp, Homo sapiens
aattcagtttcat

SEQ ID NO: 5349268 - DNA, 14 bp, Homo sapiens
aattcagtttcata

SEQ ID NO: 5349269 - DNA, 21 bp, Homo sapiens
aattcagttttagtttcaaaa

SEQ ID NO: 5349270 - DNA, 12 bp, Homo sapiens
aattcagttttt

SEQ ID NO: 5349271 - DNA, 16 bp, Homo sapiens
aattcagtttttgtat

SEQ ID NO: 5349272 - DNA, 14 bp, Homo sapiens
aattcataaaaaca

SEQ ID NO: 5349273 - DNA, 15 bp, Homo sapiens
aattcataaaaacaa

SEQ ID NO: 5349274 - DNA, 14 bp, Homo sapiens
aattcataaaaata

SEQ ID NO: 5349275 - DNA, 15 bp, Homo sapiens
aattcataaaaataa

SEQ ID NO: 5349276 - DNA, 18 bp, Homo sapiens
aattcataataaattttc

SEQ ID NO: 5349277 - DNA, 13 bp, Homo sapiens
aattcataattag

SEQ ID NO: 5349278 - DNA, 13 bp, Homo sapiens
aattcatactctg

SEQ ID NO: 5349279 - DNA, 14 bp, Homo sapiens
aattcatactctgt

SEQ ID NO: 5349280 - DNA, 19 bp, Homo sapiens
aattcatatctaaatagta

SEQ ID NO: 5349281 - DNA, 13 bp, Homo sapiens
aattcatattctg

SEQ ID NO: 5349282 - DNA, 21 bp, Homo sapiens
aattcatctagttaagtcgct

SEQ ID NO: 5349283 - DNA, 13 bp, Homo sapiens
aattcatctattt

SEQ ID NO: 5349284 - DNA, 20 bp, Homo sapiens
aattcatctatttcgagtgt

SEQ ID NO: 5349285 - DNA, 18 bp, Homo sapiens
aattcatctgtgaatctg

SEQ ID NO: 5349286 - DNA, 16 bp, Homo sapiens
aattcatcttttaatc

SEQ ID NO: 5349287 - DNA, 18 bp, Homo sapiens
aattcatgccccagtatt

SEQ ID NO: 5349288 - DNA, 14 bp, Homo sapiens
aattcatgcctttc

SEQ ID NO: 5349289 - DNA, 18 bp, Homo sapiens
aattcatgcctttcatag

SEQ ID NO: 5349290 - DNA, 17 bp, Homo sapiens
aattcatggaactttca

SEQ ID NO: 5349291 - DNA, 18 bp, Homo sapiens
aattcatggaactttcat

SEQ ID NO: 5349292 - DNA, 17 bp, Homo sapiens
aattcatgggctgtgtg

SEQ ID NO: 5349293 - DNA, 17 bp, Homo sapiens
aattcatgtaacactgt

SEQ ID NO: 5349294 - DNA, 19 bp, Homo sapiens
aattcatgtaacagttgtg

SEQ ID NO: 5349295 - DNA, 10 bp, Homo sapiens
aattcattaa

SEQ ID NO: 5349296 - DNA, 16 bp, Homo sapiens
aattcattaaagaaaa

SEQ ID NO: 5349297 - DNA, 18 bp, Homo sapiens
aattcattaaagaaaaac

SEQ ID NO: 5349298 - DNA, 21 bp, Homo sapiens
aattcattaatctgcctccct

SEQ ID NO: 5349299 - DNA, 22 bp, Homo sapiens
aattcattcccttctctcagcc

SEQ ID NO: 5349300 - DNA, 15 bp, Homo sapiens
aattcatttaagaac

SEQ ID NO: 5349301 - DNA, 17 bp, Homo sapiens
aattcatttaagaacaa

SEQ ID NO: 5349302 - DNA, 12 bp, Homo sapiens
aattcatttact

SEQ ID NO: 5349303 - DNA, 23 bp, Homo sapiens
aattcatttattaagtatatttg

SEQ ID NO: 5349304 - DNA, 15 bp, Homo sapiens
aattcatttcacatt

SEQ ID NO: 5349305 - DNA, 22 bp, Homo sapiens
aattcatttgcttgcaatctaa

SEQ ID NO: 5349306 - DNA, 15 bp, Homo sapiens
aattcatttgtattg

SEQ ID NO: 5349307 - DNA, 20 bp, Homo sapiens
aattcatttgtattgcttat

SEQ ID NO: 5349308 - DNA, 18 bp, Homo sapiens
aattcatttgtggcaatt

SEQ ID NO: 5349309 - DNA, 19 bp, Homo sapiens
aattcatttgtggcaatta

SEQ ID NO: 5349310 - DNA, 15 bp, Homo sapiens
aattccaaaatccaa

SEQ ID NO: 5349311 - DNA, 14 bp, Homo sapiens
aattccaaacatgg

SEQ ID NO: 5349312 - DNA, 18 bp, Homo sapiens
aattccaaagatctgaat

SEQ ID NO: 5349313 - DNA, 13 bp, Homo sapiens
aattccaaagcaa

SEQ ID NO: 5349314 - DNA, 18 bp, Homo sapiens
aattccaaagtctctaat

SEQ ID NO: 5349315 - DNA, 18 bp, Homo sapiens
aattccaacagtttaatg

SEQ ID NO: 5349316 - DNA, 20 bp, Homo sapiens
aattccaacagtttaatgaa

SEQ ID NO: 5349317 - DNA, 14 bp, Homo sapiens
aattccaagaaaat

SEQ ID NO: 5349318 - DNA, 23 bp, Homo sapiens
aattccaaggagttccatgaaga

SEQ ID NO: 5349319 - DNA, 18 bp, Homo sapiens
aattccaagtgattgaaa

SEQ ID NO: 5349320 - DNA, 19 bp, Homo sapiens
aattccaagtgtattttaa

SEQ ID NO: 5349321 - DNA, 16 bp, Homo sapiens
aattccaatatgatga

SEQ ID NO: 5349322 - DNA, 17 bp, Homo sapiens
aattccaattatatgag

SEQ ID NO: 5349323 - DNA, 12 bp, Homo sapiens
aattccacagct

SEQ ID NO: 5349324 - DNA, 16 bp, Homo sapiens
aattccacagggacca

SEQ ID NO: 5349325 - DNA, 17 bp, Homo sapiens
aattccacagtctctgg

SEQ ID NO: 5349326 - DNA, 18 bp, Homo sapiens
aattccaccagggccaga

SEQ ID NO: 5349327 - DNA, 21 bp, Homo sapiens
aattccacccctccttccctg

SEQ ID NO: 5349328 - DNA, 13 bp, Homo sapiens
aattccactcaaa

SEQ ID NO: 5349329 - DNA, 14 bp, Homo sapiens
aattccactgaaaa

SEQ ID NO: 5349330 - DNA, 21 bp, Homo sapiens
aattgatctgttttggatgtt

SEQ ID NO: 5349331 - DNA, 18 bp, Homo sapiens
aattgatcttttttaatt

SEQ ID NO: 5349332 - DNA, 13 bp, Homo sapiens
aattgatgatgtt

SEQ ID NO: 5349333 - DNA, 23 bp, Homo sapiens
aattgatgctaagtgatgggatt

SEQ ID NO: 5349334 - DNA, 19 bp, Homo sapiens
aattgatgggatttggtca

SEQ ID NO: 5349335 - DNA, 15 bp, Homo sapiens
aattgatgggtgggc

SEQ ID NO: 5349336 - DNA, 23 bp, Homo sapiens
aattgattaaactgtatgtctta

SEQ ID NO: 5349337 - DNA, 22 bp, Homo sapiens
aattgattattctgattccact

SEQ ID NO: 5349338 - DNA, 23 bp, Homo sapiens
aattgattattctgattccactt

SEQ ID NO: 5349339 - DNA, 12 bp, Homo sapiens
aattgattattt

SEQ ID NO: 5349340 - DNA, 15 bp, Homo sapiens
aattgattgaattaa

SEQ ID NO: 5349341 - DNA, 14 bp, Homo sapiens
aattgatttataaa

SEQ ID NO: 5349342 - DNA, 15 bp, Homo sapiens
aattgatttataaat

SEQ ID NO: 5349343 - DNA, 22 bp, Homo sapiens
aattgatttataaataacaaaa

SEQ ID NO: 5349344 - DNA, 15 bp, Homo sapiens
aattgatttcaagac

SEQ ID NO: 5349345 - DNA, 22 bp, Homo sapiens
aattgatttgacccactcacac

SEQ ID NO: 5349346 - DNA, 23 bp, Homo sapiens
aattgatttgacccactcacact

SEQ ID NO: 5349347 - DNA, 14 bp, Homo sapiens
aattgatttgcatt

SEQ ID NO: 5349348 - DNA, 20 bp, Homo sapiens
aattgatttgcattgaacac

SEQ ID NO: 5349349 - DNA, 23 bp, Homo sapiens
aattgatttgcattgaacacaaa

SEQ ID NO: 5349350 - DNA, 15 bp, Homo sapiens
aattgatttgttatg

SEQ ID NO: 5349351 - DNA, 13 bp, Homo sapiens
aattgattttgaa

SEQ ID NO: 5349352 - DNA, 22 bp, Homo sapiens
aattgatttttctcttcatttt

SEQ ID NO: 5349353 - DNA, 16 bp, Homo sapiens
aattgatttttcttct

SEQ ID NO: 5349354 - DNA, 17 bp, Homo sapiens
aattgatttttcttctt

SEQ ID NO: 5349355 - DNA, 21 bp, Homo sapiens
aattgatttttcttcttttac

SEQ ID NO: 5349356 - DNA, 22 bp, Homo sapiens
aattgcaaaactagacaaaagt

SEQ ID NO: 5349357 - DNA, 15 bp, Homo sapiens
aattgcaaaatgcgt

SEQ ID NO: 5349358 - DNA, 14 bp, Homo sapiens
aattgcaaagaaaa

SEQ ID NO: 5349359 - DNA, 21 bp, Homo sapiens
aattgcaaagaaaattctcaa

SEQ ID NO: 5349360 - DNA, 18 bp, Homo sapiens
aattgcaaatcttgaaat

SEQ ID NO: 5349361 - DNA, 12 bp, Homo sapiens
aattgcaacaat

SEQ ID NO: 5349362 - DNA, 15 bp, Homo sapiens
aattgcaacaatgca

SEQ ID NO: 5349363 - DNA, 17 bp, Homo sapiens
aattgcaacaatgcaaa

SEQ ID NO: 5349364 - DNA, 14 bp, Homo sapiens
aattgcaatacatt

SEQ ID NO: 5349365 - DNA, 14 bp, Homo sapiens
aattgcaatatata

SEQ ID NO: 5349366 - DNA, 15 bp, Homo sapiens
aattgcaatctataa

SEQ ID NO: 5349367 - DNA, 11 bp, Homo sapiens
aattgcacaat

SEQ ID NO: 5349368 - DNA, 15 bp, Homo sapiens
aattgcacaatttga

SEQ ID NO: 5349369 - DNA, 19 bp, Homo sapiens
aattgcacaatttgagcaa

SEQ ID NO: 5349370 - DNA, 21 bp, Homo sapiens
aattgcacatttttttctatg

SEQ ID NO: 5349371 - DNA, 15 bp, Homo sapiens
aattgcaccaaaaga

SEQ ID NO: 5349372 - DNA, 20 bp, Homo sapiens
aattgcaccagaaatgttta

SEQ ID NO: 5349373 - DNA, 21 bp, Homo sapiens
aattgcactcatgtggactgg

SEQ ID NO: 5349374 - DNA, 15 bp, Homo sapiens
aattgcactctaaaa

SEQ ID NO: 5349375 - DNA, 16 bp, Homo sapiens
aattgcactgaagttt

SEQ ID NO: 5349376 - DNA, 17 bp, Homo sapiens
aattgcactgaagtttt

SEQ ID NO: 5349377 - DNA, 15 bp, Homo sapiens
aattgcactgctgtt

SEQ ID NO: 5349378 - DNA, 20 bp, Homo sapiens
aattgcagataactttgact

SEQ ID NO: 5349379 - DNA, 17 bp, Homo sapiens
aattgcagatgccaaaa

SEQ ID NO: 5349380 - DNA, 16 bp, Homo sapiens
aattgcagtttacagt

SEQ ID NO: 5349381 - DNA, 19 bp, Homo sapiens
aattgcagtttacagtatt

SEQ ID NO: 5349382 - DNA, 23 bp, Homo sapiens
aattgcagtttacagtatttcta

SEQ ID NO: 5349383 - DNA, 18 bp, Homo sapiens
aattgcagtttcatgtat

SEQ ID NO: 5349384 - DNA, 21 bp, Homo sapiens
aattgcagtttcatgtatgta

SEQ ID NO: 5349385 - DNA, 19 bp, Homo sapiens
aattgcataattttctaat

SEQ ID NO: 5349386 - DNA, 17 bp, Homo sapiens
aattgcatgaaactagg

SEQ ID NO: 5349387 - DNA, 18 bp, Homo sapiens
aattgcatgctgctttaa

SEQ ID NO: 5349388 - DNA, 21 bp, Homo sapiens
aattgcatgctgctttaattg

SEQ ID NO: 5349389 - DNA, 18 bp, Homo sapiens
aattgcattgactttccc

SEQ ID NO: 5349390 - DNA, 20 bp, Homo sapiens
aattgcattgactttcccca

SEQ ID NO: 5349391 - DNA, 21 bp, Homo sapiens
aattgcattgactttccccac

SEQ ID NO: 5349392 - DNA, 23 bp, Homo sapiens
aattgcattgactttccccacca

SEQ ID NO: 5349393 - DNA, 14 bp, Homo sapiens
aattgcatttctat

SEQ ID NO: 5349394 - DNA, 16 bp, Homo sapiens
aattgcatttgctttt

SEQ ID NO: 5349395 - DNA, 13 bp, Homo sapiens
aattgcatttgtg

SEQ ID NO: 5349396 - DNA, 20 bp, Homo sapiens
aattgcattttttaaaacaa

SEQ ID NO: 5349397 - DNA, 21 bp, Homo sapiens
aattgcattttttaaaacaag

SEQ ID NO: 5349398 - DNA, 12 bp, Homo sapiens
aattgccaaaat

SEQ ID NO: 5349399 - DNA, 15 bp, Homo sapiens
aattgccaaaatata

SEQ ID NO: 5349400 - DNA, 14 bp, Homo sapiens
aattgccagcaaat

SEQ ID NO: 5349401 - DNA, 13 bp, Homo sapiens
aattgccataata

SEQ ID NO: 5349402 - DNA, 19 bp, Homo sapiens
aattgccatattgcacatg

SEQ ID NO: 5349403 - DNA, 13 bp, Homo sapiens
aattgccccatcc

SEQ ID NO: 5349404 - DNA, 18 bp, Homo sapiens
aattgcccctgcaccttt

SEQ ID NO: 5349405 - DNA, 13 bp, Homo sapiens
aattgccctgcca

SEQ ID NO: 5349406 - DNA, 21 bp, Homo sapiens
aattgcctacaataaaaagaa

SEQ ID NO: 5349407 - DNA, 16 bp, Homo sapiens
aattgcctacatttat

SEQ ID NO: 5349408 - DNA, 18 bp, Homo sapiens
aattgcctacatttatca

SEQ ID NO: 5349409 - DNA, 22 bp, Homo sapiens
aattgcctatcctgctgttcta

SEQ ID NO: 5349410 - DNA, 15 bp, Homo sapiens
aattgcctgatttgt

SEQ ID NO: 5349411 - DNA, 15 bp, Homo sapiens
aattgcctgccatgg

SEQ ID NO: 5349412 - DNA, 14 bp, Homo sapiens
aattgcctttgtaa

SEQ ID NO: 5349413 - DNA, 22 bp, Homo sapiens
aattgcctttgtaatatgagaa

SEQ ID NO: 5349414 - DNA, 14 bp, Homo sapiens
aattgcctttttct

SEQ ID NO: 5349415 - DNA, 22 bp, Homo sapiens
aattgcgctcaggggctccatg

SEQ ID NO: 5349416 - DNA, 23 bp, Homo sapiens
aattgcgctcaggggctccatgc

SEQ ID NO: 5349417 - DNA, 19 bp, Homo sapiens
aattgctaaatataaaaac

SEQ ID NO: 5349418 - DNA, 17 bp, Homo sapiens
aattgctaacaattgtt

SEQ ID NO: 5349419 - DNA, 18 bp, Homo sapiens
aattgctaacaattgtta

SEQ ID NO: 5349420 - DNA, 21 bp, Homo sapiens
aattgctaacgttttttcttc

SEQ ID NO: 5349421 - DNA, 16 bp, Homo sapiens
aattgctaattctgag

SEQ ID NO: 5349422 - DNA, 18 bp, Homo sapiens
aattgctagtgatttcat

SEQ ID NO: 5349423 - DNA, 20 bp, Homo sapiens
aattgctagtgatttcatta

SEQ ID NO: 5349424 - DNA, 21 bp, Homo sapiens
aattgctagtgatttcattac

SEQ ID NO: 5349425 - DNA, 14 bp, Homo sapiens
aattgctatcattt

SEQ ID NO: 5349426 - DNA, 15 bp, Homo sapiens
aattgctatgtgaaa

SEQ ID NO: 5349427 - DNA, 19 bp, Homo sapiens
aattgctatgttactattt

SEQ ID NO: 5349428 - DNA, 14 bp, Homo sapiens
aattgctattgtgt

SEQ ID NO: 5349429 - DNA, 22 bp, Homo sapiens
aattgctattttatttgtattc

SEQ ID NO: 5349430 - DNA, 21 bp, Homo sapiens
aattgctcacagttattacat

SEQ ID NO: 5349431 - DNA, 21 bp, Homo sapiens
aattgctcatgcatagtccca

SEQ ID NO: 5349432 - DNA, 19 bp, Homo sapiens
aattgctcatgttggccaa

SEQ ID NO: 5349433 - DNA, 20 bp, Homo sapiens
aattgctccagatctggaat

SEQ ID NO: 5349434 - DNA, 15 bp, Homo sapiens
aattgctctgtgtat

SEQ ID NO: 5349435 - DNA, 12 bp, Homo sapiens
aattgctctgtt

SEQ ID NO: 5349436 - DNA, 23 bp, Homo sapiens
aattgctgaagggcattctttcc

SEQ ID NO: 5349437 - DNA, 17 bp, Homo sapiens
aattgctgactgtagct

SEQ ID NO: 5349438 - DNA, 18 bp, Homo sapiens
aattgctgactgtagctt

SEQ ID NO: 5349439 - DNA, 13 bp, Homo sapiens
aattgctgaggca

SEQ ID NO: 5349440 - DNA, 21 bp, Homo sapiens
aattgctgataccatatgaat

SEQ ID NO: 5349441 - DNA, 17 bp, Homo sapiens
aattgctgcatatttgt

SEQ ID NO: 5349442 - DNA, 16 bp, Homo sapiens
aattgctgctctctga

SEQ ID NO: 5349443 - DNA, 13 bp, Homo sapiens
aattgctgtgcct

SEQ ID NO: 5349444 - DNA, 22 bp, Homo sapiens
aattgctgtgcctcccaaaatt

SEQ ID NO: 5349445 - DNA, 16 bp, Homo sapiens
aattgctgttgaaagc

SEQ ID NO: 5349446 - DNA, 19 bp, Homo sapiens
aattgctgttgaaagcaaa

SEQ ID NO: 5349447 - DNA, 21 bp, Homo sapiens
aattgctgttgaaagcaaaaa

SEQ ID NO: 5349448 - DNA, 19 bp, Homo sapiens
aattgcttaaaagacattt

SEQ ID NO: 5349449 - DNA, 21 bp, Homo sapiens
aattgcttactgatattatct

SEQ ID NO: 5349450 - DNA, 19 bp, Homo sapiens
aattgcttatttattgtat

SEQ ID NO: 5349451 - DNA, 18 bp, Homo sapiens
aattgcttctaaaacaat

SEQ ID NO: 5349452 - DNA, 15 bp, Homo sapiens
aattgcttctctaaa

SEQ ID NO: 5349453 - DNA, 13 bp, Homo sapiens
aattgcttctgtg

SEQ ID NO: 5349454 - DNA, 22 bp, Homo sapiens
aattgcttgaaagaaaatatgc

SEQ ID NO: 5349455 - DNA, 14 bp, Homo sapiens
aattgcttgagcat

SEQ ID NO: 5349456 - DNA, 19 bp, Homo sapiens
aattgctttaaatcttaag

SEQ ID NO: 5349457 - DNA, 22 bp, Homo sapiens
aattgctttaccttttttctta

SEQ ID NO: 5349458 - DNA, 14 bp, Homo sapiens
aattgctttatggg

SEQ ID NO: 5349459 - DNA, 20 bp, Homo sapiens
aattgctttatgggggggag

SEQ ID NO: 5349460 - DNA, 18 bp, Homo sapiens
aattgctttcctgcctcc

SEQ ID NO: 5349461 - DNA, 12 bp, Homo sapiens
aattgctttgaa

SEQ ID NO: 5349462 - DNA, 16 bp, Homo sapiens
aattgctttgccaaaa

SEQ ID NO: 5349463 - DNA, 20 bp, Homo sapiens
aattgctttgccaaaatacc

SEQ ID NO: 5349464 - DNA, 23 bp, Homo sapiens
aattgctttgtgacttcttcttc

SEQ ID NO: 5349465 - DNA, 20 bp, Homo sapiens
aattgcttttgttgtgactt

SEQ ID NO: 5349466 - DNA, 22 bp, Homo sapiens
aattgcttttgttgtgactttt

SEQ ID NO: 5349467 - DNA, 16 bp, Homo sapiens
aattggaaaagagtta

SEQ ID NO: 5349468 - DNA, 13 bp, Homo sapiens
aattggaaatatt

SEQ ID NO: 5349469 - DNA, 15 bp, Homo sapiens
aattggaactgcaat

SEQ ID NO: 5349470 - DNA, 18 bp, Homo sapiens
aattggaagtctaagaac

SEQ ID NO: 5349471 - DNA, 10 bp, Homo sapiens
aattggaatc

SEQ ID NO: 5349472 - DNA, 14 bp, Homo sapiens
aattggaatcttca

SEQ ID NO: 5349473 - DNA, 18 bp, Homo sapiens
aattggaatcttcacctc

SEQ ID NO: 5349474 - DNA, 23 bp, Homo sapiens
aattggaatggaactactgtact

SEQ ID NO: 5349475 - DNA, 19 bp, Homo sapiens
aattggactttcaaaatta

SEQ ID NO: 5349476 - DNA, 16 bp, Homo sapiens
aattggagaaaagcac

SEQ ID NO: 5349477 - DNA, 21 bp, Homo sapiens
aattggagattggcttgtctc

SEQ ID NO: 5349478 - DNA, 22 bp, Homo sapiens
aattggagattggcttgtctca

SEQ ID NO: 5349479 - DNA, 16 bp, Homo sapiens
aattggaggaaagcaa

SEQ ID NO: 5349480 - DNA, 23 bp, Homo sapiens
aattggatacagtacggatttgt

SEQ ID NO: 5349481 - DNA, 22 bp, Homo sapiens
aattggatacgacaacttgcac

SEQ ID NO: 5349482 - DNA, 11 bp, Homo sapiens
aattggatttc

SEQ ID NO: 5349483 - DNA, 20 bp, Homo sapiens
aattggcaccgaagcccaga

SEQ ID NO: 5349484 - DNA, 17 bp, Homo sapiens
aattggcagattgtttt

SEQ ID NO: 5349485 - DNA, 14 bp, Homo sapiens
aattggcagcagat

SEQ ID NO: 5349486 - DNA, 22 bp, Homo sapiens
aattggcagcagattttaggaa

SEQ ID NO: 5349487 - DNA, 18 bp, Homo sapiens
aattggcagtggcagaga

SEQ ID NO: 5349488 - DNA, 14 bp, Homo sapiens
aattggcataattt

SEQ ID NO: 5349489 - DNA, 20 bp, Homo sapiens
aattggccagaggaaatctg

SEQ ID NO: 5349490 - DNA, 15 bp, Homo sapiens
aattggccatcttaa

SEQ ID NO: 5349491 - DNA, 19 bp, Homo sapiens
aattggcctgaacagatgt

SEQ ID NO: 5349492 - DNA, 17 bp, Homo sapiens
aattggccttcgatttt

SEQ ID NO: 5349493 - DNA, 22 bp, Homo sapiens
aattggccttcgattttaaata

SEQ ID NO: 5349494 - DNA, 18 bp, Homo sapiens
aattggctaaaagacatg

SEQ ID NO: 5349495 - DNA, 13 bp, Homo sapiens
aattggctcctcc

SEQ ID NO: 5349496 - DNA, 14 bp, Homo sapiens
aattggctcctcca

SEQ ID NO: 5349497 - DNA, 21 bp, Homo sapiens
aattggctcctttcccacagt

SEQ ID NO: 5349498 - DNA, 22 bp, Homo sapiens
aattggctcctttcccacagtc

SEQ ID NO: 5349499 - DNA, 13 bp, Homo sapiens
aattggcttgttt

SEQ ID NO: 5349500 - DNA, 17 bp, Homo sapiens
aattgggaactgaaatc

SEQ ID NO: 5349501 - DNA, 16 bp, Homo sapiens
aattgggaatgcaata

SEQ ID NO: 5349502 - DNA, 14 bp, Homo sapiens
aattgggagtccag

SEQ ID NO: 5349503 - DNA, 15 bp, Homo sapiens
aattgggagtccagg

SEQ ID NO: 5349504 - DNA, 19 bp, Homo sapiens
aattgggccagcttttcaa

SEQ ID NO: 5349505 - DNA, 20 bp, Homo sapiens
aattgggccagcttttcaaa

SEQ ID NO: 5349506 - DNA, 23 bp, Homo sapiens
aattgggcccttagaatgtgaaa

SEQ ID NO: 5349507 - DNA, 18 bp, Homo sapiens
aatttccttctgttaaga

SEQ ID NO: 5349508 - DNA, 18 bp, Homo sapiens
aatttcgccgttgaagag

SEQ ID NO: 5349509 - DNA, 21 bp, Homo sapiens
aatttcgccgttgaagaggaa

SEQ ID NO: 5349510 - DNA, 13 bp, Homo sapiens
aatttcgccttaa

SEQ ID NO: 5349511 - DNA, 15 bp, Homo sapiens
aatttcgccttaaac

SEQ ID NO: 5349512 - DNA, 17 bp, Homo sapiens
aatttcgccttaaactc

SEQ ID NO: 5349513 - DNA, 21 bp, Homo sapiens
aatttcggattttttccaaaa

SEQ ID NO: 5349514 - DNA, 17 bp, Homo sapiens
aatttcgggagccttgt

SEQ ID NO: 5349515 - DNA, 17 bp, Homo sapiens
aatttcgttgtccaatt

SEQ ID NO: 5349516 - DNA, 21 bp, Homo sapiens
aatttcgttgtccaatttgta

SEQ ID NO: 5349517 - DNA, 22 bp, Homo sapiens
aatttctaaaaagattagcaag

SEQ ID NO: 5349518 - DNA, 12 bp, Homo sapiens
aatttctaaact

SEQ ID NO: 5349519 - DNA, 13 bp, Homo sapiens
aatttctaaagat

SEQ ID NO: 5349520 - DNA, 15 bp, Homo sapiens
aatttctaaagtaaa

SEQ ID NO: 5349521 - DNA, 19 bp, Homo sapiens
aatttctaaagtaaaattg

SEQ ID NO: 5349522 - DNA, 13 bp, Homo sapiens
aatttctaaatct

SEQ ID NO: 5349523 - DNA, 18 bp, Homo sapiens
aatttctaagaagttact

SEQ ID NO: 5349524 - DNA, 22 bp, Homo sapiens
aatttctaagaagttacttttt

SEQ ID NO: 5349525 - DNA, 15 bp, Homo sapiens
aatttctaatttcaa

SEQ ID NO: 5349526 - DNA, 20 bp, Homo sapiens
aatttctacaaaataacatt

SEQ ID NO: 5349527 - DNA, 15 bp, Homo sapiens
aatttctactttgaa

SEQ ID NO: 5349528 - DNA, 17 bp, Homo sapiens
aatttctactttgaagt

SEQ ID NO: 5349529 - DNA, 17 bp, Homo sapiens
aatttctaggactgaat

SEQ ID NO: 5349530 - DNA, 21 bp, Homo sapiens
aatttctagtacctgtgactc

SEQ ID NO: 5349531 - DNA, 22 bp, Homo sapiens
aatttctataaatttaagaaaa

SEQ ID NO: 5349532 - DNA, 16 bp, Homo sapiens
aatttctattaaaggt

SEQ ID NO: 5349533 - DNA, 14 bp, Homo sapiens
aatttctattgtgt

SEQ ID NO: 5349534 - DNA, 15 bp, Homo sapiens
aatttctattgtgtt

SEQ ID NO: 5349535 - DNA, 17 bp, Homo sapiens
aatttctattgtgtttc

SEQ ID NO: 5349536 - DNA, 19 bp, Homo sapiens
aatttctcaatctatgtga

SEQ ID NO: 5349537 - DNA, 18 bp, Homo sapiens
aatttctcacctgaaaat

SEQ ID NO: 5349538 - DNA, 20 bp, Homo sapiens
aatttctcagtttttgctga

SEQ ID NO: 5349539 - DNA, 14 bp, Homo sapiens
aatttctcatcaca

SEQ ID NO: 5349540 - DNA, 13 bp, Homo sapiens
aatttctccccag

SEQ ID NO: 5349541 - DNA, 21 bp, Homo sapiens
aatttctcccgaatcctgagg

SEQ ID NO: 5349542 - DNA, 15 bp, Homo sapiens
aatttctcctcattt

SEQ ID NO: 5349543 - DNA, 22 bp, Homo sapiens
aatttctcctcatttaatattt

SEQ ID NO: 5349544 - DNA, 23 bp, Homo sapiens
aatttctctacagatgtcccatt

SEQ ID NO: 5349545 - DNA, 20 bp, Homo sapiens
aatttctctcaatttgggtc

SEQ ID NO: 5349546 - DNA, 18 bp, Homo sapiens
aatttctctcagatttcc

SEQ ID NO: 5349547 - DNA, 19 bp, Homo sapiens
aatttctctcagatttcca

SEQ ID NO: 5349548 - DNA, 12 bp, Homo sapiens
aatttctcttgt

SEQ ID NO: 5349549 - DNA, 19 bp, Homo sapiens
aatttctctttttgaaaaa

SEQ ID NO: 5349550 - DNA, 19 bp, Homo sapiens
aatttctgaagaagttaat

SEQ ID NO: 5349551 - DNA, 20 bp, Homo sapiens
aatttctgaagaagttaatt

SEQ ID NO: 5349552 - DNA, 22 bp, Homo sapiens
aatttctgagaacagtgcacaa

SEQ ID NO: 5349553 - DNA, 21 bp, Homo sapiens
aatttctgattataagacaat

SEQ ID NO: 5349554 - DNA, 22 bp, Homo sapiens
aatttctgcacaggtctctgtt

SEQ ID NO: 5349555 - DNA, 23 bp, Homo sapiens
aatttctgccaataaattctaaa

SEQ ID NO: 5349556 - DNA, 18 bp, Homo sapiens
aatttctgccatttcatg

SEQ ID NO: 5349557 - DNA, 18 bp, Homo sapiens
aatttctgccctgagccc

SEQ ID NO: 5349558 - DNA, 20 bp, Homo sapiens
aatttctgcctttcccccct

SEQ ID NO: 5349559 - DNA, 12 bp, Homo sapiens
aatttctgcttg

SEQ ID NO: 5349560 - DNA, 13 bp, Homo sapiens
aatttctgtacat

SEQ ID NO: 5349561 - DNA, 14 bp, Homo sapiens
aatttctgtacatt

SEQ ID NO: 5349562 - DNA, 21 bp, Homo sapiens
aatttctgtacatttgcaatt

SEQ ID NO: 5349563 - DNA, 18 bp, Homo sapiens
aatttctgtcagaatgct

SEQ ID NO: 5349564 - DNA, 18 bp, Homo sapiens
aatttctgtccagaaaat

SEQ ID NO: 5349565 - DNA, 17 bp, Homo sapiens
aatttctgtctttctgc

SEQ ID NO: 5349566 - DNA, 20 bp, Homo sapiens
aatttcttaacttcttgctt

SEQ ID NO: 5349567 - DNA, 15 bp, Homo sapiens
aatttcttatttacc

SEQ ID NO: 5349568 - DNA, 16 bp, Homo sapiens
aatttcttcaaaatgt

SEQ ID NO: 5349569 - DNA, 23 bp, Homo sapiens
aatttcttcatgtgatgtcatga

SEQ ID NO: 5349570 - DNA, 19 bp, Homo sapiens
aatttcttcccccaaagcc

SEQ ID NO: 5349571 - DNA, 13 bp, Homo sapiens
aatttcttccttc

SEQ ID NO: 5349572 - DNA, 16 bp, Homo sapiens
aatttcttgcaatttg

SEQ ID NO: 5349573 - DNA, 20 bp, Homo sapiens
aatttcttgcaatttgaagg

SEQ ID NO: 5349574 - DNA, 21 bp, Homo sapiens
aatttcttgctctatctctca

SEQ ID NO: 5349575 - DNA, 15 bp, Homo sapiens
aatttcttgtttctc

SEQ ID NO: 5349576 - DNA, 13 bp, Homo sapiens
aatttctttaaaa

SEQ ID NO: 5349577 - DNA, 17 bp, Homo sapiens
aatttctttaaaaaaga

SEQ ID NO: 5349578 - DNA, 20 bp, Homo sapiens
aatttctttaaaaaagaaat

SEQ ID NO: 5349579 - DNA, 16 bp, Homo sapiens
aatttctttataaaat

SEQ ID NO: 5349580 - DNA, 18 bp, Homo sapiens
aatttctttgcctgttca

SEQ ID NO: 5349581 - DNA, 13 bp, Homo sapiens
aatttcttttgct

SEQ ID NO: 5349582 - DNA, 21 bp, Homo sapiens
aatttgaaaaaactttctctt

SEQ ID NO: 5349583 - DNA, 15 bp, Homo sapiens
aatttgaaaaagttc

SEQ ID NO: 5349584 - DNA, 19 bp, Homo sapiens
aatttgaaaataattgttc

SEQ ID NO: 5349585 - DNA, 16 bp, Homo sapiens
aatttgaaaatgataa

SEQ ID NO: 5349586 - DNA, 14 bp, Homo sapiens
aatttgaaaatgtc

SEQ ID NO: 5349587 - DNA, 13 bp, Homo sapiens
aatttgaaacatt

SEQ ID NO: 5349588 - DNA, 14 bp, Homo sapiens
aatttgaaacattg

SEQ ID NO: 5349589 - DNA, 19 bp, Homo sapiens
aatttgaaaggaaaaacag

SEQ ID NO: 5349590 - DNA, 20 bp, Homo sapiens
aatttgaaatggttgtcacc

SEQ ID NO: 5349591 - DNA, 14 bp, Homo sapiens
aatttgaaatttag

SEQ ID NO: 5349592 - DNA, 21 bp, Homo sapiens
aatttgaacaggtcaaagatg

SEQ ID NO: 5349593 - DNA, 17 bp, Homo sapiens
aatttgaagaattaatg

SEQ ID NO: 5349594 - DNA, 17 bp, Homo sapiens
aatttgaagatgtggat

SEQ ID NO: 5349595 - DNA, 14 bp, Homo sapiens
aatttgaagtaact

SEQ ID NO: 5349596 - DNA, 15 bp, Homo sapiens
aatttgaagtaactt

SEQ ID NO: 5349597 - DNA, 21 bp, Homo sapiens
aatttgaagtaacttatttga

SEQ ID NO: 5349598 - DNA, 15 bp, Homo sapiens
aatttgaatgaaaaa

SEQ ID NO: 5349599 - DNA, 18 bp, Homo sapiens
aatttgaatggattaaat

SEQ ID NO: 5349600 - DNA, 23 bp, Homo sapiens
aatttgaatggattaaatggcac

SEQ ID NO: 5349601 - DNA, 16 bp, Homo sapiens
aatttgaatgtatttg

SEQ ID NO: 5349602 - DNA, 17 bp, Homo sapiens
aatttgaattaaagttt

SEQ ID NO: 5349603 - DNA, 16 bp, Homo sapiens
aatttgaattttgtgt

SEQ ID NO: 5349604 - DNA, 18 bp, Homo sapiens
aatttgaattttgtgtta

SEQ ID NO: 5349605 - DNA, 19 bp, Homo sapiens
aatttgacattgtcagaat

SEQ ID NO: 5349606 - DNA, 20 bp, Homo sapiens
aatttgacattgtcagaatg

SEQ ID NO: 5349607 - DNA, 16 bp, Homo sapiens
aatttgacttttctgt

SEQ ID NO: 5349608 - DNA, 17 bp, Homo sapiens
aatttgacttttctgta

SEQ ID NO: 5349609 - DNA, 19 bp, Homo sapiens
aatttgacttttctgtaat

SEQ ID NO: 5349610 - DNA, 17 bp, Homo sapiens
aatttgagaattattcc

SEQ ID NO: 5349611 - DNA, 18 bp, Homo sapiens
aatttgagcaattcattt

SEQ ID NO: 5349612 - DNA, 16 bp, Homo sapiens
aatttgagccatttaa

SEQ ID NO: 5349613 - DNA, 15 bp, Homo sapiens
aatttgagtttgctg

SEQ ID NO: 5349614 - DNA, 14 bp, Homo sapiens
aatttgataaaaac

SEQ ID NO: 5349615 - DNA, 19 bp, Homo sapiens
aatttgataaacattcctg

SEQ ID NO: 5349616 - DNA, 14 bp, Homo sapiens
aatttgatacataa

SEQ ID NO: 5349617 - DNA, 15 bp, Homo sapiens
aatttgatacataat

SEQ ID NO: 5349618 - DNA, 17 bp, Homo sapiens
aatttgatacataataa

SEQ ID NO: 5349619 - DNA, 15 bp, Homo sapiens
aatttgatagatgtt

SEQ ID NO: 5349620 - DNA, 16 bp, Homo sapiens
aatttgatagatgttt

SEQ ID NO: 5349621 - DNA, 14 bp, Homo sapiens
aatttgatatcaca

SEQ ID NO: 5349622 - DNA, 15 bp, Homo sapiens
aatttgatatgtgaa

SEQ ID NO: 5349623 - DNA, 18 bp, Homo sapiens
aatttgatatgtgaacag

SEQ ID NO: 5349624 - DNA, 19 bp, Homo sapiens
aatttgatatgtgaacagt

SEQ ID NO: 5349625 - DNA, 18 bp, Homo sapiens
aatttgatgcccaatata

SEQ ID NO: 5349626 - DNA, 20 bp, Homo sapiens
aatttgatgcccaatatatt

SEQ ID NO: 5349627 - DNA, 23 bp, Homo sapiens
aatttgatggactaattattatt

SEQ ID NO: 5349628 - DNA, 18 bp, Homo sapiens
aatttgatggtatttctt

SEQ ID NO: 5349629 - DNA, 14 bp, Homo sapiens
aatttgatggtgaa

SEQ ID NO: 5349630 - DNA, 21 bp, Homo sapiens
aatttgatggtgaatattaca

SEQ ID NO: 5349631 - DNA, 22 bp, Homo sapiens
aatttgatgtggtgaaaagcag

SEQ ID NO: 5349632 - DNA, 15 bp, Homo sapiens
aatttgattaacaaa

SEQ ID NO: 5349633 - DNA, 18 bp, Homo sapiens
aatttgattaacaaatat

SEQ ID NO: 5349634 - DNA, 14 bp, Homo sapiens
aatttgattgattt

SEQ ID NO: 5349635 - DNA, 17 bp, Homo sapiens
aatttgattgatttgaa

SEQ ID NO: 5349636 - DNA, 12 bp, Homo sapiens
aatttgatttcc

SEQ ID NO: 5349637 - DNA, 11 bp, Homo sapiens
aatttgcaaag

SEQ ID NO: 5349638 - DNA, 16 bp, Homo sapiens
aatttgcaaagtactg

SEQ ID NO: 5349639 - DNA, 13 bp, Homo sapiens
aatttgcaactca

SEQ ID NO: 5349640 - DNA, 12 bp, Homo sapiens
aatttgcacagt

SEQ ID NO: 5349641 - DNA, 16 bp, Homo sapiens
aatttgcacagtgata

SEQ ID NO: 5349642 - DNA, 18 bp, Homo sapiens
aatttgcacagtgtgtga

SEQ ID NO: 5349643 - DNA, 14 bp, Homo sapiens
aatttgcacattaa

SEQ ID NO: 5349644 - DNA, 23 bp, Homo sapiens
aatttgcaccagttttatccata

SEQ ID NO: 5349645 - DNA, 20 bp, Homo sapiens
aatttgcacggtttgtgaga

SEQ ID NO: 5349646 - DNA, 12 bp, Homo sapiens
aatttgcactga

SEQ ID NO: 5349647 - DNA, 22 bp, Homo sapiens
aatttgcataatactaatttat

SEQ ID NO: 5349648 - DNA, 15 bp, Homo sapiens
aatttgcatccagca

SEQ ID NO: 5349649 - DNA, 13 bp, Homo sapiens
aatttgcatgtct

SEQ ID NO: 5349650 - DNA, 23 bp, Homo sapiens
aatttgcattaaattcacaaact

SEQ ID NO: 5349651 - DNA, 22 bp, Homo sapiens
aatttgccaccactagagctga

SEQ ID NO: 5349652 - DNA, 23 bp, Homo sapiens
aatttgccagaggaccaatgctt

SEQ ID NO: 5349653 - DNA, 22 bp, Homo sapiens
aatttgccagttttattttcta

SEQ ID NO: 5349654 - DNA, 19 bp, Homo sapiens
aatttgccatgacatttca

SEQ ID NO: 5349655 - DNA, 22 bp, Homo sapiens
aatttgccatttttattagaaa

SEQ ID NO: 5349656 - DNA, 13 bp, Homo sapiens
aatttgcccctgg

SEQ ID NO: 5349657 - DNA, 20 bp, Homo sapiens
aatttgccctgggaaacccc

SEQ ID NO: 5349658 - DNA, 23 bp, Homo sapiens
aatttgcctaatatgatgactgt

SEQ ID NO: 5349659 - DNA, 13 bp, Homo sapiens
aatttgcctctgt

SEQ ID NO: 5349660 - DNA, 15 bp, Homo sapiens
aatttgcctgctggg

SEQ ID NO: 5349661 - DNA, 23 bp, Homo sapiens
aatttgcgcctcggtatctggct

SEQ ID NO: 5349662 - DNA, 18 bp, Homo sapiens
aatttgctatttacaaat

SEQ ID NO: 5349663 - DNA, 20 bp, Homo sapiens
aatttgctgccaaatgcgta

SEQ ID NO: 5349664 - DNA, 23 bp, Homo sapiens
aatttgctggaacacaaagacca

SEQ ID NO: 5349665 - DNA, 20 bp, Homo sapiens
aatttgctggagaagtgtgt

SEQ ID NO: 5349666 - DNA, 11 bp, Homo sapiens
aatttgcttta

SEQ ID NO: 5349667 - DNA, 14 bp, Homo sapiens
aatttggaaactaa

SEQ ID NO: 5349668 - DNA, 16 bp, Homo sapiens
aatttggaaactaata

SEQ ID NO: 5349669 - DNA, 21 bp, Homo sapiens
aatttggaaactaataaaata

SEQ ID NO: 5349670 - DNA, 19 bp, Homo sapiens
aatttggagcacaaaattc

SEQ ID NO: 5349671 - DNA, 21 bp, Homo sapiens
aatttggagcacaaaattcaa

SEQ ID NO: 5349672 - DNA, 15 bp, Homo sapiens
aatttggagcattaa

SEQ ID NO: 5349673 - DNA, 17 bp, Homo sapiens
aatttggagtaaatata

SEQ ID NO: 5349674 - DNA, 20 bp, Homo sapiens
aatttggataataaaaattg

SEQ ID NO: 5349675 - DNA, 16 bp, Homo sapiens
aatttggattgctaat

SEQ ID NO: 5349676 - DNA, 14 bp, Homo sapiens
aatttggcaaaaca

SEQ ID NO: 5349677 - DNA, 15 bp, Homo sapiens
aatttggcaaaacaa

SEQ ID NO: 5349678 - DNA, 15 bp, Homo sapiens
aatttggcccagaga

SEQ ID NO: 5349679 - DNA, 13 bp, Homo sapiens
aatttggccttaa

SEQ ID NO: 5349680 - DNA, 19 bp, Homo sapiens
aatttggccttaagaactg

SEQ ID NO: 5349681 - DNA, 21 bp, Homo sapiens
aatttggccttaagaactgtg

SEQ ID NO: 5349682 - DNA, 23 bp, Homo sapiens
aatttggccttaagaactgtgtc

SEQ ID NO: 5349683 - DNA, 12 bp, Homo sapiens
aatttggctgct

SEQ ID NO: 5349684 - DNA, 23 bp, Homo sapiens
aatttggcttcatactctttctt

SEQ ID NO: 5349685 - DNA, 16 bp, Homo sapiens
aatttttgaaaaatat

SEQ ID NO: 5349686 - DNA, 19 bp, Homo sapiens
aatttttgagttacaattt

SEQ ID NO: 5349687 - DNA, 13 bp, Homo sapiens
aatttttgcatgt

SEQ ID NO: 5349688 - DNA, 16 bp, Homo sapiens
aatttttgcatgttta

SEQ ID NO: 5349689 - DNA, 20 bp, Homo sapiens
aatttttgccttcattacct

SEQ ID NO: 5349690 - DNA, 20 bp, Homo sapiens
aatttttgcttttagaaaag

SEQ ID NO: 5349691 - DNA, 18 bp, Homo sapiens
aatttttggattgacagt

SEQ ID NO: 5349692 - DNA, 21 bp, Homo sapiens
aatttttggggaaaaaagcac

SEQ ID NO: 5349693 - DNA, 23 bp, Homo sapiens
aatttttggtgggtgaaaggaat

SEQ ID NO: 5349694 - DNA, 14 bp, Homo sapiens
aatttttggttgaa

SEQ ID NO: 5349695 - DNA, 17 bp, Homo sapiens
aatttttgtaagaaaat

SEQ ID NO: 5349696 - DNA, 14 bp, Homo sapiens
aatttttgtacatc

SEQ ID NO: 5349697 - DNA, 17 bp, Homo sapiens
aatttttgtctcagaag

SEQ ID NO: 5349698 - DNA, 13 bp, Homo sapiens
aatttttgttttg

SEQ ID NO: 5349699 - DNA, 13 bp, Homo sapiens
aattttttaaaga

SEQ ID NO: 5349700 - DNA, 15 bp, Homo sapiens
aattttttaaatgaa

SEQ ID NO: 5349701 - DNA, 21 bp, Homo sapiens
aattttttaagtgaaaatata

SEQ ID NO: 5349702 - DNA, 23 bp, Homo sapiens
aattttttacattttcctgtgta

SEQ ID NO: 5349703 - DNA, 19 bp, Homo sapiens
aattttttacgtagctatt

SEQ ID NO: 5349704 - DNA, 17 bp, Homo sapiens
aattttttataaaagtg

SEQ ID NO: 5349705 - DNA, 18 bp, Homo sapiens
aattttttatcatgcatg

SEQ ID NO: 5349706 - DNA, 12 bp, Homo sapiens
aattttttcaaa

SEQ ID NO: 5349707 - DNA, 11 bp, Homo sapiens
aattttttcct

SEQ ID NO: 5349708 - DNA, 15 bp, Homo sapiens
aattttttgaacttt

SEQ ID NO: 5349709 - DNA, 13 bp, Homo sapiens
aattttttgaata

SEQ ID NO: 5349710 - DNA, 17 bp, Homo sapiens
aattttttgaatatgcc

SEQ ID NO: 5349711 - DNA, 19 bp, Homo sapiens
aattttttgatgtcagcct

SEQ ID NO: 5349712 - DNA, 13 bp, Homo sapiens
aattttttgatta

SEQ ID NO: 5349713 - DNA, 20 bp, Homo sapiens
aattttttggcacttgccat

SEQ ID NO: 5349714 - DNA, 15 bp, Homo sapiens
aattttttggtacaa

SEQ ID NO: 5349715 - DNA, 20 bp, Homo sapiens
aattttttggtacaaaaata

SEQ ID NO: 5349716 - DNA, 21 bp, Homo sapiens
aattttttggtacaaaaataa

SEQ ID NO: 5349717 - DNA, 15 bp, Homo sapiens
aattttttgtgatga

SEQ ID NO: 5349718 - DNA, 20 bp, Homo sapiens
aattttttgttcttcagaga

SEQ ID NO: 5349719 - DNA, 18 bp, Homo sapiens
aatttttttagaaagcat

SEQ ID NO: 5349720 - DNA, 20 bp, Homo sapiens
aatttttttagaaagcattt

SEQ ID NO: 5349721 - DNA, 22 bp, Homo sapiens
aatttttttatcgtcactgctt

SEQ ID NO: 5349722 - DNA, 16 bp, Homo sapiens
aatttttttattgttt

SEQ ID NO: 5349723 - DNA, 14 bp, Homo sapiens
aatttttttcagta

SEQ ID NO: 5349724 - DNA, 18 bp, Homo sapiens
aatttttttccagaattg

SEQ ID NO: 5349725 - DNA, 15 bp, Homo sapiens
aatttttttcctgct

SEQ ID NO: 5349726 - DNA, 16 bp, Homo sapiens
aatttttttctgcaac

SEQ ID NO: 5349727 - DNA, 20 bp, Homo sapiens
aatttttttgtaaaggaaat

SEQ ID NO: 5349728 - DNA, 14 bp, Homo sapiens
aatttttttgtatg

SEQ ID NO: 5349729 - DNA, 15 bp, Homo sapiens
aatttttttgtatga

SEQ ID NO: 5349730 - DNA, 18 bp, Homo sapiens
aatttttttgtattttag

SEQ ID NO: 5349731 - DNA, 15 bp, Homo sapiens
aattttttttaaaga

SEQ ID NO: 5349732 - DNA, 17 bp, Homo sapiens
aattttttttaatgtac

SEQ ID NO: 5349733 - DNA, 12 bp, Homo sapiens
aattttttttac

SEQ ID NO: 5349734 - DNA, 16 bp, Homo sapiens
aattttttttacattt

SEQ ID NO: 5349735 - DNA, 22 bp, Homo sapiens
aattttttttattagtattgtt

SEQ ID NO: 5349736 - DNA, 23 bp, Homo sapiens
aattttttttattagtattgttg

SEQ ID NO: 5349737 - DNA, 18 bp, Homo sapiens
aattttttttcaaatgtg

SEQ ID NO: 5349738 - DNA, 23 bp, Homo sapiens
aattttttttcatgttttaacaa

SEQ ID NO: 5349739 - DNA, 20 bp, Homo sapiens
aattttttttctgaacaaaa

SEQ ID NO: 5349740 - DNA, 15 bp, Homo sapiens
aattttttttgtaca

SEQ ID NO: 5349741 - DNA, 21 bp, Homo sapiens
aattttttttgttgtttcagt

SEQ ID NO: 5349742 - DNA, 21 bp, Homo sapiens
aattttttttgttttttgtaa

SEQ ID NO: 5349743 - DNA, 23 bp, Homo sapiens
aattttttttgttttttgtaact

SEQ ID NO: 5349744 - DNA, 20 bp, Homo sapiens
aatttttttttcatagagat

SEQ ID NO: 5349745 - DNA, 14 bp, Homo sapiens
aatttttttttcct

SEQ ID NO: 5349746 - DNA, 19 bp, Homo sapiens
aatttttttttcctagccc

SEQ ID NO: 5349747 - DNA, 15 bp, Homo sapiens
aatttttttttcctt

SEQ ID NO: 5349748 - DNA, 17 bp, Homo sapiens
aatttttttttctcttt

SEQ ID NO: 5349749 - DNA, 21 bp, Homo sapiens
aattttttttttcctcttcag

SEQ ID NO: 5349750 - DNA, 12 bp, Homo sapiens
acaaaaaaaaga

SEQ ID NO: 5349751 - DNA, 16 bp, Homo sapiens
acaaaaaaaattttag

SEQ ID NO: 5349752 - DNA, 22 bp, Homo sapiens
acaaaaaaaattttagctcttc

SEQ ID NO: 5349753 - DNA, 19 bp, Homo sapiens
acaaaaaaagttgaaggcc

SEQ ID NO: 5349754 - DNA, 23 bp, Homo sapiens
acaaaaaaagtttgttactttga

SEQ ID NO: 5349755 - DNA, 17 bp, Homo sapiens
acaaaaaaatatattta

SEQ ID NO: 5349756 - DNA, 14 bp, Homo sapiens
acaaaaaacaatat

SEQ ID NO: 5349757 - DNA, 15 bp, Homo sapiens
acaaaaaacaatatt

SEQ ID NO: 5349758 - DNA, 17 bp, Homo sapiens
acaaaaaacagattcta

SEQ ID NO: 5349759 - DNA, 16 bp, Homo sapiens
acaaaaaaccaggatg

SEQ ID NO: 5349760 - DNA, 20 bp, Homo sapiens
acaaaaaacccacaattgaa

SEQ ID NO: 5349761 - DNA, 14 bp, Homo sapiens
acaaaaaaccgagg

SEQ ID NO: 5349762 - DNA, 21 bp, Homo sapiens
acaaaaaacggggagaaataa

SEQ ID NO: 5349763 - DNA, 12 bp, Homo sapiens
acaaaaaacttt

SEQ ID NO: 5349764 - DNA, 15 bp, Homo sapiens
acaaaaaacttttaa

SEQ ID NO: 5349765 - DNA, 14 bp, Homo sapiens
acaaaaaagaaaaa

SEQ ID NO: 5349766 - DNA, 12 bp, Homo sapiens
acaaaaaagaag

SEQ ID NO: 5349767 - DNA, 15 bp, Homo sapiens
acaaaaaagagaaac

SEQ ID NO: 5349768 - DNA, 12 bp, Homo sapiens
acaaaaaagcaa

SEQ ID NO: 5349769 - DNA, 13 bp, Homo sapiens
acaaaaaaggttt

SEQ ID NO: 5349770 - DNA, 17 bp, Homo sapiens
acaaaaaatattcatct

SEQ ID NO: 5349771 - DNA, 15 bp, Homo sapiens
acaaaaaatgtaatt

SEQ ID NO: 5349772 - DNA, 12 bp, Homo sapiens
acaaaaacaaaa

SEQ ID NO: 5349773 - DNA, 17 bp, Homo sapiens
acaaaaacaaaaaaact

SEQ ID NO: 5349774 - DNA, 20 bp, Homo sapiens
acaaaaacagaatttgagaa

SEQ ID NO: 5349775 - DNA, 13 bp, Homo sapiens
acaaaaacaggta

SEQ ID NO: 5349776 - DNA, 18 bp, Homo sapiens
acaaaaaccaaatgttta

SEQ ID NO: 5349777 - DNA, 12 bp, Homo sapiens
acaaaaaccttg

SEQ ID NO: 5349778 - DNA, 23 bp, Homo sapiens
acaaaaaccttggcataagacag

SEQ ID NO: 5349779 - DNA, 17 bp, Homo sapiens
acaaaaactttccatga

SEQ ID NO: 5349780 - DNA, 20 bp, Homo sapiens
acaaaaactttccatgacag

SEQ ID NO: 5349781 - DNA, 14 bp, Homo sapiens
acaaaaagaaaaga

SEQ ID NO: 5349782 - DNA, 18 bp, Homo sapiens
acaaaaagaaaagaaaat

SEQ ID NO: 5349783 - DNA, 19 bp, Homo sapiens
acaaaaagaaatcttgtct

SEQ ID NO: 5349784 - DNA, 20 bp, Homo sapiens
acaaaaagaaatcttgtctt

SEQ ID NO: 5349785 - DNA, 16 bp, Homo sapiens
acaaaaagagaagctg

SEQ ID NO: 5349786 - DNA, 20 bp, Homo sapiens
acaaaaagataccttaaaat

SEQ ID NO: 5349787 - DNA, 13 bp, Homo sapiens
acaaaaagcacaa

SEQ ID NO: 5349788 - DNA, 20 bp, Homo sapiens
acaaaaagccacaatgaaca

SEQ ID NO: 5349789 - DNA, 22 bp, Homo sapiens
acaaaaaggcaaatattgaagt

SEQ ID NO: 5349790 - DNA, 16 bp, Homo sapiens
acaaaaagtaaagtaa

SEQ ID NO: 5349791 - DNA, 18 bp, Homo sapiens
acaaaaagtaatgtatat

SEQ ID NO: 5349792 - DNA, 15 bp, Homo sapiens
acaaaaagtgcttca

SEQ ID NO: 5349793 - DNA, 10 bp, Homo sapiens
acaaaaataa

SEQ ID NO: 5349794 - DNA, 12 bp, Homo sapiens
acaaaaataaaa

SEQ ID NO: 5349795 - DNA, 20 bp, Homo sapiens
acaaaaataaagactagagc

SEQ ID NO: 5349796 - DNA, 14 bp, Homo sapiens
acaaaaataaattt

SEQ ID NO: 5349797 - DNA, 19 bp, Homo sapiens
acaaaaatactctaattct

SEQ ID NO: 5349798 - DNA, 21 bp, Homo sapiens
acaaaaatactctaattctaa

SEQ ID NO: 5349799 - DNA, 14 bp, Homo sapiens
acaaaaatatcttg

SEQ ID NO: 5349800 - DNA, 20 bp, Homo sapiens
acaaaaatatttcagcaaac

SEQ ID NO: 5349801 - DNA, 15 bp, Homo sapiens
acaaaaatcagccag

SEQ ID NO: 5349802 - DNA, 17 bp, Homo sapiens
acaaaaatcagccagac

SEQ ID NO: 5349803 - DNA, 12 bp, Homo sapiens
acaaaaatggga

SEQ ID NO: 5349804 - DNA, 14 bp, Homo sapiens
acaaaaatggtaac

SEQ ID NO: 5349805 - DNA, 10 bp, Homo sapiens
acaaaaatgt

SEQ ID NO: 5349806 - DNA, 21 bp, Homo sapiens
acaaaaatgtaatgatcataa

SEQ ID NO: 5349807 - DNA, 17 bp, Homo sapiens
acaaaaattcacaagct

SEQ ID NO: 5349808 - DNA, 18 bp, Homo sapiens
acaaaaattgagagcttt

SEQ ID NO: 5349809 - DNA, 20 bp, Homo sapiens
acaaaaattgagagctttat

SEQ ID NO: 5349810 - DNA, 13 bp, Homo sapiens
acaaaaatttgaa

SEQ ID NO: 5349811 - DNA, 10 bp, Homo sapiens
acaaaacaaa

SEQ ID NO: 5349812 - DNA, 14 bp, Homo sapiens
acaaaacaaaacaa

SEQ ID NO: 5349813 - DNA, 17 bp, Homo sapiens
acaaaacaaaacaacaa

SEQ ID NO: 5349814 - DNA, 15 bp, Homo sapiens
acaaaacaaaactat

SEQ ID NO: 5349815 - DNA, 15 bp, Homo sapiens
acaaaacaaacttcc

SEQ ID NO: 5349816 - DNA, 15 bp, Homo sapiens
acaaaacaaatcctg

SEQ ID NO: 5349817 - DNA, 14 bp, Homo sapiens
acaaaacaacaaaa

SEQ ID NO: 5349818 - DNA, 19 bp, Homo sapiens
acaaaacaacaaaaaccaa

SEQ ID NO: 5349819 - DNA, 14 bp, Homo sapiens
acaaaacaacagca

SEQ ID NO: 5349820 - DNA, 17 bp, Homo sapiens
acaaaacaacagcaaca

SEQ ID NO: 5349821 - DNA, 20 bp, Homo sapiens
acaaaacacaggttttttca

SEQ ID NO: 5349822 - DNA, 21 bp, Homo sapiens
acaaaacatcttaggcacttt

SEQ ID NO: 5349823 - DNA, 14 bp, Homo sapiens
acaaaacattcatg

SEQ ID NO: 5349824 - DNA, 16 bp, Homo sapiens
acaaaaccaaaagtta

SEQ ID NO: 5349825 - DNA, 17 bp, Homo sapiens
acaaaaccaagccttgg

SEQ ID NO: 5349826 - DNA, 15 bp, Homo sapiens
acaaaaccacagtgt

SEQ ID NO: 5349827 - DNA, 18 bp, Homo sapiens
acaaaaccctcagcactg

SEQ ID NO: 5349828 - DNA, 15 bp, Homo sapiens
acaaaacctattttt

SEQ ID NO: 5349829 - DNA, 15 bp, Homo sapiens
acaaaacgagtcttt

SEQ ID NO: 5349830 - DNA, 17 bp, Homo sapiens
acaaaacgcgcagatgt

SEQ ID NO: 5349831 - DNA, 15 bp, Homo sapiens
acaaaactatacttg

SEQ ID NO: 5349832 - DNA, 21 bp, Homo sapiens
acaaaactatacttgaacaaa

SEQ ID NO: 5349833 - DNA, 23 bp, Homo sapiens
acaaaactatcctatgccttcaa

SEQ ID NO: 5349834 - DNA, 16 bp, Homo sapiens
acaaaactatggaaat

SEQ ID NO: 5349835 - DNA, 14 bp, Homo sapiens
acaaaactgcattt

SEQ ID NO: 5349836 - DNA, 14 bp, Homo sapiens
acaaaactggatag

SEQ ID NO: 5349837 - DNA, 19 bp, Homo sapiens
acaaaacttaaaagtattc

SEQ ID NO: 5349838 - DNA, 13 bp, Homo sapiens
acaaaacttcttg

SEQ ID NO: 5349839 - DNA, 18 bp, Homo sapiens
acaaaacttcttgtcaga

SEQ ID NO: 5349840 - DNA, 12 bp, Homo sapiens
acaaaacttgaa

SEQ ID NO: 5349841 - DNA, 13 bp, Homo sapiens
acaaaacttgaaa

SEQ ID NO: 5349842 - DNA, 11 bp, Homo sapiens
acaaaactttg

SEQ ID NO: 5349843 - DNA, 14 bp, Homo sapiens
acaaaactttttaa

SEQ ID NO: 5349844 - DNA, 17 bp, Homo sapiens
acaaaagaaaaaagcaa

SEQ ID NO: 5349845 - DNA, 18 bp, Homo sapiens
acaaaagaaaaaatatta

SEQ ID NO: 5349846 - DNA, 15 bp, Homo sapiens
acaaaagaaatacct

SEQ ID NO: 5349847 - DNA, 16 bp, Homo sapiens
acaaaagaagattaaa

SEQ ID NO: 5349848 - DNA, 16 bp, Homo sapiens
acaaaagaagtgaaaa

SEQ ID NO: 5349849 - DNA, 14 bp, Homo sapiens
acaaaagacaagca

SEQ ID NO: 5349850 - DNA, 19 bp, Homo sapiens
acaaaagactagtttgtta

SEQ ID NO: 5349851 - DNA, 14 bp, Homo sapiens
acaaaagagagaat

SEQ ID NO: 5349852 - DNA, 11 bp, Homo sapiens
acaaaagatgt

SEQ ID NO: 5349853 - DNA, 14 bp, Homo sapiens
acaaaagatttgtt

SEQ ID NO: 5349854 - DNA, 19 bp, Homo sapiens
acaaaagcaaaatttttaa

SEQ ID NO: 5349855 - DNA, 15 bp, Homo sapiens
acaaaagcaaagatg

SEQ ID NO: 5349856 - DNA, 23 bp, Homo sapiens
acaaaagcaagactgttgctcaa

SEQ ID NO: 5349857 - DNA, 20 bp, Homo sapiens
acaaaagcaattttcattta

SEQ ID NO: 5349858 - DNA, 17 bp, Homo sapiens
acaaaagcagcacaagg

SEQ ID NO: 5349859 - DNA, 11 bp, Homo sapiens
acaaaagcatg

SEQ ID NO: 5349860 - DNA, 21 bp, Homo sapiens
acaaaagctgaacacatttct

SEQ ID NO: 5349861 - DNA, 22 bp, Homo sapiens
acaaaagctgaacacatttctt

SEQ ID NO: 5349862 - DNA, 15 bp, Homo sapiens
acaaaagctgtgtct

SEQ ID NO: 5349863 - DNA, 16 bp, Homo sapiens
acaaaagcttgtgtat

SEQ ID NO: 5349864 - DNA, 11 bp, Homo sapiens
acaaaaggaat

SEQ ID NO: 5349865 - DNA, 10 bp, Homo sapiens
acaaaaggca

SEQ ID NO: 5349866 - DNA, 14 bp, Homo sapiens
acaaataatttaag

SEQ ID NO: 5349867 - DNA, 20 bp, Homo sapiens
acaaatacaaagtggaaact

SEQ ID NO: 5349868 - DNA, 19 bp, Homo sapiens
acaaatacaatacatagga

SEQ ID NO: 5349869 - DNA, 12 bp, Homo sapiens
acaaatacacat

SEQ ID NO: 5349870 - DNA, 19 bp, Homo sapiens
acaaatacattcaaattct

SEQ ID NO: 5349871 - DNA, 20 bp, Homo sapiens
acaaatactatccaaataaa

SEQ ID NO: 5349872 - DNA, 19 bp, Homo sapiens
acaaataggatgcttggga

SEQ ID NO: 5349873 - DNA, 20 bp, Homo sapiens
acaaataggatgtactgttg

SEQ ID NO: 5349874 - DNA, 23 bp, Homo sapiens
acaaataggtagagtcattcata

SEQ ID NO: 5349875 - DNA, 19 bp, Homo sapiens
acaaatagtaggcaagatg

SEQ ID NO: 5349876 - DNA, 23 bp, Homo sapiens
acaaatagtaggcaagatggcac

SEQ ID NO: 5349877 - DNA, 22 bp, Homo sapiens
acaaatagtaggctaaaaacat

SEQ ID NO: 5349878 - DNA, 17 bp, Homo sapiens
acaaatagtgctaataa

SEQ ID NO: 5349879 - DNA, 14 bp, Homo sapiens
acaaatataagaat

SEQ ID NO: 5349880 - DNA, 15 bp, Homo sapiens
acaaatataagaata

SEQ ID NO: 5349881 - DNA, 17 bp, Homo sapiens
acaaatataagaataaa

SEQ ID NO: 5349882 - DNA, 14 bp, Homo sapiens
acaaatataagatt

SEQ ID NO: 5349883 - DNA, 19 bp, Homo sapiens
acaaatatactcatttgga

SEQ ID NO: 5349884 - DNA, 15 bp, Homo sapiens
acaaatatatgtata

SEQ ID NO: 5349885 - DNA, 12 bp, Homo sapiens
acaaatatattg

SEQ ID NO: 5349886 - DNA, 15 bp, Homo sapiens
acaaatatattgtta

SEQ ID NO: 5349887 - DNA, 16 bp, Homo sapiens
acaaatatatttaatt

SEQ ID NO: 5349888 - DNA, 17 bp, Homo sapiens
acaaatatatttaattg

SEQ ID NO: 5349889 - DNA, 19 bp, Homo sapiens
acaaatatatttaattgtg

SEQ ID NO: 5349890 - DNA, 20 bp, Homo sapiens
acaaatatccaccactttaa

SEQ ID NO: 5349891 - DNA, 21 bp, Homo sapiens
acaaatatcttgtgttgtcct

SEQ ID NO: 5349892 - DNA, 14 bp, Homo sapiens
acaaatatgctaaa

SEQ ID NO: 5349893 - DNA, 19 bp, Homo sapiens
acaaatatgctaaatgtta

SEQ ID NO: 5349894 - DNA, 17 bp, Homo sapiens
acaaatatgctaatttg

SEQ ID NO: 5349895 - DNA, 18 bp, Homo sapiens
acaaatatgctaatttgg

SEQ ID NO: 5349896 - DNA, 16 bp, Homo sapiens
acaaatattaaaaagt

SEQ ID NO: 5349897 - DNA, 17 bp, Homo sapiens
acaaatattaagaaaat

SEQ ID NO: 5349898 - DNA, 15 bp, Homo sapiens
acaaatattatttgt

SEQ ID NO: 5349899 - DNA, 21 bp, Homo sapiens
acaaatattatttgtgtttcc

SEQ ID NO: 5349900 - DNA, 23 bp, Homo sapiens
acaaatattgcttggactaccta

SEQ ID NO: 5349901 - DNA, 14 bp, Homo sapiens
acaaatattgtcat

SEQ ID NO: 5349902 - DNA, 20 bp, Homo sapiens
acaaatatttatatatttga

SEQ ID NO: 5349903 - DNA, 15 bp, Homo sapiens
acaaatatttcactt

SEQ ID NO: 5349904 - DNA, 21 bp, Homo sapiens
acaaatattttctttatttgt

SEQ ID NO: 5349905 - DNA, 13 bp, Homo sapiens
acaaatcaaattg

SEQ ID NO: 5349906 - DNA, 16 bp, Homo sapiens
acaaatcaacagaagc

SEQ ID NO: 5349907 - DNA, 13 bp, Homo sapiens
acaaatcaagttt

SEQ ID NO: 5349908 - DNA, 17 bp, Homo sapiens
acaaatcaagtttccaa

SEQ ID NO: 5349909 - DNA, 20 bp, Homo sapiens
acaaatcaagtttccaagca

SEQ ID NO: 5349910 - DNA, 22 bp, Homo sapiens
acaaatcaagtttccaagcaaa

SEQ ID NO: 5349911 - DNA, 22 bp, Homo sapiens
acaaatcaccatgtaacaacca

SEQ ID NO: 5349912 - DNA, 23 bp, Homo sapiens
acaaatcaccatgtaacaaccag

SEQ ID NO: 5349913 - DNA, 20 bp, Homo sapiens
acaaatcaccttaactccct

SEQ ID NO: 5349914 - DNA, 15 bp, Homo sapiens
acaaatcagaagtca

SEQ ID NO: 5349915 - DNA, 16 bp, Homo sapiens
acaaatcagaagtcat

SEQ ID NO: 5349916 - DNA, 15 bp, Homo sapiens
acaaatcagtaattt

SEQ ID NO: 5349917 - DNA, 16 bp, Homo sapiens
acaaatcattttgatg

SEQ ID NO: 5349918 - DNA, 17 bp, Homo sapiens
acaaatcattttgatgt

SEQ ID NO: 5349919 - DNA, 20 bp, Homo sapiens
acaaatcctaggctcctggg

SEQ ID NO: 5349920 - DNA, 19 bp, Homo sapiens
acaaatctaagggaaaaag

SEQ ID NO: 5349921 - DNA, 17 bp, Homo sapiens
acaaatctaatctctta

SEQ ID NO: 5349922 - DNA, 22 bp, Homo sapiens
acaaatctaatctcttattcta

SEQ ID NO: 5349923 - DNA, 13 bp, Homo sapiens
acaaatctatatt

SEQ ID NO: 5349924 - DNA, 15 bp, Homo sapiens
acaaatctatattaa

SEQ ID NO: 5349925 - DNA, 19 bp, Homo sapiens
acaaatctatattaaagtg

SEQ ID NO: 5349926 - DNA, 20 bp, Homo sapiens
acaaatctatttaattagga

SEQ ID NO: 5349927 - DNA, 16 bp, Homo sapiens
acaaatctcactgtat

SEQ ID NO: 5349928 - DNA, 19 bp, Homo sapiens
acaaatctgtataaatgtc

SEQ ID NO: 5349929 - DNA, 20 bp, Homo sapiens
acaaatctgtgtatattatt

SEQ ID NO: 5349930 - DNA, 15 bp, Homo sapiens
acaaatcttcaaggt

SEQ ID NO: 5349931 - DNA, 21 bp, Homo sapiens
acaaatcttcaaggtgtaaaa

SEQ ID NO: 5349932 - DNA, 13 bp, Homo sapiens
acaaatgaaaatg

SEQ ID NO: 5349933 - DNA, 15 bp, Homo sapiens
acaaatgaaaatgaa

SEQ ID NO: 5349934 - DNA, 18 bp, Homo sapiens
acaaatgaaaatgaatag

SEQ ID NO: 5349935 - DNA, 12 bp, Homo sapiens
acaaatgaaaga

SEQ ID NO: 5349936 - DNA, 15 bp, Homo sapiens
acaaatgaagaaagt

SEQ ID NO: 5349937 - DNA, 21 bp, Homo sapiens
acaaatgaagtatttcatgta

SEQ ID NO: 5349938 - DNA, 12 bp, Homo sapiens
acaaatgacttt

SEQ ID NO: 5349939 - DNA, 15 bp, Homo sapiens
acaaatgactttatt

SEQ ID NO: 5349940 - DNA, 17 bp, Homo sapiens
acaaatgactttattat

SEQ ID NO: 5349941 - DNA, 23 bp, Homo sapiens
acaaatgactttattatttattt

SEQ ID NO: 5349942 - DNA, 23 bp, Homo sapiens
acaaatgatcaccatgttagcct

SEQ ID NO: 5349943 - DNA, 21 bp, Homo sapiens
acaaatgatgttttcaggtgt

SEQ ID NO: 5349944 - DNA, 13 bp, Homo sapiens
acaaatgatttcc

SEQ ID NO: 5349945 - DNA, 22 bp, Homo sapiens
acaaatgcaaatttctataaat

SEQ ID NO: 5349946 - DNA, 16 bp, Homo sapiens
acaaatgcagacacac

SEQ ID NO: 5349947 - DNA, 21 bp, Homo sapiens
acaaatgcaggtgtcctgagc

SEQ ID NO: 5349948 - DNA, 21 bp, Homo sapiens
acaaatgcagtgtatttaatg

SEQ ID NO: 5349949 - DNA, 17 bp, Homo sapiens
acaaatgcataaatgca

SEQ ID NO: 5349950 - DNA, 18 bp, Homo sapiens
acaaatgcatctttgatg

SEQ ID NO: 5349951 - DNA, 18 bp, Homo sapiens
acaaatgcatgaacaagt

SEQ ID NO: 5349952 - DNA, 22 bp, Homo sapiens
acaaatgccaaattaaaaaaga

SEQ ID NO: 5349953 - DNA, 17 bp, Homo sapiens
acaaatgctattaaagt

SEQ ID NO: 5349954 - DNA, 14 bp, Homo sapiens
acaaatgctgtggt

SEQ ID NO: 5349955 - DNA, 23 bp, Homo sapiens
acaaatgcttttccaacccatga

SEQ ID NO: 5349956 - DNA, 14 bp, Homo sapiens
acaaatggaagaga

SEQ ID NO: 5349957 - DNA, 22 bp, Homo sapiens
acaaatggaagagaagagaaag

SEQ ID NO: 5349958 - DNA, 16 bp, Homo sapiens
acaaatggaggcctgt

SEQ ID NO: 5349959 - DNA, 14 bp, Homo sapiens
acaaatggccttta

SEQ ID NO: 5349960 - DNA, 16 bp, Homo sapiens
acaaatggctgtaaaa

SEQ ID NO: 5349961 - DNA, 13 bp, Homo sapiens
acaaatgggactg

SEQ ID NO: 5349962 - DNA, 18 bp, Homo sapiens
acaaatgggactgatgtc

SEQ ID NO: 5349963 - DNA, 17 bp, Homo sapiens
acaaatgggcgcccccc

SEQ ID NO: 5349964 - DNA, 17 bp, Homo sapiens
acaaatggtgaatggat

SEQ ID NO: 5349965 - DNA, 14 bp, Homo sapiens
acaaatgtaaacat

SEQ ID NO: 5349966 - DNA, 14 bp, Homo sapiens
acaaatgtattttg

SEQ ID NO: 5349967 - DNA, 16 bp, Homo sapiens
acaaatgtattttgaa

SEQ ID NO: 5349968 - DNA, 23 bp, Homo sapiens
acaaatgtattttgaagaatatt

SEQ ID NO: 5349969 - DNA, 18 bp, Homo sapiens
acaaatgtcattgtctac

SEQ ID NO: 5349970 - DNA, 16 bp, Homo sapiens
acaaatgtcctcagag

SEQ ID NO: 5349971 - DNA, 21 bp, Homo sapiens
acaaatgtctagtttctagtg

SEQ ID NO: 5349972 - DNA, 18 bp, Homo sapiens
acaaatgtgataatatat

SEQ ID NO: 5349973 - DNA, 18 bp, Homo sapiens
acaaatgtgatttttgta

SEQ ID NO: 5349974 - DNA, 19 bp, Homo sapiens
acaaatgtgatttttgtaa

SEQ ID NO: 5349975 - DNA, 13 bp, Homo sapiens
acaaatgtggcca

SEQ ID NO: 5349976 - DNA, 21 bp, Homo sapiens
acaaatgtggccaagcctatc

SEQ ID NO: 5349977 - DNA, 13 bp, Homo sapiens
acaaatgtgtact

SEQ ID NO: 5349978 - DNA, 12 bp, Homo sapiens
acaaatgtgtat

SEQ ID NO: 5349979 - DNA, 15 bp, Homo sapiens
acaaatgtgtatgtg

SEQ ID NO: 5349980 - DNA, 16 bp, Homo sapiens
acaaatgtgtttttct

SEQ ID NO: 5349981 - DNA, 20 bp, Homo sapiens
acaaatgtgtttttctatat

SEQ ID NO: 5349982 - DNA, 21 bp, Homo sapiens
acaaatgtgtttttctatata

SEQ ID NO: 5349983 - DNA, 22 bp, Homo sapiens
acaaatgtgtttttctatatag

SEQ ID NO: 5349984 - DNA, 20 bp, Homo sapiens
acaaatgttaaaatgtgttg

SEQ ID NO: 5349985 - DNA, 23 bp, Homo sapiens
acaaatgttgacctttgaggtct

SEQ ID NO: 5349986 - DNA, 21 bp, Homo sapiens
acaaatgtttataactctagg

SEQ ID NO: 5349987 - DNA, 23 bp, Homo sapiens
acaaatgttttgctcaatagatt

SEQ ID NO: 5349988 - DNA, 18 bp, Homo sapiens
acaaattaaaaacaccta

SEQ ID NO: 5349989 - DNA, 14 bp, Homo sapiens
acaaattaaaaaga

SEQ ID NO: 5349990 - DNA, 17 bp, Homo sapiens
acaaattaaaaagattc

SEQ ID NO: 5349991 - DNA, 16 bp, Homo sapiens
acaaattaactagata

SEQ ID NO: 5349992 - DNA, 22 bp, Homo sapiens
acaaattaactagatacagaat

SEQ ID NO: 5349993 - DNA, 17 bp, Homo sapiens
acaaattagcatgcaag

SEQ ID NO: 5349994 - DNA, 20 bp, Homo sapiens
acaaattataatgtattcat

SEQ ID NO: 5349995 - DNA, 15 bp, Homo sapiens
acaaattatcttaaa

SEQ ID NO: 5349996 - DNA, 21 bp, Homo sapiens
acaaattatgctaagaatttt

SEQ ID NO: 5349997 - DNA, 14 bp, Homo sapiens
acaaattcaaataa

SEQ ID NO: 5349998 - DNA, 19 bp, Homo sapiens
acaaattcagtctctgaat

SEQ ID NO: 5349999 - DNA, 23 bp, Homo sapiens
acaaattccgattagacctttat

SEQ ID NO: 5350000 - DNA, 16 bp, Homo sapiens
acaaattcctttcaga

SEQ ID NO: 5350001 - DNA, 22 bp, Homo sapiens
acaaattcctttcagagtttta

SEQ ID NO: 5350002 - DNA, 15 bp, Homo sapiens
acaaattctacagca

SEQ ID NO: 5350003 - DNA, 16 bp, Homo sapiens
acaaattctgtttctt

SEQ ID NO: 5350004 - DNA, 20 bp, Homo sapiens
acaaattctttagtactcaa

SEQ ID NO: 5350005 - DNA, 21 bp, Homo sapiens
acaaattctttagtactcaat

SEQ ID NO: 5350006 - DNA, 14 bp, Homo sapiens
acaaattgaaaaca

SEQ ID NO: 5350007 - DNA, 18 bp, Homo sapiens
acaaattgaaaacacact

SEQ ID NO: 5350008 - DNA, 14 bp, Homo sapiens
acaaattgaaagct

SEQ ID NO: 5350009 - DNA, 22 bp, Homo sapiens
acaaattgaactctttgaatga

SEQ ID NO: 5350010 - DNA, 14 bp, Homo sapiens
acaaattggacagc

SEQ ID NO: 5350011 - DNA, 16 bp, Homo sapiens
acaaattggagcaggg

SEQ ID NO: 5350012 - DNA, 17 bp, Homo sapiens
acaaattgtcgttttta

SEQ ID NO: 5350013 - DNA, 19 bp, Homo sapiens
acaaattgtttcattttgt

SEQ ID NO: 5350014 - DNA, 18 bp, Homo sapiens
acaaatttaaaacaaaca

SEQ ID NO: 5350015 - DNA, 15 bp, Homo sapiens
acaaatttatgcatt

SEQ ID NO: 5350016 - DNA, 17 bp, Homo sapiens
acaaatttatgcatttc

SEQ ID NO: 5350017 - DNA, 21 bp, Homo sapiens
acaaatttatgcatttcattc

SEQ ID NO: 5350018 - DNA, 23 bp, Homo sapiens
acaaatttgctttgggattttct

SEQ ID NO: 5350019 - DNA, 18 bp, Homo sapiens
acaaattttcaagtttac

SEQ ID NO: 5350020 - DNA, 19 bp, Homo sapiens
acaaattttcaagtttaca

SEQ ID NO: 5350021 - DNA, 13 bp, Homo sapiens
acaaattttcaca

SEQ ID NO: 5350022 - DNA, 21 bp, Homo sapiens
acaaattttcactgctgctcc

SEQ ID NO: 5350023 - DNA, 17 bp, Homo sapiens
acaaattttcagaaggt

SEQ ID NO: 5350024 - DNA, 14 bp, Homo sapiens
acaaattttggttt

SEQ ID NO: 5350025 - DNA, 20 bp, Homo sapiens
acaaattttggttttctact

SEQ ID NO: 5350026 - DNA, 22 bp, Homo sapiens
acaaatttttactcaggctttc

SEQ ID NO: 5350027 - DNA, 15 bp, Homo sapiens
acaaatttttcctgc

SEQ ID NO: 5350028 - DNA, 18 bp, Homo sapiens
acaaatttttctgcttta

SEQ ID NO: 5350029 - DNA, 10 bp, Homo sapiens
acaacaaaaa

SEQ ID NO: 5350030 - DNA, 11 bp, Homo sapiens
acaacaaaaaa

SEQ ID NO: 5350031 - DNA, 19 bp, Homo sapiens
acaacaaaaaatacattat

SEQ ID NO: 5350032 - DNA, 17 bp, Homo sapiens
acaacaaaaagcttccc

SEQ ID NO: 5350033 - DNA, 13 bp, Homo sapiens
acaacaaaaattt

SEQ ID NO: 5350034 - DNA, 12 bp, Homo sapiens
acaacaaaagaa

SEQ ID NO: 5350035 - DNA, 13 bp, Homo sapiens
acaacaaaaggaa

SEQ ID NO: 5350036 - DNA, 14 bp, Homo sapiens
acaacaaaaggaag

SEQ ID NO: 5350037 - DNA, 15 bp, Homo sapiens
acaacaaaaggaaga

SEQ ID NO: 5350038 - DNA, 13 bp, Homo sapiens
acaacaaaaggac

SEQ ID NO: 5350039 - DNA, 14 bp, Homo sapiens
acaacaaacactgt

SEQ ID NO: 5350040 - DNA, 22 bp, Homo sapiens
acaacaaaccaaaacagaacaa

SEQ ID NO: 5350041 - DNA, 13 bp, Homo sapiens
acaacaaagacat

SEQ ID NO: 5350042 - DNA, 18 bp, Homo sapiens
acaacaaagcatgctcag

SEQ ID NO: 5350043 - DNA, 15 bp, Homo sapiens
acaagtggcagacat

SEQ ID NO: 5350044 - DNA, 21 bp, Homo sapiens
acaagtggctccccacctgga

SEQ ID NO: 5350045 - DNA, 19 bp, Homo sapiens
acaagtgggaaaacatggt

SEQ ID NO: 5350046 - DNA, 16 bp, Homo sapiens
acaagtggtgaccaaa

SEQ ID NO: 5350047 - DNA, 17 bp, Homo sapiens
acaagtggtgtttattg

SEQ ID NO: 5350048 - DNA, 19 bp, Homo sapiens
acaagtggtgtttattgca

SEQ ID NO: 5350049 - DNA, 14 bp, Homo sapiens
acaagtggttaaaa

SEQ ID NO: 5350050 - DNA, 13 bp, Homo sapiens
acaagtgtacaga

SEQ ID NO: 5350051 - DNA, 15 bp, Homo sapiens
acaagtgtacagaag

SEQ ID NO: 5350052 - DNA, 20 bp, Homo sapiens
acaagtgtataactaaacta

SEQ ID NO: 5350053 - DNA, 15 bp, Homo sapiens
acaagtgttcttagg

SEQ ID NO: 5350054 - DNA, 23 bp, Homo sapiens
acaagtgttcttaggtttactgt

SEQ ID NO: 5350055 - DNA, 11 bp, Homo sapiens
acaagtgtttc

SEQ ID NO: 5350056 - DNA, 14 bp, Homo sapiens
acaagtgtttctag

SEQ ID NO: 5350057 - DNA, 21 bp, Homo sapiens
acaagtgttttagatgttact

SEQ ID NO: 5350058 - DNA, 17 bp, Homo sapiens
acaagttatttaaatct

SEQ ID NO: 5350059 - DNA, 13 bp, Homo sapiens
acaagttccatgg

SEQ ID NO: 5350060 - DNA, 19 bp, Homo sapiens
acaagttcctggtttgaat

SEQ ID NO: 5350061 - DNA, 22 bp, Homo sapiens
acaagttctggcaagagcagat

SEQ ID NO: 5350062 - DNA, 14 bp, Homo sapiens
acaagttgaagaag

SEQ ID NO: 5350063 - DNA, 15 bp, Homo sapiens
acaagttgaagaagc

SEQ ID NO: 5350064 - DNA, 16 bp, Homo sapiens
acaagttgaagaagct

SEQ ID NO: 5350065 - DNA, 20 bp, Homo sapiens
acaagttgagctatgactta

SEQ ID NO: 5350066 - DNA, 21 bp, Homo sapiens
acaagttgagctatgacttaa

SEQ ID NO: 5350067 - DNA, 17 bp, Homo sapiens
acaagttgcgacggaga

SEQ ID NO: 5350068 - DNA, 15 bp, Homo sapiens
acaagttgctttgtt

SEQ ID NO: 5350069 - DNA, 18 bp, Homo sapiens
acaagttgctttgttaca

SEQ ID NO: 5350070 - DNA, 16 bp, Homo sapiens
acaagttggagtcact

SEQ ID NO: 5350071 - DNA, 17 bp, Homo sapiens
acaagttggctagaaga

SEQ ID NO: 5350072 - DNA, 18 bp, Homo sapiens
acaagttggctagaagaa

SEQ ID NO: 5350073 - DNA, 21 bp, Homo sapiens
acaagttggctagaagaaagt

SEQ ID NO: 5350074 - DNA, 15 bp, Homo sapiens
acaagttgtgccttt

SEQ ID NO: 5350075 - DNA, 14 bp, Homo sapiens
acaagttgtgtttg

SEQ ID NO: 5350076 - DNA, 13 bp, Homo sapiens
acaagttgttaaa

SEQ ID NO: 5350077 - DNA, 23 bp, Homo sapiens
acaagttgttaaaacatttaata

SEQ ID NO: 5350078 - DNA, 17 bp, Homo sapiens
acaagttgttattgttg

SEQ ID NO: 5350079 - DNA, 17 bp, Homo sapiens
acaagttgtttatgtat

SEQ ID NO: 5350080 - DNA, 19 bp, Homo sapiens
acaagtttacttgtctttg

SEQ ID NO: 5350081 - DNA, 16 bp, Homo sapiens
acaagtttatgtggca

SEQ ID NO: 5350082 - DNA, 12 bp, Homo sapiens
acaagtttcaga

SEQ ID NO: 5350083 - DNA, 16 bp, Homo sapiens
acaagtttgctaaaag

SEQ ID NO: 5350084 - DNA, 20 bp, Homo sapiens
acaagtttgctaaaagaaga

SEQ ID NO: 5350085 - DNA, 14 bp, Homo sapiens
acaagttttaaata

SEQ ID NO: 5350086 - DNA, 13 bp, Homo sapiens
acaagttttagtt

SEQ ID NO: 5350087 - DNA, 19 bp, Homo sapiens
acaagttttagttaaaact

SEQ ID NO: 5350088 - DNA, 21 bp, Homo sapiens
acaagttttagttaaaactca

SEQ ID NO: 5350089 - DNA, 19 bp, Homo sapiens
acaagttttggcagccatg

SEQ ID NO: 5350090 - DNA, 21 bp, Homo sapiens
acaagttttgtataaataata

SEQ ID NO: 5350091 - DNA, 16 bp, Homo sapiens
acaataaaaaccaaat

SEQ ID NO: 5350092 - DNA, 20 bp, Homo sapiens
acaataaaaatggctcagat

SEQ ID NO: 5350093 - DNA, 16 bp, Homo sapiens
acaataaaacaaataa

SEQ ID NO: 5350094 - DNA, 23 bp, Homo sapiens
acaataaaactaaatgtgtacac

SEQ ID NO: 5350095 - DNA, 11 bp, Homo sapiens
acaataaaaga

SEQ ID NO: 5350096 - DNA, 13 bp, Homo sapiens
acaataaaagctt

SEQ ID NO: 5350097 - DNA, 12 bp, Homo sapiens
acaataaaatat

SEQ ID NO: 5350098 - DNA, 11 bp, Homo sapiens
acaataaacag

SEQ ID NO: 5350099 - DNA, 17 bp, Homo sapiens
acaataaacagctgaac

SEQ ID NO: 5350100 - DNA, 20 bp, Homo sapiens
acaataaacaggaattttat

SEQ ID NO: 5350101 - DNA, 21 bp, Homo sapiens
acaataaacaggaattttatt

SEQ ID NO: 5350102 - DNA, 12 bp, Homo sapiens
acaataaacgaa

SEQ ID NO: 5350103 - DNA, 23 bp, Homo sapiens
acaataaacgaaacacagaactc

SEQ ID NO: 5350104 - DNA, 12 bp, Homo sapiens
acaataaagaat

SEQ ID NO: 5350105 - DNA, 14 bp, Homo sapiens
acaataaagactga

SEQ ID NO: 5350106 - DNA, 13 bp, Homo sapiens
acaataaagagct

SEQ ID NO: 5350107 - DNA, 18 bp, Homo sapiens
acaataaagatacatgat

SEQ ID NO: 5350108 - DNA, 22 bp, Homo sapiens
acaataaagatacatgattgaa

SEQ ID NO: 5350109 - DNA, 17 bp, Homo sapiens
acaataaagcattttgc

SEQ ID NO: 5350110 - DNA, 20 bp, Homo sapiens
acaataaagcattttgcaaa

SEQ ID NO: 5350111 - DNA, 15 bp, Homo sapiens
acaataaagtttaca

SEQ ID NO: 5350112 - DNA, 18 bp, Homo sapiens
acaataaagtttacaagc

SEQ ID NO: 5350113 - DNA, 15 bp, Homo sapiens
acaataaagtttatt

SEQ ID NO: 5350114 - DNA, 14 bp, Homo sapiens
acaataaataatct

SEQ ID NO: 5350115 - DNA, 18 bp, Homo sapiens
acaataaatatacttctg

SEQ ID NO: 5350116 - DNA, 22 bp, Homo sapiens
acaataaatattctgcatggaa

SEQ ID NO: 5350117 - DNA, 12 bp, Homo sapiens
acaataaatgct

SEQ ID NO: 5350118 - DNA, 15 bp, Homo sapiens
acaataaatggccag

SEQ ID NO: 5350119 - DNA, 20 bp, Homo sapiens
acaataaatggccagtgctg

SEQ ID NO: 5350120 - DNA, 16 bp, Homo sapiens
acaataaatggctgta

SEQ ID NO: 5350121 - DNA, 12 bp, Homo sapiens
acaataaatgta

SEQ ID NO: 5350122 - DNA, 20 bp, Homo sapiens
acaataaatgtattcaaata

SEQ ID NO: 5350123 - DNA, 16 bp, Homo sapiens
acaataaattgctaat

SEQ ID NO: 5350124 - DNA, 16 bp, Homo sapiens
acaataacccagttac

SEQ ID NO: 5350125 - DNA, 17 bp, Homo sapiens
acaataacccagttact

SEQ ID NO: 5350126 - DNA, 18 bp, Homo sapiens
acaataacccagttactt

SEQ ID NO: 5350127 - DNA, 22 bp, Homo sapiens
acaataactaaaccacttaaaa

SEQ ID NO: 5350128 - DNA, 19 bp, Homo sapiens
acaataactcctcccaggg

SEQ ID NO: 5350129 - DNA, 14 bp, Homo sapiens
acaataacttttat

SEQ ID NO: 5350130 - DNA, 21 bp, Homo sapiens
acaataagaaacagtttaaca

SEQ ID NO: 5350131 - DNA, 17 bp, Homo sapiens
acaataagaacaagttt

SEQ ID NO: 5350132 - DNA, 19 bp, Homo sapiens
acaataagacatgcttact

SEQ ID NO: 5350133 - DNA, 14 bp, Homo sapiens
acaataagccactg

SEQ ID NO: 5350134 - DNA, 12 bp, Homo sapiens
acaataagtgtt

SEQ ID NO: 5350135 - DNA, 21 bp, Homo sapiens
acaataagttacttgaaataa

SEQ ID NO: 5350136 - DNA, 10 bp, Homo sapiens
acaataataa

SEQ ID NO: 5350137 - DNA, 13 bp, Homo sapiens
acaataataaaga

SEQ ID NO: 5350138 - DNA, 15 bp, Homo sapiens
acaataataaagatg

SEQ ID NO: 5350139 - DNA, 14 bp, Homo sapiens
acaataataaatgt

SEQ ID NO: 5350140 - DNA, 18 bp, Homo sapiens
acaataatatttcaagtg

SEQ ID NO: 5350141 - DNA, 21 bp, Homo sapiens
acaataatatttcaagtgcct

SEQ ID NO: 5350142 - DNA, 22 bp, Homo sapiens
acaataatatttcaagtgccta

SEQ ID NO: 5350143 - DNA, 15 bp, Homo sapiens
acaataatgaataat

SEQ ID NO: 5350144 - DNA, 14 bp, Homo sapiens
acaataatgagagc

SEQ ID NO: 5350145 - DNA, 18 bp, Homo sapiens
acaataatgattttcttg

SEQ ID NO: 5350146 - DNA, 12 bp, Homo sapiens
acaataattaca

SEQ ID NO: 5350147 - DNA, 14 bp, Homo sapiens
acaataattcatca

SEQ ID NO: 5350148 - DNA, 20 bp, Homo sapiens
acaataattcatcaagtaat

SEQ ID NO: 5350149 - DNA, 22 bp, Homo sapiens
acaataattctacatgttgtct

SEQ ID NO: 5350150 - DNA, 21 bp, Homo sapiens
acaataattctggagatactg

SEQ ID NO: 5350151 - DNA, 14 bp, Homo sapiens
acaataatttaaca

SEQ ID NO: 5350152 - DNA, 12 bp, Homo sapiens
acaataatttca

SEQ ID NO: 5350153 - DNA, 13 bp, Homo sapiens
acaataatttcag

SEQ ID NO: 5350154 - DNA, 12 bp, Homo sapiens
acaataatttta

SEQ ID NO: 5350155 - DNA, 20 bp, Homo sapiens
acaatacaaaggttccattc

SEQ ID NO: 5350156 - DNA, 16 bp, Homo sapiens
acaatacaaatggatt

SEQ ID NO: 5350157 - DNA, 18 bp, Homo sapiens
acaatacaatgtacaatt

SEQ ID NO: 5350158 - DNA, 17 bp, Homo sapiens
acaatacagtatttctt

SEQ ID NO: 5350159 - DNA, 13 bp, Homo sapiens
acaatacatctga

SEQ ID NO: 5350160 - DNA, 19 bp, Homo sapiens
acaatacctacaataaact

SEQ ID NO: 5350161 - DNA, 20 bp, Homo sapiens
acaatacctacaataaactg

SEQ ID NO: 5350162 - DNA, 17 bp, Homo sapiens
acaatactaaataaaca

SEQ ID NO: 5350163 - DNA, 21 bp, Homo sapiens
acaatactgtatcagatgtga

SEQ ID NO: 5350164 - DNA, 18 bp, Homo sapiens
acaatactttgtgtcttt

SEQ ID NO: 5350165 - DNA, 22 bp, Homo sapiens
acaatactttgtgtcttttgtt

SEQ ID NO: 5350166 - DNA, 14 bp, Homo sapiens
acaatagaagaaat

SEQ ID NO: 5350167 - DNA, 23 bp, Homo sapiens
acaatagcatttctagaacaatt

SEQ ID NO: 5350168 - DNA, 18 bp, Homo sapiens
acaatagctattgcatgt

SEQ ID NO: 5350169 - DNA, 19 bp, Homo sapiens
acaataggtctttctctca

SEQ ID NO: 5350170 - DNA, 20 bp, Homo sapiens
acaataggtctttctctcag

SEQ ID NO: 5350171 - DNA, 11 bp, Homo sapiens
acaatagtata

SEQ ID NO: 5350172 - DNA, 20 bp, Homo sapiens
acaatagtatacattttata

SEQ ID NO: 5350173 - DNA, 20 bp, Homo sapiens
acaatagtatttctcctttg

SEQ ID NO: 5350174 - DNA, 23 bp, Homo sapiens
acaatagttcttagctttgaaac

SEQ ID NO: 5350175 - DNA, 12 bp, Homo sapiens
acaatagttttt

SEQ ID NO: 5350176 - DNA, 14 bp, Homo sapiens
acaatatagttttt

SEQ ID NO: 5350177 - DNA, 16 bp, Homo sapiens
acaatatataaaaata

SEQ ID NO: 5350178 - DNA, 23 bp, Homo sapiens
acaatatatagctggcaagaatg

SEQ ID NO: 5350179 - DNA, 16 bp, Homo sapiens
acaatatatcataact

SEQ ID NO: 5350180 - DNA, 13 bp, Homo sapiens
acaatatctgcag

SEQ ID NO: 5350181 - DNA, 16 bp, Homo sapiens
acaatatctgcagcgt

SEQ ID NO: 5350182 - DNA, 17 bp, Homo sapiens
acaatatctgcagcgtt

SEQ ID NO: 5350183 - DNA, 24 bp, Homo sapiens
acaatatgaaaaggatattatcta

SEQ ID NO: 5350184 - DNA, 16 bp, Homo sapiens
acaatatgattttaaa

SEQ ID NO: 5350185 - DNA, 19 bp, Homo sapiens
acaatatgcaatgtgaagc

SEQ ID NO: 5350186 - DNA, 16 bp, Homo sapiens
acaatatgtatagcat

SEQ ID NO: 5350187 - DNA, 14 bp, Homo sapiens
acaatatgtatgct

SEQ ID NO: 5350188 - DNA, 19 bp, Homo sapiens
acaatatgtgttttttaat

SEQ ID NO: 5350189 - DNA, 19 bp, Homo sapiens
acaatattactttgtcttt

SEQ ID NO: 5350190 - DNA, 17 bp, Homo sapiens
acaatattccagatctt

SEQ ID NO: 5350191 - DNA, 18 bp, Homo sapiens
acaatattgactttgtct

SEQ ID NO: 5350192 - DNA, 14 bp, Homo sapiens
acaatatttattgt

SEQ ID NO: 5350193 - DNA, 14 bp, Homo sapiens
acaatatttctgat

SEQ ID NO: 5350194 - DNA, 17 bp, Homo sapiens
acaatatttcttttgtt

SEQ ID NO: 5350195 - DNA, 12 bp, Homo sapiens
acaatatttgtg

SEQ ID NO: 5350196 - DNA, 19 bp, Homo sapiens
acaatatttgtgtgctaaa

SEQ ID NO: 5350197 - DNA, 16 bp, Homo sapiens
acaatattttaagcat

SEQ ID NO: 5350198 - DNA, 17 bp, Homo sapiens
acaatattttaagcatt

SEQ ID NO: 5350199 - DNA, 23 bp, Homo sapiens
acaatattttaagcattactctt

SEQ ID NO: 5350200 - DNA, 17 bp, Homo sapiens
acaatattttgtggctt

SEQ ID NO: 5350201 - DNA, 16 bp, Homo sapiens
acaatcaaagaaaaga

SEQ ID NO: 5350202 - DNA, 14 bp, Homo sapiens
acaatcaaatctcc

SEQ ID NO: 5350203 - DNA, 22 bp, Homo sapiens
acaatcacgggcggtcctgcac

SEQ ID NO: 5350204 - DNA, 19 bp, Homo sapiens
acaatcactaaactttatt

SEQ ID NO: 5350205 - DNA, 20 bp, Homo sapiens
acaatcactaaactttattt

SEQ ID NO: 5350206 - DNA, 14 bp, Homo sapiens
acaatcactattct

SEQ ID NO: 5350207 - DNA, 23 bp, Homo sapiens
acaatcactattcttaagcactt

SEQ ID NO: 5350208 - DNA, 15 bp, Homo sapiens
acaatcactgaaaca

SEQ ID NO: 5350209 - DNA, 13 bp, Homo sapiens
acaatcactgcca

SEQ ID NO: 5350210 - DNA, 12 bp, Homo sapiens
acaatcagacca

SEQ ID NO: 5350211 - DNA, 21 bp, Homo sapiens
acaatcagaccaaggaacaag

SEQ ID NO: 5350212 - DNA, 18 bp, Homo sapiens
acaatcagctccttcctg

SEQ ID NO: 5350213 - DNA, 22 bp, Homo sapiens
acaatcagctccttcctggaga

SEQ ID NO: 5350214 - DNA, 12 bp, Homo sapiens
acaatcagctgc

SEQ ID NO: 5350215 - DNA, 18 bp, Homo sapiens
acaatcagctgctttgtt

SEQ ID NO: 5350216 - DNA, 19 bp, Homo sapiens
acaatcagctgctttgtta

SEQ ID NO: 5350217 - DNA, 19 bp, Homo sapiens
acaatcagtcatcatgggt

SEQ ID NO: 5350218 - DNA, 20 bp, Homo sapiens
acaatcagtcccctcccatc

SEQ ID NO: 5350219 - DNA, 15 bp, Homo sapiens
acaatcagtgtgaat

SEQ ID NO: 5350220 - DNA, 15 bp, Homo sapiens
acaatcatctattga

SEQ ID NO: 5350221 - DNA, 19 bp, Homo sapiens
acaatcatgaacagctctg

SEQ ID NO: 5350222 - DNA, 23 bp, Homo sapiens
acaatgttggcctgtcagagctt

SEQ ID NO: 5350223 - DNA, 15 bp, Homo sapiens
acaatgttgtccaac

SEQ ID NO: 5350224 - DNA, 16 bp, Homo sapiens
acaatgttgtccaaca

SEQ ID NO: 5350225 - DNA, 17 bp, Homo sapiens
acaatgtttcttcattt

SEQ ID NO: 5350226 - DNA, 23 bp, Homo sapiens
acaatgtttgatgtccccaaagt

SEQ ID NO: 5350227 - DNA, 12 bp, Homo sapiens
acaatgttttct

SEQ ID NO: 5350228 - DNA, 18 bp, Homo sapiens
acaattaaaccgcatgtg

SEQ ID NO: 5350229 - DNA, 15 bp, Homo sapiens
acaattaactgccct

SEQ ID NO: 5350230 - DNA, 21 bp, Homo sapiens
acaattaactgccctctgaaa

SEQ ID NO: 5350231 - DNA, 17 bp, Homo sapiens
acaattaagttacaatt

SEQ ID NO: 5350232 - DNA, 14 bp, Homo sapiens
acaattaatattaa

SEQ ID NO: 5350233 - DNA, 17 bp, Homo sapiens
acaattactaaattgta

SEQ ID NO: 5350234 - DNA, 18 bp, Homo sapiens
acaattactaaattgtat

SEQ ID NO: 5350235 - DNA, 18 bp, Homo sapiens
acaattactgtacacatt

SEQ ID NO: 5350236 - DNA, 13 bp, Homo sapiens
acaattactgtga

SEQ ID NO: 5350237 - DNA, 21 bp, Homo sapiens
acaattactgtgagaactgtg

SEQ ID NO: 5350238 - DNA, 22 bp, Homo sapiens
acaattactgtgagaactgtga

SEQ ID NO: 5350239 - DNA, 20 bp, Homo sapiens
acaattagagatatttttat

SEQ ID NO: 5350240 - DNA, 21 bp, Homo sapiens
acaattagataaatgtccatt

SEQ ID NO: 5350241 - DNA, 14 bp, Homo sapiens
acaattagatttct

SEQ ID NO: 5350242 - DNA, 18 bp, Homo sapiens
acaattagcagaatggag

SEQ ID NO: 5350243 - DNA, 19 bp, Homo sapiens
acaattagcagaatggaga

SEQ ID NO: 5350244 - DNA, 15 bp, Homo sapiens
acaattaggaactga

SEQ ID NO: 5350245 - DNA, 21 bp, Homo sapiens
acaattaggcagactctttat

SEQ ID NO: 5350246 - DNA, 13 bp, Homo sapiens
acaattatgaaaa

SEQ ID NO: 5350247 - DNA, 18 bp, Homo sapiens
acaattatgtgcaaaggt

SEQ ID NO: 5350248 - DNA, 22 bp, Homo sapiens
acaattattccaaaccaaattt

SEQ ID NO: 5350249 - DNA, 17 bp, Homo sapiens
acaattattggcaaagt

SEQ ID NO: 5350250 - DNA, 17 bp, Homo sapiens
acaattattgtacacta

SEQ ID NO: 5350251 - DNA, 22 bp, Homo sapiens
acaattatttgaagatttaatt

SEQ ID NO: 5350252 - DNA, 18 bp, Homo sapiens
acaattatttttacagtt

SEQ ID NO: 5350253 - DNA, 18 bp, Homo sapiens
acaattcaagctgagaaa

SEQ ID NO: 5350254 - DNA, 21 bp, Homo sapiens
acaattcaagctgagaaaagt

SEQ ID NO: 5350255 - DNA, 16 bp, Homo sapiens
acaattcaatcaaagc

SEQ ID NO: 5350256 - DNA, 19 bp, Homo sapiens
acaattcaatcaaagctac

SEQ ID NO: 5350257 - DNA, 13 bp, Homo sapiens
acaattcagaggc

SEQ ID NO: 5350258 - DNA, 14 bp, Homo sapiens
acaattcagcatta

SEQ ID NO: 5350259 - DNA, 14 bp, Homo sapiens
acaattcatgaact

SEQ ID NO: 5350260 - DNA, 20 bp, Homo sapiens
acaattcatgaacttcgcat

SEQ ID NO: 5350261 - DNA, 16 bp, Homo sapiens
acaattcatgcctttc

SEQ ID NO: 5350262 - DNA, 16 bp, Homo sapiens
acaattcattcaccag

SEQ ID NO: 5350263 - DNA, 11 bp, Homo sapiens
acaattcattg

SEQ ID NO: 5350264 - DNA, 14 bp, Homo sapiens
acaattccaaagga

SEQ ID NO: 5350265 - DNA, 18 bp, Homo sapiens
acaattccagactttcta

SEQ ID NO: 5350266 - DNA, 23 bp, Homo sapiens
acaattcctagataaaaagatgg

SEQ ID NO: 5350267 - DNA, 14 bp, Homo sapiens
acaattcctccaga

SEQ ID NO: 5350268 - DNA, 22 bp, Homo sapiens
acaattcctccagagacactga

SEQ ID NO: 5350269 - DNA, 23 bp, Homo sapiens
acaattcctctactaacaatcag

SEQ ID NO: 5350270 - DNA, 22 bp, Homo sapiens
acaattcgaatggggtagaaac

SEQ ID NO: 5350271 - DNA, 17 bp, Homo sapiens
acaattctaaaatgatt

SEQ ID NO: 5350272 - DNA, 18 bp, Homo sapiens
acaattctaatggtaact

SEQ ID NO: 5350273 - DNA, 19 bp, Homo sapiens
acaattctaatggtaactt

SEQ ID NO: 5350274 - DNA, 15 bp, Homo sapiens
acaattctacattgt

SEQ ID NO: 5350275 - DNA, 13 bp, Homo sapiens
acaattctgatga

SEQ ID NO: 5350276 - DNA, 13 bp, Homo sapiens
acaattctgcatg

SEQ ID NO: 5350277 - DNA, 15 bp, Homo sapiens
acaattctgcatgta

SEQ ID NO: 5350278 - DNA, 11 bp, Homo sapiens
acaattctgtc

SEQ ID NO: 5350279 - DNA, 14 bp, Homo sapiens
acaattctgtccct

SEQ ID NO: 5350280 - DNA, 15 bp, Homo sapiens
acaattctgtccctg

SEQ ID NO: 5350281 - DNA, 17 bp, Homo sapiens
acaattctgtccctgtc

SEQ ID NO: 5350282 - DNA, 23 bp, Homo sapiens
acaattctgtccctgtccctgcc

SEQ ID NO: 5350283 - DNA, 15 bp, Homo sapiens
acaattctgttttta

SEQ ID NO: 5350284 - DNA, 17 bp, Homo sapiens
acaattctgtttttaat

SEQ ID NO: 5350285 - DNA, 20 bp, Homo sapiens
acaattctttgttgcttaat

SEQ ID NO: 5350286 - DNA, 22 bp, Homo sapiens
acaattctttgttgcttaatct

SEQ ID NO: 5350287 - DNA, 12 bp, Homo sapiens
acaattgaaatg

SEQ ID NO: 5350288 - DNA, 19 bp, Homo sapiens
acaattgaaatttttaaat

SEQ ID NO: 5350289 - DNA, 17 bp, Homo sapiens
acaattgaacttaaata

SEQ ID NO: 5350290 - DNA, 19 bp, Homo sapiens
acaattgagggaagtttga

SEQ ID NO: 5350291 - DNA, 18 bp, Homo sapiens
acaattgatacttcaggt

SEQ ID NO: 5350292 - DNA, 22 bp, Homo sapiens
acaattgatacttcaggtgctt

SEQ ID NO: 5350293 - DNA, 13 bp, Homo sapiens
acaattgatcttt

SEQ ID NO: 5350294 - DNA, 16 bp, Homo sapiens
acaattgcaaatcaga

SEQ ID NO: 5350295 - DNA, 17 bp, Homo sapiens
acaattgcactgctgtt

SEQ ID NO: 5350296 - DNA, 21 bp, Homo sapiens
acaattgcttactcattaaaa

SEQ ID NO: 5350297 - DNA, 15 bp, Homo sapiens
acaattggtaaaact

SEQ ID NO: 5350298 - DNA, 22 bp, Homo sapiens
acaattggtaaaactcactgtg

SEQ ID NO: 5350299 - DNA, 19 bp, Homo sapiens
acaattgtccatggtctca

SEQ ID NO: 5350300 - DNA, 22 bp, Homo sapiens
acaattgtgggcataaactgtt

SEQ ID NO: 5350301 - DNA, 21 bp, Homo sapiens
acaattgtgtagcctttttgt

SEQ ID NO: 5350302 - DNA, 21 bp, Homo sapiens
acaattgtgtgaattaatttc

SEQ ID NO: 5350303 - DNA, 22 bp, Homo sapiens
acaattgttgactaaaatgctg

SEQ ID NO: 5350304 - DNA, 16 bp, Homo sapiens
acaattgttttaatct

SEQ ID NO: 5350305 - DNA, 20 bp, Homo sapiens
acaattgttttaatctgaaa

SEQ ID NO: 5350306 - DNA, 23 bp, Homo sapiens
acaattgttttaatctgaaattc

SEQ ID NO: 5350307 - DNA, 13 bp, Homo sapiens
acaatttaaaaca

SEQ ID NO: 5350308 - DNA, 14 bp, Homo sapiens
acaatttaatgtat

SEQ ID NO: 5350309 - DNA, 15 bp, Homo sapiens
acaatttacttttaa

SEQ ID NO: 5350310 - DNA, 21 bp, Homo sapiens
acaatttacttttaataaagt

SEQ ID NO: 5350311 - DNA, 20 bp, Homo sapiens
acaatttagaaaacattcat

SEQ ID NO: 5350312 - DNA, 20 bp, Homo sapiens
acaatttaggaatgctcaat

SEQ ID NO: 5350313 - DNA, 22 bp, Homo sapiens
acaatttcaaaagaacattctt

SEQ ID NO: 5350314 - DNA, 17 bp, Homo sapiens
acaatttcaaaatgcat

SEQ ID NO: 5350315 - DNA, 19 bp, Homo sapiens
acaatttcaaaatgcatgt

SEQ ID NO: 5350316 - DNA, 12 bp, Homo sapiens
acaatttcaatg

SEQ ID NO: 5350317 - DNA, 22 bp, Homo sapiens
acaatttcacatggactttgga

SEQ ID NO: 5350318 - DNA, 22 bp, Homo sapiens
acaatttcatttccagcatttt

SEQ ID NO: 5350319 - DNA, 19 bp, Homo sapiens
acaatttccaagaatgatg

SEQ ID NO: 5350320 - DNA, 16 bp, Homo sapiens
acaatttcctttatat

SEQ ID NO: 5350321 - DNA, 11 bp, Homo sapiens
acaatttctgt

SEQ ID NO: 5350322 - DNA, 17 bp, Homo sapiens
acaatttctttaaaaaa

SEQ ID NO: 5350323 - DNA, 16 bp, Homo sapiens
acaatttcttttggtt

SEQ ID NO: 5350324 - DNA, 21 bp, Homo sapiens
acaatttgagatgtatttcaa

SEQ ID NO: 5350325 - DNA, 17 bp, Homo sapiens
acaatttgagcaattca

SEQ ID NO: 5350326 - DNA, 13 bp, Homo sapiens
acaatttgataca

SEQ ID NO: 5350327 - DNA, 15 bp, Homo sapiens
acaatttgatacata

SEQ ID NO: 5350328 - DNA, 18 bp, Homo sapiens
acaatttgatacataata

SEQ ID NO: 5350329 - DNA, 21 bp, Homo sapiens
acaatttgatacataataaaa

SEQ ID NO: 5350330 - DNA, 11 bp, Homo sapiens
acaatttgcca

SEQ ID NO: 5350331 - DNA, 19 bp, Homo sapiens
acaatttgccttaggaagt

SEQ ID NO: 5350332 - DNA, 21 bp, Homo sapiens
acaatttgccttaggaagtga

SEQ ID NO: 5350333 - DNA, 23 bp, Homo sapiens
acaatttgccttaggaagtgact

SEQ ID NO: 5350334 - DNA, 22 bp, Homo sapiens
acaatttggcaattttgtggtt

SEQ ID NO: 5350335 - DNA, 20 bp, Homo sapiens
acaatttggtcttagcttta

SEQ ID NO: 5350336 - DNA, 22 bp, Homo sapiens
acaatttggtcttagctttaca

SEQ ID NO: 5350337 - DNA, 22 bp, Homo sapiens
acaatttgttaattcctatgaa

SEQ ID NO: 5350338 - DNA, 13 bp, Homo sapiens
acaattttaaata

SEQ ID NO: 5350339 - DNA, 17 bp, Homo sapiens
acaattttaaataagat

SEQ ID NO: 5350340 - DNA, 20 bp, Homo sapiens
acaattttacctattctgaa

SEQ ID NO: 5350341 - DNA, 22 bp, Homo sapiens
acaattttacctattctgaaaa

SEQ ID NO: 5350342 - DNA, 17 bp, Homo sapiens
acaattttcagatttgc

SEQ ID NO: 5350343 - DNA, 18 bp, Homo sapiens
acaattttcagatttgca

SEQ ID NO: 5350344 - DNA, 21 bp, Homo sapiens
acaattttctatttaaaaaat

SEQ ID NO: 5350345 - DNA, 14 bp, Homo sapiens
acaattttctgtaa

SEQ ID NO: 5350346 - DNA, 20 bp, Homo sapiens
acaattttctgtaatctttt

SEQ ID NO: 5350347 - DNA, 23 bp, Homo sapiens
acaattttctgtaatcttttatt

SEQ ID NO: 5350348 - DNA, 15 bp, Homo sapiens
acaattttgtacaaa

SEQ ID NO: 5350349 - DNA, 11 bp, Homo sapiens
acaattttgtc

SEQ ID NO: 5350350 - DNA, 14 bp, Homo sapiens
acaattttgtctta

SEQ ID NO: 5350351 - DNA, 20 bp, Homo sapiens
acaattttgtcttaagtgtt

SEQ ID NO: 5350352 - DNA, 23 bp, Homo sapiens
acaattttgtcttaagtgtttct

SEQ ID NO: 5350353 - DNA, 14 bp, Homo sapiens
acaattttgtttct

SEQ ID NO: 5350354 - DNA, 15 bp, Homo sapiens
acaattttgtttctg

SEQ ID NO: 5350355 - DNA, 18 bp, Homo sapiens
acaattttgtttctgtac

SEQ ID NO: 5350356 - DNA, 17 bp, Homo sapiens
acaatttttaataaatt

SEQ ID NO: 5350357 - DNA, 13 bp, Homo sapiens
acaatttttaatg

SEQ ID NO: 5350358 - DNA, 19 bp, Homo sapiens
acaatttttatttctttta

SEQ ID NO: 5350359 - DNA, 19 bp, Homo sapiens
acaatttttgctgttttca

SEQ ID NO: 5350360 - DNA, 16 bp, Homo sapiens
acaattttttatcatg

SEQ ID NO: 5350361 - DNA, 22 bp, Homo sapiens
acaattttttatcatgcatgtc

SEQ ID NO: 5350362 - DNA, 21 bp, Homo sapiens
acaattttttattaaatttat

SEQ ID NO: 5350363 - DNA, 20 bp, Homo sapiens
acaattttttgtgatgaaaa

SEQ ID NO: 5350364 - DNA, 24 bp, Homo sapiens
acaattttttttattagtattgtt

SEQ ID NO: 5350365 - DNA, 16 bp, Homo sapiens
acaattttttttttcc

SEQ ID NO: 5350366 - DNA, 18 bp, Homo sapiens
acaattttttttttcctc

SEQ ID NO: 5350367 - DNA, 19 bp, Homo sapiens
acacaaaaaaataataaaa

SEQ ID NO: 5350368 - DNA, 17 bp, Homo sapiens
acacaaaaaccttggca

SEQ ID NO: 5350369 - DNA, 18 bp, Homo sapiens
acacaaaaagaaagctgt

SEQ ID NO: 5350370 - DNA, 20 bp, Homo sapiens
acacaaaaagaaagctgtga

SEQ ID NO: 5350371 - DNA, 16 bp, Homo sapiens
acacaaaaaggagcgg

SEQ ID NO: 5350372 - DNA, 17 bp, Homo sapiens
acacaaaacaaatcctg

SEQ ID NO: 5350373 - DNA, 16 bp, Homo sapiens
acacaaaacaacagca

SEQ ID NO: 5350374 - DNA, 20 bp, Homo sapiens
acacaaaacaacagcaacaa

SEQ ID NO: 5350375 - DNA, 16 bp, Homo sapiens
acacaaaacattcatg

SEQ ID NO: 5350376 - DNA, 18 bp, Homo sapiens
acacaaaacattcatgta

SEQ ID NO: 5350377 - DNA, 19 bp, Homo sapiens
acacaaaacattcatgtaa

SEQ ID NO: 5350378 - DNA, 11 bp, Homo sapiens
acacaaaagaa

SEQ ID NO: 5350379 - DNA, 21 bp, Homo sapiens
acacaaaagaagaaataaata

SEQ ID NO: 5350380 - DNA, 15 bp, Homo sapiens
acacaaaagatggga

SEQ ID NO: 5350381 - DNA, 12 bp, Homo sapiens
acacaaaatcaa

SEQ ID NO: 5350382 - DNA, 14 bp, Homo sapiens
acacaaacaaacaa

SEQ ID NO: 5350383 - DNA, 22 bp, Homo sapiens
acacaaacaaacaagctaggtg

SEQ ID NO: 5350384 - DNA, 17 bp, Homo sapiens
acacaaacacattgtta

SEQ ID NO: 5350385 - DNA, 16 bp, Homo sapiens
acacaaacacctccta

SEQ ID NO: 5350386 - DNA, 13 bp, Homo sapiens
acacaaacaggaa

SEQ ID NO: 5350387 - DNA, 22 bp, Homo sapiens
acacaaaccacaactgacacag

SEQ ID NO: 5350388 - DNA, 22 bp, Homo sapiens
acacaaaccattttattttttg

SEQ ID NO: 5350389 - DNA, 15 bp, Homo sapiens
acacaaacctgcctg

SEQ ID NO: 5350390 - DNA, 17 bp, Homo sapiens
acacaaacctgcctggg

SEQ ID NO: 5350391 - DNA, 15 bp, Homo sapiens
acacaaacgtatgta

SEQ ID NO: 5350392 - DNA, 13 bp, Homo sapiens
acacaaagacatg

SEQ ID NO: 5350393 - DNA, 18 bp, Homo sapiens
acacaaagacatggaagg

SEQ ID NO: 5350394 - DNA, 15 bp, Homo sapiens
acacaaagattttct

SEQ ID NO: 5350395 - DNA, 20 bp, Homo sapiens
acacaaagattttctaagga

SEQ ID NO: 5350396 - DNA, 15 bp, Homo sapiens
acacaaagcacattg

SEQ ID NO: 5350397 - DNA, 13 bp, Homo sapiens
acacaaagcctgt

SEQ ID NO: 5350398 - DNA, 16 bp, Homo sapiens
acacaaagcttctaaa

SEQ ID NO: 5350399 - DNA, 14 bp, Homo sapiens
acacattgccttct

SEQ ID NO: 5350400 - DNA, 17 bp, Homo sapiens
acacattgctacctcag

SEQ ID NO: 5350401 - DNA, 19 bp, Homo sapiens
acacattggaatgccttgg

SEQ ID NO: 5350402 - DNA, 19 bp, Homo sapiens
acacattggaattgatgtc

SEQ ID NO: 5350403 - DNA, 13 bp, Homo sapiens
acacattgtgtta

SEQ ID NO: 5350404 - DNA, 14 bp, Homo sapiens
acacattgttttcc

SEQ ID NO: 5350405 - DNA, 17 bp, Homo sapiens
acacattgttttccaga

SEQ ID NO: 5350406 - DNA, 22 bp, Homo sapiens
acacattgttttccagaagcct

SEQ ID NO: 5350407 - DNA, 15 bp, Homo sapiens
acacatttaaaacat

SEQ ID NO: 5350408 - DNA, 15 bp, Homo sapiens
acacatttaccaaat

SEQ ID NO: 5350409 - DNA, 21 bp, Homo sapiens
acacatttaccaaattgcttg

SEQ ID NO: 5350410 - DNA, 18 bp, Homo sapiens
acacatttcacttttctg

SEQ ID NO: 5350411 - DNA, 13 bp, Homo sapiens
acacatttcatag

SEQ ID NO: 5350412 - DNA, 14 bp, Homo sapiens
acacatttcatcta

SEQ ID NO: 5350413 - DNA, 23 bp, Homo sapiens
acacatttccattcatggatatt

SEQ ID NO: 5350414 - DNA, 21 bp, Homo sapiens
acacatttcctttaccctcca

SEQ ID NO: 5350415 - DNA, 19 bp, Homo sapiens
acacatttctattttgcaa

SEQ ID NO: 5350416 - DNA, 11 bp, Homo sapiens
acacatttctt

SEQ ID NO: 5350417 - DNA, 17 bp, Homo sapiens
acacatttcttaaaaca

SEQ ID NO: 5350418 - DNA, 19 bp, Homo sapiens
acacatttcttaaaacaca

SEQ ID NO: 5350419 - DNA, 21 bp, Homo sapiens
acacatttggaatgcacacag

SEQ ID NO: 5350420 - DNA, 21 bp, Homo sapiens
acacatttgggatgttccttt

SEQ ID NO: 5350421 - DNA, 12 bp, Homo sapiens
acacatttgtac

SEQ ID NO: 5350422 - DNA, 22 bp, Homo sapiens
acacatttgttgccagatttca

SEQ ID NO: 5350423 - DNA, 11 bp, Homo sapiens
acacattttaa

SEQ ID NO: 5350424 - DNA, 20 bp, Homo sapiens
acacattttattttattatg

SEQ ID NO: 5350425 - DNA, 21 bp, Homo sapiens
acacattttattttattatgc

SEQ ID NO: 5350426 - DNA, 22 bp, Homo sapiens
acacattttattttattatgca

SEQ ID NO: 5350427 - DNA, 22 bp, Homo sapiens
acacattttctcctaggagaag

SEQ ID NO: 5350428 - DNA, 21 bp, Homo sapiens
acacattttggttcttctcaa

SEQ ID NO: 5350429 - DNA, 14 bp, Homo sapiens
acacattttgtaaa

SEQ ID NO: 5350430 - DNA, 13 bp, Homo sapiens
acacattttgtat

SEQ ID NO: 5350431 - DNA, 15 bp, Homo sapiens
acacattttgtataa

SEQ ID NO: 5350432 - DNA, 13 bp, Homo sapiens
acacatttttaaa

SEQ ID NO: 5350433 - DNA, 16 bp, Homo sapiens
acacatttttaaaaca

SEQ ID NO: 5350434 - DNA, 22 bp, Homo sapiens
acacatttttaaagctttcccc

SEQ ID NO: 5350435 - DNA, 19 bp, Homo sapiens
acacatttttaaattgtta

SEQ ID NO: 5350436 - DNA, 12 bp, Homo sapiens
acacatttttct

SEQ ID NO: 5350437 - DNA, 22 bp, Homo sapiens
acacatttttggatttctgtga

SEQ ID NO: 5350438 - DNA, 23 bp, Homo sapiens
acacatttttggatttctgtgaa

SEQ ID NO: 5350439 - DNA, 16 bp, Homo sapiens
acacattttttaaatg

SEQ ID NO: 5350440 - DNA, 18 bp, Homo sapiens
acaccaaagataaggact

SEQ ID NO: 5350441 - DNA, 19 bp, Homo sapiens
acaccaaatagcttttcac

SEQ ID NO: 5350442 - DNA, 14 bp, Homo sapiens
acaccaaatataac

SEQ ID NO: 5350443 - DNA, 23 bp, Homo sapiens
acaccaaatattttcaagctttt

SEQ ID NO: 5350444 - DNA, 20 bp, Homo sapiens
acaccaaatgactactacac

SEQ ID NO: 5350445 - DNA, 19 bp, Homo sapiens
acaccaaattccaaacttc

SEQ ID NO: 5350446 - DNA, 21 bp, Homo sapiens
acaccaaattgctgagatgtt

SEQ ID NO: 5350447 - DNA, 14 bp, Homo sapiens
acaccaaccagaca

SEQ ID NO: 5350448 - DNA, 18 bp, Homo sapiens
acaccaactgctctcaaa

SEQ ID NO: 5350449 - DNA, 13 bp, Homo sapiens
acaccaagaaacc

SEQ ID NO: 5350450 - DNA, 20 bp, Homo sapiens
acaccaagcacagcagcctg

SEQ ID NO: 5350451 - DNA, 21 bp, Homo sapiens
acaccaagcacagcagcctgg

SEQ ID NO: 5350452 - DNA, 18 bp, Homo sapiens
acaccaagctgtgccacc

SEQ ID NO: 5350453 - DNA, 22 bp, Homo sapiens
acaccaagctgtgccaccctgg

SEQ ID NO: 5350454 - DNA, 15 bp, Homo sapiens
acaccaatattcata

SEQ ID NO: 5350455 - DNA, 16 bp, Homo sapiens
acaccaatcagagagc

SEQ ID NO: 5350456 - DNA, 21 bp, Homo sapiens
acaccaatcagagagcctaga

SEQ ID NO: 5350457 - DNA, 16 bp, Homo sapiens
acaccaatcccagggc

SEQ ID NO: 5350458 - DNA, 18 bp, Homo sapiens
acaccaatcccagggctg

SEQ ID NO: 5350459 - DNA, 20 bp, Homo sapiens
acaccaatcccagggctggc

SEQ ID NO: 5350460 - DNA, 22 bp, Homo sapiens
acaccaatcccagggctggctc

SEQ ID NO: 5350461 - DNA, 14 bp, Homo sapiens
acaccaatcttact

SEQ ID NO: 5350462 - DNA, 23 bp, Homo sapiens
acaccaatttggtaaaaatgctg

SEQ ID NO: 5350463 - DNA, 12 bp, Homo sapiens
acaccacacaca

SEQ ID NO: 5350464 - DNA, 13 bp, Homo sapiens
acaccacacacaa

SEQ ID NO: 5350465 - DNA, 17 bp, Homo sapiens
acaccacacacaacagc

SEQ ID NO: 5350466 - DNA, 19 bp, Homo sapiens
acaccacacacaacagcca

SEQ ID NO: 5350467 - DNA, 14 bp, Homo sapiens
acaccacacccagc

SEQ ID NO: 5350468 - DNA, 15 bp, Homo sapiens
acaccacacccagcc

SEQ ID NO: 5350469 - DNA, 16 bp, Homo sapiens
acaccacacccagcct

SEQ ID NO: 5350470 - DNA, 17 bp, Homo sapiens
acaccacacccagcctc

SEQ ID NO: 5350471 - DNA, 16 bp, Homo sapiens
acaccacactttcaaa

SEQ ID NO: 5350472 - DNA, 11 bp, Homo sapiens
acaccacagac

SEQ ID NO: 5350473 - DNA, 17 bp, Homo sapiens
acaccacagcaagccgg

SEQ ID NO: 5350474 - DNA, 13 bp, Homo sapiens
acaccacagcctc

SEQ ID NO: 5350475 - DNA, 17 bp, Homo sapiens
acaccacagcctcccct

SEQ ID NO: 5350476 - DNA, 18 bp, Homo sapiens
acaccacaggatctgaac

SEQ ID NO: 5350477 - DNA, 23 bp, Homo sapiens
acaccaccaaatgacaagtcaca

SEQ ID NO: 5350478 - DNA, 12 bp, Homo sapiens
acaccaccctcc

SEQ ID NO: 5350479 - DNA, 18 bp, Homo sapiens
acaccaccgagctctgtg

SEQ ID NO: 5350480 - DNA, 19 bp, Homo sapiens
acaccaccgagctctgtgg

SEQ ID NO: 5350481 - DNA, 21 bp, Homo sapiens
acaccaccgagctctgtggga

SEQ ID NO: 5350482 - DNA, 21 bp, Homo sapiens
acaccaccgccctcctcgctg

SEQ ID NO: 5350483 - DNA, 16 bp, Homo sapiens
acaccacgaatttggt

SEQ ID NO: 5350484 - DNA, 19 bp, Homo sapiens
acaccacgctggagctgtg

SEQ ID NO: 5350485 - DNA, 18 bp, Homo sapiens
acaccacgtcctggtctt

SEQ ID NO: 5350486 - DNA, 19 bp, Homo sapiens
acaccactaaccatcccca

SEQ ID NO: 5350487 - DNA, 15 bp, Homo sapiens
acaccactacattct

SEQ ID NO: 5350488 - DNA, 13 bp, Homo sapiens
acaccactagcct

SEQ ID NO: 5350489 - DNA, 16 bp, Homo sapiens
acaccactatagtgta

SEQ ID NO: 5350490 - DNA, 15 bp, Homo sapiens
acaccactcctgcca

SEQ ID NO: 5350491 - DNA, 21 bp, Homo sapiens
acaccactcctgccagcccgg

SEQ ID NO: 5350492 - DNA, 17 bp, Homo sapiens
acaccactctggcagcc

SEQ ID NO: 5350493 - DNA, 20 bp, Homo sapiens
acaccactctggcagccaca

SEQ ID NO: 5350494 - DNA, 19 bp, Homo sapiens
acaccactgagctctgcct

SEQ ID NO: 5350495 - DNA, 20 bp, Homo sapiens
acaccactgagctctgcctc

SEQ ID NO: 5350496 - DNA, 14 bp, Homo sapiens
acaccactgccctg

SEQ ID NO: 5350497 - DNA, 22 bp, Homo sapiens
acaccagaaagcctcctctgga

SEQ ID NO: 5350498 - DNA, 22 bp, Homo sapiens
acaccagaagctgttgggagaa

SEQ ID NO: 5350499 - DNA, 17 bp, Homo sapiens
acaccagaataatgagt

SEQ ID NO: 5350500 - DNA, 22 bp, Homo sapiens
acaccagactgaagtaaacagc

SEQ ID NO: 5350501 - DNA, 22 bp, Homo sapiens
acaccagagcagatgcagagag

SEQ ID NO: 5350502 - DNA, 12 bp, Homo sapiens
acaccagagccc

SEQ ID NO: 5350503 - DNA, 17 bp, Homo sapiens
acaccagagctgccgac

SEQ ID NO: 5350504 - DNA, 14 bp, Homo sapiens
acaccagcattcct

SEQ ID NO: 5350505 - DNA, 16 bp, Homo sapiens
acaccagcattccttt

SEQ ID NO: 5350506 - DNA, 12 bp, Homo sapiens
acaccagccagg

SEQ ID NO: 5350507 - DNA, 17 bp, Homo sapiens
acaccagccaggctctg

SEQ ID NO: 5350508 - DNA, 23 bp, Homo sapiens
acaccagccatcatgtgcctgga

SEQ ID NO: 5350509 - DNA, 17 bp, Homo sapiens
acaccagcccctgcccc

SEQ ID NO: 5350510 - DNA, 22 bp, Homo sapiens
acaccagcccctgccccagccc

SEQ ID NO: 5350511 - DNA, 20 bp, Homo sapiens
acaccagcggcctggagtcg

SEQ ID NO: 5350512 - DNA, 12 bp, Homo sapiens
acaccagctgta

SEQ ID NO: 5350513 - DNA, 15 bp, Homo sapiens
acaccagctgttctg

SEQ ID NO: 5350514 - DNA, 16 bp, Homo sapiens
acaccaggaatttaga

SEQ ID NO: 5350515 - DNA, 22 bp, Homo sapiens
acaccaggacttaagacaaatg

SEQ ID NO: 5350516 - DNA, 18 bp, Homo sapiens
acaccaggactttaatct

SEQ ID NO: 5350517 - DNA, 21 bp, Homo sapiens
acaccaggccgtcctcccggg

SEQ ID NO: 5350518 - DNA, 22 bp, Homo sapiens
acaccaggccgtcctcccgggc

SEQ ID NO: 5350519 - DNA, 17 bp, Homo sapiens
acaccagggccagcctc

SEQ ID NO: 5350520 - DNA, 21 bp, Homo sapiens
acaccagtaataaaaagccac

SEQ ID NO: 5350521 - DNA, 23 bp, Homo sapiens
acaccagtcacctcgtctccctg

SEQ ID NO: 5350522 - DNA, 15 bp, Homo sapiens
acaccagtgcaagca

SEQ ID NO: 5350523 - DNA, 23 bp, Homo sapiens
acaccagtggcagctgccccagg

SEQ ID NO: 5350524 - DNA, 12 bp, Homo sapiens
acaccagtgtta

SEQ ID NO: 5350525 - DNA, 15 bp, Homo sapiens
acaccagttactgtt

SEQ ID NO: 5350526 - DNA, 18 bp, Homo sapiens
acaccagttacttgtgtt

SEQ ID NO: 5350527 - DNA, 20 bp, Homo sapiens
acaccataagctactgccat

SEQ ID NO: 5350528 - DNA, 19 bp, Homo sapiens
acaccatcacagcttgttt

SEQ ID NO: 5350529 - DNA, 15 bp, Homo sapiens
acaccatcctgagcc

SEQ ID NO: 5350530 - DNA, 20 bp, Homo sapiens
acaccatcgatcatgatgta

SEQ ID NO: 5350531 - DNA, 16 bp, Homo sapiens
acaccatctggcccag

SEQ ID NO: 5350532 - DNA, 17 bp, Homo sapiens
acaccatctggcccagg

SEQ ID NO: 5350533 - DNA, 18 bp, Homo sapiens
acaccatctggcccaggc

SEQ ID NO: 5350534 - DNA, 23 bp, Homo sapiens
acaccatctggcccaggctggcc

SEQ ID NO: 5350535 - DNA, 18 bp, Homo sapiens
acaccatcttcagctgta

SEQ ID NO: 5350536 - DNA, 21 bp, Homo sapiens
acaccatcttttattcttttt

SEQ ID NO: 5350537 - DNA, 14 bp, Homo sapiens
acaccatgtgcaat

SEQ ID NO: 5350538 - DNA, 15 bp, Homo sapiens
acaccatgtgcaata

SEQ ID NO: 5350539 - DNA, 23 bp, Homo sapiens
acaccatgtgcaataagattggt

SEQ ID NO: 5350540 - DNA, 21 bp, Homo sapiens
acaccattaccaaaataataa

SEQ ID NO: 5350541 - DNA, 19 bp, Homo sapiens
acaccattataaaaacact

SEQ ID NO: 5350542 - DNA, 14 bp, Homo sapiens
acaccattattcca

SEQ ID NO: 5350543 - DNA, 21 bp, Homo sapiens
acaccattcattccatgtcca

SEQ ID NO: 5350544 - DNA, 18 bp, Homo sapiens
acaccattctcctgcctc

SEQ ID NO: 5350545 - DNA, 19 bp, Homo sapiens
acaccattctcctgcctca

SEQ ID NO: 5350546 - DNA, 12 bp, Homo sapiens
acaccattctga

SEQ ID NO: 5350547 - DNA, 19 bp, Homo sapiens
acaccattgcatgaattca

SEQ ID NO: 5350548 - DNA, 19 bp, Homo sapiens
acaccattgttccttacct

SEQ ID NO: 5350549 - DNA, 13 bp, Homo sapiens
acaccattttgta

SEQ ID NO: 5350550 - DNA, 15 bp, Homo sapiens
acaccattttgtaaa

SEQ ID NO: 5350551 - DNA, 13 bp, Homo sapiens
acaccattttttt

SEQ ID NO: 5350552 - DNA, 13 bp, Homo sapiens
acacccaaaaata

SEQ ID NO: 5350553 - DNA, 15 bp, Homo sapiens
acacccaagagggct

SEQ ID NO: 5350554 - DNA, 15 bp, Homo sapiens
acacccaagcacaaa

SEQ ID NO: 5350555 - DNA, 21 bp, Homo sapiens
acacccaaggattctgttctg

SEQ ID NO: 5350556 - DNA, 22 bp, Homo sapiens
acacccacaatcccacctagcc

SEQ ID NO: 5350557 - DNA, 22 bp, Homo sapiens
acacccacacaggtggccatca

SEQ ID NO: 5350558 - DNA, 14 bp, Homo sapiens
acacccacccacat

SEQ ID NO: 5350559 - DNA, 19 bp, Homo sapiens
acacccaccccctgcctgg

SEQ ID NO: 5350560 - DNA, 11 bp, Homo sapiens
acacccaccct

SEQ ID NO: 5350561 - DNA, 15 bp, Homo sapiens
acacccaccctgtgc

SEQ ID NO: 5350562 - DNA, 17 bp, Homo sapiens
acacccaccgtccgccc

SEQ ID NO: 5350563 - DNA, 11 bp, Homo sapiens
acacccacctg

SEQ ID NO: 5350564 - DNA, 12 bp, Homo sapiens
acacccacctgc

SEQ ID NO: 5350565 - DNA, 12 bp, Homo sapiens
acacccactgcc

SEQ ID NO: 5350566 - DNA, 15 bp, Homo sapiens
acacccagaccttcc

SEQ ID NO: 5350567 - DNA, 22 bp, Homo sapiens
acacccagagtagccatgagga

SEQ ID NO: 5350568 - DNA, 23 bp, Homo sapiens
acacccagcaatagagacgggac

SEQ ID NO: 5350569 - DNA, 12 bp, Homo sapiens
acacccagcctc

SEQ ID NO: 5350570 - DNA, 14 bp, Homo sapiens
acacccagcctcag

SEQ ID NO: 5350571 - DNA, 16 bp, Homo sapiens
acacccagcctcagtc

SEQ ID NO: 5350572 - DNA, 20 bp, Homo sapiens
acacccagcctcagtcctcc

SEQ ID NO: 5350573 - DNA, 23 bp, Homo sapiens
acacccagcctcagtcctcccct

SEQ ID NO: 5350574 - DNA, 16 bp, Homo sapiens
acacccagcctctgta

SEQ ID NO: 5350575 - DNA, 13 bp, Homo sapiens
acacccagcctgt

SEQ ID NO: 5350576 - DNA, 20 bp, Homo sapiens
acactaattccttaaatgaa

SEQ ID NO: 5350577 - DNA, 22 bp, Homo sapiens
acactaattccttaaatgaact

SEQ ID NO: 5350578 - DNA, 15 bp, Homo sapiens
acactacaaatgtta

SEQ ID NO: 5350579 - DNA, 17 bp, Homo sapiens
acactacaagtttataa

SEQ ID NO: 5350580 - DNA, 16 bp, Homo sapiens
acactacaccacacac

SEQ ID NO: 5350581 - DNA, 18 bp, Homo sapiens
acactacattttttctaa

SEQ ID NO: 5350582 - DNA, 20 bp, Homo sapiens
acactacattttttctaata

SEQ ID NO: 5350583 - DNA, 18 bp, Homo sapiens
acactaccaaacactcag

SEQ ID NO: 5350584 - DNA, 22 bp, Homo sapiens
acactaccaaacactcagtcca

SEQ ID NO: 5350585 - DNA, 14 bp, Homo sapiens
acactaccccatat

SEQ ID NO: 5350586 - DNA, 17 bp, Homo sapiens
acactaccccatataca

SEQ ID NO: 5350587 - DNA, 18 bp, Homo sapiens
acactaccgaatgtgtct

SEQ ID NO: 5350588 - DNA, 19 bp, Homo sapiens
acactaccgaatgtgtctt

SEQ ID NO: 5350589 - DNA, 20 bp, Homo sapiens
acactaccgaatgtgtcttt

SEQ ID NO: 5350590 - DNA, 21 bp, Homo sapiens
acactacgaagagtatttgga

SEQ ID NO: 5350591 - DNA, 14 bp, Homo sapiens
acactactacctct

SEQ ID NO: 5350592 - DNA, 18 bp, Homo sapiens
acactacttttgcttttt

SEQ ID NO: 5350593 - DNA, 14 bp, Homo sapiens
acactagaaagaag

SEQ ID NO: 5350594 - DNA, 12 bp, Homo sapiens
acactagacaaa

SEQ ID NO: 5350595 - DNA, 15 bp, Homo sapiens
acactagaggccagg

SEQ ID NO: 5350596 - DNA, 21 bp, Homo sapiens
acactagccagacactctgct

SEQ ID NO: 5350597 - DNA, 13 bp, Homo sapiens
acactagcctctc

SEQ ID NO: 5350598 - DNA, 23 bp, Homo sapiens
acactagccttggcctctttcct

SEQ ID NO: 5350599 - DNA, 22 bp, Homo sapiens
acactagctaatatcaatagaa

SEQ ID NO: 5350600 - DNA, 22 bp, Homo sapiens
acactagcttgaacttagatgt

SEQ ID NO: 5350601 - DNA, 15 bp, Homo sapiens
acactaggagactgg

SEQ ID NO: 5350602 - DNA, 23 bp, Homo sapiens
acactaggatgaattatcttgga

SEQ ID NO: 5350603 - DNA, 20 bp, Homo sapiens
acactagtagctgttttgaa

SEQ ID NO: 5350604 - DNA, 23 bp, Homo sapiens
acactagtagctgttttgaataa

SEQ ID NO: 5350605 - DNA, 15 bp, Homo sapiens
acactagtctgtgtg

SEQ ID NO: 5350606 - DNA, 20 bp, Homo sapiens
acactagtctgtgtgctgtg

SEQ ID NO: 5350607 - DNA, 18 bp, Homo sapiens
acactagttttgtgccag

SEQ ID NO: 5350608 - DNA, 16 bp, Homo sapiens
acactataaggctgag

SEQ ID NO: 5350609 - DNA, 15 bp, Homo sapiens
acactatagagaacc

SEQ ID NO: 5350610 - DNA, 13 bp, Homo sapiens
acactatatctgt

SEQ ID NO: 5350611 - DNA, 21 bp, Homo sapiens
acactatcaacactgcagcat

SEQ ID NO: 5350612 - DNA, 15 bp, Homo sapiens
acactatgataaagt

SEQ ID NO: 5350613 - DNA, 14 bp, Homo sapiens
acactatgcacaga

SEQ ID NO: 5350614 - DNA, 15 bp, Homo sapiens
acactatgcacagag

SEQ ID NO: 5350615 - DNA, 16 bp, Homo sapiens
acactatgcacagagc

SEQ ID NO: 5350616 - DNA, 19 bp, Homo sapiens
acactatggtatttgagtg

SEQ ID NO: 5350617 - DNA, 16 bp, Homo sapiens
acactattacagtatt

SEQ ID NO: 5350618 - DNA, 21 bp, Homo sapiens
acactattacagtattgctat

SEQ ID NO: 5350619 - DNA, 18 bp, Homo sapiens
acactattaccatgagaa

SEQ ID NO: 5350620 - DNA, 16 bp, Homo sapiens
acactattcactaaaa

SEQ ID NO: 5350621 - DNA, 23 bp, Homo sapiens
acactattctccagaaaaatcaa

SEQ ID NO: 5350622 - DNA, 16 bp, Homo sapiens
acactattgcattgtt

SEQ ID NO: 5350623 - DNA, 17 bp, Homo sapiens
acactattgcattgttc

SEQ ID NO: 5350624 - DNA, 23 bp, Homo sapiens
acactatttgagttggccaagaa

SEQ ID NO: 5350625 - DNA, 13 bp, Homo sapiens
acactatttgtga

SEQ ID NO: 5350626 - DNA, 11 bp, Homo sapiens
acactatttta

SEQ ID NO: 5350627 - DNA, 14 bp, Homo sapiens
acactattttatgc

SEQ ID NO: 5350628 - DNA, 19 bp, Homo sapiens
acactattttcagaatctg

SEQ ID NO: 5350629 - DNA, 18 bp, Homo sapiens
acactcaaatcaagaaac

SEQ ID NO: 5350630 - DNA, 20 bp, Homo sapiens
acactcaagactatgttctc

SEQ ID NO: 5350631 - DNA, 23 bp, Homo sapiens
acactcaagtgccattcatcctt

SEQ ID NO: 5350632 - DNA, 20 bp, Homo sapiens
acactcacatttattctgct

SEQ ID NO: 5350633 - DNA, 14 bp, Homo sapiens
acactcaccagtgg

SEQ ID NO: 5350634 - DNA, 19 bp, Homo sapiens
acactcaccagtggccttt

SEQ ID NO: 5350635 - DNA, 20 bp, Homo sapiens
acactcaccatgaagcgaaa

SEQ ID NO: 5350636 - DNA, 16 bp, Homo sapiens
acactcacccaacaat

SEQ ID NO: 5350637 - DNA, 21 bp, Homo sapiens
acactcactcctgagacccct

SEQ ID NO: 5350638 - DNA, 18 bp, Homo sapiens
acactcactgcctgcagc

SEQ ID NO: 5350639 - DNA, 18 bp, Homo sapiens
acactcagaaaattccct

SEQ ID NO: 5350640 - DNA, 22 bp, Homo sapiens
acactcagaaaattccctgggg

SEQ ID NO: 5350641 - DNA, 23 bp, Homo sapiens
acactcagaaaattccctggggt

SEQ ID NO: 5350642 - DNA, 16 bp, Homo sapiens
acactcagaaagaggt

SEQ ID NO: 5350643 - DNA, 16 bp, Homo sapiens
acactcagaagcctgg

SEQ ID NO: 5350644 - DNA, 17 bp, Homo sapiens
acactcagaagcctggg

SEQ ID NO: 5350645 - DNA, 20 bp, Homo sapiens
acactcagaagcctgggggc

SEQ ID NO: 5350646 - DNA, 18 bp, Homo sapiens
acactcagagtaatgtct

SEQ ID NO: 5350647 - DNA, 21 bp, Homo sapiens
acactcagcagacatttatct

SEQ ID NO: 5350648 - DNA, 13 bp, Homo sapiens
acactcagccact

SEQ ID NO: 5350649 - DNA, 17 bp, Homo sapiens
acactcagccactgtca

SEQ ID NO: 5350650 - DNA, 12 bp, Homo sapiens
acactcagctgt

SEQ ID NO: 5350651 - DNA, 14 bp, Homo sapiens
acactcagctgttc

SEQ ID NO: 5350652 - DNA, 17 bp, Homo sapiens
acactcaggcctgtgcc

SEQ ID NO: 5350653 - DNA, 11 bp, Homo sapiens
acactcagggc

SEQ ID NO: 5350654 - DNA, 16 bp, Homo sapiens
acactcagggcagctg

SEQ ID NO: 5350655 - DNA, 19 bp, Homo sapiens
acactcagggcagctgcct

SEQ ID NO: 5350656 - DNA, 20 bp, Homo sapiens
acactcagggcagctgcctg

SEQ ID NO: 5350657 - DNA, 18 bp, Homo sapiens
acactcagtccactgttg

SEQ ID NO: 5350658 - DNA, 16 bp, Homo sapiens
acactcagttgttcaa

SEQ ID NO: 5350659 - DNA, 23 bp, Homo sapiens
acactcatattgccctaattaaa

SEQ ID NO: 5350660 - DNA, 16 bp, Homo sapiens
acactcatcaggtaaa

SEQ ID NO: 5350661 - DNA, 15 bp, Homo sapiens
acactcatccctggt

SEQ ID NO: 5350662 - DNA, 19 bp, Homo sapiens
acactcatgcggcccagcc

SEQ ID NO: 5350663 - DNA, 19 bp, Homo sapiens
acactcattgacctgaggc

SEQ ID NO: 5350664 - DNA, 23 bp, Homo sapiens
acactcattgacctgaggccctt

SEQ ID NO: 5350665 - DNA, 20 bp, Homo sapiens
acactcattttcaatttcta

SEQ ID NO: 5350666 - DNA, 11 bp, Homo sapiens
acactccaacg

SEQ ID NO: 5350667 - DNA, 16 bp, Homo sapiens
acactccaagatatgg

SEQ ID NO: 5350668 - DNA, 18 bp, Homo sapiens
acactccaattaaggatt

SEQ ID NO: 5350669 - DNA, 21 bp, Homo sapiens
acactccaattaaggatttta

SEQ ID NO: 5350670 - DNA, 18 bp, Homo sapiens
acactccaccctccacct

SEQ ID NO: 5350671 - DNA, 23 bp, Homo sapiens
acactccagaattacccttcctc

SEQ ID NO: 5350672 - DNA, 15 bp, Homo sapiens
acactccagcctgag

SEQ ID NO: 5350673 - DNA, 14 bp, Homo sapiens
acactccagcctgg

SEQ ID NO: 5350674 - DNA, 15 bp, Homo sapiens
acactccaggccctg

SEQ ID NO: 5350675 - DNA, 18 bp, Homo sapiens
acactccaggccctgccc

SEQ ID NO: 5350676 - DNA, 13 bp, Homo sapiens
acactccagtgcc

SEQ ID NO: 5350677 - DNA, 19 bp, Homo sapiens
acactccagtgccagcaat

SEQ ID NO: 5350678 - DNA, 21 bp, Homo sapiens
acactccagtgccagcaatga

SEQ ID NO: 5350679 - DNA, 13 bp, Homo sapiens
acactccagtggc

SEQ ID NO: 5350680 - DNA, 14 bp, Homo sapiens
acactccatcagct

SEQ ID NO: 5350681 - DNA, 16 bp, Homo sapiens
acactccatcagctta

SEQ ID NO: 5350682 - DNA, 16 bp, Homo sapiens
acactccatgagtgtc

SEQ ID NO: 5350683 - DNA, 16 bp, Homo sapiens
acactcccacccagtc

SEQ ID NO: 5350684 - DNA, 22 bp, Homo sapiens
acactcccacccagtctctgct

SEQ ID NO: 5350685 - DNA, 13 bp, Homo sapiens
acactcccaggga

SEQ ID NO: 5350686 - DNA, 17 bp, Homo sapiens
acactcccccagactgc

SEQ ID NO: 5350687 - DNA, 17 bp, Homo sapiens
acactcccccctccatt

SEQ ID NO: 5350688 - DNA, 23 bp, Homo sapiens
acactcctatctcaactctgttt

SEQ ID NO: 5350689 - DNA, 13 bp, Homo sapiens
acactcctcctgc

SEQ ID NO: 5350690 - DNA, 16 bp, Homo sapiens
acactcctcctgccag

SEQ ID NO: 5350691 - DNA, 20 bp, Homo sapiens
acactcctcctgccagctct

SEQ ID NO: 5350692 - DNA, 21 bp, Homo sapiens
acactcctcctgccagctctg

SEQ ID NO: 5350693 - DNA, 15 bp, Homo sapiens
acactcctgggctct

SEQ ID NO: 5350694 - DNA, 11 bp, Homo sapiens
acactccttca

SEQ ID NO: 5350695 - DNA, 13 bp, Homo sapiens
acactccttcaca

SEQ ID NO: 5350696 - DNA, 18 bp, Homo sapiens
acactccttccccttgtc

SEQ ID NO: 5350697 - DNA, 14 bp, Homo sapiens
acactccttgcatc

SEQ ID NO: 5350698 - DNA, 18 bp, Homo sapiens
acactcgaaaagagcact

SEQ ID NO: 5350699 - DNA, 17 bp, Homo sapiens
acactcgaactcgggag

SEQ ID NO: 5350700 - DNA, 21 bp, Homo sapiens
acactcgaactcgggagggaa

SEQ ID NO: 5350701 - DNA, 16 bp, Homo sapiens
acactcgcccgcccac

SEQ ID NO: 5350702 - DNA, 15 bp, Homo sapiens
acactcgtcacccca

SEQ ID NO: 5350703 - DNA, 15 bp, Homo sapiens
acactctatatgtag

SEQ ID NO: 5350704 - DNA, 20 bp, Homo sapiens
acactctcaaagcaaataat

SEQ ID NO: 5350705 - DNA, 17 bp, Homo sapiens
acactctcatgtcccct

SEQ ID NO: 5350706 - DNA, 15 bp, Homo sapiens
acactctccttgcag

SEQ ID NO: 5350707 - DNA, 21 bp, Homo sapiens
acactctcgtggtatgtatgg

SEQ ID NO: 5350708 - DNA, 15 bp, Homo sapiens
acactctctgcagcc

SEQ ID NO: 5350709 - DNA, 21 bp, Homo sapiens
acactctctgcagcccagcct

SEQ ID NO: 5350710 - DNA, 17 bp, Homo sapiens
acactctctgtacaaaa

SEQ ID NO: 5350711 - DNA, 23 bp, Homo sapiens
acactctcttctccattccctag

SEQ ID NO: 5350712 - DNA, 22 bp, Homo sapiens
acactctcttcttactgtattt

SEQ ID NO: 5350713 - DNA, 20 bp, Homo sapiens
acactctcttgggccagccc

SEQ ID NO: 5350714 - DNA, 16 bp, Homo sapiens
acactctgacaagctg

SEQ ID NO: 5350715 - DNA, 20 bp, Homo sapiens
acactctgacaagctggcca

SEQ ID NO: 5350716 - DNA, 18 bp, Homo sapiens
acactctgagtctctgaa

SEQ ID NO: 5350717 - DNA, 15 bp, Homo sapiens
acactctgccttcct

SEQ ID NO: 5350718 - DNA, 17 bp, Homo sapiens
acactctgctgtttgac

SEQ ID NO: 5350719 - DNA, 14 bp, Homo sapiens
acactctggctggt

SEQ ID NO: 5350720 - DNA, 12 bp, Homo sapiens
acactcttcaag

SEQ ID NO: 5350721 - DNA, 23 bp, Homo sapiens
acactcttcagtgactcctgctg

SEQ ID NO: 5350722 - DNA, 20 bp, Homo sapiens
acactcttcttgagcagacc

SEQ ID NO: 5350723 - DNA, 21 bp, Homo sapiens
acactcttttgctttattcca

SEQ ID NO: 5350724 - DNA, 15 bp, Homo sapiens
acactgaaaccaaaa

SEQ ID NO: 5350725 - DNA, 19 bp, Homo sapiens
acactgaaaccaaaacata

SEQ ID NO: 5350726 - DNA, 13 bp, Homo sapiens
acactgaaagttt

SEQ ID NO: 5350727 - DNA, 17 bp, Homo sapiens
acactgaaatatacaca

SEQ ID NO: 5350728 - DNA, 20 bp, Homo sapiens
acactgaaatatacacacag

SEQ ID NO: 5350729 - DNA, 21 bp, Homo sapiens
acactgaaatatacacacagc

SEQ ID NO: 5350730 - DNA, 22 bp, Homo sapiens
acactgaaatatacacacagca

SEQ ID NO: 5350731 - DNA, 14 bp, Homo sapiens
acactgaagaagca

SEQ ID NO: 5350732 - DNA, 20 bp, Homo sapiens
acactgaatggaaataaata

SEQ ID NO: 5350733 - DNA, 21 bp, Homo sapiens
acactgaatttttatgtgtga

SEQ ID NO: 5350734 - DNA, 22 bp, Homo sapiens
acactgaatttttatgtgtgat

SEQ ID NO: 5350735 - DNA, 20 bp, Homo sapiens
acactgacataatgtagtga

SEQ ID NO: 5350736 - DNA, 15 bp, Homo sapiens
acactgaccaagtgc

SEQ ID NO: 5350737 - DNA, 20 bp, Homo sapiens
acactgaccaagtgctggcc

SEQ ID NO: 5350738 - DNA, 17 bp, Homo sapiens
acactgaccacactgta

SEQ ID NO: 5350739 - DNA, 17 bp, Homo sapiens
acactgaccatccactc

SEQ ID NO: 5350740 - DNA, 20 bp, Homo sapiens
acactgagaaatagtgcact

SEQ ID NO: 5350741 - DNA, 20 bp, Homo sapiens
acactgagaatgtaagaact

SEQ ID NO: 5350742 - DNA, 22 bp, Homo sapiens
acactgagaatgtaagaactac

SEQ ID NO: 5350743 - DNA, 15 bp, Homo sapiens
acactgagcaagatc

SEQ ID NO: 5350744 - DNA, 13 bp, Homo sapiens
acactgagccagt

SEQ ID NO: 5350745 - DNA, 11 bp, Homo sapiens
acactgagccc

SEQ ID NO: 5350746 - DNA, 21 bp, Homo sapiens
acactgagctgtgacccagag

SEQ ID NO: 5350747 - DNA, 13 bp, Homo sapiens
acactgaggactg

SEQ ID NO: 5350748 - DNA, 18 bp, Homo sapiens
acactgaggcagccttgg

SEQ ID NO: 5350749 - DNA, 20 bp, Homo sapiens
acactgagtcagaattcttc

SEQ ID NO: 5350750 - DNA, 14 bp, Homo sapiens
acactgagtttcta

SEQ ID NO: 5350751 - DNA, 19 bp, Homo sapiens
acactgatctgaacatctg

SEQ ID NO: 5350752 - DNA, 20 bp, Homo sapiens
acactgatctgaacatctgg

SEQ ID NO: 5350753 - DNA, 18 bp, Homo sapiens
acagaaagtggtgctcag

SEQ ID NO: 5350754 - DNA, 19 bp, Homo sapiens
acagaaagtggtgctcagt

SEQ ID NO: 5350755 - DNA, 22 bp, Homo sapiens
acagaaagtggtgctcagttgt

SEQ ID NO: 5350756 - DNA, 16 bp, Homo sapiens
acagaaataacagctg

SEQ ID NO: 5350757 - DNA, 18 bp, Homo sapiens
acagaaatactgctctga

SEQ ID NO: 5350758 - DNA, 17 bp, Homo sapiens
acagaaatataataaaa

SEQ ID NO: 5350759 - DNA, 19 bp, Homo sapiens
acagaaatatataaaaata

SEQ ID NO: 5350760 - DNA, 16 bp, Homo sapiens
acagaaatctgaaaaa

SEQ ID NO: 5350761 - DNA, 22 bp, Homo sapiens
acagaaatgacaacaaggccct

SEQ ID NO: 5350762 - DNA, 17 bp, Homo sapiens
acagaaatggaaagcag

SEQ ID NO: 5350763 - DNA, 22 bp, Homo sapiens
acagaaatggggaattctctaa

SEQ ID NO: 5350764 - DNA, 20 bp, Homo sapiens
acagaaattggtaccttgca

SEQ ID NO: 5350765 - DNA, 23 bp, Homo sapiens
acagaaattggtaccttgcacac

SEQ ID NO: 5350766 - DNA, 19 bp, Homo sapiens
acagaaattgtatattgta

SEQ ID NO: 5350767 - DNA, 12 bp, Homo sapiens
acagaaatttaa

SEQ ID NO: 5350768 - DNA, 14 bp, Homo sapiens
acagaacaacaaca

SEQ ID NO: 5350769 - DNA, 17 bp, Homo sapiens
acagaacaacaacaaag

SEQ ID NO: 5350770 - DNA, 15 bp, Homo sapiens
acagaacacaaatgt

SEQ ID NO: 5350771 - DNA, 21 bp, Homo sapiens
acagaacacagccaaagtaaa

SEQ ID NO: 5350772 - DNA, 21 bp, Homo sapiens
acagaacacataattcaggaa

SEQ ID NO: 5350773 - DNA, 13 bp, Homo sapiens
acagaacactaaa

SEQ ID NO: 5350774 - DNA, 14 bp, Homo sapiens
acagaacactgtct

SEQ ID NO: 5350775 - DNA, 23 bp, Homo sapiens
acagaacaggaggtgtgaatgca

SEQ ID NO: 5350776 - DNA, 14 bp, Homo sapiens
acagaacagggtca

SEQ ID NO: 5350777 - DNA, 14 bp, Homo sapiens
acagaacagtttgt

SEQ ID NO: 5350778 - DNA, 16 bp, Homo sapiens
acagaacatagacaga

SEQ ID NO: 5350779 - DNA, 21 bp, Homo sapiens
acagaacatgctgttatttag

SEQ ID NO: 5350780 - DNA, 13 bp, Homo sapiens
acagaaccagagg

SEQ ID NO: 5350781 - DNA, 19 bp, Homo sapiens
acagaaccagagggttgta

SEQ ID NO: 5350782 - DNA, 14 bp, Homo sapiens
acagaaccagcact

SEQ ID NO: 5350783 - DNA, 15 bp, Homo sapiens
acagaaccagcactc

SEQ ID NO: 5350784 - DNA, 16 bp, Homo sapiens
acagaaccagcactcc

SEQ ID NO: 5350785 - DNA, 14 bp, Homo sapiens
acagaaccctccac

SEQ ID NO: 5350786 - DNA, 20 bp, Homo sapiens
acagaacctactgttccttt

SEQ ID NO: 5350787 - DNA, 22 bp, Homo sapiens
acagaacctactgttcctttca

SEQ ID NO: 5350788 - DNA, 18 bp, Homo sapiens
acagaactaaatgttcta

SEQ ID NO: 5350789 - DNA, 15 bp, Homo sapiens
acagaactacatatt

SEQ ID NO: 5350790 - DNA, 20 bp, Homo sapiens
acagaactgcttactagccc

SEQ ID NO: 5350791 - DNA, 20 bp, Homo sapiens
acagaacttcagcattgtaa

SEQ ID NO: 5350792 - DNA, 17 bp, Homo sapiens
acagaacttgaatgtgt

SEQ ID NO: 5350793 - DNA, 12 bp, Homo sapiens
acagaagaaaaa

SEQ ID NO: 5350794 - DNA, 16 bp, Homo sapiens
acagaagaaggcagca

SEQ ID NO: 5350795 - DNA, 19 bp, Homo sapiens
acagaagacacgtgttttt

SEQ ID NO: 5350796 - DNA, 21 bp, Homo sapiens
acagaagacacgtgtttttgt

SEQ ID NO: 5350797 - DNA, 14 bp, Homo sapiens
acagaagacagcag

SEQ ID NO: 5350798 - DNA, 15 bp, Homo sapiens
acagaagagaaggaa

SEQ ID NO: 5350799 - DNA, 13 bp, Homo sapiens
acagaagaggagg

SEQ ID NO: 5350800 - DNA, 19 bp, Homo sapiens
acagaagagtttcttaact

SEQ ID NO: 5350801 - DNA, 15 bp, Homo sapiens
acagaagattacaaa

SEQ ID NO: 5350802 - DNA, 14 bp, Homo sapiens
acagaagcagctct

SEQ ID NO: 5350803 - DNA, 16 bp, Homo sapiens
acagaagcagcttctt

SEQ ID NO: 5350804 - DNA, 12 bp, Homo sapiens
acagaagcattt

SEQ ID NO: 5350805 - DNA, 13 bp, Homo sapiens
acagaagcatttg

SEQ ID NO: 5350806 - DNA, 17 bp, Homo sapiens
acagaagccaagctccc

SEQ ID NO: 5350807 - DNA, 22 bp, Homo sapiens
acagaagccaagctccctggag

SEQ ID NO: 5350808 - DNA, 23 bp, Homo sapiens
acagaagccaagctccctggagc

SEQ ID NO: 5350809 - DNA, 15 bp, Homo sapiens
acagaagcccatgtc

SEQ ID NO: 5350810 - DNA, 21 bp, Homo sapiens
acagaagcctcactgcaagca

SEQ ID NO: 5350811 - DNA, 21 bp, Homo sapiens
acagaagctttttgtttgcat

SEQ ID NO: 5350812 - DNA, 22 bp, Homo sapiens
acagaagctttttgtttgcatc

SEQ ID NO: 5350813 - DNA, 19 bp, Homo sapiens
acagaaggaatctgtgcag

SEQ ID NO: 5350814 - DNA, 20 bp, Homo sapiens
acagaaggaatctgtgcaga

SEQ ID NO: 5350815 - DNA, 20 bp, Homo sapiens
acagaaggcaaagtttccat

SEQ ID NO: 5350816 - DNA, 13 bp, Homo sapiens
acagaaggcccga

SEQ ID NO: 5350817 - DNA, 18 bp, Homo sapiens
acagaaggcccgaggagg

SEQ ID NO: 5350818 - DNA, 16 bp, Homo sapiens
acagaaggctcctgcc

SEQ ID NO: 5350819 - DNA, 19 bp, Homo sapiens
acagaaggctcctgccccc

SEQ ID NO: 5350820 - DNA, 22 bp, Homo sapiens
acagaaggggactgccacctcc

SEQ ID NO: 5350821 - DNA, 23 bp, Homo sapiens
acagaaggggactgccacctccc

SEQ ID NO: 5350822 - DNA, 14 bp, Homo sapiens
acagaaggggatgg

SEQ ID NO: 5350823 - DNA, 19 bp, Homo sapiens
acagaaggggatgggaaat

SEQ ID NO: 5350824 - DNA, 18 bp, Homo sapiens
acagaaggtgttcaaaca

SEQ ID NO: 5350825 - DNA, 22 bp, Homo sapiens
acagaagtagttttgttcatga

SEQ ID NO: 5350826 - DNA, 18 bp, Homo sapiens
acagaagtatcaagccat

SEQ ID NO: 5350827 - DNA, 16 bp, Homo sapiens
acagaagtcatgaagc

SEQ ID NO: 5350828 - DNA, 18 bp, Homo sapiens
acagaagtcatgaagccc

SEQ ID NO: 5350829 - DNA, 19 bp, Homo sapiens
acagaagtccctaggaggg

SEQ ID NO: 5350830 - DNA, 21 bp, Homo sapiens
acagaagtcctgtatgtctgt

SEQ ID NO: 5350831 - DNA, 22 bp, Homo sapiens
acagaagtcctgtatgtctgtc

SEQ ID NO: 5350832 - DNA, 18 bp, Homo sapiens
acagaagtgaggatgaga

SEQ ID NO: 5350833 - DNA, 16 bp, Homo sapiens
acagaagttgtgaaac

SEQ ID NO: 5350834 - DNA, 17 bp, Homo sapiens
acagaagttgtgaaact

SEQ ID NO: 5350835 - DNA, 17 bp, Homo sapiens
acagaataaagcagcct

SEQ ID NO: 5350836 - DNA, 15 bp, Homo sapiens
acagaataatgaatg

SEQ ID NO: 5350837 - DNA, 18 bp, Homo sapiens
acagaatactagccagag

SEQ ID NO: 5350838 - DNA, 15 bp, Homo sapiens
acagaatagggtggc

SEQ ID NO: 5350839 - DNA, 21 bp, Homo sapiens
acagaatagtttacacactgt

SEQ ID NO: 5350840 - DNA, 15 bp, Homo sapiens
acagaatatacacat

SEQ ID NO: 5350841 - DNA, 23 bp, Homo sapiens
acagaatatacacattttgtaaa

SEQ ID NO: 5350842 - DNA, 16 bp, Homo sapiens
acagaatatgtttcaa

SEQ ID NO: 5350843 - DNA, 17 bp, Homo sapiens
acagaatatgtttcaaa

SEQ ID NO: 5350844 - DNA, 21 bp, Homo sapiens
acagaatatgtttcaaacttt

SEQ ID NO: 5350845 - DNA, 17 bp, Homo sapiens
acagaatattaaatatt

SEQ ID NO: 5350846 - DNA, 18 bp, Homo sapiens
acagaatattaaatatta

SEQ ID NO: 5350847 - DNA, 19 bp, Homo sapiens
acagaatatttctattgaa

SEQ ID NO: 5350848 - DNA, 22 bp, Homo sapiens
acagaatatttttatatttcct

SEQ ID NO: 5350849 - DNA, 22 bp, Homo sapiens
acagaatcagtgttaaattcat

SEQ ID NO: 5350850 - DNA, 22 bp, Homo sapiens
acagaatcatatgattctgctt

SEQ ID NO: 5350851 - DNA, 13 bp, Homo sapiens
acagaatcttctg

SEQ ID NO: 5350852 - DNA, 14 bp, Homo sapiens
acagaatcttctgg

SEQ ID NO: 5350853 - DNA, 19 bp, Homo sapiens
acagaatcttgttttgaaa

SEQ ID NO: 5350854 - DNA, 15 bp, Homo sapiens
acagaatgaaaaatg

SEQ ID NO: 5350855 - DNA, 20 bp, Homo sapiens
acagaatgaaaaatgaaaga

SEQ ID NO: 5350856 - DNA, 21 bp, Homo sapiens
acagaatgaaaaatgaaagat

SEQ ID NO: 5350857 - DNA, 16 bp, Homo sapiens
acagaatgactgacaa

SEQ ID NO: 5350858 - DNA, 16 bp, Homo sapiens
acagaatgatgccaaa

SEQ ID NO: 5350859 - DNA, 18 bp, Homo sapiens
acagaatgcattaaaaaa

SEQ ID NO: 5350860 - DNA, 13 bp, Homo sapiens
acagaatgctcag

SEQ ID NO: 5350861 - DNA, 17 bp, Homo sapiens
acagaatgtatctgtga

SEQ ID NO: 5350862 - DNA, 18 bp, Homo sapiens
acagaatgtatctgtgaa

SEQ ID NO: 5350863 - DNA, 16 bp, Homo sapiens
acagaatgtcaccagt

SEQ ID NO: 5350864 - DNA, 21 bp, Homo sapiens
acagaatgtgtctcaggaaaa

SEQ ID NO: 5350865 - DNA, 13 bp, Homo sapiens
acagaatgtgttc

SEQ ID NO: 5350866 - DNA, 16 bp, Homo sapiens
acagaatgtgttcttt

SEQ ID NO: 5350867 - DNA, 18 bp, Homo sapiens
acagaatgtgttcttttc

SEQ ID NO: 5350868 - DNA, 21 bp, Homo sapiens
acagaatgttttactgtgaaa

SEQ ID NO: 5350869 - DNA, 22 bp, Homo sapiens
acagaattactgtaactgatta

SEQ ID NO: 5350870 - DNA, 23 bp, Homo sapiens
acagaattagaaaagttaacatt

SEQ ID NO: 5350871 - DNA, 19 bp, Homo sapiens
acagaattctcccagcgtt

SEQ ID NO: 5350872 - DNA, 22 bp, Homo sapiens
acagaattgggcccttagaatg

SEQ ID NO: 5350873 - DNA, 13 bp, Homo sapiens
acagaatttgaga

SEQ ID NO: 5350874 - DNA, 14 bp, Homo sapiens
acagaatttttaat

SEQ ID NO: 5350875 - DNA, 20 bp, Homo sapiens
acagaatttttaatgacttt

SEQ ID NO: 5350876 - DNA, 13 bp, Homo sapiens
acagaatttttcc

SEQ ID NO: 5350877 - DNA, 15 bp, Homo sapiens
acagaattttttttg

SEQ ID NO: 5350878 - DNA, 13 bp, Homo sapiens
acagacaaaaaca

SEQ ID NO: 5350879 - DNA, 15 bp, Homo sapiens
acagacaaaaacaag

SEQ ID NO: 5350880 - DNA, 18 bp, Homo sapiens
acagacaaagcataatca

SEQ ID NO: 5350881 - DNA, 17 bp, Homo sapiens
acagacaagcaacccaa

SEQ ID NO: 5350882 - DNA, 21 bp, Homo sapiens
acagacaagggggatgttgtg

SEQ ID NO: 5350883 - DNA, 20 bp, Homo sapiens
acagacaattctaatggtaa

SEQ ID NO: 5350884 - DNA, 22 bp, Homo sapiens
acagacaattctaatggtaact

SEQ ID NO: 5350885 - DNA, 23 bp, Homo sapiens
acagacaattctaatggtaactt

SEQ ID NO: 5350886 - DNA, 11 bp, Homo sapiens
acagacacaca

SEQ ID NO: 5350887 - DNA, 12 bp, Homo sapiens
acagacacacac

SEQ ID NO: 5350888 - DNA, 18 bp, Homo sapiens
acagacacacacacgcac

SEQ ID NO: 5350889 - DNA, 14 bp, Homo sapiens
acagacacacgcac

SEQ ID NO: 5350890 - DNA, 18 bp, Homo sapiens
acagacacaggcccggct

SEQ ID NO: 5350891 - DNA, 23 bp, Homo sapiens
acagacacaggcccggctccagg

SEQ ID NO: 5350892 - DNA, 19 bp, Homo sapiens
acagacaccacagcctccc

SEQ ID NO: 5350893 - DNA, 19 bp, Homo sapiens
acagacacccataataaaa

SEQ ID NO: 5350894 - DNA, 20 bp, Homo sapiens
acagacacccataataaaat

SEQ ID NO: 5350895 - DNA, 13 bp, Homo sapiens
acagacaccctcc

SEQ ID NO: 5350896 - DNA, 21 bp, Homo sapiens
acagacaccctccactctgag

SEQ ID NO: 5350897 - DNA, 11 bp, Homo sapiens
acagacacctc

SEQ ID NO: 5350898 - DNA, 19 bp, Homo sapiens
acagacacctccccctacc

SEQ ID NO: 5350899 - DNA, 20 bp, Homo sapiens
acagacacctccccctaccc

SEQ ID NO: 5350900 - DNA, 22 bp, Homo sapiens
acagacactaacgaaatatcaa

SEQ ID NO: 5350901 - DNA, 18 bp, Homo sapiens
acagacactaagttatag

SEQ ID NO: 5350902 - DNA, 15 bp, Homo sapiens
acagacactacatat

SEQ ID NO: 5350903 - DNA, 17 bp, Homo sapiens
acagacactgttgcaaa

SEQ ID NO: 5350904 - DNA, 13 bp, Homo sapiens
acagacagcagct

SEQ ID NO: 5350905 - DNA, 13 bp, Homo sapiens
acagacagccctc

SEQ ID NO: 5350906 - DNA, 18 bp, Homo sapiens
acagacagcttacaggag

SEQ ID NO: 5350907 - DNA, 20 bp, Homo sapiens
acagacagcttacaggagcc

SEQ ID NO: 5350908 - DNA, 13 bp, Homo sapiens
acagacaggaatt

SEQ ID NO: 5350909 - DNA, 18 bp, Homo sapiens
acagacaggacccctgca

SEQ ID NO: 5350910 - DNA, 15 bp, Homo sapiens
acagacaggagaaat

SEQ ID NO: 5350911 - DNA, 21 bp, Homo sapiens
acagacaggagaaatgcatcc

SEQ ID NO: 5350912 - DNA, 18 bp, Homo sapiens
acagacatcaagtgccag

SEQ ID NO: 5350913 - DNA, 21 bp, Homo sapiens
acagacatctcctcaccccag

SEQ ID NO: 5350914 - DNA, 16 bp, Homo sapiens
acagacatgagccact

SEQ ID NO: 5350915 - DNA, 22 bp, Homo sapiens
acagacatggagatgtaaaatg

SEQ ID NO: 5350916 - DNA, 12 bp, Homo sapiens
acagacattgtt

SEQ ID NO: 5350917 - DNA, 17 bp, Homo sapiens
acagacattttgtgtga

SEQ ID NO: 5350918 - DNA, 17 bp, Homo sapiens
acagaccaatagacatt

SEQ ID NO: 5350919 - DNA, 23 bp, Homo sapiens
acagaccacaggaagatgggagg

SEQ ID NO: 5350920 - DNA, 23 bp, Homo sapiens
acagaccacctgcttctgaactc

SEQ ID NO: 5350921 - DNA, 23 bp, Homo sapiens
acagaccagcagcaatctgtctt

SEQ ID NO: 5350922 - DNA, 22 bp, Homo sapiens
acagaccagcatagttctgcaa

SEQ ID NO: 5350923 - DNA, 19 bp, Homo sapiens
acagaccagtgaccccaga

SEQ ID NO: 5350924 - DNA, 17 bp, Homo sapiens
acagaccatctgtatgt

SEQ ID NO: 5350925 - DNA, 22 bp, Homo sapiens
acagaccatctgtatgttaggt

SEQ ID NO: 5350926 - DNA, 15 bp, Homo sapiens
acagaccatggatat

SEQ ID NO: 5350927 - DNA, 19 bp, Homo sapiens
acagaccatggatatgttg

SEQ ID NO: 5350928 - DNA, 15 bp, Homo sapiens
acagacccacacatg

SEQ ID NO: 5350929 - DNA, 20 bp, Homo sapiens
acagatgtagatataaatat

SEQ ID NO: 5350930 - DNA, 16 bp, Homo sapiens
acagatgtatcatgat

SEQ ID NO: 5350931 - DNA, 20 bp, Homo sapiens
acagatgtcagccgagccgg

SEQ ID NO: 5350932 - DNA, 20 bp, Homo sapiens
acagatgtcagcttcccagc

SEQ ID NO: 5350933 - DNA, 14 bp, Homo sapiens
acagatgtccatca

SEQ ID NO: 5350934 - DNA, 16 bp, Homo sapiens
acagatgtccatcaga

SEQ ID NO: 5350935 - DNA, 22 bp, Homo sapiens
acagatgtccatcagatgacaa

SEQ ID NO: 5350936 - DNA, 17 bp, Homo sapiens
acagatgtgaaaatata

SEQ ID NO: 5350937 - DNA, 21 bp, Homo sapiens
acagatgtgaaggacatgaga

SEQ ID NO: 5350938 - DNA, 22 bp, Homo sapiens
acagatgtgaaggacatgagac

SEQ ID NO: 5350939 - DNA, 23 bp, Homo sapiens
acagatgtgaaggacatgagact

SEQ ID NO: 5350940 - DNA, 15 bp, Homo sapiens
acagatgtgcccaga

SEQ ID NO: 5350941 - DNA, 19 bp, Homo sapiens
acagatgtgcccagagtag

SEQ ID NO: 5350942 - DNA, 17 bp, Homo sapiens
acagatgtggacatgca

SEQ ID NO: 5350943 - DNA, 18 bp, Homo sapiens
acagatgtggacatgcac

SEQ ID NO: 5350944 - DNA, 19 bp, Homo sapiens
acagatgtggacatgcacc

SEQ ID NO: 5350945 - DNA, 20 bp, Homo sapiens
acagatgtggacatgcaccc

SEQ ID NO: 5350946 - DNA, 21 bp, Homo sapiens
acagatgtggacatgcacccg

SEQ ID NO: 5350947 - DNA, 20 bp, Homo sapiens
acagatgtgggccaccatgt

SEQ ID NO: 5350948 - DNA, 22 bp, Homo sapiens
acagatgtgggctttgatttcc

SEQ ID NO: 5350949 - DNA, 20 bp, Homo sapiens
acagatgtgtctgggagagc

SEQ ID NO: 5350950 - DNA, 21 bp, Homo sapiens
acagatgtgtctgggagagcc

SEQ ID NO: 5350951 - DNA, 12 bp, Homo sapiens
acagatgttatt

SEQ ID NO: 5350952 - DNA, 13 bp, Homo sapiens
acagatgttattt

SEQ ID NO: 5350953 - DNA, 15 bp, Homo sapiens
acagatgttattttt

SEQ ID NO: 5350954 - DNA, 19 bp, Homo sapiens
acagatgttcccccatctc

SEQ ID NO: 5350955 - DNA, 19 bp, Homo sapiens
acagatgtttgttttcaaa

SEQ ID NO: 5350956 - DNA, 23 bp, Homo sapiens
acagatgtttttaattctagtat

SEQ ID NO: 5350957 - DNA, 22 bp, Homo sapiens
acagattaaacttcacctacaa

SEQ ID NO: 5350958 - DNA, 18 bp, Homo sapiens
acagattacttcagggct

SEQ ID NO: 5350959 - DNA, 16 bp, Homo sapiens
acagattataataaat

SEQ ID NO: 5350960 - DNA, 17 bp, Homo sapiens
acagattatcacattaa

SEQ ID NO: 5350961 - DNA, 20 bp, Homo sapiens
acagattatcacattaattt

SEQ ID NO: 5350962 - DNA, 15 bp, Homo sapiens
acagattatgtatta

SEQ ID NO: 5350963 - DNA, 13 bp, Homo sapiens
acagattatttgt

SEQ ID NO: 5350964 - DNA, 19 bp, Homo sapiens
acagattcagaatgagaat

SEQ ID NO: 5350965 - DNA, 17 bp, Homo sapiens
acagattcaggccagcc

SEQ ID NO: 5350966 - DNA, 18 bp, Homo sapiens
acagattcaggccagccc

SEQ ID NO: 5350967 - DNA, 19 bp, Homo sapiens
acagattcaggccagccca

SEQ ID NO: 5350968 - DNA, 23 bp, Homo sapiens
acagattccattaagagtgaatg

SEQ ID NO: 5350969 - DNA, 13 bp, Homo sapiens
acagattcccagg

SEQ ID NO: 5350970 - DNA, 13 bp, Homo sapiens
acagattcctgtt

SEQ ID NO: 5350971 - DNA, 14 bp, Homo sapiens
acagattctgacat

SEQ ID NO: 5350972 - DNA, 17 bp, Homo sapiens
acagattctgattccct

SEQ ID NO: 5350973 - DNA, 15 bp, Homo sapiens
acagattctttcagt

SEQ ID NO: 5350974 - DNA, 13 bp, Homo sapiens
acagattgacagg

SEQ ID NO: 5350975 - DNA, 23 bp, Homo sapiens
acagattgacagggactttgctg

SEQ ID NO: 5350976 - DNA, 14 bp, Homo sapiens
acagattgcctcct

SEQ ID NO: 5350977 - DNA, 15 bp, Homo sapiens
acagattgctacaca

SEQ ID NO: 5350978 - DNA, 17 bp, Homo sapiens
acagattgctacacaca

SEQ ID NO: 5350979 - DNA, 13 bp, Homo sapiens
acagattgctgct

SEQ ID NO: 5350980 - DNA, 16 bp, Homo sapiens
acagattgctgcttct

SEQ ID NO: 5350981 - DNA, 23 bp, Homo sapiens
acagattggattttatgttgaca

SEQ ID NO: 5350982 - DNA, 22 bp, Homo sapiens
acagattgggcggggcttctct

SEQ ID NO: 5350983 - DNA, 14 bp, Homo sapiens
acagattgtttcta

SEQ ID NO: 5350984 - DNA, 15 bp, Homo sapiens
acagattgtttctat

SEQ ID NO: 5350985 - DNA, 20 bp, Homo sapiens
acagatttaagcaagaccat

SEQ ID NO: 5350986 - DNA, 17 bp, Homo sapiens
acagatttattcctttg

SEQ ID NO: 5350987 - DNA, 18 bp, Homo sapiens
acagatttcagtaatgtc

SEQ ID NO: 5350988 - DNA, 19 bp, Homo sapiens
acagatttcagtaatgtct

SEQ ID NO: 5350989 - DNA, 17 bp, Homo sapiens
acagatttcatacctca

SEQ ID NO: 5350990 - DNA, 12 bp, Homo sapiens
acagatttctaa

SEQ ID NO: 5350991 - DNA, 17 bp, Homo sapiens
acagatttctaagttaa

SEQ ID NO: 5350992 - DNA, 14 bp, Homo sapiens
acagatttgagctc

SEQ ID NO: 5350993 - DNA, 16 bp, Homo sapiens
acagatttgttcattc

SEQ ID NO: 5350994 - DNA, 11 bp, Homo sapiens
acagattttaa

SEQ ID NO: 5350995 - DNA, 17 bp, Homo sapiens
acagattttaattgtca

SEQ ID NO: 5350996 - DNA, 20 bp, Homo sapiens
acagattttaattgtcatgg

SEQ ID NO: 5350997 - DNA, 17 bp, Homo sapiens
acagattttatttatgc

SEQ ID NO: 5350998 - DNA, 21 bp, Homo sapiens
acagattttatttgtaatttt

SEQ ID NO: 5350999 - DNA, 22 bp, Homo sapiens
acagatttttatgttttctttc

SEQ ID NO: 5351000 - DNA, 20 bp, Homo sapiens
acagatttttggtagtttct

SEQ ID NO: 5351001 - DNA, 23 bp, Homo sapiens
acagattttttctttaaataaaa

SEQ ID NO: 5351002 - DNA, 22 bp, Homo sapiens
acagcaaaaaaagcaacttttc

SEQ ID NO: 5351003 - DNA, 14 bp, Homo sapiens
acagcaaaagttct

SEQ ID NO: 5351004 - DNA, 15 bp, Homo sapiens
acagcaaacaggtgc

SEQ ID NO: 5351005 - DNA, 22 bp, Homo sapiens
acagcaaacaggtgctaatttg

SEQ ID NO: 5351006 - DNA, 13 bp, Homo sapiens
acagcaaaccaag

SEQ ID NO: 5351007 - DNA, 15 bp, Homo sapiens
acagcaaaccaagag

SEQ ID NO: 5351008 - DNA, 21 bp, Homo sapiens
acagcaaaccaagagattgct

SEQ ID NO: 5351009 - DNA, 14 bp, Homo sapiens
acagcaaagccata

SEQ ID NO: 5351010 - DNA, 22 bp, Homo sapiens
acagcaaagccatattctaaat

SEQ ID NO: 5351011 - DNA, 22 bp, Homo sapiens
acagcaaataaccattggttaa

SEQ ID NO: 5351012 - DNA, 19 bp, Homo sapiens
acagcaaattaatgtgtaa

SEQ ID NO: 5351013 - DNA, 20 bp, Homo sapiens
acagcaaatttataatttta

SEQ ID NO: 5351014 - DNA, 21 bp, Homo sapiens
acagcaacaggaatctcagag

SEQ ID NO: 5351015 - DNA, 23 bp, Homo sapiens
acagcaacaggaatctcagagac

SEQ ID NO: 5351016 - DNA, 14 bp, Homo sapiens
acagcaaccccagg

SEQ ID NO: 5351017 - DNA, 20 bp, Homo sapiens
acagcaacgatcacaaatga

SEQ ID NO: 5351018 - DNA, 22 bp, Homo sapiens
acagcaacgatcacaaatgact

SEQ ID NO: 5351019 - DNA, 13 bp, Homo sapiens
acagcaactgacc

SEQ ID NO: 5351020 - DNA, 15 bp, Homo sapiens
acagcaactgacctg

SEQ ID NO: 5351021 - DNA, 14 bp, Homo sapiens
acagcaagaaataa

SEQ ID NO: 5351022 - DNA, 17 bp, Homo sapiens
acagcaagatgtttctt

SEQ ID NO: 5351023 - DNA, 22 bp, Homo sapiens
acagcaagccggccccccctct

SEQ ID NO: 5351024 - DNA, 21 bp, Homo sapiens
acagcaaggagatttacaact

SEQ ID NO: 5351025 - DNA, 20 bp, Homo sapiens
acagcaaggaggctggctgg

SEQ ID NO: 5351026 - DNA, 23 bp, Homo sapiens
acagcaaggaggctggctggggc

SEQ ID NO: 5351027 - DNA, 16 bp, Homo sapiens
acagcaaggcacctgc

SEQ ID NO: 5351028 - DNA, 18 bp, Homo sapiens
acagcaaggcacctgcag

SEQ ID NO: 5351029 - DNA, 23 bp, Homo sapiens
acagcaagggagagaatccaagc

SEQ ID NO: 5351030 - DNA, 14 bp, Homo sapiens
acagcaaggtgtgg

SEQ ID NO: 5351031 - DNA, 18 bp, Homo sapiens
acagcaaggtgtggaggc

SEQ ID NO: 5351032 - DNA, 15 bp, Homo sapiens
acagcaagtgtgaat

SEQ ID NO: 5351033 - DNA, 17 bp, Homo sapiens
acagcaagtttataaaa

SEQ ID NO: 5351034 - DNA, 20 bp, Homo sapiens
acagcaatatttaacaattt

SEQ ID NO: 5351035 - DNA, 15 bp, Homo sapiens
acagcaattcatggt

SEQ ID NO: 5351036 - DNA, 21 bp, Homo sapiens
acagcaattcatggttcaagt

SEQ ID NO: 5351037 - DNA, 19 bp, Homo sapiens
acagcaattcctcaggcta

SEQ ID NO: 5351038 - DNA, 15 bp, Homo sapiens
acagcaattggctcc

SEQ ID NO: 5351039 - DNA, 20 bp, Homo sapiens
acagcacaaacacacctctg

SEQ ID NO: 5351040 - DNA, 21 bp, Homo sapiens
acagcacaaggtggcagcaag

SEQ ID NO: 5351041 - DNA, 22 bp, Homo sapiens
acagcacaaggtggcagcaagc

SEQ ID NO: 5351042 - DNA, 16 bp, Homo sapiens
acagcacacacagtgg

SEQ ID NO: 5351043 - DNA, 14 bp, Homo sapiens
acagcacacaggca

SEQ ID NO: 5351044 - DNA, 18 bp, Homo sapiens
acagcacaccagccgctg

SEQ ID NO: 5351045 - DNA, 18 bp, Homo sapiens
acagcacacctgtgtcca

SEQ ID NO: 5351046 - DNA, 19 bp, Homo sapiens
acagcacacctgtgtccaa

SEQ ID NO: 5351047 - DNA, 18 bp, Homo sapiens
acagcacacggtgagggt

SEQ ID NO: 5351048 - DNA, 14 bp, Homo sapiens
acagcacagaatga

SEQ ID NO: 5351049 - DNA, 14 bp, Homo sapiens
acagcacagagaag

SEQ ID NO: 5351050 - DNA, 22 bp, Homo sapiens
acagcacagagaagacaaaatt

SEQ ID NO: 5351051 - DNA, 12 bp, Homo sapiens
acagcacagcca

SEQ ID NO: 5351052 - DNA, 16 bp, Homo sapiens
acagcacagctccctg

SEQ ID NO: 5351053 - DNA, 17 bp, Homo sapiens
acagcacagctccctgc

SEQ ID NO: 5351054 - DNA, 19 bp, Homo sapiens
acagcacatttgttaatga

SEQ ID NO: 5351055 - DNA, 18 bp, Homo sapiens
acagcaccaaaggctcag

SEQ ID NO: 5351056 - DNA, 21 bp, Homo sapiens
acagcaccaccatttaatttc

SEQ ID NO: 5351057 - DNA, 22 bp, Homo sapiens
acagcaccaccatttaatttca

SEQ ID NO: 5351058 - DNA, 14 bp, Homo sapiens
acagcaccactgct

SEQ ID NO: 5351059 - DNA, 14 bp, Homo sapiens
acagcacccaggct

SEQ ID NO: 5351060 - DNA, 19 bp, Homo sapiens
acagcacccaggctccatg

SEQ ID NO: 5351061 - DNA, 20 bp, Homo sapiens
acagcacccaggctccatgg

SEQ ID NO: 5351062 - DNA, 17 bp, Homo sapiens
acagcaccgggggagag

SEQ ID NO: 5351063 - DNA, 17 bp, Homo sapiens
acagcacctccccgctg

SEQ ID NO: 5351064 - DNA, 19 bp, Homo sapiens
acagcacctcctctctgct

SEQ ID NO: 5351065 - DNA, 21 bp, Homo sapiens
acagcacctcctctctgctgg

SEQ ID NO: 5351066 - DNA, 12 bp, Homo sapiens
acagcactactc

SEQ ID NO: 5351067 - DNA, 19 bp, Homo sapiens
acagcactactgggtgtca

SEQ ID NO: 5351068 - DNA, 20 bp, Homo sapiens
acagcactactgggtgtcat

SEQ ID NO: 5351069 - DNA, 16 bp, Homo sapiens
acagcactgcctgcca

SEQ ID NO: 5351070 - DNA, 19 bp, Homo sapiens
acagcactgcctgccaagc

SEQ ID NO: 5351071 - DNA, 19 bp, Homo sapiens
acagcactggctctctcca

SEQ ID NO: 5351072 - DNA, 20 bp, Homo sapiens
acagcactggctctctccag

SEQ ID NO: 5351073 - DNA, 14 bp, Homo sapiens
acagcactggggag

SEQ ID NO: 5351074 - DNA, 18 bp, Homo sapiens
acagcagaaacccatgtg

SEQ ID NO: 5351075 - DNA, 13 bp, Homo sapiens
acagcagaatgaa

SEQ ID NO: 5351076 - DNA, 14 bp, Homo sapiens
acagcagaatgaag

SEQ ID NO: 5351077 - DNA, 15 bp, Homo sapiens
acagcagaatgaaga

SEQ ID NO: 5351078 - DNA, 22 bp, Homo sapiens
acagcagacaccattcattcca

SEQ ID NO: 5351079 - DNA, 18 bp, Homo sapiens
acagcagactcagctctg

SEQ ID NO: 5351080 - DNA, 22 bp, Homo sapiens
acagcagatccacctgcacaaa

SEQ ID NO: 5351081 - DNA, 15 bp, Homo sapiens
acagcagcaagaaaa

SEQ ID NO: 5351082 - DNA, 13 bp, Homo sapiens
acagcagcactcc

SEQ ID NO: 5351083 - DNA, 20 bp, Homo sapiens
acagcagcactcccgctgca

SEQ ID NO: 5351084 - DNA, 16 bp, Homo sapiens
acagcagcactgcaga

SEQ ID NO: 5351085 - DNA, 22 bp, Homo sapiens
acagcagcagaacaagtgcctc

SEQ ID NO: 5351086 - DNA, 15 bp, Homo sapiens
acagcagcagcctgc

SEQ ID NO: 5351087 - DNA, 21 bp, Homo sapiens
acagcagcagcctgcacctgc

SEQ ID NO: 5351088 - DNA, 11 bp, Homo sapiens
acagcagcctg

SEQ ID NO: 5351089 - DNA, 13 bp, Homo sapiens
acagcagcctgct

SEQ ID NO: 5351090 - DNA, 23 bp, Homo sapiens
acagcagcgcagccgagccccag

SEQ ID NO: 5351091 - DNA, 15 bp, Homo sapiens
acagcagctcaggca

SEQ ID NO: 5351092 - DNA, 17 bp, Homo sapiens
acagcagctcaggcaca

SEQ ID NO: 5351093 - DNA, 13 bp, Homo sapiens
acagcagctcata

SEQ ID NO: 5351094 - DNA, 22 bp, Homo sapiens
acagcagctcatagaattttga

SEQ ID NO: 5351095 - DNA, 14 bp, Homo sapiens
acagcagctccaac

SEQ ID NO: 5351096 - DNA, 20 bp, Homo sapiens
acagcagctgaagccagctc

SEQ ID NO: 5351097 - DNA, 13 bp, Homo sapiens
acagcagctggac

SEQ ID NO: 5351098 - DNA, 21 bp, Homo sapiens
acagcagctggactgggtggg

SEQ ID NO: 5351099 - DNA, 23 bp, Homo sapiens
acagcagctggtgccccacctgc

SEQ ID NO: 5351100 - DNA, 24 bp, Homo sapiens
acagcagctggtgccccacctgcc

SEQ ID NO: 5351101 - DNA, 24 bp, Homo sapiens
acagcagctgttcaacaagagtaa

SEQ ID NO: 5351102 - DNA, 20 bp, Homo sapiens
acagcaggaactgagccaga

SEQ ID NO: 5351103 - DNA, 21 bp, Homo sapiens
acagcaggacctgtgctttga

SEQ ID NO: 5351104 - DNA, 16 bp, Homo sapiens
acagcaggagcatggc

SEQ ID NO: 5351105 - DNA, 15 bp, Homo sapiens
acagctccttttcca

SEQ ID NO: 5351106 - DNA, 15 bp, Homo sapiens
acagctctcactggc

SEQ ID NO: 5351107 - DNA, 14 bp, Homo sapiens
acagctctcctcca

SEQ ID NO: 5351108 - DNA, 14 bp, Homo sapiens
acagctctgagatc

SEQ ID NO: 5351109 - DNA, 12 bp, Homo sapiens
acagctctgctg

SEQ ID NO: 5351110 - DNA, 14 bp, Homo sapiens
acagctctgctgga

SEQ ID NO: 5351111 - DNA, 15 bp, Homo sapiens
acagctctgctggaa

SEQ ID NO: 5351112 - DNA, 14 bp, Homo sapiens
acagctctgggcct

SEQ ID NO: 5351113 - DNA, 14 bp, Homo sapiens
acagctctgtagtt

SEQ ID NO: 5351114 - DNA, 16 bp, Homo sapiens
acagctctgtcctggg

SEQ ID NO: 5351115 - DNA, 19 bp, Homo sapiens
acagctctgtttagaggag

SEQ ID NO: 5351116 - DNA, 14 bp, Homo sapiens
acagctcttcacac

SEQ ID NO: 5351117 - DNA, 16 bp, Homo sapiens
acagctcttcacacca

SEQ ID NO: 5351118 - DNA, 17 bp, Homo sapiens
acagctcttcactcagc

SEQ ID NO: 5351119 - DNA, 23 bp, Homo sapiens
acagctcttcactcagccacacc

SEQ ID NO: 5351120 - DNA, 14 bp, Homo sapiens
acagctcttcattc

SEQ ID NO: 5351121 - DNA, 18 bp, Homo sapiens
acagctcttctccaggct

SEQ ID NO: 5351122 - DNA, 17 bp, Homo sapiens
acagctcttcttgaaaa

SEQ ID NO: 5351123 - DNA, 14 bp, Homo sapiens
acagctctttaaca

SEQ ID NO: 5351124 - DNA, 19 bp, Homo sapiens
acagctgaaagacagtaaa

SEQ ID NO: 5351125 - DNA, 21 bp, Homo sapiens
acagctgacggtttctccccg

SEQ ID NO: 5351126 - DNA, 15 bp, Homo sapiens
acagctgagagactt

SEQ ID NO: 5351127 - DNA, 23 bp, Homo sapiens
acagctgagcacccagctctgtc

SEQ ID NO: 5351128 - DNA, 14 bp, Homo sapiens
acagctgagcactt

SEQ ID NO: 5351129 - DNA, 16 bp, Homo sapiens
acagctgagtgggaac

SEQ ID NO: 5351130 - DNA, 17 bp, Homo sapiens
acagctgagttgttgag

SEQ ID NO: 5351131 - DNA, 17 bp, Homo sapiens
acagctgataaatttaa

SEQ ID NO: 5351132 - DNA, 23 bp, Homo sapiens
acagctgatatttgttttgaaag

SEQ ID NO: 5351133 - DNA, 23 bp, Homo sapiens
acagctgcactgaggcagcgacc

SEQ ID NO: 5351134 - DNA, 20 bp, Homo sapiens
acagctgcattagaaaaaga

SEQ ID NO: 5351135 - DNA, 12 bp, Homo sapiens
acagctgcccta

SEQ ID NO: 5351136 - DNA, 19 bp, Homo sapiens
acagctgccctagctgacc

SEQ ID NO: 5351137 - DNA, 17 bp, Homo sapiens
acagctgccctgctgcc

SEQ ID NO: 5351138 - DNA, 16 bp, Homo sapiens
acagctgccctggctg

SEQ ID NO: 5351139 - DNA, 11 bp, Homo sapiens
acagctgcctc

SEQ ID NO: 5351140 - DNA, 13 bp, Homo sapiens
acagctgcctccg

SEQ ID NO: 5351141 - DNA, 12 bp, Homo sapiens
acagctgcctgc

SEQ ID NO: 5351142 - DNA, 23 bp, Homo sapiens
acagctgcctgggatccctcatc

SEQ ID NO: 5351143 - DNA, 17 bp, Homo sapiens
acagctgccttagcttc

SEQ ID NO: 5351144 - DNA, 21 bp, Homo sapiens
acagctgccttagcttcagga

SEQ ID NO: 5351145 - DNA, 10 bp, Homo sapiens
acagctgctc

SEQ ID NO: 5351146 - DNA, 13 bp, Homo sapiens
acagctgctcaga

SEQ ID NO: 5351147 - DNA, 20 bp, Homo sapiens
acagctgctcctagagggag

SEQ ID NO: 5351148 - DNA, 16 bp, Homo sapiens
acagctgctggccagg

SEQ ID NO: 5351149 - DNA, 12 bp, Homo sapiens
acagctgctggg

SEQ ID NO: 5351150 - DNA, 17 bp, Homo sapiens
acagctgctgggaccca

SEQ ID NO: 5351151 - DNA, 17 bp, Homo sapiens
acagctgctgttctcag

SEQ ID NO: 5351152 - DNA, 22 bp, Homo sapiens
acagctgctgttctcaggacag

SEQ ID NO: 5351153 - DNA, 14 bp, Homo sapiens
acagctgcttcccc

SEQ ID NO: 5351154 - DNA, 13 bp, Homo sapiens
acagctgcttctc

SEQ ID NO: 5351155 - DNA, 14 bp, Homo sapiens
acagctgcttctcc

SEQ ID NO: 5351156 - DNA, 13 bp, Homo sapiens
acagctgcttgtg

SEQ ID NO: 5351157 - DNA, 21 bp, Homo sapiens
acagctgctttctgttgtcat

SEQ ID NO: 5351158 - DNA, 14 bp, Homo sapiens
acagctgctttgag

SEQ ID NO: 5351159 - DNA, 15 bp, Homo sapiens
acagctgctttgagc

SEQ ID NO: 5351160 - DNA, 21 bp, Homo sapiens
acagctggaaagttgggcccc

SEQ ID NO: 5351161 - DNA, 17 bp, Homo sapiens
acagctggaccctgacc

SEQ ID NO: 5351162 - DNA, 23 bp, Homo sapiens
acagctggaccctgcttcaccct

SEQ ID NO: 5351163 - DNA, 15 bp, Homo sapiens
acagctggagctctc

SEQ ID NO: 5351164 - DNA, 21 bp, Homo sapiens
acagctggaggaatacatttt

SEQ ID NO: 5351165 - DNA, 22 bp, Homo sapiens
acagctggaggaatacatttta

SEQ ID NO: 5351166 - DNA, 13 bp, Homo sapiens
acagctggcctcc

SEQ ID NO: 5351167 - DNA, 16 bp, Homo sapiens
acagctggctctactt

SEQ ID NO: 5351168 - DNA, 13 bp, Homo sapiens
acagctggctctg

SEQ ID NO: 5351169 - DNA, 18 bp, Homo sapiens
acagctggctgctgacag

SEQ ID NO: 5351170 - DNA, 23 bp, Homo sapiens
acagctggctgctgacaggatgt

SEQ ID NO: 5351171 - DNA, 16 bp, Homo sapiens
acagctggctgggcct

SEQ ID NO: 5351172 - DNA, 19 bp, Homo sapiens
acagctggctgggccttca

SEQ ID NO: 5351173 - DNA, 12 bp, Homo sapiens
acagctgggacc

SEQ ID NO: 5351174 - DNA, 17 bp, Homo sapiens
acagctgggagcctggt

SEQ ID NO: 5351175 - DNA, 12 bp, Homo sapiens
acagctgggcaa

SEQ ID NO: 5351176 - DNA, 15 bp, Homo sapiens
acagctgggcaaagc

SEQ ID NO: 5351177 - DNA, 13 bp, Homo sapiens
acagctgggcagg

SEQ ID NO: 5351178 - DNA, 17 bp, Homo sapiens
acagctgggcagggtga

SEQ ID NO: 5351179 - DNA, 23 bp, Homo sapiens
acagctggggtgcagggatgtgg

SEQ ID NO: 5351180 - DNA, 18 bp, Homo sapiens
acagctgggtggcactgc

SEQ ID NO: 5351181 - DNA, 22 bp, Homo sapiens
acagctgtatagctgcttccag

SEQ ID NO: 5351182 - DNA, 14 bp, Homo sapiens
acagctgtatgatt

SEQ ID NO: 5351183 - DNA, 19 bp, Homo sapiens
acagctgtattgtctgaac

SEQ ID NO: 5351184 - DNA, 20 bp, Homo sapiens
acagctgtattgtctgaact

SEQ ID NO: 5351185 - DNA, 16 bp, Homo sapiens
acagctgtatttatat

SEQ ID NO: 5351186 - DNA, 21 bp, Homo sapiens
acagctgtattttggctttct

SEQ ID NO: 5351187 - DNA, 10 bp, Homo sapiens
acagctgtct

SEQ ID NO: 5351188 - DNA, 11 bp, Homo sapiens
acagctgtctg

SEQ ID NO: 5351189 - DNA, 15 bp, Homo sapiens
acagctgtctgccag

SEQ ID NO: 5351190 - DNA, 21 bp, Homo sapiens
acagctgtgagccatgcctcc

SEQ ID NO: 5351191 - DNA, 23 bp, Homo sapiens
acagctgtgagccatgcctccct

SEQ ID NO: 5351192 - DNA, 15 bp, Homo sapiens
acagctgtgaggaca

SEQ ID NO: 5351193 - DNA, 15 bp, Homo sapiens
acagctgtgccggga

SEQ ID NO: 5351194 - DNA, 12 bp, Homo sapiens
acagctgtgcct

SEQ ID NO: 5351195 - DNA, 17 bp, Homo sapiens
acagctgtgcctcgctc

SEQ ID NO: 5351196 - DNA, 12 bp, Homo sapiens
acagctgtgctc

SEQ ID NO: 5351197 - DNA, 18 bp, Homo sapiens
acagctgtgctccacact

SEQ ID NO: 5351198 - DNA, 23 bp, Homo sapiens
acagctgtgctccacactcagaa

SEQ ID NO: 5351199 - DNA, 13 bp, Homo sapiens
acagctgttcctg

SEQ ID NO: 5351200 - DNA, 16 bp, Homo sapiens
acagctgttcctgtgt

SEQ ID NO: 5351201 - DNA, 23 bp, Homo sapiens
acagctgttcctgtgttcttcgt

SEQ ID NO: 5351202 - DNA, 14 bp, Homo sapiens
acagctgtttaaga

SEQ ID NO: 5351203 - DNA, 17 bp, Homo sapiens
acagctgtttaagatgg

SEQ ID NO: 5351204 - DNA, 20 bp, Homo sapiens
acagctgtttgaattggacc

SEQ ID NO: 5351205 - DNA, 20 bp, Homo sapiens
acagcttaaattcttcaaga

SEQ ID NO: 5351206 - DNA, 16 bp, Homo sapiens
acagcttaacaatgca

SEQ ID NO: 5351207 - DNA, 17 bp, Homo sapiens
acagcttaacaatgcaa

SEQ ID NO: 5351208 - DNA, 19 bp, Homo sapiens
acagcttaacaatgcaact

SEQ ID NO: 5351209 - DNA, 22 bp, Homo sapiens
acagcttacactgattggtgtt

SEQ ID NO: 5351210 - DNA, 16 bp, Homo sapiens
acagcttacaggagcc

SEQ ID NO: 5351211 - DNA, 22 bp, Homo sapiens
acagcttacaggagccagcctg

SEQ ID NO: 5351212 - DNA, 17 bp, Homo sapiens
acagcttagatttcata

SEQ ID NO: 5351213 - DNA, 14 bp, Homo sapiens
acagcttagtgaga

SEQ ID NO: 5351214 - DNA, 17 bp, Homo sapiens
acagcttcaccacttgt

SEQ ID NO: 5351215 - DNA, 22 bp, Homo sapiens
acagcttcaccacttgtccatt

SEQ ID NO: 5351216 - DNA, 17 bp, Homo sapiens
acagcttcaccctgtca

SEQ ID NO: 5351217 - DNA, 19 bp, Homo sapiens
acagcttcacttaaaatca

SEQ ID NO: 5351218 - DNA, 13 bp, Homo sapiens
acagcttcagaaa

SEQ ID NO: 5351219 - DNA, 17 bp, Homo sapiens
acagcttcagccaggag

SEQ ID NO: 5351220 - DNA, 18 bp, Homo sapiens
acagcttcagccaggagc

SEQ ID NO: 5351221 - DNA, 22 bp, Homo sapiens
acagcttcaggttatcgaaata

SEQ ID NO: 5351222 - DNA, 16 bp, Homo sapiens
acagcttcagtccatg

SEQ ID NO: 5351223 - DNA, 20 bp, Homo sapiens
acagcttcatgcctttgtaa

SEQ ID NO: 5351224 - DNA, 14 bp, Homo sapiens
acagcttcctcaca

SEQ ID NO: 5351225 - DNA, 23 bp, Homo sapiens
acagcttcctcacacccctgtcc

SEQ ID NO: 5351226 - DNA, 12 bp, Homo sapiens
acagcttctctg

SEQ ID NO: 5351227 - DNA, 13 bp, Homo sapiens
acagcttctggag

SEQ ID NO: 5351228 - DNA, 20 bp, Homo sapiens
acagcttctggagcagaact

SEQ ID NO: 5351229 - DNA, 20 bp, Homo sapiens
acagcttgaccagacctaga

SEQ ID NO: 5351230 - DNA, 16 bp, Homo sapiens
acagcttgagccgggc

SEQ ID NO: 5351231 - DNA, 22 bp, Homo sapiens
acagcttgagccgggcccctgg

SEQ ID NO: 5351232 - DNA, 16 bp, Homo sapiens
acagcttgccagggat

SEQ ID NO: 5351233 - DNA, 16 bp, Homo sapiens
acagcttgctgtcact

SEQ ID NO: 5351234 - DNA, 13 bp, Homo sapiens
acagcttggcact

SEQ ID NO: 5351235 - DNA, 21 bp, Homo sapiens
acagcttggtgtacttaatac

SEQ ID NO: 5351236 - DNA, 15 bp, Homo sapiens
acagcttgtattttg

SEQ ID NO: 5351237 - DNA, 11 bp, Homo sapiens
acagcttgtct

SEQ ID NO: 5351238 - DNA, 13 bp, Homo sapiens
acagcttgtctct

SEQ ID NO: 5351239 - DNA, 20 bp, Homo sapiens
acagcttgtctcttgcctgc

SEQ ID NO: 5351240 - DNA, 22 bp, Homo sapiens
acagcttgtctcttgcctgcca

SEQ ID NO: 5351241 - DNA, 16 bp, Homo sapiens
acagcttgttttggac

SEQ ID NO: 5351242 - DNA, 20 bp, Homo sapiens
acagctttcatgattagcaa

SEQ ID NO: 5351243 - DNA, 14 bp, Homo sapiens
acagctttcccagg

SEQ ID NO: 5351244 - DNA, 15 bp, Homo sapiens
acagctttcccaggt

SEQ ID NO: 5351245 - DNA, 20 bp, Homo sapiens
acagctttcccctcattttt

SEQ ID NO: 5351246 - DNA, 19 bp, Homo sapiens
acagctttcctcaaaaagc

SEQ ID NO: 5351247 - DNA, 17 bp, Homo sapiens
acagctttcctgggtga

SEQ ID NO: 5351248 - DNA, 18 bp, Homo sapiens
acagctttctaactcaca

SEQ ID NO: 5351249 - DNA, 22 bp, Homo sapiens
acagctttctaactcacaggca

SEQ ID NO: 5351250 - DNA, 23 bp, Homo sapiens
acagctttctaactcacaggcat

SEQ ID NO: 5351251 - DNA, 18 bp, Homo sapiens
acagctttctgaccttca

SEQ ID NO: 5351252 - DNA, 12 bp, Homo sapiens
acagctttctgg

SEQ ID NO: 5351253 - DNA, 17 bp, Homo sapiens
acagctttctgggatgt

SEQ ID NO: 5351254 - DNA, 20 bp, Homo sapiens
acagctttctgggatgtcac

SEQ ID NO: 5351255 - DNA, 21 bp, Homo sapiens
acagctttctgggatgtcaca

SEQ ID NO: 5351256 - DNA, 13 bp, Homo sapiens
acagctttcttat

SEQ ID NO: 5351257 - DNA, 17 bp, Homo sapiens
acagctttcttgctccc

SEQ ID NO: 5351258 - DNA, 12 bp, Homo sapiens
acagctttgact

SEQ ID NO: 5351259 - DNA, 14 bp, Homo sapiens
acagctttgaggaa

SEQ ID NO: 5351260 - DNA, 14 bp, Homo sapiens
acagctttgcaccc

SEQ ID NO: 5351261 - DNA, 19 bp, Homo sapiens
acagctttgcacccctttc

SEQ ID NO: 5351262 - DNA, 11 bp, Homo sapiens
acagctttgct

SEQ ID NO: 5351263 - DNA, 12 bp, Homo sapiens
acagctttgctg

SEQ ID NO: 5351264 - DNA, 21 bp, Homo sapiens
acagctttggggtgtcttttt

SEQ ID NO: 5351265 - DNA, 15 bp, Homo sapiens
acagctttgtctcca

SEQ ID NO: 5351266 - DNA, 19 bp, Homo sapiens
acagctttgtgactgtata

SEQ ID NO: 5351267 - DNA, 20 bp, Homo sapiens
acagctttgtgactgtatat

SEQ ID NO: 5351268 - DNA, 19 bp, Homo sapiens
acagcttttagtacccacc

SEQ ID NO: 5351269 - DNA, 14 bp, Homo sapiens
acagcttttctctt

SEQ ID NO: 5351270 - DNA, 16 bp, Homo sapiens
acagcttttcttgata

SEQ ID NO: 5351271 - DNA, 22 bp, Homo sapiens
acagcttttgcaacttaatact

SEQ ID NO: 5351272 - DNA, 20 bp, Homo sapiens
acagcttttgtatagaaaat

SEQ ID NO: 5351273 - DNA, 14 bp, Homo sapiens
acaggaaaaaaaat

SEQ ID NO: 5351274 - DNA, 19 bp, Homo sapiens
acaggaaaaaaaattctgt

SEQ ID NO: 5351275 - DNA, 14 bp, Homo sapiens
acaggaaaaacaaa

SEQ ID NO: 5351276 - DNA, 14 bp, Homo sapiens
acaggaaaaaccaa

SEQ ID NO: 5351277 - DNA, 17 bp, Homo sapiens
acaggaaaaaccaacag

SEQ ID NO: 5351278 - DNA, 17 bp, Homo sapiens
acaggaaaagagggaga

SEQ ID NO: 5351279 - DNA, 21 bp, Homo sapiens
acaggaaaagcatgtcttatt

SEQ ID NO: 5351280 - DNA, 21 bp, Homo sapiens
acaggaaaagctgctgacagt

SEQ ID NO: 5351281 - DNA, 21 bp, Homo sapiens
acaggaaaataaaatatttaa

SEQ ID NO: 5351282 - DNA, 16 bp, Homo sapiens
acaggaaaatgtatcc

SEQ ID NO: 5351283 - DNA, 12 bp, Homo sapiens
acaggaaagagc

SEQ ID NO: 5351284 - DNA, 15 bp, Homo sapiens
acaggaaagagctag

SEQ ID NO: 5351285 - DNA, 15 bp, Homo sapiens
acagtaggatgtgga

SEQ ID NO: 5351286 - DNA, 13 bp, Homo sapiens
acagtaggtcccg

SEQ ID NO: 5351287 - DNA, 23 bp, Homo sapiens
acagtagtaccaaatgctttaaa

SEQ ID NO: 5351288 - DNA, 16 bp, Homo sapiens
acagtagtataatgta

SEQ ID NO: 5351289 - DNA, 23 bp, Homo sapiens
acagtagtataatgtatgaattt

SEQ ID NO: 5351290 - DNA, 17 bp, Homo sapiens
acagtagtgagaagaat

SEQ ID NO: 5351291 - DNA, 13 bp, Homo sapiens
acagtagtgttct

SEQ ID NO: 5351292 - DNA, 23 bp, Homo sapiens
acagtagttagaattatatcact

SEQ ID NO: 5351293 - DNA, 23 bp, Homo sapiens
acagtagttgtattcttctgtat

SEQ ID NO: 5351294 - DNA, 16 bp, Homo sapiens
acagtataaaaataga

SEQ ID NO: 5351295 - DNA, 20 bp, Homo sapiens
acagtataattaacatgtta

SEQ ID NO: 5351296 - DNA, 21 bp, Homo sapiens
acagtataattaacatgttaa

SEQ ID NO: 5351297 - DNA, 18 bp, Homo sapiens
acagtatataagcttttt

SEQ ID NO: 5351298 - DNA, 23 bp, Homo sapiens
acagtatcactgtctttcctaga

SEQ ID NO: 5351299 - DNA, 21 bp, Homo sapiens
acagtatcagtattttcacac

SEQ ID NO: 5351300 - DNA, 15 bp, Homo sapiens
acagtatcccacatc

SEQ ID NO: 5351301 - DNA, 21 bp, Homo sapiens
acagtatcccacatccaactc

SEQ ID NO: 5351302 - DNA, 11 bp, Homo sapiens
acagtatctct

SEQ ID NO: 5351303 - DNA, 14 bp, Homo sapiens
acagtatctgctgt

SEQ ID NO: 5351304 - DNA, 19 bp, Homo sapiens
acagtatctgctgttcttc

SEQ ID NO: 5351305 - DNA, 15 bp, Homo sapiens
acagtatcttcaaaa

SEQ ID NO: 5351306 - DNA, 19 bp, Homo sapiens
acagtatcttcaaaaatac

SEQ ID NO: 5351307 - DNA, 19 bp, Homo sapiens
acagtatgagtcaatgtgc

SEQ ID NO: 5351308 - DNA, 18 bp, Homo sapiens
acagtatgcttgctctaa

SEQ ID NO: 5351309 - DNA, 19 bp, Homo sapiens
acagtatgggggttgtaaa

SEQ ID NO: 5351310 - DNA, 20 bp, Homo sapiens
acagtatgggggttgtaaat

SEQ ID NO: 5351311 - DNA, 21 bp, Homo sapiens
acagtatgggggttgtaaatt

SEQ ID NO: 5351312 - DNA, 23 bp, Homo sapiens
acagtatggtaactttgcaaatg

SEQ ID NO: 5351313 - DNA, 23 bp, Homo sapiens
acagtatgtgggatattgaatgt

SEQ ID NO: 5351314 - DNA, 17 bp, Homo sapiens
acagtatgtgtctagca

SEQ ID NO: 5351315 - DNA, 21 bp, Homo sapiens
acagtattaacatcaaagact

SEQ ID NO: 5351316 - DNA, 13 bp, Homo sapiens
acagtattaaggg

SEQ ID NO: 5351317 - DNA, 18 bp, Homo sapiens
acagtattaagggtagga

SEQ ID NO: 5351318 - DNA, 21 bp, Homo sapiens
acagtattatagacaaaagaa

SEQ ID NO: 5351319 - DNA, 16 bp, Homo sapiens
acagtattcccactct

SEQ ID NO: 5351320 - DNA, 17 bp, Homo sapiens
acagtattctcagtgct

SEQ ID NO: 5351321 - DNA, 17 bp, Homo sapiens
acagtattctgtaccat

SEQ ID NO: 5351322 - DNA, 19 bp, Homo sapiens
acagtattgaaaaattatc

SEQ ID NO: 5351323 - DNA, 15 bp, Homo sapiens
acagtattgccacct

SEQ ID NO: 5351324 - DNA, 12 bp, Homo sapiens
acagtattgctc

SEQ ID NO: 5351325 - DNA, 15 bp, Homo sapiens
acagtattgctcacc

SEQ ID NO: 5351326 - DNA, 22 bp, Homo sapiens
acagtattgctcacccagtgcc

SEQ ID NO: 5351327 - DNA, 15 bp, Homo sapiens
acagtattgggcagg

SEQ ID NO: 5351328 - DNA, 18 bp, Homo sapiens
acagtattgtagaaagct

SEQ ID NO: 5351329 - DNA, 18 bp, Homo sapiens
acagtatttaacattctt

SEQ ID NO: 5351330 - DNA, 20 bp, Homo sapiens
acagtatttattttttcaaa

SEQ ID NO: 5351331 - DNA, 15 bp, Homo sapiens
acagtatttcattgc

SEQ ID NO: 5351332 - DNA, 13 bp, Homo sapiens
acagtatttccat

SEQ ID NO: 5351333 - DNA, 23 bp, Homo sapiens
acagtatttctggtgtatatttt

SEQ ID NO: 5351334 - DNA, 15 bp, Homo sapiens
acagtattttaagaa

SEQ ID NO: 5351335 - DNA, 22 bp, Homo sapiens
acagtattttaagaagttgctg

SEQ ID NO: 5351336 - DNA, 24 bp, Homo sapiens
acagtattttgctagtgcatttca

SEQ ID NO: 5351337 - DNA, 20 bp, Homo sapiens
acagtatttttcagatataa

SEQ ID NO: 5351338 - DNA, 16 bp, Homo sapiens
acagtcaaaacagaga

SEQ ID NO: 5351339 - DNA, 18 bp, Homo sapiens
acagtcaaaaccaagtca

SEQ ID NO: 5351340 - DNA, 16 bp, Homo sapiens
acagtcaaaataattc

SEQ ID NO: 5351341 - DNA, 22 bp, Homo sapiens
acagtcaaatatcatttactct

SEQ ID NO: 5351342 - DNA, 17 bp, Homo sapiens
acagtcaaccaacccca

SEQ ID NO: 5351343 - DNA, 16 bp, Homo sapiens
acagtcaagatacata

SEQ ID NO: 5351344 - DNA, 19 bp, Homo sapiens
acagtcaatctatgagggt

SEQ ID NO: 5351345 - DNA, 22 bp, Homo sapiens
acagtcacaattttctgtgcca

SEQ ID NO: 5351346 - DNA, 13 bp, Homo sapiens
acagtcacacaga

SEQ ID NO: 5351347 - DNA, 22 bp, Homo sapiens
acagtcacacagagcgcctcac

SEQ ID NO: 5351348 - DNA, 15 bp, Homo sapiens
acagtcaccactgtg

SEQ ID NO: 5351349 - DNA, 22 bp, Homo sapiens
acagtcacccctccctccctct

SEQ ID NO: 5351350 - DNA, 12 bp, Homo sapiens
acagtcacctca

SEQ ID NO: 5351351 - DNA, 15 bp, Homo sapiens
acagtcacctcacaa

SEQ ID NO: 5351352 - DNA, 16 bp, Homo sapiens
acagtcacgcctgaaa

SEQ ID NO: 5351353 - DNA, 20 bp, Homo sapiens
acagtcacgcctgaaacttt

SEQ ID NO: 5351354 - DNA, 19 bp, Homo sapiens
acagtcactgccactttgc

SEQ ID NO: 5351355 - DNA, 22 bp, Homo sapiens
acagtcactgccactttgcaca

SEQ ID NO: 5351356 - DNA, 20 bp, Homo sapiens
acagtcagatttccagtctc

SEQ ID NO: 5351357 - DNA, 21 bp, Homo sapiens
acagtcagatttccagtctcc

SEQ ID NO: 5351358 - DNA, 19 bp, Homo sapiens
acagtcagcatgcttccca

SEQ ID NO: 5351359 - DNA, 20 bp, Homo sapiens
acagtcagcatgcttcccag

SEQ ID NO: 5351360 - DNA, 15 bp, Homo sapiens
acagtcagcatttct

SEQ ID NO: 5351361 - DNA, 20 bp, Homo sapiens
acagtcagccagcttggtgg

SEQ ID NO: 5351362 - DNA, 18 bp, Homo sapiens
acagtcagctcttcatct

SEQ ID NO: 5351363 - DNA, 15 bp, Homo sapiens
acagtcaggttgaag

SEQ ID NO: 5351364 - DNA, 16 bp, Homo sapiens
acagtcaggttgaaga

SEQ ID NO: 5351365 - DNA, 20 bp, Homo sapiens
acagtcagtggagagatgtt

SEQ ID NO: 5351366 - DNA, 14 bp, Homo sapiens
acagtcatattttt

SEQ ID NO: 5351367 - DNA, 21 bp, Homo sapiens
acagtcatcgctcgtgtgttc

SEQ ID NO: 5351368 - DNA, 13 bp, Homo sapiens
acagtcatcttta

SEQ ID NO: 5351369 - DNA, 17 bp, Homo sapiens
acagtcatgaggcagct

SEQ ID NO: 5351370 - DNA, 14 bp, Homo sapiens
acagtcatggcctg

SEQ ID NO: 5351371 - DNA, 21 bp, Homo sapiens
acagtcatggtggccacggcc

SEQ ID NO: 5351372 - DNA, 14 bp, Homo sapiens
acagtcattattta

SEQ ID NO: 5351373 - DNA, 18 bp, Homo sapiens
acagtcattatttaaagc

SEQ ID NO: 5351374 - DNA, 14 bp, Homo sapiens
acagtcattcacat

SEQ ID NO: 5351375 - DNA, 15 bp, Homo sapiens
acagtcattccaaga

SEQ ID NO: 5351376 - DNA, 19 bp, Homo sapiens
acagtcattctaggatgtg

SEQ ID NO: 5351377 - DNA, 14 bp, Homo sapiens
acagtcatttaaaa

SEQ ID NO: 5351378 - DNA, 17 bp, Homo sapiens
acagtcatttgcgcaca

SEQ ID NO: 5351379 - DNA, 21 bp, Homo sapiens
acagtcatttgcgcacaactt

SEQ ID NO: 5351380 - DNA, 20 bp, Homo sapiens
acagtccaaccagaaacacc

SEQ ID NO: 5351381 - DNA, 21 bp, Homo sapiens
acagtccacagctgaagagca

SEQ ID NO: 5351382 - DNA, 13 bp, Homo sapiens
acagtccacaggg

SEQ ID NO: 5351383 - DNA, 22 bp, Homo sapiens
acagtccacaggggccaccacc

SEQ ID NO: 5351384 - DNA, 14 bp, Homo sapiens
acagtccagaccca

SEQ ID NO: 5351385 - DNA, 16 bp, Homo sapiens
acagtcccagcacatt

SEQ ID NO: 5351386 - DNA, 22 bp, Homo sapiens
acagtcccagcacatttcctct

SEQ ID NO: 5351387 - DNA, 13 bp, Homo sapiens
acagtccccagac

SEQ ID NO: 5351388 - DNA, 14 bp, Homo sapiens
acagtccccagact

SEQ ID NO: 5351389 - DNA, 14 bp, Homo sapiens
acagtcccccaccc

SEQ ID NO: 5351390 - DNA, 20 bp, Homo sapiens
acagtcccccacccacctcc

SEQ ID NO: 5351391 - DNA, 21 bp, Homo sapiens
acagtcccccacccacctcct

SEQ ID NO: 5351392 - DNA, 22 bp, Homo sapiens
acagtcccccacccacctcctg

SEQ ID NO: 5351393 - DNA, 14 bp, Homo sapiens
acagtccctcacct

SEQ ID NO: 5351394 - DNA, 13 bp, Homo sapiens
acagtccctcctg

SEQ ID NO: 5351395 - DNA, 14 bp, Homo sapiens
acagtccctcctgt

SEQ ID NO: 5351396 - DNA, 16 bp, Homo sapiens
acagtccctgctgggg

SEQ ID NO: 5351397 - DNA, 15 bp, Homo sapiens
acagtccgcagttgt

SEQ ID NO: 5351398 - DNA, 18 bp, Homo sapiens
acagtcctaactggtata

SEQ ID NO: 5351399 - DNA, 22 bp, Homo sapiens
acagtcctatttagacatgtaa

SEQ ID NO: 5351400 - DNA, 22 bp, Homo sapiens
acagtcctcacacacggaggcc

SEQ ID NO: 5351401 - DNA, 18 bp, Homo sapiens
acagtcctcacagcctct

SEQ ID NO: 5351402 - DNA, 13 bp, Homo sapiens
acagtcctccatc

SEQ ID NO: 5351403 - DNA, 21 bp, Homo sapiens
acagtcctgggagaacctcag

SEQ ID NO: 5351404 - DNA, 22 bp, Homo sapiens
acagtcctgggagaacctcagg

SEQ ID NO: 5351405 - DNA, 18 bp, Homo sapiens
acagtccttaccagcaga

SEQ ID NO: 5351406 - DNA, 21 bp, Homo sapiens
acagtccttaccagcagagca

SEQ ID NO: 5351407 - DNA, 23 bp, Homo sapiens
acagtccttcaaaatccttccaa

SEQ ID NO: 5351408 - DNA, 20 bp, Homo sapiens
acagtcgctcagtctgttca

SEQ ID NO: 5351409 - DNA, 16 bp, Homo sapiens
acagtcggaaaagcgt

SEQ ID NO: 5351410 - DNA, 19 bp, Homo sapiens
acagtcggtgaccccatca

SEQ ID NO: 5351411 - DNA, 15 bp, Homo sapiens
acagtcgtaaaagag

SEQ ID NO: 5351412 - DNA, 16 bp, Homo sapiens
acagtcgtaaaagaga

SEQ ID NO: 5351413 - DNA, 16 bp, Homo sapiens
acagtctaaaaattga

SEQ ID NO: 5351414 - DNA, 22 bp, Homo sapiens
acagtctaagtaagtgtctgtg

SEQ ID NO: 5351415 - DNA, 13 bp, Homo sapiens
acagtctaatttt

SEQ ID NO: 5351416 - DNA, 14 bp, Homo sapiens
acagtctaattttt

SEQ ID NO: 5351417 - DNA, 18 bp, Homo sapiens
acagtctaatttttattc

SEQ ID NO: 5351418 - DNA, 14 bp, Homo sapiens
acagtctagtttcc

SEQ ID NO: 5351419 - DNA, 15 bp, Homo sapiens
acagtctcaattttg

SEQ ID NO: 5351420 - DNA, 14 bp, Homo sapiens
acagtctcactctg

SEQ ID NO: 5351421 - DNA, 15 bp, Homo sapiens
acagtctcaggaaat

SEQ ID NO: 5351422 - DNA, 17 bp, Homo sapiens
acagtctcaggaaatca

SEQ ID NO: 5351423 - DNA, 19 bp, Homo sapiens
acagtctcattacagattt

SEQ ID NO: 5351424 - DNA, 13 bp, Homo sapiens
acagtctccccca

SEQ ID NO: 5351425 - DNA, 17 bp, Homo sapiens
acagtctctactgttat

SEQ ID NO: 5351426 - DNA, 19 bp, Homo sapiens
acagtctctactgttatta

SEQ ID NO: 5351427 - DNA, 19 bp, Homo sapiens
acagtctctttaatcttca

SEQ ID NO: 5351428 - DNA, 22 bp, Homo sapiens
acagtctctttcttcctttcta

SEQ ID NO: 5351429 - DNA, 11 bp, Homo sapiens
acagtctgtct

SEQ ID NO: 5351430 - DNA, 12 bp, Homo sapiens
acagtctgtctt

SEQ ID NO: 5351431 - DNA, 18 bp, Homo sapiens
acagtcttatcaactggt

SEQ ID NO: 5351432 - DNA, 13 bp, Homo sapiens
acagtcttattta

SEQ ID NO: 5351433 - DNA, 14 bp, Homo sapiens
acagtcttatttaa

SEQ ID NO: 5351434 - DNA, 13 bp, Homo sapiens
acagtcttccaca

SEQ ID NO: 5351435 - DNA, 21 bp, Homo sapiens
acagtcttccacaaagaaaat

SEQ ID NO: 5351436 - DNA, 14 bp, Homo sapiens
acagtcttccattt

SEQ ID NO: 5351437 - DNA, 14 bp, Homo sapiens
acagtcttgtgaac

SEQ ID NO: 5351438 - DNA, 22 bp, Homo sapiens
acagtgaaagtcaattcagtga

SEQ ID NO: 5351439 - DNA, 17 bp, Homo sapiens
acagtgaaatgagcagc

SEQ ID NO: 5351440 - DNA, 13 bp, Homo sapiens
acagtgaacagct

SEQ ID NO: 5351441 - DNA, 14 bp, Homo sapiens
acagtgaagacaga

SEQ ID NO: 5351442 - DNA, 16 bp, Homo sapiens
acagtgaagttttact

SEQ ID NO: 5351443 - DNA, 15 bp, Homo sapiens
acagtgaataaaagg

SEQ ID NO: 5351444 - DNA, 17 bp, Homo sapiens
acagtgaatattgcttt

SEQ ID NO: 5351445 - DNA, 16 bp, Homo sapiens
acagtgaatgtgtctg

SEQ ID NO: 5351446 - DNA, 19 bp, Homo sapiens
acagtgaatgtgtctggac

SEQ ID NO: 5351447 - DNA, 15 bp, Homo sapiens
acagtgaatgtgtgt

SEQ ID NO: 5351448 - DNA, 20 bp, Homo sapiens
acagtgaatgtgtgtatgta

SEQ ID NO: 5351449 - DNA, 16 bp, Homo sapiens
acagtgaatttaagca

SEQ ID NO: 5351450 - DNA, 22 bp, Homo sapiens
acagtgaatttctgatttcact

SEQ ID NO: 5351451 - DNA, 18 bp, Homo sapiens
acagtgacactactttct

SEQ ID NO: 5351452 - DNA, 22 bp, Homo sapiens
acagtgacactggaccaggtcc

SEQ ID NO: 5351453 - DNA, 20 bp, Homo sapiens
acagtgacgtgactcagagc

SEQ ID NO: 5351454 - DNA, 21 bp, Homo sapiens
acagtgacgtgactcagagct

SEQ ID NO: 5351455 - DNA, 15 bp, Homo sapiens
acagtgactccctgg

SEQ ID NO: 5351456 - DNA, 19 bp, Homo sapiens
acagtgactcgggctcctg

SEQ ID NO: 5351457 - DNA, 15 bp, Homo sapiens
acagtgagaaaagaa

SEQ ID NO: 5351458 - DNA, 12 bp, Homo sapiens
acagtgagaaag

SEQ ID NO: 5351459 - DNA, 21 bp, Homo sapiens
acagtgagacagtctggaaag

SEQ ID NO: 5351460 - DNA, 22 bp, Homo sapiens
acagtgagacagtctggaaagt

SEQ ID NO: 5351461 - DNA, 14 bp, Homo sapiens
acagtgagactctg

SEQ ID NO: 5351462 - DNA, 15 bp, Homo sapiens
acataaaacaaaacc

SEQ ID NO: 5351463 - DNA, 23 bp, Homo sapiens
acataaaacacccttgaaaatat

SEQ ID NO: 5351464 - DNA, 11 bp, Homo sapiens
acataaaacag

SEQ ID NO: 5351465 - DNA, 17 bp, Homo sapiens
acataaaactttaaaag

SEQ ID NO: 5351466 - DNA, 15 bp, Homo sapiens
acataaaagaatgta

SEQ ID NO: 5351467 - DNA, 18 bp, Homo sapiens
acataaaagaatgtacag

SEQ ID NO: 5351468 - DNA, 14 bp, Homo sapiens
acataaaagtctgt

SEQ ID NO: 5351469 - DNA, 13 bp, Homo sapiens
acataaaatatac

SEQ ID NO: 5351470 - DNA, 19 bp, Homo sapiens
acataaaatatacaaacat

SEQ ID NO: 5351471 - DNA, 13 bp, Homo sapiens
acataaacaaaga

SEQ ID NO: 5351472 - DNA, 15 bp, Homo sapiens
acataaacaaagaca

SEQ ID NO: 5351473 - DNA, 13 bp, Homo sapiens
acataaacacatt

SEQ ID NO: 5351474 - DNA, 16 bp, Homo sapiens
acataaacacatttcc

SEQ ID NO: 5351475 - DNA, 17 bp, Homo sapiens
acataaacacttctcct

SEQ ID NO: 5351476 - DNA, 11 bp, Homo sapiens
acataaacatc

SEQ ID NO: 5351477 - DNA, 12 bp, Homo sapiens
acataaacccat

SEQ ID NO: 5351478 - DNA, 16 bp, Homo sapiens
acataaacccatctgt

SEQ ID NO: 5351479 - DNA, 14 bp, Homo sapiens
acataaacttaaaa

SEQ ID NO: 5351480 - DNA, 14 bp, Homo sapiens
acataaacttttgc

SEQ ID NO: 5351481 - DNA, 18 bp, Homo sapiens
acataaagaaacactttc

SEQ ID NO: 5351482 - DNA, 19 bp, Homo sapiens
acataaagaaacactttct

SEQ ID NO: 5351483 - DNA, 14 bp, Homo sapiens
acataaagaaattc

SEQ ID NO: 5351484 - DNA, 15 bp, Homo sapiens
acataaagaaattca

SEQ ID NO: 5351485 - DNA, 21 bp, Homo sapiens
acataaagaaattcaagaagt

SEQ ID NO: 5351486 - DNA, 13 bp, Homo sapiens
acataaagcaaat

SEQ ID NO: 5351487 - DNA, 23 bp, Homo sapiens
acataaagcactacctaagtaat

SEQ ID NO: 5351488 - DNA, 12 bp, Homo sapiens
acataaaggaaa

SEQ ID NO: 5351489 - DNA, 18 bp, Homo sapiens
acataaaggaaaagacac

SEQ ID NO: 5351490 - DNA, 22 bp, Homo sapiens
acataaaggttattttctcctg

SEQ ID NO: 5351491 - DNA, 23 bp, Homo sapiens
acataaaggttattttctcctga

SEQ ID NO: 5351492 - DNA, 19 bp, Homo sapiens
acataaagtaataactgtt

SEQ ID NO: 5351493 - DNA, 21 bp, Homo sapiens
acataaagttctctgtaatta

SEQ ID NO: 5351494 - DNA, 12 bp, Homo sapiens
acataaagttga

SEQ ID NO: 5351495 - DNA, 15 bp, Homo sapiens
acataaagttgtatt

SEQ ID NO: 5351496 - DNA, 15 bp, Homo sapiens
acataaataaaatga

SEQ ID NO: 5351497 - DNA, 19 bp, Homo sapiens
acataaataaaatgaccag

SEQ ID NO: 5351498 - DNA, 18 bp, Homo sapiens
acataaatagtagaaaaa

SEQ ID NO: 5351499 - DNA, 14 bp, Homo sapiens
acataaatctgtct

SEQ ID NO: 5351500 - DNA, 18 bp, Homo sapiens
acataaatctgtctgatt

SEQ ID NO: 5351501 - DNA, 20 bp, Homo sapiens
acataaatctgtctgattct

SEQ ID NO: 5351502 - DNA, 15 bp, Homo sapiens
acataaatctgtgaa

SEQ ID NO: 5351503 - DNA, 22 bp, Homo sapiens
acataaatcttaatacttgaac

SEQ ID NO: 5351504 - DNA, 13 bp, Homo sapiens
acataaattgtaa

SEQ ID NO: 5351505 - DNA, 12 bp, Homo sapiens
acataaatttta

SEQ ID NO: 5351506 - DNA, 15 bp, Homo sapiens
acataaattttaatt

SEQ ID NO: 5351507 - DNA, 16 bp, Homo sapiens
acataaattttaattc

SEQ ID NO: 5351508 - DNA, 18 bp, Homo sapiens
acataaattttaattcaa

SEQ ID NO: 5351509 - DNA, 14 bp, Homo sapiens
acataacaacaaca

SEQ ID NO: 5351510 - DNA, 21 bp, Homo sapiens
acataacaacctttcccattt

SEQ ID NO: 5351511 - DNA, 12 bp, Homo sapiens
acataacaagaa

SEQ ID NO: 5351512 - DNA, 15 bp, Homo sapiens
acataacaagaaaat

SEQ ID NO: 5351513 - DNA, 13 bp, Homo sapiens
acataacagaatg

SEQ ID NO: 5351514 - DNA, 15 bp, Homo sapiens
acataacagaatgca

SEQ ID NO: 5351515 - DNA, 18 bp, Homo sapiens
acataacagaatgcacca

SEQ ID NO: 5351516 - DNA, 13 bp, Homo sapiens
acataacaggcat

SEQ ID NO: 5351517 - DNA, 22 bp, Homo sapiens
acataacaggcattgcactaaa

SEQ ID NO: 5351518 - DNA, 16 bp, Homo sapiens
acataacagggtaaat

SEQ ID NO: 5351519 - DNA, 20 bp, Homo sapiens
acataacagggtaaattatt

SEQ ID NO: 5351520 - DNA, 16 bp, Homo sapiens
acataacataaatttt

SEQ ID NO: 5351521 - DNA, 20 bp, Homo sapiens
acataaccaacattaaaact

SEQ ID NO: 5351522 - DNA, 16 bp, Homo sapiens
acataaccactgcttc

SEQ ID NO: 5351523 - DNA, 14 bp, Homo sapiens
acataaccagcggg

SEQ ID NO: 5351524 - DNA, 19 bp, Homo sapiens
acataacggaaagttttta

SEQ ID NO: 5351525 - DNA, 15 bp, Homo sapiens
acataacgtttttcc

SEQ ID NO: 5351526 - DNA, 12 bp, Homo sapiens
acataactaaat

SEQ ID NO: 5351527 - DNA, 15 bp, Homo sapiens
acataactaaatttg

SEQ ID NO: 5351528 - DNA, 16 bp, Homo sapiens
acataactagtttaat

SEQ ID NO: 5351529 - DNA, 20 bp, Homo sapiens
acataactagtttaattaac

SEQ ID NO: 5351530 - DNA, 12 bp, Homo sapiens
acataactgaaa

SEQ ID NO: 5351531 - DNA, 20 bp, Homo sapiens
acataactgaaaatgtgcta

SEQ ID NO: 5351532 - DNA, 15 bp, Homo sapiens
acataactgatctat

SEQ ID NO: 5351533 - DNA, 13 bp, Homo sapiens
acataactgcttc

SEQ ID NO: 5351534 - DNA, 14 bp, Homo sapiens
acataactgcttct

SEQ ID NO: 5351535 - DNA, 15 bp, Homo sapiens
acataactgcttctt

SEQ ID NO: 5351536 - DNA, 14 bp, Homo sapiens
acataactgtaaca

SEQ ID NO: 5351537 - DNA, 14 bp, Homo sapiens
acataacttcagtg

SEQ ID NO: 5351538 - DNA, 16 bp, Homo sapiens
acataacttcagtgca

SEQ ID NO: 5351539 - DNA, 18 bp, Homo sapiens
acataacttctcatgtat

SEQ ID NO: 5351540 - DNA, 20 bp, Homo sapiens
acataacttctcatgtatat

SEQ ID NO: 5351541 - DNA, 22 bp, Homo sapiens
acataacttgatatagaaagct

SEQ ID NO: 5351542 - DNA, 15 bp, Homo sapiens
acataagaaggcaat

SEQ ID NO: 5351543 - DNA, 17 bp, Homo sapiens
acataagaaggcaattt

SEQ ID NO: 5351544 - DNA, 19 bp, Homo sapiens
acataagaccgtgtcccaa

SEQ ID NO: 5351545 - DNA, 21 bp, Homo sapiens
acataagagaaagaggccaga

SEQ ID NO: 5351546 - DNA, 17 bp, Homo sapiens
acataagagagatgaga

SEQ ID NO: 5351547 - DNA, 12 bp, Homo sapiens
acataagagctt

SEQ ID NO: 5351548 - DNA, 17 bp, Homo sapiens
acataagagctttttca

SEQ ID NO: 5351549 - DNA, 14 bp, Homo sapiens
acataagatcactg

SEQ ID NO: 5351550 - DNA, 17 bp, Homo sapiens
acataagatcactgcca

SEQ ID NO: 5351551 - DNA, 15 bp, Homo sapiens
acataagccattatt

SEQ ID NO: 5351552 - DNA, 18 bp, Homo sapiens
acataagccattattcac

SEQ ID NO: 5351553 - DNA, 22 bp, Homo sapiens
acataagcggcgtaagtttaaa

SEQ ID NO: 5351554 - DNA, 17 bp, Homo sapiens
acataagctaaatcata

SEQ ID NO: 5351555 - DNA, 18 bp, Homo sapiens
acataagctagaaaaatt

SEQ ID NO: 5351556 - DNA, 17 bp, Homo sapiens
acataagcttccatttt

SEQ ID NO: 5351557 - DNA, 18 bp, Homo sapiens
acataagcttccatttta

SEQ ID NO: 5351558 - DNA, 15 bp, Homo sapiens
acataagcttctcaa

SEQ ID NO: 5351559 - DNA, 21 bp, Homo sapiens
acataagggcattatgtaaca

SEQ ID NO: 5351560 - DNA, 19 bp, Homo sapiens
acataaggggtttgccatt

SEQ ID NO: 5351561 - DNA, 20 bp, Homo sapiens
acataaggggtttgccattt

SEQ ID NO: 5351562 - DNA, 20 bp, Homo sapiens
acataagtaattcaagaaaa

SEQ ID NO: 5351563 - DNA, 22 bp, Homo sapiens
acataagttgcatttagaaatc

SEQ ID NO: 5351564 - DNA, 13 bp, Homo sapiens
acataagttttct

SEQ ID NO: 5351565 - DNA, 17 bp, Homo sapiens
acataataaaaaattat

SEQ ID NO: 5351566 - DNA, 14 bp, Homo sapiens
acataataaatcac

SEQ ID NO: 5351567 - DNA, 15 bp, Homo sapiens
acataataaatcaca

SEQ ID NO: 5351568 - DNA, 17 bp, Homo sapiens
acataataagtttcata

SEQ ID NO: 5351569 - DNA, 21 bp, Homo sapiens
acataatacacttgccctgct

SEQ ID NO: 5351570 - DNA, 14 bp, Homo sapiens
acataatagaattt

SEQ ID NO: 5351571 - DNA, 18 bp, Homo sapiens
acataatagaatttccta

SEQ ID NO: 5351572 - DNA, 18 bp, Homo sapiens
acataatatagcttaaaa

SEQ ID NO: 5351573 - DNA, 19 bp, Homo sapiens
acataatatatgacttcct

SEQ ID NO: 5351574 - DNA, 21 bp, Homo sapiens
acataatatcttgaagaatat

SEQ ID NO: 5351575 - DNA, 15 bp, Homo sapiens
acataatctctctag

SEQ ID NO: 5351576 - DNA, 12 bp, Homo sapiens
acataatctctg

SEQ ID NO: 5351577 - DNA, 22 bp, Homo sapiens
acataatgagtaatgcagacat

SEQ ID NO: 5351578 - DNA, 22 bp, Homo sapiens
acataatgcgtgcataccactt

SEQ ID NO: 5351579 - DNA, 17 bp, Homo sapiens
acataatggggtcctgg

SEQ ID NO: 5351580 - DNA, 13 bp, Homo sapiens
acataatggtact

SEQ ID NO: 5351581 - DNA, 19 bp, Homo sapiens
acataatggtactcccaaa

SEQ ID NO: 5351582 - DNA, 22 bp, Homo sapiens
acataatggtactcccaaactg

SEQ ID NO: 5351583 - DNA, 20 bp, Homo sapiens
acataatggttgtgaaatgt

SEQ ID NO: 5351584 - DNA, 20 bp, Homo sapiens
acataatgtatcatgaagaa

SEQ ID NO: 5351585 - DNA, 20 bp, Homo sapiens
acataatgtattgttggtaa

SEQ ID NO: 5351586 - DNA, 21 bp, Homo sapiens
acataatgttagtagcactga

SEQ ID NO: 5351587 - DNA, 20 bp, Homo sapiens
acataattaaagtgtccatt

SEQ ID NO: 5351588 - DNA, 21 bp, Homo sapiens
acataattaacacttaaggtt

SEQ ID NO: 5351589 - DNA, 14 bp, Homo sapiens
acataattatttct

SEQ ID NO: 5351590 - DNA, 17 bp, Homo sapiens
acataattcattaaaaa

SEQ ID NO: 5351591 - DNA, 18 bp, Homo sapiens
acataattgattaaaatc

SEQ ID NO: 5351592 - DNA, 14 bp, Homo sapiens
acataattgcatga

SEQ ID NO: 5351593 - DNA, 23 bp, Homo sapiens
acataattgtgaccaatacattt

SEQ ID NO: 5351594 - DNA, 14 bp, Homo sapiens
acataatttaaaat

SEQ ID NO: 5351595 - DNA, 21 bp, Homo sapiens
acataatttagtttcatataa

SEQ ID NO: 5351596 - DNA, 23 bp, Homo sapiens
acataatttcagtgggaaatatg

SEQ ID NO: 5351597 - DNA, 22 bp, Homo sapiens
acataatttgcaatttcaggaa

SEQ ID NO: 5351598 - DNA, 12 bp, Homo sapiens
acataatttttt

SEQ ID NO: 5351599 - DNA, 18 bp, Homo sapiens
acataattttttattcaa

SEQ ID NO: 5351600 - DNA, 18 bp, Homo sapiens
acataattttttttttct

SEQ ID NO: 5351601 - DNA, 21 bp, Homo sapiens
acataattttttttttttaac

SEQ ID NO: 5351602 - DNA, 22 bp, Homo sapiens
acatacaaaaaaaatctttaat

SEQ ID NO: 5351603 - DNA, 15 bp, Homo sapiens
acatacaaaagaatt

SEQ ID NO: 5351604 - DNA, 14 bp, Homo sapiens
acatacaaatatat

SEQ ID NO: 5351605 - DNA, 21 bp, Homo sapiens
acatacaaatgcatctttgat

SEQ ID NO: 5351606 - DNA, 21 bp, Homo sapiens
acatacaacctatgtaatttt

SEQ ID NO: 5351607 - DNA, 22 bp, Homo sapiens
acatacaacctatgtaattttt

SEQ ID NO: 5351608 - DNA, 17 bp, Homo sapiens
acatacaatttactttt

SEQ ID NO: 5351609 - DNA, 17 bp, Homo sapiens
acatacaatttgcactg

SEQ ID NO: 5351610 - DNA, 13 bp, Homo sapiens
acatacacataca

SEQ ID NO: 5351611 - DNA, 13 bp, Homo sapiens
acatacaccagca

SEQ ID NO: 5351612 - DNA, 18 bp, Homo sapiens
acatacacgaaagagaga

SEQ ID NO: 5351613 - DNA, 21 bp, Homo sapiens
acatacacttgtataaatgta

SEQ ID NO: 5351614 - DNA, 19 bp, Homo sapiens
acatacagaattactgtaa

SEQ ID NO: 5351615 - DNA, 23 bp, Homo sapiens
acatacagaggatgccttttctg

SEQ ID NO: 5351616 - DNA, 12 bp, Homo sapiens
acatacagatgg

SEQ ID NO: 5351617 - DNA, 12 bp, Homo sapiens
acatacagattt

SEQ ID NO: 5351618 - DNA, 13 bp, Homo sapiens
acatacaggtgct

SEQ ID NO: 5351619 - DNA, 17 bp, Homo sapiens
acatacaggtgctcaat

SEQ ID NO: 5351620 - DNA, 12 bp, Homo sapiens
acatacagtata

SEQ ID NO: 5351621 - DNA, 16 bp, Homo sapiens
acatacatacaaatat

SEQ ID NO: 5351622 - DNA, 13 bp, Homo sapiens
acatacatacaca

SEQ ID NO: 5351623 - DNA, 16 bp, Homo sapiens
acatacatacatatat

SEQ ID NO: 5351624 - DNA, 17 bp, Homo sapiens
acatacatacatatata

SEQ ID NO: 5351625 - DNA, 18 bp, Homo sapiens
acatacatacatatatat

SEQ ID NO: 5351626 - DNA, 14 bp, Homo sapiens
acatacatagacat

SEQ ID NO: 5351627 - DNA, 19 bp, Homo sapiens
acatacatgatacattttt

SEQ ID NO: 5351628 - DNA, 15 bp, Homo sapiens
acatacatgtcacat

SEQ ID NO: 5351629 - DNA, 11 bp, Homo sapiens
acatacattaa

SEQ ID NO: 5351630 - DNA, 17 bp, Homo sapiens
acatacattaaaactag

SEQ ID NO: 5351631 - DNA, 23 bp, Homo sapiens
acatacatttaaaaaacatttta

SEQ ID NO: 5351632 - DNA, 17 bp, Homo sapiens
acataccacacttaaaa

SEQ ID NO: 5351633 - DNA, 18 bp, Homo sapiens
acataccccactgggcac

SEQ ID NO: 5351634 - DNA, 14 bp, Homo sapiens
acataccccctccc

SEQ ID NO: 5351635 - DNA, 17 bp, Homo sapiens
acatacccgcctagctg

SEQ ID NO: 5351636 - DNA, 19 bp, Homo sapiens
acataccggggctcctctc

SEQ ID NO: 5351637 - DNA, 17 bp, Homo sapiens
acatacctcatctcttg

SEQ ID NO: 5351638 - DNA, 22 bp, Homo sapiens
acatacctctctctatatatac

SEQ ID NO: 5351639 - DNA, 19 bp, Homo sapiens
acatacgatttaaggtatt

SEQ ID NO: 5351640 - DNA, 19 bp, Homo sapiens
acatacgcaattgtatata

SEQ ID NO: 5351641 - DNA, 20 bp, Homo sapiens
acatctggcttattttaatg

SEQ ID NO: 5351642 - DNA, 21 bp, Homo sapiens
acatctgggatcatgatagac

SEQ ID NO: 5351643 - DNA, 16 bp, Homo sapiens
acatctgtaaagaaaa

SEQ ID NO: 5351644 - DNA, 20 bp, Homo sapiens
acatctgtatatcagctcta

SEQ ID NO: 5351645 - DNA, 22 bp, Homo sapiens
acatctgtatatcagctctaaa

SEQ ID NO: 5351646 - DNA, 13 bp, Homo sapiens
acatctgtcagtg

SEQ ID NO: 5351647 - DNA, 16 bp, Homo sapiens
acatctgtcagtgagt

SEQ ID NO: 5351648 - DNA, 16 bp, Homo sapiens
acatctgtcctcaccc

SEQ ID NO: 5351649 - DNA, 18 bp, Homo sapiens
acatctgtcctcaccctg

SEQ ID NO: 5351650 - DNA, 23 bp, Homo sapiens
acatctgtcctcaccctgtggga

SEQ ID NO: 5351651 - DNA, 22 bp, Homo sapiens
acatctgtctttcatctcccag

SEQ ID NO: 5351652 - DNA, 12 bp, Homo sapiens
acatctgtgtat

SEQ ID NO: 5351653 - DNA, 12 bp, Homo sapiens
acatctgtgtct

SEQ ID NO: 5351654 - DNA, 15 bp, Homo sapiens
acatctgtgtctctg

SEQ ID NO: 5351655 - DNA, 17 bp, Homo sapiens
acatctgtgtctctgga

SEQ ID NO: 5351656 - DNA, 14 bp, Homo sapiens
acatctgtgtctgt

SEQ ID NO: 5351657 - DNA, 14 bp, Homo sapiens
acatctgtgttcta

SEQ ID NO: 5351658 - DNA, 17 bp, Homo sapiens
acatctgtgtttcaagt

SEQ ID NO: 5351659 - DNA, 13 bp, Homo sapiens
acatctgttttgt

SEQ ID NO: 5351660 - DNA, 20 bp, Homo sapiens
acatcttaaattcatttcta

SEQ ID NO: 5351661 - DNA, 15 bp, Homo sapiens
acatcttacctctca

SEQ ID NO: 5351662 - DNA, 16 bp, Homo sapiens
acatcttacctctcat

SEQ ID NO: 5351663 - DNA, 16 bp, Homo sapiens
acatcttatagatgca

SEQ ID NO: 5351664 - DNA, 19 bp, Homo sapiens
acatcttattgaataaaga

SEQ ID NO: 5351665 - DNA, 16 bp, Homo sapiens
acatcttatttacttg

SEQ ID NO: 5351666 - DNA, 16 bp, Homo sapiens
acatcttatttcctca

SEQ ID NO: 5351667 - DNA, 13 bp, Homo sapiens
acatcttcagatt

SEQ ID NO: 5351668 - DNA, 13 bp, Homo sapiens
acatcttcagctc

SEQ ID NO: 5351669 - DNA, 11 bp, Homo sapiens
acatcttcata

SEQ ID NO: 5351670 - DNA, 15 bp, Homo sapiens
acatcttcatataaa

SEQ ID NO: 5351671 - DNA, 16 bp, Homo sapiens
acatcttcatataaac

SEQ ID NO: 5351672 - DNA, 14 bp, Homo sapiens
acatcttcattaat

SEQ ID NO: 5351673 - DNA, 22 bp, Homo sapiens
acatcttctcaaccttatcaag

SEQ ID NO: 5351674 - DNA, 14 bp, Homo sapiens
acatcttctcagtg

SEQ ID NO: 5351675 - DNA, 13 bp, Homo sapiens
acatcttgaaaat

SEQ ID NO: 5351676 - DNA, 20 bp, Homo sapiens
acatcttgaatactctgccc

SEQ ID NO: 5351677 - DNA, 19 bp, Homo sapiens
acatcttgaatccttccat

SEQ ID NO: 5351678 - DNA, 23 bp, Homo sapiens
acatcttgactaggtattgtcta

SEQ ID NO: 5351679 - DNA, 20 bp, Homo sapiens
acatcttgatctgctcagcc

SEQ ID NO: 5351680 - DNA, 16 bp, Homo sapiens
acatcttgcattcaaa

SEQ ID NO: 5351681 - DNA, 19 bp, Homo sapiens
acatcttgcctacttttct

SEQ ID NO: 5351682 - DNA, 24 bp, Homo sapiens
acatcttggcacatttaagagaca

SEQ ID NO: 5351683 - DNA, 20 bp, Homo sapiens
acatcttgtcaacatgcatt

SEQ ID NO: 5351684 - DNA, 13 bp, Homo sapiens
acatcttgtgcat

SEQ ID NO: 5351685 - DNA, 15 bp, Homo sapiens
acatcttgtgcatgc

SEQ ID NO: 5351686 - DNA, 18 bp, Homo sapiens
acatcttgtgcatgcaaa

SEQ ID NO: 5351687 - DNA, 22 bp, Homo sapiens
acatcttgtgcatgcaaaaatg

SEQ ID NO: 5351688 - DNA, 22 bp, Homo sapiens
acatctttaacatagtcctgtt

SEQ ID NO: 5351689 - DNA, 15 bp, Homo sapiens
acatctttacgtact

SEQ ID NO: 5351690 - DNA, 18 bp, Homo sapiens
acatctttacgtactgta

SEQ ID NO: 5351691 - DNA, 19 bp, Homo sapiens
acatctttattgaaattct

SEQ ID NO: 5351692 - DNA, 13 bp, Homo sapiens
acatctttcacat

SEQ ID NO: 5351693 - DNA, 20 bp, Homo sapiens
acatctttcctcaagtatct

SEQ ID NO: 5351694 - DNA, 14 bp, Homo sapiens
acatctttcctgtc

SEQ ID NO: 5351695 - DNA, 16 bp, Homo sapiens
acatctttctttttaa

SEQ ID NO: 5351696 - DNA, 22 bp, Homo sapiens
acatctttgaaattatgtaaat

SEQ ID NO: 5351697 - DNA, 14 bp, Homo sapiens
acatctttggtcat

SEQ ID NO: 5351698 - DNA, 12 bp, Homo sapiens
acatcttttcta

SEQ ID NO: 5351699 - DNA, 24 bp, Homo sapiens
acatcttttcttgcctctgtcccc

SEQ ID NO: 5351700 - DNA, 16 bp, Homo sapiens
acatcttttgggaagc

SEQ ID NO: 5351701 - DNA, 16 bp, Homo sapiens
acatctttttaaagct

SEQ ID NO: 5351702 - DNA, 16 bp, Homo sapiens
acatctttttcctccc

SEQ ID NO: 5351703 - DNA, 17 bp, Homo sapiens
acatctttttcctccct

SEQ ID NO: 5351704 - DNA, 17 bp, Homo sapiens
acatgaaaacacatttt

SEQ ID NO: 5351705 - DNA, 19 bp, Homo sapiens
acatgaaaacacatttttc

SEQ ID NO: 5351706 - DNA, 12 bp, Homo sapiens
acatgaaaacat

SEQ ID NO: 5351707 - DNA, 13 bp, Homo sapiens
acatgaaaacatt

SEQ ID NO: 5351708 - DNA, 15 bp, Homo sapiens
acatgaaaacattga

SEQ ID NO: 5351709 - DNA, 16 bp, Homo sapiens
acatgaaaactatttt

SEQ ID NO: 5351710 - DNA, 15 bp, Homo sapiens
acatgaaaattttaa

SEQ ID NO: 5351711 - DNA, 20 bp, Homo sapiens
acatgaaactgaataaggag

SEQ ID NO: 5351712 - DNA, 22 bp, Homo sapiens
acatgaaagaacccaagacatc

SEQ ID NO: 5351713 - DNA, 11 bp, Homo sapiens
acatgaaagcg

SEQ ID NO: 5351714 - DNA, 16 bp, Homo sapiens
acatgaaataatgcac

SEQ ID NO: 5351715 - DNA, 13 bp, Homo sapiens
acatgaaatatat

SEQ ID NO: 5351716 - DNA, 12 bp, Homo sapiens
acatgaaatgaa

SEQ ID NO: 5351717 - DNA, 14 bp, Homo sapiens
acatgaacagcttg

SEQ ID NO: 5351718 - DNA, 18 bp, Homo sapiens
acatgaagaatagaaaca

SEQ ID NO: 5351719 - DNA, 13 bp, Homo sapiens
acatgaagaatgt

SEQ ID NO: 5351720 - DNA, 21 bp, Homo sapiens
acatgaagcaattagtctgaa

SEQ ID NO: 5351721 - DNA, 17 bp, Homo sapiens
acatgaagctgtataat

SEQ ID NO: 5351722 - DNA, 15 bp, Homo sapiens
acatgaagcttcatg

SEQ ID NO: 5351723 - DNA, 15 bp, Homo sapiens
acatgaaggtaaata

SEQ ID NO: 5351724 - DNA, 16 bp, Homo sapiens
acatgaaggtaaataa

SEQ ID NO: 5351725 - DNA, 22 bp, Homo sapiens
acatgaaggtaaataaaaagaa

SEQ ID NO: 5351726 - DNA, 16 bp, Homo sapiens
acatgaagtccaagca

SEQ ID NO: 5351727 - DNA, 21 bp, Homo sapiens
acatgaataaaaataaagttt

SEQ ID NO: 5351728 - DNA, 15 bp, Homo sapiens
acatgaatacaaatt

SEQ ID NO: 5351729 - DNA, 13 bp, Homo sapiens
acatgaatatgat

SEQ ID NO: 5351730 - DNA, 22 bp, Homo sapiens
acatgaatgcagtcatgcaaac

SEQ ID NO: 5351731 - DNA, 21 bp, Homo sapiens
acatgaatggagacttctaat

SEQ ID NO: 5351732 - DNA, 13 bp, Homo sapiens
acatgaatttaat

SEQ ID NO: 5351733 - DNA, 15 bp, Homo sapiens
acatgaatttaatgt

SEQ ID NO: 5351734 - DNA, 17 bp, Homo sapiens
acatgaattttagcttt

SEQ ID NO: 5351735 - DNA, 21 bp, Homo sapiens
acatgaatttttatgatttct

SEQ ID NO: 5351736 - DNA, 12 bp, Homo sapiens
acatgacactga

SEQ ID NO: 5351737 - DNA, 17 bp, Homo sapiens
acatgacactgaaatgc

SEQ ID NO: 5351738 - DNA, 19 bp, Homo sapiens
acatgacactgaaatgcct

SEQ ID NO: 5351739 - DNA, 13 bp, Homo sapiens
acatgacactgac

SEQ ID NO: 5351740 - DNA, 16 bp, Homo sapiens
acatgacactgacctt

SEQ ID NO: 5351741 - DNA, 16 bp, Homo sapiens
acatgacatccacatg

SEQ ID NO: 5351742 - DNA, 11 bp, Homo sapiens
acatgacattt

SEQ ID NO: 5351743 - DNA, 15 bp, Homo sapiens
acatgacccagcctg

SEQ ID NO: 5351744 - DNA, 16 bp, Homo sapiens
acatgacccagcctga

SEQ ID NO: 5351745 - DNA, 20 bp, Homo sapiens
acatgacccgtacacaccac

SEQ ID NO: 5351746 - DNA, 18 bp, Homo sapiens
acatgaccctctgtcccc

SEQ ID NO: 5351747 - DNA, 22 bp, Homo sapiens
acatgaccctctgtccccaggc

SEQ ID NO: 5351748 - DNA, 14 bp, Homo sapiens
acatgaccctgggc

SEQ ID NO: 5351749 - DNA, 20 bp, Homo sapiens
acatgaccctgggcttctgt

SEQ ID NO: 5351750 - DNA, 18 bp, Homo sapiens
acatgacgacaaagctgc

SEQ ID NO: 5351751 - DNA, 23 bp, Homo sapiens
acatgacgccagataaaatgttc

SEQ ID NO: 5351752 - DNA, 21 bp, Homo sapiens
acatgacgtggtaaaatgtga

SEQ ID NO: 5351753 - DNA, 20 bp, Homo sapiens
acatgactacatagtaagta

SEQ ID NO: 5351754 - DNA, 23 bp, Homo sapiens
acatgactctttattgtctgtaa

SEQ ID NO: 5351755 - DNA, 14 bp, Homo sapiens
acatgactgggcct

SEQ ID NO: 5351756 - DNA, 20 bp, Homo sapiens
acatgactgtttcttttgta

SEQ ID NO: 5351757 - DNA, 20 bp, Homo sapiens
acatgacttattatgcataa

SEQ ID NO: 5351758 - DNA, 19 bp, Homo sapiens
acatgacttccttatttct

SEQ ID NO: 5351759 - DNA, 12 bp, Homo sapiens
acatgagaaaga

SEQ ID NO: 5351760 - DNA, 16 bp, Homo sapiens
acatgagaaagggaga

SEQ ID NO: 5351761 - DNA, 15 bp, Homo sapiens
acatgagactaagag

SEQ ID NO: 5351762 - DNA, 19 bp, Homo sapiens
acatgagagtagggccctg

SEQ ID NO: 5351763 - DNA, 22 bp, Homo sapiens
acatgagatcagggcctgcccc

SEQ ID NO: 5351764 - DNA, 15 bp, Homo sapiens
acatgagatggagag

SEQ ID NO: 5351765 - DNA, 23 bp, Homo sapiens
acatgagcatcaggccaggccct

SEQ ID NO: 5351766 - DNA, 12 bp, Homo sapiens
acatgagccagt

SEQ ID NO: 5351767 - DNA, 18 bp, Homo sapiens
acatgagcgctactcttg

SEQ ID NO: 5351768 - DNA, 22 bp, Homo sapiens
acatgagctatttccattccag

SEQ ID NO: 5351769 - DNA, 18 bp, Homo sapiens
acatgaggactctattct

SEQ ID NO: 5351770 - DNA, 22 bp, Homo sapiens
acatgaggactctattctttaa

SEQ ID NO: 5351771 - DNA, 17 bp, Homo sapiens
acatgaggagggtgccc

SEQ ID NO: 5351772 - DNA, 13 bp, Homo sapiens
acatgaggccact

SEQ ID NO: 5351773 - DNA, 17 bp, Homo sapiens
acatgaggggacatttt

SEQ ID NO: 5351774 - DNA, 20 bp, Homo sapiens
acatgaggtactgagagtga

SEQ ID NO: 5351775 - DNA, 15 bp, Homo sapiens
acatgagtaaagcag

SEQ ID NO: 5351776 - DNA, 17 bp, Homo sapiens
acatgagtatcatcaga

SEQ ID NO: 5351777 - DNA, 13 bp, Homo sapiens
acatgagtcaaga

SEQ ID NO: 5351778 - DNA, 13 bp, Homo sapiens
acatgagtgctga

SEQ ID NO: 5351779 - DNA, 14 bp, Homo sapiens
acatgagtgctgat

SEQ ID NO: 5351780 - DNA, 13 bp, Homo sapiens
acatgagtgtcaa

SEQ ID NO: 5351781 - DNA, 15 bp, Homo sapiens
acatgagttattcat

SEQ ID NO: 5351782 - DNA, 18 bp, Homo sapiens
acatgataagacattttg

SEQ ID NO: 5351783 - DNA, 16 bp, Homo sapiens
acatgatactattcag

SEQ ID NO: 5351784 - DNA, 22 bp, Homo sapiens
acatgatccccgtctctgccct

SEQ ID NO: 5351785 - DNA, 19 bp, Homo sapiens
acatgatgaaaaattatag

SEQ ID NO: 5351786 - DNA, 13 bp, Homo sapiens
acatgatggggaa

SEQ ID NO: 5351787 - DNA, 22 bp, Homo sapiens
acatgatgttatgtaccatatg

SEQ ID NO: 5351788 - DNA, 14 bp, Homo sapiens
acatgattaatgat

SEQ ID NO: 5351789 - DNA, 13 bp, Homo sapiens
acatgattccttc

SEQ ID NO: 5351790 - DNA, 22 bp, Homo sapiens
acatgattccttcctgttctga

SEQ ID NO: 5351791 - DNA, 13 bp, Homo sapiens
acatgatttcaca

SEQ ID NO: 5351792 - DNA, 22 bp, Homo sapiens
acatgatttcacaaatattaaa

SEQ ID NO: 5351793 - DNA, 21 bp, Homo sapiens
acatgatttccttgaatgtgg

SEQ ID NO: 5351794 - DNA, 22 bp, Homo sapiens
acatgattttcttttgttttct

SEQ ID NO: 5351795 - DNA, 15 bp, Homo sapiens
acatgcaacccgaag

SEQ ID NO: 5351796 - DNA, 23 bp, Homo sapiens
acatgcaagaccagtattctaaa

SEQ ID NO: 5351797 - DNA, 16 bp, Homo sapiens
acatgcaaggtcattt

SEQ ID NO: 5351798 - DNA, 19 bp, Homo sapiens
acatgcaaggtcatttttt

SEQ ID NO: 5351799 - DNA, 18 bp, Homo sapiens
acatgcaagtgagaagct

SEQ ID NO: 5351800 - DNA, 18 bp, Homo sapiens
acatgcaataaaatttaa

SEQ ID NO: 5351801 - DNA, 19 bp, Homo sapiens
acatgcaataaaatttaaa

SEQ ID NO: 5351802 - DNA, 22 bp, Homo sapiens
acatgcaataacaagcatgcat

SEQ ID NO: 5351803 - DNA, 21 bp, Homo sapiens
acatgcaatttattaaaatga

SEQ ID NO: 5351804 - DNA, 11 bp, Homo sapiens
acatgcacaca

SEQ ID NO: 5351805 - DNA, 20 bp, Homo sapiens
acatgcacagctaacatgga

SEQ ID NO: 5351806 - DNA, 23 bp, Homo sapiens
acatgcacagctaacatggaagt

SEQ ID NO: 5351807 - DNA, 11 bp, Homo sapiens
acatgcacagt

SEQ ID NO: 5351808 - DNA, 14 bp, Homo sapiens
acatgcacagtcat

SEQ ID NO: 5351809 - DNA, 20 bp, Homo sapiens
acatgcacagtttgcaatct

SEQ ID NO: 5351810 - DNA, 12 bp, Homo sapiens
acatgcacatgt

SEQ ID NO: 5351811 - DNA, 19 bp, Homo sapiens
acatgcacatgtattctgt

SEQ ID NO: 5351812 - DNA, 20 bp, Homo sapiens
acatgcacattttgtacatt

SEQ ID NO: 5351813 - DNA, 13 bp, Homo sapiens
acatgcacccgca

SEQ ID NO: 5351814 - DNA, 21 bp, Homo sapiens
acatgcacccgcatgtacaaa

SEQ ID NO: 5351815 - DNA, 22 bp, Homo sapiens
acatgcacccgcatgtacaaaa

SEQ ID NO: 5351816 - DNA, 17 bp, Homo sapiens
acatgcaccctggactt

SEQ ID NO: 5351817 - DNA, 16 bp, Homo sapiens
acatgcactatgagga

SEQ ID NO: 5351818 - DNA, 16 bp, Homo sapiens
acatgcactcagtgtg

SEQ ID NO: 5351819 - DNA, 20 bp, Homo sapiens
acatgcactcagtgtggact

SEQ ID NO: 5351820 - DNA, 15 bp, Homo sapiens
acattaaatgactct

SEQ ID NO: 5351821 - DNA, 21 bp, Homo sapiens
acattaaatgactcttccctc

SEQ ID NO: 5351822 - DNA, 21 bp, Homo sapiens
acattaaatgcaataatttta

SEQ ID NO: 5351823 - DNA, 17 bp, Homo sapiens
acattaaatgtcttata

SEQ ID NO: 5351824 - DNA, 14 bp, Homo sapiens
acattaacaaataa

SEQ ID NO: 5351825 - DNA, 15 bp, Homo sapiens
acattaacaagatca

SEQ ID NO: 5351826 - DNA, 11 bp, Homo sapiens
acattaacagt

SEQ ID NO: 5351827 - DNA, 22 bp, Homo sapiens
acattaacagttttccatgaaa

SEQ ID NO: 5351828 - DNA, 16 bp, Homo sapiens
acattaacatctatta

SEQ ID NO: 5351829 - DNA, 14 bp, Homo sapiens
acattaacattttg

SEQ ID NO: 5351830 - DNA, 18 bp, Homo sapiens
acattaactcaggcattt

SEQ ID NO: 5351831 - DNA, 15 bp, Homo sapiens
acattaactcattag

SEQ ID NO: 5351832 - DNA, 22 bp, Homo sapiens
acattaactccctccaccagcc

SEQ ID NO: 5351833 - DNA, 13 bp, Homo sapiens
acattaacttgaa

SEQ ID NO: 5351834 - DNA, 14 bp, Homo sapiens
acattaacttgaaa

SEQ ID NO: 5351835 - DNA, 16 bp, Homo sapiens
acattaacttgaaaat

SEQ ID NO: 5351836 - DNA, 13 bp, Homo sapiens
acattaagaaaat

SEQ ID NO: 5351837 - DNA, 14 bp, Homo sapiens
acattaagaaaatc

SEQ ID NO: 5351838 - DNA, 19 bp, Homo sapiens
acattaaggaatttgatga

SEQ ID NO: 5351839 - DNA, 14 bp, Homo sapiens
acattaaggagcag

SEQ ID NO: 5351840 - DNA, 18 bp, Homo sapiens
acattaatagcagccttt

SEQ ID NO: 5351841 - DNA, 17 bp, Homo sapiens
acattaatatttaccaa

SEQ ID NO: 5351842 - DNA, 18 bp, Homo sapiens
acattaatatttaccaaa

SEQ ID NO: 5351843 - DNA, 19 bp, Homo sapiens
acattaatatttaccaaag

SEQ ID NO: 5351844 - DNA, 14 bp, Homo sapiens
acattaatgcccag

SEQ ID NO: 5351845 - DNA, 15 bp, Homo sapiens
acattaatgcccagc

SEQ ID NO: 5351846 - DNA, 23 bp, Homo sapiens
acattaatgcccagccagccacc

SEQ ID NO: 5351847 - DNA, 21 bp, Homo sapiens
acattaatgtcctcttgctgt

SEQ ID NO: 5351848 - DNA, 15 bp, Homo sapiens
acattaatgttaatt

SEQ ID NO: 5351849 - DNA, 14 bp, Homo sapiens
acattaatgttgaa

SEQ ID NO: 5351850 - DNA, 15 bp, Homo sapiens
acattaatgttgatt

SEQ ID NO: 5351851 - DNA, 17 bp, Homo sapiens
acattaatgttgatttc

SEQ ID NO: 5351852 - DNA, 16 bp, Homo sapiens
acattaattaattaaa

SEQ ID NO: 5351853 - DNA, 16 bp, Homo sapiens
acattaattgaggctt

SEQ ID NO: 5351854 - DNA, 19 bp, Homo sapiens
acattaattgctaacaatt

SEQ ID NO: 5351855 - DNA, 15 bp, Homo sapiens
acattaattttgtgc

SEQ ID NO: 5351856 - DNA, 18 bp, Homo sapiens
acattaattttgtgcatt

SEQ ID NO: 5351857 - DNA, 19 bp, Homo sapiens
acattaattttgtgcattc

SEQ ID NO: 5351858 - DNA, 20 bp, Homo sapiens
acattaattttgtgcattct

SEQ ID NO: 5351859 - DNA, 15 bp, Homo sapiens
acattacaaatttct

SEQ ID NO: 5351860 - DNA, 15 bp, Homo sapiens
acattacagccaggt

SEQ ID NO: 5351861 - DNA, 12 bp, Homo sapiens
acattacagttc

SEQ ID NO: 5351862 - DNA, 20 bp, Homo sapiens
acattacatcatcctcctta

SEQ ID NO: 5351863 - DNA, 15 bp, Homo sapiens
acattacatctgagt

SEQ ID NO: 5351864 - DNA, 15 bp, Homo sapiens
acattacatgtaaat

SEQ ID NO: 5351865 - DNA, 17 bp, Homo sapiens
acattacattaacattt

SEQ ID NO: 5351866 - DNA, 17 bp, Homo sapiens
acattacattgccattt

SEQ ID NO: 5351867 - DNA, 15 bp, Homo sapiens
acattaccattcata

SEQ ID NO: 5351868 - DNA, 19 bp, Homo sapiens
acattaccttactgtggag

SEQ ID NO: 5351869 - DNA, 21 bp, Homo sapiens
acattaccttgtctttcaaaa

SEQ ID NO: 5351870 - DNA, 16 bp, Homo sapiens
acattactatagcata

SEQ ID NO: 5351871 - DNA, 14 bp, Homo sapiens
acattactgtatgt

SEQ ID NO: 5351872 - DNA, 16 bp, Homo sapiens
acattactgtatgtat

SEQ ID NO: 5351873 - DNA, 16 bp, Homo sapiens
acattacttgcacaag

SEQ ID NO: 5351874 - DNA, 12 bp, Homo sapiens
acattagaaaaa

SEQ ID NO: 5351875 - DNA, 19 bp, Homo sapiens
acattagaaaaaaatgaaa

SEQ ID NO: 5351876 - DNA, 14 bp, Homo sapiens
acattagaaatatt

SEQ ID NO: 5351877 - DNA, 13 bp, Homo sapiens
acattagaagaaa

SEQ ID NO: 5351878 - DNA, 16 bp, Homo sapiens
acattagaagaaaaca

SEQ ID NO: 5351879 - DNA, 22 bp, Homo sapiens
acattagaagaaaacatatatt

SEQ ID NO: 5351880 - DNA, 13 bp, Homo sapiens
acattagacacac

SEQ ID NO: 5351881 - DNA, 15 bp, Homo sapiens
acattagacacacat

SEQ ID NO: 5351882 - DNA, 20 bp, Homo sapiens
acattagacacacatataca

SEQ ID NO: 5351883 - DNA, 15 bp, Homo sapiens
acattagagaaaacc

SEQ ID NO: 5351884 - DNA, 17 bp, Homo sapiens
acattagagaaaacctt

SEQ ID NO: 5351885 - DNA, 18 bp, Homo sapiens
acattagagaaaacctta

SEQ ID NO: 5351886 - DNA, 21 bp, Homo sapiens
acattagataaattactataa

SEQ ID NO: 5351887 - DNA, 16 bp, Homo sapiens
acattagatgtcatga

SEQ ID NO: 5351888 - DNA, 22 bp, Homo sapiens
acattagcagtttgctttgtat

SEQ ID NO: 5351889 - DNA, 12 bp, Homo sapiens
acattaggaatt

SEQ ID NO: 5351890 - DNA, 16 bp, Homo sapiens
acattaggaattgttt

SEQ ID NO: 5351891 - DNA, 19 bp, Homo sapiens
acattaggcattgagactt

SEQ ID NO: 5351892 - DNA, 16 bp, Homo sapiens
acattaggggaaccat

SEQ ID NO: 5351893 - DNA, 19 bp, Homo sapiens
acattaggggattcttctt

SEQ ID NO: 5351894 - DNA, 15 bp, Homo sapiens
acattaggttgtgaa

SEQ ID NO: 5351895 - DNA, 16 bp, Homo sapiens
acattagtgagattta

SEQ ID NO: 5351896 - DNA, 19 bp, Homo sapiens
acattagttctatttctat

SEQ ID NO: 5351897 - DNA, 13 bp, Homo sapiens
acattagttgcac

SEQ ID NO: 5351898 - DNA, 15 bp, Homo sapiens
acattagttgcacta

SEQ ID NO: 5351899 - DNA, 13 bp, Homo sapiens
acattagttttaa

SEQ ID NO: 5351900 - DNA, 11 bp, Homo sapiens
acattataaac

SEQ ID NO: 5351901 - DNA, 19 bp, Homo sapiens
acattataaaccttcagaa

SEQ ID NO: 5351902 - DNA, 19 bp, Homo sapiens
acattataacaactattta

SEQ ID NO: 5351903 - DNA, 16 bp, Homo sapiens
acattataataaaatt

SEQ ID NO: 5351904 - DNA, 18 bp, Homo sapiens
acattataataaaatttc

SEQ ID NO: 5351905 - DNA, 16 bp, Homo sapiens
acattataatgtacag

SEQ ID NO: 5351906 - DNA, 19 bp, Homo sapiens
acattataccgcagagtat

SEQ ID NO: 5351907 - DNA, 21 bp, Homo sapiens
acattataccgcagagtattt

SEQ ID NO: 5351908 - DNA, 17 bp, Homo sapiens
acattatagaaattact

SEQ ID NO: 5351909 - DNA, 18 bp, Homo sapiens
acattatattgcaatgaa

SEQ ID NO: 5351910 - DNA, 13 bp, Homo sapiens
acattatcattca

SEQ ID NO: 5351911 - DNA, 15 bp, Homo sapiens
acattatccctctgg

SEQ ID NO: 5351912 - DNA, 16 bp, Homo sapiens
acattatcctgtgtga

SEQ ID NO: 5351913 - DNA, 18 bp, Homo sapiens
acattatcgggagcagtg

SEQ ID NO: 5351914 - DNA, 19 bp, Homo sapiens
acattatcgggagcagtgt

SEQ ID NO: 5351915 - DNA, 22 bp, Homo sapiens
acattatcgggagcagtgtctt

SEQ ID NO: 5351916 - DNA, 20 bp, Homo sapiens
acattatctaactgtgctca

SEQ ID NO: 5351917 - DNA, 14 bp, Homo sapiens
acattatcttctgg

SEQ ID NO: 5351918 - DNA, 20 bp, Homo sapiens
acattatctttgatatgtga

SEQ ID NO: 5351919 - DNA, 14 bp, Homo sapiens
acattatgaagaat

SEQ ID NO: 5351920 - DNA, 13 bp, Homo sapiens
acattatgatcta

SEQ ID NO: 5351921 - DNA, 23 bp, Homo sapiens
acattatgatctaataaacttta

SEQ ID NO: 5351922 - DNA, 15 bp, Homo sapiens
acattatgtgtgcat

SEQ ID NO: 5351923 - DNA, 13 bp, Homo sapiens
acattatgttatt

SEQ ID NO: 5351924 - DNA, 23 bp, Homo sapiens
acattatgttattggaattttct

SEQ ID NO: 5351925 - DNA, 19 bp, Homo sapiens
acattatgttttatttaaa

SEQ ID NO: 5351926 - DNA, 20 bp, Homo sapiens
acattatgttttatttaaat

SEQ ID NO: 5351927 - DNA, 23 bp, Homo sapiens
acattatgttttatttaaatgct

SEQ ID NO: 5351928 - DNA, 13 bp, Homo sapiens
acattattaatca

SEQ ID NO: 5351929 - DNA, 16 bp, Homo sapiens
acattattaatcattc

SEQ ID NO: 5351930 - DNA, 16 bp, Homo sapiens
acattattagaatata

SEQ ID NO: 5351931 - DNA, 19 bp, Homo sapiens
acattattggacttccatt

SEQ ID NO: 5351932 - DNA, 21 bp, Homo sapiens
acattattggacttccatttg

SEQ ID NO: 5351933 - DNA, 22 bp, Homo sapiens
acattatttattaaaaatgttc

SEQ ID NO: 5351934 - DNA, 16 bp, Homo sapiens
acattatttattcagc

SEQ ID NO: 5351935 - DNA, 13 bp, Homo sapiens
acattatttctag

SEQ ID NO: 5351936 - DNA, 14 bp, Homo sapiens
acattatttgcatg

SEQ ID NO: 5351937 - DNA, 13 bp, Homo sapiens
acattattttaaa

SEQ ID NO: 5351938 - DNA, 15 bp, Homo sapiens
acattattttaattg

SEQ ID NO: 5351939 - DNA, 17 bp, Homo sapiens
acattattttgtatgga

SEQ ID NO: 5351940 - DNA, 13 bp, Homo sapiens
acattatttttag

SEQ ID NO: 5351941 - DNA, 15 bp, Homo sapiens
acattatttttagat

SEQ ID NO: 5351942 - DNA, 22 bp, Homo sapiens
acattcaagattaaactgagtg

SEQ ID NO: 5351943 - DNA, 19 bp, Homo sapiens
acattcaatgaattatatt

SEQ ID NO: 5351944 - DNA, 21 bp, Homo sapiens
acattcacaaagaaacgttgc

SEQ ID NO: 5351945 - DNA, 13 bp, Homo sapiens
acattcacagcac

SEQ ID NO: 5351946 - DNA, 14 bp, Homo sapiens
acattcacagccca

SEQ ID NO: 5351947 - DNA, 23 bp, Homo sapiens
acattcacagcccagaaccacag

SEQ ID NO: 5351948 - DNA, 14 bp, Homo sapiens
acattcacctgccc

SEQ ID NO: 5351949 - DNA, 13 bp, Homo sapiens
acattcactgagt

SEQ ID NO: 5351950 - DNA, 11 bp, Homo sapiens
acattcactgg

SEQ ID NO: 5351951 - DNA, 22 bp, Homo sapiens
acattcagaaaacttcaagaca

SEQ ID NO: 5351952 - DNA, 17 bp, Homo sapiens
acattcagaggaagaca

SEQ ID NO: 5351953 - DNA, 18 bp, Homo sapiens
acattcagctctggagaa

SEQ ID NO: 5351954 - DNA, 21 bp, Homo sapiens
acattcagctctggagaacag

SEQ ID NO: 5351955 - DNA, 15 bp, Homo sapiens
acattcagctgaggt

SEQ ID NO: 5351956 - DNA, 19 bp, Homo sapiens
acattcaggaattcttgga

SEQ ID NO: 5351957 - DNA, 13 bp, Homo sapiens
acattcaggagct

SEQ ID NO: 5351958 - DNA, 14 bp, Homo sapiens
acattcaggcatgc

SEQ ID NO: 5351959 - DNA, 17 bp, Homo sapiens
acattcataaggaaatg

SEQ ID NO: 5351960 - DNA, 22 bp, Homo sapiens
acattcatagtctttggagaaa

SEQ ID NO: 5351961 - DNA, 20 bp, Homo sapiens
acattcatatttgcaataaa

SEQ ID NO: 5351962 - DNA, 21 bp, Homo sapiens
acattcatccagttgcaataa

SEQ ID NO: 5351963 - DNA, 10 bp, Homo sapiens
acattcatgt

SEQ ID NO: 5351964 - DNA, 15 bp, Homo sapiens
acattcatgtaactc

SEQ ID NO: 5351965 - DNA, 19 bp, Homo sapiens
acattcatgtgtaggaaga

SEQ ID NO: 5351966 - DNA, 23 bp, Homo sapiens
acattcattcaacagctgatgcc

SEQ ID NO: 5351967 - DNA, 22 bp, Homo sapiens
acattccaaaagggggcctggg

SEQ ID NO: 5351968 - DNA, 16 bp, Homo sapiens
acattccaaacagagt

SEQ ID NO: 5351969 - DNA, 15 bp, Homo sapiens
acattccaagacagt

SEQ ID NO: 5351970 - DNA, 17 bp, Homo sapiens
acattccacagctgccc

SEQ ID NO: 5351971 - DNA, 17 bp, Homo sapiens
acattccacatctgttt

SEQ ID NO: 5351972 - DNA, 14 bp, Homo sapiens
acattccagccagg

SEQ ID NO: 5351973 - DNA, 15 bp, Homo sapiens
acattccagccaggc

SEQ ID NO: 5351974 - DNA, 16 bp, Homo sapiens
acattccagccaggcc

SEQ ID NO: 5351975 - DNA, 18 bp, Homo sapiens
acattccagccaggccca

SEQ ID NO: 5351976 - DNA, 21 bp, Homo sapiens
acattccagccaggcccaggc

SEQ ID NO: 5351977 - DNA, 14 bp, Homo sapiens
acattccagggctg

SEQ ID NO: 5351978 - DNA, 17 bp, Homo sapiens
acattccagggctgggg

SEQ ID NO: 5351979 - DNA, 20 bp, Homo sapiens
acattccagtgtattttctg

SEQ ID NO: 5351980 - DNA, 13 bp, Homo sapiens
acattccatcctt

SEQ ID NO: 5351981 - DNA, 17 bp, Homo sapiens
acattcccatctgtcac

SEQ ID NO: 5351982 - DNA, 16 bp, Homo sapiens
acattcccatggtggc

SEQ ID NO: 5351983 - DNA, 16 bp, Homo sapiens
acattccccagagtgg

SEQ ID NO: 5351984 - DNA, 19 bp, Homo sapiens
acattcccccttcaacaaa

SEQ ID NO: 5351985 - DNA, 13 bp, Homo sapiens
acattcccctccc

SEQ ID NO: 5351986 - DNA, 21 bp, Homo sapiens
acattcccctcccacctctcc

SEQ ID NO: 5351987 - DNA, 18 bp, Homo sapiens
acattccctctaatttga

SEQ ID NO: 5351988 - DNA, 12 bp, Homo sapiens
acattccctctc

SEQ ID NO: 5351989 - DNA, 17 bp, Homo sapiens
acattccctctcctgcc

SEQ ID NO: 5351990 - DNA, 18 bp, Homo sapiens
acattccctctcctgccc

SEQ ID NO: 5351991 - DNA, 16 bp, Homo sapiens
acattccctggaattg

SEQ ID NO: 5351992 - DNA, 13 bp, Homo sapiens
acattccctggcc

SEQ ID NO: 5351993 - DNA, 14 bp, Homo sapiens
acattccctggcct

SEQ ID NO: 5351994 - DNA, 22 bp, Homo sapiens
acattccgaggggctcagttct

SEQ ID NO: 5351995 - DNA, 22 bp, Homo sapiens
acattcctagagagcagaaata

SEQ ID NO: 5351996 - DNA, 15 bp, Homo sapiens
acattcctcagctgc

SEQ ID NO: 5351997 - DNA, 17 bp, Homo sapiens
acattcctcatgaatgt

SEQ ID NO: 5351998 - DNA, 21 bp, Homo sapiens
acattcctcatgaatgtaaat

SEQ ID NO: 5351999 - DNA, 13 bp, Homo sapiens
acattcctccagc

SEQ ID NO: 5352000 - DNA, 13 bp, Homo sapiens
acatttggggaga

SEQ ID NO: 5352001 - DNA, 17 bp, Homo sapiens
acatttggggagagata

SEQ ID NO: 5352002 - DNA, 18 bp, Homo sapiens
acatttgggttactattt

SEQ ID NO: 5352003 - DNA, 17 bp, Homo sapiens
acatttggtaatgtttt

SEQ ID NO: 5352004 - DNA, 22 bp, Homo sapiens
acatttggtggtactttattct

SEQ ID NO: 5352005 - DNA, 16 bp, Homo sapiens
acatttgtaagtgtaa

SEQ ID NO: 5352006 - DNA, 23 bp, Homo sapiens
acatttgtaagtgtaaaaaatgt

SEQ ID NO: 5352007 - DNA, 15 bp, Homo sapiens
acatttgtacagaat

SEQ ID NO: 5352008 - DNA, 15 bp, Homo sapiens
acatttgtacattcc

SEQ ID NO: 5352009 - DNA, 19 bp, Homo sapiens
acatttgtacattcctgat

SEQ ID NO: 5352010 - DNA, 16 bp, Homo sapiens
acatttgtactttatt

SEQ ID NO: 5352011 - DNA, 21 bp, Homo sapiens
acatttgtagcatcctcttta

SEQ ID NO: 5352012 - DNA, 21 bp, Homo sapiens
acatttgtataaaataatttt

SEQ ID NO: 5352013 - DNA, 12 bp, Homo sapiens
acatttgtatat

SEQ ID NO: 5352014 - DNA, 13 bp, Homo sapiens
acatttgtatatt

SEQ ID NO: 5352015 - DNA, 18 bp, Homo sapiens
acatttgtcacagaaatc

SEQ ID NO: 5352016 - DNA, 15 bp, Homo sapiens
acatttgtcagtatt

SEQ ID NO: 5352017 - DNA, 11 bp, Homo sapiens
acatttgtcat

SEQ ID NO: 5352018 - DNA, 17 bp, Homo sapiens
acatttgtcattttcat

SEQ ID NO: 5352019 - DNA, 16 bp, Homo sapiens
acatttgtcctgcaga

SEQ ID NO: 5352020 - DNA, 22 bp, Homo sapiens
acatttgtcctgcagagctggg

SEQ ID NO: 5352021 - DNA, 15 bp, Homo sapiens
acatttgtgcataaa

SEQ ID NO: 5352022 - DNA, 20 bp, Homo sapiens
acatttgtgccgacactgtt

SEQ ID NO: 5352023 - DNA, 22 bp, Homo sapiens
acatttgtgctccattttttct

SEQ ID NO: 5352024 - DNA, 22 bp, Homo sapiens
acatttgtgtcactgtacagtt

SEQ ID NO: 5352025 - DNA, 14 bp, Homo sapiens
acatttgtgtgtta

SEQ ID NO: 5352026 - DNA, 18 bp, Homo sapiens
acatttgttaatgattct

SEQ ID NO: 5352027 - DNA, 19 bp, Homo sapiens
acatttgttaatgattctt

SEQ ID NO: 5352028 - DNA, 19 bp, Homo sapiens
acatttgttcatgagtgga

SEQ ID NO: 5352029 - DNA, 13 bp, Homo sapiens
acatttgttcctg

SEQ ID NO: 5352030 - DNA, 17 bp, Homo sapiens
acatttgttctgggtta

SEQ ID NO: 5352031 - DNA, 16 bp, Homo sapiens
acatttgtttccccca

SEQ ID NO: 5352032 - DNA, 20 bp, Homo sapiens
acatttgtttgtattcatgt

SEQ ID NO: 5352033 - DNA, 18 bp, Homo sapiens
acattttaaaaacataga

SEQ ID NO: 5352034 - DNA, 22 bp, Homo sapiens
acattttaaaaataaatgaaaa

SEQ ID NO: 5352035 - DNA, 21 bp, Homo sapiens
acattttaaaacgttttctct

SEQ ID NO: 5352036 - DNA, 14 bp, Homo sapiens
acattttaaataaa

SEQ ID NO: 5352037 - DNA, 15 bp, Homo sapiens
acattttaacaagaa

SEQ ID NO: 5352038 - DNA, 13 bp, Homo sapiens
acattttaacatg

SEQ ID NO: 5352039 - DNA, 13 bp, Homo sapiens
acattttaagtgc

SEQ ID NO: 5352040 - DNA, 22 bp, Homo sapiens
acattttaatacagattgaaag

SEQ ID NO: 5352041 - DNA, 15 bp, Homo sapiens
acattttaatgcacc

SEQ ID NO: 5352042 - DNA, 13 bp, Homo sapiens
acattttacagta

SEQ ID NO: 5352043 - DNA, 13 bp, Homo sapiens
acattttacatat

SEQ ID NO: 5352044 - DNA, 14 bp, Homo sapiens
acattttacattaa

SEQ ID NO: 5352045 - DNA, 15 bp, Homo sapiens
acattttacattaaa

SEQ ID NO: 5352046 - DNA, 14 bp, Homo sapiens
acattttactattt

SEQ ID NO: 5352047 - DNA, 11 bp, Homo sapiens
acattttactg

SEQ ID NO: 5352048 - DNA, 22 bp, Homo sapiens
acattttagaatgtcaataaat

SEQ ID NO: 5352049 - DNA, 16 bp, Homo sapiens
acattttagacagtaa

SEQ ID NO: 5352050 - DNA, 23 bp, Homo sapiens
acattttaggatctcgcctggaa

SEQ ID NO: 5352051 - DNA, 15 bp, Homo sapiens
acattttagttactg

SEQ ID NO: 5352052 - DNA, 10 bp, Homo sapiens
acattttata

SEQ ID NO: 5352053 - DNA, 14 bp, Homo sapiens
acattttataaagt

SEQ ID NO: 5352054 - DNA, 18 bp, Homo sapiens
acattttatatctggatt

SEQ ID NO: 5352055 - DNA, 20 bp, Homo sapiens
acattttatatttttgtaca

SEQ ID NO: 5352056 - DNA, 22 bp, Homo sapiens
acattttatcattaaaaattac

SEQ ID NO: 5352057 - DNA, 17 bp, Homo sapiens
acattttatcattaatt

SEQ ID NO: 5352058 - DNA, 17 bp, Homo sapiens
acattttattaaacaca

SEQ ID NO: 5352059 - DNA, 17 bp, Homo sapiens
acattttattacactaa

SEQ ID NO: 5352060 - DNA, 18 bp, Homo sapiens
acattttattgtcagaat

SEQ ID NO: 5352061 - DNA, 16 bp, Homo sapiens
acattttatttattag

SEQ ID NO: 5352062 - DNA, 23 bp, Homo sapiens
acattttatttattagctgtaaa

SEQ ID NO: 5352063 - DNA, 14 bp, Homo sapiens
acattttattttat

SEQ ID NO: 5352064 - DNA, 22 bp, Homo sapiens
acattttatttttaaaatatta

SEQ ID NO: 5352065 - DNA, 22 bp, Homo sapiens
acattttcactggaagatttat

SEQ ID NO: 5352066 - DNA, 14 bp, Homo sapiens
acattttcagccaa

SEQ ID NO: 5352067 - DNA, 13 bp, Homo sapiens
acattttcatatg

SEQ ID NO: 5352068 - DNA, 13 bp, Homo sapiens
acattttcctgtg

SEQ ID NO: 5352069 - DNA, 14 bp, Homo sapiens
acattttcctgtgt

SEQ ID NO: 5352070 - DNA, 12 bp, Homo sapiens
acattttccttt

SEQ ID NO: 5352071 - DNA, 13 bp, Homo sapiens
acattttctaaat

SEQ ID NO: 5352072 - DNA, 16 bp, Homo sapiens
acattttctcagtgtg

SEQ ID NO: 5352073 - DNA, 17 bp, Homo sapiens
acattttctcctaggag

SEQ ID NO: 5352074 - DNA, 14 bp, Homo sapiens
acattttctcttag

SEQ ID NO: 5352075 - DNA, 19 bp, Homo sapiens
acattttctctttaaaaga

SEQ ID NO: 5352076 - DNA, 20 bp, Homo sapiens
acattttctgtgtgtacatg

SEQ ID NO: 5352077 - DNA, 13 bp, Homo sapiens
acattttcttaat

SEQ ID NO: 5352078 - DNA, 16 bp, Homo sapiens
acattttcttgaattt

SEQ ID NO: 5352079 - DNA, 14 bp, Homo sapiens
acattttcttgtcc

SEQ ID NO: 5352080 - DNA, 15 bp, Homo sapiens
acattttctttcata

SEQ ID NO: 5352081 - DNA, 21 bp, Homo sapiens
acattttctttctttttctgg

SEQ ID NO: 5352082 - DNA, 21 bp, Homo sapiens
acattttcttttattatcagt

SEQ ID NO: 5352083 - DNA, 21 bp, Homo sapiens
acattttcttttgttcttgat

SEQ ID NO: 5352084 - DNA, 14 bp, Homo sapiens
acattttctttttt

SEQ ID NO: 5352085 - DNA, 19 bp, Homo sapiens
acattttctttttttaact

SEQ ID NO: 5352086 - DNA, 23 bp, Homo sapiens
acattttctttttttattaaaca

SEQ ID NO: 5352087 - DNA, 14 bp, Homo sapiens
acattttgaaaata

SEQ ID NO: 5352088 - DNA, 13 bp, Homo sapiens
acattttgaaagt

SEQ ID NO: 5352089 - DNA, 17 bp, Homo sapiens
acattttgaaagtctgt

SEQ ID NO: 5352090 - DNA, 21 bp, Homo sapiens
acattttgaaagtctgtcctt

SEQ ID NO: 5352091 - DNA, 15 bp, Homo sapiens
acattttgaaggaaa

SEQ ID NO: 5352092 - DNA, 12 bp, Homo sapiens
acattttgagaa

SEQ ID NO: 5352093 - DNA, 21 bp, Homo sapiens
acattttgcagctatggacaa

SEQ ID NO: 5352094 - DNA, 15 bp, Homo sapiens
acattttgctctgtg

SEQ ID NO: 5352095 - DNA, 16 bp, Homo sapiens
acattttgctttataa

SEQ ID NO: 5352096 - DNA, 18 bp, Homo sapiens
acattttggaaattgttg

SEQ ID NO: 5352097 - DNA, 15 bp, Homo sapiens
acattttggatttct

SEQ ID NO: 5352098 - DNA, 19 bp, Homo sapiens
acattttggatttctttat

SEQ ID NO: 5352099 - DNA, 22 bp, Homo sapiens
acattttggatttctttatata

SEQ ID NO: 5352100 - DNA, 18 bp, Homo sapiens
acattttggtgagaaatg

SEQ ID NO: 5352101 - DNA, 20 bp, Homo sapiens
acattttgtaacaaagaact

SEQ ID NO: 5352102 - DNA, 15 bp, Homo sapiens
acattttgtatgctg

SEQ ID NO: 5352103 - DNA, 22 bp, Homo sapiens
acattttgtatggagttaaata

SEQ ID NO: 5352104 - DNA, 18 bp, Homo sapiens
acattttgtggctgttga

SEQ ID NO: 5352105 - DNA, 13 bp, Homo sapiens
acattttgtgtga

SEQ ID NO: 5352106 - DNA, 17 bp, Homo sapiens
acattttgtgtgagact

SEQ ID NO: 5352107 - DNA, 21 bp, Homo sapiens
acattttgttatagaatactt

SEQ ID NO: 5352108 - DNA, 12 bp, Homo sapiens
acattttgttct

SEQ ID NO: 5352109 - DNA, 20 bp, Homo sapiens
acattttgttcttacacata

SEQ ID NO: 5352110 - DNA, 13 bp, Homo sapiens
acattttgttgta

SEQ ID NO: 5352111 - DNA, 14 bp, Homo sapiens
acattttgttgtaa

SEQ ID NO: 5352112 - DNA, 15 bp, Homo sapiens
acatttttaaatgta

SEQ ID NO: 5352113 - DNA, 16 bp, Homo sapiens
acatttttaaattctt

SEQ ID NO: 5352114 - DNA, 24 bp, Homo sapiens
acatttttaaattcttactctgga

SEQ ID NO: 5352115 - DNA, 20 bp, Homo sapiens
acatttttaaattgttagct

SEQ ID NO: 5352116 - DNA, 16 bp, Homo sapiens
acatttttaagatgca

SEQ ID NO: 5352117 - DNA, 23 bp, Homo sapiens
acatttttaagctccatgtgcat

SEQ ID NO: 5352118 - DNA, 21 bp, Homo sapiens
acatttttaagtgctgcattt

SEQ ID NO: 5352119 - DNA, 23 bp, Homo sapiens
acatttttaagtgctgcatttaa

SEQ ID NO: 5352120 - DNA, 14 bp, Homo sapiens
acatttttaattga

SEQ ID NO: 5352121 - DNA, 21 bp, Homo sapiens
acatttttaatttaacaaact

SEQ ID NO: 5352122 - DNA, 12 bp, Homo sapiens
acatttttacaa

SEQ ID NO: 5352123 - DNA, 14 bp, Homo sapiens
acatttttacaata

SEQ ID NO: 5352124 - DNA, 15 bp, Homo sapiens
acatttttacaataa

SEQ ID NO: 5352125 - DNA, 16 bp, Homo sapiens
acatttttatacctgt

SEQ ID NO: 5352126 - DNA, 16 bp, Homo sapiens
acatttttatttatga

SEQ ID NO: 5352127 - DNA, 23 bp, Homo sapiens
acatttttatttatgaagtttaa

SEQ ID NO: 5352128 - DNA, 19 bp, Homo sapiens
acatttttcaactttgaat

SEQ ID NO: 5352129 - DNA, 21 bp, Homo sapiens
acatttttcaactttgaataa

SEQ ID NO: 5352130 - DNA, 23 bp, Homo sapiens
acatttttcaactttgaataaag

SEQ ID NO: 5352131 - DNA, 19 bp, Homo sapiens
acatttttcacttttgcta

SEQ ID NO: 5352132 - DNA, 16 bp, Homo sapiens
acatttttcagcagca

SEQ ID NO: 5352133 - DNA, 13 bp, Homo sapiens
acatttttcattc

SEQ ID NO: 5352134 - DNA, 21 bp, Homo sapiens
acatttttccgtttgcttttg

SEQ ID NO: 5352135 - DNA, 18 bp, Homo sapiens
acatttttcctctctgca

SEQ ID NO: 5352136 - DNA, 13 bp, Homo sapiens
acatttttctgat

SEQ ID NO: 5352137 - DNA, 23 bp, Homo sapiens
acatttttcttagggaaggatac

SEQ ID NO: 5352138 - DNA, 16 bp, Homo sapiens
acatttttgaggaagt

SEQ ID NO: 5352139 - DNA, 20 bp, Homo sapiens
acatttttgatcaaatgtac

SEQ ID NO: 5352140 - DNA, 20 bp, Homo sapiens
acatttttggatttctgtga

SEQ ID NO: 5352141 - DNA, 15 bp, Homo sapiens
acatttttgtacatt

SEQ ID NO: 5352142 - DNA, 18 bp, Homo sapiens
acatttttgtacattatg

SEQ ID NO: 5352143 - DNA, 21 bp, Homo sapiens
acatttttgtacattatgtta

SEQ ID NO: 5352144 - DNA, 16 bp, Homo sapiens
acatttttgtctgtcc

SEQ ID NO: 5352145 - DNA, 17 bp, Homo sapiens
acatttttgtttttaat

SEQ ID NO: 5352146 - DNA, 14 bp, Homo sapiens
acattttttaaaca

SEQ ID NO: 5352147 - DNA, 16 bp, Homo sapiens
acattttttaaatgca

SEQ ID NO: 5352148 - DNA, 16 bp, Homo sapiens
acattttttaactttc

SEQ ID NO: 5352149 - DNA, 19 bp, Homo sapiens
acattttttcttctgaaga

SEQ ID NO: 5352150 - DNA, 21 bp, Homo sapiens
acattttttcttctgaagatt

SEQ ID NO: 5352151 - DNA, 15 bp, Homo sapiens
acattttttctttat

SEQ ID NO: 5352152 - DNA, 14 bp, Homo sapiens
acattttttgaaat

SEQ ID NO: 5352153 - DNA, 14 bp, Homo sapiens
acattttttgctat

SEQ ID NO: 5352154 - DNA, 21 bp, Homo sapiens
acattttttgtttcttggtgt

SEQ ID NO: 5352155 - DNA, 13 bp, Homo sapiens
acatttttttaag

SEQ ID NO: 5352156 - DNA, 22 bp, Homo sapiens
acatttttttatgctcttgaaa

SEQ ID NO: 5352157 - DNA, 18 bp, Homo sapiens
acatttttttgcatgcat

SEQ ID NO: 5352158 - DNA, 19 bp, Homo sapiens
acatttttttttctccata

SEQ ID NO: 5352159 - DNA, 20 bp, Homo sapiens
acatttttttttttaatttt

SEQ ID NO: 5352160 - DNA, 18 bp, Homo sapiens
accaaaaaaatccagaaa

SEQ ID NO: 5352161 - DNA, 13 bp, Homo sapiens
accaaaaaaattg

SEQ ID NO: 5352162 - DNA, 19 bp, Homo sapiens
accaaaaaaccccagctat

SEQ ID NO: 5352163 - DNA, 18 bp, Homo sapiens
accaaaaaactaaagcag

SEQ ID NO: 5352164 - DNA, 22 bp, Homo sapiens
accaaaaaagtatttttttaag

SEQ ID NO: 5352165 - DNA, 15 bp, Homo sapiens
accaaaaaatctata

SEQ ID NO: 5352166 - DNA, 22 bp, Homo sapiens
accaaaaacatttgattaataa

SEQ ID NO: 5352167 - DNA, 13 bp, Homo sapiens
accaaaaaccagt

SEQ ID NO: 5352168 - DNA, 22 bp, Homo sapiens
accaaaaaccatgttgcgttca

SEQ ID NO: 5352169 - DNA, 11 bp, Homo sapiens
accaaaaagag

SEQ ID NO: 5352170 - DNA, 21 bp, Homo sapiens
accaaaaaggctagtttattt

SEQ ID NO: 5352171 - DNA, 14 bp, Homo sapiens
accaaaaatagaaa

SEQ ID NO: 5352172 - DNA, 11 bp, Homo sapiens
accaaaaatat

SEQ ID NO: 5352173 - DNA, 23 bp, Homo sapiens
accaaaaatctcaatatttcaga

SEQ ID NO: 5352174 - DNA, 14 bp, Homo sapiens
accaaaaattgcca

SEQ ID NO: 5352175 - DNA, 20 bp, Homo sapiens
accaaaaattgcgagccttt

SEQ ID NO: 5352176 - DNA, 13 bp, Homo sapiens
accaaaacagatg

SEQ ID NO: 5352177 - DNA, 11 bp, Homo sapiens
accaaaacagg

SEQ ID NO: 5352178 - DNA, 22 bp, Homo sapiens
accaaaacatccacttaagttc

SEQ ID NO: 5352179 - DNA, 17 bp, Homo sapiens
accaattgaagcatgaa

SEQ ID NO: 5352180 - DNA, 22 bp, Homo sapiens
accaattgactctcacactgaa

SEQ ID NO: 5352181 - DNA, 18 bp, Homo sapiens
accaattgccctgccagg

SEQ ID NO: 5352182 - DNA, 20 bp, Homo sapiens
accaattgtacattccctgc

SEQ ID NO: 5352183 - DNA, 17 bp, Homo sapiens
accaattgtcaaattac

SEQ ID NO: 5352184 - DNA, 16 bp, Homo sapiens
accaattgtgctgcca

SEQ ID NO: 5352185 - DNA, 18 bp, Homo sapiens
accaatttagaatgaata

SEQ ID NO: 5352186 - DNA, 15 bp, Homo sapiens
accaatttcttcctt

SEQ ID NO: 5352187 - DNA, 22 bp, Homo sapiens
accaatttcttccttccacagt

SEQ ID NO: 5352188 - DNA, 18 bp, Homo sapiens
accaatttgcaccagttt

SEQ ID NO: 5352189 - DNA, 20 bp, Homo sapiens
accaatttgcaccagtttta

SEQ ID NO: 5352190 - DNA, 16 bp, Homo sapiens
accaattttaaataca

SEQ ID NO: 5352191 - DNA, 16 bp, Homo sapiens
accaattttttgttct

SEQ ID NO: 5352192 - DNA, 17 bp, Homo sapiens
accacaaaagcaaaatt

SEQ ID NO: 5352193 - DNA, 20 bp, Homo sapiens
accacaaaagcaaaattttt

SEQ ID NO: 5352194 - DNA, 14 bp, Homo sapiens
accacaaaatatac

SEQ ID NO: 5352195 - DNA, 19 bp, Homo sapiens
accacaaacggagcccctg

SEQ ID NO: 5352196 - DNA, 20 bp, Homo sapiens
accacaaacggagcccctga

SEQ ID NO: 5352197 - DNA, 20 bp, Homo sapiens
accacaaaggccaaactgct

SEQ ID NO: 5352198 - DNA, 16 bp, Homo sapiens
accacaaatgcataaa

SEQ ID NO: 5352199 - DNA, 16 bp, Homo sapiens
accacaaccaggaaga

SEQ ID NO: 5352200 - DNA, 14 bp, Homo sapiens
accacaacctccac

SEQ ID NO: 5352201 - DNA, 21 bp, Homo sapiens
accacaacctccacctcctgg

SEQ ID NO: 5352202 - DNA, 20 bp, Homo sapiens
accacaactaacaatgcctt

SEQ ID NO: 5352203 - DNA, 20 bp, Homo sapiens
accacaactattttcagatg

SEQ ID NO: 5352204 - DNA, 16 bp, Homo sapiens
accacaagacatttct

SEQ ID NO: 5352205 - DNA, 14 bp, Homo sapiens
accacaagcatctc

SEQ ID NO: 5352206 - DNA, 20 bp, Homo sapiens
accacaagccaccttttgta

SEQ ID NO: 5352207 - DNA, 17 bp, Homo sapiens
accacaagcctgagaac

SEQ ID NO: 5352208 - DNA, 15 bp, Homo sapiens
accacaagctgagca

SEQ ID NO: 5352209 - DNA, 16 bp, Homo sapiens
accacaagctgagcag

SEQ ID NO: 5352210 - DNA, 20 bp, Homo sapiens
accacaaggctgaaaagtgc

SEQ ID NO: 5352211 - DNA, 12 bp, Homo sapiens
accacaagggct

SEQ ID NO: 5352212 - DNA, 23 bp, Homo sapiens
accacaaggtccactccctgctc

SEQ ID NO: 5352213 - DNA, 16 bp, Homo sapiens
accacaagtatctaaa

SEQ ID NO: 5352214 - DNA, 14 bp, Homo sapiens
accacaatatgtat

SEQ ID NO: 5352215 - DNA, 19 bp, Homo sapiens
accacaatgtttcttcatt

SEQ ID NO: 5352216 - DNA, 11 bp, Homo sapiens
accacacaaag

SEQ ID NO: 5352217 - DNA, 13 bp, Homo sapiens
accacacacaaca

SEQ ID NO: 5352218 - DNA, 16 bp, Homo sapiens
accacacacacaaggt

SEQ ID NO: 5352219 - DNA, 19 bp, Homo sapiens
accacacacacaaggtgct

SEQ ID NO: 5352220 - DNA, 14 bp, Homo sapiens
accacacacagcct

SEQ ID NO: 5352221 - DNA, 17 bp, Homo sapiens
accacacagaggctgcc

SEQ ID NO: 5352222 - DNA, 18 bp, Homo sapiens
accacacagtcacccctc

SEQ ID NO: 5352223 - DNA, 21 bp, Homo sapiens
accacacagtcacccctccct

SEQ ID NO: 5352224 - DNA, 15 bp, Homo sapiens
accacacatcccagc

SEQ ID NO: 5352225 - DNA, 17 bp, Homo sapiens
accacacatcccagccc

SEQ ID NO: 5352226 - DNA, 18 bp, Homo sapiens
accacacatcccagccca

SEQ ID NO: 5352227 - DNA, 14 bp, Homo sapiens
accacacatttcac

SEQ ID NO: 5352228 - DNA, 17 bp, Homo sapiens
accacaccaaacctctc

SEQ ID NO: 5352229 - DNA, 17 bp, Homo sapiens
accacaccaaccaggcc

SEQ ID NO: 5352230 - DNA, 13 bp, Homo sapiens
accacacccaact

SEQ ID NO: 5352231 - DNA, 12 bp, Homo sapiens
accacacccagc

SEQ ID NO: 5352232 - DNA, 20 bp, Homo sapiens
accacacccagcccacttct

SEQ ID NO: 5352233 - DNA, 23 bp, Homo sapiens
accacacccagcccacttctgcc

SEQ ID NO: 5352234 - DNA, 16 bp, Homo sapiens
accacacccagcctca

SEQ ID NO: 5352235 - DNA, 24 bp, Homo sapiens
accacacccagcctcagtcctccc

SEQ ID NO: 5352236 - DNA, 21 bp, Homo sapiens
accacacccaggtctcttcct

SEQ ID NO: 5352237 - DNA, 18 bp, Homo sapiens
accacacccgaagtcctg

SEQ ID NO: 5352238 - DNA, 21 bp, Homo sapiens
accacacccggctaatttttt

SEQ ID NO: 5352239 - DNA, 18 bp, Homo sapiens
accacaccctgcctgctg

SEQ ID NO: 5352240 - DNA, 19 bp, Homo sapiens
accacaccctgcctgctgt

SEQ ID NO: 5352241 - DNA, 22 bp, Homo sapiens
accacacctaaattaacaaatt

SEQ ID NO: 5352242 - DNA, 16 bp, Homo sapiens
accacacctccctgaa

SEQ ID NO: 5352243 - DNA, 13 bp, Homo sapiens
accacacctggct

SEQ ID NO: 5352244 - DNA, 15 bp, Homo sapiens
accacacgctgtctc

SEQ ID NO: 5352245 - DNA, 16 bp, Homo sapiens
accacactctgcctgg

SEQ ID NO: 5352246 - DNA, 18 bp, Homo sapiens
accacactgaatctcccc

SEQ ID NO: 5352247 - DNA, 14 bp, Homo sapiens
accacactgttgag

SEQ ID NO: 5352248 - DNA, 14 bp, Homo sapiens
accacactttcaaa

SEQ ID NO: 5352249 - DNA, 15 bp, Homo sapiens
accacactttcaaag

SEQ ID NO: 5352250 - DNA, 19 bp, Homo sapiens
accacactttgagaacctg

SEQ ID NO: 5352251 - DNA, 11 bp, Homo sapiens
accacagacac

SEQ ID NO: 5352252 - DNA, 12 bp, Homo sapiens
accacagacaca

SEQ ID NO: 5352253 - DNA, 24 bp, Homo sapiens
accacagacacaatatgtatgctt

SEQ ID NO: 5352254 - DNA, 14 bp, Homo sapiens
accacagacacaca

SEQ ID NO: 5352255 - DNA, 16 bp, Homo sapiens
accacagacacacaca

SEQ ID NO: 5352256 - DNA, 20 bp, Homo sapiens
accacagacacacacacgca

SEQ ID NO: 5352257 - DNA, 15 bp, Homo sapiens
accacagacactcct

SEQ ID NO: 5352258 - DNA, 18 bp, Homo sapiens
accacagacactcctggg

SEQ ID NO: 5352259 - DNA, 21 bp, Homo sapiens
accacagacatactaaccagc

SEQ ID NO: 5352260 - DNA, 20 bp, Homo sapiens
accacagacgccacctggcg

SEQ ID NO: 5352261 - DNA, 13 bp, Homo sapiens
accacagacttgc

SEQ ID NO: 5352262 - DNA, 15 bp, Homo sapiens
accacagacttgcac

SEQ ID NO: 5352263 - DNA, 15 bp, Homo sapiens
accacagagctgtca

SEQ ID NO: 5352264 - DNA, 16 bp, Homo sapiens
accacagaggctgtgg

SEQ ID NO: 5352265 - DNA, 20 bp, Homo sapiens
accacagagttttttaaaca

SEQ ID NO: 5352266 - DNA, 23 bp, Homo sapiens
accacagatgtgtctgggagagc

SEQ ID NO: 5352267 - DNA, 23 bp, Homo sapiens
accacagcaacgatcacaaatga

SEQ ID NO: 5352268 - DNA, 14 bp, Homo sapiens
accacagcaactga

SEQ ID NO: 5352269 - DNA, 18 bp, Homo sapiens
accacagcaaggcacctg

SEQ ID NO: 5352270 - DNA, 18 bp, Homo sapiens
accacagcaattggctcc

SEQ ID NO: 5352271 - DNA, 16 bp, Homo sapiens
accacagcacagccaa

SEQ ID NO: 5352272 - DNA, 10 bp, Homo sapiens
accacagcag

SEQ ID NO: 5352273 - DNA, 17 bp, Homo sapiens
accacagcagacaccat

SEQ ID NO: 5352274 - DNA, 11 bp, Homo sapiens
accacagcagt

SEQ ID NO: 5352275 - DNA, 12 bp, Homo sapiens
accacagcatcg

SEQ ID NO: 5352276 - DNA, 20 bp, Homo sapiens
accacagccagcacctggca

SEQ ID NO: 5352277 - DNA, 14 bp, Homo sapiens
accacagccctgtc

SEQ ID NO: 5352278 - DNA, 16 bp, Homo sapiens
accacagccctgtcag

SEQ ID NO: 5352279 - DNA, 23 bp, Homo sapiens
accacagccgggtgtgtgtctgc

SEQ ID NO: 5352280 - DNA, 13 bp, Homo sapiens
accacagcctcca

SEQ ID NO: 5352281 - DNA, 20 bp, Homo sapiens
accacagcctccccttccca

SEQ ID NO: 5352282 - DNA, 12 bp, Homo sapiens
accacagctcct

SEQ ID NO: 5352283 - DNA, 16 bp, Homo sapiens
accacagctgcagcca

SEQ ID NO: 5352284 - DNA, 12 bp, Homo sapiens
accacagctgcc

SEQ ID NO: 5352285 - DNA, 13 bp, Homo sapiens
accacagctgcct

SEQ ID NO: 5352286 - DNA, 20 bp, Homo sapiens
accacagctgcctccgggcc

SEQ ID NO: 5352287 - DNA, 13 bp, Homo sapiens
accacagctgctg

SEQ ID NO: 5352288 - DNA, 15 bp, Homo sapiens
accacagctgctgga

SEQ ID NO: 5352289 - DNA, 13 bp, Homo sapiens
accacagctgggc

SEQ ID NO: 5352290 - DNA, 20 bp, Homo sapiens
accacagctgggcagggtga

SEQ ID NO: 5352291 - DNA, 17 bp, Homo sapiens
accacaggaagatggga

SEQ ID NO: 5352292 - DNA, 14 bp, Homo sapiens
accacaggaagccg

SEQ ID NO: 5352293 - DNA, 17 bp, Homo sapiens
accacaggatgcatatt

SEQ ID NO: 5352294 - DNA, 17 bp, Homo sapiens
accacaggcatctacac

SEQ ID NO: 5352295 - DNA, 15 bp, Homo sapiens
accacaggcccttgg

SEQ ID NO: 5352296 - DNA, 13 bp, Homo sapiens
accacaggctgcc

SEQ ID NO: 5352297 - DNA, 18 bp, Homo sapiens
accacagggccagaggga

SEQ ID NO: 5352298 - DNA, 19 bp, Homo sapiens
accacagggccagagggag

SEQ ID NO: 5352299 - DNA, 18 bp, Homo sapiens
accacagggccttgaatc

SEQ ID NO: 5352300 - DNA, 22 bp, Homo sapiens
accacagggttcaaaatgtctg

SEQ ID NO: 5352301 - DNA, 15 bp, Homo sapiens
accacaggtgcccgc

SEQ ID NO: 5352302 - DNA, 16 bp, Homo sapiens
accacagtcagtggag

SEQ ID NO: 5352303 - DNA, 18 bp, Homo sapiens
accacagtccctcacctc

SEQ ID NO: 5352304 - DNA, 19 bp, Homo sapiens
accacagtgagcctgagag

SEQ ID NO: 5352305 - DNA, 11 bp, Homo sapiens
accacagtgtc

SEQ ID NO: 5352306 - DNA, 19 bp, Homo sapiens
accacatagcatgcttcct

SEQ ID NO: 5352307 - DNA, 22 bp, Homo sapiens
accacatagcatgcttcctttc

SEQ ID NO: 5352308 - DNA, 23 bp, Homo sapiens
accacatagcatgcttcctttct

SEQ ID NO: 5352309 - DNA, 16 bp, Homo sapiens
accacatataacactt

SEQ ID NO: 5352310 - DNA, 22 bp, Homo sapiens
accacatataacacttaacttc

SEQ ID NO: 5352311 - DNA, 17 bp, Homo sapiens
accacatcaaataagaa

SEQ ID NO: 5352312 - DNA, 22 bp, Homo sapiens
accacatcctccgtccagccgc

SEQ ID NO: 5352313 - DNA, 16 bp, Homo sapiens
accacatctaagcctg

SEQ ID NO: 5352314 - DNA, 20 bp, Homo sapiens
accacatcttgctctgctga

SEQ ID NO: 5352315 - DNA, 14 bp, Homo sapiens
accacatgccactg

SEQ ID NO: 5352316 - DNA, 18 bp, Homo sapiens
accacatgccactgcctg

SEQ ID NO: 5352317 - DNA, 11 bp, Homo sapiens
accacatgggc

SEQ ID NO: 5352318 - DNA, 15 bp, Homo sapiens
accacatgggctggg

SEQ ID NO: 5352319 - DNA, 17 bp, Homo sapiens
accacatgggctggggg

SEQ ID NO: 5352320 - DNA, 24 bp, Homo sapiens
accacatggtccatttcatgtgat

SEQ ID NO: 5352321 - DNA, 14 bp, Homo sapiens
accacatgtcccag

SEQ ID NO: 5352322 - DNA, 17 bp, Homo sapiens
accacatgtcccagatc

SEQ ID NO: 5352323 - DNA, 15 bp, Homo sapiens
accacattccatgac

SEQ ID NO: 5352324 - DNA, 14 bp, Homo sapiens
accacattgcctca

SEQ ID NO: 5352325 - DNA, 15 bp, Homo sapiens
accacattgcctcat

SEQ ID NO: 5352326 - DNA, 24 bp, Homo sapiens
accacattggagatgtttagtaat

SEQ ID NO: 5352327 - DNA, 18 bp, Homo sapiens
accacattggggaaattt

SEQ ID NO: 5352328 - DNA, 18 bp, Homo sapiens
accacatttctaagcctt

SEQ ID NO: 5352329 - DNA, 23 bp, Homo sapiens
accacattttaggatctcgcctg

SEQ ID NO: 5352330 - DNA, 14 bp, Homo sapiens
accaccaaaaacaa

SEQ ID NO: 5352331 - DNA, 11 bp, Homo sapiens
accaccaaagt

SEQ ID NO: 5352332 - DNA, 13 bp, Homo sapiens
accaccaaatgac

SEQ ID NO: 5352333 - DNA, 16 bp, Homo sapiens
accaccaacacacagg

SEQ ID NO: 5352334 - DNA, 19 bp, Homo sapiens
accaccaactactacctgt

SEQ ID NO: 5352335 - DNA, 12 bp, Homo sapiens
accaccacacca

SEQ ID NO: 5352336 - DNA, 16 bp, Homo sapiens
accaccactggccacc

SEQ ID NO: 5352337 - DNA, 24 bp, Homo sapiens
accaccactggccaccaggctggc

SEQ ID NO: 5352338 - DNA, 15 bp, Homo sapiens
accaccactgtccct

SEQ ID NO: 5352339 - DNA, 21 bp, Homo sapiens
accaccactgtccctaccact

SEQ ID NO: 5352340 - DNA, 13 bp, Homo sapiens
accaccagaagcc

SEQ ID NO: 5352341 - DNA, 15 bp, Homo sapiens
accaccagaagccca

SEQ ID NO: 5352342 - DNA, 17 bp, Homo sapiens
accaccagaagcccaga

SEQ ID NO: 5352343 - DNA, 12 bp, Homo sapiens
accaccagcagg

SEQ ID NO: 5352344 - DNA, 14 bp, Homo sapiens
accaccagcaggca

SEQ ID NO: 5352345 - DNA, 16 bp, Homo sapiens
accaccagcaggcagg

SEQ ID NO: 5352346 - DNA, 10 bp, Homo sapiens
accaccagcg

SEQ ID NO: 5352347 - DNA, 19 bp, Homo sapiens
accaccaggactgaaagaa

SEQ ID NO: 5352348 - DNA, 12 bp, Homo sapiens
accaccaggagc

SEQ ID NO: 5352349 - DNA, 15 bp, Homo sapiens
accaccaggagcagc

SEQ ID NO: 5352350 - DNA, 20 bp, Homo sapiens
accaccagggcatctctggg

SEQ ID NO: 5352351 - DNA, 18 bp, Homo sapiens
accaccagggtcccagga

SEQ ID NO: 5352352 - DNA, 14 bp, Homo sapiens
accaccagggtgga

SEQ ID NO: 5352353 - DNA, 21 bp, Homo sapiens
accaccagggtggaccaggcc

SEQ ID NO: 5352354 - DNA, 16 bp, Homo sapiens
accaccatgcccagct

SEQ ID NO: 5352355 - DNA, 16 bp, Homo sapiens
accacccacaaagaaa

SEQ ID NO: 5352356 - DNA, 13 bp, Homo sapiens
accacccacccca

SEQ ID NO: 5352357 - DNA, 11 bp, Homo sapiens
accacccagcc

SEQ ID NO: 5352358 - DNA, 12 bp, Homo sapiens
accacccagccc

SEQ ID NO: 5352359 - DNA, 15 bp, Homo sapiens
accagccagccctgg

SEQ ID NO: 5352360 - DNA, 11 bp, Homo sapiens
accagccaggc

SEQ ID NO: 5352361 - DNA, 14 bp, Homo sapiens
accagccaggcaga

SEQ ID NO: 5352362 - DNA, 17 bp, Homo sapiens
accagccagtaaatggg

SEQ ID NO: 5352363 - DNA, 15 bp, Homo sapiens
accagccatcatgtg

SEQ ID NO: 5352364 - DNA, 20 bp, Homo sapiens
accagccatcatgtgcctgg

SEQ ID NO: 5352365 - DNA, 16 bp, Homo sapiens
accagccatcctccct

SEQ ID NO: 5352366 - DNA, 14 bp, Homo sapiens
accagcccacagca

SEQ ID NO: 5352367 - DNA, 22 bp, Homo sapiens
accagcccacgctgactacagg

SEQ ID NO: 5352368 - DNA, 11 bp, Homo sapiens
accagcccagc

SEQ ID NO: 5352369 - DNA, 13 bp, Homo sapiens
accagcccagcct

SEQ ID NO: 5352370 - DNA, 15 bp, Homo sapiens
accagcccagcctgc

SEQ ID NO: 5352371 - DNA, 19 bp, Homo sapiens
accagcccattggccgagc

SEQ ID NO: 5352372 - DNA, 16 bp, Homo sapiens
accagccccactgcca

SEQ ID NO: 5352373 - DNA, 13 bp, Homo sapiens
accagccccagca

SEQ ID NO: 5352374 - DNA, 14 bp, Homo sapiens
accagccccagcaa

SEQ ID NO: 5352375 - DNA, 15 bp, Homo sapiens
accagccccagcaag

SEQ ID NO: 5352376 - DNA, 17 bp, Homo sapiens
accagccccagcaagag

SEQ ID NO: 5352377 - DNA, 18 bp, Homo sapiens
accagccccagcaagagc

SEQ ID NO: 5352378 - DNA, 18 bp, Homo sapiens
accagccccagtgcccac

SEQ ID NO: 5352379 - DNA, 21 bp, Homo sapiens
accagcccccaggaagacatt

SEQ ID NO: 5352380 - DNA, 18 bp, Homo sapiens
accagcccccgccccaga

SEQ ID NO: 5352381 - DNA, 14 bp, Homo sapiens
accagccccctgga

SEQ ID NO: 5352382 - DNA, 15 bp, Homo sapiens
accagccccctggat

SEQ ID NO: 5352383 - DNA, 17 bp, Homo sapiens
accagccccctggatgg

SEQ ID NO: 5352384 - DNA, 21 bp, Homo sapiens
accagccccctggatgggcat

SEQ ID NO: 5352385 - DNA, 15 bp, Homo sapiens
accagccccttcctg

SEQ ID NO: 5352386 - DNA, 18 bp, Homo sapiens
accagcccgacagtgcca

SEQ ID NO: 5352387 - DNA, 22 bp, Homo sapiens
accagcccgacagtgccatccc

SEQ ID NO: 5352388 - DNA, 14 bp, Homo sapiens
accagcccggcctg

SEQ ID NO: 5352389 - DNA, 21 bp, Homo sapiens
accagcccggcctgctcccag

SEQ ID NO: 5352390 - DNA, 20 bp, Homo sapiens
accagccctagctgtcccat

SEQ ID NO: 5352391 - DNA, 11 bp, Homo sapiens
accagccctcc

SEQ ID NO: 5352392 - DNA, 20 bp, Homo sapiens
accagccctccagagcagga

SEQ ID NO: 5352393 - DNA, 15 bp, Homo sapiens
accagccctgcacga

SEQ ID NO: 5352394 - DNA, 14 bp, Homo sapiens
accagccctgcagc

SEQ ID NO: 5352395 - DNA, 16 bp, Homo sapiens
accagccctgctgctt

SEQ ID NO: 5352396 - DNA, 11 bp, Homo sapiens
accagccctgg

SEQ ID NO: 5352397 - DNA, 19 bp, Homo sapiens
accagccgaccggccctgc

SEQ ID NO: 5352398 - DNA, 15 bp, Homo sapiens
accagccgctgcagg

SEQ ID NO: 5352399 - DNA, 16 bp, Homo sapiens
accagccgctgcaggg

SEQ ID NO: 5352400 - DNA, 22 bp, Homo sapiens
accagcctcaaaaacgccctca

SEQ ID NO: 5352401 - DNA, 20 bp, Homo sapiens
accagcctccatgctgcctc

SEQ ID NO: 5352402 - DNA, 21 bp, Homo sapiens
accagcctccatgctgcctcc

SEQ ID NO: 5352403 - DNA, 17 bp, Homo sapiens
accagcctcgtcttcat

SEQ ID NO: 5352404 - DNA, 14 bp, Homo sapiens
accagcctctgctc

SEQ ID NO: 5352405 - DNA, 13 bp, Homo sapiens
accagcctgactg

SEQ ID NO: 5352406 - DNA, 15 bp, Homo sapiens
accagcctgactgca

SEQ ID NO: 5352407 - DNA, 17 bp, Homo sapiens
accagcctgactgcaca

SEQ ID NO: 5352408 - DNA, 12 bp, Homo sapiens
accagcctgagc

SEQ ID NO: 5352409 - DNA, 14 bp, Homo sapiens
accagcctgagcca

SEQ ID NO: 5352410 - DNA, 14 bp, Homo sapiens
accagcctgccagg

SEQ ID NO: 5352411 - DNA, 17 bp, Homo sapiens
accagcctgccaggccc

SEQ ID NO: 5352412 - DNA, 12 bp, Homo sapiens
accagcctggcc

SEQ ID NO: 5352413 - DNA, 13 bp, Homo sapiens
accagcctggcca

SEQ ID NO: 5352414 - DNA, 17 bp, Homo sapiens
accagcctggccaacat

SEQ ID NO: 5352415 - DNA, 18 bp, Homo sapiens
accagcctggccaacatg

SEQ ID NO: 5352416 - DNA, 15 bp, Homo sapiens
accagcctggggcct

SEQ ID NO: 5352417 - DNA, 16 bp, Homo sapiens
accagcctggggcctt

SEQ ID NO: 5352418 - DNA, 18 bp, Homo sapiens
accagcctgtaccttgct

SEQ ID NO: 5352419 - DNA, 23 bp, Homo sapiens
accagcctgttggacccgctctg

SEQ ID NO: 5352420 - DNA, 15 bp, Homo sapiens
accagccttacagct

SEQ ID NO: 5352421 - DNA, 14 bp, Homo sapiens
accagccttgctct

SEQ ID NO: 5352422 - DNA, 23 bp, Homo sapiens
accagccttgctctcttcaataa

SEQ ID NO: 5352423 - DNA, 18 bp, Homo sapiens
accagccttggtgccacc

SEQ ID NO: 5352424 - DNA, 17 bp, Homo sapiens
accagcgcccccactcc

SEQ ID NO: 5352425 - DNA, 20 bp, Homo sapiens
accagcgcccccactcctcc

SEQ ID NO: 5352426 - DNA, 13 bp, Homo sapiens
accagcggctgct

SEQ ID NO: 5352427 - DNA, 14 bp, Homo sapiens
accagcggctgctc

SEQ ID NO: 5352428 - DNA, 21 bp, Homo sapiens
accagcgtatatataagaaag

SEQ ID NO: 5352429 - DNA, 23 bp, Homo sapiens
accagcgtatatataagaaagac

SEQ ID NO: 5352430 - DNA, 18 bp, Homo sapiens
accagcgttcccttctcc

SEQ ID NO: 5352431 - DNA, 16 bp, Homo sapiens
accagctaccctgtgt

SEQ ID NO: 5352432 - DNA, 14 bp, Homo sapiens
accagctacttgat

SEQ ID NO: 5352433 - DNA, 15 bp, Homo sapiens
accagctatctgtca

SEQ ID NO: 5352434 - DNA, 23 bp, Homo sapiens
accagctatctgtcatctctctg

SEQ ID NO: 5352435 - DNA, 21 bp, Homo sapiens
accagctcagaggcccaggaa

SEQ ID NO: 5352436 - DNA, 12 bp, Homo sapiens
accagctcagcc

SEQ ID NO: 5352437 - DNA, 13 bp, Homo sapiens
accagctcagccc

SEQ ID NO: 5352438 - DNA, 22 bp, Homo sapiens
accagctcagccccggccactc

SEQ ID NO: 5352439 - DNA, 23 bp, Homo sapiens
accagctcaggacagatgccaca

SEQ ID NO: 5352440 - DNA, 18 bp, Homo sapiens
accagctcaggggacact

SEQ ID NO: 5352441 - DNA, 20 bp, Homo sapiens
accagctcaggggacactgg

SEQ ID NO: 5352442 - DNA, 14 bp, Homo sapiens
accagctcatctcc

SEQ ID NO: 5352443 - DNA, 15 bp, Homo sapiens
accagctcatctcca

SEQ ID NO: 5352444 - DNA, 21 bp, Homo sapiens
accagctccacacattccagc

SEQ ID NO: 5352445 - DNA, 18 bp, Homo sapiens
accagctccactggcctg

SEQ ID NO: 5352446 - DNA, 19 bp, Homo sapiens
accagctccactggcctgc

SEQ ID NO: 5352447 - DNA, 10 bp, Homo sapiens
accagctccc

SEQ ID NO: 5352448 - DNA, 19 bp, Homo sapiens
accagctcccaacagaggc

SEQ ID NO: 5352449 - DNA, 20 bp, Homo sapiens
accagctcccaacagaggcc

SEQ ID NO: 5352450 - DNA, 22 bp, Homo sapiens
accagctcccaacagaggcctc

SEQ ID NO: 5352451 - DNA, 15 bp, Homo sapiens
accagctcccagggt

SEQ ID NO: 5352452 - DNA, 19 bp, Homo sapiens
accagctccccctccctcc

SEQ ID NO: 5352453 - DNA, 20 bp, Homo sapiens
accagctccccctccctccc

SEQ ID NO: 5352454 - DNA, 19 bp, Homo sapiens
accagctcctccagccctg

SEQ ID NO: 5352455 - DNA, 20 bp, Homo sapiens
accagctcctccagccctgc

SEQ ID NO: 5352456 - DNA, 13 bp, Homo sapiens
accagctcctccc

SEQ ID NO: 5352457 - DNA, 23 bp, Homo sapiens
accagctcgtttttcagcacccc

SEQ ID NO: 5352458 - DNA, 16 bp, Homo sapiens
accagctctcttcctg

SEQ ID NO: 5352459 - DNA, 13 bp, Homo sapiens
accagctctgtgg

SEQ ID NO: 5352460 - DNA, 14 bp, Homo sapiens
accagctctgtggc

SEQ ID NO: 5352461 - DNA, 17 bp, Homo sapiens
accagctctgtggcctg

SEQ ID NO: 5352462 - DNA, 10 bp, Homo sapiens
accagctgca

SEQ ID NO: 5352463 - DNA, 13 bp, Homo sapiens
accagctgcaaag

SEQ ID NO: 5352464 - DNA, 15 bp, Homo sapiens
accagctgcaaagtg

SEQ ID NO: 5352465 - DNA, 17 bp, Homo sapiens
accagctgcaaagtgtt

SEQ ID NO: 5352466 - DNA, 14 bp, Homo sapiens
accagctgcagccc

SEQ ID NO: 5352467 - DNA, 14 bp, Homo sapiens
accagctgccaaaa

SEQ ID NO: 5352468 - DNA, 20 bp, Homo sapiens
accagctgccaaaatcgtag

SEQ ID NO: 5352469 - DNA, 19 bp, Homo sapiens
accagctgcgcttgctttt

SEQ ID NO: 5352470 - DNA, 18 bp, Homo sapiens
accagctgctactcataa

SEQ ID NO: 5352471 - DNA, 22 bp, Homo sapiens
accagctgctccgaggacccag

SEQ ID NO: 5352472 - DNA, 14 bp, Homo sapiens
accagctgctctgc

SEQ ID NO: 5352473 - DNA, 19 bp, Homo sapiens
accagctggagtgagggcc

SEQ ID NO: 5352474 - DNA, 16 bp, Homo sapiens
accagctggctctgca

SEQ ID NO: 5352475 - DNA, 17 bp, Homo sapiens
accagctggctctgcag

SEQ ID NO: 5352476 - DNA, 19 bp, Homo sapiens
accagctggctctgcagca

SEQ ID NO: 5352477 - DNA, 22 bp, Homo sapiens
accagctgttctgtcccttgga

SEQ ID NO: 5352478 - DNA, 23 bp, Homo sapiens
accagctgttctgtcccttggag

SEQ ID NO: 5352479 - DNA, 20 bp, Homo sapiens
accagcttaaaacacttctt

SEQ ID NO: 5352480 - DNA, 15 bp, Homo sapiens
accagcttccttcag

SEQ ID NO: 5352481 - DNA, 18 bp, Homo sapiens
accagcttccttcagaga

SEQ ID NO: 5352482 - DNA, 23 bp, Homo sapiens
accagcttccttcagagagcagt

SEQ ID NO: 5352483 - DNA, 17 bp, Homo sapiens
accagcttccttcatct

SEQ ID NO: 5352484 - DNA, 16 bp, Homo sapiens
accagcttctttctcg

SEQ ID NO: 5352485 - DNA, 19 bp, Homo sapiens
accagcttggctcaggctg

SEQ ID NO: 5352486 - DNA, 20 bp, Homo sapiens
accagcttggctcaggctga

SEQ ID NO: 5352487 - DNA, 21 bp, Homo sapiens
accagcttgtatgcaatggat

SEQ ID NO: 5352488 - DNA, 18 bp, Homo sapiens
accagcttgttctgggct

SEQ ID NO: 5352489 - DNA, 20 bp, Homo sapiens
accaggaaagccacacggag

SEQ ID NO: 5352490 - DNA, 18 bp, Homo sapiens
accaggaaaggcttggct

SEQ ID NO: 5352491 - DNA, 17 bp, Homo sapiens
accaggaacctcttcag

SEQ ID NO: 5352492 - DNA, 19 bp, Homo sapiens
accaggaagaaggacttgt

SEQ ID NO: 5352493 - DNA, 17 bp, Homo sapiens
accaggacaggaccaga

SEQ ID NO: 5352494 - DNA, 13 bp, Homo sapiens
accaggacccagg

SEQ ID NO: 5352495 - DNA, 22 bp, Homo sapiens
accaggactagggctggagtga

SEQ ID NO: 5352496 - DNA, 19 bp, Homo sapiens
accaggactatagcccagg

SEQ ID NO: 5352497 - DNA, 21 bp, Homo sapiens
accaggactatagcccaggtc

SEQ ID NO: 5352498 - DNA, 17 bp, Homo sapiens
accaggactccctcctc

SEQ ID NO: 5352499 - DNA, 17 bp, Homo sapiens
accaggacttgtgcaga

SEQ ID NO: 5352500 - DNA, 15 bp, Homo sapiens
accaggactttaatc

SEQ ID NO: 5352501 - DNA, 20 bp, Homo sapiens
accaggagaaccactacatg

SEQ ID NO: 5352502 - DNA, 11 bp, Homo sapiens
accaggagaca

SEQ ID NO: 5352503 - DNA, 19 bp, Homo sapiens
accaggagcacctggaccc

SEQ ID NO: 5352504 - DNA, 20 bp, Homo sapiens
accaggagccaggtgtcctg

SEQ ID NO: 5352505 - DNA, 21 bp, Homo sapiens
accaggagctagcccagtccc

SEQ ID NO: 5352506 - DNA, 15 bp, Homo sapiens
accaggagctgctca

SEQ ID NO: 5352507 - DNA, 15 bp, Homo sapiens
accaggaggcctggg

SEQ ID NO: 5352508 - DNA, 18 bp, Homo sapiens
accaggaggcctgggaga

SEQ ID NO: 5352509 - DNA, 18 bp, Homo sapiens
accaggagggcactggag

SEQ ID NO: 5352510 - DNA, 19 bp, Homo sapiens
accaggatagagactggaa

SEQ ID NO: 5352511 - DNA, 19 bp, Homo sapiens
accaggatccagcctcact

SEQ ID NO: 5352512 - DNA, 14 bp, Homo sapiens
accaggatgaaggc

SEQ ID NO: 5352513 - DNA, 13 bp, Homo sapiens
accaggatggagc

SEQ ID NO: 5352514 - DNA, 14 bp, Homo sapiens
accaggatggccct

SEQ ID NO: 5352515 - DNA, 13 bp, Homo sapiens
accaggatttata

SEQ ID NO: 5352516 - DNA, 14 bp, Homo sapiens
accaggatttattt

SEQ ID NO: 5352517 - DNA, 14 bp, Homo sapiens
accaggcaacctcc

SEQ ID NO: 5352518 - DNA, 16 bp, Homo sapiens
accaggcaacctccca

SEQ ID NO: 5352519 - DNA, 20 bp, Homo sapiens
accaggcaacctcccatccc

SEQ ID NO: 5352520 - DNA, 23 bp, Homo sapiens
accaggcacctcccctcccgccc

SEQ ID NO: 5352521 - DNA, 16 bp, Homo sapiens
accaggcacctcttcc

SEQ ID NO: 5352522 - DNA, 21 bp, Homo sapiens
accaggcagcctctggggggt

SEQ ID NO: 5352523 - DNA, 17 bp, Homo sapiens
accaggcagctccagct

SEQ ID NO: 5352524 - DNA, 18 bp, Homo sapiens
accaggcagctccagctg

SEQ ID NO: 5352525 - DNA, 12 bp, Homo sapiens
accaggcagctg

SEQ ID NO: 5352526 - DNA, 14 bp, Homo sapiens
accaggcagctgag

SEQ ID NO: 5352527 - DNA, 18 bp, Homo sapiens
accaggcagctgagacca

SEQ ID NO: 5352528 - DNA, 11 bp, Homo sapiens
accaggccaat

SEQ ID NO: 5352529 - DNA, 12 bp, Homo sapiens
accaggccaatc

SEQ ID NO: 5352530 - DNA, 12 bp, Homo sapiens
accaggccacca

SEQ ID NO: 5352531 - DNA, 13 bp, Homo sapiens
accaggccagctc

SEQ ID NO: 5352532 - DNA, 19 bp, Homo sapiens
accaggcccaaggagggtc

SEQ ID NO: 5352533 - DNA, 22 bp, Homo sapiens
accaggcccacgaggagcagca

SEQ ID NO: 5352534 - DNA, 16 bp, Homo sapiens
accaggcccagccagt

SEQ ID NO: 5352535 - DNA, 16 bp, Homo sapiens
accaggccccagcctc

SEQ ID NO: 5352536 - DNA, 17 bp, Homo sapiens
accaggccccagcctcc

SEQ ID NO: 5352537 - DNA, 15 bp, Homo sapiens
accaggccctggcta

SEQ ID NO: 5352538 - DNA, 19 bp, Homo sapiens
accaggccgccccagcctc

SEQ ID NO: 5352539 - DNA, 17 bp, Homo sapiens
acccaaagctgagcctg

SEQ ID NO: 5352540 - DNA, 18 bp, Homo sapiens
acccaaagctgagcctgc

SEQ ID NO: 5352541 - DNA, 12 bp, Homo sapiens
acccaaagggtt

SEQ ID NO: 5352542 - DNA, 14 bp, Homo sapiens
acccaaaggtggca

SEQ ID NO: 5352543 - DNA, 23 bp, Homo sapiens
acccaaagtattcttcttttctt

SEQ ID NO: 5352544 - DNA, 17 bp, Homo sapiens
acccaaatcacatctca

SEQ ID NO: 5352545 - DNA, 20 bp, Homo sapiens
acccaaattataagggccct

SEQ ID NO: 5352546 - DNA, 14 bp, Homo sapiens
acccaacaatgagt

SEQ ID NO: 5352547 - DNA, 16 bp, Homo sapiens
acccaaccacagagga

SEQ ID NO: 5352548 - DNA, 23 bp, Homo sapiens
acccaaccacatcccactcacaa

SEQ ID NO: 5352549 - DNA, 12 bp, Homo sapiens
acccaaccactc

SEQ ID NO: 5352550 - DNA, 15 bp, Homo sapiens
acccaacccaaacca

SEQ ID NO: 5352551 - DNA, 18 bp, Homo sapiens
acccaacccaatccctct

SEQ ID NO: 5352552 - DNA, 23 bp, Homo sapiens
acccaacccatgcccctgacaga

SEQ ID NO: 5352553 - DNA, 22 bp, Homo sapiens
acccaaccctatctcctgacag

SEQ ID NO: 5352554 - DNA, 13 bp, Homo sapiens
acccaacctgtcc

SEQ ID NO: 5352555 - DNA, 13 bp, Homo sapiens
acccaacgctcca

SEQ ID NO: 5352556 - DNA, 20 bp, Homo sapiens
acccaactactgagctgaga

SEQ ID NO: 5352557 - DNA, 19 bp, Homo sapiens
acccaactagctctatgtt

SEQ ID NO: 5352558 - DNA, 19 bp, Homo sapiens
acccaactgacttctgcta

SEQ ID NO: 5352559 - DNA, 18 bp, Homo sapiens
acccaactgatcctgctc

SEQ ID NO: 5352560 - DNA, 22 bp, Homo sapiens
acccaactgatcctgctccagc

SEQ ID NO: 5352561 - DNA, 20 bp, Homo sapiens
acccaactttctcactgctg

SEQ ID NO: 5352562 - DNA, 21 bp, Homo sapiens
acccaagaactcctgaaatca

SEQ ID NO: 5352563 - DNA, 18 bp, Homo sapiens
acccaagacctcagggca

SEQ ID NO: 5352564 - DNA, 19 bp, Homo sapiens
acccaagacctcagggcac

SEQ ID NO: 5352565 - DNA, 18 bp, Homo sapiens
acccaagagcaagggctt

SEQ ID NO: 5352566 - DNA, 20 bp, Homo sapiens
acccaagataaaagaatggc

SEQ ID NO: 5352567 - DNA, 15 bp, Homo sapiens
acccaagcacaaact

SEQ ID NO: 5352568 - DNA, 22 bp, Homo sapiens
acccaagcacaaactgtcgtct

SEQ ID NO: 5352569 - DNA, 14 bp, Homo sapiens
acccaagcccaaac

SEQ ID NO: 5352570 - DNA, 15 bp, Homo sapiens
acccaagcccaaact

SEQ ID NO: 5352571 - DNA, 22 bp, Homo sapiens
acccaagccctgaggcctgagg

SEQ ID NO: 5352572 - DNA, 15 bp, Homo sapiens
acccaagcctgctgg

SEQ ID NO: 5352573 - DNA, 15 bp, Homo sapiens
acccaagctccaacc

SEQ ID NO: 5352574 - DNA, 16 bp, Homo sapiens
acccaagctctgggga

SEQ ID NO: 5352575 - DNA, 12 bp, Homo sapiens
acccaaggagaa

SEQ ID NO: 5352576 - DNA, 14 bp, Homo sapiens
acccaaggagaacg

SEQ ID NO: 5352577 - DNA, 19 bp, Homo sapiens
acccaaggagcacaggtcc

SEQ ID NO: 5352578 - DNA, 22 bp, Homo sapiens
acccaaggagcacaggtcccac

SEQ ID NO: 5352579 - DNA, 15 bp, Homo sapiens
acccaaggaggaaaa

SEQ ID NO: 5352580 - DNA, 15 bp, Homo sapiens
acccaaggattttta

SEQ ID NO: 5352581 - DNA, 17 bp, Homo sapiens
acccaaggatttttaaa

SEQ ID NO: 5352582 - DNA, 17 bp, Homo sapiens
acccaagggcagaaagt

SEQ ID NO: 5352583 - DNA, 20 bp, Homo sapiens
acccaagggcagaaagtaga

SEQ ID NO: 5352584 - DNA, 15 bp, Homo sapiens
acccaaggtgaggtg

SEQ ID NO: 5352585 - DNA, 19 bp, Homo sapiens
acccaaggtggtcttggag

SEQ ID NO: 5352586 - DNA, 16 bp, Homo sapiens
acccaagtccctgtca

SEQ ID NO: 5352587 - DNA, 22 bp, Homo sapiens
acccaagtcttgagcaatgttt

SEQ ID NO: 5352588 - DNA, 23 bp, Homo sapiens
acccaagtggacgttaggccagg

SEQ ID NO: 5352589 - DNA, 24 bp, Homo sapiens
acccaagtggacgttaggccaggc

SEQ ID NO: 5352590 - DNA, 19 bp, Homo sapiens
acccaagtggatattttct

SEQ ID NO: 5352591 - DNA, 19 bp, Homo sapiens
acccaagtggcccccaccc

SEQ ID NO: 5352592 - DNA, 14 bp, Homo sapiens
acccaataaaactg

SEQ ID NO: 5352593 - DNA, 15 bp, Homo sapiens
acccaatacttttgt

SEQ ID NO: 5352594 - DNA, 16 bp, Homo sapiens
acccaatccctctcca

SEQ ID NO: 5352595 - DNA, 17 bp, Homo sapiens
acccaatgcctgtgaag

SEQ ID NO: 5352596 - DNA, 16 bp, Homo sapiens
acccaatgctgctcca

SEQ ID NO: 5352597 - DNA, 19 bp, Homo sapiens
acccaatgggaccgtgccc

SEQ ID NO: 5352598 - DNA, 21 bp, Homo sapiens
acccaatgggaccgtgcccca

SEQ ID NO: 5352599 - DNA, 19 bp, Homo sapiens
acccaatgtctcccacacc

SEQ ID NO: 5352600 - DNA, 21 bp, Homo sapiens
acccaattcaggactggctca

SEQ ID NO: 5352601 - DNA, 18 bp, Homo sapiens
acccaatttccaagacag

SEQ ID NO: 5352602 - DNA, 14 bp, Homo sapiens
acccaattttaaaa

SEQ ID NO: 5352603 - DNA, 22 bp, Homo sapiens
acccaattttaaaaaataacat

SEQ ID NO: 5352604 - DNA, 14 bp, Homo sapiens
acccacaaaaatgt

SEQ ID NO: 5352605 - DNA, 12 bp, Homo sapiens
acccacaaactc

SEQ ID NO: 5352606 - DNA, 16 bp, Homo sapiens
acccacaaactccagg

SEQ ID NO: 5352607 - DNA, 18 bp, Homo sapiens
acccacaaactccaggct

SEQ ID NO: 5352608 - DNA, 17 bp, Homo sapiens
acccacaagaaatgaaa

SEQ ID NO: 5352609 - DNA, 19 bp, Homo sapiens
acccacaagaactcctccc

SEQ ID NO: 5352610 - DNA, 16 bp, Homo sapiens
acccacaatctgagca

SEQ ID NO: 5352611 - DNA, 22 bp, Homo sapiens
acccacaattgccttggagatc

SEQ ID NO: 5352612 - DNA, 18 bp, Homo sapiens
acccacacaaataacaag

SEQ ID NO: 5352613 - DNA, 17 bp, Homo sapiens
acccacacagctgccct

SEQ ID NO: 5352614 - DNA, 19 bp, Homo sapiens
acccacacattccagggct

SEQ ID NO: 5352615 - DNA, 23 bp, Homo sapiens
acccacacattccagggctgggg

SEQ ID NO: 5352616 - DNA, 18 bp, Homo sapiens
acccacaccctacagcag

SEQ ID NO: 5352617 - DNA, 18 bp, Homo sapiens
acccacacgactgcaaca

SEQ ID NO: 5352618 - DNA, 19 bp, Homo sapiens
acccacactgcaacaggaa

SEQ ID NO: 5352619 - DNA, 14 bp, Homo sapiens
acccacagaacttg

SEQ ID NO: 5352620 - DNA, 14 bp, Homo sapiens
acccacagagcaag

SEQ ID NO: 5352621 - DNA, 20 bp, Homo sapiens
acccacagatgtctctgggg

SEQ ID NO: 5352622 - DNA, 14 bp, Homo sapiens
acccacagccatag

SEQ ID NO: 5352623 - DNA, 12 bp, Homo sapiens
acccacagcctc

SEQ ID NO: 5352624 - DNA, 17 bp, Homo sapiens
acccacagcctccaagt

SEQ ID NO: 5352625 - DNA, 12 bp, Homo sapiens
acccacagctca

SEQ ID NO: 5352626 - DNA, 13 bp, Homo sapiens
acccacagctcag

SEQ ID NO: 5352627 - DNA, 18 bp, Homo sapiens
acccacagctcagctgcc

SEQ ID NO: 5352628 - DNA, 21 bp, Homo sapiens
acccacagctctgggcctctt

SEQ ID NO: 5352629 - DNA, 22 bp, Homo sapiens
acccacagctctgggcctcttt

SEQ ID NO: 5352630 - DNA, 12 bp, Homo sapiens
acccacagggcc

SEQ ID NO: 5352631 - DNA, 13 bp, Homo sapiens
acccacagggcct

SEQ ID NO: 5352632 - DNA, 21 bp, Homo sapiens
acccacagggcctgactttta

SEQ ID NO: 5352633 - DNA, 22 bp, Homo sapiens
acccacagggcctgacttttac

SEQ ID NO: 5352634 - DNA, 21 bp, Homo sapiens
acccacaggtgaggggcagga

SEQ ID NO: 5352635 - DNA, 23 bp, Homo sapiens
acccacagtgagaggggagggct

SEQ ID NO: 5352636 - DNA, 13 bp, Homo sapiens
acccacagtttta

SEQ ID NO: 5352637 - DNA, 17 bp, Homo sapiens
acccacagttttagttg

SEQ ID NO: 5352638 - DNA, 21 bp, Homo sapiens
acccacataaaagccccagct

SEQ ID NO: 5352639 - DNA, 12 bp, Homo sapiens
acccacataaac

SEQ ID NO: 5352640 - DNA, 18 bp, Homo sapiens
acccacattactttttat

SEQ ID NO: 5352641 - DNA, 23 bp, Homo sapiens
acccaccaaatgcctctgccttg

SEQ ID NO: 5352642 - DNA, 15 bp, Homo sapiens
acccaccagcctaag

SEQ ID NO: 5352643 - DNA, 16 bp, Homo sapiens
acccaccagctccaca

SEQ ID NO: 5352644 - DNA, 19 bp, Homo sapiens
acccaccaggccagctcag

SEQ ID NO: 5352645 - DNA, 15 bp, Homo sapiens
acccaccagtgcctt

SEQ ID NO: 5352646 - DNA, 14 bp, Homo sapiens
acccaccatccttc

SEQ ID NO: 5352647 - DNA, 15 bp, Homo sapiens
acccaccatccttcc

SEQ ID NO: 5352648 - DNA, 16 bp, Homo sapiens
acccacccagcccctc

SEQ ID NO: 5352649 - DNA, 19 bp, Homo sapiens
acccacccagcccctctcc

SEQ ID NO: 5352650 - DNA, 14 bp, Homo sapiens
acccacccatcttc

SEQ ID NO: 5352651 - DNA, 20 bp, Homo sapiens
acccacccatcttcctgctg

SEQ ID NO: 5352652 - DNA, 21 bp, Homo sapiens
acccacccatcttcctgctgc

SEQ ID NO: 5352653 - DNA, 21 bp, Homo sapiens
acccaccccaactctccccag

SEQ ID NO: 5352654 - DNA, 20 bp, Homo sapiens
acccaccccacgcccgcacc

SEQ ID NO: 5352655 - DNA, 15 bp, Homo sapiens
acccaccccagcaca

SEQ ID NO: 5352656 - DNA, 14 bp, Homo sapiens
acccaccccatgga

SEQ ID NO: 5352657 - DNA, 10 bp, Homo sapiens
acccaccccc

SEQ ID NO: 5352658 - DNA, 17 bp, Homo sapiens
acccacccccacccaag

SEQ ID NO: 5352659 - DNA, 12 bp, Homo sapiens
acccacccccag

SEQ ID NO: 5352660 - DNA, 15 bp, Homo sapiens
acccacccccagcct

SEQ ID NO: 5352661 - DNA, 22 bp, Homo sapiens
acccacccccaggcctcctagg

SEQ ID NO: 5352662 - DNA, 21 bp, Homo sapiens
acccaccccctctttgtgtac

SEQ ID NO: 5352663 - DNA, 21 bp, Homo sapiens
acccaccccctgcctggttct

SEQ ID NO: 5352664 - DNA, 13 bp, Homo sapiens
acccacccccttt

SEQ ID NO: 5352665 - DNA, 17 bp, Homo sapiens
acccaccccctttggtt

SEQ ID NO: 5352666 - DNA, 16 bp, Homo sapiens
acccacccctcctggg

SEQ ID NO: 5352667 - DNA, 12 bp, Homo sapiens
acccacccctgc

SEQ ID NO: 5352668 - DNA, 17 bp, Homo sapiens
acccacccctgcccagg

SEQ ID NO: 5352669 - DNA, 16 bp, Homo sapiens
acccacccgacctggc

SEQ ID NO: 5352670 - DNA, 18 bp, Homo sapiens
acccacccgacctggctg

SEQ ID NO: 5352671 - DNA, 23 bp, Homo sapiens
acccacccgacctggctgcccct

SEQ ID NO: 5352672 - DNA, 20 bp, Homo sapiens
acccacccgccttggcctcc

SEQ ID NO: 5352673 - DNA, 20 bp, Homo sapiens
acccaccctaatttgccctt

SEQ ID NO: 5352674 - DNA, 14 bp, Homo sapiens
acccaccctgtgcc

SEQ ID NO: 5352675 - DNA, 22 bp, Homo sapiens
acccaccctgtggctcacagtg

SEQ ID NO: 5352676 - DNA, 21 bp, Homo sapiens
acccaccctttctacttccaa

SEQ ID NO: 5352677 - DNA, 20 bp, Homo sapiens
acccaccctttttttggggt

SEQ ID NO: 5352678 - DNA, 20 bp, Homo sapiens
acccaccgatggagccccca

SEQ ID NO: 5352679 - DNA, 21 bp, Homo sapiens
acccaccgatggagcccccag

SEQ ID NO: 5352680 - DNA, 14 bp, Homo sapiens
acccaccgggccac

SEQ ID NO: 5352681 - DNA, 17 bp, Homo sapiens
acccaccgtccgccctg

SEQ ID NO: 5352682 - DNA, 22 bp, Homo sapiens
acccaccgtccgccctgctcct

SEQ ID NO: 5352683 - DNA, 18 bp, Homo sapiens
acccaccgtctcggccct

SEQ ID NO: 5352684 - DNA, 19 bp, Homo sapiens
acccaccgtctcggccctg

SEQ ID NO: 5352685 - DNA, 20 bp, Homo sapiens
acccaccgtctcggccctga

SEQ ID NO: 5352686 - DNA, 20 bp, Homo sapiens
acccacctccacccagcccc

SEQ ID NO: 5352687 - DNA, 12 bp, Homo sapiens
acccacctcctg

SEQ ID NO: 5352688 - DNA, 20 bp, Homo sapiens
acccacctcctgcggctcag

SEQ ID NO: 5352689 - DNA, 22 bp, Homo sapiens
acccacctcctgcggctcagcc

SEQ ID NO: 5352690 - DNA, 21 bp, Homo sapiens
acccacctctggccctgtgta

SEQ ID NO: 5352691 - DNA, 21 bp, Homo sapiens
acccacctgaggctcagccct

SEQ ID NO: 5352692 - DNA, 19 bp, Homo sapiens
acccacctgcgcttctgct

SEQ ID NO: 5352693 - DNA, 17 bp, Homo sapiens
acccacctgctgagaga

SEQ ID NO: 5352694 - DNA, 14 bp, Homo sapiens
acccacctggagcc

SEQ ID NO: 5352695 - DNA, 15 bp, Homo sapiens
acccacctggagccc

SEQ ID NO: 5352696 - DNA, 13 bp, Homo sapiens
acccacctggctt

SEQ ID NO: 5352697 - DNA, 16 bp, Homo sapiens
acccacctgttttctg

SEQ ID NO: 5352698 - DNA, 17 bp, Homo sapiens
acccacctgttttctga

SEQ ID NO: 5352699 - DNA, 21 bp, Homo sapiens
acccaccttgttggagcctgc

SEQ ID NO: 5352700 - DNA, 17 bp, Homo sapiens
acccacgacctgtcctg

SEQ ID NO: 5352701 - DNA, 18 bp, Homo sapiens
acccacgacctgtcctgt

SEQ ID NO: 5352702 - DNA, 22 bp, Homo sapiens
acccacgacctgtcctgtcttt

SEQ ID NO: 5352703 - DNA, 12 bp, Homo sapiens
acccacgaggat

SEQ ID NO: 5352704 - DNA, 22 bp, Homo sapiens
acccacggagccctccctatgt

SEQ ID NO: 5352705 - DNA, 13 bp, Homo sapiens
acccacggctctc

SEQ ID NO: 5352706 - DNA, 22 bp, Homo sapiens
acccacgtccacgcggccacct

SEQ ID NO: 5352707 - DNA, 21 bp, Homo sapiens
acccacgttctcacacccacc

SEQ ID NO: 5352708 - DNA, 23 bp, Homo sapiens
acccacgtttgttcgcttcctga

SEQ ID NO: 5352709 - DNA, 17 bp, Homo sapiens
acccactaagtaacctc

SEQ ID NO: 5352710 - DNA, 23 bp, Homo sapiens
acccactaattgtaaggtattgc

SEQ ID NO: 5352711 - DNA, 14 bp, Homo sapiens
acccactcaccagg

SEQ ID NO: 5352712 - DNA, 13 bp, Homo sapiens
acccactcagctc

SEQ ID NO: 5352713 - DNA, 15 bp, Homo sapiens
acccactccacacca

SEQ ID NO: 5352714 - DNA, 21 bp, Homo sapiens
acccactccacaccagtaata

SEQ ID NO: 5352715 - DNA, 17 bp, Homo sapiens
acccactcccttcccca

SEQ ID NO: 5352716 - DNA, 19 bp, Homo sapiens
accccaaagagagcactgt

SEQ ID NO: 5352717 - DNA, 18 bp, Homo sapiens
accccaaagccccttgct

SEQ ID NO: 5352718 - DNA, 18 bp, Homo sapiens
accccaaagctttcctgc

SEQ ID NO: 5352719 - DNA, 20 bp, Homo sapiens
accccaaaggaacactgaca

SEQ ID NO: 5352720 - DNA, 16 bp, Homo sapiens
accccaaagtccaggc

SEQ ID NO: 5352721 - DNA, 23 bp, Homo sapiens
accccaaatgctctctcttctta

SEQ ID NO: 5352722 - DNA, 20 bp, Homo sapiens
accccaacctctgttcccca

SEQ ID NO: 5352723 - DNA, 19 bp, Homo sapiens
accccaacctgctctcctc

SEQ ID NO: 5352724 - DNA, 16 bp, Homo sapiens
accccaactcccagcc

SEQ ID NO: 5352725 - DNA, 15 bp, Homo sapiens
accccaactctcccc

SEQ ID NO: 5352726 - DNA, 20 bp, Homo sapiens
accccaagacagtcttttat

SEQ ID NO: 5352727 - DNA, 13 bp, Homo sapiens
accccaagagaac

SEQ ID NO: 5352728 - DNA, 19 bp, Homo sapiens
accccaagagtttcttctc

SEQ ID NO: 5352729 - DNA, 12 bp, Homo sapiens
accccaagcagc

SEQ ID NO: 5352730 - DNA, 14 bp, Homo sapiens
accccaagcagcat

SEQ ID NO: 5352731 - DNA, 13 bp, Homo sapiens
accccaagcattc

SEQ ID NO: 5352732 - DNA, 21 bp, Homo sapiens
accccaagccagcccggccgc

SEQ ID NO: 5352733 - DNA, 21 bp, Homo sapiens
accccaagcgccctggccccc

SEQ ID NO: 5352734 - DNA, 21 bp, Homo sapiens
accccaagctgcctctgggcc

SEQ ID NO: 5352735 - DNA, 22 bp, Homo sapiens
accccaaggacctgcctccccg

SEQ ID NO: 5352736 - DNA, 13 bp, Homo sapiens
accccaaggactg

SEQ ID NO: 5352737 - DNA, 17 bp, Homo sapiens
accccaaggagggagat

SEQ ID NO: 5352738 - DNA, 13 bp, Homo sapiens
accccaagggaca

SEQ ID NO: 5352739 - DNA, 21 bp, Homo sapiens
accccaagggacaaccccatc

SEQ ID NO: 5352740 - DNA, 17 bp, Homo sapiens
accccaagggggctgct

SEQ ID NO: 5352741 - DNA, 18 bp, Homo sapiens
accccaatatatgtattt

SEQ ID NO: 5352742 - DNA, 19 bp, Homo sapiens
accccaatccctgccactg

SEQ ID NO: 5352743 - DNA, 15 bp, Homo sapiens
accccaattaactga

SEQ ID NO: 5352744 - DNA, 19 bp, Homo sapiens
accccaattaactgaagca

SEQ ID NO: 5352745 - DNA, 15 bp, Homo sapiens
accccaattccttgt

SEQ ID NO: 5352746 - DNA, 23 bp, Homo sapiens
accccacaatttctttaaaaaag

SEQ ID NO: 5352747 - DNA, 17 bp, Homo sapiens
accccacacacgccaga

SEQ ID NO: 5352748 - DNA, 22 bp, Homo sapiens
accccacaccaggccgtcctcc

SEQ ID NO: 5352749 - DNA, 17 bp, Homo sapiens
accccacaccccagccc

SEQ ID NO: 5352750 - DNA, 15 bp, Homo sapiens
accccacacgccggg

SEQ ID NO: 5352751 - DNA, 18 bp, Homo sapiens
accccacacgctcctccc

SEQ ID NO: 5352752 - DNA, 14 bp, Homo sapiens
accccacagaacct

SEQ ID NO: 5352753 - DNA, 18 bp, Homo sapiens
accccacagctggggccg

SEQ ID NO: 5352754 - DNA, 17 bp, Homo sapiens
accccacatccttctca

SEQ ID NO: 5352755 - DNA, 21 bp, Homo sapiens
accccacatccttctcactgc

SEQ ID NO: 5352756 - DNA, 23 bp, Homo sapiens
accccaccacacacacccttccc

SEQ ID NO: 5352757 - DNA, 19 bp, Homo sapiens
accccaccatatgaattgt

SEQ ID NO: 5352758 - DNA, 18 bp, Homo sapiens
accccacccacttctgca

SEQ ID NO: 5352759 - DNA, 13 bp, Homo sapiens
accccacccagct

SEQ ID NO: 5352760 - DNA, 15 bp, Homo sapiens
accccacccagctcc

SEQ ID NO: 5352761 - DNA, 16 bp, Homo sapiens
accccacccagctcca

SEQ ID NO: 5352762 - DNA, 16 bp, Homo sapiens
accccaccccaccccc

SEQ ID NO: 5352763 - DNA, 12 bp, Homo sapiens
accccaccccct

SEQ ID NO: 5352764 - DNA, 19 bp, Homo sapiens
accccaccctccctggagt

SEQ ID NO: 5352765 - DNA, 16 bp, Homo sapiens
accccaccctgcccct

SEQ ID NO: 5352766 - DNA, 17 bp, Homo sapiens
accccaccctgtctgca

SEQ ID NO: 5352767 - DNA, 18 bp, Homo sapiens
accccaccctgtctgcag

SEQ ID NO: 5352768 - DNA, 16 bp, Homo sapiens
accccacccttgccca

SEQ ID NO: 5352769 - DNA, 19 bp, Homo sapiens
accccacctcatgcctggc

SEQ ID NO: 5352770 - DNA, 14 bp, Homo sapiens
accccacctccact

SEQ ID NO: 5352771 - DNA, 15 bp, Homo sapiens
accccacctccactc

SEQ ID NO: 5352772 - DNA, 16 bp, Homo sapiens
accccacctccactcc

SEQ ID NO: 5352773 - DNA, 20 bp, Homo sapiens
accccacgcccgcacccccg

SEQ ID NO: 5352774 - DNA, 16 bp, Homo sapiens
accccactcacagaga

SEQ ID NO: 5352775 - DNA, 14 bp, Homo sapiens
accccactccagcc

SEQ ID NO: 5352776 - DNA, 19 bp, Homo sapiens
accccactccagccctgtc

SEQ ID NO: 5352777 - DNA, 14 bp, Homo sapiens
accccactcccaca

SEQ ID NO: 5352778 - DNA, 16 bp, Homo sapiens
accccactcccctcac

SEQ ID NO: 5352779 - DNA, 14 bp, Homo sapiens
accccactcctcag

SEQ ID NO: 5352780 - DNA, 14 bp, Homo sapiens
accccactgagagc

SEQ ID NO: 5352781 - DNA, 15 bp, Homo sapiens
accccactgagagct

SEQ ID NO: 5352782 - DNA, 21 bp, Homo sapiens
accccactgagagctgctcct

SEQ ID NO: 5352783 - DNA, 14 bp, Homo sapiens
accccactggagtc

SEQ ID NO: 5352784 - DNA, 20 bp, Homo sapiens
accccactggagtctctctc

SEQ ID NO: 5352785 - DNA, 14 bp, Homo sapiens
accccactgggaga

SEQ ID NO: 5352786 - DNA, 15 bp, Homo sapiens
accccactgggcaca

SEQ ID NO: 5352787 - DNA, 19 bp, Homo sapiens
accccactgggcacacgca

SEQ ID NO: 5352788 - DNA, 19 bp, Homo sapiens
accccactgggccagccct

SEQ ID NO: 5352789 - DNA, 22 bp, Homo sapiens
accccacttagcctttcttttc

SEQ ID NO: 5352790 - DNA, 17 bp, Homo sapiens
accccacttatgctgct

SEQ ID NO: 5352791 - DNA, 20 bp, Homo sapiens
accccacttatgctgctgtg

SEQ ID NO: 5352792 - DNA, 23 bp, Homo sapiens
accccacttatgctgctgtgaat

SEQ ID NO: 5352793 - DNA, 14 bp, Homo sapiens
accccagaaatcac

SEQ ID NO: 5352794 - DNA, 20 bp, Homo sapiens
accccagaaatcactgtgaa

SEQ ID NO: 5352795 - DNA, 21 bp, Homo sapiens
accccagaaatcactgtgaaa

SEQ ID NO: 5352796 - DNA, 19 bp, Homo sapiens
accccagaaattctggccc

SEQ ID NO: 5352797 - DNA, 14 bp, Homo sapiens
accccagacactgg

SEQ ID NO: 5352798 - DNA, 17 bp, Homo sapiens
accccagacccaaccca

SEQ ID NO: 5352799 - DNA, 13 bp, Homo sapiens
accccagacctca

SEQ ID NO: 5352800 - DNA, 18 bp, Homo sapiens
accccagacgatgtcttc

SEQ ID NO: 5352801 - DNA, 13 bp, Homo sapiens
accccagactcca

SEQ ID NO: 5352802 - DNA, 14 bp, Homo sapiens
accccagactccag

SEQ ID NO: 5352803 - DNA, 18 bp, Homo sapiens
accccagactccaggccc

SEQ ID NO: 5352804 - DNA, 19 bp, Homo sapiens
accccagactccaggcccc

SEQ ID NO: 5352805 - DNA, 19 bp, Homo sapiens
accccagagccacacatgg

SEQ ID NO: 5352806 - DNA, 11 bp, Homo sapiens
accccagaggc

SEQ ID NO: 5352807 - DNA, 20 bp, Homo sapiens
accccagagggaccagctgg

SEQ ID NO: 5352808 - DNA, 10 bp, Homo sapiens
accccagagt

SEQ ID NO: 5352809 - DNA, 21 bp, Homo sapiens
accccagagtgggagaggctg

SEQ ID NO: 5352810 - DNA, 11 bp, Homo sapiens
accccagagtt

SEQ ID NO: 5352811 - DNA, 12 bp, Homo sapiens
accccagagttg

SEQ ID NO: 5352812 - DNA, 17 bp, Homo sapiens
accccagatacctgtga

SEQ ID NO: 5352813 - DNA, 21 bp, Homo sapiens
accccagatacctgtgaggac

SEQ ID NO: 5352814 - DNA, 18 bp, Homo sapiens
accccagcacagccacct

SEQ ID NO: 5352815 - DNA, 20 bp, Homo sapiens
accccagcacagctcctccc

SEQ ID NO: 5352816 - DNA, 22 bp, Homo sapiens
accccagcacagctcctcccct

SEQ ID NO: 5352817 - DNA, 17 bp, Homo sapiens
accccagcagtcctggg

SEQ ID NO: 5352818 - DNA, 18 bp, Homo sapiens
accccagcatcagcacag

SEQ ID NO: 5352819 - DNA, 13 bp, Homo sapiens
accccagcatcct

SEQ ID NO: 5352820 - DNA, 17 bp, Homo sapiens
accccagcattccagct

SEQ ID NO: 5352821 - DNA, 21 bp, Homo sapiens
accccagcattccagctctgc

SEQ ID NO: 5352822 - DNA, 22 bp, Homo sapiens
accccagcattctcaggcacca

SEQ ID NO: 5352823 - DNA, 18 bp, Homo sapiens
accccagccactcctcaa

SEQ ID NO: 5352824 - DNA, 12 bp, Homo sapiens
accccagccagg

SEQ ID NO: 5352825 - DNA, 16 bp, Homo sapiens
accccagccaggctcc

SEQ ID NO: 5352826 - DNA, 12 bp, Homo sapiens
accccagcccac

SEQ ID NO: 5352827 - DNA, 21 bp, Homo sapiens
accccagcccaccctgctcct

SEQ ID NO: 5352828 - DNA, 13 bp, Homo sapiens
accccagcccaga

SEQ ID NO: 5352829 - DNA, 17 bp, Homo sapiens
accccagcccccacagc

SEQ ID NO: 5352830 - DNA, 18 bp, Homo sapiens
accccagcccccacagcc

SEQ ID NO: 5352831 - DNA, 20 bp, Homo sapiens
accccagcccccacagccct

SEQ ID NO: 5352832 - DNA, 15 bp, Homo sapiens
accccagcctcactc

SEQ ID NO: 5352833 - DNA, 21 bp, Homo sapiens
accccagcctcattgtgccaa

SEQ ID NO: 5352834 - DNA, 23 bp, Homo sapiens
accccagcctcattgtgccaagc

SEQ ID NO: 5352835 - DNA, 19 bp, Homo sapiens
accccagcctcgcctgtca

SEQ ID NO: 5352836 - DNA, 14 bp, Homo sapiens
accccagcctgacc

SEQ ID NO: 5352837 - DNA, 16 bp, Homo sapiens
accccagcctgacctg

SEQ ID NO: 5352838 - DNA, 17 bp, Homo sapiens
accccagcctgacctga

SEQ ID NO: 5352839 - DNA, 13 bp, Homo sapiens
accccagccttgg

SEQ ID NO: 5352840 - DNA, 20 bp, Homo sapiens
accccagctattttctgacc

SEQ ID NO: 5352841 - DNA, 11 bp, Homo sapiens
accccagctcc

SEQ ID NO: 5352842 - DNA, 16 bp, Homo sapiens
accccagctccaggca

SEQ ID NO: 5352843 - DNA, 17 bp, Homo sapiens
accccagctccaggcag

SEQ ID NO: 5352844 - DNA, 18 bp, Homo sapiens
accccagctccaggcagg

SEQ ID NO: 5352845 - DNA, 12 bp, Homo sapiens
accccagctccg

SEQ ID NO: 5352846 - DNA, 12 bp, Homo sapiens
accccagctgcc

SEQ ID NO: 5352847 - DNA, 17 bp, Homo sapiens
accccagctgccggcag

SEQ ID NO: 5352848 - DNA, 15 bp, Homo sapiens
accccagctgcggca

SEQ ID NO: 5352849 - DNA, 14 bp, Homo sapiens
accccagctgctct

SEQ ID NO: 5352850 - DNA, 17 bp, Homo sapiens
accccagctgctctaag

SEQ ID NO: 5352851 - DNA, 20 bp, Homo sapiens
accccagctgctctaagccc

SEQ ID NO: 5352852 - DNA, 11 bp, Homo sapiens
accccagctgg

SEQ ID NO: 5352853 - DNA, 12 bp, Homo sapiens
accccagctggc

SEQ ID NO: 5352854 - DNA, 13 bp, Homo sapiens
accccagctggcc

SEQ ID NO: 5352855 - DNA, 14 bp, Homo sapiens
accccagctgggag

SEQ ID NO: 5352856 - DNA, 19 bp, Homo sapiens
accccagctggggccaggc

SEQ ID NO: 5352857 - DNA, 22 bp, Homo sapiens
accccagctggggccaggctgg

SEQ ID NO: 5352858 - DNA, 19 bp, Homo sapiens
accccagctgtgagccttg

SEQ ID NO: 5352859 - DNA, 17 bp, Homo sapiens
accccaggaaaagcaca

SEQ ID NO: 5352860 - DNA, 22 bp, Homo sapiens
accccaggatgcatgcagggcc

SEQ ID NO: 5352861 - DNA, 18 bp, Homo sapiens
accccaggcaatagtcaa

SEQ ID NO: 5352862 - DNA, 18 bp, Homo sapiens
accccaggcagctcctgt

SEQ ID NO: 5352863 - DNA, 16 bp, Homo sapiens
accccaggcatcccat

SEQ ID NO: 5352864 - DNA, 18 bp, Homo sapiens
accccaggcatcccatcc

SEQ ID NO: 5352865 - DNA, 22 bp, Homo sapiens
accccaggccataccaggtgct

SEQ ID NO: 5352866 - DNA, 16 bp, Homo sapiens
accccaggcccactca

SEQ ID NO: 5352867 - DNA, 12 bp, Homo sapiens
accccaggcccc

SEQ ID NO: 5352868 - DNA, 14 bp, Homo sapiens
accccaggccccga

SEQ ID NO: 5352869 - DNA, 15 bp, Homo sapiens
accccaggccctgcc

SEQ ID NO: 5352870 - DNA, 15 bp, Homo sapiens
accccaggcccttca

SEQ ID NO: 5352871 - DNA, 20 bp, Homo sapiens
accccaggctggagtgcagt

SEQ ID NO: 5352872 - DNA, 15 bp, Homo sapiens
accccaggctgggct

SEQ ID NO: 5352873 - DNA, 22 bp, Homo sapiens
accccaggctgggctgttcact

SEQ ID NO: 5352874 - DNA, 15 bp, Homo sapiens
accccagggcactgc

SEQ ID NO: 5352875 - DNA, 18 bp, Homo sapiens
accccagggcccccacag

SEQ ID NO: 5352876 - DNA, 13 bp, Homo sapiens
accccagggcctg

SEQ ID NO: 5352877 - DNA, 14 bp, Homo sapiens
accccagggcctga

SEQ ID NO: 5352878 - DNA, 15 bp, Homo sapiens
accccagggcctgag

SEQ ID NO: 5352879 - DNA, 17 bp, Homo sapiens
accccagggcctgagcc

SEQ ID NO: 5352880 - DNA, 17 bp, Homo sapiens
accccaggtcaggggct

SEQ ID NO: 5352881 - DNA, 19 bp, Homo sapiens
accccagtcaagctcctag

SEQ ID NO: 5352882 - DNA, 15 bp, Homo sapiens
accccagtcacttct

SEQ ID NO: 5352883 - DNA, 15 bp, Homo sapiens
accccagtcccaggg

SEQ ID NO: 5352884 - DNA, 22 bp, Homo sapiens
accccagtccccgggaaaggcc

SEQ ID NO: 5352885 - DNA, 20 bp, Homo sapiens
accccagtgcctgcacatca

SEQ ID NO: 5352886 - DNA, 16 bp, Homo sapiens
accccagtggccactc

SEQ ID NO: 5352887 - DNA, 23 bp, Homo sapiens
accccagtggccactcagcttcc

SEQ ID NO: 5352888 - DNA, 14 bp, Homo sapiens
accccagtgggaac

SEQ ID NO: 5352889 - DNA, 23 bp, Homo sapiens
accccagttctgctcctctccag

SEQ ID NO: 5352890 - DNA, 15 bp, Homo sapiens
accccagttttttga

SEQ ID NO: 5352891 - DNA, 14 bp, Homo sapiens
accccataagccct

SEQ ID NO: 5352892 - DNA, 19 bp, Homo sapiens
accccataagccctgagac

SEQ ID NO: 5352893 - DNA, 17 bp, Homo sapiens
accccataataaccctg

SEQ ID NO: 5352894 - DNA, 18 bp, Homo sapiens
accccataccccttattg

SEQ ID NO: 5352895 - DNA, 16 bp, Homo sapiens
acccgcaagtcaagcc

SEQ ID NO: 5352896 - DNA, 22 bp, Homo sapiens
acccgcatgtacaaaaacacaa

SEQ ID NO: 5352897 - DNA, 15 bp, Homo sapiens
acccgccagccccgc

SEQ ID NO: 5352898 - DNA, 19 bp, Homo sapiens
acccgcccacccgccttgt

SEQ ID NO: 5352899 - DNA, 16 bp, Homo sapiens
acccgccccagagact

SEQ ID NO: 5352900 - DNA, 18 bp, Homo sapiens
acccgccccagagactgc

SEQ ID NO: 5352901 - DNA, 20 bp, Homo sapiens
acccgccccagagactgccc

SEQ ID NO: 5352902 - DNA, 21 bp, Homo sapiens
acccgccccagagactgccca

SEQ ID NO: 5352903 - DNA, 22 bp, Homo sapiens
acccgccccagagactgcccac

SEQ ID NO: 5352904 - DNA, 16 bp, Homo sapiens
acccgccccgccccct

SEQ ID NO: 5352905 - DNA, 20 bp, Homo sapiens
acccgccccgcgcaccccac

SEQ ID NO: 5352906 - DNA, 19 bp, Homo sapiens
acccgccgcctcccacggc

SEQ ID NO: 5352907 - DNA, 15 bp, Homo sapiens
acccgcctagctgct

SEQ ID NO: 5352908 - DNA, 18 bp, Homo sapiens
acccgcctagctgctgtc

SEQ ID NO: 5352909 - DNA, 16 bp, Homo sapiens
acccgcctccctctca

SEQ ID NO: 5352910 - DNA, 13 bp, Homo sapiens
acccgcctctccc

SEQ ID NO: 5352911 - DNA, 13 bp, Homo sapiens
acccgcctgacac

SEQ ID NO: 5352912 - DNA, 14 bp, Homo sapiens
acccgcctgctccc

SEQ ID NO: 5352913 - DNA, 23 bp, Homo sapiens
acccgcggcccgcgcagctgcct

SEQ ID NO: 5352914 - DNA, 18 bp, Homo sapiens
acccgctcatcactggat

SEQ ID NO: 5352915 - DNA, 12 bp, Homo sapiens
acccgctctgga

SEQ ID NO: 5352916 - DNA, 12 bp, Homo sapiens
acccgctgccca

SEQ ID NO: 5352917 - DNA, 17 bp, Homo sapiens
acccgctgcccagccct

SEQ ID NO: 5352918 - DNA, 18 bp, Homo sapiens
acccgctgcccagccctc

SEQ ID NO: 5352919 - DNA, 18 bp, Homo sapiens
acccgctgcccctccccg

SEQ ID NO: 5352920 - DNA, 20 bp, Homo sapiens
acccgctggagcccacagcg

SEQ ID NO: 5352921 - DNA, 12 bp, Homo sapiens
acccgctggggg

SEQ ID NO: 5352922 - DNA, 17 bp, Homo sapiens
acccgctgggggctggc

SEQ ID NO: 5352923 - DNA, 22 bp, Homo sapiens
acccggagctaacactggcccc

SEQ ID NO: 5352924 - DNA, 23 bp, Homo sapiens
acccggagctaacactggcccct

SEQ ID NO: 5352925 - DNA, 12 bp, Homo sapiens
acccggaggcca

SEQ ID NO: 5352926 - DNA, 18 bp, Homo sapiens
acccggaggggcctggca

SEQ ID NO: 5352927 - DNA, 17 bp, Homo sapiens
acccggatctccaggcc

SEQ ID NO: 5352928 - DNA, 20 bp, Homo sapiens
acccggatctccaggcccag

SEQ ID NO: 5352929 - DNA, 21 bp, Homo sapiens
acccggatgaactcaatgcat

SEQ ID NO: 5352930 - DNA, 18 bp, Homo sapiens
acccggattggccctgcc

SEQ ID NO: 5352931 - DNA, 23 bp, Homo sapiens
acccggattggccctgcccctcc

SEQ ID NO: 5352932 - DNA, 16 bp, Homo sapiens
acccggcaccccctgc

SEQ ID NO: 5352933 - DNA, 19 bp, Homo sapiens
acccggcaccccctgcagc

SEQ ID NO: 5352934 - DNA, 20 bp, Homo sapiens
acccggcaccccctgcagct

SEQ ID NO: 5352935 - DNA, 22 bp, Homo sapiens
acccggcaccccctgcagcttg

SEQ ID NO: 5352936 - DNA, 15 bp, Homo sapiens
acccggcagcccccc

SEQ ID NO: 5352937 - DNA, 22 bp, Homo sapiens
acccggcaggctagaacctggc

SEQ ID NO: 5352938 - DNA, 20 bp, Homo sapiens
acccggccacagctgctgga

SEQ ID NO: 5352939 - DNA, 14 bp, Homo sapiens
acccggcccagaga

SEQ ID NO: 5352940 - DNA, 22 bp, Homo sapiens
acccggcccccgccctctgccc

SEQ ID NO: 5352941 - DNA, 16 bp, Homo sapiens
acccggcccctaccag

SEQ ID NO: 5352942 - DNA, 16 bp, Homo sapiens
acccggcccctgctgg

SEQ ID NO: 5352943 - DNA, 20 bp, Homo sapiens
acccggcccctgctggttca

SEQ ID NO: 5352944 - DNA, 22 bp, Homo sapiens
acccggcccggctgagccctgc

SEQ ID NO: 5352945 - DNA, 19 bp, Homo sapiens
acccggcctctctgcccca

SEQ ID NO: 5352946 - DNA, 20 bp, Homo sapiens
acccggcctctctgccccac

SEQ ID NO: 5352947 - DNA, 22 bp, Homo sapiens
acccggcctctctgccccaccc

SEQ ID NO: 5352948 - DNA, 23 bp, Homo sapiens
acccggcctctctgccccaccca

SEQ ID NO: 5352949 - DNA, 19 bp, Homo sapiens
acccggcctggatgccagc

SEQ ID NO: 5352950 - DNA, 16 bp, Homo sapiens
acccggcggccctgct

SEQ ID NO: 5352951 - DNA, 19 bp, Homo sapiens
acccggctccccctgcttc

SEQ ID NO: 5352952 - DNA, 18 bp, Homo sapiens
acccggctgactcagtgc

SEQ ID NO: 5352953 - DNA, 12 bp, Homo sapiens
acccggctgggc

SEQ ID NO: 5352954 - DNA, 22 bp, Homo sapiens
acccggctgggtcggccctgcc

SEQ ID NO: 5352955 - DNA, 23 bp, Homo sapiens
acccggctgggtcggccctgccc

SEQ ID NO: 5352956 - DNA, 22 bp, Homo sapiens
acccgggaacctccccagcctg

SEQ ID NO: 5352957 - DNA, 15 bp, Homo sapiens
acccgggaaggaagg

SEQ ID NO: 5352958 - DNA, 20 bp, Homo sapiens
acccgggaaggaaggctctc

SEQ ID NO: 5352959 - DNA, 12 bp, Homo sapiens
acccgggaaggg

SEQ ID NO: 5352960 - DNA, 21 bp, Homo sapiens
acccgggaccaaactcacgga

SEQ ID NO: 5352961 - DNA, 19 bp, Homo sapiens
acccgggaccacagctgct

SEQ ID NO: 5352962 - DNA, 21 bp, Homo sapiens
acccgggcaagggtcctcttt

SEQ ID NO: 5352963 - DNA, 13 bp, Homo sapiens
acccgggctcagg

SEQ ID NO: 5352964 - DNA, 17 bp, Homo sapiens
acccggggcagctggca

SEQ ID NO: 5352965 - DNA, 22 bp, Homo sapiens
acccggggcccagggcaagctc

SEQ ID NO: 5352966 - DNA, 16 bp, Homo sapiens
acccgggggagcccag

SEQ ID NO: 5352967 - DNA, 17 bp, Homo sapiens
acccgggggagcccagt

SEQ ID NO: 5352968 - DNA, 18 bp, Homo sapiens
acccgggggagcccagtg

SEQ ID NO: 5352969 - DNA, 14 bp, Homo sapiens
acccggttgcagtc

SEQ ID NO: 5352970 - DNA, 15 bp, Homo sapiens
acccgtacccccgtg

SEQ ID NO: 5352971 - DNA, 21 bp, Homo sapiens
acccgtacccccgtggtcttt

SEQ ID NO: 5352972 - DNA, 23 bp, Homo sapiens
acccgtacccccgtggtctttga

SEQ ID NO: 5352973 - DNA, 14 bp, Homo sapiens
acccgtatctgccc

SEQ ID NO: 5352974 - DNA, 13 bp, Homo sapiens
acccgtccattca

SEQ ID NO: 5352975 - DNA, 17 bp, Homo sapiens
acccgtccattcagaaa

SEQ ID NO: 5352976 - DNA, 15 bp, Homo sapiens
acccgtccccacacg

SEQ ID NO: 5352977 - DNA, 22 bp, Homo sapiens
acccgtcctccctcagcctccc

SEQ ID NO: 5352978 - DNA, 15 bp, Homo sapiens
acccgtcctctcggc

SEQ ID NO: 5352979 - DNA, 19 bp, Homo sapiens
acccgtcctggggtggttg

SEQ ID NO: 5352980 - DNA, 14 bp, Homo sapiens
acccgtctccagct

SEQ ID NO: 5352981 - DNA, 15 bp, Homo sapiens
acccgtgaatgtgcc

SEQ ID NO: 5352982 - DNA, 22 bp, Homo sapiens
acccgtgacctgagatgtgtga

SEQ ID NO: 5352983 - DNA, 16 bp, Homo sapiens
acccgtgagcgcctgt

SEQ ID NO: 5352984 - DNA, 21 bp, Homo sapiens
acccgtgccaagtccaggtcc

SEQ ID NO: 5352985 - DNA, 20 bp, Homo sapiens
acccgtgccacgcgctctgc

SEQ ID NO: 5352986 - DNA, 16 bp, Homo sapiens
acccgtgcctgggccc

SEQ ID NO: 5352987 - DNA, 13 bp, Homo sapiens
acccgtggaggct

SEQ ID NO: 5352988 - DNA, 15 bp, Homo sapiens
acccgtggaggctgc

SEQ ID NO: 5352989 - DNA, 16 bp, Homo sapiens
acccgtgttctcctcc

SEQ ID NO: 5352990 - DNA, 19 bp, Homo sapiens
acccgttaatttaaagctg

SEQ ID NO: 5352991 - DNA, 21 bp, Homo sapiens
acccgttcaacttttcctttg

SEQ ID NO: 5352992 - DNA, 16 bp, Homo sapiens
acccgttcatggggga

SEQ ID NO: 5352993 - DNA, 20 bp, Homo sapiens
acccgttctgctggcctgga

SEQ ID NO: 5352994 - DNA, 20 bp, Homo sapiens
acccgtttcccggttcagga

SEQ ID NO: 5352995 - DNA, 23 bp, Homo sapiens
acccgtttcccggttcaggacca

SEQ ID NO: 5352996 - DNA, 14 bp, Homo sapiens
acccgttttatgat

SEQ ID NO: 5352997 - DNA, 15 bp, Homo sapiens
accctaaaatgacag

SEQ ID NO: 5352998 - DNA, 22 bp, Homo sapiens
accctaaagcaaatctgccacc

SEQ ID NO: 5352999 - DNA, 15 bp, Homo sapiens
accctaaagggagaa

SEQ ID NO: 5353000 - DNA, 16 bp, Homo sapiens
accctaaatctgagga

SEQ ID NO: 5353001 - DNA, 16 bp, Homo sapiens
accctaaccaagttcc

SEQ ID NO: 5353002 - DNA, 17 bp, Homo sapiens
accctaaccaagttcct

SEQ ID NO: 5353003 - DNA, 15 bp, Homo sapiens
accctaacccggagg

SEQ ID NO: 5353004 - DNA, 16 bp, Homo sapiens
accctaactcttgctc

SEQ ID NO: 5353005 - DNA, 17 bp, Homo sapiens
accctaactgagctgcc

SEQ ID NO: 5353006 - DNA, 15 bp, Homo sapiens
accctaagggcagcc

SEQ ID NO: 5353007 - DNA, 16 bp, Homo sapiens
accctaagggcagccc

SEQ ID NO: 5353008 - DNA, 24 bp, Homo sapiens
accctaagtgtggatgttcagaat

SEQ ID NO: 5353009 - DNA, 19 bp, Homo sapiens
accctaatgtcttcataaa

SEQ ID NO: 5353010 - DNA, 23 bp, Homo sapiens
accctaatgtcttcataaagtac

SEQ ID NO: 5353011 - DNA, 18 bp, Homo sapiens
accctaatttgcccttca

SEQ ID NO: 5353012 - DNA, 21 bp, Homo sapiens
accctacaagttgatcatgca

SEQ ID NO: 5353013 - DNA, 15 bp, Homo sapiens
accctacacctctgg

SEQ ID NO: 5353014 - DNA, 13 bp, Homo sapiens
accctacagacag

SEQ ID NO: 5353015 - DNA, 12 bp, Homo sapiens
accctacagcag

SEQ ID NO: 5353016 - DNA, 14 bp, Homo sapiens
accctacagcagat

SEQ ID NO: 5353017 - DNA, 16 bp, Homo sapiens
accctacagtatataa

SEQ ID NO: 5353018 - DNA, 19 bp, Homo sapiens
accctaccaactttactgt

SEQ ID NO: 5353019 - DNA, 13 bp, Homo sapiens
accctaccagctc

SEQ ID NO: 5353020 - DNA, 14 bp, Homo sapiens
accctaccagctcc

SEQ ID NO: 5353021 - DNA, 13 bp, Homo sapiens
accctaccctggc

SEQ ID NO: 5353022 - DNA, 15 bp, Homo sapiens
accctaccctggcag

SEQ ID NO: 5353023 - DNA, 16 bp, Homo sapiens
accctaccctggcagg

SEQ ID NO: 5353024 - DNA, 13 bp, Homo sapiens
accctacctgttc

SEQ ID NO: 5353025 - DNA, 16 bp, Homo sapiens
accctaccttccccag

SEQ ID NO: 5353026 - DNA, 19 bp, Homo sapiens
accctaccttccccagact

SEQ ID NO: 5353027 - DNA, 15 bp, Homo sapiens
accctactgtggatt

SEQ ID NO: 5353028 - DNA, 14 bp, Homo sapiens
accctactgtgggg

SEQ ID NO: 5353029 - DNA, 20 bp, Homo sapiens
accctactgtggggagagat

SEQ ID NO: 5353030 - DNA, 22 bp, Homo sapiens
accctacttcattttcagagtg

SEQ ID NO: 5353031 - DNA, 18 bp, Homo sapiens
accctagaagaaaacccg

SEQ ID NO: 5353032 - DNA, 14 bp, Homo sapiens
accctagaggacta

SEQ ID NO: 5353033 - DNA, 13 bp, Homo sapiens
accctagcaaaag

SEQ ID NO: 5353034 - DNA, 19 bp, Homo sapiens
accctagcacaaatttgct

SEQ ID NO: 5353035 - DNA, 19 bp, Homo sapiens
accctagccaatgtctcct

SEQ ID NO: 5353036 - DNA, 17 bp, Homo sapiens
accctagccagagaata

SEQ ID NO: 5353037 - DNA, 16 bp, Homo sapiens
accctagccattcctg

SEQ ID NO: 5353038 - DNA, 17 bp, Homo sapiens
accctagccattcctgg

SEQ ID NO: 5353039 - DNA, 18 bp, Homo sapiens
accctagccctctccctc

SEQ ID NO: 5353040 - DNA, 17 bp, Homo sapiens
accctaggtctccaccc

SEQ ID NO: 5353041 - DNA, 14 bp, Homo sapiens
accctaggtgctca

SEQ ID NO: 5353042 - DNA, 22 bp, Homo sapiens
accctaggttccctgttcttcc

SEQ ID NO: 5353043 - DNA, 17 bp, Homo sapiens
accctagtgatttttgg

SEQ ID NO: 5353044 - DNA, 16 bp, Homo sapiens
accctagttattttct

SEQ ID NO: 5353045 - DNA, 15 bp, Homo sapiens
accctatacattttg

SEQ ID NO: 5353046 - DNA, 23 bp, Homo sapiens
accctatagagagggggctctcc

SEQ ID NO: 5353047 - DNA, 15 bp, Homo sapiens
accctatatctataa

SEQ ID NO: 5353048 - DNA, 14 bp, Homo sapiens
accctatatgctta

SEQ ID NO: 5353049 - DNA, 17 bp, Homo sapiens
accctatatgtagtata

SEQ ID NO: 5353050 - DNA, 15 bp, Homo sapiens
accctatctgtgatt

SEQ ID NO: 5353051 - DNA, 16 bp, Homo sapiens
accctatgccttttgt

SEQ ID NO: 5353052 - DNA, 15 bp, Homo sapiens
accctatggccactg

SEQ ID NO: 5353053 - DNA, 14 bp, Homo sapiens
accctatgggtcta

SEQ ID NO: 5353054 - DNA, 16 bp, Homo sapiens
accctatgggtctagg

SEQ ID NO: 5353055 - DNA, 13 bp, Homo sapiens
accctattcccta

SEQ ID NO: 5353056 - DNA, 23 bp, Homo sapiens
accctattctatccatctcctgg

SEQ ID NO: 5353057 - DNA, 13 bp, Homo sapiens
accctattgctgc

SEQ ID NO: 5353058 - DNA, 11 bp, Homo sapiens
accctattttc

SEQ ID NO: 5353059 - DNA, 15 bp, Homo sapiens
accctcaaatgtcag

SEQ ID NO: 5353060 - DNA, 19 bp, Homo sapiens
accctcaaatgtcagagct

SEQ ID NO: 5353061 - DNA, 14 bp, Homo sapiens
accctcacacacac

SEQ ID NO: 5353062 - DNA, 18 bp, Homo sapiens
accctcacacacacagct

SEQ ID NO: 5353063 - DNA, 19 bp, Homo sapiens
accctcacacacacagctg

SEQ ID NO: 5353064 - DNA, 22 bp, Homo sapiens
accctcacacacacagctgggc

SEQ ID NO: 5353065 - DNA, 20 bp, Homo sapiens
accctcaccccctcctggca

SEQ ID NO: 5353066 - DNA, 9 bp, Homo sapiens
accctcact

SEQ ID NO: 5353067 - DNA, 17 bp, Homo sapiens
accctcactctgccagg

SEQ ID NO: 5353068 - DNA, 18 bp, Homo sapiens
accctcactctgccaggg

SEQ ID NO: 5353069 - DNA, 21 bp, Homo sapiens
accctcactgggactttgtaa

SEQ ID NO: 5353070 - DNA, 21 bp, Homo sapiens
accctcagaaacactggggct

SEQ ID NO: 5353071 - DNA, 22 bp, Homo sapiens
accctcagaatattaagcacat

SEQ ID NO: 5353072 - DNA, 18 bp, Homo sapiens
accctcagcaccccttcc

SEQ ID NO: 5353073 - DNA, 17 bp, Homo sapiens
accctgggcttctgtac

SEQ ID NO: 5353074 - DNA, 11 bp, Homo sapiens
accctggggac

SEQ ID NO: 5353075 - DNA, 17 bp, Homo sapiens
accctggggactctgct

SEQ ID NO: 5353076 - DNA, 18 bp, Homo sapiens
accctggggcaggggtgc

SEQ ID NO: 5353077 - DNA, 14 bp, Homo sapiens
accctggggcctga

SEQ ID NO: 5353078 - DNA, 19 bp, Homo sapiens
accctggggcctggacctg

SEQ ID NO: 5353079 - DNA, 22 bp, Homo sapiens
accctggggcctggacctgcct

SEQ ID NO: 5353080 - DNA, 22 bp, Homo sapiens
accctggggctgcttaggaaac

SEQ ID NO: 5353081 - DNA, 14 bp, Homo sapiens
accctgggggcaca

SEQ ID NO: 5353082 - DNA, 16 bp, Homo sapiens
accctgggtcaccttc

SEQ ID NO: 5353083 - DNA, 21 bp, Homo sapiens
accctgggtcaggaaattact

SEQ ID NO: 5353084 - DNA, 14 bp, Homo sapiens
accctgggtgccat

SEQ ID NO: 5353085 - DNA, 20 bp, Homo sapiens
accctgggtgggagcatagg

SEQ ID NO: 5353086 - DNA, 19 bp, Homo sapiens
accctgggtgggctctgtg

SEQ ID NO: 5353087 - DNA, 17 bp, Homo sapiens
accctgggtttggcccc

SEQ ID NO: 5353088 - DNA, 18 bp, Homo sapiens
accctgggtttggcccct

SEQ ID NO: 5353089 - DNA, 19 bp, Homo sapiens
accctggtaggaaagcacc

SEQ ID NO: 5353090 - DNA, 21 bp, Homo sapiens
accctggtccagtcgggagga

SEQ ID NO: 5353091 - DNA, 13 bp, Homo sapiens
accctggtcctga

SEQ ID NO: 5353092 - DNA, 20 bp, Homo sapiens
accctggtctccgtggcact

SEQ ID NO: 5353093 - DNA, 20 bp, Homo sapiens
accctggtctgaggatgtag

SEQ ID NO: 5353094 - DNA, 16 bp, Homo sapiens
accctggtgacctcct

SEQ ID NO: 5353095 - DNA, 18 bp, Homo sapiens
accctggtgacctcctgt

SEQ ID NO: 5353096 - DNA, 19 bp, Homo sapiens
accctggtgctttccttca

SEQ ID NO: 5353097 - DNA, 22 bp, Homo sapiens
accctggtgctttccttcatct

SEQ ID NO: 5353098 - DNA, 14 bp, Homo sapiens
accctggtgggctg

SEQ ID NO: 5353099 - DNA, 17 bp, Homo sapiens
accctggtggtatttta

SEQ ID NO: 5353100 - DNA, 18 bp, Homo sapiens
accctggtgtctcctcca

SEQ ID NO: 5353101 - DNA, 15 bp, Homo sapiens
accctgtacctcatc

SEQ ID NO: 5353102 - DNA, 17 bp, Homo sapiens
accctgtacctcatccc

SEQ ID NO: 5353103 - DNA, 22 bp, Homo sapiens
accctgtactgttctgtgtctt

SEQ ID NO: 5353104 - DNA, 15 bp, Homo sapiens
accctgtatggagct

SEQ ID NO: 5353105 - DNA, 15 bp, Homo sapiens
accctgtcaaacatt

SEQ ID NO: 5353106 - DNA, 14 bp, Homo sapiens
accctgtcaagctt

SEQ ID NO: 5353107 - DNA, 21 bp, Homo sapiens
accctgtcaagttaacaagga

SEQ ID NO: 5353108 - DNA, 21 bp, Homo sapiens
accctgtcagaatcatgctgt

SEQ ID NO: 5353109 - DNA, 23 bp, Homo sapiens
accctgtcagaatcatgctgttc

SEQ ID NO: 5353110 - DNA, 16 bp, Homo sapiens
accctgtcccaggcag

SEQ ID NO: 5353111 - DNA, 21 bp, Homo sapiens
accctgtccggcccagtgcca

SEQ ID NO: 5353112 - DNA, 15 bp, Homo sapiens
accctgtcctagaga

SEQ ID NO: 5353113 - DNA, 11 bp, Homo sapiens
accctgtcctc

SEQ ID NO: 5353114 - DNA, 20 bp, Homo sapiens
accctgtcctgcacaccctg

SEQ ID NO: 5353115 - DNA, 23 bp, Homo sapiens
accctgtcctgcacaccctgggc

SEQ ID NO: 5353116 - DNA, 21 bp, Homo sapiens
accctgtcctgcagtcccaca

SEQ ID NO: 5353117 - DNA, 23 bp, Homo sapiens
accctgtcctgcagtcccacact

SEQ ID NO: 5353118 - DNA, 14 bp, Homo sapiens
accctgtcctttgc

SEQ ID NO: 5353119 - DNA, 11 bp, Homo sapiens
accctgtctct

SEQ ID NO: 5353120 - DNA, 14 bp, Homo sapiens
accctgtctctact

SEQ ID NO: 5353121 - DNA, 21 bp, Homo sapiens
accctgtctgccccgccctca

SEQ ID NO: 5353122 - DNA, 14 bp, Homo sapiens
accctgtctgtccc

SEQ ID NO: 5353123 - DNA, 13 bp, Homo sapiens
accctgtcttcct

SEQ ID NO: 5353124 - DNA, 18 bp, Homo sapiens
accctgtcttcctctgca

SEQ ID NO: 5353125 - DNA, 19 bp, Homo sapiens
accctgtcttcctctgcaa

SEQ ID NO: 5353126 - DNA, 21 bp, Homo sapiens
accctgtcttcctctgcaagt

SEQ ID NO: 5353127 - DNA, 14 bp, Homo sapiens
accctgtcttctta

SEQ ID NO: 5353128 - DNA, 17 bp, Homo sapiens
accctgtgaccctctca

SEQ ID NO: 5353129 - DNA, 16 bp, Homo sapiens
accctgtgatggggcc

SEQ ID NO: 5353130 - DNA, 17 bp, Homo sapiens
accctgtgatggggccc

SEQ ID NO: 5353131 - DNA, 14 bp, Homo sapiens
accctgtgcaggag

SEQ ID NO: 5353132 - DNA, 19 bp, Homo sapiens
accctgtgccccgcctccc

SEQ ID NO: 5353133 - DNA, 22 bp, Homo sapiens
accctgtgccccgcctcccggg

SEQ ID NO: 5353134 - DNA, 22 bp, Homo sapiens
accctgtgccctccttcccaat

SEQ ID NO: 5353135 - DNA, 11 bp, Homo sapiens
accctgtgcct

SEQ ID NO: 5353136 - DNA, 23 bp, Homo sapiens
accctgtgctggtgtcctgacca

SEQ ID NO: 5353137 - DNA, 12 bp, Homo sapiens
accctgtggaag

SEQ ID NO: 5353138 - DNA, 19 bp, Homo sapiens
accctgtggcaaatgccag

SEQ ID NO: 5353139 - DNA, 12 bp, Homo sapiens
accctgtggcca

SEQ ID NO: 5353140 - DNA, 15 bp, Homo sapiens
accctgtggccctgg

SEQ ID NO: 5353141 - DNA, 16 bp, Homo sapiens
accctgtggccctggc

SEQ ID NO: 5353142 - DNA, 19 bp, Homo sapiens
accctgtgggaccgcctgg

SEQ ID NO: 5353143 - DNA, 18 bp, Homo sapiens
accctgtgggggcggctg

SEQ ID NO: 5353144 - DNA, 21 bp, Homo sapiens
accctgtgggtgtctccctcg

SEQ ID NO: 5353145 - DNA, 17 bp, Homo sapiens
accctgtggtcttcctc

SEQ ID NO: 5353146 - DNA, 21 bp, Homo sapiens
accctgtggtttccaaggagc

SEQ ID NO: 5353147 - DNA, 20 bp, Homo sapiens
accctgtgtatacagccctg

SEQ ID NO: 5353148 - DNA, 10 bp, Homo sapiens
accctgtgtc

SEQ ID NO: 5353149 - DNA, 11 bp, Homo sapiens
accctgtgtca

SEQ ID NO: 5353150 - DNA, 17 bp, Homo sapiens
accctgtgtcagagcct

SEQ ID NO: 5353151 - DNA, 21 bp, Homo sapiens
accctgttacttatgtagaaa

SEQ ID NO: 5353152 - DNA, 16 bp, Homo sapiens
accctgttagttttgt

SEQ ID NO: 5353153 - DNA, 20 bp, Homo sapiens
accctgttcaggctggctcg

SEQ ID NO: 5353154 - DNA, 13 bp, Homo sapiens
accctgttcctgc

SEQ ID NO: 5353155 - DNA, 14 bp, Homo sapiens
accctgttcctgct

SEQ ID NO: 5353156 - DNA, 16 bp, Homo sapiens
accctgttcctgctgc

SEQ ID NO: 5353157 - DNA, 20 bp, Homo sapiens
accctgttgcaaaggaaata

SEQ ID NO: 5353158 - DNA, 14 bp, Homo sapiens
accctgtttcctga

SEQ ID NO: 5353159 - DNA, 18 bp, Homo sapiens
accctgtttctgtagaaa

SEQ ID NO: 5353160 - DNA, 15 bp, Homo sapiens
accctgttttccaca

SEQ ID NO: 5353161 - DNA, 18 bp, Homo sapiens
acccttacagcctctgac

SEQ ID NO: 5353162 - DNA, 13 bp, Homo sapiens
acccttacagtag

SEQ ID NO: 5353163 - DNA, 19 bp, Homo sapiens
acccttaccccttagcctc

SEQ ID NO: 5353164 - DNA, 22 bp, Homo sapiens
acccttactggcttacctcctc

SEQ ID NO: 5353165 - DNA, 13 bp, Homo sapiens
acccttagaatcc

SEQ ID NO: 5353166 - DNA, 17 bp, Homo sapiens
acccttagcagcccagc

SEQ ID NO: 5353167 - DNA, 14 bp, Homo sapiens
acccttaggccttt

SEQ ID NO: 5353168 - DNA, 19 bp, Homo sapiens
acccttatctgacctcttt

SEQ ID NO: 5353169 - DNA, 15 bp, Homo sapiens
acccttattgctgtc

SEQ ID NO: 5353170 - DNA, 21 bp, Homo sapiens
acccttattgctgtcctggag

SEQ ID NO: 5353171 - DNA, 16 bp, Homo sapiens
acccttcaactcctgg

SEQ ID NO: 5353172 - DNA, 22 bp, Homo sapiens
acccttcacgctggcttccagc

SEQ ID NO: 5353173 - DNA, 15 bp, Homo sapiens
acccttcagacccca

SEQ ID NO: 5353174 - DNA, 17 bp, Homo sapiens
acccttcagaccccagt

SEQ ID NO: 5353175 - DNA, 20 bp, Homo sapiens
acccttcagtgctacatttt

SEQ ID NO: 5353176 - DNA, 18 bp, Homo sapiens
acccttcatcttcctgtg

SEQ ID NO: 5353177 - DNA, 21 bp, Homo sapiens
acccttcatcttcctgtgtcc

SEQ ID NO: 5353178 - DNA, 15 bp, Homo sapiens
acccttccacagctg

SEQ ID NO: 5353179 - DNA, 13 bp, Homo sapiens
acccttccagaca

SEQ ID NO: 5353180 - DNA, 14 bp, Homo sapiens
acccttcccagccc

SEQ ID NO: 5353181 - DNA, 13 bp, Homo sapiens
acccttccccact

SEQ ID NO: 5353182 - DNA, 16 bp, Homo sapiens
acccttccccactccc

SEQ ID NO: 5353183 - DNA, 14 bp, Homo sapiens
acccttccctcttc

SEQ ID NO: 5353184 - DNA, 16 bp, Homo sapiens
acccttccctcttccc

SEQ ID NO: 5353185 - DNA, 12 bp, Homo sapiens
acccttccctgc

SEQ ID NO: 5353186 - DNA, 13 bp, Homo sapiens
acccttccctgcc

SEQ ID NO: 5353187 - DNA, 11 bp, Homo sapiens
acccttcctca

SEQ ID NO: 5353188 - DNA, 20 bp, Homo sapiens
acccttcctcatctgtgcct

SEQ ID NO: 5353189 - DNA, 21 bp, Homo sapiens
acccttcctcatctgtgcctg

SEQ ID NO: 5353190 - DNA, 17 bp, Homo sapiens
acccttcctgagcttta

SEQ ID NO: 5353191 - DNA, 11 bp, Homo sapiens
acccttcctgc

SEQ ID NO: 5353192 - DNA, 17 bp, Homo sapiens
acccttcctgcatttct

SEQ ID NO: 5353193 - DNA, 14 bp, Homo sapiens
acccttcctgctgc

SEQ ID NO: 5353194 - DNA, 19 bp, Homo sapiens
acccttcctgctgctgcta

SEQ ID NO: 5353195 - DNA, 17 bp, Homo sapiens
acccttcctggcccagg

SEQ ID NO: 5353196 - DNA, 18 bp, Homo sapiens
acccttcctggcccaggc

SEQ ID NO: 5353197 - DNA, 21 bp, Homo sapiens
acccttctacaaaagaagtgt

SEQ ID NO: 5353198 - DNA, 21 bp, Homo sapiens
acccttctactttttccttcc

SEQ ID NO: 5353199 - DNA, 16 bp, Homo sapiens
acccttctccaaaggc

SEQ ID NO: 5353200 - DNA, 15 bp, Homo sapiens
acccttctcccactc

SEQ ID NO: 5353201 - DNA, 15 bp, Homo sapiens
acccttctcccctgc

SEQ ID NO: 5353202 - DNA, 17 bp, Homo sapiens
acccttctcctcttgta

SEQ ID NO: 5353203 - DNA, 18 bp, Homo sapiens
acccttctcctttccttc

SEQ ID NO: 5353204 - DNA, 13 bp, Homo sapiens
acccttctgcttt

SEQ ID NO: 5353205 - DNA, 13 bp, Homo sapiens
acccttctgggca

SEQ ID NO: 5353206 - DNA, 14 bp, Homo sapiens
acccttctgggtcc

SEQ ID NO: 5353207 - DNA, 18 bp, Homo sapiens
acccttctgtgcccagct

SEQ ID NO: 5353208 - DNA, 21 bp, Homo sapiens
acccttctgtgcccagctcag

SEQ ID NO: 5353209 - DNA, 20 bp, Homo sapiens
acccttcttgcctgctgggc

SEQ ID NO: 5353210 - DNA, 16 bp, Homo sapiens
acccttcttgtctctc

SEQ ID NO: 5353211 - DNA, 17 bp, Homo sapiens
acccttctttaaatcaa

SEQ ID NO: 5353212 - DNA, 19 bp, Homo sapiens
acccttctttaaatcaaaa

SEQ ID NO: 5353213 - DNA, 23 bp, Homo sapiens
acccttctttaaatcaaaagctg

SEQ ID NO: 5353214 - DNA, 13 bp, Homo sapiens
acccttcttttct

SEQ ID NO: 5353215 - DNA, 13 bp, Homo sapiens
acccttgaaaaga

SEQ ID NO: 5353216 - DNA, 16 bp, Homo sapiens
acccttgaaaagacat

SEQ ID NO: 5353217 - DNA, 15 bp, Homo sapiens
acccttgaaaatata

SEQ ID NO: 5353218 - DNA, 11 bp, Homo sapiens
acccttgacac

SEQ ID NO: 5353219 - DNA, 14 bp, Homo sapiens
acccttgactgtta

SEQ ID NO: 5353220 - DNA, 13 bp, Homo sapiens
acccttgagccct

SEQ ID NO: 5353221 - DNA, 15 bp, Homo sapiens
acccttgagccctcc

SEQ ID NO: 5353222 - DNA, 21 bp, Homo sapiens
acccttgcaccgtcctcagca

SEQ ID NO: 5353223 - DNA, 20 bp, Homo sapiens
acccttgcatccattgttgt

SEQ ID NO: 5353224 - DNA, 15 bp, Homo sapiens
acccttgcattagaa

SEQ ID NO: 5353225 - DNA, 23 bp, Homo sapiens
acccttgccaaggccgcccacct

SEQ ID NO: 5353226 - DNA, 23 bp, Homo sapiens
acccttgcccacttctccttcgc

SEQ ID NO: 5353227 - DNA, 21 bp, Homo sapiens
acccttgcctgcctcctaggc

SEQ ID NO: 5353228 - DNA, 23 bp, Homo sapiens
acccttgcctgcctcctaggctg

SEQ ID NO: 5353229 - DNA, 15 bp, Homo sapiens
acccttgctgcttta

SEQ ID NO: 5353230 - DNA, 18 bp, Homo sapiens
acccttgctttcctgggc

SEQ ID NO: 5353231 - DNA, 15 bp, Homo sapiens
acccttggaaaacaa

SEQ ID NO: 5353232 - DNA, 23 bp, Homo sapiens
acccttggaaaacaaaagtttta

SEQ ID NO: 5353233 - DNA, 11 bp, Homo sapiens
acccttggcct

SEQ ID NO: 5353234 - DNA, 12 bp, Homo sapiens
acccttggcctc

SEQ ID NO: 5353235 - DNA, 15 bp, Homo sapiens
acccttggcctgtcc

SEQ ID NO: 5353236 - DNA, 17 bp, Homo sapiens
acccttggcctgtctca

SEQ ID NO: 5353237 - DNA, 17 bp, Homo sapiens
acccttggcttgcccac

SEQ ID NO: 5353238 - DNA, 22 bp, Homo sapiens
acccttgggcagagtcctgcct

SEQ ID NO: 5353239 - DNA, 18 bp, Homo sapiens
acccttggtctcatgccc

SEQ ID NO: 5353240 - DNA, 21 bp, Homo sapiens
acccttggtctcatgccccgc

SEQ ID NO: 5353241 - DNA, 17 bp, Homo sapiens
acccttggtctgtgttc

SEQ ID NO: 5353242 - DNA, 21 bp, Homo sapiens
acccttggtgtttcccttcct

SEQ ID NO: 5353243 - DNA, 22 bp, Homo sapiens
acccttggtgtttcccttcctc

SEQ ID NO: 5353244 - DNA, 17 bp, Homo sapiens
acccttggttcctaact

SEQ ID NO: 5353245 - DNA, 14 bp, Homo sapiens
acccttgtacccca

SEQ ID NO: 5353246 - DNA, 18 bp, Homo sapiens
acccttgtaccccatccc

SEQ ID NO: 5353247 - DNA, 20 bp, Homo sapiens
acccttgtaccccatccctt

SEQ ID NO: 5353248 - DNA, 14 bp, Homo sapiens
acccttgttattat

SEQ ID NO: 5353249 - DNA, 21 bp, Homo sapiens
accctttaagatatccatctt

SEQ ID NO: 5353250 - DNA, 22 bp, Homo sapiens
accctttacattttgtgcagtg

SEQ ID NO: 5353251 - DNA, 20 bp, Homo sapiens
accctttagtgtacatttat

SEQ ID NO: 5353252 - DNA, 15 bp, Homo sapiens
acctatctcagccat

SEQ ID NO: 5353253 - DNA, 17 bp, Homo sapiens
acctatctcagccatag

SEQ ID NO: 5353254 - DNA, 13 bp, Homo sapiens
acctatgaagttt

SEQ ID NO: 5353255 - DNA, 15 bp, Homo sapiens
acctatgactttttt

SEQ ID NO: 5353256 - DNA, 13 bp, Homo sapiens
acctatgccagtg

SEQ ID NO: 5353257 - DNA, 12 bp, Homo sapiens
acctatgcctgt

SEQ ID NO: 5353258 - DNA, 13 bp, Homo sapiens
acctatgcctgtg

SEQ ID NO: 5353259 - DNA, 22 bp, Homo sapiens
acctatgcttctagaaagcccc

SEQ ID NO: 5353260 - DNA, 23 bp, Homo sapiens
acctatggaagtggttctatgtc

SEQ ID NO: 5353261 - DNA, 22 bp, Homo sapiens
acctatggcccagccactgcag

SEQ ID NO: 5353262 - DNA, 16 bp, Homo sapiens
acctatggctgcctgc

SEQ ID NO: 5353263 - DNA, 18 bp, Homo sapiens
acctatgtcaacagtata

SEQ ID NO: 5353264 - DNA, 15 bp, Homo sapiens
acctatgtcatttca

SEQ ID NO: 5353265 - DNA, 19 bp, Homo sapiens
acctatgtcatttcatttc

SEQ ID NO: 5353266 - DNA, 22 bp, Homo sapiens
acctatgtcatttcatttccta

SEQ ID NO: 5353267 - DNA, 19 bp, Homo sapiens
acctatgtgaaactctatt

SEQ ID NO: 5353268 - DNA, 20 bp, Homo sapiens
acctatgtgaaactctatta

SEQ ID NO: 5353269 - DNA, 15 bp, Homo sapiens
acctattaaaggaaa

SEQ ID NO: 5353270 - DNA, 16 bp, Homo sapiens
acctattaaaggaaaa

SEQ ID NO: 5353271 - DNA, 14 bp, Homo sapiens
acctattatcagaa

SEQ ID NO: 5353272 - DNA, 19 bp, Homo sapiens
acctattcaccctccactt

SEQ ID NO: 5353273 - DNA, 23 bp, Homo sapiens
acctattcaccctccacttcccg

SEQ ID NO: 5353274 - DNA, 14 bp, Homo sapiens
acctattctgaaaa

SEQ ID NO: 5353275 - DNA, 19 bp, Homo sapiens
acctattctgaaaaagaca

SEQ ID NO: 5353276 - DNA, 20 bp, Homo sapiens
acctattctgtagttgcagc

SEQ ID NO: 5353277 - DNA, 17 bp, Homo sapiens
acctatttccagaaata

SEQ ID NO: 5353278 - DNA, 14 bp, Homo sapiens
acctatttcctcag

SEQ ID NO: 5353279 - DNA, 14 bp, Homo sapiens
acctatttctcttt

SEQ ID NO: 5353280 - DNA, 22 bp, Homo sapiens
acctatttctctttctttacaa

SEQ ID NO: 5353281 - DNA, 18 bp, Homo sapiens
acctatttcttaaacact

SEQ ID NO: 5353282 - DNA, 15 bp, Homo sapiens
acctattttcatttg

SEQ ID NO: 5353283 - DNA, 21 bp, Homo sapiens
acctattttcatttgtacaag

SEQ ID NO: 5353284 - DNA, 20 bp, Homo sapiens
acctattttgaaaaattcct

SEQ ID NO: 5353285 - DNA, 15 bp, Homo sapiens
acctattttgaaagg

SEQ ID NO: 5353286 - DNA, 22 bp, Homo sapiens
acctattttgaaaggtcagaat

SEQ ID NO: 5353287 - DNA, 16 bp, Homo sapiens
acctcaaaacactttc

SEQ ID NO: 5353288 - DNA, 13 bp, Homo sapiens
acctcaaaagaaa

SEQ ID NO: 5353289 - DNA, 22 bp, Homo sapiens
acctcaaaataagccatgctgc

SEQ ID NO: 5353290 - DNA, 15 bp, Homo sapiens
acctcaaaatttaac

SEQ ID NO: 5353291 - DNA, 21 bp, Homo sapiens
acctcaaactaggaggaaaag

SEQ ID NO: 5353292 - DNA, 16 bp, Homo sapiens
acctcaaactatctgg

SEQ ID NO: 5353293 - DNA, 12 bp, Homo sapiens
acctcaaactgg

SEQ ID NO: 5353294 - DNA, 22 bp, Homo sapiens
acctcaaagcacctgaacagtt

SEQ ID NO: 5353295 - DNA, 15 bp, Homo sapiens
acctcaaagggcagt

SEQ ID NO: 5353296 - DNA, 21 bp, Homo sapiens
acctcaaagggcagttttgag

SEQ ID NO: 5353297 - DNA, 22 bp, Homo sapiens
acctcaaagtaaaaattgaact

SEQ ID NO: 5353298 - DNA, 14 bp, Homo sapiens
acctcaaataccac

SEQ ID NO: 5353299 - DNA, 12 bp, Homo sapiens
acctcaaattta

SEQ ID NO: 5353300 - DNA, 17 bp, Homo sapiens
acctcaacaaagaagaa

SEQ ID NO: 5353301 - DNA, 16 bp, Homo sapiens
acctcaacaagaagaa

SEQ ID NO: 5353302 - DNA, 17 bp, Homo sapiens
acctcaacaagaagaat

SEQ ID NO: 5353303 - DNA, 21 bp, Homo sapiens
acctcaacccccatttctatt

SEQ ID NO: 5353304 - DNA, 16 bp, Homo sapiens
acctcaacctgtaaat

SEQ ID NO: 5353305 - DNA, 22 bp, Homo sapiens
acctcaactaacccttaaaaat

SEQ ID NO: 5353306 - DNA, 22 bp, Homo sapiens
acctcaactgcctactccaaaa

SEQ ID NO: 5353307 - DNA, 14 bp, Homo sapiens
acctcaagaccccc

SEQ ID NO: 5353308 - DNA, 21 bp, Homo sapiens
acctcaagggggactgtcttt

SEQ ID NO: 5353309 - DNA, 20 bp, Homo sapiens
acctcaagtgatcctcccac

SEQ ID NO: 5353310 - DNA, 23 bp, Homo sapiens
acctcaagtgatctgcccacctc

SEQ ID NO: 5353311 - DNA, 16 bp, Homo sapiens
acctcaagtgcaagga

SEQ ID NO: 5353312 - DNA, 19 bp, Homo sapiens
acctcaagtgcaaggacca

SEQ ID NO: 5353313 - DNA, 14 bp, Homo sapiens
acctcaagttcttg

SEQ ID NO: 5353314 - DNA, 16 bp, Homo sapiens
acctcaagttcttgga

SEQ ID NO: 5353315 - DNA, 21 bp, Homo sapiens
acctcaatcagtctcagaatg

SEQ ID NO: 5353316 - DNA, 14 bp, Homo sapiens
acctcaatgtttga

SEQ ID NO: 5353317 - DNA, 15 bp, Homo sapiens
acctcaattgacatt

SEQ ID NO: 5353318 - DNA, 15 bp, Homo sapiens
acctcaatttatgtt

SEQ ID NO: 5353319 - DNA, 18 bp, Homo sapiens
acctcaattttcactgtg

SEQ ID NO: 5353320 - DNA, 21 bp, Homo sapiens
acctcaatttttgtttttgag

SEQ ID NO: 5353321 - DNA, 23 bp, Homo sapiens
acctcacaaccgtacagtttctg

SEQ ID NO: 5353322 - DNA, 17 bp, Homo sapiens
acctcacaactccttcc

SEQ ID NO: 5353323 - DNA, 16 bp, Homo sapiens
acctcacacacctctg

SEQ ID NO: 5353324 - DNA, 10 bp, Homo sapiens
acctcacact

SEQ ID NO: 5353325 - DNA, 15 bp, Homo sapiens
acctcacactactgt

SEQ ID NO: 5353326 - DNA, 15 bp, Homo sapiens
acctcacagaaatgt

SEQ ID NO: 5353327 - DNA, 17 bp, Homo sapiens
acctcacagaaatgtta

SEQ ID NO: 5353328 - DNA, 14 bp, Homo sapiens
acctcacagtgacc

SEQ ID NO: 5353329 - DNA, 15 bp, Homo sapiens
acctcacagtgaccc

SEQ ID NO: 5353330 - DNA, 19 bp, Homo sapiens
acctcacagtgacccttcc

SEQ ID NO: 5353331 - DNA, 15 bp, Homo sapiens
acctcacatttgtga

SEQ ID NO: 5353332 - DNA, 12 bp, Homo sapiens
acctcaccaaac

SEQ ID NO: 5353333 - DNA, 15 bp, Homo sapiens
acctcaccaactcct

SEQ ID NO: 5353334 - DNA, 12 bp, Homo sapiens
acctcaccccac

SEQ ID NO: 5353335 - DNA, 15 bp, Homo sapiens
acctcaccccactta

SEQ ID NO: 5353336 - DNA, 19 bp, Homo sapiens
acctcaccccgaggccctg

SEQ ID NO: 5353337 - DNA, 21 bp, Homo sapiens
acctcaccccgaggccctgca

SEQ ID NO: 5353338 - DNA, 22 bp, Homo sapiens
acctcaccccgttacagctccc

SEQ ID NO: 5353339 - DNA, 20 bp, Homo sapiens
acctcaccggcatgctggcc

SEQ ID NO: 5353340 - DNA, 14 bp, Homo sapiens
acctcacctagaaa

SEQ ID NO: 5353341 - DNA, 16 bp, Homo sapiens
acctcacctctttgtt

SEQ ID NO: 5353342 - DNA, 19 bp, Homo sapiens
acctcacctgagacctcca

SEQ ID NO: 5353343 - DNA, 14 bp, Homo sapiens
acctcacctggtcc

SEQ ID NO: 5353344 - DNA, 17 bp, Homo sapiens
acctcacgactggtcac

SEQ ID NO: 5353345 - DNA, 16 bp, Homo sapiens
acctcacgcacctccc

SEQ ID NO: 5353346 - DNA, 17 bp, Homo sapiens
acctcacgcacctccca

SEQ ID NO: 5353347 - DNA, 19 bp, Homo sapiens
acctcacgcacctcccatc

SEQ ID NO: 5353348 - DNA, 21 bp, Homo sapiens
acctcacgtgcaaagccacca

SEQ ID NO: 5353349 - DNA, 14 bp, Homo sapiens
acctcactagctcc

SEQ ID NO: 5353350 - DNA, 20 bp, Homo sapiens
acctcactattcaagtatta

SEQ ID NO: 5353351 - DNA, 16 bp, Homo sapiens
acctcactcagcacca

SEQ ID NO: 5353352 - DNA, 20 bp, Homo sapiens
acctcactcagcaccactca

SEQ ID NO: 5353353 - DNA, 13 bp, Homo sapiens
acctcactcctgt

SEQ ID NO: 5353354 - DNA, 23 bp, Homo sapiens
acctcactctgctaccttgcccc

SEQ ID NO: 5353355 - DNA, 16 bp, Homo sapiens
acctcactctttatag

SEQ ID NO: 5353356 - DNA, 20 bp, Homo sapiens
acctcactgagaggcctgga

SEQ ID NO: 5353357 - DNA, 22 bp, Homo sapiens
acctcactgagaggcctggagc

SEQ ID NO: 5353358 - DNA, 15 bp, Homo sapiens
acctcactgaggaag

SEQ ID NO: 5353359 - DNA, 14 bp, Homo sapiens
acctcactggcctg

SEQ ID NO: 5353360 - DNA, 23 bp, Homo sapiens
acctcactggcctgccatgccag

SEQ ID NO: 5353361 - DNA, 15 bp, Homo sapiens
acctcactgggcctt

SEQ ID NO: 5353362 - DNA, 16 bp, Homo sapiens
acctcactggtgcatt

SEQ ID NO: 5353363 - DNA, 18 bp, Homo sapiens
acctcactggtgcattta

SEQ ID NO: 5353364 - DNA, 14 bp, Homo sapiens
acctcactgtcatc

SEQ ID NO: 5353365 - DNA, 19 bp, Homo sapiens
acctcactgtcatctgcca

SEQ ID NO: 5353366 - DNA, 12 bp, Homo sapiens
acctcacttccc

SEQ ID NO: 5353367 - DNA, 22 bp, Homo sapiens
acctcacttcccgtagctgcca

SEQ ID NO: 5353368 - DNA, 23 bp, Homo sapiens
acctcacttgtggcagcttccct

SEQ ID NO: 5353369 - DNA, 14 bp, Homo sapiens
acctcactttacat

SEQ ID NO: 5353370 - DNA, 13 bp, Homo sapiens
acctcacttttga

SEQ ID NO: 5353371 - DNA, 11 bp, Homo sapiens
acctcagaaaa

SEQ ID NO: 5353372 - DNA, 23 bp, Homo sapiens
acctcagaaagtcaccaggactt

SEQ ID NO: 5353373 - DNA, 13 bp, Homo sapiens
acctcagaagtaa

SEQ ID NO: 5353374 - DNA, 20 bp, Homo sapiens
acctcagaagtaaaggaatt

SEQ ID NO: 5353375 - DNA, 18 bp, Homo sapiens
acctcagacaatccactc

SEQ ID NO: 5353376 - DNA, 19 bp, Homo sapiens
acctcagacaatccactct

SEQ ID NO: 5353377 - DNA, 17 bp, Homo sapiens
acctcagaccccggggt

SEQ ID NO: 5353378 - DNA, 22 bp, Homo sapiens
acctcagaggctgttcttgggg

SEQ ID NO: 5353379 - DNA, 16 bp, Homo sapiens
acctcagatggcagct

SEQ ID NO: 5353380 - DNA, 12 bp, Homo sapiens
acctcagcaaat

SEQ ID NO: 5353381 - DNA, 20 bp, Homo sapiens
acctcagcaaatcctcttct

SEQ ID NO: 5353382 - DNA, 23 bp, Homo sapiens
acctcagcaagctgcccagccct

SEQ ID NO: 5353383 - DNA, 21 bp, Homo sapiens
acctcagcatttactttgttt

SEQ ID NO: 5353384 - DNA, 22 bp, Homo sapiens
acctcagccatgaggagttgct

SEQ ID NO: 5353385 - DNA, 17 bp, Homo sapiens
acctcagccccactgac

SEQ ID NO: 5353386 - DNA, 16 bp, Homo sapiens
acctcagccctggccc

SEQ ID NO: 5353387 - DNA, 18 bp, Homo sapiens
acctcagccctggccctg

SEQ ID NO: 5353388 - DNA, 10 bp, Homo sapiens
acctcagcct

SEQ ID NO: 5353389 - DNA, 11 bp, Homo sapiens
acctcagcctc

SEQ ID NO: 5353390 - DNA, 12 bp, Homo sapiens
acctcagcctcc

SEQ ID NO: 5353391 - DNA, 14 bp, Homo sapiens
acctcagcctccca

SEQ ID NO: 5353392 - DNA, 15 bp, Homo sapiens
acctcagcctcccaa

SEQ ID NO: 5353393 - DNA, 18 bp, Homo sapiens
acctcagcctcccagagt

SEQ ID NO: 5353394 - DNA, 23 bp, Homo sapiens
acctcagcctcccagagtgctag

SEQ ID NO: 5353395 - DNA, 12 bp, Homo sapiens
acctcagcctgg

SEQ ID NO: 5353396 - DNA, 19 bp, Homo sapiens
acctcagcctggagaggcc

SEQ ID NO: 5353397 - DNA, 17 bp, Homo sapiens
acctcagcctggccaga

SEQ ID NO: 5353398 - DNA, 15 bp, Homo sapiens
acctcagctctggga

SEQ ID NO: 5353399 - DNA, 17 bp, Homo sapiens
acctcagctctgggaga

SEQ ID NO: 5353400 - DNA, 23 bp, Homo sapiens
acctcagctctgggagaggattt

SEQ ID NO: 5353401 - DNA, 16 bp, Homo sapiens
acctcagctgcacatt

SEQ ID NO: 5353402 - DNA, 19 bp, Homo sapiens
acctcagctgcacattcct

SEQ ID NO: 5353403 - DNA, 22 bp, Homo sapiens
acctcagctgcacattcctggc

SEQ ID NO: 5353404 - DNA, 15 bp, Homo sapiens
acctcagctgcctcc

SEQ ID NO: 5353405 - DNA, 17 bp, Homo sapiens
acctcaggagggcaggc

SEQ ID NO: 5353406 - DNA, 18 bp, Homo sapiens
acctcaggcactagcctt

SEQ ID NO: 5353407 - DNA, 11 bp, Homo sapiens
acctcaggcct

SEQ ID NO: 5353408 - DNA, 22 bp, Homo sapiens
acctcaggctcctaaagagaca

SEQ ID NO: 5353409 - DNA, 16 bp, Homo sapiens
acctcagggacaacat

SEQ ID NO: 5353410 - DNA, 10 bp, Homo sapiens
acctcagggc

SEQ ID NO: 5353411 - DNA, 15 bp, Homo sapiens
acctcagggccaagc

SEQ ID NO: 5353412 - DNA, 15 bp, Homo sapiens
acctcagggctccca

SEQ ID NO: 5353413 - DNA, 16 bp, Homo sapiens
acctcagggctcccag

SEQ ID NO: 5353414 - DNA, 12 bp, Homo sapiens
acctcagggctg

SEQ ID NO: 5353415 - DNA, 18 bp, Homo sapiens
acctcagggctgtcccag

SEQ ID NO: 5353416 - DNA, 22 bp, Homo sapiens
acctcagggctgtcccagcccc

SEQ ID NO: 5353417 - DNA, 23 bp, Homo sapiens
acctcaggggagacttaggccag

SEQ ID NO: 5353418 - DNA, 12 bp, Homo sapiens
acctcaggggca

SEQ ID NO: 5353419 - DNA, 23 bp, Homo sapiens
acctcagggtattgcttgccact

SEQ ID NO: 5353420 - DNA, 20 bp, Homo sapiens
acctcaggtacggagaagaa

SEQ ID NO: 5353421 - DNA, 15 bp, Homo sapiens
acctcaggtgatcca

SEQ ID NO: 5353422 - DNA, 21 bp, Homo sapiens
acctcaggtgatccacccacc

SEQ ID NO: 5353423 - DNA, 22 bp, Homo sapiens
acctcaggtgatctgcccgcct

SEQ ID NO: 5353424 - DNA, 16 bp, Homo sapiens
acctcaggttgctggt

SEQ ID NO: 5353425 - DNA, 17 bp, Homo sapiens
acctcaggttgctggtt

SEQ ID NO: 5353426 - DNA, 15 bp, Homo sapiens
acctcagtaatttag

SEQ ID NO: 5353427 - DNA, 18 bp, Homo sapiens
acctcagtatttatgtaa

SEQ ID NO: 5353428 - DNA, 21 bp, Homo sapiens
acctcagtatttatgtaattt

SEQ ID NO: 5353429 - DNA, 16 bp, Homo sapiens
acctcagtcatatttc

SEQ ID NO: 5353430 - DNA, 11 bp, Homo sapiens
acctccctcct

SEQ ID NO: 5353431 - DNA, 15 bp, Homo sapiens
acctccctcctcagg

SEQ ID NO: 5353432 - DNA, 19 bp, Homo sapiens
acctccctcctgatgtttt

SEQ ID NO: 5353433 - DNA, 18 bp, Homo sapiens
acctccctcttgttttgt

SEQ ID NO: 5353434 - DNA, 14 bp, Homo sapiens
acctccctgaacca

SEQ ID NO: 5353435 - DNA, 13 bp, Homo sapiens
acctccctgaccc

SEQ ID NO: 5353436 - DNA, 17 bp, Homo sapiens
acctccctgacccgtct

SEQ ID NO: 5353437 - DNA, 14 bp, Homo sapiens
acctccctgcaacc

SEQ ID NO: 5353438 - DNA, 15 bp, Homo sapiens
acctccctgcagctt

SEQ ID NO: 5353439 - DNA, 12 bp, Homo sapiens
acctccctgccc

SEQ ID NO: 5353440 - DNA, 18 bp, Homo sapiens
acctccctgcccaggccg

SEQ ID NO: 5353441 - DNA, 18 bp, Homo sapiens
acctccctgctcagtgct

SEQ ID NO: 5353442 - DNA, 13 bp, Homo sapiens
acctccctggctt

SEQ ID NO: 5353443 - DNA, 14 bp, Homo sapiens
acctccctgtgaga

SEQ ID NO: 5353444 - DNA, 13 bp, Homo sapiens
acctcccttccct

SEQ ID NO: 5353445 - DNA, 14 bp, Homo sapiens
acctcccttgggca

SEQ ID NO: 5353446 - DNA, 22 bp, Homo sapiens
acctccgagaggcagccagacc

SEQ ID NO: 5353447 - DNA, 19 bp, Homo sapiens
acctccgccccagacacac

SEQ ID NO: 5353448 - DNA, 14 bp, Homo sapiens
acctccgcccctgc

SEQ ID NO: 5353449 - DNA, 15 bp, Homo sapiens
acctccgcccctgcc

SEQ ID NO: 5353450 - DNA, 16 bp, Homo sapiens
acctccgcctcccggg

SEQ ID NO: 5353451 - DNA, 15 bp, Homo sapiens
acctccggggagagc

SEQ ID NO: 5353452 - DNA, 22 bp, Homo sapiens
acctccgtcctctccccagcct

SEQ ID NO: 5353453 - DNA, 17 bp, Homo sapiens
acctcctaaaaggccca

SEQ ID NO: 5353454 - DNA, 19 bp, Homo sapiens
acctcctaaaaggcccaga

SEQ ID NO: 5353455 - DNA, 16 bp, Homo sapiens
acctcctaatggcatg

SEQ ID NO: 5353456 - DNA, 22 bp, Homo sapiens
acctcctaatggcatggagact

SEQ ID NO: 5353457 - DNA, 14 bp, Homo sapiens
acctcctacccctt

SEQ ID NO: 5353458 - DNA, 18 bp, Homo sapiens
acctcctaccccttcctg

SEQ ID NO: 5353459 - DNA, 20 bp, Homo sapiens
acctcctaccccttcctgtc

SEQ ID NO: 5353460 - DNA, 22 bp, Homo sapiens
acctcctaccccttcctgtcct

SEQ ID NO: 5353461 - DNA, 16 bp, Homo sapiens
acctcctaccctccca

SEQ ID NO: 5353462 - DNA, 21 bp, Homo sapiens
acctcctagcaagacctgttg

SEQ ID NO: 5353463 - DNA, 16 bp, Homo sapiens
acctcctataaagctt

SEQ ID NO: 5353464 - DNA, 17 bp, Homo sapiens
acctcctatccttggag

SEQ ID NO: 5353465 - DNA, 19 bp, Homo sapiens
acctcctatgggttgtcac

SEQ ID NO: 5353466 - DNA, 22 bp, Homo sapiens
acctcctattttaattggaatt

SEQ ID NO: 5353467 - DNA, 23 bp, Homo sapiens
acctcctcacttggctgtctgac

SEQ ID NO: 5353468 - DNA, 14 bp, Homo sapiens
acctcctcagcctg

SEQ ID NO: 5353469 - DNA, 13 bp, Homo sapiens
acctcctcaggga

SEQ ID NO: 5353470 - DNA, 15 bp, Homo sapiens
acctcctcatggcag

SEQ ID NO: 5353471 - DNA, 23 bp, Homo sapiens
acctcctccaagaagccctcctt

SEQ ID NO: 5353472 - DNA, 13 bp, Homo sapiens
acctcctccactc

SEQ ID NO: 5353473 - DNA, 14 bp, Homo sapiens
acctcctcccactg

SEQ ID NO: 5353474 - DNA, 18 bp, Homo sapiens
acctcctcccactgccca

SEQ ID NO: 5353475 - DNA, 13 bp, Homo sapiens
acctcctccctca

SEQ ID NO: 5353476 - DNA, 14 bp, Homo sapiens
acctcctccctcat

SEQ ID NO: 5353477 - DNA, 19 bp, Homo sapiens
acctcctccctcattcatc

SEQ ID NO: 5353478 - DNA, 21 bp, Homo sapiens
acctcctccctcattcatctt

SEQ ID NO: 5353479 - DNA, 15 bp, Homo sapiens
acctcctccctgtta

SEQ ID NO: 5353480 - DNA, 22 bp, Homo sapiens
acctcctccgtgggcagctcct

SEQ ID NO: 5353481 - DNA, 15 bp, Homo sapiens
acctcctcctgccct

SEQ ID NO: 5353482 - DNA, 16 bp, Homo sapiens
acctcctcctgccctc

SEQ ID NO: 5353483 - DNA, 16 bp, Homo sapiens
acctcctcctgctgct

SEQ ID NO: 5353484 - DNA, 22 bp, Homo sapiens
acctcctcctttgtttaataaa

SEQ ID NO: 5353485 - DNA, 22 bp, Homo sapiens
acctcctcggctggctgtccac

SEQ ID NO: 5353486 - DNA, 19 bp, Homo sapiens
acctcctctcactccccag

SEQ ID NO: 5353487 - DNA, 17 bp, Homo sapiens
acctcctctcagtgttt

SEQ ID NO: 5353488 - DNA, 13 bp, Homo sapiens
acctcctctcctg

SEQ ID NO: 5353489 - DNA, 16 bp, Homo sapiens
acctcctctgccagca

SEQ ID NO: 5353490 - DNA, 18 bp, Homo sapiens
acctcctctgccagcagg

SEQ ID NO: 5353491 - DNA, 20 bp, Homo sapiens
acctcctctgccagcaggaa

SEQ ID NO: 5353492 - DNA, 21 bp, Homo sapiens
acctcctctgccagcaggaat

SEQ ID NO: 5353493 - DNA, 20 bp, Homo sapiens
acctcctctgtgatttcttt

SEQ ID NO: 5353494 - DNA, 21 bp, Homo sapiens
acctcctctgtgatttctttc

SEQ ID NO: 5353495 - DNA, 16 bp, Homo sapiens
acctcctcttctgacg

SEQ ID NO: 5353496 - DNA, 22 bp, Homo sapiens
acctcctgacaacgtctcttca

SEQ ID NO: 5353497 - DNA, 13 bp, Homo sapiens
acctcctgagaaa

SEQ ID NO: 5353498 - DNA, 19 bp, Homo sapiens
acctcctgagaaggcgagg

SEQ ID NO: 5353499 - DNA, 16 bp, Homo sapiens
acctcctgcaataaaa

SEQ ID NO: 5353500 - DNA, 12 bp, Homo sapiens
acctcctgccca

SEQ ID NO: 5353501 - DNA, 13 bp, Homo sapiens
acctcctgcccag

SEQ ID NO: 5353502 - DNA, 15 bp, Homo sapiens
acctcctgcccagga

SEQ ID NO: 5353503 - DNA, 13 bp, Homo sapiens
acctcctgcctcg

SEQ ID NO: 5353504 - DNA, 22 bp, Homo sapiens
acctcctgcggctcagccttgc

SEQ ID NO: 5353505 - DNA, 12 bp, Homo sapiens
acctcctgctct

SEQ ID NO: 5353506 - DNA, 15 bp, Homo sapiens
acctcctgctctggg

SEQ ID NO: 5353507 - DNA, 14 bp, Homo sapiens
acctcctgctgggc

SEQ ID NO: 5353508 - DNA, 13 bp, Homo sapiens
acctcctgctgtg

SEQ ID NO: 5353509 - DNA, 9 bp, Homo sapiens
acctcctgg

SEQ ID NO: 5353510 - DNA, 12 bp, Homo sapiens
acctcctggggc

SEQ ID NO: 5353511 - DNA, 23 bp, Homo sapiens
acctcctgggtttaagcaatgct

SEQ ID NO: 5353512 - DNA, 13 bp, Homo sapiens
acctcctgtcact

SEQ ID NO: 5353513 - DNA, 17 bp, Homo sapiens
acctcctgtctctggcc

SEQ ID NO: 5353514 - DNA, 13 bp, Homo sapiens
acctcctgtggaa

SEQ ID NO: 5353515 - DNA, 20 bp, Homo sapiens
acctcctgtggaacccagca

SEQ ID NO: 5353516 - DNA, 22 bp, Homo sapiens
acctcctgtgttgtgctgggag

SEQ ID NO: 5353517 - DNA, 13 bp, Homo sapiens
acctccttacctg

SEQ ID NO: 5353518 - DNA, 15 bp, Homo sapiens
acctccttacctgga

SEQ ID NO: 5353519 - DNA, 18 bp, Homo sapiens
acctccttagccctgtct

SEQ ID NO: 5353520 - DNA, 13 bp, Homo sapiens
acctccttcccca

SEQ ID NO: 5353521 - DNA, 15 bp, Homo sapiens
acctccttccccagc

SEQ ID NO: 5353522 - DNA, 17 bp, Homo sapiens
acctccttccccagctc

SEQ ID NO: 5353523 - DNA, 13 bp, Homo sapiens
acctccttccctc

SEQ ID NO: 5353524 - DNA, 16 bp, Homo sapiens
acctccttccctctct

SEQ ID NO: 5353525 - DNA, 19 bp, Homo sapiens
acctccttccctctctgga

SEQ ID NO: 5353526 - DNA, 13 bp, Homo sapiens
acctccttcctcc

SEQ ID NO: 5353527 - DNA, 17 bp, Homo sapiens
acctccttctgcaaagt

SEQ ID NO: 5353528 - DNA, 19 bp, Homo sapiens
acctccttgctttgctgtt

SEQ ID NO: 5353529 - DNA, 19 bp, Homo sapiens
acctcctttaccctcatct

SEQ ID NO: 5353530 - DNA, 18 bp, Homo sapiens
acctcctttctcttctct

SEQ ID NO: 5353531 - DNA, 20 bp, Homo sapiens
acctcctttctcttctctgt

SEQ ID NO: 5353532 - DNA, 13 bp, Homo sapiens
acctccttttctt

SEQ ID NO: 5353533 - DNA, 21 bp, Homo sapiens
acctccttttcttctagcttt

SEQ ID NO: 5353534 - DNA, 21 bp, Homo sapiens
acctcgaagctgttctctgct

SEQ ID NO: 5353535 - DNA, 14 bp, Homo sapiens
acctcgaggctctt

SEQ ID NO: 5353536 - DNA, 14 bp, Homo sapiens
acctcgagtactgt

SEQ ID NO: 5353537 - DNA, 15 bp, Homo sapiens
acctcgagtactgtg

SEQ ID NO: 5353538 - DNA, 18 bp, Homo sapiens
acctcgagtactgtgggc

SEQ ID NO: 5353539 - DNA, 15 bp, Homo sapiens
acctcgcatcattgc

SEQ ID NO: 5353540 - DNA, 15 bp, Homo sapiens
acctcgccctctctc

SEQ ID NO: 5353541 - DNA, 22 bp, Homo sapiens
acctcgccctctctcaccagcc

SEQ ID NO: 5353542 - DNA, 12 bp, Homo sapiens
acctcgccgtgt

SEQ ID NO: 5353543 - DNA, 21 bp, Homo sapiens
acctcgcggcgcagcccctgg

SEQ ID NO: 5353544 - DNA, 15 bp, Homo sapiens
acctcgctcccctct

SEQ ID NO: 5353545 - DNA, 20 bp, Homo sapiens
acctcgctcccctctggaat

SEQ ID NO: 5353546 - DNA, 21 bp, Homo sapiens
acctcgctcccctctggaatc

SEQ ID NO: 5353547 - DNA, 18 bp, Homo sapiens
acctcgctggactctcag

SEQ ID NO: 5353548 - DNA, 16 bp, Homo sapiens
acctcggacagagccc

SEQ ID NO: 5353549 - DNA, 17 bp, Homo sapiens
acctcggacagagcccc

SEQ ID NO: 5353550 - DNA, 18 bp, Homo sapiens
acctcggagcatggtgtt

SEQ ID NO: 5353551 - DNA, 16 bp, Homo sapiens
acctcggcacacactg

SEQ ID NO: 5353552 - DNA, 13 bp, Homo sapiens
acctcggccctcc

SEQ ID NO: 5353553 - DNA, 15 bp, Homo sapiens
acctcggcctcccaa

SEQ ID NO: 5353554 - DNA, 19 bp, Homo sapiens
acctcggcttgtgggctgg

SEQ ID NO: 5353555 - DNA, 21 bp, Homo sapiens
acctcggcttgtgggctggtg

SEQ ID NO: 5353556 - DNA, 17 bp, Homo sapiens
acctcgggatggttggt

SEQ ID NO: 5353557 - DNA, 15 bp, Homo sapiens
acctcgggcctgctg

SEQ ID NO: 5353558 - DNA, 14 bp, Homo sapiens
acctcgggctgttc

SEQ ID NO: 5353559 - DNA, 21 bp, Homo sapiens
acctcggggacaccagagctg

SEQ ID NO: 5353560 - DNA, 17 bp, Homo sapiens
acctcggggagaggggg

SEQ ID NO: 5353561 - DNA, 14 bp, Homo sapiens
acctcggggtgggg

SEQ ID NO: 5353562 - DNA, 17 bp, Homo sapiens
acctcggtgccttcctc

SEQ ID NO: 5353563 - DNA, 19 bp, Homo sapiens
acctcggtgccttcctctt

SEQ ID NO: 5353564 - DNA, 18 bp, Homo sapiens
acctcgtactcaggagcc

SEQ ID NO: 5353565 - DNA, 23 bp, Homo sapiens
acctcgtcccgttctccattctg

SEQ ID NO: 5353566 - DNA, 21 bp, Homo sapiens
acctcgtcctccccctgccag

SEQ ID NO: 5353567 - DNA, 12 bp, Homo sapiens
acctcgtgaaga

SEQ ID NO: 5353568 - DNA, 22 bp, Homo sapiens
acctcgtgatccgcctgcctct

SEQ ID NO: 5353569 - DNA, 23 bp, Homo sapiens
acctcgtgtctagtagaacaatg

SEQ ID NO: 5353570 - DNA, 14 bp, Homo sapiens
acctcgttagagaa

SEQ ID NO: 5353571 - DNA, 23 bp, Homo sapiens
acctcgttagggaagagaaacag

SEQ ID NO: 5353572 - DNA, 20 bp, Homo sapiens
acctcgttgacatgcacagt

SEQ ID NO: 5353573 - DNA, 18 bp, Homo sapiens
acctctaaaacagtcctt

SEQ ID NO: 5353574 - DNA, 18 bp, Homo sapiens
acctctaaattctttcat

SEQ ID NO: 5353575 - DNA, 21 bp, Homo sapiens
acctctaaattctttcatttt

SEQ ID NO: 5353576 - DNA, 14 bp, Homo sapiens
acctctaacaccac

SEQ ID NO: 5353577 - DNA, 18 bp, Homo sapiens
acctctaacaccacactg

SEQ ID NO: 5353578 - DNA, 23 bp, Homo sapiens
acctctaacaccacactgaccac

SEQ ID NO: 5353579 - DNA, 15 bp, Homo sapiens
acctctaacagcacc

SEQ ID NO: 5353580 - DNA, 16 bp, Homo sapiens
acctctaactgtgcaa

SEQ ID NO: 5353581 - DNA, 16 bp, Homo sapiens
acctctaataaacact

SEQ ID NO: 5353582 - DNA, 17 bp, Homo sapiens
acctctaatagaggcag

SEQ ID NO: 5353583 - DNA, 12 bp, Homo sapiens
acctctaatagt

SEQ ID NO: 5353584 - DNA, 16 bp, Homo sapiens
acctctaatagtataa

SEQ ID NO: 5353585 - DNA, 19 bp, Homo sapiens
acctctaatagtataaacc

SEQ ID NO: 5353586 - DNA, 14 bp, Homo sapiens
acctctacaggcat

SEQ ID NO: 5353587 - DNA, 20 bp, Homo sapiens
acctctacccaaaccctagg

SEQ ID NO: 5353588 - DNA, 19 bp, Homo sapiens
acctctacggacctcacat

SEQ ID NO: 5353589 - DNA, 23 bp, Homo sapiens
acctctactaaaaagaaggaaaa

SEQ ID NO: 5353590 - DNA, 13 bp, Homo sapiens
acctctactgtct

SEQ ID NO: 5353591 - DNA, 15 bp, Homo sapiens
acctctactgtctcc

SEQ ID NO: 5353592 - DNA, 13 bp, Homo sapiens
acctctagaattt

SEQ ID NO: 5353593 - DNA, 19 bp, Homo sapiens
acctctagaattttaagcc

SEQ ID NO: 5353594 - DNA, 14 bp, Homo sapiens
acctctaggaggag

SEQ ID NO: 5353595 - DNA, 15 bp, Homo sapiens
acctctatccaaaga

SEQ ID NO: 5353596 - DNA, 21 bp, Homo sapiens
acctctattcttgggaaacac

SEQ ID NO: 5353597 - DNA, 16 bp, Homo sapiens
acctctattttaatta

SEQ ID NO: 5353598 - DNA, 15 bp, Homo sapiens
acctctcaagctagt

SEQ ID NO: 5353599 - DNA, 12 bp, Homo sapiens
acctctcaatat

SEQ ID NO: 5353600 - DNA, 21 bp, Homo sapiens
acctctcaatattcaataaag

SEQ ID NO: 5353601 - DNA, 19 bp, Homo sapiens
acctctcacgggccctgcc

SEQ ID NO: 5353602 - DNA, 13 bp, Homo sapiens
acctctcactccc

SEQ ID NO: 5353603 - DNA, 17 bp, Homo sapiens
acctctcacttttttat

SEQ ID NO: 5353604 - DNA, 19 bp, Homo sapiens
acctctcagagcaagcctt

SEQ ID NO: 5353605 - DNA, 17 bp, Homo sapiens
acctctcagatccctcg

SEQ ID NO: 5353606 - DNA, 22 bp, Homo sapiens
acctctcagcatagcctgcctg

SEQ ID NO: 5353607 - DNA, 23 bp, Homo sapiens
acctctcagcatagcctgcctga

SEQ ID NO: 5353608 - DNA, 20 bp, Homo sapiens
acctctcagcccctcagaga

SEQ ID NO: 5353609 - DNA, 15 bp, Homo sapiens
acctgaactttcatt

SEQ ID NO: 5353610 - DNA, 19 bp, Homo sapiens
acctgaagactgaggacaa

SEQ ID NO: 5353611 - DNA, 18 bp, Homo sapiens
acctgaagagcgctcctc

SEQ ID NO: 5353612 - DNA, 20 bp, Homo sapiens
acctgaagagcgctcctctg

SEQ ID NO: 5353613 - DNA, 22 bp, Homo sapiens
acctgaagagcgctcctctgcc

SEQ ID NO: 5353614 - DNA, 13 bp, Homo sapiens
acctgaagatgtc

SEQ ID NO: 5353615 - DNA, 14 bp, Homo sapiens
acctgaagatgtct

SEQ ID NO: 5353616 - DNA, 23 bp, Homo sapiens
acctgaagcatgaaactgtgtat

SEQ ID NO: 5353617 - DNA, 20 bp, Homo sapiens
acctgaaggacctccccctg

SEQ ID NO: 5353618 - DNA, 21 bp, Homo sapiens
acctgaagggtgacatcccag

SEQ ID NO: 5353619 - DNA, 20 bp, Homo sapiens
acctgaaggtcccctggcag

SEQ ID NO: 5353620 - DNA, 15 bp, Homo sapiens
acctgaagtctttgt

SEQ ID NO: 5353621 - DNA, 15 bp, Homo sapiens
acctgaagttcacca

SEQ ID NO: 5353622 - DNA, 17 bp, Homo sapiens
acctgaataattactac

SEQ ID NO: 5353623 - DNA, 18 bp, Homo sapiens
acctgaataccacttacc

SEQ ID NO: 5353624 - DNA, 18 bp, Homo sapiens
acctgaatagctcccaga

SEQ ID NO: 5353625 - DNA, 23 bp, Homo sapiens
acctgaatagctcccagatttca

SEQ ID NO: 5353626 - DNA, 17 bp, Homo sapiens
acctgaatcagctggac

SEQ ID NO: 5353627 - DNA, 18 bp, Homo sapiens
acctgaatcagctggaca

SEQ ID NO: 5353628 - DNA, 12 bp, Homo sapiens
acctgaatcttt

SEQ ID NO: 5353629 - DNA, 19 bp, Homo sapiens
acctgaatgacctgcagtc

SEQ ID NO: 5353630 - DNA, 20 bp, Homo sapiens
acctgaatggagaatacatc

SEQ ID NO: 5353631 - DNA, 13 bp, Homo sapiens
acctgaattaaag

SEQ ID NO: 5353632 - DNA, 17 bp, Homo sapiens
acctgaattaaagtcta

SEQ ID NO: 5353633 - DNA, 14 bp, Homo sapiens
acctgaattattaa

SEQ ID NO: 5353634 - DNA, 16 bp, Homo sapiens
acctgacaatggcagc

SEQ ID NO: 5353635 - DNA, 17 bp, Homo sapiens
acctgacaatggcagct

SEQ ID NO: 5353636 - DNA, 15 bp, Homo sapiens
acctgacacaagagg

SEQ ID NO: 5353637 - DNA, 15 bp, Homo sapiens
acctgacacatcttg

SEQ ID NO: 5353638 - DNA, 14 bp, Homo sapiens
acctgacacctgcc

SEQ ID NO: 5353639 - DNA, 20 bp, Homo sapiens
acctgacacctgccgctgct

SEQ ID NO: 5353640 - DNA, 19 bp, Homo sapiens
acctgacactcccttgggc

SEQ ID NO: 5353641 - DNA, 17 bp, Homo sapiens
acctgacagcaaacaca

SEQ ID NO: 5353642 - DNA, 19 bp, Homo sapiens
acctgacagcaaacacagt

SEQ ID NO: 5353643 - DNA, 22 bp, Homo sapiens
acctgaccaggggccctacctg

SEQ ID NO: 5353644 - DNA, 23 bp, Homo sapiens
acctgaccaggggccctacctgg

SEQ ID NO: 5353645 - DNA, 17 bp, Homo sapiens
acctgaccgctgcccag

SEQ ID NO: 5353646 - DNA, 16 bp, Homo sapiens
acctgaccggcacctg

SEQ ID NO: 5353647 - DNA, 18 bp, Homo sapiens
acctgaccggcacctgcg

SEQ ID NO: 5353648 - DNA, 20 bp, Homo sapiens
acctgaccgtgggcggggcc

SEQ ID NO: 5353649 - DNA, 14 bp, Homo sapiens
acctgacctctgca

SEQ ID NO: 5353650 - DNA, 16 bp, Homo sapiens
acctgacctcttgctg

SEQ ID NO: 5353651 - DNA, 20 bp, Homo sapiens
acctgacctcttgctgtctc

SEQ ID NO: 5353652 - DNA, 17 bp, Homo sapiens
acctgactcaggcatca

SEQ ID NO: 5353653 - DNA, 16 bp, Homo sapiens
acctgactctgaaatc

SEQ ID NO: 5353654 - DNA, 17 bp, Homo sapiens
acctgactctgaaatct

SEQ ID NO: 5353655 - DNA, 18 bp, Homo sapiens
acctgactctgaaatctg

SEQ ID NO: 5353656 - DNA, 19 bp, Homo sapiens
acctgactctgaaatctga

SEQ ID NO: 5353657 - DNA, 16 bp, Homo sapiens
acctgagaccctactg

SEQ ID NO: 5353658 - DNA, 18 bp, Homo sapiens
acctgagaccctactgaa

SEQ ID NO: 5353659 - DNA, 20 bp, Homo sapiens
acctgagaccctgggagaga

SEQ ID NO: 5353660 - DNA, 12 bp, Homo sapiens
acctgagacctc

SEQ ID NO: 5353661 - DNA, 14 bp, Homo sapiens
acctgagacctcca

SEQ ID NO: 5353662 - DNA, 22 bp, Homo sapiens
acctgagacgggcatcgcagga

SEQ ID NO: 5353663 - DNA, 21 bp, Homo sapiens
acctgagactcacactctctg

SEQ ID NO: 5353664 - DNA, 23 bp, Homo sapiens
acctgagactcacactctctgca

SEQ ID NO: 5353665 - DNA, 13 bp, Homo sapiens
acctgagactttc

SEQ ID NO: 5353666 - DNA, 14 bp, Homo sapiens
acctgagactttca

SEQ ID NO: 5353667 - DNA, 17 bp, Homo sapiens
acctgagatctatatgg

SEQ ID NO: 5353668 - DNA, 16 bp, Homo sapiens
acctgagatgctggga

SEQ ID NO: 5353669 - DNA, 12 bp, Homo sapiens
acctgagatgga

SEQ ID NO: 5353670 - DNA, 16 bp, Homo sapiens
acctgagatggccctc

SEQ ID NO: 5353671 - DNA, 21 bp, Homo sapiens
acctgagatggccctctggta

SEQ ID NO: 5353672 - DNA, 14 bp, Homo sapiens
acctgagatgtgtg

SEQ ID NO: 5353673 - DNA, 19 bp, Homo sapiens
acctgagatttattaaaga

SEQ ID NO: 5353674 - DNA, 18 bp, Homo sapiens
acctgagcattcaggcag

SEQ ID NO: 5353675 - DNA, 21 bp, Homo sapiens
acctgagcccgcagcccagac

SEQ ID NO: 5353676 - DNA, 12 bp, Homo sapiens
acctgagcctgc

SEQ ID NO: 5353677 - DNA, 13 bp, Homo sapiens
acctgagcctgcc

SEQ ID NO: 5353678 - DNA, 22 bp, Homo sapiens
acctgagcctggccatgtcctc

SEQ ID NO: 5353679 - DNA, 21 bp, Homo sapiens
acctgagcgctgtggactgtc

SEQ ID NO: 5353680 - DNA, 20 bp, Homo sapiens
acctgagcgggagtcaggga

SEQ ID NO: 5353681 - DNA, 22 bp, Homo sapiens
acctgagcgggagtcagggacc

SEQ ID NO: 5353682 - DNA, 14 bp, Homo sapiens
acctgagctcccca

SEQ ID NO: 5353683 - DNA, 14 bp, Homo sapiens
acctgagctgggag

SEQ ID NO: 5353684 - DNA, 20 bp, Homo sapiens
acctgaggacatggcttctg

SEQ ID NO: 5353685 - DNA, 23 bp, Homo sapiens
acctgaggatgcaacaaatattt

SEQ ID NO: 5353686 - DNA, 21 bp, Homo sapiens
acctgaggccaggacgtctgg

SEQ ID NO: 5353687 - DNA, 15 bp, Homo sapiens
acctgaggcccagca

SEQ ID NO: 5353688 - DNA, 18 bp, Homo sapiens
acctgaggcccagcagag

SEQ ID NO: 5353689 - DNA, 14 bp, Homo sapiens
acctgaggcccttc

SEQ ID NO: 5353690 - DNA, 22 bp, Homo sapiens
acctgaggcccttctctccagc

SEQ ID NO: 5353691 - DNA, 14 bp, Homo sapiens
acctgaggctggtt

SEQ ID NO: 5353692 - DNA, 15 bp, Homo sapiens
acctgagggcaaaga

SEQ ID NO: 5353693 - DNA, 15 bp, Homo sapiens
acctgagggtctgta

SEQ ID NO: 5353694 - DNA, 19 bp, Homo sapiens
acctgagggtctgtaggtt

SEQ ID NO: 5353695 - DNA, 17 bp, Homo sapiens
acctgaggtctcattca

SEQ ID NO: 5353696 - DNA, 21 bp, Homo sapiens
acctgaggtgggcccaggacc

SEQ ID NO: 5353697 - DNA, 15 bp, Homo sapiens
acctgagtatttttt

SEQ ID NO: 5353698 - DNA, 21 bp, Homo sapiens
acctgagtcgtacagaaagct

SEQ ID NO: 5353699 - DNA, 18 bp, Homo sapiens
acctgagtctgctatatt

SEQ ID NO: 5353700 - DNA, 16 bp, Homo sapiens
acctgagttgaagagg

SEQ ID NO: 5353701 - DNA, 21 bp, Homo sapiens
acctgataagggagagggaaa

SEQ ID NO: 5353702 - DNA, 17 bp, Homo sapiens
acctgatacctgcctgg

SEQ ID NO: 5353703 - DNA, 18 bp, Homo sapiens
acctgatacctgcctggg

SEQ ID NO: 5353704 - DNA, 19 bp, Homo sapiens
acctgatacggctccccag

SEQ ID NO: 5353705 - DNA, 21 bp, Homo sapiens
acctgatactcctaaaacttt

SEQ ID NO: 5353706 - DNA, 14 bp, Homo sapiens
acctgatcaatgac

SEQ ID NO: 5353707 - DNA, 22 bp, Homo sapiens
acctgatcactagcctgtcatc

SEQ ID NO: 5353708 - DNA, 18 bp, Homo sapiens
acctgatcatggtcagct

SEQ ID NO: 5353709 - DNA, 14 bp, Homo sapiens
acctgatctggccc

SEQ ID NO: 5353710 - DNA, 23 bp, Homo sapiens
acctgatctggcccaagctgggc

SEQ ID NO: 5353711 - DNA, 14 bp, Homo sapiens
acctgatgaaaata

SEQ ID NO: 5353712 - DNA, 17 bp, Homo sapiens
acctgatgccccttccc

SEQ ID NO: 5353713 - DNA, 19 bp, Homo sapiens
acctgatgtacctgatgct

SEQ ID NO: 5353714 - DNA, 22 bp, Homo sapiens
acctgatgtcagctgctgttga

SEQ ID NO: 5353715 - DNA, 15 bp, Homo sapiens
acctgattgatcaca

SEQ ID NO: 5353716 - DNA, 14 bp, Homo sapiens
acctgattgtattt

SEQ ID NO: 5353717 - DNA, 15 bp, Homo sapiens
acctgattgtatttt

SEQ ID NO: 5353718 - DNA, 17 bp, Homo sapiens
acctgattgtgtctctt

SEQ ID NO: 5353719 - DNA, 16 bp, Homo sapiens
acctgatttattgaaa

SEQ ID NO: 5353720 - DNA, 17 bp, Homo sapiens
acctgatttcagaagag

SEQ ID NO: 5353721 - DNA, 21 bp, Homo sapiens
acctgatttccatttgcaaca

SEQ ID NO: 5353722 - DNA, 14 bp, Homo sapiens
acctgattttcaaa

SEQ ID NO: 5353723 - DNA, 17 bp, Homo sapiens
acctgattttttttcct

SEQ ID NO: 5353724 - DNA, 15 bp, Homo sapiens
acctgcaaagatctg

SEQ ID NO: 5353725 - DNA, 22 bp, Homo sapiens
acctgcaaagatctgtcctcag

SEQ ID NO: 5353726 - DNA, 16 bp, Homo sapiens
acctgcaagatttcac

SEQ ID NO: 5353727 - DNA, 15 bp, Homo sapiens
acctgcaagcagaac

SEQ ID NO: 5353728 - DNA, 12 bp, Homo sapiens
acctgcaagccc

SEQ ID NO: 5353729 - DNA, 16 bp, Homo sapiens
acctgcaagccccagg

SEQ ID NO: 5353730 - DNA, 17 bp, Homo sapiens
acctgcaagccccaggg

SEQ ID NO: 5353731 - DNA, 19 bp, Homo sapiens
acctgcaaggcaaagtaaa

SEQ ID NO: 5353732 - DNA, 20 bp, Homo sapiens
acctgcaataaaaaaattac

SEQ ID NO: 5353733 - DNA, 15 bp, Homo sapiens
acctgcaatcccagc

SEQ ID NO: 5353734 - DNA, 19 bp, Homo sapiens
acctgcaatcccagcacct

SEQ ID NO: 5353735 - DNA, 20 bp, Homo sapiens
acctgcacaaacatagacag

SEQ ID NO: 5353736 - DNA, 13 bp, Homo sapiens
acctgcacacagg

SEQ ID NO: 5353737 - DNA, 19 bp, Homo sapiens
acctgcacacaggacagcg

SEQ ID NO: 5353738 - DNA, 21 bp, Homo sapiens
acctgcacacaggacagcggg

SEQ ID NO: 5353739 - DNA, 19 bp, Homo sapiens
acctgcacacccctgcaca

SEQ ID NO: 5353740 - DNA, 22 bp, Homo sapiens
acctgcacacccctgcacacac

SEQ ID NO: 5353741 - DNA, 23 bp, Homo sapiens
acctgcacaccgtccctctcccc

SEQ ID NO: 5353742 - DNA, 13 bp, Homo sapiens
acctgcacactcc

SEQ ID NO: 5353743 - DNA, 20 bp, Homo sapiens
acctgcacactgtcctatta

SEQ ID NO: 5353744 - DNA, 13 bp, Homo sapiens
acctgcacaggct

SEQ ID NO: 5353745 - DNA, 19 bp, Homo sapiens
acctgcacaggcttgctgt

SEQ ID NO: 5353746 - DNA, 18 bp, Homo sapiens
acctgcacattgggtggg

SEQ ID NO: 5353747 - DNA, 21 bp, Homo sapiens
acctgcacattgggtggggct

SEQ ID NO: 5353748 - DNA, 20 bp, Homo sapiens
acctgcacctccccccactg

SEQ ID NO: 5353749 - DNA, 15 bp, Homo sapiens
acctgcacctctgga

SEQ ID NO: 5353750 - DNA, 12 bp, Homo sapiens
acctgcagagaa

SEQ ID NO: 5353751 - DNA, 14 bp, Homo sapiens
acctgcagccccag

SEQ ID NO: 5353752 - DNA, 17 bp, Homo sapiens
acctgcagccccaggcc

SEQ ID NO: 5353753 - DNA, 19 bp, Homo sapiens
acctgcaggcggggctcct

SEQ ID NO: 5353754 - DNA, 16 bp, Homo sapiens
acctgcaggctccatg

SEQ ID NO: 5353755 - DNA, 21 bp, Homo sapiens
acctgcaggctccatgcacct

SEQ ID NO: 5353756 - DNA, 13 bp, Homo sapiens
acctgcagggagc

SEQ ID NO: 5353757 - DNA, 22 bp, Homo sapiens
acctgcaggttgggccatactg

SEQ ID NO: 5353758 - DNA, 15 bp, Homo sapiens
acctgcagtcagggc

SEQ ID NO: 5353759 - DNA, 23 bp, Homo sapiens
acctgcagtgaggggccctccat

SEQ ID NO: 5353760 - DNA, 11 bp, Homo sapiens
acctgcagtta

SEQ ID NO: 5353761 - DNA, 17 bp, Homo sapiens
acctgcagttggcctca

SEQ ID NO: 5353762 - DNA, 20 bp, Homo sapiens
acctgcagttggcctcagca

SEQ ID NO: 5353763 - DNA, 22 bp, Homo sapiens
acctgcagttggcctcagcaga

SEQ ID NO: 5353764 - DNA, 17 bp, Homo sapiens
acctgcagtttttaatt

SEQ ID NO: 5353765 - DNA, 15 bp, Homo sapiens
acctgcatatctcta

SEQ ID NO: 5353766 - DNA, 15 bp, Homo sapiens
acctgcatatttagc

SEQ ID NO: 5353767 - DNA, 18 bp, Homo sapiens
acctgcatatttagctgt

SEQ ID NO: 5353768 - DNA, 15 bp, Homo sapiens
acctgcatcagcctc

SEQ ID NO: 5353769 - DNA, 16 bp, Homo sapiens
acctgcatctggggcc

SEQ ID NO: 5353770 - DNA, 23 bp, Homo sapiens
acctgcatgcagcaacacccaag

SEQ ID NO: 5353771 - DNA, 22 bp, Homo sapiens
acctgcatggtgtttatgcaca

SEQ ID NO: 5353772 - DNA, 10 bp, Homo sapiens
acctgcattt

SEQ ID NO: 5353773 - DNA, 23 bp, Homo sapiens
acctgcatttttcactttgctct

SEQ ID NO: 5353774 - DNA, 13 bp, Homo sapiens
acctgccaagagt

SEQ ID NO: 5353775 - DNA, 19 bp, Homo sapiens
acctgccaatgattccaga

SEQ ID NO: 5353776 - DNA, 11 bp, Homo sapiens
acctgccacca

SEQ ID NO: 5353777 - DNA, 18 bp, Homo sapiens
acctgccaccagggagct

SEQ ID NO: 5353778 - DNA, 20 bp, Homo sapiens
acctgccacccccaggtctt

SEQ ID NO: 5353779 - DNA, 21 bp, Homo sapiens
acctgccacccccttccctgg

SEQ ID NO: 5353780 - DNA, 13 bp, Homo sapiens
acctgccaccgcc

SEQ ID NO: 5353781 - DNA, 15 bp, Homo sapiens
acctgccaccgccag

SEQ ID NO: 5353782 - DNA, 19 bp, Homo sapiens
acctgccactaggctgggt

SEQ ID NO: 5353783 - DNA, 15 bp, Homo sapiens
acctgccacttccag

SEQ ID NO: 5353784 - DNA, 15 bp, Homo sapiens
acctgccagccatca

SEQ ID NO: 5353785 - DNA, 14 bp, Homo sapiens
acctgccagcctgg

SEQ ID NO: 5353786 - DNA, 18 bp, Homo sapiens
acctgtcaccgtgagcag

SEQ ID NO: 5353787 - DNA, 18 bp, Homo sapiens
acctgtcagcccaagcag

SEQ ID NO: 5353788 - DNA, 13 bp, Homo sapiens
acctgtcatctgg

SEQ ID NO: 5353789 - DNA, 16 bp, Homo sapiens
acctgtcatctgggcc

SEQ ID NO: 5353790 - DNA, 15 bp, Homo sapiens
acctgtcatgccccc

SEQ ID NO: 5353791 - DNA, 16 bp, Homo sapiens
acctgtcattttgcac

SEQ ID NO: 5353792 - DNA, 18 bp, Homo sapiens
acctgtcattttgcactg

SEQ ID NO: 5353793 - DNA, 20 bp, Homo sapiens
acctgtcattttgcactgta

SEQ ID NO: 5353794 - DNA, 20 bp, Homo sapiens
acctgtccccaccctccact

SEQ ID NO: 5353795 - DNA, 21 bp, Homo sapiens
acctgtccccaccctccactc

SEQ ID NO: 5353796 - DNA, 12 bp, Homo sapiens
acctgtccccca

SEQ ID NO: 5353797 - DNA, 17 bp, Homo sapiens
acctgtcccccactctc

SEQ ID NO: 5353798 - DNA, 24 bp, Homo sapiens
acctgtcccccactctctcaccca

SEQ ID NO: 5353799 - DNA, 18 bp, Homo sapiens
acctgtccggcccagtgc

SEQ ID NO: 5353800 - DNA, 23 bp, Homo sapiens
acctgtccggcccagtgccagct

SEQ ID NO: 5353801 - DNA, 14 bp, Homo sapiens
acctgtcctcctgg

SEQ ID NO: 5353802 - DNA, 18 bp, Homo sapiens
acctgtcctcctggtggg

SEQ ID NO: 5353803 - DNA, 20 bp, Homo sapiens
acctgtccttactcagagct

SEQ ID NO: 5353804 - DNA, 23 bp, Homo sapiens
acctgtccttactcagagctgcg

SEQ ID NO: 5353805 - DNA, 14 bp, Homo sapiens
acctgtccttgcac

SEQ ID NO: 5353806 - DNA, 14 bp, Homo sapiens
acctgtcgcccagt

SEQ ID NO: 5353807 - DNA, 18 bp, Homo sapiens
acctgtcggtggctgcct

SEQ ID NO: 5353808 - DNA, 19 bp, Homo sapiens
acctgtcggtggctgcctt

SEQ ID NO: 5353809 - DNA, 23 bp, Homo sapiens
acctgtctaggtctcctcagggt

SEQ ID NO: 5353810 - DNA, 18 bp, Homo sapiens
acctgtctcacctggact

SEQ ID NO: 5353811 - DNA, 16 bp, Homo sapiens
acctgtctccactgtg

SEQ ID NO: 5353812 - DNA, 17 bp, Homo sapiens
acctgtctccactgtgc

SEQ ID NO: 5353813 - DNA, 14 bp, Homo sapiens
acctgtctccctgg

SEQ ID NO: 5353814 - DNA, 22 bp, Homo sapiens
acctgtctcctttcaccccagg

SEQ ID NO: 5353815 - DNA, 17 bp, Homo sapiens
acctgtctctctcttct

SEQ ID NO: 5353816 - DNA, 20 bp, Homo sapiens
acctgtctgctccagctctg

SEQ ID NO: 5353817 - DNA, 13 bp, Homo sapiens
acctgtctgctgc

SEQ ID NO: 5353818 - DNA, 14 bp, Homo sapiens
acctgtctgctgcc

SEQ ID NO: 5353819 - DNA, 17 bp, Homo sapiens
acctgtctgctgccagc

SEQ ID NO: 5353820 - DNA, 18 bp, Homo sapiens
acctgtctgctgccagca

SEQ ID NO: 5353821 - DNA, 20 bp, Homo sapiens
acctgtctgctgccagcaca

SEQ ID NO: 5353822 - DNA, 21 bp, Homo sapiens
acctgtctgctgccagcacag

SEQ ID NO: 5353823 - DNA, 14 bp, Homo sapiens
acctgtctgtctgt

SEQ ID NO: 5353824 - DNA, 14 bp, Homo sapiens
acctgtctgtgcag

SEQ ID NO: 5353825 - DNA, 18 bp, Homo sapiens
acctgtctgtgcagatgc

SEQ ID NO: 5353826 - DNA, 21 bp, Homo sapiens
acctgtcttgaataagagtga

SEQ ID NO: 5353827 - DNA, 19 bp, Homo sapiens
acctgtcttgcctttttca

SEQ ID NO: 5353828 - DNA, 21 bp, Homo sapiens
acctgtcttgcctttttcatt

SEQ ID NO: 5353829 - DNA, 14 bp, Homo sapiens
acctgtgacagcag

SEQ ID NO: 5353830 - DNA, 19 bp, Homo sapiens
acctgtgaccagcactgtc

SEQ ID NO: 5353831 - DNA, 15 bp, Homo sapiens
acctgtgacctggtc

SEQ ID NO: 5353832 - DNA, 18 bp, Homo sapiens
acctgtgacctggtctgg

SEQ ID NO: 5353833 - DNA, 12 bp, Homo sapiens
acctgtgactct

SEQ ID NO: 5353834 - DNA, 16 bp, Homo sapiens
acctgtgactcttagc

SEQ ID NO: 5353835 - DNA, 13 bp, Homo sapiens
acctgtgagacca

SEQ ID NO: 5353836 - DNA, 14 bp, Homo sapiens
acctgtgaggactg

SEQ ID NO: 5353837 - DNA, 13 bp, Homo sapiens
acctgtgcaaaat

SEQ ID NO: 5353838 - DNA, 19 bp, Homo sapiens
acctgtgcacaccccactc

SEQ ID NO: 5353839 - DNA, 22 bp, Homo sapiens
acctgtgcagtcccgtggaggg

SEQ ID NO: 5353840 - DNA, 16 bp, Homo sapiens
acctgtgccctcacca

SEQ ID NO: 5353841 - DNA, 17 bp, Homo sapiens
acctgtgccctcaccac

SEQ ID NO: 5353842 - DNA, 12 bp, Homo sapiens
acctgtgcctcc

SEQ ID NO: 5353843 - DNA, 16 bp, Homo sapiens
acctgtgcctccctct

SEQ ID NO: 5353844 - DNA, 16 bp, Homo sapiens
acctgtgcctcggctt

SEQ ID NO: 5353845 - DNA, 16 bp, Homo sapiens
acctgtgcctgcttct

SEQ ID NO: 5353846 - DNA, 18 bp, Homo sapiens
acctgtgctacctctaac

SEQ ID NO: 5353847 - DNA, 13 bp, Homo sapiens
acctgtgctggag

SEQ ID NO: 5353848 - DNA, 14 bp, Homo sapiens
acctgtgctgtgag

SEQ ID NO: 5353849 - DNA, 19 bp, Homo sapiens
acctgtgcttcgggccctt

SEQ ID NO: 5353850 - DNA, 18 bp, Homo sapiens
acctgtgcttggaaccag

SEQ ID NO: 5353851 - DNA, 17 bp, Homo sapiens
acctgtggataaaacat

SEQ ID NO: 5353852 - DNA, 13 bp, Homo sapiens
acctgtggatatt

SEQ ID NO: 5353853 - DNA, 15 bp, Homo sapiens
acctgtggccagagc

SEQ ID NO: 5353854 - DNA, 17 bp, Homo sapiens
acctgtggcctctcagt

SEQ ID NO: 5353855 - DNA, 14 bp, Homo sapiens
acctgtggctcagg

SEQ ID NO: 5353856 - DNA, 15 bp, Homo sapiens
acctgtggctctaca

SEQ ID NO: 5353857 - DNA, 13 bp, Homo sapiens
acctgtgggctga

SEQ ID NO: 5353858 - DNA, 14 bp, Homo sapiens
acctgtggggcccc

SEQ ID NO: 5353859 - DNA, 15 bp, Homo sapiens
acctgtggggcctgg

SEQ ID NO: 5353860 - DNA, 16 bp, Homo sapiens
acctgtggtgcaaaag

SEQ ID NO: 5353861 - DNA, 13 bp, Homo sapiens
acctgtgtcacta

SEQ ID NO: 5353862 - DNA, 11 bp, Homo sapiens
acctgtgtcca

SEQ ID NO: 5353863 - DNA, 14 bp, Homo sapiens
acctgtgtctgcga

SEQ ID NO: 5353864 - DNA, 12 bp, Homo sapiens
acctgtgtctta

SEQ ID NO: 5353865 - DNA, 13 bp, Homo sapiens
acctgtgtgaact

SEQ ID NO: 5353866 - DNA, 19 bp, Homo sapiens
acctgtgtgagagaattta

SEQ ID NO: 5353867 - DNA, 15 bp, Homo sapiens
acctgtgtgcccagc

SEQ ID NO: 5353868 - DNA, 13 bp, Homo sapiens
acctgtgtgcttg

SEQ ID NO: 5353869 - DNA, 16 bp, Homo sapiens
acctgtgtgttctttt

SEQ ID NO: 5353870 - DNA, 18 bp, Homo sapiens
acctgtgtgttcttttga

SEQ ID NO: 5353871 - DNA, 21 bp, Homo sapiens
acctgtgtgttcttttgatac

SEQ ID NO: 5353872 - DNA, 22 bp, Homo sapiens
acctgtgtgttcttttgataca

SEQ ID NO: 5353873 - DNA, 15 bp, Homo sapiens
acctgtgttccagcc

SEQ ID NO: 5353874 - DNA, 18 bp, Homo sapiens
acctgtgtttcttgcctc

SEQ ID NO: 5353875 - DNA, 21 bp, Homo sapiens
acctgtgtttcttgcctcatt

SEQ ID NO: 5353876 - DNA, 20 bp, Homo sapiens
acctgtgtttttttctaaaa

SEQ ID NO: 5353877 - DNA, 17 bp, Homo sapiens
acctgttaaaattatac

SEQ ID NO: 5353878 - DNA, 19 bp, Homo sapiens
acctgttaatttttatact

SEQ ID NO: 5353879 - DNA, 16 bp, Homo sapiens
acctgttacactgggc

SEQ ID NO: 5353880 - DNA, 14 bp, Homo sapiens
acctgttagctccc

SEQ ID NO: 5353881 - DNA, 21 bp, Homo sapiens
acctgttaggtctcatgccca

SEQ ID NO: 5353882 - DNA, 22 bp, Homo sapiens
acctgttaggtctcatgcccac

SEQ ID NO: 5353883 - DNA, 15 bp, Homo sapiens
acctgttatgccaaa

SEQ ID NO: 5353884 - DNA, 17 bp, Homo sapiens
acctgttatgtatgaag

SEQ ID NO: 5353885 - DNA, 14 bp, Homo sapiens
acctgttatttcta

SEQ ID NO: 5353886 - DNA, 16 bp, Homo sapiens
acctgttcaggagctg

SEQ ID NO: 5353887 - DNA, 17 bp, Homo sapiens
acctgttcagtgtcccg

SEQ ID NO: 5353888 - DNA, 22 bp, Homo sapiens
acctgttcagtgtcccgggccc

SEQ ID NO: 5353889 - DNA, 18 bp, Homo sapiens
acctgttcatttgaagaa

SEQ ID NO: 5353890 - DNA, 20 bp, Homo sapiens
acctgttcctgactgttctc

SEQ ID NO: 5353891 - DNA, 21 bp, Homo sapiens
acctgttcctgactgttctct

SEQ ID NO: 5353892 - DNA, 14 bp, Homo sapiens
acctgttctgaaat

SEQ ID NO: 5353893 - DNA, 13 bp, Homo sapiens
acctgttctgtag

SEQ ID NO: 5353894 - DNA, 20 bp, Homo sapiens
acctgttgagcatcacagaa

SEQ ID NO: 5353895 - DNA, 20 bp, Homo sapiens
acctgttgctccaggatgca

SEQ ID NO: 5353896 - DNA, 15 bp, Homo sapiens
acctgttgctgtgtt

SEQ ID NO: 5353897 - DNA, 16 bp, Homo sapiens
acctgttgcttacaat

SEQ ID NO: 5353898 - DNA, 18 bp, Homo sapiens
acctgttgcttacaattt

SEQ ID NO: 5353899 - DNA, 20 bp, Homo sapiens
acctgttgcttacaattttt

SEQ ID NO: 5353900 - DNA, 15 bp, Homo sapiens
acctgttggcctgtg

SEQ ID NO: 5353901 - DNA, 16 bp, Homo sapiens
acctgttggctacaca

SEQ ID NO: 5353902 - DNA, 14 bp, Homo sapiens
acctgtttaaatat

SEQ ID NO: 5353903 - DNA, 16 bp, Homo sapiens
acctgtttaaatattt

SEQ ID NO: 5353904 - DNA, 13 bp, Homo sapiens
acctgtttaaatt

SEQ ID NO: 5353905 - DNA, 15 bp, Homo sapiens
acctgtttaaattgc

SEQ ID NO: 5353906 - DNA, 23 bp, Homo sapiens
acctgtttaaattgctcacagtt

SEQ ID NO: 5353907 - DNA, 18 bp, Homo sapiens
acctgtttcaccagtgtt

SEQ ID NO: 5353908 - DNA, 22 bp, Homo sapiens
acctgtttcccgggcaatttaa

SEQ ID NO: 5353909 - DNA, 16 bp, Homo sapiens
acctgtttctctttgt

SEQ ID NO: 5353910 - DNA, 18 bp, Homo sapiens
acctgttttcgcacctac

SEQ ID NO: 5353911 - DNA, 16 bp, Homo sapiens
acctgttttctgaaac

SEQ ID NO: 5353912 - DNA, 14 bp, Homo sapiens
acctgttttcttca

SEQ ID NO: 5353913 - DNA, 18 bp, Homo sapiens
acctgtttttaagctgtt

SEQ ID NO: 5353914 - DNA, 15 bp, Homo sapiens
accttaaaaaggact

SEQ ID NO: 5353915 - DNA, 13 bp, Homo sapiens
accttaaaaatgc

SEQ ID NO: 5353916 - DNA, 16 bp, Homo sapiens
accttaaaaggtactg

SEQ ID NO: 5353917 - DNA, 13 bp, Homo sapiens
accttaaaagtaa

SEQ ID NO: 5353918 - DNA, 21 bp, Homo sapiens
accttaaaagtaataaagaga

SEQ ID NO: 5353919 - DNA, 23 bp, Homo sapiens
accttaaaagtaataaagagaaa

SEQ ID NO: 5353920 - DNA, 12 bp, Homo sapiens
accttaaaattt

SEQ ID NO: 5353921 - DNA, 17 bp, Homo sapiens
accttaaaatttgaaac

SEQ ID NO: 5353922 - DNA, 13 bp, Homo sapiens
accttaaaggtca

SEQ ID NO: 5353923 - DNA, 14 bp, Homo sapiens
accttaaatgctta

SEQ ID NO: 5353924 - DNA, 21 bp, Homo sapiens
accttaaattaaacaatttat

SEQ ID NO: 5353925 - DNA, 20 bp, Homo sapiens
accttaaattagtacagcac

SEQ ID NO: 5353926 - DNA, 16 bp, Homo sapiens
accttaaccttaaaat

SEQ ID NO: 5353927 - DNA, 16 bp, Homo sapiens
accttaagacactgtg

SEQ ID NO: 5353928 - DNA, 22 bp, Homo sapiens
accttaagacctactgttctaa

SEQ ID NO: 5353929 - DNA, 17 bp, Homo sapiens
accttaaggaaaagtaa

SEQ ID NO: 5353930 - DNA, 19 bp, Homo sapiens
accttaaggcagtagttct

SEQ ID NO: 5353931 - DNA, 19 bp, Homo sapiens
accttaagtaatcatctaa

SEQ ID NO: 5353932 - DNA, 14 bp, Homo sapiens
accttaatatttct

SEQ ID NO: 5353933 - DNA, 18 bp, Homo sapiens
accttaatgacaacactt

SEQ ID NO: 5353934 - DNA, 23 bp, Homo sapiens
accttaatgtggggcctcagtta

SEQ ID NO: 5353935 - DNA, 17 bp, Homo sapiens
accttaatttaactttc

SEQ ID NO: 5353936 - DNA, 14 bp, Homo sapiens
accttaatttatta

SEQ ID NO: 5353937 - DNA, 16 bp, Homo sapiens
accttaatttgactgt

SEQ ID NO: 5353938 - DNA, 21 bp, Homo sapiens
accttaattttacagcccttg

SEQ ID NO: 5353939 - DNA, 14 bp, Homo sapiens
accttacaaccaca

SEQ ID NO: 5353940 - DNA, 14 bp, Homo sapiens
accttacattccta

SEQ ID NO: 5353941 - DNA, 16 bp, Homo sapiens
accttacattcctaga

SEQ ID NO: 5353942 - DNA, 14 bp, Homo sapiens
accttaccaaaaaa

SEQ ID NO: 5353943 - DNA, 17 bp, Homo sapiens
accttaccaactttctg

SEQ ID NO: 5353944 - DNA, 18 bp, Homo sapiens
accttaccaactttctgt

SEQ ID NO: 5353945 - DNA, 20 bp, Homo sapiens
accttaccaactttctgtaa

SEQ ID NO: 5353946 - DNA, 18 bp, Homo sapiens
accttaccctactggctg

SEQ ID NO: 5353947 - DNA, 19 bp, Homo sapiens
accttaccctactggctgt

SEQ ID NO: 5353948 - DNA, 18 bp, Homo sapiens
accttacgatcaggcaca

SEQ ID NO: 5353949 - DNA, 12 bp, Homo sapiens
accttactcagg

SEQ ID NO: 5353950 - DNA, 15 bp, Homo sapiens
accttactggcactg

SEQ ID NO: 5353951 - DNA, 20 bp, Homo sapiens
accttacttaaagcttgttt

SEQ ID NO: 5353952 - DNA, 18 bp, Homo sapiens
accttagaaatcattgta

SEQ ID NO: 5353953 - DNA, 22 bp, Homo sapiens
accttagaaatcattgtagaaa

SEQ ID NO: 5353954 - DNA, 20 bp, Homo sapiens
accttagataatatttctga

SEQ ID NO: 5353955 - DNA, 22 bp, Homo sapiens
accttagatgttctaagtcttt

SEQ ID NO: 5353956 - DNA, 17 bp, Homo sapiens
accttagcgttctggac

SEQ ID NO: 5353957 - DNA, 17 bp, Homo sapiens
accttaggccttcctct

SEQ ID NO: 5353958 - DNA, 21 bp, Homo sapiens
accttaggccttcctctctcc

SEQ ID NO: 5353959 - DNA, 18 bp, Homo sapiens
accttaggctttgtatga

SEQ ID NO: 5353960 - DNA, 20 bp, Homo sapiens
accttaggctttgtatgaca

SEQ ID NO: 5353961 - DNA, 22 bp, Homo sapiens
accttagggtggctttaattgt

SEQ ID NO: 5353962 - DNA, 21 bp, Homo sapiens
accttagtacctttttaacag

SEQ ID NO: 5353963 - DNA, 22 bp, Homo sapiens
accttagtcatcagatatgctt

SEQ ID NO: 5353964 - DNA, 15 bp, Homo sapiens
accttagtgtttctg

SEQ ID NO: 5353965 - DNA, 17 bp, Homo sapiens
acctttgtgccctatca

SEQ ID NO: 5353966 - DNA, 14 bp, Homo sapiens
acctttgtgtaata

SEQ ID NO: 5353967 - DNA, 20 bp, Homo sapiens
acctttgtttccttattcag

SEQ ID NO: 5353968 - DNA, 19 bp, Homo sapiens
accttttaaaaaaataata

SEQ ID NO: 5353969 - DNA, 20 bp, Homo sapiens
accttttaaaaaaataatat

SEQ ID NO: 5353970 - DNA, 13 bp, Homo sapiens
accttttaaagtg

SEQ ID NO: 5353971 - DNA, 14 bp, Homo sapiens
accttttaaagtgt

SEQ ID NO: 5353972 - DNA, 19 bp, Homo sapiens
accttttaaagtgtttcag

SEQ ID NO: 5353973 - DNA, 12 bp, Homo sapiens
accttttaacac

SEQ ID NO: 5353974 - DNA, 18 bp, Homo sapiens
accttttaagacattttc

SEQ ID NO: 5353975 - DNA, 15 bp, Homo sapiens
accttttaagttaat

SEQ ID NO: 5353976 - DNA, 21 bp, Homo sapiens
accttttaagttaatgaaata

SEQ ID NO: 5353977 - DNA, 14 bp, Homo sapiens
accttttaatcaga

SEQ ID NO: 5353978 - DNA, 15 bp, Homo sapiens
accttttaccagctt

SEQ ID NO: 5353979 - DNA, 14 bp, Homo sapiens
accttttactgtga

SEQ ID NO: 5353980 - DNA, 14 bp, Homo sapiens
accttttataagac

SEQ ID NO: 5353981 - DNA, 19 bp, Homo sapiens
accttttatcaataaagca

SEQ ID NO: 5353982 - DNA, 15 bp, Homo sapiens
accttttatccactt

SEQ ID NO: 5353983 - DNA, 20 bp, Homo sapiens
accttttatgaatcaaatat

SEQ ID NO: 5353984 - DNA, 15 bp, Homo sapiens
accttttatgtagta

SEQ ID NO: 5353985 - DNA, 14 bp, Homo sapiens
accttttattacat

SEQ ID NO: 5353986 - DNA, 20 bp, Homo sapiens
accttttattgacacagaaa

SEQ ID NO: 5353987 - DNA, 13 bp, Homo sapiens
accttttcaggaa

SEQ ID NO: 5353988 - DNA, 22 bp, Homo sapiens
accttttcaggaaaataactta

SEQ ID NO: 5353989 - DNA, 15 bp, Homo sapiens
accttttcagggctg

SEQ ID NO: 5353990 - DNA, 16 bp, Homo sapiens
accttttcatgtacag

SEQ ID NO: 5353991 - DNA, 17 bp, Homo sapiens
accttttccttatactg

SEQ ID NO: 5353992 - DNA, 10 bp, Homo sapiens
accttttcta

SEQ ID NO: 5353993 - DNA, 23 bp, Homo sapiens
accttttctaaaaagtcaattca

SEQ ID NO: 5353994 - DNA, 20 bp, Homo sapiens
accttttctagtctgtcttc

SEQ ID NO: 5353995 - DNA, 15 bp, Homo sapiens
accttttctataagt

SEQ ID NO: 5353996 - DNA, 16 bp, Homo sapiens
accttttctataagtt

SEQ ID NO: 5353997 - DNA, 22 bp, Homo sapiens
accttttctataagttgtacca

SEQ ID NO: 5353998 - DNA, 11 bp, Homo sapiens
accttttctct

SEQ ID NO: 5353999 - DNA, 13 bp, Homo sapiens
accttttcttcat

SEQ ID NO: 5354000 - DNA, 14 bp, Homo sapiens
accttttcttcatt

SEQ ID NO: 5354001 - DNA, 14 bp, Homo sapiens
accttttctttacc

SEQ ID NO: 5354002 - DNA, 16 bp, Homo sapiens
accttttgcatttctt

SEQ ID NO: 5354003 - DNA, 20 bp, Homo sapiens
accttttggtctggagggaa

SEQ ID NO: 5354004 - DNA, 20 bp, Homo sapiens
accttttgtatttaaaacct

SEQ ID NO: 5354005 - DNA, 12 bp, Homo sapiens
accttttgtttt

SEQ ID NO: 5354006 - DNA, 17 bp, Homo sapiens
accttttgtttttccag

SEQ ID NO: 5354007 - DNA, 14 bp, Homo sapiens
acctttttaatcca

SEQ ID NO: 5354008 - DNA, 21 bp, Homo sapiens
acctttttataggttgttctt

SEQ ID NO: 5354009 - DNA, 20 bp, Homo sapiens
acctttttatattttatact

SEQ ID NO: 5354010 - DNA, 16 bp, Homo sapiens
acctttttatttcaaa

SEQ ID NO: 5354011 - DNA, 19 bp, Homo sapiens
acctttttatttgcatgtg

SEQ ID NO: 5354012 - DNA, 21 bp, Homo sapiens
acctttttccctcttcccaga

SEQ ID NO: 5354013 - DNA, 19 bp, Homo sapiens
acctttttcttgatcttaa

SEQ ID NO: 5354014 - DNA, 13 bp, Homo sapiens
acctttttgtaaa

SEQ ID NO: 5354015 - DNA, 19 bp, Homo sapiens
acctttttgtatgtgaaca

SEQ ID NO: 5354016 - DNA, 15 bp, Homo sapiens
accttttttaagatt

SEQ ID NO: 5354017 - DNA, 16 bp, Homo sapiens
accttttttaagattt

SEQ ID NO: 5354018 - DNA, 20 bp, Homo sapiens
accttttttaagatttttct

SEQ ID NO: 5354019 - DNA, 22 bp, Homo sapiens
accttttttaagatttttctca

SEQ ID NO: 5354020 - DNA, 13 bp, Homo sapiens
accttttttatac

SEQ ID NO: 5354021 - DNA, 19 bp, Homo sapiens
accttttttatacataaac

SEQ ID NO: 5354022 - DNA, 20 bp, Homo sapiens
accttttttatacataaaca

SEQ ID NO: 5354023 - DNA, 21 bp, Homo sapiens
accttttttatacataaacaa

SEQ ID NO: 5354024 - DNA, 20 bp, Homo sapiens
accttttttatgatgctatt

SEQ ID NO: 5354025 - DNA, 20 bp, Homo sapiens
accttttttgttttttcaaa

SEQ ID NO: 5354026 - DNA, 24 bp, Homo sapiens
acctttttttatcgtttttgtatt

SEQ ID NO: 5354027 - DNA, 15 bp, Homo sapiens
acctttttttctctc

SEQ ID NO: 5354028 - DNA, 14 bp, Homo sapiens
accttttttttacg

SEQ ID NO: 5354029 - DNA, 17 bp, Homo sapiens
accttttttttacggaa

SEQ ID NO: 5354030 - DNA, 23 bp, Homo sapiens
accttttttttacggaattccaa

SEQ ID NO: 5354031 - DNA, 19 bp, Homo sapiens
acctttttttttgaaacag

SEQ ID NO: 5354032 - DNA, 19 bp, Homo sapiens
accttttttttttttccaa

SEQ ID NO: 5354033 - DNA, 13 bp, Homo sapiens
acgaaaaaatggt

SEQ ID NO: 5354034 - DNA, 21 bp, Homo sapiens
acgaaaaagtgattgtgaagg

SEQ ID NO: 5354035 - DNA, 13 bp, Homo sapiens
acgaaacacagaa

SEQ ID NO: 5354036 - DNA, 21 bp, Homo sapiens
acgaaactccatctcaaaaca

SEQ ID NO: 5354037 - DNA, 22 bp, Homo sapiens
acgaaactccatctcaaaacaa

SEQ ID NO: 5354038 - DNA, 18 bp, Homo sapiens
acgaaacttgttattgtg

SEQ ID NO: 5354039 - DNA, 13 bp, Homo sapiens
acgaaagaaggca

SEQ ID NO: 5354040 - DNA, 17 bp, Homo sapiens
acgaaagtatttacttt

SEQ ID NO: 5354041 - DNA, 23 bp, Homo sapiens
acgaaagtatttactttttaaaa

SEQ ID NO: 5354042 - DNA, 21 bp, Homo sapiens
acgaaataattgttgttctgt

SEQ ID NO: 5354043 - DNA, 18 bp, Homo sapiens
acgaaatggaaacacaca

SEQ ID NO: 5354044 - DNA, 13 bp, Homo sapiens
acgaaatggctga

SEQ ID NO: 5354045 - DNA, 14 bp, Homo sapiens
acgaaatggctgaa

SEQ ID NO: 5354046 - DNA, 17 bp, Homo sapiens
acgaacacaagaaaaag

SEQ ID NO: 5354047 - DNA, 13 bp, Homo sapiens
acgaacagcccgc

SEQ ID NO: 5354048 - DNA, 14 bp, Homo sapiens
acgaacaggggcca

SEQ ID NO: 5354049 - DNA, 20 bp, Homo sapiens
acgaacccactgtgcttaca

SEQ ID NO: 5354050 - DNA, 17 bp, Homo sapiens
acgaacggaagggttgg

SEQ ID NO: 5354051 - DNA, 17 bp, Homo sapiens
acgaactggctacagta

SEQ ID NO: 5354052 - DNA, 14 bp, Homo sapiens
acgaacttccatgg

SEQ ID NO: 5354053 - DNA, 15 bp, Homo sapiens
acgaagaagagccac

SEQ ID NO: 5354054 - DNA, 18 bp, Homo sapiens
acgaagaagagccacagt

SEQ ID NO: 5354055 - DNA, 12 bp, Homo sapiens
acgaagccttaa

SEQ ID NO: 5354056 - DNA, 19 bp, Homo sapiens
acgaagcggagagagccaa

SEQ ID NO: 5354057 - DNA, 17 bp, Homo sapiens
acgaaggctgcccctgt

SEQ ID NO: 5354058 - DNA, 23 bp, Homo sapiens
acgaaggggccccggggctggca

SEQ ID NO: 5354059 - DNA, 16 bp, Homo sapiens
acgaagtctttttcat

SEQ ID NO: 5354060 - DNA, 20 bp, Homo sapiens
acgaataaacgcagaagagg

SEQ ID NO: 5354061 - DNA, 18 bp, Homo sapiens
acgaatagacatcaaact

SEQ ID NO: 5354062 - DNA, 14 bp, Homo sapiens
acgaatatgaatgt

SEQ ID NO: 5354063 - DNA, 18 bp, Homo sapiens
acgaatatggacatatca

SEQ ID NO: 5354064 - DNA, 14 bp, Homo sapiens
acgaatattttcag

SEQ ID NO: 5354065 - DNA, 18 bp, Homo sapiens
acgaatcttatttttcct

SEQ ID NO: 5354066 - DNA, 18 bp, Homo sapiens
acgaatcttctcaatggg

SEQ ID NO: 5354067 - DNA, 21 bp, Homo sapiens
acgaatgaaaataactgaatt

SEQ ID NO: 5354068 - DNA, 18 bp, Homo sapiens
acgaatgcatattcaaca

SEQ ID NO: 5354069 - DNA, 20 bp, Homo sapiens
acgaatgcatattcaacaca

SEQ ID NO: 5354070 - DNA, 22 bp, Homo sapiens
acgaatgcatattcaacacact

SEQ ID NO: 5354071 - DNA, 13 bp, Homo sapiens
acgaatggaccct

SEQ ID NO: 5354072 - DNA, 19 bp, Homo sapiens
acgaattatttttttaaac

SEQ ID NO: 5354073 - DNA, 20 bp, Homo sapiens
acgacaatagctttaccctc

SEQ ID NO: 5354074 - DNA, 19 bp, Homo sapiens
acgacacatatacatatga

SEQ ID NO: 5354075 - DNA, 12 bp, Homo sapiens
acgacagaggag

SEQ ID NO: 5354076 - DNA, 22 bp, Homo sapiens
acgacagtactttcaatgaaca

SEQ ID NO: 5354077 - DNA, 17 bp, Homo sapiens
acgaccacagggtctgc

SEQ ID NO: 5354078 - DNA, 14 bp, Homo sapiens
acgaccagcccctt

SEQ ID NO: 5354079 - DNA, 20 bp, Homo sapiens
acgaccagccccttcctggg

SEQ ID NO: 5354080 - DNA, 22 bp, Homo sapiens
acgaccagccccttcctgggta

SEQ ID NO: 5354081 - DNA, 17 bp, Homo sapiens
acgacccttaggccttt

SEQ ID NO: 5354082 - DNA, 23 bp, Homo sapiens
acgacctggggtgggcacaggga

SEQ ID NO: 5354083 - DNA, 13 bp, Homo sapiens
acgacctgtcctg

SEQ ID NO: 5354084 - DNA, 18 bp, Homo sapiens
acgacctgtcctgtcttt

SEQ ID NO: 5354085 - DNA, 13 bp, Homo sapiens
acgacgccctctc

SEQ ID NO: 5354086 - DNA, 14 bp, Homo sapiens
acgacgctgcagag

SEQ ID NO: 5354087 - DNA, 16 bp, Homo sapiens
acgacgtcagcctctt

SEQ ID NO: 5354088 - DNA, 14 bp, Homo sapiens
acgactactttgct

SEQ ID NO: 5354089 - DNA, 16 bp, Homo sapiens
acgactagcccaggac

SEQ ID NO: 5354090 - DNA, 15 bp, Homo sapiens
acgactcaaaatgac

SEQ ID NO: 5354091 - DNA, 13 bp, Homo sapiens
acgactcttcctg

SEQ ID NO: 5354092 - DNA, 12 bp, Homo sapiens
acgactgaagaa

SEQ ID NO: 5354093 - DNA, 19 bp, Homo sapiens
acgactgcaacatacaggt

SEQ ID NO: 5354094 - DNA, 12 bp, Homo sapiens
acgactgtctcc

SEQ ID NO: 5354095 - DNA, 14 bp, Homo sapiens
acgactttctttaa

SEQ ID NO: 5354096 - DNA, 13 bp, Homo sapiens
acgacttttgttt

SEQ ID NO: 5354097 - DNA, 17 bp, Homo sapiens
acgagaaaatctgcatg

SEQ ID NO: 5354098 - DNA, 21 bp, Homo sapiens
acgagaacctgaaggggaagg

SEQ ID NO: 5354099 - DNA, 14 bp, Homo sapiens
acgagaagtgccct

SEQ ID NO: 5354100 - DNA, 12 bp, Homo sapiens
acgagacaacag

SEQ ID NO: 5354101 - DNA, 19 bp, Homo sapiens
acgagacaacagcacacag

SEQ ID NO: 5354102 - DNA, 17 bp, Homo sapiens
acgagacacattgcctt

SEQ ID NO: 5354103 - DNA, 19 bp, Homo sapiens
acgagacacattgccttct

SEQ ID NO: 5354104 - DNA, 15 bp, Homo sapiens
acgagacccccatcc

SEQ ID NO: 5354105 - DNA, 23 bp, Homo sapiens
acgagacccccatccagcctcca

SEQ ID NO: 5354106 - DNA, 19 bp, Homo sapiens
acgagaccctacaggagag

SEQ ID NO: 5354107 - DNA, 19 bp, Homo sapiens
acgagactttctcctggcc

SEQ ID NO: 5354108 - DNA, 20 bp, Homo sapiens
acgagagagtcttccaggta

SEQ ID NO: 5354109 - DNA, 17 bp, Homo sapiens
acgagagcagaggtctc

SEQ ID NO: 5354110 - DNA, 21 bp, Homo sapiens
acgagaggggaagagtgtact

SEQ ID NO: 5354111 - DNA, 15 bp, Homo sapiens
acgagatcttccttc

SEQ ID NO: 5354112 - DNA, 11 bp, Homo sapiens
acgagatttgc

SEQ ID NO: 5354113 - DNA, 14 bp, Homo sapiens
acgagcactggcca

SEQ ID NO: 5354114 - DNA, 19 bp, Homo sapiens
acgagcagagcgcagcccc

SEQ ID NO: 5354115 - DNA, 16 bp, Homo sapiens
acgagcagcccagggc

SEQ ID NO: 5354116 - DNA, 19 bp, Homo sapiens
acgagcaggctactgtcag

SEQ ID NO: 5354117 - DNA, 23 bp, Homo sapiens
acgagcatccccctcctctccct

SEQ ID NO: 5354118 - DNA, 15 bp, Homo sapiens
acgagccacaagctg

SEQ ID NO: 5354119 - DNA, 19 bp, Homo sapiens
acgagccacaagctgcact

SEQ ID NO: 5354120 - DNA, 23 bp, Homo sapiens
acgagccccacagagcaggaagc

SEQ ID NO: 5354121 - DNA, 20 bp, Homo sapiens
acgagcccttttagatgctt

SEQ ID NO: 5354122 - DNA, 19 bp, Homo sapiens
acgagcctcctcagggggt

SEQ ID NO: 5354123 - DNA, 23 bp, Homo sapiens
acgagcctcctcagggggtagga

SEQ ID NO: 5354124 - DNA, 16 bp, Homo sapiens
acgagcctggaagcac

SEQ ID NO: 5354125 - DNA, 22 bp, Homo sapiens
acgagccttctcaccccaggat

SEQ ID NO: 5354126 - DNA, 13 bp, Homo sapiens
acgagccttttca

SEQ ID NO: 5354127 - DNA, 20 bp, Homo sapiens
acgaggaaaaggtccttgcc

SEQ ID NO: 5354128 - DNA, 22 bp, Homo sapiens
acgaggaatctgtgggtctggg

SEQ ID NO: 5354129 - DNA, 12 bp, Homo sapiens
acgaggagcagc

SEQ ID NO: 5354130 - DNA, 13 bp, Homo sapiens
acgaggagcagca

SEQ ID NO: 5354131 - DNA, 14 bp, Homo sapiens
acgaggaggaacca

SEQ ID NO: 5354132 - DNA, 14 bp, Homo sapiens
acgaggcaggggct

SEQ ID NO: 5354133 - DNA, 19 bp, Homo sapiens
acgaggcattcgggccggt

SEQ ID NO: 5354134 - DNA, 18 bp, Homo sapiens
acgaggccaagctgagga

SEQ ID NO: 5354135 - DNA, 19 bp, Homo sapiens
acgaggccactcagaggcc

SEQ ID NO: 5354136 - DNA, 11 bp, Homo sapiens
acgaggccctc

SEQ ID NO: 5354137 - DNA, 18 bp, Homo sapiens
acgaggccctcgggccca

SEQ ID NO: 5354138 - DNA, 19 bp, Homo sapiens
acgaggccctcgggcccag

SEQ ID NO: 5354139 - DNA, 20 bp, Homo sapiens
acgaggccctcgggcccagc

SEQ ID NO: 5354140 - DNA, 22 bp, Homo sapiens
acgaggccctcgggcccagccc

SEQ ID NO: 5354141 - DNA, 23 bp, Homo sapiens
acgaggccctcgggcccagcccc

SEQ ID NO: 5354142 - DNA, 15 bp, Homo sapiens
acgaggccttcagaa

SEQ ID NO: 5354143 - DNA, 19 bp, Homo sapiens
acgcgtatgttcgttgcag

SEQ ID NO: 5354144 - DNA, 20 bp, Homo sapiens
acgcgtatgttcgttgcagc

SEQ ID NO: 5354145 - DNA, 17 bp, Homo sapiens
acgcgtccacatacact

SEQ ID NO: 5354146 - DNA, 22 bp, Homo sapiens
acgcgtccacatacactgcatt

SEQ ID NO: 5354147 - DNA, 18 bp, Homo sapiens
acgcgtgcataaaaactg

SEQ ID NO: 5354148 - DNA, 16 bp, Homo sapiens
acgcgtgcatatgcta

SEQ ID NO: 5354149 - DNA, 20 bp, Homo sapiens
acgcgtggtaaatgacccag

SEQ ID NO: 5354150 - DNA, 23 bp, Homo sapiens
acgcgtgtgtacacgggactgac

SEQ ID NO: 5354151 - DNA, 15 bp, Homo sapiens
acgcgtgtgtgcctg

SEQ ID NO: 5354152 - DNA, 13 bp, Homo sapiens
acgcgttgaaatt

SEQ ID NO: 5354153 - DNA, 20 bp, Homo sapiens
acgcgttgaaattgtaatta

SEQ ID NO: 5354154 - DNA, 20 bp, Homo sapiens
acgctaaagagcccttgcct

SEQ ID NO: 5354155 - DNA, 19 bp, Homo sapiens
acgctatccagttgcaggt

SEQ ID NO: 5354156 - DNA, 19 bp, Homo sapiens
acgctcaaggaaggatgcc

SEQ ID NO: 5354157 - DNA, 14 bp, Homo sapiens
acgctcaatgccca

SEQ ID NO: 5354158 - DNA, 16 bp, Homo sapiens
acgctcaatgcccagt

SEQ ID NO: 5354159 - DNA, 21 bp, Homo sapiens
acgctcaatgcccagtaaaat

SEQ ID NO: 5354160 - DNA, 22 bp, Homo sapiens
acgctcaatgcccagtaaaatt

SEQ ID NO: 5354161 - DNA, 22 bp, Homo sapiens
acgctcagccccaggccagctg

SEQ ID NO: 5354162 - DNA, 11 bp, Homo sapiens
acgctcagtgc

SEQ ID NO: 5354163 - DNA, 13 bp, Homo sapiens
acgctccaaagtc

SEQ ID NO: 5354164 - DNA, 16 bp, Homo sapiens
acgctccagctgcccc

SEQ ID NO: 5354165 - DNA, 14 bp, Homo sapiens
acgctccccgcctg

SEQ ID NO: 5354166 - DNA, 22 bp, Homo sapiens
acgctccccgcctgttcccccg

SEQ ID NO: 5354167 - DNA, 11 bp, Homo sapiens
acgctcccctc

SEQ ID NO: 5354168 - DNA, 12 bp, Homo sapiens
acgctcccctcc

SEQ ID NO: 5354169 - DNA, 13 bp, Homo sapiens
acgctcccctcca

SEQ ID NO: 5354170 - DNA, 14 bp, Homo sapiens
acgctcccctccat

SEQ ID NO: 5354171 - DNA, 19 bp, Homo sapiens
acgctccctccccctgccc

SEQ ID NO: 5354172 - DNA, 21 bp, Homo sapiens
acgctccctgacttctccccc

SEQ ID NO: 5354173 - DNA, 15 bp, Homo sapiens
acgctccctggaagc

SEQ ID NO: 5354174 - DNA, 11 bp, Homo sapiens
acgctcctctg

SEQ ID NO: 5354175 - DNA, 12 bp, Homo sapiens
acgctcctctgc

SEQ ID NO: 5354176 - DNA, 15 bp, Homo sapiens
acgctcctctgccct

SEQ ID NO: 5354177 - DNA, 14 bp, Homo sapiens
acgctccttcctct

SEQ ID NO: 5354178 - DNA, 21 bp, Homo sapiens
acgctcgcgggcagcgggcca

SEQ ID NO: 5354179 - DNA, 12 bp, Homo sapiens
acgctcgctgcc

SEQ ID NO: 5354180 - DNA, 14 bp, Homo sapiens
acgctcgctgccat

SEQ ID NO: 5354181 - DNA, 17 bp, Homo sapiens
acgctctaccctgcagc

SEQ ID NO: 5354182 - DNA, 16 bp, Homo sapiens
acgctctcctcgagcc

SEQ ID NO: 5354183 - DNA, 22 bp, Homo sapiens
acgctctcctttctttctaact

SEQ ID NO: 5354184 - DNA, 19 bp, Homo sapiens
acgctctcgtctctcgttt

SEQ ID NO: 5354185 - DNA, 11 bp, Homo sapiens
acgctctctgg

SEQ ID NO: 5354186 - DNA, 14 bp, Homo sapiens
acgctctctggcct

SEQ ID NO: 5354187 - DNA, 15 bp, Homo sapiens
acgctctctggcctt

SEQ ID NO: 5354188 - DNA, 13 bp, Homo sapiens
acgctctctgtct

SEQ ID NO: 5354189 - DNA, 20 bp, Homo sapiens
acgctctctgtctggctgta

SEQ ID NO: 5354190 - DNA, 18 bp, Homo sapiens
acgctctgcaccttctga

SEQ ID NO: 5354191 - DNA, 13 bp, Homo sapiens
acgctctggacat

SEQ ID NO: 5354192 - DNA, 16 bp, Homo sapiens
acgctctggtgcagtc

SEQ ID NO: 5354193 - DNA, 15 bp, Homo sapiens
acgctgaagcggtca

SEQ ID NO: 5354194 - DNA, 19 bp, Homo sapiens
acgctgaagcggtcagact

SEQ ID NO: 5354195 - DNA, 13 bp, Homo sapiens
acgctgaataaat

SEQ ID NO: 5354196 - DNA, 13 bp, Homo sapiens
acgctgaatgaga

SEQ ID NO: 5354197 - DNA, 16 bp, Homo sapiens
acgctgactacagggc

SEQ ID NO: 5354198 - DNA, 18 bp, Homo sapiens
acgctgactacagggccg

SEQ ID NO: 5354199 - DNA, 15 bp, Homo sapiens
acgctgagccacctg

SEQ ID NO: 5354200 - DNA, 20 bp, Homo sapiens
acgctgatgtttatgtactg

SEQ ID NO: 5354201 - DNA, 17 bp, Homo sapiens
acgctgattcctaaggc

SEQ ID NO: 5354202 - DNA, 18 bp, Homo sapiens
acgctgattcctaaggcc

SEQ ID NO: 5354203 - DNA, 17 bp, Homo sapiens
acgctgcagaccccagg

SEQ ID NO: 5354204 - DNA, 23 bp, Homo sapiens
acgctgccatttccctgaacaga

SEQ ID NO: 5354205 - DNA, 13 bp, Homo sapiens
acgctgccctgca

SEQ ID NO: 5354206 - DNA, 19 bp, Homo sapiens
acgctgcctgccaaagtag

SEQ ID NO: 5354207 - DNA, 15 bp, Homo sapiens
acgctgcctggtctg

SEQ ID NO: 5354208 - DNA, 22 bp, Homo sapiens
acgctgcctggtctgtctggat

SEQ ID NO: 5354209 - DNA, 18 bp, Homo sapiens
acgctgccttcggtaccc

SEQ ID NO: 5354210 - DNA, 17 bp, Homo sapiens
acgctgctctcctgaca

SEQ ID NO: 5354211 - DNA, 19 bp, Homo sapiens
acgctgctctgccccagct

SEQ ID NO: 5354212 - DNA, 21 bp, Homo sapiens
acgctgctgcaggacattaat

SEQ ID NO: 5354213 - DNA, 23 bp, Homo sapiens
acgctggagatgcaaggtgctgg

SEQ ID NO: 5354214 - DNA, 13 bp, Homo sapiens
acgctggagctgt

SEQ ID NO: 5354215 - DNA, 22 bp, Homo sapiens
acgctgggaataggtttcaaca

SEQ ID NO: 5354216 - DNA, 15 bp, Homo sapiens
acgctgggacacaga

SEQ ID NO: 5354217 - DNA, 17 bp, Homo sapiens
acgctgggacacagacc

SEQ ID NO: 5354218 - DNA, 11 bp, Homo sapiens
acgctgggcct

SEQ ID NO: 5354219 - DNA, 21 bp, Homo sapiens
acgctgggtattaccatgtaa

SEQ ID NO: 5354220 - DNA, 20 bp, Homo sapiens
acgctgtcaaaagttggact

SEQ ID NO: 5354221 - DNA, 22 bp, Homo sapiens
acgctgtccattgccacggcca

SEQ ID NO: 5354222 - DNA, 23 bp, Homo sapiens
acgctgtccctagtaaaaataca

SEQ ID NO: 5354223 - DNA, 14 bp, Homo sapiens
acgctgtcctctcg

SEQ ID NO: 5354224 - DNA, 11 bp, Homo sapiens
acgctgtctcc

SEQ ID NO: 5354225 - DNA, 14 bp, Homo sapiens
acgctgtctccaga

SEQ ID NO: 5354226 - DNA, 15 bp, Homo sapiens
acgctgtctccagac

SEQ ID NO: 5354227 - DNA, 19 bp, Homo sapiens
acgctgtctccagaccccc

SEQ ID NO: 5354228 - DNA, 18 bp, Homo sapiens
acgctgtgatgctgtgtg

SEQ ID NO: 5354229 - DNA, 20 bp, Homo sapiens
acgctgtgattggcaggagg

SEQ ID NO: 5354230 - DNA, 21 bp, Homo sapiens
acgctgtgattggcaggaggc

SEQ ID NO: 5354231 - DNA, 12 bp, Homo sapiens
acgctgtgctgc

SEQ ID NO: 5354232 - DNA, 16 bp, Homo sapiens
acgctgtgctgccctg

SEQ ID NO: 5354233 - DNA, 18 bp, Homo sapiens
acgctgtgctgccctgcc

SEQ ID NO: 5354234 - DNA, 22 bp, Homo sapiens
acgctgttctaatggcacttat

SEQ ID NO: 5354235 - DNA, 21 bp, Homo sapiens
acgcttaaaggtgtcttcctc

SEQ ID NO: 5354236 - DNA, 14 bp, Homo sapiens
acgcttaaatacag

SEQ ID NO: 5354237 - DNA, 13 bp, Homo sapiens
acgcttccagacc

SEQ ID NO: 5354238 - DNA, 20 bp, Homo sapiens
acgcttccagaccacctgcc

SEQ ID NO: 5354239 - DNA, 21 bp, Homo sapiens
acgcttcgggaaaatattcat

SEQ ID NO: 5354240 - DNA, 18 bp, Homo sapiens
acgcttctgaatgctgct

SEQ ID NO: 5354241 - DNA, 17 bp, Homo sapiens
acgcttctgagcagggg

SEQ ID NO: 5354242 - DNA, 23 bp, Homo sapiens
acgcttctggaggtggggagggc

SEQ ID NO: 5354243 - DNA, 20 bp, Homo sapiens
acgcttcttatgtagagttt

SEQ ID NO: 5354244 - DNA, 21 bp, Homo sapiens
acgcttgacaggacagcatgg

SEQ ID NO: 5354245 - DNA, 20 bp, Homo sapiens
acgcttgcttaggagattta

SEQ ID NO: 5354246 - DNA, 20 bp, Homo sapiens
acgcttgtagaactcactct

SEQ ID NO: 5354247 - DNA, 21 bp, Homo sapiens
acgcttgtagaactcactctg

SEQ ID NO: 5354248 - DNA, 12 bp, Homo sapiens
acgcttgtgaat

SEQ ID NO: 5354249 - DNA, 15 bp, Homo sapiens
acgcttgtgacagtg

SEQ ID NO: 5354250 - DNA, 18 bp, Homo sapiens
acgctttcctgaatccaa

SEQ ID NO: 5354251 - DNA, 14 bp, Homo sapiens
acgctttgtttact

SEQ ID NO: 5354252 - DNA, 16 bp, Homo sapiens
acgctttgtttactct

SEQ ID NO: 5354253 - DNA, 16 bp, Homo sapiens
acgcttttaattctca

SEQ ID NO: 5354254 - DNA, 23 bp, Homo sapiens
acgcttttaattctcatttgttc

SEQ ID NO: 5354255 - DNA, 15 bp, Homo sapiens
acgcttttgagtggg

SEQ ID NO: 5354256 - DNA, 23 bp, Homo sapiens
acgcttttgggaaaactgggtgg

SEQ ID NO: 5354257 - DNA, 17 bp, Homo sapiens
acgctttttgaaaaagc

SEQ ID NO: 5354258 - DNA, 13 bp, Homo sapiens
acggaacagatct

SEQ ID NO: 5354259 - DNA, 17 bp, Homo sapiens
acggaacgttggacttt

SEQ ID NO: 5354260 - DNA, 20 bp, Homo sapiens
acggaataagagacctgttt

SEQ ID NO: 5354261 - DNA, 19 bp, Homo sapiens
acggaatagttggctagga

SEQ ID NO: 5354262 - DNA, 18 bp, Homo sapiens
acggacaataaacctccg

SEQ ID NO: 5354263 - DNA, 14 bp, Homo sapiens
acggaccactcgag

SEQ ID NO: 5354264 - DNA, 17 bp, Homo sapiens
acggaccgcatcctcca

SEQ ID NO: 5354265 - DNA, 18 bp, Homo sapiens
acggaccgcatcctccag

SEQ ID NO: 5354266 - DNA, 22 bp, Homo sapiens
acggacgtcctgctggcacctc

SEQ ID NO: 5354267 - DNA, 16 bp, Homo sapiens
acggacgtttccatca

SEQ ID NO: 5354268 - DNA, 19 bp, Homo sapiens
acggactcagactcctggc

SEQ ID NO: 5354269 - DNA, 22 bp, Homo sapiens
acggactcagtggacactcaga

SEQ ID NO: 5354270 - DNA, 15 bp, Homo sapiens
acggactcccgggcc

SEQ ID NO: 5354271 - DNA, 23 bp, Homo sapiens
acggagaaactcatcatttttat

SEQ ID NO: 5354272 - DNA, 17 bp, Homo sapiens
acggagaccccggtggc

SEQ ID NO: 5354273 - DNA, 22 bp, Homo sapiens
acggagatgaagaacatctgga

SEQ ID NO: 5354274 - DNA, 14 bp, Homo sapiens
acggagatgtttca

SEQ ID NO: 5354275 - DNA, 15 bp, Homo sapiens
acggagcactgcacc

SEQ ID NO: 5354276 - DNA, 22 bp, Homo sapiens
acggagccatgtcatgtgccac

SEQ ID NO: 5354277 - DNA, 20 bp, Homo sapiens
acggagcccctgaaagcctc

SEQ ID NO: 5354278 - DNA, 14 bp, Homo sapiens
acggagctcctggc

SEQ ID NO: 5354279 - DNA, 14 bp, Homo sapiens
acggaggaacagat

SEQ ID NO: 5354280 - DNA, 22 bp, Homo sapiens
acggaggagttttggcagccag

SEQ ID NO: 5354281 - DNA, 18 bp, Homo sapiens
acggaggcaggaccaggc

SEQ ID NO: 5354282 - DNA, 18 bp, Homo sapiens
acggaggcatcctaccct

SEQ ID NO: 5354283 - DNA, 12 bp, Homo sapiens
acggaggccaga

SEQ ID NO: 5354284 - DNA, 15 bp, Homo sapiens
acggagtacagacgt

SEQ ID NO: 5354285 - DNA, 13 bp, Homo sapiens
acggagtctcgct

SEQ ID NO: 5354286 - DNA, 13 bp, Homo sapiens
acggagtcttgct

SEQ ID NO: 5354287 - DNA, 19 bp, Homo sapiens
acggagtggggggacagag

SEQ ID NO: 5354288 - DNA, 17 bp, Homo sapiens
acggatcagaaatacag

SEQ ID NO: 5354289 - DNA, 20 bp, Homo sapiens
acggatccatgtagcaggac

SEQ ID NO: 5354290 - DNA, 21 bp, Homo sapiens
acggatccatgtagcaggact

SEQ ID NO: 5354291 - DNA, 14 bp, Homo sapiens
acggatctgctggg

SEQ ID NO: 5354292 - DNA, 16 bp, Homo sapiens
acggatgattggatta

SEQ ID NO: 5354293 - DNA, 13 bp, Homo sapiens
acggatgatttct

SEQ ID NO: 5354294 - DNA, 22 bp, Homo sapiens
acggatgcccattcctgcctgg

SEQ ID NO: 5354295 - DNA, 23 bp, Homo sapiens
acggatgcccattcctgcctggt

SEQ ID NO: 5354296 - DNA, 19 bp, Homo sapiens
acggatgcgtgggcagagg

SEQ ID NO: 5354297 - DNA, 20 bp, Homo sapiens
acggatgcgtgggcagagga

SEQ ID NO: 5354298 - DNA, 21 bp, Homo sapiens
acggatgcgtgggcagaggaa

SEQ ID NO: 5354299 - DNA, 19 bp, Homo sapiens
acggatgctccgaggactg

SEQ ID NO: 5354300 - DNA, 14 bp, Homo sapiens
acggatggaaggag

SEQ ID NO: 5354301 - DNA, 19 bp, Homo sapiens
acggatggtgcatgggctc

SEQ ID NO: 5354302 - DNA, 18 bp, Homo sapiens
acggattatctagagaat

SEQ ID NO: 5354303 - DNA, 17 bp, Homo sapiens
acggattattttttcag

SEQ ID NO: 5354304 - DNA, 12 bp, Homo sapiens
acggattccaaa

SEQ ID NO: 5354305 - DNA, 16 bp, Homo sapiens
acggattctaaggact

SEQ ID NO: 5354306 - DNA, 15 bp, Homo sapiens
acggatttatttttc

SEQ ID NO: 5354307 - DNA, 14 bp, Homo sapiens
acggattttcagtt

SEQ ID NO: 5354308 - DNA, 15 bp, Homo sapiens
acggattttcagtta

SEQ ID NO: 5354309 - DNA, 14 bp, Homo sapiens
acggcaacagcatg

SEQ ID NO: 5354310 - DNA, 19 bp, Homo sapiens
acggcaaccacatgtccca

SEQ ID NO: 5354311 - DNA, 22 bp, Homo sapiens
acggcaacctgcggaaggaggt

SEQ ID NO: 5354312 - DNA, 16 bp, Homo sapiens
acggcaaggctgaggt

SEQ ID NO: 5354313 - DNA, 13 bp, Homo sapiens
acggcactccagc

SEQ ID NO: 5354314 - DNA, 22 bp, Homo sapiens
acggcactgagagagcgcagcc

SEQ ID NO: 5354315 - DNA, 14 bp, Homo sapiens
acggcactgtggcc

SEQ ID NO: 5354316 - DNA, 20 bp, Homo sapiens
acggcagaaaacagagcctg

SEQ ID NO: 5354317 - DNA, 21 bp, Homo sapiens
acggcagaaaacagagcctgc

SEQ ID NO: 5354318 - DNA, 22 bp, Homo sapiens
acggcagacctcttagagtcct

SEQ ID NO: 5354319 - DNA, 19 bp, Homo sapiens
acggcagagaccccaggat

SEQ ID NO: 5354320 - DNA, 18 bp, Homo sapiens
acggcagccaccctgcca

SEQ ID NO: 5354321 - DNA, 20 bp, Homo sapiens
acgtctgtgagtctgtcctt

SEQ ID NO: 5354322 - DNA, 15 bp, Homo sapiens
acgtctgtgctctgt

SEQ ID NO: 5354323 - DNA, 19 bp, Homo sapiens
acgtctgtgctctgtcctt

SEQ ID NO: 5354324 - DNA, 18 bp, Homo sapiens
acgtcttcttgctgcagc

SEQ ID NO: 5354325 - DNA, 17 bp, Homo sapiens
acgtctttagatgctat

SEQ ID NO: 5354326 - DNA, 14 bp, Homo sapiens
acgtctttcctgct

SEQ ID NO: 5354327 - DNA, 17 bp, Homo sapiens
acgtctttcctgctaca

SEQ ID NO: 5354328 - DNA, 15 bp, Homo sapiens
acgtctttttaagcc

SEQ ID NO: 5354329 - DNA, 19 bp, Homo sapiens
acgtgaaagatgcaagcac

SEQ ID NO: 5354330 - DNA, 21 bp, Homo sapiens
acgtgaaaggaatacacttgt

SEQ ID NO: 5354331 - DNA, 23 bp, Homo sapiens
acgtgaaatacttcgatgatgat

SEQ ID NO: 5354332 - DNA, 13 bp, Homo sapiens
acgtgaaatattt

SEQ ID NO: 5354333 - DNA, 17 bp, Homo sapiens
acgtgaaatttgcctct

SEQ ID NO: 5354334 - DNA, 16 bp, Homo sapiens
acgtgaagaaataaat

SEQ ID NO: 5354335 - DNA, 15 bp, Homo sapiens
acgtgaagcctcccg

SEQ ID NO: 5354336 - DNA, 19 bp, Homo sapiens
acgtgaataggctgctttt

SEQ ID NO: 5354337 - DNA, 14 bp, Homo sapiens
acgtgaatgtctca

SEQ ID NO: 5354338 - DNA, 15 bp, Homo sapiens
acgtgaatgtctcag

SEQ ID NO: 5354339 - DNA, 21 bp, Homo sapiens
acgtgacacaaacacacacaa

SEQ ID NO: 5354340 - DNA, 14 bp, Homo sapiens
acgtgacaggctcg

SEQ ID NO: 5354341 - DNA, 16 bp, Homo sapiens
acgtgacagtgcctgg

SEQ ID NO: 5354342 - DNA, 15 bp, Homo sapiens
acgtgaccagccccg

SEQ ID NO: 5354343 - DNA, 15 bp, Homo sapiens
acgtgaccctctgct

SEQ ID NO: 5354344 - DNA, 14 bp, Homo sapiens
acgtgaccctgtgc

SEQ ID NO: 5354345 - DNA, 15 bp, Homo sapiens
acgtgaccctgtgcc

SEQ ID NO: 5354346 - DNA, 20 bp, Homo sapiens
acgtgactgccccaactcct

SEQ ID NO: 5354347 - DNA, 18 bp, Homo sapiens
acgtgagagaaagagaga

SEQ ID NO: 5354348 - DNA, 16 bp, Homo sapiens
acgtgagagaccctcg

SEQ ID NO: 5354349 - DNA, 21 bp, Homo sapiens
acgtgaggcccctgtgcagta

SEQ ID NO: 5354350 - DNA, 18 bp, Homo sapiens
acgtgagggggagctgaa

SEQ ID NO: 5354351 - DNA, 20 bp, Homo sapiens
acgtgataatgcagataaat

SEQ ID NO: 5354352 - DNA, 22 bp, Homo sapiens
acgtgatctctgttacaaaaga

SEQ ID NO: 5354353 - DNA, 21 bp, Homo sapiens
acgtgatgttttgaatgtgga

SEQ ID NO: 5354354 - DNA, 17 bp, Homo sapiens
acgtgattgattcagta

SEQ ID NO: 5354355 - DNA, 19 bp, Homo sapiens
acgtgattgattcagtatc

SEQ ID NO: 5354356 - DNA, 18 bp, Homo sapiens
acgtgatttccagtgagt

SEQ ID NO: 5354357 - DNA, 16 bp, Homo sapiens
acgtgatttttaaatt

SEQ ID NO: 5354358 - DNA, 16 bp, Homo sapiens
acgtgcaacagactgc

SEQ ID NO: 5354359 - DNA, 20 bp, Homo sapiens
acgtgcaacagactgcctta

SEQ ID NO: 5354360 - DNA, 23 bp, Homo sapiens
acgtgcaactgacactcccaccc

SEQ ID NO: 5354361 - DNA, 19 bp, Homo sapiens
acgtgcaatttgtttgtgc

SEQ ID NO: 5354362 - DNA, 15 bp, Homo sapiens
acgtgcacacacctg

SEQ ID NO: 5354363 - DNA, 13 bp, Homo sapiens
acgtgcacagctt

SEQ ID NO: 5354364 - DNA, 11 bp, Homo sapiens
acgtgcacagg

SEQ ID NO: 5354365 - DNA, 20 bp, Homo sapiens
acgtgcacctgtactcagga

SEQ ID NO: 5354366 - DNA, 21 bp, Homo sapiens
acgtgcacctgtactcaggag

SEQ ID NO: 5354367 - DNA, 13 bp, Homo sapiens
acgtgcactgtga

SEQ ID NO: 5354368 - DNA, 23 bp, Homo sapiens
acgtgcactgtgaatcctggcaa

SEQ ID NO: 5354369 - DNA, 18 bp, Homo sapiens
acgtgcaggacagctctt

SEQ ID NO: 5354370 - DNA, 15 bp, Homo sapiens
acgtgcattgtgctt

SEQ ID NO: 5354371 - DNA, 16 bp, Homo sapiens
acgtgcattgtgcttc

SEQ ID NO: 5354372 - DNA, 18 bp, Homo sapiens
acgtgcatttaaactctg

SEQ ID NO: 5354373 - DNA, 22 bp, Homo sapiens
acgtgcatttaaactctgccag

SEQ ID NO: 5354374 - DNA, 13 bp, Homo sapiens
acgtgccagcagc

SEQ ID NO: 5354375 - DNA, 19 bp, Homo sapiens
acgtgccaggcccggggct

SEQ ID NO: 5354376 - DNA, 14 bp, Homo sapiens
acgtgcccatttca

SEQ ID NO: 5354377 - DNA, 18 bp, Homo sapiens
acgtgcccatttcacaca

SEQ ID NO: 5354378 - DNA, 17 bp, Homo sapiens
acgtgcccccagagtgt

SEQ ID NO: 5354379 - DNA, 13 bp, Homo sapiens
acgtgccccccag

SEQ ID NO: 5354380 - DNA, 20 bp, Homo sapiens
acgtgcctgtagtcccagct

SEQ ID NO: 5354381 - DNA, 16 bp, Homo sapiens
acgtgccttaggaata

SEQ ID NO: 5354382 - DNA, 15 bp, Homo sapiens
acgtgccttttgcac

SEQ ID NO: 5354383 - DNA, 19 bp, Homo sapiens
acgtgccttttgcacccct

SEQ ID NO: 5354384 - DNA, 20 bp, Homo sapiens
acgtgccttttgcacccctc

SEQ ID NO: 5354385 - DNA, 22 bp, Homo sapiens
acgtgccttttgcacccctccc

SEQ ID NO: 5354386 - DNA, 14 bp, Homo sapiens
acgtgcgcgcccag

SEQ ID NO: 5354387 - DNA, 17 bp, Homo sapiens
acgtgcgcgcccaggcc

SEQ ID NO: 5354388 - DNA, 20 bp, Homo sapiens
acgtgcgtgtgagtgtgtgt

SEQ ID NO: 5354389 - DNA, 14 bp, Homo sapiens
acgtgctcactgtg

SEQ ID NO: 5354390 - DNA, 24 bp, Homo sapiens
acgtgctccgtagctctgctgctg

SEQ ID NO: 5354391 - DNA, 16 bp, Homo sapiens
acgtgctcgcagcctg

SEQ ID NO: 5354392 - DNA, 14 bp, Homo sapiens
acgtgctgctcaag

SEQ ID NO: 5354393 - DNA, 13 bp, Homo sapiens
acgtgctggagag

SEQ ID NO: 5354394 - DNA, 15 bp, Homo sapiens
acgtgctggagagta

SEQ ID NO: 5354395 - DNA, 21 bp, Homo sapiens
acgtgcttcctctcttgacat

SEQ ID NO: 5354396 - DNA, 12 bp, Homo sapiens
acgtgcttcttt

SEQ ID NO: 5354397 - DNA, 16 bp, Homo sapiens
acgtggaacctctgtc

SEQ ID NO: 5354398 - DNA, 17 bp, Homo sapiens
acgtggacatgcctcaa

SEQ ID NO: 5354399 - DNA, 14 bp, Homo sapiens
acgtggacctgcct

SEQ ID NO: 5354400 - DNA, 15 bp, Homo sapiens
acgtggagagctggt

SEQ ID NO: 5354401 - DNA, 14 bp, Homo sapiens
acgtggagagggat

SEQ ID NO: 5354402 - DNA, 15 bp, Homo sapiens
acgtggagagggatg

SEQ ID NO: 5354403 - DNA, 16 bp, Homo sapiens
acgtggagctcttggc

SEQ ID NO: 5354404 - DNA, 21 bp, Homo sapiens
acgtggaggaatgctccccca

SEQ ID NO: 5354405 - DNA, 17 bp, Homo sapiens
acgtggaggagcagtgc

SEQ ID NO: 5354406 - DNA, 21 bp, Homo sapiens
acgtggattgtatttaagaca

SEQ ID NO: 5354407 - DNA, 17 bp, Homo sapiens
acgtggcacacactgac

SEQ ID NO: 5354408 - DNA, 20 bp, Homo sapiens
acgtggcacacactgaccac

SEQ ID NO: 5354409 - DNA, 13 bp, Homo sapiens
acgtggcacctcc

SEQ ID NO: 5354410 - DNA, 16 bp, Homo sapiens
acgtggcacctcctcg

SEQ ID NO: 5354411 - DNA, 15 bp, Homo sapiens
acgtggccaggagcc

SEQ ID NO: 5354412 - DNA, 16 bp, Homo sapiens
acgtggccgctgccca

SEQ ID NO: 5354413 - DNA, 22 bp, Homo sapiens
acgtggccgctgctgtgacagg

SEQ ID NO: 5354414 - DNA, 14 bp, Homo sapiens
acgtggctcagcca

SEQ ID NO: 5354415 - DNA, 19 bp, Homo sapiens
acgtggctcagccagcact

SEQ ID NO: 5354416 - DNA, 15 bp, Homo sapiens
acgtggctgcttcaa

SEQ ID NO: 5354417 - DNA, 23 bp, Homo sapiens
acgtggctgcttcaaggatcctg

SEQ ID NO: 5354418 - DNA, 16 bp, Homo sapiens
acgtgggagacaagaa

SEQ ID NO: 5354419 - DNA, 13 bp, Homo sapiens
acgtgggagaggc

SEQ ID NO: 5354420 - DNA, 12 bp, Homo sapiens
acgtgggaggct

SEQ ID NO: 5354421 - DNA, 13 bp, Homo sapiens
acgtgggaggctg

SEQ ID NO: 5354422 - DNA, 23 bp, Homo sapiens
acgtgggagttcagctgcttctc

SEQ ID NO: 5354423 - DNA, 20 bp, Homo sapiens
acgtgggcattcaaatgtat

SEQ ID NO: 5354424 - DNA, 20 bp, Homo sapiens
acgtgggcggcagagaggac

SEQ ID NO: 5354425 - DNA, 23 bp, Homo sapiens
acgtgggctgggcccacaaaggc

SEQ ID NO: 5354426 - DNA, 14 bp, Homo sapiens
acgtggggcagcac

SEQ ID NO: 5354427 - DNA, 14 bp, Homo sapiens
acgtggggcccact

SEQ ID NO: 5354428 - DNA, 22 bp, Homo sapiens
acgtggggtgagggatcactgc

SEQ ID NO: 5354429 - DNA, 20 bp, Homo sapiens
acgtgggtacccaggctggt

SEQ ID NO: 5354430 - DNA, 22 bp, Homo sapiens
acgtgggtcttcagggggccag

SEQ ID NO: 5354431 - DNA, 14 bp, Homo sapiens
acgtggtagtcact

SEQ ID NO: 5354432 - DNA, 19 bp, Homo sapiens
acgtggtcaccttcgagta

SEQ ID NO: 5354433 - DNA, 23 bp, Homo sapiens
acgtggtcactgtgcactgccct

SEQ ID NO: 5354434 - DNA, 20 bp, Homo sapiens
acgtggtctagaccagggct

SEQ ID NO: 5354435 - DNA, 22 bp, Homo sapiens
acgtggtgacctcacacacctc

SEQ ID NO: 5354436 - DNA, 16 bp, Homo sapiens
acgtggtggctcacac

SEQ ID NO: 5354437 - DNA, 22 bp, Homo sapiens
acgtggttcagagactggcagc

SEQ ID NO: 5354438 - DNA, 20 bp, Homo sapiens
acgtggttgccgtctctggc

SEQ ID NO: 5354439 - DNA, 18 bp, Homo sapiens
acgtggttggggccctgc

SEQ ID NO: 5354440 - DNA, 19 bp, Homo sapiens
acgtgtaaaggaaaataat

SEQ ID NO: 5354441 - DNA, 19 bp, Homo sapiens
acgtgtaaccagttataaa

SEQ ID NO: 5354442 - DNA, 13 bp, Homo sapiens
acgtgtaatgaca

SEQ ID NO: 5354443 - DNA, 13 bp, Homo sapiens
acgtgtacagcac

SEQ ID NO: 5354444 - DNA, 17 bp, Homo sapiens
acgtgtacagcacagaa

SEQ ID NO: 5354445 - DNA, 17 bp, Homo sapiens
acgtgtatagtatctgt

SEQ ID NO: 5354446 - DNA, 18 bp, Homo sapiens
acgtgtatagtatctgta

SEQ ID NO: 5354447 - DNA, 11 bp, Homo sapiens
acgtgtatgtt

SEQ ID NO: 5354448 - DNA, 17 bp, Homo sapiens
acgtgtatgtttcttct

SEQ ID NO: 5354449 - DNA, 16 bp, Homo sapiens
acgtgtatgtttttca

SEQ ID NO: 5354450 - DNA, 23 bp, Homo sapiens
acgtgtatgtttttcagttcaaa

SEQ ID NO: 5354451 - DNA, 13 bp, Homo sapiens
acgtgtcccgagc

SEQ ID NO: 5354452 - DNA, 13 bp, Homo sapiens
acgtgtcttccac

SEQ ID NO: 5354453 - DNA, 19 bp, Homo sapiens
acgtgtcttccactttgca

SEQ ID NO: 5354454 - DNA, 13 bp, Homo sapiens
acgtgtgaaatct

SEQ ID NO: 5354455 - DNA, 15 bp, Homo sapiens
acgtgtgaaatctgt

SEQ ID NO: 5354456 - DNA, 15 bp, Homo sapiens
acgtgtgatgtatgt

SEQ ID NO: 5354457 - DNA, 15 bp, Homo sapiens
acgtgtgatttttct

SEQ ID NO: 5354458 - DNA, 15 bp, Homo sapiens
acgtgtgcagactgt

SEQ ID NO: 5354459 - DNA, 15 bp, Homo sapiens
acgtgtgctgggatc

SEQ ID NO: 5354460 - DNA, 23 bp, Homo sapiens
acgtgtgggccgtggcttgggct

SEQ ID NO: 5354461 - DNA, 12 bp, Homo sapiens
acgtgtgtgaag

SEQ ID NO: 5354462 - DNA, 16 bp, Homo sapiens
acgtgtgtgactcaga

SEQ ID NO: 5354463 - DNA, 18 bp, Homo sapiens
acgtgttaattataaaca

SEQ ID NO: 5354464 - DNA, 23 bp, Homo sapiens
acgtgttaattataaacagcagg

SEQ ID NO: 5354465 - DNA, 20 bp, Homo sapiens
acgtgttaggaggctgcatg

SEQ ID NO: 5354466 - DNA, 21 bp, Homo sapiens
acgtgttattattattatatt

SEQ ID NO: 5354467 - DNA, 22 bp, Homo sapiens
acgtgttcattttattttcatg

SEQ ID NO: 5354468 - DNA, 17 bp, Homo sapiens
acgtgtttcgggccagg

SEQ ID NO: 5354469 - DNA, 17 bp, Homo sapiens
acgtgttttccatccca

SEQ ID NO: 5354470 - DNA, 12 bp, Homo sapiens
acgttaaaagac

SEQ ID NO: 5354471 - DNA, 16 bp, Homo sapiens
acgttaaaagacagtg

SEQ ID NO: 5354472 - DNA, 23 bp, Homo sapiens
acgttaaaagcaaaaagatgtat

SEQ ID NO: 5354473 - DNA, 16 bp, Homo sapiens
acgttaaaagtgtaca

SEQ ID NO: 5354474 - DNA, 22 bp, Homo sapiens
acgttaagtccaaggagaagaa

SEQ ID NO: 5354475 - DNA, 18 bp, Homo sapiens
acgttagaccacaaatag

SEQ ID NO: 5354476 - DNA, 13 bp, Homo sapiens
acgttaggaccag

SEQ ID NO: 5354477 - DNA, 19 bp, Homo sapiens
acgttaggcatttcctgct

SEQ ID NO: 5354478 - DNA, 21 bp, Homo sapiens
acgttaggcatttcctgctga

SEQ ID NO: 5354479 - DNA, 16 bp, Homo sapiens
acgttagtcgtgagct

SEQ ID NO: 5354480 - DNA, 14 bp, Homo sapiens
acgttatatattgt

SEQ ID NO: 5354481 - DNA, 16 bp, Homo sapiens
acgttatggtgtttct

SEQ ID NO: 5354482 - DNA, 17 bp, Homo sapiens
acgttatggtgtttctc

SEQ ID NO: 5354483 - DNA, 13 bp, Homo sapiens
acgttcacccctc

SEQ ID NO: 5354484 - DNA, 14 bp, Homo sapiens
acgttcacccctcc

SEQ ID NO: 5354485 - DNA, 16 bp, Homo sapiens
acgttcacccctccac

SEQ ID NO: 5354486 - DNA, 14 bp, Homo sapiens
acgttcagggaggg

SEQ ID NO: 5354487 - DNA, 12 bp, Homo sapiens
acgttcatgttc

SEQ ID NO: 5354488 - DNA, 17 bp, Homo sapiens
acgttcatgttcatctc

SEQ ID NO: 5354489 - DNA, 13 bp, Homo sapiens
acgttccacagtt

SEQ ID NO: 5354490 - DNA, 14 bp, Homo sapiens
acgttccagccggc

SEQ ID NO: 5354491 - DNA, 14 bp, Homo sapiens
acgttcctaagctg

SEQ ID NO: 5354492 - DNA, 19 bp, Homo sapiens
acgttcctggccccctcat

SEQ ID NO: 5354493 - DNA, 18 bp, Homo sapiens
acgttccttactgcagaa

SEQ ID NO: 5354494 - DNA, 20 bp, Homo sapiens
acgttccttactgcagaata

SEQ ID NO: 5354495 - DNA, 17 bp, Homo sapiens
acgttctcacacccacc

SEQ ID NO: 5354496 - DNA, 14 bp, Homo sapiens
acgttctccagccc

SEQ ID NO: 5354497 - DNA, 19 bp, Homo sapiens
acgttctccagcccacacc

SEQ ID NO: 5354498 - DNA, 18 bp, Homo sapiens
acgttctctttaaaagct

SEQ ID NO: 5354499 - DNA, 19 bp, Homo sapiens
acgttcttacaagcttaaa

SEQ ID NO: 5354500 - DNA, 14 bp, Homo sapiens
actaatcaatactt

SEQ ID NO: 5354501 - DNA, 15 bp, Homo sapiens
actaatcaatacttt

SEQ ID NO: 5354502 - DNA, 21 bp, Homo sapiens
actaatcacaaactgaatgac

SEQ ID NO: 5354503 - DNA, 20 bp, Homo sapiens
actaatcagatgatggccat

SEQ ID NO: 5354504 - DNA, 19 bp, Homo sapiens
actaatccttaataactat

SEQ ID NO: 5354505 - DNA, 22 bp, Homo sapiens
actaatccttaataactatggt

SEQ ID NO: 5354506 - DNA, 18 bp, Homo sapiens
actaatctattgggttca

SEQ ID NO: 5354507 - DNA, 19 bp, Homo sapiens
actaatctgggaagggaag

SEQ ID NO: 5354508 - DNA, 19 bp, Homo sapiens
actaatcttaaccctgtgc

SEQ ID NO: 5354509 - DNA, 20 bp, Homo sapiens
actaatcttaaccctgtgct

SEQ ID NO: 5354510 - DNA, 17 bp, Homo sapiens
actaatcttgaatgttt

SEQ ID NO: 5354511 - DNA, 17 bp, Homo sapiens
actaatgaaatttacag

SEQ ID NO: 5354512 - DNA, 22 bp, Homo sapiens
actaatgaagtattacatgatt

SEQ ID NO: 5354513 - DNA, 15 bp, Homo sapiens
actaatgaattgaaa

SEQ ID NO: 5354514 - DNA, 21 bp, Homo sapiens
actaatgacaagtgacttatt

SEQ ID NO: 5354515 - DNA, 20 bp, Homo sapiens
actaatgagctttgggcaat

SEQ ID NO: 5354516 - DNA, 20 bp, Homo sapiens
actaatgagtatgaacttga

SEQ ID NO: 5354517 - DNA, 22 bp, Homo sapiens
actaatgagtatgaacttgaga

SEQ ID NO: 5354518 - DNA, 17 bp, Homo sapiens
actaatgagtatttggt

SEQ ID NO: 5354519 - DNA, 20 bp, Homo sapiens
actaatgataatcccaccac

SEQ ID NO: 5354520 - DNA, 13 bp, Homo sapiens
actaatgatgttt

SEQ ID NO: 5354521 - DNA, 20 bp, Homo sapiens
actaatgccctatcttagta

SEQ ID NO: 5354522 - DNA, 24 bp, Homo sapiens
actaatgccttactcttcttgaaa

SEQ ID NO: 5354523 - DNA, 16 bp, Homo sapiens
actaatgctaagaaat

SEQ ID NO: 5354524 - DNA, 18 bp, Homo sapiens
actaatgcttacaacttt

SEQ ID NO: 5354525 - DNA, 24 bp, Homo sapiens
actaatggccaagtgtacatttga

SEQ ID NO: 5354526 - DNA, 12 bp, Homo sapiens
actaatgtaaaa

SEQ ID NO: 5354527 - DNA, 17 bp, Homo sapiens
actaattaaaatctgga

SEQ ID NO: 5354528 - DNA, 18 bp, Homo sapiens
actaattaaaatctggaa

SEQ ID NO: 5354529 - DNA, 15 bp, Homo sapiens
actaattaacatata

SEQ ID NO: 5354530 - DNA, 17 bp, Homo sapiens
actaattataatgcaaa

SEQ ID NO: 5354531 - DNA, 21 bp, Homo sapiens
actaattatactactttgtta

SEQ ID NO: 5354532 - DNA, 20 bp, Homo sapiens
actaattattattttaaaat

SEQ ID NO: 5354533 - DNA, 22 bp, Homo sapiens
actaattattcctctttgccca

SEQ ID NO: 5354534 - DNA, 16 bp, Homo sapiens
actaattcatttatta

SEQ ID NO: 5354535 - DNA, 13 bp, Homo sapiens
actaattccacac

SEQ ID NO: 5354536 - DNA, 14 bp, Homo sapiens
actaattctatgtc

SEQ ID NO: 5354537 - DNA, 17 bp, Homo sapiens
actaattgacttgcaaa

SEQ ID NO: 5354538 - DNA, 19 bp, Homo sapiens
actaattgagcctgtgcct

SEQ ID NO: 5354539 - DNA, 22 bp, Homo sapiens
actaattggctacatgttgcaa

SEQ ID NO: 5354540 - DNA, 14 bp, Homo sapiens
actaattgtataac

SEQ ID NO: 5354541 - DNA, 20 bp, Homo sapiens
actaattgtataacaggtta

SEQ ID NO: 5354542 - DNA, 18 bp, Homo sapiens
actaatttaaaccagcag

SEQ ID NO: 5354543 - DNA, 22 bp, Homo sapiens
actaatttaaaccagcagaaaa

SEQ ID NO: 5354544 - DNA, 23 bp, Homo sapiens
actaatttaaaccagcagaaaag

SEQ ID NO: 5354545 - DNA, 17 bp, Homo sapiens
actaatttatactttaa

SEQ ID NO: 5354546 - DNA, 13 bp, Homo sapiens
actaatttattgc

SEQ ID NO: 5354547 - DNA, 20 bp, Homo sapiens
actaatttcaaaatgctttt

SEQ ID NO: 5354548 - DNA, 13 bp, Homo sapiens
actaatttcttct

SEQ ID NO: 5354549 - DNA, 15 bp, Homo sapiens
actaatttgctctgt

SEQ ID NO: 5354550 - DNA, 19 bp, Homo sapiens
actaatttggctttcacat

SEQ ID NO: 5354551 - DNA, 20 bp, Homo sapiens
actaattttgtatttttagt

SEQ ID NO: 5354552 - DNA, 19 bp, Homo sapiens
actaatttttgtattattt

SEQ ID NO: 5354553 - DNA, 15 bp, Homo sapiens
actaattttttaaga

SEQ ID NO: 5354554 - DNA, 21 bp, Homo sapiens
actaattttttaagaggaatt

SEQ ID NO: 5354555 - DNA, 15 bp, Homo sapiens
actacaaaaccgttt

SEQ ID NO: 5354556 - DNA, 21 bp, Homo sapiens
actacaaaaccgtttagtcat

SEQ ID NO: 5354557 - DNA, 20 bp, Homo sapiens
actacaaaatacaatcctgt

SEQ ID NO: 5354558 - DNA, 13 bp, Homo sapiens
actacaaaatttg

SEQ ID NO: 5354559 - DNA, 18 bp, Homo sapiens
actacaaaatttgaaatt

SEQ ID NO: 5354560 - DNA, 20 bp, Homo sapiens
actacaaacaaaatttctat

SEQ ID NO: 5354561 - DNA, 22 bp, Homo sapiens
actacaaacaaaatttctatta

SEQ ID NO: 5354562 - DNA, 23 bp, Homo sapiens
actacaaagcttctatcccagga

SEQ ID NO: 5354563 - DNA, 16 bp, Homo sapiens
actacaaagctttgct

SEQ ID NO: 5354564 - DNA, 17 bp, Homo sapiens
actacaaaggtttaaat

SEQ ID NO: 5354565 - DNA, 18 bp, Homo sapiens
actacaaaggtttaaatg

SEQ ID NO: 5354566 - DNA, 20 bp, Homo sapiens
actacaaaggtttaaatgaa

SEQ ID NO: 5354567 - DNA, 13 bp, Homo sapiens
actacaaatcaag

SEQ ID NO: 5354568 - DNA, 14 bp, Homo sapiens
actacaaattatca

SEQ ID NO: 5354569 - DNA, 22 bp, Homo sapiens
actacaacctccaccttccagg

SEQ ID NO: 5354570 - DNA, 17 bp, Homo sapiens
actacaagcttttaact

SEQ ID NO: 5354571 - DNA, 20 bp, Homo sapiens
actacaatatgtacatttct

SEQ ID NO: 5354572 - DNA, 18 bp, Homo sapiens
actacaatgatggtaaag

SEQ ID NO: 5354573 - DNA, 12 bp, Homo sapiens
actacacaatac

SEQ ID NO: 5354574 - DNA, 15 bp, Homo sapiens
actacacaatacagt

SEQ ID NO: 5354575 - DNA, 18 bp, Homo sapiens
actacacactgctcattt

SEQ ID NO: 5354576 - DNA, 13 bp, Homo sapiens
actacacattttt

SEQ ID NO: 5354577 - DNA, 15 bp, Homo sapiens
actacacatttttaa

SEQ ID NO: 5354578 - DNA, 16 bp, Homo sapiens
actacacatttttaaa

SEQ ID NO: 5354579 - DNA, 13 bp, Homo sapiens
actacaccacaca

SEQ ID NO: 5354580 - DNA, 16 bp, Homo sapiens
actacaccacacacaa

SEQ ID NO: 5354581 - DNA, 16 bp, Homo sapiens
actacacccagcaata

SEQ ID NO: 5354582 - DNA, 13 bp, Homo sapiens
actacacctggct

SEQ ID NO: 5354583 - DNA, 14 bp, Homo sapiens
actacactaataaa

SEQ ID NO: 5354584 - DNA, 19 bp, Homo sapiens
actacactcaactaatttt

SEQ ID NO: 5354585 - DNA, 15 bp, Homo sapiens
actacactccagcct

SEQ ID NO: 5354586 - DNA, 19 bp, Homo sapiens
actacactttgctagtgaa

SEQ ID NO: 5354587 - DNA, 18 bp, Homo sapiens
actacagaaaaaccagag

SEQ ID NO: 5354588 - DNA, 13 bp, Homo sapiens
actacagaaagca

SEQ ID NO: 5354589 - DNA, 22 bp, Homo sapiens
actacagaaagcaaatcagaca

SEQ ID NO: 5354590 - DNA, 18 bp, Homo sapiens
actacagaagtggaagga

SEQ ID NO: 5354591 - DNA, 16 bp, Homo sapiens
actacagacctgcttt

SEQ ID NO: 5354592 - DNA, 15 bp, Homo sapiens
actacagagaaggct

SEQ ID NO: 5354593 - DNA, 18 bp, Homo sapiens
actacagagcagctcccc

SEQ ID NO: 5354594 - DNA, 19 bp, Homo sapiens
actacagagcagctcccca

SEQ ID NO: 5354595 - DNA, 15 bp, Homo sapiens
actacagaggattct

SEQ ID NO: 5354596 - DNA, 23 bp, Homo sapiens
actacagagtctgacaggaagac

SEQ ID NO: 5354597 - DNA, 14 bp, Homo sapiens
actacagatctccc

SEQ ID NO: 5354598 - DNA, 15 bp, Homo sapiens
actacagcataaatc

SEQ ID NO: 5354599 - DNA, 16 bp, Homo sapiens
actacagctatatttg

SEQ ID NO: 5354600 - DNA, 19 bp, Homo sapiens
actacagctatatttgatt

SEQ ID NO: 5354601 - DNA, 17 bp, Homo sapiens
actacagctatgaagaa

SEQ ID NO: 5354602 - DNA, 11 bp, Homo sapiens
actacaggcac

SEQ ID NO: 5354603 - DNA, 15 bp, Homo sapiens
actacaggttttatg

SEQ ID NO: 5354604 - DNA, 20 bp, Homo sapiens
actacagtcaagatagaaag

SEQ ID NO: 5354605 - DNA, 16 bp, Homo sapiens
actacagtcctcccat

SEQ ID NO: 5354606 - DNA, 17 bp, Homo sapiens
actacagtcctcccatc

SEQ ID NO: 5354607 - DNA, 16 bp, Homo sapiens
actacagtctaaagct

SEQ ID NO: 5354608 - DNA, 17 bp, Homo sapiens
actacagtctaaagctg

SEQ ID NO: 5354609 - DNA, 13 bp, Homo sapiens
actacagtttgtt

SEQ ID NO: 5354610 - DNA, 23 bp, Homo sapiens
actacataaactgactttatcct

SEQ ID NO: 5354611 - DNA, 19 bp, Homo sapiens
actacataatctctggaaa

SEQ ID NO: 5354612 - DNA, 17 bp, Homo sapiens
actacatcgccctccac

SEQ ID NO: 5354613 - DNA, 19 bp, Homo sapiens
actacatcgccctccacat

SEQ ID NO: 5354614 - DNA, 16 bp, Homo sapiens
actacatctgatatca

SEQ ID NO: 5354615 - DNA, 18 bp, Homo sapiens
actacatctgatatcagg

SEQ ID NO: 5354616 - DNA, 13 bp, Homo sapiens
actacatctgcct

SEQ ID NO: 5354617 - DNA, 11 bp, Homo sapiens
actacatctgg

SEQ ID NO: 5354618 - DNA, 13 bp, Homo sapiens
actacatgatgac

SEQ ID NO: 5354619 - DNA, 17 bp, Homo sapiens
actacatgggccagccc

SEQ ID NO: 5354620 - DNA, 14 bp, Homo sapiens
actacatgtaaaat

SEQ ID NO: 5354621 - DNA, 18 bp, Homo sapiens
actacatgtggtttatag

SEQ ID NO: 5354622 - DNA, 21 bp, Homo sapiens
actacattaaaagctttagat

SEQ ID NO: 5354623 - DNA, 20 bp, Homo sapiens
actacattaggttgtgaatg

SEQ ID NO: 5354624 - DNA, 15 bp, Homo sapiens
actacattatggaat

SEQ ID NO: 5354625 - DNA, 13 bp, Homo sapiens
actacattcattt

SEQ ID NO: 5354626 - DNA, 13 bp, Homo sapiens
actacatttatga

SEQ ID NO: 5354627 - DNA, 13 bp, Homo sapiens
actacatttgcat

SEQ ID NO: 5354628 - DNA, 12 bp, Homo sapiens
actacattttaa

SEQ ID NO: 5354629 - DNA, 16 bp, Homo sapiens
actacattttgaggtt

SEQ ID NO: 5354630 - DNA, 17 bp, Homo sapiens
actaccaaaagacatta

SEQ ID NO: 5354631 - DNA, 19 bp, Homo sapiens
actaccaaaagacattaga

SEQ ID NO: 5354632 - DNA, 22 bp, Homo sapiens
actaccaaaagacattagagaa

SEQ ID NO: 5354633 - DNA, 13 bp, Homo sapiens
actaccacaagga

SEQ ID NO: 5354634 - DNA, 19 bp, Homo sapiens
actaccaccctcgctgcca

SEQ ID NO: 5354635 - DNA, 15 bp, Homo sapiens
actaccacctcaggt

SEQ ID NO: 5354636 - DNA, 20 bp, Homo sapiens
actaccacctcaggtgactt

SEQ ID NO: 5354637 - DNA, 18 bp, Homo sapiens
actaccacttatttctaa

SEQ ID NO: 5354638 - DNA, 18 bp, Homo sapiens
actaccagaagggcttca

SEQ ID NO: 5354639 - DNA, 14 bp, Homo sapiens
actaccagccagcc

SEQ ID NO: 5354640 - DNA, 15 bp, Homo sapiens
actaccagggtctct

SEQ ID NO: 5354641 - DNA, 18 bp, Homo sapiens
actaccagtgggcatgta

SEQ ID NO: 5354642 - DNA, 16 bp, Homo sapiens
actaccatacagacag

SEQ ID NO: 5354643 - DNA, 19 bp, Homo sapiens
actaccatctgatgtttca

SEQ ID NO: 5354644 - DNA, 23 bp, Homo sapiens
actacccacgttctcacacccac

SEQ ID NO: 5354645 - DNA, 15 bp, Homo sapiens
actacccagctctgt

SEQ ID NO: 5354646 - DNA, 22 bp, Homo sapiens
actacccaggttaagaaaataa

SEQ ID NO: 5354647 - DNA, 20 bp, Homo sapiens
actaccccagaacgcatgca

SEQ ID NO: 5354648 - DNA, 23 bp, Homo sapiens
actacccccacagacctgctctg

SEQ ID NO: 5354649 - DNA, 23 bp, Homo sapiens
actacccccttttcagctgagcc

SEQ ID NO: 5354650 - DNA, 20 bp, Homo sapiens
actaccccgactatccctgc

SEQ ID NO: 5354651 - DNA, 21 bp, Homo sapiens
actaccccgactatccctgca

SEQ ID NO: 5354652 - DNA, 20 bp, Homo sapiens
actaccctacacctctgggc

SEQ ID NO: 5354653 - DNA, 13 bp, Homo sapiens
actaccctccaga

SEQ ID NO: 5354654 - DNA, 19 bp, Homo sapiens
actaccctcctgtaaaata

SEQ ID NO: 5354655 - DNA, 19 bp, Homo sapiens
actaccctctcaaatggac

SEQ ID NO: 5354656 - DNA, 14 bp, Homo sapiens
actaccctgggctc

SEQ ID NO: 5354657 - DNA, 15 bp, Homo sapiens
actacccttctcctt

SEQ ID NO: 5354658 - DNA, 23 bp, Homo sapiens
actacccttctcctttccttccc

SEQ ID NO: 5354659 - DNA, 21 bp, Homo sapiens
actaccctttgctggaagaaa

SEQ ID NO: 5354660 - DNA, 16 bp, Homo sapiens
actaccgtgccagcag

SEQ ID NO: 5354661 - DNA, 19 bp, Homo sapiens
actaccgtggaccacctag

SEQ ID NO: 5354662 - DNA, 15 bp, Homo sapiens
actacctagaagtaa

SEQ ID NO: 5354663 - DNA, 22 bp, Homo sapiens
actacctagaagtaagaagagg

SEQ ID NO: 5354664 - DNA, 18 bp, Homo sapiens
actacctataaatggact

SEQ ID NO: 5354665 - DNA, 17 bp, Homo sapiens
actacctataggaaagt

SEQ ID NO: 5354666 - DNA, 16 bp, Homo sapiens
actacctatattcctt

SEQ ID NO: 5354667 - DNA, 14 bp, Homo sapiens
actacctctgtgcc

SEQ ID NO: 5354668 - DNA, 21 bp, Homo sapiens
actacctgccctcagcttgga

SEQ ID NO: 5354669 - DNA, 12 bp, Homo sapiens
actacctggctg

SEQ ID NO: 5354670 - DNA, 22 bp, Homo sapiens
actacctgtaatgacaggcctg

SEQ ID NO: 5354671 - DNA, 18 bp, Homo sapiens
actacctgtatttaaaaa

SEQ ID NO: 5354672 - DNA, 19 bp, Homo sapiens
actacctgtcccctatgcc

SEQ ID NO: 5354673 - DNA, 17 bp, Homo sapiens
actacctgtgagcatgg

SEQ ID NO: 5354674 - DNA, 15 bp, Homo sapiens
actaccttatcactg

SEQ ID NO: 5354675 - DNA, 17 bp, Homo sapiens
actaccttgaaaataag

SEQ ID NO: 5354676 - DNA, 23 bp, Homo sapiens
actacgcatgactaattttttaa

SEQ ID NO: 5354677 - DNA, 18 bp, Homo sapiens
actatattaaattctgaa

SEQ ID NO: 5354678 - DNA, 11 bp, Homo sapiens
actatattaac

SEQ ID NO: 5354679 - DNA, 19 bp, Homo sapiens
actatattagtatgtatgt

SEQ ID NO: 5354680 - DNA, 16 bp, Homo sapiens
actatattctggccag

SEQ ID NO: 5354681 - DNA, 18 bp, Homo sapiens
actatattgattgtcctt

SEQ ID NO: 5354682 - DNA, 22 bp, Homo sapiens
actatatttaataccaccaaca

SEQ ID NO: 5354683 - DNA, 23 bp, Homo sapiens
actatatttaataccaccaacaa

SEQ ID NO: 5354684 - DNA, 21 bp, Homo sapiens
actatatttgagcactggtct

SEQ ID NO: 5354685 - DNA, 13 bp, Homo sapiens
actatatttgcta

SEQ ID NO: 5354686 - DNA, 14 bp, Homo sapiens
actatattttagat

SEQ ID NO: 5354687 - DNA, 20 bp, Homo sapiens
actatattttagatgcaatg

SEQ ID NO: 5354688 - DNA, 19 bp, Homo sapiens
actatcaaactgaagccag

SEQ ID NO: 5354689 - DNA, 19 bp, Homo sapiens
actatcaactacaaattag

SEQ ID NO: 5354690 - DNA, 18 bp, Homo sapiens
actatcaatatttaagtt

SEQ ID NO: 5354691 - DNA, 14 bp, Homo sapiens
actatcaattttaa

SEQ ID NO: 5354692 - DNA, 15 bp, Homo sapiens
actatcaccagtgca

SEQ ID NO: 5354693 - DNA, 13 bp, Homo sapiens
actatcagcagcg

SEQ ID NO: 5354694 - DNA, 13 bp, Homo sapiens
actatcaggcaga

SEQ ID NO: 5354695 - DNA, 16 bp, Homo sapiens
actatcagggcaagct

SEQ ID NO: 5354696 - DNA, 16 bp, Homo sapiens
actatcagttccctct

SEQ ID NO: 5354697 - DNA, 17 bp, Homo sapiens
actatcatcttattcag

SEQ ID NO: 5354698 - DNA, 15 bp, Homo sapiens
actatcattctcagt

SEQ ID NO: 5354699 - DNA, 22 bp, Homo sapiens
actatcatttttacactattgt

SEQ ID NO: 5354700 - DNA, 20 bp, Homo sapiens
actatccccaaactccttta

SEQ ID NO: 5354701 - DNA, 21 bp, Homo sapiens
actatcccctgcgctttgaac

SEQ ID NO: 5354702 - DNA, 18 bp, Homo sapiens
actatcccggctgccctt

SEQ ID NO: 5354703 - DNA, 15 bp, Homo sapiens
actatcctgacttct

SEQ ID NO: 5354704 - DNA, 21 bp, Homo sapiens
actatccttctctttcaatgt

SEQ ID NO: 5354705 - DNA, 16 bp, Homo sapiens
actatctaaatgttga

SEQ ID NO: 5354706 - DNA, 13 bp, Homo sapiens
actatctacaaaa

SEQ ID NO: 5354707 - DNA, 18 bp, Homo sapiens
actatctcacttccagat

SEQ ID NO: 5354708 - DNA, 16 bp, Homo sapiens
actatctcatttccaa

SEQ ID NO: 5354709 - DNA, 17 bp, Homo sapiens
actatctcatttccaag

SEQ ID NO: 5354710 - DNA, 12 bp, Homo sapiens
actatctcccct

SEQ ID NO: 5354711 - DNA, 19 bp, Homo sapiens
actatctccgttccatctg

SEQ ID NO: 5354712 - DNA, 20 bp, Homo sapiens
actatctctactgaatgtca

SEQ ID NO: 5354713 - DNA, 15 bp, Homo sapiens
actatctgcattatc

SEQ ID NO: 5354714 - DNA, 12 bp, Homo sapiens
actatctgcttt

SEQ ID NO: 5354715 - DNA, 12 bp, Homo sapiens
actatctgggtg

SEQ ID NO: 5354716 - DNA, 14 bp, Homo sapiens
actatctgtattta

SEQ ID NO: 5354717 - DNA, 18 bp, Homo sapiens
actatctgtatttattat

SEQ ID NO: 5354718 - DNA, 17 bp, Homo sapiens
actatctgtctggtggc

SEQ ID NO: 5354719 - DNA, 20 bp, Homo sapiens
actatctgtgcgtagaagtt

SEQ ID NO: 5354720 - DNA, 22 bp, Homo sapiens
actatctgtgcgtagaagttct

SEQ ID NO: 5354721 - DNA, 12 bp, Homo sapiens
actatcttcttc

SEQ ID NO: 5354722 - DNA, 13 bp, Homo sapiens
actatcttcttca

SEQ ID NO: 5354723 - DNA, 14 bp, Homo sapiens
actatcttcttcaa

SEQ ID NO: 5354724 - DNA, 16 bp, Homo sapiens
actatcttggtgaatt

SEQ ID NO: 5354725 - DNA, 18 bp, Homo sapiens
actatctttcagctccag

SEQ ID NO: 5354726 - DNA, 14 bp, Homo sapiens
actatctttcagga

SEQ ID NO: 5354727 - DNA, 13 bp, Homo sapiens
actatctttgtct

SEQ ID NO: 5354728 - DNA, 19 bp, Homo sapiens
actatgaaaagctagaatt

SEQ ID NO: 5354729 - DNA, 15 bp, Homo sapiens
actatgaaacctttt

SEQ ID NO: 5354730 - DNA, 19 bp, Homo sapiens
actatgaaacgaatataag

SEQ ID NO: 5354731 - DNA, 11 bp, Homo sapiens
actatgaaata

SEQ ID NO: 5354732 - DNA, 16 bp, Homo sapiens
actatgaaataaaaaa

SEQ ID NO: 5354733 - DNA, 14 bp, Homo sapiens
actatgaacactgt

SEQ ID NO: 5354734 - DNA, 15 bp, Homo sapiens
actatgaacactgtc

SEQ ID NO: 5354735 - DNA, 22 bp, Homo sapiens
actatgaactgaaggcagcatg

SEQ ID NO: 5354736 - DNA, 22 bp, Homo sapiens
actatgaagttttttttataca

SEQ ID NO: 5354737 - DNA, 13 bp, Homo sapiens
actatgaatttgt

SEQ ID NO: 5354738 - DNA, 17 bp, Homo sapiens
actatgacaatcttatt

SEQ ID NO: 5354739 - DNA, 18 bp, Homo sapiens
actatgacaatttttgct

SEQ ID NO: 5354740 - DNA, 15 bp, Homo sapiens
actatgacactgagc

SEQ ID NO: 5354741 - DNA, 18 bp, Homo sapiens
actatgaggagcctctga

SEQ ID NO: 5354742 - DNA, 15 bp, Homo sapiens
actatgatcacagtg

SEQ ID NO: 5354743 - DNA, 17 bp, Homo sapiens
actatgatcagaagaac

SEQ ID NO: 5354744 - DNA, 16 bp, Homo sapiens
actatgatgggcttct

SEQ ID NO: 5354745 - DNA, 15 bp, Homo sapiens
actatgattattaac

SEQ ID NO: 5354746 - DNA, 14 bp, Homo sapiens
actatgatttctga

SEQ ID NO: 5354747 - DNA, 16 bp, Homo sapiens
actatgcaaaagtaca

SEQ ID NO: 5354748 - DNA, 19 bp, Homo sapiens
actatgcacaacagagtaa

SEQ ID NO: 5354749 - DNA, 16 bp, Homo sapiens
actatgcacaatttaa

SEQ ID NO: 5354750 - DNA, 15 bp, Homo sapiens
actatgcacactttt

SEQ ID NO: 5354751 - DNA, 18 bp, Homo sapiens
actatgcacctataaata

SEQ ID NO: 5354752 - DNA, 23 bp, Homo sapiens
actatgcatggtgccccaggacc

SEQ ID NO: 5354753 - DNA, 19 bp, Homo sapiens
actatgccgtcttctgccc

SEQ ID NO: 5354754 - DNA, 18 bp, Homo sapiens
actatgcgtaaatcaact

SEQ ID NO: 5354755 - DNA, 14 bp, Homo sapiens
actatgcgttttta

SEQ ID NO: 5354756 - DNA, 18 bp, Homo sapiens
actatgcgtttttataaa

SEQ ID NO: 5354757 - DNA, 16 bp, Homo sapiens
actatggaagccacat

SEQ ID NO: 5354758 - DNA, 17 bp, Homo sapiens
actatggaatgtcagtg

SEQ ID NO: 5354759 - DNA, 19 bp, Homo sapiens
actatggagcctggcacag

SEQ ID NO: 5354760 - DNA, 22 bp, Homo sapiens
actatggagtgcaccaaagaga

SEQ ID NO: 5354761 - DNA, 16 bp, Homo sapiens
actatggctccaacag

SEQ ID NO: 5354762 - DNA, 16 bp, Homo sapiens
actatggctgtatttt

SEQ ID NO: 5354763 - DNA, 22 bp, Homo sapiens
actatggctgtatttttagaga

SEQ ID NO: 5354764 - DNA, 16 bp, Homo sapiens
actatgggatgtatat

SEQ ID NO: 5354765 - DNA, 22 bp, Homo sapiens
actatggtagccagatgataaa

SEQ ID NO: 5354766 - DNA, 22 bp, Homo sapiens
actatggtatgctggccagcac

SEQ ID NO: 5354767 - DNA, 14 bp, Homo sapiens
actatggtgccaat

SEQ ID NO: 5354768 - DNA, 17 bp, Homo sapiens
actatggtgctgccttg

SEQ ID NO: 5354769 - DNA, 19 bp, Homo sapiens
actatggttcccaataaaa

SEQ ID NO: 5354770 - DNA, 22 bp, Homo sapiens
actatggttcccaataaaagtg

SEQ ID NO: 5354771 - DNA, 12 bp, Homo sapiens
actatggttttt

SEQ ID NO: 5354772 - DNA, 14 bp, Homo sapiens
actatgtaaacaaa

SEQ ID NO: 5354773 - DNA, 20 bp, Homo sapiens
actatgtaaacaaaaaagct

SEQ ID NO: 5354774 - DNA, 12 bp, Homo sapiens
actatgtaaatg

SEQ ID NO: 5354775 - DNA, 21 bp, Homo sapiens
actatgtaagggctttaaata

SEQ ID NO: 5354776 - DNA, 23 bp, Homo sapiens
actatgtaatgcttatgtgttgc

SEQ ID NO: 5354777 - DNA, 18 bp, Homo sapiens
actatgtaggtaaattct

SEQ ID NO: 5354778 - DNA, 18 bp, Homo sapiens
actatgtatgtaaaatat

SEQ ID NO: 5354779 - DNA, 19 bp, Homo sapiens
actatgtattaccagcccc

SEQ ID NO: 5354780 - DNA, 14 bp, Homo sapiens
actatgtccagatt

SEQ ID NO: 5354781 - DNA, 15 bp, Homo sapiens
actatgtctgaacat

SEQ ID NO: 5354782 - DNA, 14 bp, Homo sapiens
actatgtggatgtg

SEQ ID NO: 5354783 - DNA, 18 bp, Homo sapiens
actatgtgtcatgatttc

SEQ ID NO: 5354784 - DNA, 18 bp, Homo sapiens
actatgtgtgttgtttcc

SEQ ID NO: 5354785 - DNA, 19 bp, Homo sapiens
actatgtgtgttgtttcca

SEQ ID NO: 5354786 - DNA, 22 bp, Homo sapiens
actatgtgtgttgtttccatag

SEQ ID NO: 5354787 - DNA, 15 bp, Homo sapiens
actatgttgcccagg

SEQ ID NO: 5354788 - DNA, 21 bp, Homo sapiens
actattaaacatgctgtacat

SEQ ID NO: 5354789 - DNA, 16 bp, Homo sapiens
actattaaagtgccat

SEQ ID NO: 5354790 - DNA, 14 bp, Homo sapiens
actattaaatgttg

SEQ ID NO: 5354791 - DNA, 14 bp, Homo sapiens
actattaacctttt

SEQ ID NO: 5354792 - DNA, 17 bp, Homo sapiens
actattaagagcaataa

SEQ ID NO: 5354793 - DNA, 17 bp, Homo sapiens
actattaagcaagaatg

SEQ ID NO: 5354794 - DNA, 14 bp, Homo sapiens
actattaagcagta

SEQ ID NO: 5354795 - DNA, 22 bp, Homo sapiens
actattaagcagtaaaaactgt

SEQ ID NO: 5354796 - DNA, 17 bp, Homo sapiens
actattacagtattgct

SEQ ID NO: 5354797 - DNA, 17 bp, Homo sapiens
actattacagtgttgga

SEQ ID NO: 5354798 - DNA, 14 bp, Homo sapiens
actattacatattt

SEQ ID NO: 5354799 - DNA, 13 bp, Homo sapiens
actattacttgaa

SEQ ID NO: 5354800 - DNA, 15 bp, Homo sapiens
actattacttgaact

SEQ ID NO: 5354801 - DNA, 13 bp, Homo sapiens
actattacttttc

SEQ ID NO: 5354802 - DNA, 14 bp, Homo sapiens
actattagagaaac

SEQ ID NO: 5354803 - DNA, 17 bp, Homo sapiens
actattagagtatttcc

SEQ ID NO: 5354804 - DNA, 17 bp, Homo sapiens
actattaggaggaatgt

SEQ ID NO: 5354805 - DNA, 16 bp, Homo sapiens
actattatagaaattc

SEQ ID NO: 5354806 - DNA, 20 bp, Homo sapiens
actattatagaaattctgaa

SEQ ID NO: 5354807 - DNA, 14 bp, Homo sapiens
actattatgaaatc

SEQ ID NO: 5354808 - DNA, 16 bp, Homo sapiens
actattatgaaatcat

SEQ ID NO: 5354809 - DNA, 17 bp, Homo sapiens
actattatgaaatcata

SEQ ID NO: 5354810 - DNA, 21 bp, Homo sapiens
actattatgttgttagagaaa

SEQ ID NO: 5354811 - DNA, 13 bp, Homo sapiens
actattattaata

SEQ ID NO: 5354812 - DNA, 16 bp, Homo sapiens
actattattaataaat

SEQ ID NO: 5354813 - DNA, 14 bp, Homo sapiens
actattcaaacagt

SEQ ID NO: 5354814 - DNA, 16 bp, Homo sapiens
actattcaaacagtct

SEQ ID NO: 5354815 - DNA, 13 bp, Homo sapiens
actattcaaggat

SEQ ID NO: 5354816 - DNA, 13 bp, Homo sapiens
actattcaagtat

SEQ ID NO: 5354817 - DNA, 14 bp, Homo sapiens
actattcaatgcaa

SEQ ID NO: 5354818 - DNA, 15 bp, Homo sapiens
actattcaatgcaat

SEQ ID NO: 5354819 - DNA, 16 bp, Homo sapiens
actattcaatgcaatg

SEQ ID NO: 5354820 - DNA, 17 bp, Homo sapiens
actattcatcaatgaag

SEQ ID NO: 5354821 - DNA, 13 bp, Homo sapiens
actattccatgtt

SEQ ID NO: 5354822 - DNA, 16 bp, Homo sapiens
actattccatgtttta

SEQ ID NO: 5354823 - DNA, 18 bp, Homo sapiens
actattccatgttttaaa

SEQ ID NO: 5354824 - DNA, 20 bp, Homo sapiens
actattccccagcagggtct

SEQ ID NO: 5354825 - DNA, 22 bp, Homo sapiens
actattccctttgacttcagct

SEQ ID NO: 5354826 - DNA, 23 bp, Homo sapiens
actattccctttgacttcagctg

SEQ ID NO: 5354827 - DNA, 16 bp, Homo sapiens
actattcgaatgaaaa

SEQ ID NO: 5354828 - DNA, 19 bp, Homo sapiens
actattcgaatgaaaagac

SEQ ID NO: 5354829 - DNA, 21 bp, Homo sapiens
actattctaatcagtagttca

SEQ ID NO: 5354830 - DNA, 23 bp, Homo sapiens
actattctataaacatatgcaaa

SEQ ID NO: 5354831 - DNA, 22 bp, Homo sapiens
actattctcggggccctgtgta

SEQ ID NO: 5354832 - DNA, 23 bp, Homo sapiens
actattctgattacacaaaacaa

SEQ ID NO: 5354833 - DNA, 17 bp, Homo sapiens
actattctgtatctttc

SEQ ID NO: 5354834 - DNA, 21 bp, Homo sapiens
actattctgttaaaatcagga

SEQ ID NO: 5354835 - DNA, 17 bp, Homo sapiens
actattcttaagcactt

SEQ ID NO: 5354836 - DNA, 18 bp, Homo sapiens
actattcttaagcacttt

SEQ ID NO: 5354837 - DNA, 21 bp, Homo sapiens
actattcttaagcactttgaa

SEQ ID NO: 5354838 - DNA, 13 bp, Homo sapiens
actattcttaata

SEQ ID NO: 5354839 - DNA, 17 bp, Homo sapiens
actattcttgatgtaaa

SEQ ID NO: 5354840 - DNA, 19 bp, Homo sapiens
actattcttgatgtaaaat

SEQ ID NO: 5354841 - DNA, 19 bp, Homo sapiens
actattcttggttcttatt

SEQ ID NO: 5354842 - DNA, 12 bp, Homo sapiens
actattgacatc

SEQ ID NO: 5354843 - DNA, 14 bp, Homo sapiens
actattgagtcttc

SEQ ID NO: 5354844 - DNA, 17 bp, Homo sapiens
actattgcttgcacaaa

SEQ ID NO: 5354845 - DNA, 16 bp, Homo sapiens
actattggaaagtact

SEQ ID NO: 5354846 - DNA, 19 bp, Homo sapiens
actattggagggtgggaga

SEQ ID NO: 5354847 - DNA, 14 bp, Homo sapiens
actattgggaggga

SEQ ID NO: 5354848 - DNA, 17 bp, Homo sapiens
actattgggagggatga

SEQ ID NO: 5354849 - DNA, 23 bp, Homo sapiens
actattgggtatgaactaaaaag

SEQ ID NO: 5354850 - DNA, 15 bp, Homo sapiens
actattgtaatcatt

SEQ ID NO: 5354851 - DNA, 14 bp, Homo sapiens
actattgtagagtg

SEQ ID NO: 5354852 - DNA, 13 bp, Homo sapiens
actattgtattat

SEQ ID NO: 5354853 - DNA, 22 bp, Homo sapiens
actattgtattatagtactgct

SEQ ID NO: 5354854 - DNA, 16 bp, Homo sapiens
actattgttagtctct

SEQ ID NO: 5354855 - DNA, 14 bp, Homo sapiens
actattgtttaaaa

SEQ ID NO: 5354856 - DNA, 14 bp, Homo sapiens
actatttaaaataa

SEQ ID NO: 5354857 - DNA, 18 bp, Homo sapiens
actcaggatccagtccct

SEQ ID NO: 5354858 - DNA, 23 bp, Homo sapiens
actcaggatgggaagaaaaagga

SEQ ID NO: 5354859 - DNA, 12 bp, Homo sapiens
actcaggccaca

SEQ ID NO: 5354860 - DNA, 16 bp, Homo sapiens
actcaggcccaaagcc

SEQ ID NO: 5354861 - DNA, 14 bp, Homo sapiens
actcaggcccagaa

SEQ ID NO: 5354862 - DNA, 23 bp, Homo sapiens
actcaggcctctgcagaagccaa

SEQ ID NO: 5354863 - DNA, 22 bp, Homo sapiens
actcaggcctgccaatgccaca

SEQ ID NO: 5354864 - DNA, 14 bp, Homo sapiens
actcaggcctgtgc

SEQ ID NO: 5354865 - DNA, 15 bp, Homo sapiens
actcaggcctgtgcc

SEQ ID NO: 5354866 - DNA, 18 bp, Homo sapiens
actcaggcctgtgcccac

SEQ ID NO: 5354867 - DNA, 18 bp, Homo sapiens
actcaggcgcctggcaca

SEQ ID NO: 5354868 - DNA, 23 bp, Homo sapiens
actcaggcgggacagtgctgcag

SEQ ID NO: 5354869 - DNA, 23 bp, Homo sapiens
actcaggctttcactatttcctt

SEQ ID NO: 5354870 - DNA, 22 bp, Homo sapiens
actcaggctttcagctgtgctt

SEQ ID NO: 5354871 - DNA, 13 bp, Homo sapiens
actcagggacaga

SEQ ID NO: 5354872 - DNA, 22 bp, Homo sapiens
actcagggaccggtgctgcagg

SEQ ID NO: 5354873 - DNA, 19 bp, Homo sapiens
actcagggactcaggccag

SEQ ID NO: 5354874 - DNA, 13 bp, Homo sapiens
actcagggcagct

SEQ ID NO: 5354875 - DNA, 18 bp, Homo sapiens
actcagggcagctgcctg

SEQ ID NO: 5354876 - DNA, 19 bp, Homo sapiens
actcagggcagctgcctgg

SEQ ID NO: 5354877 - DNA, 21 bp, Homo sapiens
actcagggcagctgcctggcc

SEQ ID NO: 5354878 - DNA, 15 bp, Homo sapiens
actcagggcattctg

SEQ ID NO: 5354879 - DNA, 17 bp, Homo sapiens
actcagggctcctccca

SEQ ID NO: 5354880 - DNA, 20 bp, Homo sapiens
actcagggctcctcccagct

SEQ ID NO: 5354881 - DNA, 16 bp, Homo sapiens
actcagggctcctggg

SEQ ID NO: 5354882 - DNA, 20 bp, Homo sapiens
actcagggctggcccgggga

SEQ ID NO: 5354883 - DNA, 19 bp, Homo sapiens
actcagggcttctcctctg

SEQ ID NO: 5354884 - DNA, 14 bp, Homo sapiens
actcaggggacccc

SEQ ID NO: 5354885 - DNA, 21 bp, Homo sapiens
actcaggggaccccactcccc

SEQ ID NO: 5354886 - DNA, 21 bp, Homo sapiens
actcaggtagggagctaagga

SEQ ID NO: 5354887 - DNA, 22 bp, Homo sapiens
actcaggtctgtaactgcccag

SEQ ID NO: 5354888 - DNA, 15 bp, Homo sapiens
actcaggtgggccct

SEQ ID NO: 5354889 - DNA, 15 bp, Homo sapiens
actcaggttccagaa

SEQ ID NO: 5354890 - DNA, 23 bp, Homo sapiens
actcaggttgtagtaaagaaatt

SEQ ID NO: 5354891 - DNA, 22 bp, Homo sapiens
actcagtagccatatcttccaa

SEQ ID NO: 5354892 - DNA, 19 bp, Homo sapiens
actcagtaggtctgaaggc

SEQ ID NO: 5354893 - DNA, 15 bp, Homo sapiens
actcagtcagcccag

SEQ ID NO: 5354894 - DNA, 19 bp, Homo sapiens
actcagtccatagcagaga

SEQ ID NO: 5354895 - DNA, 23 bp, Homo sapiens
actcagtcccccaccacactgaa

SEQ ID NO: 5354896 - DNA, 19 bp, Homo sapiens
actcagtctcaaataataa

SEQ ID NO: 5354897 - DNA, 15 bp, Homo sapiens
actcagtctgtggga

SEQ ID NO: 5354898 - DNA, 21 bp, Homo sapiens
actcagtctgtgggagctcag

SEQ ID NO: 5354899 - DNA, 19 bp, Homo sapiens
actcagtgaccagtgcctg

SEQ ID NO: 5354900 - DNA, 24 bp, Homo sapiens
actcagtgaccagtgcctgtgagc

SEQ ID NO: 5354901 - DNA, 22 bp, Homo sapiens
actcagtgactgttgtagcatt

SEQ ID NO: 5354902 - DNA, 22 bp, Homo sapiens
actcagtgcagggacagcctgc

SEQ ID NO: 5354903 - DNA, 13 bp, Homo sapiens
actcagtgcctcc

SEQ ID NO: 5354904 - DNA, 22 bp, Homo sapiens
actcagtgggctgtttctgctt

SEQ ID NO: 5354905 - DNA, 17 bp, Homo sapiens
actcagtggggctggca

SEQ ID NO: 5354906 - DNA, 16 bp, Homo sapiens
actcagtgttagagaa

SEQ ID NO: 5354907 - DNA, 21 bp, Homo sapiens
actcagtgttagagaaatcct

SEQ ID NO: 5354908 - DNA, 11 bp, Homo sapiens
actcagtgttg

SEQ ID NO: 5354909 - DNA, 14 bp, Homo sapiens
actcagtgttgact

SEQ ID NO: 5354910 - DNA, 20 bp, Homo sapiens
actcagtgttgactgtaggc

SEQ ID NO: 5354911 - DNA, 22 bp, Homo sapiens
actcagttcaaaccatttcagc

SEQ ID NO: 5354912 - DNA, 14 bp, Homo sapiens
actcagttctgctc

SEQ ID NO: 5354913 - DNA, 15 bp, Homo sapiens
actcagttcttggcc

SEQ ID NO: 5354914 - DNA, 20 bp, Homo sapiens
actcagttcttggcctgcta

SEQ ID NO: 5354915 - DNA, 23 bp, Homo sapiens
actcagtttcacaagtgagccct

SEQ ID NO: 5354916 - DNA, 22 bp, Homo sapiens
actcagtttgtcagactttaaa

SEQ ID NO: 5354917 - DNA, 15 bp, Homo sapiens
actcagttttaacta

SEQ ID NO: 5354918 - DNA, 13 bp, Homo sapiens
actcagttttctt

SEQ ID NO: 5354919 - DNA, 15 bp, Homo sapiens
actcagttttttgta

SEQ ID NO: 5354920 - DNA, 15 bp, Homo sapiens
actcataaaggacac

SEQ ID NO: 5354921 - DNA, 22 bp, Homo sapiens
actcataaaggacactggatca

SEQ ID NO: 5354922 - DNA, 17 bp, Homo sapiens
actcataaatactaact

SEQ ID NO: 5354923 - DNA, 23 bp, Homo sapiens
actcataagttggaccagaggaa

SEQ ID NO: 5354924 - DNA, 22 bp, Homo sapiens
actcatacagtctctatttgat

SEQ ID NO: 5354925 - DNA, 15 bp, Homo sapiens
actcatacatctggc

SEQ ID NO: 5354926 - DNA, 19 bp, Homo sapiens
actcatactgtcatataat

SEQ ID NO: 5354927 - DNA, 17 bp, Homo sapiens
actcatactgtgctgga

SEQ ID NO: 5354928 - DNA, 19 bp, Homo sapiens
actcatactgtgctggagc

SEQ ID NO: 5354929 - DNA, 18 bp, Homo sapiens
actcatagacactgatct

SEQ ID NO: 5354930 - DNA, 18 bp, Homo sapiens
actcatagccacttttat

SEQ ID NO: 5354931 - DNA, 17 bp, Homo sapiens
actcatataattatatg

SEQ ID NO: 5354932 - DNA, 15 bp, Homo sapiens
actcatattactggt

SEQ ID NO: 5354933 - DNA, 20 bp, Homo sapiens
actcatattctgggctcctg

SEQ ID NO: 5354934 - DNA, 11 bp, Homo sapiens
actcatattgc

SEQ ID NO: 5354935 - DNA, 20 bp, Homo sapiens
actcatcaatggggccagtc

SEQ ID NO: 5354936 - DNA, 17 bp, Homo sapiens
actcatcagagcagcta

SEQ ID NO: 5354937 - DNA, 13 bp, Homo sapiens
actcatcatttgt

SEQ ID NO: 5354938 - DNA, 18 bp, Homo sapiens
actcatcatttttataca

SEQ ID NO: 5354939 - DNA, 21 bp, Homo sapiens
actcatccacacttaagccct

SEQ ID NO: 5354940 - DNA, 13 bp, Homo sapiens
actcatccagacc

SEQ ID NO: 5354941 - DNA, 13 bp, Homo sapiens
actcatccattaa

SEQ ID NO: 5354942 - DNA, 20 bp, Homo sapiens
actcatcccccatcagatga

SEQ ID NO: 5354943 - DNA, 15 bp, Homo sapiens
actcatccgcctggc

SEQ ID NO: 5354944 - DNA, 21 bp, Homo sapiens
actcatccgcctggcccggga

SEQ ID NO: 5354945 - DNA, 14 bp, Homo sapiens
actcatcctctttt

SEQ ID NO: 5354946 - DNA, 17 bp, Homo sapiens
actcatcctgattttta

SEQ ID NO: 5354947 - DNA, 15 bp, Homo sapiens
actcatccttgccca

SEQ ID NO: 5354948 - DNA, 17 bp, Homo sapiens
actcatccttgcccagg

SEQ ID NO: 5354949 - DNA, 18 bp, Homo sapiens
actcatccttgcccaggt

SEQ ID NO: 5354950 - DNA, 17 bp, Homo sapiens
actcatcgggcccaggg

SEQ ID NO: 5354951 - DNA, 21 bp, Homo sapiens
actcatcgttctaaaatcaag

SEQ ID NO: 5354952 - DNA, 23 bp, Homo sapiens
actcatctaggtaaattacagtt

SEQ ID NO: 5354953 - DNA, 13 bp, Homo sapiens
actcatctgttat

SEQ ID NO: 5354954 - DNA, 14 bp, Homo sapiens
actcatctgttatc

SEQ ID NO: 5354955 - DNA, 15 bp, Homo sapiens
actcatctgttatcc

SEQ ID NO: 5354956 - DNA, 20 bp, Homo sapiens
actcatctgttatcctgcta

SEQ ID NO: 5354957 - DNA, 23 bp, Homo sapiens
actcatctgttatcctgctagct

SEQ ID NO: 5354958 - DNA, 18 bp, Homo sapiens
actcatcttagtgcctga

SEQ ID NO: 5354959 - DNA, 24 bp, Homo sapiens
actcatctttatcctaaaaatctg

SEQ ID NO: 5354960 - DNA, 18 bp, Homo sapiens
actcatctttccctcctt

SEQ ID NO: 5354961 - DNA, 14 bp, Homo sapiens
actcatcttttgaa

SEQ ID NO: 5354962 - DNA, 17 bp, Homo sapiens
actcatgaacaaaatga

SEQ ID NO: 5354963 - DNA, 18 bp, Homo sapiens
actcatgaacaaaatgaa

SEQ ID NO: 5354964 - DNA, 13 bp, Homo sapiens
actcatgaatgaa

SEQ ID NO: 5354965 - DNA, 16 bp, Homo sapiens
actcatgaatgaaaat

SEQ ID NO: 5354966 - DNA, 17 bp, Homo sapiens
actcatgcatgcaaatt

SEQ ID NO: 5354967 - DNA, 16 bp, Homo sapiens
actcatgcattgtcct

SEQ ID NO: 5354968 - DNA, 11 bp, Homo sapiens
actcatgccag

SEQ ID NO: 5354969 - DNA, 14 bp, Homo sapiens
actcatgctgaaag

SEQ ID NO: 5354970 - DNA, 22 bp, Homo sapiens
actcatggacaaagttctgtat

SEQ ID NO: 5354971 - DNA, 15 bp, Homo sapiens
actcatggcagctgt

SEQ ID NO: 5354972 - DNA, 19 bp, Homo sapiens
actcatggcagctgtttct

SEQ ID NO: 5354973 - DNA, 21 bp, Homo sapiens
actcatggcagctgtttctca

SEQ ID NO: 5354974 - DNA, 22 bp, Homo sapiens
actcatggcagctgtttctcat

SEQ ID NO: 5354975 - DNA, 18 bp, Homo sapiens
actcatggccttgtctaa

SEQ ID NO: 5354976 - DNA, 19 bp, Homo sapiens
actcatggggaagcttcca

SEQ ID NO: 5354977 - DNA, 20 bp, Homo sapiens
actcatggggaagcttccat

SEQ ID NO: 5354978 - DNA, 15 bp, Homo sapiens
actcatgggtaataa

SEQ ID NO: 5354979 - DNA, 17 bp, Homo sapiens
actcatgggtacccaga

SEQ ID NO: 5354980 - DNA, 22 bp, Homo sapiens
actcatggtgaggcttaacaat

SEQ ID NO: 5354981 - DNA, 15 bp, Homo sapiens
actcatgtgactctt

SEQ ID NO: 5354982 - DNA, 13 bp, Homo sapiens
actcatgtgattt

SEQ ID NO: 5354983 - DNA, 21 bp, Homo sapiens
actcatgttgttcccacacac

SEQ ID NO: 5354984 - DNA, 16 bp, Homo sapiens
actcattaatttctct

SEQ ID NO: 5354985 - DNA, 17 bp, Homo sapiens
actcattaatttctctc

SEQ ID NO: 5354986 - DNA, 18 bp, Homo sapiens
actcattaatttctctca

SEQ ID NO: 5354987 - DNA, 13 bp, Homo sapiens
actcattagactg

SEQ ID NO: 5354988 - DNA, 21 bp, Homo sapiens
actcattagactggaacttga

SEQ ID NO: 5354989 - DNA, 13 bp, Homo sapiens
actcattcagtcc

SEQ ID NO: 5354990 - DNA, 16 bp, Homo sapiens
actcattctatgaaca

SEQ ID NO: 5354991 - DNA, 21 bp, Homo sapiens
actcattctcttcttgctata

SEQ ID NO: 5354992 - DNA, 15 bp, Homo sapiens
actcattctgaagga

SEQ ID NO: 5354993 - DNA, 21 bp, Homo sapiens
actcattctgatcctcagccc

SEQ ID NO: 5354994 - DNA, 15 bp, Homo sapiens
actcattcttctgta

SEQ ID NO: 5354995 - DNA, 14 bp, Homo sapiens
actcattgaaatgt

SEQ ID NO: 5354996 - DNA, 16 bp, Homo sapiens
actcattgaaatgtaa

SEQ ID NO: 5354997 - DNA, 17 bp, Homo sapiens
actcattgaaatgtaat

SEQ ID NO: 5354998 - DNA, 16 bp, Homo sapiens
actcattgaaatgtca

SEQ ID NO: 5354999 - DNA, 22 bp, Homo sapiens
actcattgacctgaggcccttc

SEQ ID NO: 5355000 - DNA, 20 bp, Homo sapiens
actcattgcagcagataact

SEQ ID NO: 5355001 - DNA, 21 bp, Homo sapiens
actcattgcagcagataactt

SEQ ID NO: 5355002 - DNA, 23 bp, Homo sapiens
actcattgcagcagataactttt

SEQ ID NO: 5355003 - DNA, 14 bp, Homo sapiens
actcattgccccca

SEQ ID NO: 5355004 - DNA, 17 bp, Homo sapiens
actcattgcccccacct

SEQ ID NO: 5355005 - DNA, 21 bp, Homo sapiens
actcattgctgagcctctgct

SEQ ID NO: 5355006 - DNA, 14 bp, Homo sapiens
actcattgtagaaa

SEQ ID NO: 5355007 - DNA, 20 bp, Homo sapiens
actcatttaaagtattttat

SEQ ID NO: 5355008 - DNA, 16 bp, Homo sapiens
actcatttacaactga

SEQ ID NO: 5355009 - DNA, 16 bp, Homo sapiens
actcatttatttccat

SEQ ID NO: 5355010 - DNA, 19 bp, Homo sapiens
actcatttatttccatatt

SEQ ID NO: 5355011 - DNA, 13 bp, Homo sapiens
actcatttcatct

SEQ ID NO: 5355012 - DNA, 14 bp, Homo sapiens
actcatttcatctc

SEQ ID NO: 5355013 - DNA, 22 bp, Homo sapiens
actcatttggatataaatctta

SEQ ID NO: 5355014 - DNA, 15 bp, Homo sapiens
actcattttctataa

SEQ ID NO: 5355015 - DNA, 21 bp, Homo sapiens
actcattttctataacagata

SEQ ID NO: 5355016 - DNA, 12 bp, Homo sapiens
actcattttgct

SEQ ID NO: 5355017 - DNA, 14 bp, Homo sapiens
actcattttgcttg

SEQ ID NO: 5355018 - DNA, 20 bp, Homo sapiens
actcatttttcatgataatg

SEQ ID NO: 5355019 - DNA, 16 bp, Homo sapiens
actcatttttttaatt

SEQ ID NO: 5355020 - DNA, 19 bp, Homo sapiens
actcatttttttaatttat

SEQ ID NO: 5355021 - DNA, 16 bp, Homo sapiens
actcatttttttttga

SEQ ID NO: 5355022 - DNA, 17 bp, Homo sapiens
actccaaaaagaaatat

SEQ ID NO: 5355023 - DNA, 19 bp, Homo sapiens
actccaaaaagaaatatta

SEQ ID NO: 5355024 - DNA, 15 bp, Homo sapiens
actccaaaaagacaa

SEQ ID NO: 5355025 - DNA, 19 bp, Homo sapiens
actccaaaaagacaagtgc

SEQ ID NO: 5355026 - DNA, 20 bp, Homo sapiens
actccaaaaagacaagtgct

SEQ ID NO: 5355027 - DNA, 18 bp, Homo sapiens
actccaaacaattctgat

SEQ ID NO: 5355028 - DNA, 20 bp, Homo sapiens
actccaaacaattctgatga

SEQ ID NO: 5355029 - DNA, 19 bp, Homo sapiens
actccaaacagacccctgt

SEQ ID NO: 5355030 - DNA, 11 bp, Homo sapiens
actccaaactc

SEQ ID NO: 5355031 - DNA, 21 bp, Homo sapiens
actccaaagaaatgtaaggga

SEQ ID NO: 5355032 - DNA, 15 bp, Homo sapiens
actccaaagagaaac

SEQ ID NO: 5355033 - DNA, 18 bp, Homo sapiens
actcgagaccataaagat

SEQ ID NO: 5355034 - DNA, 23 bp, Homo sapiens
actcgagaccttttcaacttggc

SEQ ID NO: 5355035 - DNA, 19 bp, Homo sapiens
actcgagagggctgagccc

SEQ ID NO: 5355036 - DNA, 22 bp, Homo sapiens
actcgagagggctgagcccctc

SEQ ID NO: 5355037 - DNA, 18 bp, Homo sapiens
actcgagcccacccagca

SEQ ID NO: 5355038 - DNA, 19 bp, Homo sapiens
actcgaggactgtatttgt

SEQ ID NO: 5355039 - DNA, 15 bp, Homo sapiens
actcgagtctgaggc

SEQ ID NO: 5355040 - DNA, 14 bp, Homo sapiens
actcgagtgtttaa

SEQ ID NO: 5355041 - DNA, 17 bp, Homo sapiens
actcgagtgtttaaatg

SEQ ID NO: 5355042 - DNA, 19 bp, Homo sapiens
actcgagtgtttaaatgct

SEQ ID NO: 5355043 - DNA, 18 bp, Homo sapiens
actcgatcaaaaccttcc

SEQ ID NO: 5355044 - DNA, 11 bp, Homo sapiens
actcgatgcac

SEQ ID NO: 5355045 - DNA, 20 bp, Homo sapiens
actcgatgtaagggattcct

SEQ ID NO: 5355046 - DNA, 20 bp, Homo sapiens
actcgatttaaactccagca

SEQ ID NO: 5355047 - DNA, 21 bp, Homo sapiens
actcgatttaaactccagcat

SEQ ID NO: 5355048 - DNA, 18 bp, Homo sapiens
actcgcacctgtgctgga

SEQ ID NO: 5355049 - DNA, 14 bp, Homo sapiens
actcgcactgcaaa

SEQ ID NO: 5355050 - DNA, 15 bp, Homo sapiens
actcgcactgcaaat

SEQ ID NO: 5355051 - DNA, 17 bp, Homo sapiens
actcgcaggaccaaggg

SEQ ID NO: 5355052 - DNA, 13 bp, Homo sapiens
actcgcagtcgca

SEQ ID NO: 5355053 - DNA, 19 bp, Homo sapiens
actcgccatctcctgggcc

SEQ ID NO: 5355054 - DNA, 21 bp, Homo sapiens
actcgccatttcctcacgtgc

SEQ ID NO: 5355055 - DNA, 19 bp, Homo sapiens
actcgcccgcccactgtcc

SEQ ID NO: 5355056 - DNA, 20 bp, Homo sapiens
actcgcccgcccactgtcct

SEQ ID NO: 5355057 - DNA, 22 bp, Homo sapiens
actcgcctgggaaattgctcca

SEQ ID NO: 5355058 - DNA, 17 bp, Homo sapiens
actcgcgacaatgcaaa

SEQ ID NO: 5355059 - DNA, 20 bp, Homo sapiens
actcgcgacaatgcaaacca

SEQ ID NO: 5355060 - DNA, 23 bp, Homo sapiens
actcgcgacaatgcaaaccatca

SEQ ID NO: 5355061 - DNA, 14 bp, Homo sapiens
actcgcgagagggt

SEQ ID NO: 5355062 - DNA, 15 bp, Homo sapiens
actcgcttcccccat

SEQ ID NO: 5355063 - DNA, 15 bp, Homo sapiens
actcgcttgtgcaga

SEQ ID NO: 5355064 - DNA, 23 bp, Homo sapiens
actcggatgtgtcctttctgaac

SEQ ID NO: 5355065 - DNA, 15 bp, Homo sapiens
actcggccactgtgt

SEQ ID NO: 5355066 - DNA, 17 bp, Homo sapiens
actcggccactgtgtct

SEQ ID NO: 5355067 - DNA, 13 bp, Homo sapiens
actcggcccaggg

SEQ ID NO: 5355068 - DNA, 16 bp, Homo sapiens
actcgggagctgcaca

SEQ ID NO: 5355069 - DNA, 22 bp, Homo sapiens
actcgggaggctgagacaggag

SEQ ID NO: 5355070 - DNA, 21 bp, Homo sapiens
actcgggaggctgaggcacaa

SEQ ID NO: 5355071 - DNA, 20 bp, Homo sapiens
actcgggctaagtccagctc

SEQ ID NO: 5355072 - DNA, 17 bp, Homo sapiens
actcgggctcctgtgcc

SEQ ID NO: 5355073 - DNA, 19 bp, Homo sapiens
actcgggctcctgtgccct

SEQ ID NO: 5355074 - DNA, 19 bp, Homo sapiens
actcgggggcgcctggagg

SEQ ID NO: 5355075 - DNA, 14 bp, Homo sapiens
actcgggggctgtc

SEQ ID NO: 5355076 - DNA, 16 bp, Homo sapiens
actcgggggtgctggg

SEQ ID NO: 5355077 - DNA, 23 bp, Homo sapiens
actcgggggtgctggggccaggg

SEQ ID NO: 5355078 - DNA, 23 bp, Homo sapiens
actcgggggtggagtgagactga

SEQ ID NO: 5355079 - DNA, 13 bp, Homo sapiens
actcgggtgcgtg

SEQ ID NO: 5355080 - DNA, 17 bp, Homo sapiens
actcgggttaagaaata

SEQ ID NO: 5355081 - DNA, 18 bp, Homo sapiens
actcgggttaagaaatac

SEQ ID NO: 5355082 - DNA, 19 bp, Homo sapiens
actcgggttaagaaatacc

SEQ ID NO: 5355083 - DNA, 22 bp, Homo sapiens
actcggtcaaaatattttttaa

SEQ ID NO: 5355084 - DNA, 17 bp, Homo sapiens
actcggtgtaaaaccat

SEQ ID NO: 5355085 - DNA, 18 bp, Homo sapiens
actcggtgtaaaaccatg

SEQ ID NO: 5355086 - DNA, 17 bp, Homo sapiens
actcggtgtgtggccgc

SEQ ID NO: 5355087 - DNA, 12 bp, Homo sapiens
actcggtttctc

SEQ ID NO: 5355088 - DNA, 14 bp, Homo sapiens
actcggtttctcca

SEQ ID NO: 5355089 - DNA, 16 bp, Homo sapiens
actcggtttctccaaa

SEQ ID NO: 5355090 - DNA, 23 bp, Homo sapiens
actcgtataagcatggagaacag

SEQ ID NO: 5355091 - DNA, 17 bp, Homo sapiens
actcgtcaccccagccc

SEQ ID NO: 5355092 - DNA, 15 bp, Homo sapiens
actcgtctcccccaa

SEQ ID NO: 5355093 - DNA, 16 bp, Homo sapiens
actcgtctgactgtgt

SEQ ID NO: 5355094 - DNA, 12 bp, Homo sapiens
actcgtctgatg

SEQ ID NO: 5355095 - DNA, 13 bp, Homo sapiens
actcgtcttggca

SEQ ID NO: 5355096 - DNA, 14 bp, Homo sapiens
actcgtgacagcct

SEQ ID NO: 5355097 - DNA, 15 bp, Homo sapiens
actcgtggctgtcaa

SEQ ID NO: 5355098 - DNA, 23 bp, Homo sapiens
actcgtgtctggcacagcctggc

SEQ ID NO: 5355099 - DNA, 20 bp, Homo sapiens
actcgtgttcactcagcact

SEQ ID NO: 5355100 - DNA, 16 bp, Homo sapiens
actcgttaaagcaaag

SEQ ID NO: 5355101 - DNA, 16 bp, Homo sapiens
actcgttattcataca

SEQ ID NO: 5355102 - DNA, 22 bp, Homo sapiens
actcgttcacctccaagcattt

SEQ ID NO: 5355103 - DNA, 18 bp, Homo sapiens
actcgttctcgtgaccca

SEQ ID NO: 5355104 - DNA, 19 bp, Homo sapiens
actcgttctcgtgacccag

SEQ ID NO: 5355105 - DNA, 12 bp, Homo sapiens
actctaaaaact

SEQ ID NO: 5355106 - DNA, 19 bp, Homo sapiens
actctaaaatggacatttt

SEQ ID NO: 5355107 - DNA, 18 bp, Homo sapiens
actctaaacccacatatt

SEQ ID NO: 5355108 - DNA, 21 bp, Homo sapiens
actctaaactgcaaacagaaa

SEQ ID NO: 5355109 - DNA, 17 bp, Homo sapiens
actctaaagaaacagaa

SEQ ID NO: 5355110 - DNA, 13 bp, Homo sapiens
actctaaagcaaa

SEQ ID NO: 5355111 - DNA, 18 bp, Homo sapiens
actctaaagcaaatttat

SEQ ID NO: 5355112 - DNA, 19 bp, Homo sapiens
actctaaagccaagcactt

SEQ ID NO: 5355113 - DNA, 18 bp, Homo sapiens
actctaaatatttcatga

SEQ ID NO: 5355114 - DNA, 16 bp, Homo sapiens
actctaaatgcagttt

SEQ ID NO: 5355115 - DNA, 23 bp, Homo sapiens
actctaaattctttatttctgtc

SEQ ID NO: 5355116 - DNA, 17 bp, Homo sapiens
actctaaccagtgtaca

SEQ ID NO: 5355117 - DNA, 18 bp, Homo sapiens
actctaaccctgtggaag

SEQ ID NO: 5355118 - DNA, 20 bp, Homo sapiens
actctaaccctgtggaagca

SEQ ID NO: 5355119 - DNA, 15 bp, Homo sapiens
actctaactctgaga

SEQ ID NO: 5355120 - DNA, 22 bp, Homo sapiens
actctaactctgagagctgttt

SEQ ID NO: 5355121 - DNA, 15 bp, Homo sapiens
actctaactgtatat

SEQ ID NO: 5355122 - DNA, 21 bp, Homo sapiens
actctaactgtatatttgtat

SEQ ID NO: 5355123 - DNA, 14 bp, Homo sapiens
actctaagaaagaa

SEQ ID NO: 5355124 - DNA, 19 bp, Homo sapiens
actctaagatgttatattt

SEQ ID NO: 5355125 - DNA, 17 bp, Homo sapiens
actctaagctcagtgct

SEQ ID NO: 5355126 - DNA, 12 bp, Homo sapiens
actctaagctgt

SEQ ID NO: 5355127 - DNA, 18 bp, Homo sapiens
actctaagctgtgtgcag

SEQ ID NO: 5355128 - DNA, 20 bp, Homo sapiens
actctaagtctccaagaata

SEQ ID NO: 5355129 - DNA, 16 bp, Homo sapiens
actctaagtgtaaaaa

SEQ ID NO: 5355130 - DNA, 23 bp, Homo sapiens
actctaagtgtttgctgcaattt

SEQ ID NO: 5355131 - DNA, 21 bp, Homo sapiens
actctaatagtgcttaaaaat

SEQ ID NO: 5355132 - DNA, 17 bp, Homo sapiens
actctaatatacagtgt

SEQ ID NO: 5355133 - DNA, 13 bp, Homo sapiens
actctaatatgat

SEQ ID NO: 5355134 - DNA, 21 bp, Homo sapiens
actctaatatgattatacaaa

SEQ ID NO: 5355135 - DNA, 15 bp, Homo sapiens
actctaatattgctt

SEQ ID NO: 5355136 - DNA, 17 bp, Homo sapiens
actctaatattgcttct

SEQ ID NO: 5355137 - DNA, 21 bp, Homo sapiens
actctaattctaaccagagca

SEQ ID NO: 5355138 - DNA, 21 bp, Homo sapiens
actctacaattcctctgataa

SEQ ID NO: 5355139 - DNA, 18 bp, Homo sapiens
actctacatgtaactatt

SEQ ID NO: 5355140 - DNA, 21 bp, Homo sapiens
actctacatgtaactatttct

SEQ ID NO: 5355141 - DNA, 12 bp, Homo sapiens
actctacattta

SEQ ID NO: 5355142 - DNA, 19 bp, Homo sapiens
actctacccctgctcccat

SEQ ID NO: 5355143 - DNA, 19 bp, Homo sapiens
actctaccctcccaccccc

SEQ ID NO: 5355144 - DNA, 13 bp, Homo sapiens
actctaccctctt

SEQ ID NO: 5355145 - DNA, 22 bp, Homo sapiens
actctaccctggtaggaaagca

SEQ ID NO: 5355146 - DNA, 10 bp, Homo sapiens
actctacctc

SEQ ID NO: 5355147 - DNA, 18 bp, Homo sapiens
actctacctccttagctt

SEQ ID NO: 5355148 - DNA, 19 bp, Homo sapiens
actctacctccttagcttt

SEQ ID NO: 5355149 - DNA, 21 bp, Homo sapiens
actctacctgcaagatttcac

SEQ ID NO: 5355150 - DNA, 16 bp, Homo sapiens
actctacctgcacact

SEQ ID NO: 5355151 - DNA, 22 bp, Homo sapiens
actctacgccaaagtgcagccc

SEQ ID NO: 5355152 - DNA, 14 bp, Homo sapiens
actctactgcccca

SEQ ID NO: 5355153 - DNA, 20 bp, Homo sapiens
actctacttagcatgtccct

SEQ ID NO: 5355154 - DNA, 21 bp, Homo sapiens
actctacttagcatgtcccta

SEQ ID NO: 5355155 - DNA, 19 bp, Homo sapiens
actctagaaaacgcgacct

SEQ ID NO: 5355156 - DNA, 23 bp, Homo sapiens
actctagaaaacgcgaccttggc

SEQ ID NO: 5355157 - DNA, 10 bp, Homo sapiens
actctagaag

SEQ ID NO: 5355158 - DNA, 17 bp, Homo sapiens
actctagaagctcaggt

SEQ ID NO: 5355159 - DNA, 20 bp, Homo sapiens
actctagacaagatattgta

SEQ ID NO: 5355160 - DNA, 12 bp, Homo sapiens
actctagatggc

SEQ ID NO: 5355161 - DNA, 21 bp, Homo sapiens
actctagatggcaacattgga

SEQ ID NO: 5355162 - DNA, 21 bp, Homo sapiens
actctagatgtttagatgagg

SEQ ID NO: 5355163 - DNA, 23 bp, Homo sapiens
actctagatgtttagatgaggtt

SEQ ID NO: 5355164 - DNA, 23 bp, Homo sapiens
actctagattttgttttgctttt

SEQ ID NO: 5355165 - DNA, 19 bp, Homo sapiens
actctagcaaggctcatct

SEQ ID NO: 5355166 - DNA, 20 bp, Homo sapiens
actctagcctgggccagaga

SEQ ID NO: 5355167 - DNA, 17 bp, Homo sapiens
actctaggactctgcac

SEQ ID NO: 5355168 - DNA, 12 bp, Homo sapiens
actctaggactt

SEQ ID NO: 5355169 - DNA, 16 bp, Homo sapiens
actctaggacttcaaa

SEQ ID NO: 5355170 - DNA, 22 bp, Homo sapiens
actctaggatgtatattttata

SEQ ID NO: 5355171 - DNA, 20 bp, Homo sapiens
actctagggagtatgctgga

SEQ ID NO: 5355172 - DNA, 18 bp, Homo sapiens
actctagggatataaaaa

SEQ ID NO: 5355173 - DNA, 20 bp, Homo sapiens
actctagggatataaaaaca

SEQ ID NO: 5355174 - DNA, 21 bp, Homo sapiens
actctaggggtcaggctccat

SEQ ID NO: 5355175 - DNA, 19 bp, Homo sapiens
actctaggttatacaataa

SEQ ID NO: 5355176 - DNA, 13 bp, Homo sapiens
actctagtcaatg

SEQ ID NO: 5355177 - DNA, 22 bp, Homo sapiens
actctagtcaatgacatgaatt

SEQ ID NO: 5355178 - DNA, 23 bp, Homo sapiens
actctagtcaatgacatgaattt

SEQ ID NO: 5355179 - DNA, 12 bp, Homo sapiens
actctagttctg

SEQ ID NO: 5355180 - DNA, 20 bp, Homo sapiens
actctagttctgttgttttg

SEQ ID NO: 5355181 - DNA, 21 bp, Homo sapiens
actctataaagaaacttttga

SEQ ID NO: 5355182 - DNA, 22 bp, Homo sapiens
actctataaagaaacttttgaa

SEQ ID NO: 5355183 - DNA, 19 bp, Homo sapiens
actctatagttattgtttt

SEQ ID NO: 5355184 - DNA, 20 bp, Homo sapiens
actctatagttattgtttta

SEQ ID NO: 5355185 - DNA, 20 bp, Homo sapiens
actctatcagcattgtttca

SEQ ID NO: 5355186 - DNA, 16 bp, Homo sapiens
actctatccctggctt

SEQ ID NO: 5355187 - DNA, 17 bp, Homo sapiens
actctatgatgattgct

SEQ ID NO: 5355188 - DNA, 18 bp, Homo sapiens
actctatgatgattgctt

SEQ ID NO: 5355189 - DNA, 16 bp, Homo sapiens
actctatgccccaaat

SEQ ID NO: 5355190 - DNA, 23 bp, Homo sapiens
actctatgggtatcaaacagctc

SEQ ID NO: 5355191 - DNA, 23 bp, Homo sapiens
actctattatggaacccaatgga

SEQ ID NO: 5355192 - DNA, 18 bp, Homo sapiens
actctattgatacaatat

SEQ ID NO: 5355193 - DNA, 16 bp, Homo sapiens
actctatttaagattc

SEQ ID NO: 5355194 - DNA, 12 bp, Homo sapiens
actctattttaa

SEQ ID NO: 5355195 - DNA, 14 bp, Homo sapiens
actctatttttaca

SEQ ID NO: 5355196 - DNA, 18 bp, Homo sapiens
actctatttttgtaaaaa

SEQ ID NO: 5355197 - DNA, 21 bp, Homo sapiens
actctatttttgtaaaaaggg

SEQ ID NO: 5355198 - DNA, 22 bp, Homo sapiens
actctattttttactacataat

SEQ ID NO: 5355199 - DNA, 14 bp, Homo sapiens
actctcacatgttt

SEQ ID NO: 5355200 - DNA, 12 bp, Homo sapiens
actctcaccatg

SEQ ID NO: 5355201 - DNA, 14 bp, Homo sapiens
actctcacctcgtg

SEQ ID NO: 5355202 - DNA, 18 bp, Homo sapiens
actctcagaaataaatca

SEQ ID NO: 5355203 - DNA, 20 bp, Homo sapiens
actctcagagactcccagga

SEQ ID NO: 5355204 - DNA, 15 bp, Homo sapiens
actctcagaggcccc

SEQ ID NO: 5355205 - DNA, 22 bp, Homo sapiens
actctcaggaccaaagctttca

SEQ ID NO: 5355206 - DNA, 15 bp, Homo sapiens
actctcaggaggcgc

SEQ ID NO: 5355207 - DNA, 18 bp, Homo sapiens
actctcaggatcaagaaa

SEQ ID NO: 5355208 - DNA, 18 bp, Homo sapiens
actctcagtctctgagca

SEQ ID NO: 5355209 - DNA, 17 bp, Homo sapiens
actgaacccagagtcag

SEQ ID NO: 5355210 - DNA, 20 bp, Homo sapiens
actgaacccagagtcaggaa

SEQ ID NO: 5355211 - DNA, 22 bp, Homo sapiens
actgaacccagagtcaggaaga

SEQ ID NO: 5355212 - DNA, 18 bp, Homo sapiens
actgaaccggctttacca

SEQ ID NO: 5355213 - DNA, 23 bp, Homo sapiens
actgaaccttaggctttgtatga

SEQ ID NO: 5355214 - DNA, 19 bp, Homo sapiens
actgaacgatccttcaaag

SEQ ID NO: 5355215 - DNA, 22 bp, Homo sapiens
actgaactagcaattggttgtt

SEQ ID NO: 5355216 - DNA, 21 bp, Homo sapiens
actgaactattttaaataaaa

SEQ ID NO: 5355217 - DNA, 18 bp, Homo sapiens
actgaactcactttcctc

SEQ ID NO: 5355218 - DNA, 13 bp, Homo sapiens
actgaactcagga

SEQ ID NO: 5355219 - DNA, 20 bp, Homo sapiens
actgaactctgacaacagac

SEQ ID NO: 5355220 - DNA, 14 bp, Homo sapiens
actgaactgctttt

SEQ ID NO: 5355221 - DNA, 15 bp, Homo sapiens
actgaactgctttta

SEQ ID NO: 5355222 - DNA, 22 bp, Homo sapiens
actgaactgcttttaaaagtgc

SEQ ID NO: 5355223 - DNA, 12 bp, Homo sapiens
actgaactgtaa

SEQ ID NO: 5355224 - DNA, 13 bp, Homo sapiens
actgaactgtaac

SEQ ID NO: 5355225 - DNA, 12 bp, Homo sapiens
actgaactgtga

SEQ ID NO: 5355226 - DNA, 15 bp, Homo sapiens
actgaactgtttggt

SEQ ID NO: 5355227 - DNA, 15 bp, Homo sapiens
actgaacttttcaaa

SEQ ID NO: 5355228 - DNA, 19 bp, Homo sapiens
actgaacttttcaaaataa

SEQ ID NO: 5355229 - DNA, 21 bp, Homo sapiens
actgaagaaatctttccagtt

SEQ ID NO: 5355230 - DNA, 22 bp, Homo sapiens
actgaagaagcaccaatcatga

SEQ ID NO: 5355231 - DNA, 13 bp, Homo sapiens
actgaagaaggat

SEQ ID NO: 5355232 - DNA, 22 bp, Homo sapiens
actgaagaagtcactgaacaaa

SEQ ID NO: 5355233 - DNA, 18 bp, Homo sapiens
actgaagacctccacatt

SEQ ID NO: 5355234 - DNA, 12 bp, Homo sapiens
actgaagagaca

SEQ ID NO: 5355235 - DNA, 13 bp, Homo sapiens
actgaagagacac

SEQ ID NO: 5355236 - DNA, 12 bp, Homo sapiens
actgaagagtaa

SEQ ID NO: 5355237 - DNA, 16 bp, Homo sapiens
actgaagatagaagaa

SEQ ID NO: 5355238 - DNA, 23 bp, Homo sapiens
actgaagatagaagaaaaaagaa

SEQ ID NO: 5355239 - DNA, 15 bp, Homo sapiens
actgaagatattcca

SEQ ID NO: 5355240 - DNA, 18 bp, Homo sapiens
actgaagcaaataccaaa

SEQ ID NO: 5355241 - DNA, 22 bp, Homo sapiens
actgaagcaaataccaaagcag

SEQ ID NO: 5355242 - DNA, 17 bp, Homo sapiens
actgaagcaacttgatg

SEQ ID NO: 5355243 - DNA, 13 bp, Homo sapiens
actgaagcacagc

SEQ ID NO: 5355244 - DNA, 13 bp, Homo sapiens
actgaagcagagt

SEQ ID NO: 5355245 - DNA, 19 bp, Homo sapiens
actgaagcataaacatcac

SEQ ID NO: 5355246 - DNA, 19 bp, Homo sapiens
actgaagccaaatgaaact

SEQ ID NO: 5355247 - DNA, 20 bp, Homo sapiens
actgaagccggacagctgcc

SEQ ID NO: 5355248 - DNA, 21 bp, Homo sapiens
actgaagccggacagctgccc

SEQ ID NO: 5355249 - DNA, 14 bp, Homo sapiens
actgaagcctgcag

SEQ ID NO: 5355250 - DNA, 19 bp, Homo sapiens
actgaagcctgcaggagtt

SEQ ID NO: 5355251 - DNA, 16 bp, Homo sapiens
actgaagcgaacatct

SEQ ID NO: 5355252 - DNA, 13 bp, Homo sapiens
actgaagctgctg

SEQ ID NO: 5355253 - DNA, 16 bp, Homo sapiens
actgaagctggggctt

SEQ ID NO: 5355254 - DNA, 17 bp, Homo sapiens
actgaagctttttattt

SEQ ID NO: 5355255 - DNA, 18 bp, Homo sapiens
actgaaggaaaaacacaa

SEQ ID NO: 5355256 - DNA, 23 bp, Homo sapiens
actgaaggaaaaacacaagcaaa

SEQ ID NO: 5355257 - DNA, 13 bp, Homo sapiens
actgaaggaaaag

SEQ ID NO: 5355258 - DNA, 19 bp, Homo sapiens
actgaaggacctgagctgg

SEQ ID NO: 5355259 - DNA, 13 bp, Homo sapiens
actgaaggagaag

SEQ ID NO: 5355260 - DNA, 21 bp, Homo sapiens
actgaaggagaaggtgcccca

SEQ ID NO: 5355261 - DNA, 16 bp, Homo sapiens
actgaaggcaaatctc

SEQ ID NO: 5355262 - DNA, 23 bp, Homo sapiens
actgaaggcagcatgtatagttg

SEQ ID NO: 5355263 - DNA, 16 bp, Homo sapiens
actgaaggcatatgca

SEQ ID NO: 5355264 - DNA, 19 bp, Homo sapiens
actgaaggcttctgcagct

SEQ ID NO: 5355265 - DNA, 13 bp, Homo sapiens
actgaaggggcac

SEQ ID NO: 5355266 - DNA, 15 bp, Homo sapiens
actgaagtaataact

SEQ ID NO: 5355267 - DNA, 20 bp, Homo sapiens
actgaagtaataactgatga

SEQ ID NO: 5355268 - DNA, 15 bp, Homo sapiens
actgaagtcagttct

SEQ ID NO: 5355269 - DNA, 22 bp, Homo sapiens
actgaagtccaaattgtttgta

SEQ ID NO: 5355270 - DNA, 16 bp, Homo sapiens
actgaagtctgaaatt

SEQ ID NO: 5355271 - DNA, 23 bp, Homo sapiens
actgaagtcttactacagaaatg

SEQ ID NO: 5355272 - DNA, 19 bp, Homo sapiens
actgaagtcttttctgtca

SEQ ID NO: 5355273 - DNA, 15 bp, Homo sapiens
actgaagtgaataca

SEQ ID NO: 5355274 - DNA, 18 bp, Homo sapiens
actgaagtgaatacatgg

SEQ ID NO: 5355275 - DNA, 16 bp, Homo sapiens
actgaagtgattgaaa

SEQ ID NO: 5355276 - DNA, 17 bp, Homo sapiens
actgaagtgcagctcag

SEQ ID NO: 5355277 - DNA, 18 bp, Homo sapiens
actgaagtgcagctcagg

SEQ ID NO: 5355278 - DNA, 16 bp, Homo sapiens
actgaagtgcttgcag

SEQ ID NO: 5355279 - DNA, 16 bp, Homo sapiens
actgaagtggccctcc

SEQ ID NO: 5355280 - DNA, 15 bp, Homo sapiens
actgaagtggctggt

SEQ ID NO: 5355281 - DNA, 21 bp, Homo sapiens
actgaagtggctggtagaaaa

SEQ ID NO: 5355282 - DNA, 12 bp, Homo sapiens
actgaagtttga

SEQ ID NO: 5355283 - DNA, 18 bp, Homo sapiens
actgaagtttgataaata

SEQ ID NO: 5355284 - DNA, 23 bp, Homo sapiens
actgaagtttgataaatagtgtt

SEQ ID NO: 5355285 - DNA, 18 bp, Homo sapiens
actgaagtttttgaaata

SEQ ID NO: 5355286 - DNA, 20 bp, Homo sapiens
actgaataaactcaaaactc

SEQ ID NO: 5355287 - DNA, 16 bp, Homo sapiens
actgaataaatcatgt

SEQ ID NO: 5355288 - DNA, 15 bp, Homo sapiens
actgaataaattcag

SEQ ID NO: 5355289 - DNA, 23 bp, Homo sapiens
actgaataaggagaagagtattt

SEQ ID NO: 5355290 - DNA, 14 bp, Homo sapiens
actgaatacttgaa

SEQ ID NO: 5355291 - DNA, 21 bp, Homo sapiens
actgaatacttgaagtaggaa

SEQ ID NO: 5355292 - DNA, 15 bp, Homo sapiens
actgaataggaaaat

SEQ ID NO: 5355293 - DNA, 14 bp, Homo sapiens
actgaatagttcag

SEQ ID NO: 5355294 - DNA, 21 bp, Homo sapiens
actgaatataaagcttaataa

SEQ ID NO: 5355295 - DNA, 12 bp, Homo sapiens
actgaatatata

SEQ ID NO: 5355296 - DNA, 13 bp, Homo sapiens
actgaatatataa

SEQ ID NO: 5355297 - DNA, 15 bp, Homo sapiens
actgaatatttatat

SEQ ID NO: 5355298 - DNA, 21 bp, Homo sapiens
actgaatatttatatttcact

SEQ ID NO: 5355299 - DNA, 17 bp, Homo sapiens
actgaatattttggaaa

SEQ ID NO: 5355300 - DNA, 21 bp, Homo sapiens
actgaatccatatttcaacag

SEQ ID NO: 5355301 - DNA, 19 bp, Homo sapiens
actgaatctcccctcctca

SEQ ID NO: 5355302 - DNA, 17 bp, Homo sapiens
actgaatctgagaaagt

SEQ ID NO: 5355303 - DNA, 21 bp, Homo sapiens
actgaatgaaacccccacaca

SEQ ID NO: 5355304 - DNA, 22 bp, Homo sapiens
actgaatgaaacccccacacac

SEQ ID NO: 5355305 - DNA, 23 bp, Homo sapiens
actgaatgacttgacttcaaaag

SEQ ID NO: 5355306 - DNA, 15 bp, Homo sapiens
actgaatgatctatt

SEQ ID NO: 5355307 - DNA, 17 bp, Homo sapiens
actgaatgcataaataa

SEQ ID NO: 5355308 - DNA, 21 bp, Homo sapiens
actgaatgcctcaatgtgacc

SEQ ID NO: 5355309 - DNA, 11 bp, Homo sapiens
actgaatgtta

SEQ ID NO: 5355310 - DNA, 20 bp, Homo sapiens
actgaatgttttatttatca

SEQ ID NO: 5355311 - DNA, 16 bp, Homo sapiens
actgaattaagttatt

SEQ ID NO: 5355312 - DNA, 13 bp, Homo sapiens
actgaattaatca

SEQ ID NO: 5355313 - DNA, 19 bp, Homo sapiens
actgaattataagaggctg

SEQ ID NO: 5355314 - DNA, 15 bp, Homo sapiens
actgaattcactcca

SEQ ID NO: 5355315 - DNA, 16 bp, Homo sapiens
actgaattcactccag

SEQ ID NO: 5355316 - DNA, 16 bp, Homo sapiens
actgaattctgccttg

SEQ ID NO: 5355317 - DNA, 14 bp, Homo sapiens
actgaattgtatca

SEQ ID NO: 5355318 - DNA, 22 bp, Homo sapiens
actgaattgtcagatgtggagt

SEQ ID NO: 5355319 - DNA, 13 bp, Homo sapiens
actgaatttctat

SEQ ID NO: 5355320 - DNA, 19 bp, Homo sapiens
actgaatttctatggcata

SEQ ID NO: 5355321 - DNA, 19 bp, Homo sapiens
actgaatttctttgattta

SEQ ID NO: 5355322 - DNA, 22 bp, Homo sapiens
actgaatttctttgatttaact

SEQ ID NO: 5355323 - DNA, 23 bp, Homo sapiens
actgaatttcttttgccgttatt

SEQ ID NO: 5355324 - DNA, 15 bp, Homo sapiens
actgaatttgtactt

SEQ ID NO: 5355325 - DNA, 19 bp, Homo sapiens
actgaattttaaatgttca

SEQ ID NO: 5355326 - DNA, 17 bp, Homo sapiens
actgaatttttcttgcg

SEQ ID NO: 5355327 - DNA, 15 bp, Homo sapiens
actgaatttttttgt

SEQ ID NO: 5355328 - DNA, 16 bp, Homo sapiens
actgaatttttttgta

SEQ ID NO: 5355329 - DNA, 15 bp, Homo sapiens
actgacaaagatgca

SEQ ID NO: 5355330 - DNA, 16 bp, Homo sapiens
actgacaaatcaagtt

SEQ ID NO: 5355331 - DNA, 17 bp, Homo sapiens
actgacaaatcaagttt

SEQ ID NO: 5355332 - DNA, 14 bp, Homo sapiens
actgacaacattat

SEQ ID NO: 5355333 - DNA, 18 bp, Homo sapiens
actgacaagccatcttga

SEQ ID NO: 5355334 - DNA, 15 bp, Homo sapiens
actgacaagcctcag

SEQ ID NO: 5355335 - DNA, 17 bp, Homo sapiens
actgacaagctccattt

SEQ ID NO: 5355336 - DNA, 17 bp, Homo sapiens
actgacaatgtattttg

SEQ ID NO: 5355337 - DNA, 17 bp, Homo sapiens
actgacacaaaagaaga

SEQ ID NO: 5355338 - DNA, 20 bp, Homo sapiens
actgacacaaaagaagaaat

SEQ ID NO: 5355339 - DNA, 16 bp, Homo sapiens
actgacacaaaggaag

SEQ ID NO: 5355340 - DNA, 20 bp, Homo sapiens
actgacacaggaaaccaaca

SEQ ID NO: 5355341 - DNA, 12 bp, Homo sapiens
actgacacaggc

SEQ ID NO: 5355342 - DNA, 17 bp, Homo sapiens
actgacacaggccagcc

SEQ ID NO: 5355343 - DNA, 14 bp, Homo sapiens
actgacacagtaaa

SEQ ID NO: 5355344 - DNA, 16 bp, Homo sapiens
actgacacatcagcat

SEQ ID NO: 5355345 - DNA, 22 bp, Homo sapiens
actgacaccctggtcctgactt

SEQ ID NO: 5355346 - DNA, 19 bp, Homo sapiens
actgacacctcactgagga

SEQ ID NO: 5355347 - DNA, 17 bp, Homo sapiens
actgacacctttgcagg

SEQ ID NO: 5355348 - DNA, 16 bp, Homo sapiens
actgacactcagatgc

SEQ ID NO: 5355349 - DNA, 20 bp, Homo sapiens
actgacactgcgaactctca

SEQ ID NO: 5355350 - DNA, 15 bp, Homo sapiens
actgacagacttaga

SEQ ID NO: 5355351 - DNA, 19 bp, Homo sapiens
actgacagaggctcactga

SEQ ID NO: 5355352 - DNA, 14 bp, Homo sapiens
actgacagaggggg

SEQ ID NO: 5355353 - DNA, 21 bp, Homo sapiens
actgacagatgaccgcaataa

SEQ ID NO: 5355354 - DNA, 16 bp, Homo sapiens
actgacagatttccat

SEQ ID NO: 5355355 - DNA, 15 bp, Homo sapiens
actgacagccttgcc

SEQ ID NO: 5355356 - DNA, 23 bp, Homo sapiens
actgacatcaattttaccctgag

SEQ ID NO: 5355357 - DNA, 13 bp, Homo sapiens
actgacatcagat

SEQ ID NO: 5355358 - DNA, 19 bp, Homo sapiens
actgacatcagatttctta

SEQ ID NO: 5355359 - DNA, 13 bp, Homo sapiens
actgacatggtgc

SEQ ID NO: 5355360 - DNA, 22 bp, Homo sapiens
actgacattgttggccaaagcc

SEQ ID NO: 5355361 - DNA, 16 bp, Homo sapiens
actgacatttcacttc

SEQ ID NO: 5355362 - DNA, 16 bp, Homo sapiens
actgaccaaagactgc

SEQ ID NO: 5355363 - DNA, 19 bp, Homo sapiens
actgaccaaagactgcaga

SEQ ID NO: 5355364 - DNA, 21 bp, Homo sapiens
actgaccaaatcacccaatcc

SEQ ID NO: 5355365 - DNA, 21 bp, Homo sapiens
actgaccaatattgtacagtt

SEQ ID NO: 5355366 - DNA, 21 bp, Homo sapiens
actgaccacacattaggctgt

SEQ ID NO: 5355367 - DNA, 16 bp, Homo sapiens
actgaccactggccta

SEQ ID NO: 5355368 - DNA, 14 bp, Homo sapiens
actgaccagaacta

SEQ ID NO: 5355369 - DNA, 14 bp, Homo sapiens
actgaccagcagct

SEQ ID NO: 5355370 - DNA, 23 bp, Homo sapiens
actgaccagcctccatgctgcct

SEQ ID NO: 5355371 - DNA, 17 bp, Homo sapiens
actgaccagcggctgct

SEQ ID NO: 5355372 - DNA, 20 bp, Homo sapiens
actgaccatcatgccctctc

SEQ ID NO: 5355373 - DNA, 16 bp, Homo sapiens
actgaccatccactct

SEQ ID NO: 5355374 - DNA, 22 bp, Homo sapiens
actgaccatccactctaccctc

SEQ ID NO: 5355375 - DNA, 23 bp, Homo sapiens
actgaccatccactctaccctcc

SEQ ID NO: 5355376 - DNA, 14 bp, Homo sapiens
actgaccccctccc

SEQ ID NO: 5355377 - DNA, 17 bp, Homo sapiens
actgaccctcaggcaca

SEQ ID NO: 5355378 - DNA, 20 bp, Homo sapiens
actgaccctggagcggctct

SEQ ID NO: 5355379 - DNA, 24 bp, Homo sapiens
actgaccctggagcggctctcctg

SEQ ID NO: 5355380 - DNA, 13 bp, Homo sapiens
actgaccctgggg

SEQ ID NO: 5355381 - DNA, 15 bp, Homo sapiens
actgaccctggggct

SEQ ID NO: 5355382 - DNA, 12 bp, Homo sapiens
actgacccttcc

SEQ ID NO: 5355383 - DNA, 19 bp, Homo sapiens
actgacccttccagacata

SEQ ID NO: 5355384 - DNA, 19 bp, Homo sapiens
actgaccgccgcttccagc

SEQ ID NO: 5355385 - DNA, 16 bp, Homo sapiens
actgaccggtgctttt

SEQ ID NO: 5355386 - DNA, 17 bp, Homo sapiens
actgaccgtatgatgag

SEQ ID NO: 5355387 - DNA, 17 bp, Homo sapiens
actgccacaaggaagaa

SEQ ID NO: 5355388 - DNA, 15 bp, Homo sapiens
actgccacaccctcc

SEQ ID NO: 5355389 - DNA, 23 bp, Homo sapiens
actgccaccagcaatgccctgcc

SEQ ID NO: 5355390 - DNA, 11 bp, Homo sapiens
actgccacctc

SEQ ID NO: 5355391 - DNA, 23 bp, Homo sapiens
actgccacctccccttgccagct

SEQ ID NO: 5355392 - DNA, 22 bp, Homo sapiens
actgccaccttgggtctgtgtc

SEQ ID NO: 5355393 - DNA, 16 bp, Homo sapiens
actgccaccttgtggc

SEQ ID NO: 5355394 - DNA, 24 bp, Homo sapiens
actgccacgtgccttaggaatact

SEQ ID NO: 5355395 - DNA, 22 bp, Homo sapiens
actgccactaaaatccacccag

SEQ ID NO: 5355396 - DNA, 16 bp, Homo sapiens
actgccactgtgtgcc

SEQ ID NO: 5355397 - DNA, 20 bp, Homo sapiens
actgccactttgcacatttt

SEQ ID NO: 5355398 - DNA, 19 bp, Homo sapiens
actgccagatgctgatgtt

SEQ ID NO: 5355399 - DNA, 23 bp, Homo sapiens
actgccagatgctgatgttcagt

SEQ ID NO: 5355400 - DNA, 19 bp, Homo sapiens
actgccagcagcagcaggt

SEQ ID NO: 5355401 - DNA, 17 bp, Homo sapiens
actgccagcccaccccc

SEQ ID NO: 5355402 - DNA, 16 bp, Homo sapiens
actgccagctcttcct

SEQ ID NO: 5355403 - DNA, 12 bp, Homo sapiens
actgccaggcac

SEQ ID NO: 5355404 - DNA, 16 bp, Homo sapiens
actgccaggcacctgg

SEQ ID NO: 5355405 - DNA, 21 bp, Homo sapiens
actgccaggcacctggcctgc

SEQ ID NO: 5355406 - DNA, 22 bp, Homo sapiens
actgccaggcacctggcctgct

SEQ ID NO: 5355407 - DNA, 17 bp, Homo sapiens
actgccaggccagcctc

SEQ ID NO: 5355408 - DNA, 18 bp, Homo sapiens
actgccaggctctctttg

SEQ ID NO: 5355409 - DNA, 17 bp, Homo sapiens
actgccagggccgcggc

SEQ ID NO: 5355410 - DNA, 20 bp, Homo sapiens
actgccaggtggttgggttc

SEQ ID NO: 5355411 - DNA, 15 bp, Homo sapiens
actgccataaaacat

SEQ ID NO: 5355412 - DNA, 20 bp, Homo sapiens
actgccataaaatctcacgc

SEQ ID NO: 5355413 - DNA, 16 bp, Homo sapiens
actgccataacttgtt

SEQ ID NO: 5355414 - DNA, 22 bp, Homo sapiens
actgccatacataatatatgac

SEQ ID NO: 5355415 - DNA, 16 bp, Homo sapiens
actgccatattaaatt

SEQ ID NO: 5355416 - DNA, 21 bp, Homo sapiens
actgccatattaaattttttg

SEQ ID NO: 5355417 - DNA, 16 bp, Homo sapiens
actgccatattgtgta

SEQ ID NO: 5355418 - DNA, 19 bp, Homo sapiens
actgccatattgtgtaatt

SEQ ID NO: 5355419 - DNA, 14 bp, Homo sapiens
actgccatcctggc

SEQ ID NO: 5355420 - DNA, 21 bp, Homo sapiens
actgccatcggacaggaggat

SEQ ID NO: 5355421 - DNA, 18 bp, Homo sapiens
actgccatgatagctggg

SEQ ID NO: 5355422 - DNA, 20 bp, Homo sapiens
actgccatgcaccaggactg

SEQ ID NO: 5355423 - DNA, 23 bp, Homo sapiens
actgccattacccagtgccgagg

SEQ ID NO: 5355424 - DNA, 16 bp, Homo sapiens
actgccattagactga

SEQ ID NO: 5355425 - DNA, 18 bp, Homo sapiens
actgccattattttctgt

SEQ ID NO: 5355426 - DNA, 20 bp, Homo sapiens
actgccattattttctgtca

SEQ ID NO: 5355427 - DNA, 23 bp, Homo sapiens
actgccattattttctgtcagat

SEQ ID NO: 5355428 - DNA, 14 bp, Homo sapiens
actgcccaaagtgc

SEQ ID NO: 5355429 - DNA, 21 bp, Homo sapiens
actgcccaaggataggtattt

SEQ ID NO: 5355430 - DNA, 17 bp, Homo sapiens
actgcccaccaaaggtc

SEQ ID NO: 5355431 - DNA, 11 bp, Homo sapiens
actgcccaccc

SEQ ID NO: 5355432 - DNA, 13 bp, Homo sapiens
actgcccaccccc

SEQ ID NO: 5355433 - DNA, 14 bp, Homo sapiens
actgcccaccccct

SEQ ID NO: 5355434 - DNA, 15 bp, Homo sapiens
actgcccaccccctc

SEQ ID NO: 5355435 - DNA, 12 bp, Homo sapiens
actgcccaccct

SEQ ID NO: 5355436 - DNA, 15 bp, Homo sapiens
actgcccagccactc

SEQ ID NO: 5355437 - DNA, 16 bp, Homo sapiens
actgcccagccactcc

SEQ ID NO: 5355438 - DNA, 14 bp, Homo sapiens
actgcccagcggac

SEQ ID NO: 5355439 - DNA, 19 bp, Homo sapiens
actgcccaggcctgcctgt

SEQ ID NO: 5355440 - DNA, 12 bp, Homo sapiens
actgcccagggg

SEQ ID NO: 5355441 - DNA, 16 bp, Homo sapiens
actgcccatcagtgac

SEQ ID NO: 5355442 - DNA, 18 bp, Homo sapiens
actgcccatcagtgacag

SEQ ID NO: 5355443 - DNA, 16 bp, Homo sapiens
actgcccattgtaact

SEQ ID NO: 5355444 - DNA, 15 bp, Homo sapiens
actgccccaactcct

SEQ ID NO: 5355445 - DNA, 17 bp, Homo sapiens
actgccccaactcctgg

SEQ ID NO: 5355446 - DNA, 18 bp, Homo sapiens
actgccccaactcctgga

SEQ ID NO: 5355447 - DNA, 15 bp, Homo sapiens
actgccccaccagcc

SEQ ID NO: 5355448 - DNA, 18 bp, Homo sapiens
actgccccacggagacag

SEQ ID NO: 5355449 - DNA, 19 bp, Homo sapiens
actgccccacggagacaga

SEQ ID NO: 5355450 - DNA, 12 bp, Homo sapiens
actgccccacgt

SEQ ID NO: 5355451 - DNA, 18 bp, Homo sapiens
actgccccacgttgtccc

SEQ ID NO: 5355452 - DNA, 20 bp, Homo sapiens
actgccccacgttgtccctg

SEQ ID NO: 5355453 - DNA, 17 bp, Homo sapiens
actgccccacttctggc

SEQ ID NO: 5355454 - DNA, 18 bp, Homo sapiens
actgccccacttctggca

SEQ ID NO: 5355455 - DNA, 14 bp, Homo sapiens
actgccccagctcc

SEQ ID NO: 5355456 - DNA, 15 bp, Homo sapiens
actgccccatctcct

SEQ ID NO: 5355457 - DNA, 14 bp, Homo sapiens
actgcccccactgt

SEQ ID NO: 5355458 - DNA, 13 bp, Homo sapiens
actgcccccagaa

SEQ ID NO: 5355459 - DNA, 12 bp, Homo sapiens
actgccccctcc

SEQ ID NO: 5355460 - DNA, 14 bp, Homo sapiens
actgccccctcctg

SEQ ID NO: 5355461 - DNA, 17 bp, Homo sapiens
actgccccctctgccct

SEQ ID NO: 5355462 - DNA, 20 bp, Homo sapiens
actgccccctctgccctgcg

SEQ ID NO: 5355463 - DNA, 14 bp, Homo sapiens
actgccccgcgtct

SEQ ID NO: 5355464 - DNA, 19 bp, Homo sapiens
actgccccgtgtgaatgta

SEQ ID NO: 5355465 - DNA, 21 bp, Homo sapiens
actgccccgtgtgaatgtagc

SEQ ID NO: 5355466 - DNA, 22 bp, Homo sapiens
actgcccctgcacctgcttctc

SEQ ID NO: 5355467 - DNA, 23 bp, Homo sapiens
actgcccctgcacctgcttctca

SEQ ID NO: 5355468 - DNA, 20 bp, Homo sapiens
actgcccctgccctgaggag

SEQ ID NO: 5355469 - DNA, 13 bp, Homo sapiens
actgccccttgct

SEQ ID NO: 5355470 - DNA, 18 bp, Homo sapiens
actgccccttgcttctca

SEQ ID NO: 5355471 - DNA, 22 bp, Homo sapiens
actgcccggcacagatgctcca

SEQ ID NO: 5355472 - DNA, 21 bp, Homo sapiens
actgcccggggcagctgccag

SEQ ID NO: 5355473 - DNA, 19 bp, Homo sapiens
actgccctaagcccccagg

SEQ ID NO: 5355474 - DNA, 21 bp, Homo sapiens
actgccctaagcccccagggc

SEQ ID NO: 5355475 - DNA, 17 bp, Homo sapiens
actgccctccagggcca

SEQ ID NO: 5355476 - DNA, 13 bp, Homo sapiens
actgccctccgaa

SEQ ID NO: 5355477 - DNA, 15 bp, Homo sapiens
actgccctctccaca

SEQ ID NO: 5355478 - DNA, 18 bp, Homo sapiens
actgccctctccacaccc

SEQ ID NO: 5355479 - DNA, 14 bp, Homo sapiens
actgccctctgaaa

SEQ ID NO: 5355480 - DNA, 22 bp, Homo sapiens
actgccctctgccactgacagg

SEQ ID NO: 5355481 - DNA, 12 bp, Homo sapiens
actgccctctgt

SEQ ID NO: 5355482 - DNA, 21 bp, Homo sapiens
actgccctctgttcagtaaca

SEQ ID NO: 5355483 - DNA, 22 bp, Homo sapiens
actgccctctgttcagtaacag

SEQ ID NO: 5355484 - DNA, 11 bp, Homo sapiens
actgccctgcc

SEQ ID NO: 5355485 - DNA, 18 bp, Homo sapiens
actgccctgcctgcccac

SEQ ID NO: 5355486 - DNA, 23 bp, Homo sapiens
actgccctgttcatgtgcctctg

SEQ ID NO: 5355487 - DNA, 24 bp, Homo sapiens
actgccctgttcatgtgcctctgc

SEQ ID NO: 5355488 - DNA, 20 bp, Homo sapiens
actgccgaagaattgtcttg

SEQ ID NO: 5355489 - DNA, 19 bp, Homo sapiens
actgccgaccgaggctgga

SEQ ID NO: 5355490 - DNA, 22 bp, Homo sapiens
actgccgcaagtctgcagcccg

SEQ ID NO: 5355491 - DNA, 18 bp, Homo sapiens
actgccgctgcccccacc

SEQ ID NO: 5355492 - DNA, 20 bp, Homo sapiens
actgccggtcacccaggctc

SEQ ID NO: 5355493 - DNA, 20 bp, Homo sapiens
actgccggtcatttgaatga

SEQ ID NO: 5355494 - DNA, 16 bp, Homo sapiens
actgccgtaatttaac

SEQ ID NO: 5355495 - DNA, 17 bp, Homo sapiens
actgccgtaatttaact

SEQ ID NO: 5355496 - DNA, 22 bp, Homo sapiens
actgccgtcacccactctgcac

SEQ ID NO: 5355497 - DNA, 18 bp, Homo sapiens
actgccgtcagtgctgtg

SEQ ID NO: 5355498 - DNA, 20 bp, Homo sapiens
actgccgtcagtgctgtgct

SEQ ID NO: 5355499 - DNA, 20 bp, Homo sapiens
actgccgtgcattagcacag

SEQ ID NO: 5355500 - DNA, 23 bp, Homo sapiens
actgcctaccagtcgccctctgt

SEQ ID NO: 5355501 - DNA, 16 bp, Homo sapiens
actgcctactgcatcg

SEQ ID NO: 5355502 - DNA, 20 bp, Homo sapiens
actgcctagaaacaacactg

SEQ ID NO: 5355503 - DNA, 21 bp, Homo sapiens
actgcctagaaacaacactgt

SEQ ID NO: 5355504 - DNA, 11 bp, Homo sapiens
actgcctagga

SEQ ID NO: 5355505 - DNA, 20 bp, Homo sapiens
actgcctattcacgccgtaa

SEQ ID NO: 5355506 - DNA, 16 bp, Homo sapiens
actgcctattttaata

SEQ ID NO: 5355507 - DNA, 21 bp, Homo sapiens
actgcctattttaataaacac

SEQ ID NO: 5355508 - DNA, 12 bp, Homo sapiens
actgcctcagcg

SEQ ID NO: 5355509 - DNA, 18 bp, Homo sapiens
actgcctcccccagggtc

SEQ ID NO: 5355510 - DNA, 23 bp, Homo sapiens
actgcctcccccgaatgcatttg

SEQ ID NO: 5355511 - DNA, 16 bp, Homo sapiens
actgcctcctgcctgg

SEQ ID NO: 5355512 - DNA, 17 bp, Homo sapiens
actgcctccttgccagc

SEQ ID NO: 5355513 - DNA, 22 bp, Homo sapiens
actgcctcgggaacctcactct

SEQ ID NO: 5355514 - DNA, 19 bp, Homo sapiens
actgcctctatgccctgca

SEQ ID NO: 5355515 - DNA, 21 bp, Homo sapiens
actgcctctatgccctgcaga

SEQ ID NO: 5355516 - DNA, 12 bp, Homo sapiens
actgcctctccc

SEQ ID NO: 5355517 - DNA, 11 bp, Homo sapiens
actgcctctgc

SEQ ID NO: 5355518 - DNA, 15 bp, Homo sapiens
actgcctctgccaca

SEQ ID NO: 5355519 - DNA, 13 bp, Homo sapiens
actgcctctgcct

SEQ ID NO: 5355520 - DNA, 20 bp, Homo sapiens
actgcctgacaattatgaaa

SEQ ID NO: 5355521 - DNA, 15 bp, Homo sapiens
actgcctgaccttgg

SEQ ID NO: 5355522 - DNA, 13 bp, Homo sapiens
actgcctgcagct

SEQ ID NO: 5355523 - DNA, 22 bp, Homo sapiens
actgcctgcctcccctccgcag

SEQ ID NO: 5355524 - DNA, 15 bp, Homo sapiens
actgcctgccttaag

SEQ ID NO: 5355525 - DNA, 11 bp, Homo sapiens
actgcctgctc

SEQ ID NO: 5355526 - DNA, 15 bp, Homo sapiens
actgcctgctcccat

SEQ ID NO: 5355527 - DNA, 12 bp, Homo sapiens
actgcctgggcc

SEQ ID NO: 5355528 - DNA, 21 bp, Homo sapiens
actgcctgggccatgcgaggg

SEQ ID NO: 5355529 - DNA, 20 bp, Homo sapiens
actgcctgtagcaatggcca

SEQ ID NO: 5355530 - DNA, 13 bp, Homo sapiens
actgcctgtatac

SEQ ID NO: 5355531 - DNA, 16 bp, Homo sapiens
actgcctgtatacttt

SEQ ID NO: 5355532 - DNA, 20 bp, Homo sapiens
actgcctgtatactttagta

SEQ ID NO: 5355533 - DNA, 16 bp, Homo sapiens
actgcctgtctgcttg

SEQ ID NO: 5355534 - DNA, 21 bp, Homo sapiens
actgcctgtctgcttgcatct

SEQ ID NO: 5355535 - DNA, 15 bp, Homo sapiens
actgccttaaaactt

SEQ ID NO: 5355536 - DNA, 11 bp, Homo sapiens
actgccttaat

SEQ ID NO: 5355537 - DNA, 20 bp, Homo sapiens
actgccttaatgagaacatt

SEQ ID NO: 5355538 - DNA, 19 bp, Homo sapiens
actgccttaccttcactta

SEQ ID NO: 5355539 - DNA, 15 bp, Homo sapiens
actgccttagcctct

SEQ ID NO: 5355540 - DNA, 17 bp, Homo sapiens
actgccttccaggagca

SEQ ID NO: 5355541 - DNA, 17 bp, Homo sapiens
actgccttcgcttcttg

SEQ ID NO: 5355542 - DNA, 16 bp, Homo sapiens
actgccttctcctctc

SEQ ID NO: 5355543 - DNA, 19 bp, Homo sapiens
actgccttctcctctctgg

SEQ ID NO: 5355544 - DNA, 21 bp, Homo sapiens
actgccttctcctctctgggc

SEQ ID NO: 5355545 - DNA, 12 bp, Homo sapiens
actgccttgaaa

SEQ ID NO: 5355546 - DNA, 17 bp, Homo sapiens
actgccttgaaaaatga

SEQ ID NO: 5355547 - DNA, 16 bp, Homo sapiens
actgccttggcccctc

SEQ ID NO: 5355548 - DNA, 19 bp, Homo sapiens
actgccttgtttaatgtta

SEQ ID NO: 5355549 - DNA, 13 bp, Homo sapiens
actgcctttcaaa

SEQ ID NO: 5355550 - DNA, 19 bp, Homo sapiens
actgcctttcagaagtgat

SEQ ID NO: 5355551 - DNA, 13 bp, Homo sapiens
actgcctttgacc

SEQ ID NO: 5355552 - DNA, 14 bp, Homo sapiens
actgcctttgctgc

SEQ ID NO: 5355553 - DNA, 16 bp, Homo sapiens
actgcctttgctgcct

SEQ ID NO: 5355554 - DNA, 17 bp, Homo sapiens
actgcgactttctgcct

SEQ ID NO: 5355555 - DNA, 16 bp, Homo sapiens
actgcgaggacatcaa

SEQ ID NO: 5355556 - DNA, 21 bp, Homo sapiens
actgcgaggttgttttaaagt

SEQ ID NO: 5355557 - DNA, 17 bp, Homo sapiens
actgcgcacagccccag

SEQ ID NO: 5355558 - DNA, 20 bp, Homo sapiens
actgcgccacggcactccag

SEQ ID NO: 5355559 - DNA, 16 bp, Homo sapiens
actgcgcctcgtgctg

SEQ ID NO: 5355560 - DNA, 16 bp, Homo sapiens
actgcggaacaggagt

SEQ ID NO: 5355561 - DNA, 22 bp, Homo sapiens
actgcggaagccaaaggcagct

SEQ ID NO: 5355562 - DNA, 19 bp, Homo sapiens
actgcggaccaagggactc

SEQ ID NO: 5355563 - DNA, 19 bp, Homo sapiens
actgcggagcagcctccag

SEQ ID NO: 5355564 - DNA, 13 bp, Homo sapiens
actggcagaagca

SEQ ID NO: 5355565 - DNA, 14 bp, Homo sapiens
actggcagaagcat

SEQ ID NO: 5355566 - DNA, 20 bp, Homo sapiens
actggcagagagatcttccc

SEQ ID NO: 5355567 - DNA, 22 bp, Homo sapiens
actggcagagaggtaaagggtg

SEQ ID NO: 5355568 - DNA, 13 bp, Homo sapiens
actggcagagcac

SEQ ID NO: 5355569 - DNA, 15 bp, Homo sapiens
actggcagagcacag

SEQ ID NO: 5355570 - DNA, 19 bp, Homo sapiens
actggcagagcacagccca

SEQ ID NO: 5355571 - DNA, 14 bp, Homo sapiens
actggcagcatctt

SEQ ID NO: 5355572 - DNA, 13 bp, Homo sapiens
actggcagccagg

SEQ ID NO: 5355573 - DNA, 21 bp, Homo sapiens
actggcagccagggagcccgg

SEQ ID NO: 5355574 - DNA, 20 bp, Homo sapiens
actggcaggagcctcgtgtc

SEQ ID NO: 5355575 - DNA, 21 bp, Homo sapiens
actggcaggggagacaggagc

SEQ ID NO: 5355576 - DNA, 13 bp, Homo sapiens
actggcaggtgtg

SEQ ID NO: 5355577 - DNA, 22 bp, Homo sapiens
actggcatagccctcctgagca

SEQ ID NO: 5355578 - DNA, 16 bp, Homo sapiens
actggcatctccctga

SEQ ID NO: 5355579 - DNA, 17 bp, Homo sapiens
actggcatctccctgac

SEQ ID NO: 5355580 - DNA, 10 bp, Homo sapiens
actggcatgc

SEQ ID NO: 5355581 - DNA, 19 bp, Homo sapiens
actggcatggattaataga

SEQ ID NO: 5355582 - DNA, 17 bp, Homo sapiens
actggcatgtcatttgc

SEQ ID NO: 5355583 - DNA, 17 bp, Homo sapiens
actggcattgtccctgt

SEQ ID NO: 5355584 - DNA, 21 bp, Homo sapiens
actggcattgtccctgtgcct

SEQ ID NO: 5355585 - DNA, 21 bp, Homo sapiens
actggcatttttagctccttg

SEQ ID NO: 5355586 - DNA, 17 bp, Homo sapiens
actggccaagctgaggt

SEQ ID NO: 5355587 - DNA, 21 bp, Homo sapiens
actggccacaaggacgctggc

SEQ ID NO: 5355588 - DNA, 18 bp, Homo sapiens
actggccaccaggctggc

SEQ ID NO: 5355589 - DNA, 22 bp, Homo sapiens
actggccaccaggctggcgcag

SEQ ID NO: 5355590 - DNA, 13 bp, Homo sapiens
actggccacccaa

SEQ ID NO: 5355591 - DNA, 18 bp, Homo sapiens
actggccacccctcccca

SEQ ID NO: 5355592 - DNA, 12 bp, Homo sapiens
actggccagaga

SEQ ID NO: 5355593 - DNA, 20 bp, Homo sapiens
actggccagagagggcccag

SEQ ID NO: 5355594 - DNA, 14 bp, Homo sapiens
actggccagaggca

SEQ ID NO: 5355595 - DNA, 15 bp, Homo sapiens
actggccagctctgg

SEQ ID NO: 5355596 - DNA, 11 bp, Homo sapiens
actggccaggg

SEQ ID NO: 5355597 - DNA, 22 bp, Homo sapiens
actggccagggccacgctccag

SEQ ID NO: 5355598 - DNA, 18 bp, Homo sapiens
actggccagtcctagagc

SEQ ID NO: 5355599 - DNA, 23 bp, Homo sapiens
actggccagtcctagagctcctg

SEQ ID NO: 5355600 - DNA, 17 bp, Homo sapiens
actggccatgcaagtgg

SEQ ID NO: 5355601 - DNA, 16 bp, Homo sapiens
actggccatggcctgc

SEQ ID NO: 5355602 - DNA, 19 bp, Homo sapiens
actggccatttttctgggg

SEQ ID NO: 5355603 - DNA, 17 bp, Homo sapiens
actggcccacacgtgca

SEQ ID NO: 5355604 - DNA, 15 bp, Homo sapiens
actggcccagtgcca

SEQ ID NO: 5355605 - DNA, 16 bp, Homo sapiens
actggcccagtgccag

SEQ ID NO: 5355606 - DNA, 20 bp, Homo sapiens
actggccccggatcagagca

SEQ ID NO: 5355607 - DNA, 21 bp, Homo sapiens
actggcccctactttgtggca

SEQ ID NO: 5355608 - DNA, 20 bp, Homo sapiens
actggcccctaggctgctgc

SEQ ID NO: 5355609 - DNA, 17 bp, Homo sapiens
actggccctcttcttac

SEQ ID NO: 5355610 - DNA, 23 bp, Homo sapiens
actggcccttgcccaactcccag

SEQ ID NO: 5355611 - DNA, 22 bp, Homo sapiens
actggccggcccacgtcctggg

SEQ ID NO: 5355612 - DNA, 23 bp, Homo sapiens
actggccggcccacgtcctgggt

SEQ ID NO: 5355613 - DNA, 15 bp, Homo sapiens
actggccgggcaggc

SEQ ID NO: 5355614 - DNA, 16 bp, Homo sapiens
actggccgggcaggcg

SEQ ID NO: 5355615 - DNA, 16 bp, Homo sapiens
actggccgtatctgag

SEQ ID NO: 5355616 - DNA, 20 bp, Homo sapiens
actggcctaggggccagggc

SEQ ID NO: 5355617 - DNA, 15 bp, Homo sapiens
actggcctcaaagca

SEQ ID NO: 5355618 - DNA, 19 bp, Homo sapiens
actggcctcgcctggcctg

SEQ ID NO: 5355619 - DNA, 14 bp, Homo sapiens
actggcctctgtga

SEQ ID NO: 5355620 - DNA, 23 bp, Homo sapiens
actggcctctgtgattacataga

SEQ ID NO: 5355621 - DNA, 13 bp, Homo sapiens
actggcctgactt

SEQ ID NO: 5355622 - DNA, 16 bp, Homo sapiens
actggcctgaggagca

SEQ ID NO: 5355623 - DNA, 19 bp, Homo sapiens
actggcctgaggagcagca

SEQ ID NO: 5355624 - DNA, 18 bp, Homo sapiens
actggcctgcctcctccg

SEQ ID NO: 5355625 - DNA, 23 bp, Homo sapiens
actggcctgggtctccctggtgg

SEQ ID NO: 5355626 - DNA, 23 bp, Homo sapiens
actggcctgttctgtaggagaga

SEQ ID NO: 5355627 - DNA, 19 bp, Homo sapiens
actggccttctgatgaaat

SEQ ID NO: 5355628 - DNA, 18 bp, Homo sapiens
actggccttgcctccagg

SEQ ID NO: 5355629 - DNA, 17 bp, Homo sapiens
actggccttttcactga

SEQ ID NO: 5355630 - DNA, 15 bp, Homo sapiens
actggcgaagcctga

SEQ ID NO: 5355631 - DNA, 17 bp, Homo sapiens
actggcgaagcctgagc

SEQ ID NO: 5355632 - DNA, 19 bp, Homo sapiens
actggcgaagcctgagcag

SEQ ID NO: 5355633 - DNA, 22 bp, Homo sapiens
actggcgaagcctgagcaggca

SEQ ID NO: 5355634 - DNA, 23 bp, Homo sapiens
actggcgaagcctgagcaggcag

SEQ ID NO: 5355635 - DNA, 19 bp, Homo sapiens
actggcgacacgtagcagc

SEQ ID NO: 5355636 - DNA, 18 bp, Homo sapiens
actggcgatctcccaggg

SEQ ID NO: 5355637 - DNA, 13 bp, Homo sapiens
actggcgccttct

SEQ ID NO: 5355638 - DNA, 19 bp, Homo sapiens
actggcggagaaggagagg

SEQ ID NO: 5355639 - DNA, 23 bp, Homo sapiens
actggcgtagaagtttttgtact

SEQ ID NO: 5355640 - DNA, 21 bp, Homo sapiens
actggcgtctggactgttctg

SEQ ID NO: 5355641 - DNA, 15 bp, Homo sapiens
actggcgtggattaa

SEQ ID NO: 5355642 - DNA, 16 bp, Homo sapiens
actggcgttcacctcc

SEQ ID NO: 5355643 - DNA, 21 bp, Homo sapiens
actggcgttcacctccctgct

SEQ ID NO: 5355644 - DNA, 21 bp, Homo sapiens
actggctagagtcctcactcc

SEQ ID NO: 5355645 - DNA, 12 bp, Homo sapiens
actggctcaccc

SEQ ID NO: 5355646 - DNA, 14 bp, Homo sapiens
actggctcacccct

SEQ ID NO: 5355647 - DNA, 21 bp, Homo sapiens
actggctcacccctctccccc

SEQ ID NO: 5355648 - DNA, 22 bp, Homo sapiens
actggctcacccctctcccccg

SEQ ID NO: 5355649 - DNA, 16 bp, Homo sapiens
actggctcctccagca

SEQ ID NO: 5355650 - DNA, 19 bp, Homo sapiens
actggctcctccagcaaga

SEQ ID NO: 5355651 - DNA, 14 bp, Homo sapiens
actggctcctccca

SEQ ID NO: 5355652 - DNA, 16 bp, Homo sapiens
actggctcctcccagc

SEQ ID NO: 5355653 - DNA, 18 bp, Homo sapiens
actggctcctcccagcac

SEQ ID NO: 5355654 - DNA, 16 bp, Homo sapiens
actggctcctctgtgg

SEQ ID NO: 5355655 - DNA, 15 bp, Homo sapiens
actggctcctggacc

SEQ ID NO: 5355656 - DNA, 19 bp, Homo sapiens
actggctcctttgcctctg

SEQ ID NO: 5355657 - DNA, 22 bp, Homo sapiens
actggctcctttgcctctgcta

SEQ ID NO: 5355658 - DNA, 15 bp, Homo sapiens
actggctctccaagt

SEQ ID NO: 5355659 - DNA, 16 bp, Homo sapiens
actggctctccaagtg

SEQ ID NO: 5355660 - DNA, 17 bp, Homo sapiens
actggctctcctggccc

SEQ ID NO: 5355661 - DNA, 12 bp, Homo sapiens
actggctctggg

SEQ ID NO: 5355662 - DNA, 14 bp, Homo sapiens
actggctctgggac

SEQ ID NO: 5355663 - DNA, 9 bp, Homo sapiens
actggctga

SEQ ID NO: 5355664 - DNA, 21 bp, Homo sapiens
actggctgcaagtggttaaga

SEQ ID NO: 5355665 - DNA, 15 bp, Homo sapiens
actggctgcacagcc

SEQ ID NO: 5355666 - DNA, 18 bp, Homo sapiens
actggctgcacagcccaa

SEQ ID NO: 5355667 - DNA, 17 bp, Homo sapiens
actggctgcctccactc

SEQ ID NO: 5355668 - DNA, 21 bp, Homo sapiens
actggctgcctccactcccac

SEQ ID NO: 5355669 - DNA, 22 bp, Homo sapiens
actggctgcctccactcccact

SEQ ID NO: 5355670 - DNA, 14 bp, Homo sapiens
actggctgctccct

SEQ ID NO: 5355671 - DNA, 13 bp, Homo sapiens
actggctgctctg

SEQ ID NO: 5355672 - DNA, 18 bp, Homo sapiens
actggctggcctgagcaa

SEQ ID NO: 5355673 - DNA, 12 bp, Homo sapiens
actggctggctc

SEQ ID NO: 5355674 - DNA, 16 bp, Homo sapiens
actggctggctgcagt

SEQ ID NO: 5355675 - DNA, 20 bp, Homo sapiens
actggctgggagtccttacc

SEQ ID NO: 5355676 - DNA, 16 bp, Homo sapiens
actggctgggcccctg

SEQ ID NO: 5355677 - DNA, 19 bp, Homo sapiens
actggctgggcccctgggg

SEQ ID NO: 5355678 - DNA, 13 bp, Homo sapiens
actggctggggca

SEQ ID NO: 5355679 - DNA, 15 bp, Homo sapiens
actggctggggcaga

SEQ ID NO: 5355680 - DNA, 18 bp, Homo sapiens
actggctgtctgcctgta

SEQ ID NO: 5355681 - DNA, 12 bp, Homo sapiens
actggctgtgcc

SEQ ID NO: 5355682 - DNA, 16 bp, Homo sapiens
actggctgtgcctccc

SEQ ID NO: 5355683 - DNA, 21 bp, Homo sapiens
actggctgtgggctcccttcc

SEQ ID NO: 5355684 - DNA, 22 bp, Homo sapiens
actggctgtgggctcccttcct

SEQ ID NO: 5355685 - DNA, 21 bp, Homo sapiens
actggctgtgtgaccttaggc

SEQ ID NO: 5355686 - DNA, 16 bp, Homo sapiens
actggcttaacttagt

SEQ ID NO: 5355687 - DNA, 19 bp, Homo sapiens
actggcttaacttagtata

SEQ ID NO: 5355688 - DNA, 18 bp, Homo sapiens
actggcttacctcctcat

SEQ ID NO: 5355689 - DNA, 15 bp, Homo sapiens
actggcttctgtgca

SEQ ID NO: 5355690 - DNA, 15 bp, Homo sapiens
actggcttgaaggac

SEQ ID NO: 5355691 - DNA, 16 bp, Homo sapiens
actggcttgctcccgc

SEQ ID NO: 5355692 - DNA, 15 bp, Homo sapiens
actggcttgtacatt

SEQ ID NO: 5355693 - DNA, 18 bp, Homo sapiens
actggcttgtacattttt

SEQ ID NO: 5355694 - DNA, 16 bp, Homo sapiens
actggctttggcttct

SEQ ID NO: 5355695 - DNA, 18 bp, Homo sapiens
actggctttggcttcttg

SEQ ID NO: 5355696 - DNA, 20 bp, Homo sapiens
actggctttgtcccacagct

SEQ ID NO: 5355697 - DNA, 14 bp, Homo sapiens
actggcttttatta

SEQ ID NO: 5355698 - DNA, 20 bp, Homo sapiens
actggcttttattaatgcac

SEQ ID NO: 5355699 - DNA, 11 bp, Homo sapiens
actgggaaact

SEQ ID NO: 5355700 - DNA, 21 bp, Homo sapiens
actgggaaataagcaaaaaac

SEQ ID NO: 5355701 - DNA, 23 bp, Homo sapiens
actgggaaataagcaaaaaactg

SEQ ID NO: 5355702 - DNA, 12 bp, Homo sapiens
actgggaaatga

SEQ ID NO: 5355703 - DNA, 17 bp, Homo sapiens
actgggaacccctttcc

SEQ ID NO: 5355704 - DNA, 12 bp, Homo sapiens
actgggaagaag

SEQ ID NO: 5355705 - DNA, 20 bp, Homo sapiens
actgggaagctggagtgctg

SEQ ID NO: 5355706 - DNA, 13 bp, Homo sapiens
actgggaaggaaa

SEQ ID NO: 5355707 - DNA, 16 bp, Homo sapiens
actgggaaggaaacaa

SEQ ID NO: 5355708 - DNA, 17 bp, Homo sapiens
actgggaaggctacttc

SEQ ID NO: 5355709 - DNA, 20 bp, Homo sapiens
actgggaaggcttgggattt

SEQ ID NO: 5355710 - DNA, 19 bp, Homo sapiens
actgggaagggggcaggcc

SEQ ID NO: 5355711 - DNA, 18 bp, Homo sapiens
actgggaatttatttatg

SEQ ID NO: 5355712 - DNA, 18 bp, Homo sapiens
actgggacactgtcagtg

SEQ ID NO: 5355713 - DNA, 16 bp, Homo sapiens
actgggacagcccagg

SEQ ID NO: 5355714 - DNA, 14 bp, Homo sapiens
actgggacagctgg

SEQ ID NO: 5355715 - DNA, 16 bp, Homo sapiens
actgggacagctggct

SEQ ID NO: 5355716 - DNA, 16 bp, Homo sapiens
actgggacggctcctg

SEQ ID NO: 5355717 - DNA, 22 bp, Homo sapiens
actgggactcccagcagagccc

SEQ ID NO: 5355718 - DNA, 16 bp, Homo sapiens
actgggagaagagaac

SEQ ID NO: 5355719 - DNA, 16 bp, Homo sapiens
actgggagaatcacta

SEQ ID NO: 5355720 - DNA, 19 bp, Homo sapiens
actgggagaggtgccagca

SEQ ID NO: 5355721 - DNA, 14 bp, Homo sapiens
actgggagagtcct

SEQ ID NO: 5355722 - DNA, 20 bp, Homo sapiens
actgggagccacttctcccc

SEQ ID NO: 5355723 - DNA, 22 bp, Homo sapiens
actgggagccacttctccccag

SEQ ID NO: 5355724 - DNA, 17 bp, Homo sapiens
actgggagcccccagcc

SEQ ID NO: 5355725 - DNA, 18 bp, Homo sapiens
actgggagcccccagcct

SEQ ID NO: 5355726 - DNA, 19 bp, Homo sapiens
actgggagcccccagcctg

SEQ ID NO: 5355727 - DNA, 12 bp, Homo sapiens
actgggagccta

SEQ ID NO: 5355728 - DNA, 15 bp, Homo sapiens
actgggaggaggggg

SEQ ID NO: 5355729 - DNA, 18 bp, Homo sapiens
actgggaggagggggagg

SEQ ID NO: 5355730 - DNA, 20 bp, Homo sapiens
actgggaggccgaggcaggg

SEQ ID NO: 5355731 - DNA, 18 bp, Homo sapiens
actgggagtcagagccct

SEQ ID NO: 5355732 - DNA, 21 bp, Homo sapiens
actgggagtcagagccctggc

SEQ ID NO: 5355733 - DNA, 14 bp, Homo sapiens
actgggagtgtggg

SEQ ID NO: 5355734 - DNA, 21 bp, Homo sapiens
actgggagtgtgggctgccct

SEQ ID NO: 5355735 - DNA, 18 bp, Homo sapiens
actgggataactgatttc

SEQ ID NO: 5355736 - DNA, 16 bp, Homo sapiens
actgggatgagccgct

SEQ ID NO: 5355737 - DNA, 14 bp, Homo sapiens
actgggatgcctct

SEQ ID NO: 5355738 - DNA, 18 bp, Homo sapiens
actgggatgtagagaggc

SEQ ID NO: 5355739 - DNA, 18 bp, Homo sapiens
actgggattcatggcttt

SEQ ID NO: 5355740 - DNA, 21 bp, Homo sapiens
actgggcaacactgcaggaca

SEQ ID NO: 5355741 - DNA, 13 bp, Homo sapiens
actgggcaatgat

SEQ ID NO: 5355742 - DNA, 21 bp, Homo sapiens
actgtatagtttaaagggagg

SEQ ID NO: 5355743 - DNA, 18 bp, Homo sapiens
actgtatataaacatatt

SEQ ID NO: 5355744 - DNA, 19 bp, Homo sapiens
actgtatatgtattccctt

SEQ ID NO: 5355745 - DNA, 22 bp, Homo sapiens
actgtatatgtcaaaaatattt

SEQ ID NO: 5355746 - DNA, 13 bp, Homo sapiens
actgtatattatt

SEQ ID NO: 5355747 - DNA, 14 bp, Homo sapiens
actgtatattgcta

SEQ ID NO: 5355748 - DNA, 15 bp, Homo sapiens
actgtatattgctaa

SEQ ID NO: 5355749 - DNA, 18 bp, Homo sapiens
actgtatattttaagaag

SEQ ID NO: 5355750 - DNA, 14 bp, Homo sapiens
actgtatattttgt

SEQ ID NO: 5355751 - DNA, 16 bp, Homo sapiens
actgtatcaatttcta

SEQ ID NO: 5355752 - DNA, 23 bp, Homo sapiens
actgtatcaatttctaatgttta

SEQ ID NO: 5355753 - DNA, 17 bp, Homo sapiens
actgtatcatctttgcc

SEQ ID NO: 5355754 - DNA, 18 bp, Homo sapiens
actgtatcatctttgcca

SEQ ID NO: 5355755 - DNA, 11 bp, Homo sapiens
actgtatcctt

SEQ ID NO: 5355756 - DNA, 12 bp, Homo sapiens
actgtatctaaa

SEQ ID NO: 5355757 - DNA, 19 bp, Homo sapiens
actgtatctaaaaaataac

SEQ ID NO: 5355758 - DNA, 22 bp, Homo sapiens
actgtatctaggcaacatagta

SEQ ID NO: 5355759 - DNA, 23 bp, Homo sapiens
actgtatctaggcaacatagtat

SEQ ID NO: 5355760 - DNA, 17 bp, Homo sapiens
actgtatctaggcattt

SEQ ID NO: 5355761 - DNA, 14 bp, Homo sapiens
actgtatggaaaca

SEQ ID NO: 5355762 - DNA, 21 bp, Homo sapiens
actgtatggaaacactgattt

SEQ ID NO: 5355763 - DNA, 16 bp, Homo sapiens
actgtatgtataaatt

SEQ ID NO: 5355764 - DNA, 23 bp, Homo sapiens
actgtatgtcttataagaaaaca

SEQ ID NO: 5355765 - DNA, 20 bp, Homo sapiens
actgtatgtgccaaagcttt

SEQ ID NO: 5355766 - DNA, 17 bp, Homo sapiens
actgtatgtgtgtaggt

SEQ ID NO: 5355767 - DNA, 22 bp, Homo sapiens
actgtatgtgtgtaggttatct

SEQ ID NO: 5355768 - DNA, 12 bp, Homo sapiens
actgtatgttat

SEQ ID NO: 5355769 - DNA, 16 bp, Homo sapiens
actgtatgttatagaa

SEQ ID NO: 5355770 - DNA, 20 bp, Homo sapiens
actgtatgtttttactgaat

SEQ ID NO: 5355771 - DNA, 20 bp, Homo sapiens
actgtattaaagatgcaggt

SEQ ID NO: 5355772 - DNA, 21 bp, Homo sapiens
actgtattaagagtgaaaatt

SEQ ID NO: 5355773 - DNA, 20 bp, Homo sapiens
actgtattacataaataaat

SEQ ID NO: 5355774 - DNA, 16 bp, Homo sapiens
actgtattgctcctcc

SEQ ID NO: 5355775 - DNA, 21 bp, Homo sapiens
actgtattgctcctcccactt

SEQ ID NO: 5355776 - DNA, 18 bp, Homo sapiens
actgtatttaagaaaaca

SEQ ID NO: 5355777 - DNA, 15 bp, Homo sapiens
actgtatttaaggaa

SEQ ID NO: 5355778 - DNA, 21 bp, Homo sapiens
actgtatttaaggaatcaaat

SEQ ID NO: 5355779 - DNA, 22 bp, Homo sapiens
actgtatttaaggaatcaaatc

SEQ ID NO: 5355780 - DNA, 15 bp, Homo sapiens
actgtatttcagtat

SEQ ID NO: 5355781 - DNA, 17 bp, Homo sapiens
actgtatttcagtattt

SEQ ID NO: 5355782 - DNA, 16 bp, Homo sapiens
actgtatttcattatc

SEQ ID NO: 5355783 - DNA, 22 bp, Homo sapiens
actgtatttcggctatgtctca

SEQ ID NO: 5355784 - DNA, 11 bp, Homo sapiens
actgtatttct

SEQ ID NO: 5355785 - DNA, 13 bp, Homo sapiens
actgtatttctaa

SEQ ID NO: 5355786 - DNA, 17 bp, Homo sapiens
actgtatttctgtggaa

SEQ ID NO: 5355787 - DNA, 12 bp, Homo sapiens
actgtatttgaa

SEQ ID NO: 5355788 - DNA, 11 bp, Homo sapiens
actgtatttgt

SEQ ID NO: 5355789 - DNA, 14 bp, Homo sapiens
actgtatttgtgac

SEQ ID NO: 5355790 - DNA, 22 bp, Homo sapiens
actgtatttgtgactaattgta

SEQ ID NO: 5355791 - DNA, 15 bp, Homo sapiens
actgtatttgttaat

SEQ ID NO: 5355792 - DNA, 16 bp, Homo sapiens
actgtatttgttaatt

SEQ ID NO: 5355793 - DNA, 21 bp, Homo sapiens
actgtattttgtattgtttca

SEQ ID NO: 5355794 - DNA, 13 bp, Homo sapiens
actgtatttttac

SEQ ID NO: 5355795 - DNA, 20 bp, Homo sapiens
actgtatttttacctttttc

SEQ ID NO: 5355796 - DNA, 20 bp, Homo sapiens
actgtatttttactattgaa

SEQ ID NO: 5355797 - DNA, 17 bp, Homo sapiens
actgtcaaaatatttct

SEQ ID NO: 5355798 - DNA, 16 bp, Homo sapiens
actgtcaaagaatcaa

SEQ ID NO: 5355799 - DNA, 21 bp, Homo sapiens
actgtcaaatgaacttttaca

SEQ ID NO: 5355800 - DNA, 23 bp, Homo sapiens
actgtcaaatgaacttttacaga

SEQ ID NO: 5355801 - DNA, 20 bp, Homo sapiens
actgtcaaggctgcttagaa

SEQ ID NO: 5355802 - DNA, 21 bp, Homo sapiens
actgtcaaggctgcttagaat

SEQ ID NO: 5355803 - DNA, 12 bp, Homo sapiens
actgtcaataaa

SEQ ID NO: 5355804 - DNA, 18 bp, Homo sapiens
actgtcaataaacagctt

SEQ ID NO: 5355805 - DNA, 23 bp, Homo sapiens
actgtcaatgaggttatgagaaa

SEQ ID NO: 5355806 - DNA, 20 bp, Homo sapiens
actgtcaatggactgcacct

SEQ ID NO: 5355807 - DNA, 18 bp, Homo sapiens
actgtcacactggtgctg

SEQ ID NO: 5355808 - DNA, 17 bp, Homo sapiens
actgtcaccctccacct

SEQ ID NO: 5355809 - DNA, 14 bp, Homo sapiens
actgtcaccctgag

SEQ ID NO: 5355810 - DNA, 19 bp, Homo sapiens
actgtcacggaacagatct

SEQ ID NO: 5355811 - DNA, 20 bp, Homo sapiens
actgtcacggggttccctcc

SEQ ID NO: 5355812 - DNA, 15 bp, Homo sapiens
actgtcactgtttct

SEQ ID NO: 5355813 - DNA, 16 bp, Homo sapiens
actgtcactgtttctc

SEQ ID NO: 5355814 - DNA, 21 bp, Homo sapiens
actgtcagagctgttggcctc

SEQ ID NO: 5355815 - DNA, 13 bp, Homo sapiens
actgtcagattaa

SEQ ID NO: 5355816 - DNA, 15 bp, Homo sapiens
actgtcagattaaat

SEQ ID NO: 5355817 - DNA, 22 bp, Homo sapiens
actgtcagattaaattacagct

SEQ ID NO: 5355818 - DNA, 19 bp, Homo sapiens
actgtcagcccacagcagc

SEQ ID NO: 5355819 - DNA, 14 bp, Homo sapiens
actgtcagccctca

SEQ ID NO: 5355820 - DNA, 18 bp, Homo sapiens
actgtcagccctcactgt

SEQ ID NO: 5355821 - DNA, 18 bp, Homo sapiens
actgtcagccgggccctg

SEQ ID NO: 5355822 - DNA, 14 bp, Homo sapiens
actgtcaggaatgg

SEQ ID NO: 5355823 - DNA, 14 bp, Homo sapiens
actgtcagggaggg

SEQ ID NO: 5355824 - DNA, 15 bp, Homo sapiens
actgtcagtcccact

SEQ ID NO: 5355825 - DNA, 23 bp, Homo sapiens
actgtcagtcccactgcaccccc

SEQ ID NO: 5355826 - DNA, 17 bp, Homo sapiens
actgtcagtgctagatt

SEQ ID NO: 5355827 - DNA, 16 bp, Homo sapiens
actgtcagttcatcct

SEQ ID NO: 5355828 - DNA, 21 bp, Homo sapiens
actgtcataatctctttccat

SEQ ID NO: 5355829 - DNA, 14 bp, Homo sapiens
actgtcataatggt

SEQ ID NO: 5355830 - DNA, 13 bp, Homo sapiens
actgtcatagaaa

SEQ ID NO: 5355831 - DNA, 23 bp, Homo sapiens
actgtcatagggattgtccctgt

SEQ ID NO: 5355832 - DNA, 21 bp, Homo sapiens
actgtcatcctcaaagaaagt

SEQ ID NO: 5355833 - DNA, 12 bp, Homo sapiens
actgtcatctgc

SEQ ID NO: 5355834 - DNA, 13 bp, Homo sapiens
actgtcatctgcc

SEQ ID NO: 5355835 - DNA, 15 bp, Homo sapiens
actgtcatctgtagg

SEQ ID NO: 5355836 - DNA, 14 bp, Homo sapiens
actgtcatgtggct

SEQ ID NO: 5355837 - DNA, 12 bp, Homo sapiens
actgtcattccc

SEQ ID NO: 5355838 - DNA, 22 bp, Homo sapiens
actgtccacttctagctcggaa

SEQ ID NO: 5355839 - DNA, 13 bp, Homo sapiens
actgtccagagag

SEQ ID NO: 5355840 - DNA, 12 bp, Homo sapiens
actgtccagggc

SEQ ID NO: 5355841 - DNA, 14 bp, Homo sapiens
actgtccagggccc

SEQ ID NO: 5355842 - DNA, 22 bp, Homo sapiens
actgtccaggtaggaaacaatt

SEQ ID NO: 5355843 - DNA, 21 bp, Homo sapiens
actgtcccagctaccaagtca

SEQ ID NO: 5355844 - DNA, 23 bp, Homo sapiens
actgtcccggagctcaggccctg

SEQ ID NO: 5355845 - DNA, 22 bp, Homo sapiens
actgtccctaccactgagccct

SEQ ID NO: 5355846 - DNA, 13 bp, Homo sapiens
actgtccctcaaa

SEQ ID NO: 5355847 - DNA, 20 bp, Homo sapiens
actgtccctcaaatgaccca

SEQ ID NO: 5355848 - DNA, 12 bp, Homo sapiens
actgtccctcct

SEQ ID NO: 5355849 - DNA, 15 bp, Homo sapiens
actgtccctcctggt

SEQ ID NO: 5355850 - DNA, 15 bp, Homo sapiens
actgtccctctcagt

SEQ ID NO: 5355851 - DNA, 21 bp, Homo sapiens
actgtccctctcagtgccttc

SEQ ID NO: 5355852 - DNA, 22 bp, Homo sapiens
actgtccctctcagtgccttct

SEQ ID NO: 5355853 - DNA, 12 bp, Homo sapiens
actgtccctctt

SEQ ID NO: 5355854 - DNA, 14 bp, Homo sapiens
actgtccctgcttt

SEQ ID NO: 5355855 - DNA, 20 bp, Homo sapiens
actgtccctgctttctggta

SEQ ID NO: 5355856 - DNA, 16 bp, Homo sapiens
actgtccctgtccttc

SEQ ID NO: 5355857 - DNA, 20 bp, Homo sapiens
actgtccctgtccttctaca

SEQ ID NO: 5355858 - DNA, 16 bp, Homo sapiens
actgtcccttgcctca

SEQ ID NO: 5355859 - DNA, 15 bp, Homo sapiens
actgtccgctgtctc

SEQ ID NO: 5355860 - DNA, 19 bp, Homo sapiens
actgtccgctgtctccctc

SEQ ID NO: 5355861 - DNA, 23 bp, Homo sapiens
actgtcctacccaccctcctttc

SEQ ID NO: 5355862 - DNA, 14 bp, Homo sapiens
actgtcctagccag

SEQ ID NO: 5355863 - DNA, 12 bp, Homo sapiens
actgtcctccca

SEQ ID NO: 5355864 - DNA, 15 bp, Homo sapiens
actgtcctcccacag

SEQ ID NO: 5355865 - DNA, 16 bp, Homo sapiens
actgtcctcccacaga

SEQ ID NO: 5355866 - DNA, 18 bp, Homo sapiens
actgtcctccttggcggc

SEQ ID NO: 5355867 - DNA, 18 bp, Homo sapiens
actgtcctctcccctcca

SEQ ID NO: 5355868 - DNA, 16 bp, Homo sapiens
actgtcctgggcctgc

SEQ ID NO: 5355869 - DNA, 19 bp, Homo sapiens
actgtcctgggcctgcaga

SEQ ID NO: 5355870 - DNA, 13 bp, Homo sapiens
actgtcctgggcg

SEQ ID NO: 5355871 - DNA, 12 bp, Homo sapiens
actgtcctgtcc

SEQ ID NO: 5355872 - DNA, 17 bp, Homo sapiens
actgtcctgtcctgctc

SEQ ID NO: 5355873 - DNA, 17 bp, Homo sapiens
actgtccttccctgcca

SEQ ID NO: 5355874 - DNA, 18 bp, Homo sapiens
actgtccttccctgccac

SEQ ID NO: 5355875 - DNA, 17 bp, Homo sapiens
actgtcctttctccagg

SEQ ID NO: 5355876 - DNA, 18 bp, Homo sapiens
actgtcctttctccaggc

SEQ ID NO: 5355877 - DNA, 21 bp, Homo sapiens
actgtcgccacacgcctctgt

SEQ ID NO: 5355878 - DNA, 14 bp, Homo sapiens
actgtcgctgcttc

SEQ ID NO: 5355879 - DNA, 17 bp, Homo sapiens
actgtcgctgcttcgtg

SEQ ID NO: 5355880 - DNA, 17 bp, Homo sapiens
actgtcggagaggctgt

SEQ ID NO: 5355881 - DNA, 20 bp, Homo sapiens
actgtcggagaggctgtctg

SEQ ID NO: 5355882 - DNA, 21 bp, Homo sapiens
actgtcggagaggctgtctgg

SEQ ID NO: 5355883 - DNA, 17 bp, Homo sapiens
actgtcggaggaaagac

SEQ ID NO: 5355884 - DNA, 16 bp, Homo sapiens
actgtcgtgtttacaa

SEQ ID NO: 5355885 - DNA, 22 bp, Homo sapiens
actgtctaagcagttttgtaaa

SEQ ID NO: 5355886 - DNA, 18 bp, Homo sapiens
actgtctacgttaagata

SEQ ID NO: 5355887 - DNA, 18 bp, Homo sapiens
actgtctagcacttcctt

SEQ ID NO: 5355888 - DNA, 16 bp, Homo sapiens
actgtctagccactcc

SEQ ID NO: 5355889 - DNA, 20 bp, Homo sapiens
actgtctagccactccctcc

SEQ ID NO: 5355890 - DNA, 17 bp, Homo sapiens
actgtctaggaaaataa

SEQ ID NO: 5355891 - DNA, 14 bp, Homo sapiens
actgtctatatata

SEQ ID NO: 5355892 - DNA, 13 bp, Homo sapiens
actgtctatggat

SEQ ID NO: 5355893 - DNA, 17 bp, Homo sapiens
actgtctattaaaattc

SEQ ID NO: 5355894 - DNA, 19 bp, Homo sapiens
actgtctcaaaaaaacaaa

SEQ ID NO: 5355895 - DNA, 19 bp, Homo sapiens
actgtctcaagagggcact

SEQ ID NO: 5355896 - DNA, 23 bp, Homo sapiens
actgtctcaagagggcactggtg

SEQ ID NO: 5355897 - DNA, 22 bp, Homo sapiens
actgtctccatggccctgcaaa

SEQ ID NO: 5355898 - DNA, 21 bp, Homo sapiens
actgtctcctccctgggctaa

SEQ ID NO: 5355899 - DNA, 14 bp, Homo sapiens
actgtctccttccc

SEQ ID NO: 5355900 - DNA, 20 bp, Homo sapiens
actgtctccttcccactgtc

SEQ ID NO: 5355901 - DNA, 17 bp, Homo sapiens
actgtctcggcagaggt

SEQ ID NO: 5355902 - DNA, 15 bp, Homo sapiens
actgtctctcatgaa

SEQ ID NO: 5355903 - DNA, 15 bp, Homo sapiens
actgtctctcctgat

SEQ ID NO: 5355904 - DNA, 12 bp, Homo sapiens
actgtctctgga

SEQ ID NO: 5355905 - DNA, 18 bp, Homo sapiens
actgtctgactacaacat

SEQ ID NO: 5355906 - DNA, 20 bp, Homo sapiens
actgtctggggagcgggtct

SEQ ID NO: 5355907 - DNA, 22 bp, Homo sapiens
actgtctggggagcgggtctgc

SEQ ID NO: 5355908 - DNA, 16 bp, Homo sapiens
actgtctggggcccca

SEQ ID NO: 5355909 - DNA, 19 bp, Homo sapiens
actgtctggttttaacaat

SEQ ID NO: 5355910 - DNA, 16 bp, Homo sapiens
actgtctgtacctaaa

SEQ ID NO: 5355911 - DNA, 15 bp, Homo sapiens
actgtctgtagtgtt

SEQ ID NO: 5355912 - DNA, 19 bp, Homo sapiens
actgtctgtagtgttttgt

SEQ ID NO: 5355913 - DNA, 14 bp, Homo sapiens
actgtctgtccctg

SEQ ID NO: 5355914 - DNA, 17 bp, Homo sapiens
actgtctgtctccatcg

SEQ ID NO: 5355915 - DNA, 12 bp, Homo sapiens
actgtctgtctg

SEQ ID NO: 5355916 - DNA, 16 bp, Homo sapiens
actgtctgttctgcac

SEQ ID NO: 5355917 - DNA, 20 bp, Homo sapiens
actgtctgttgcttcagtaa

SEQ ID NO: 5355918 - DNA, 19 bp, Homo sapiens
actgtcttaaatcagttta

SEQ ID NO: 5355919 - DNA, 14 bp, Homo sapiens
actgtcttaattaa

SEQ ID NO: 5355920 - DNA, 15 bp, Homo sapiens
acttaatgtatgtta

SEQ ID NO: 5355921 - DNA, 17 bp, Homo sapiens
acttaatgtttcttaga

SEQ ID NO: 5355922 - DNA, 23 bp, Homo sapiens
acttaattctcattatgaagatg

SEQ ID NO: 5355923 - DNA, 17 bp, Homo sapiens
acttaatttacttaagt

SEQ ID NO: 5355924 - DNA, 15 bp, Homo sapiens
acttaatttgtaaac

SEQ ID NO: 5355925 - DNA, 21 bp, Homo sapiens
acttaatttgtaaacttctga

SEQ ID NO: 5355926 - DNA, 11 bp, Homo sapiens
acttaatttta

SEQ ID NO: 5355927 - DNA, 14 bp, Homo sapiens
acttacaaaaatgg

SEQ ID NO: 5355928 - DNA, 14 bp, Homo sapiens
acttacaaaagcag

SEQ ID NO: 5355929 - DNA, 20 bp, Homo sapiens
acttacaaaagcagctttta

SEQ ID NO: 5355930 - DNA, 12 bp, Homo sapiens
acttacaagaaa

SEQ ID NO: 5355931 - DNA, 18 bp, Homo sapiens
acttacaagactgtaaat

SEQ ID NO: 5355932 - DNA, 22 bp, Homo sapiens
acttacacacctgagaatgtgc

SEQ ID NO: 5355933 - DNA, 24 bp, Homo sapiens
acttacaccagtttgactgtgcta

SEQ ID NO: 5355934 - DNA, 13 bp, Homo sapiens
acttacactgaaa

SEQ ID NO: 5355935 - DNA, 14 bp, Homo sapiens
acttacacttataa

SEQ ID NO: 5355936 - DNA, 17 bp, Homo sapiens
acttacactttatgcac

SEQ ID NO: 5355937 - DNA, 17 bp, Homo sapiens
acttacagcaaatcctt

SEQ ID NO: 5355938 - DNA, 16 bp, Homo sapiens
acttacatatctgact

SEQ ID NO: 5355939 - DNA, 15 bp, Homo sapiens
acttacatcatgtgt

SEQ ID NO: 5355940 - DNA, 18 bp, Homo sapiens
acttacatcttctgtgaa

SEQ ID NO: 5355941 - DNA, 14 bp, Homo sapiens
acttacatttacaa

SEQ ID NO: 5355942 - DNA, 18 bp, Homo sapiens
acttaccaggcaccaaaa

SEQ ID NO: 5355943 - DNA, 14 bp, Homo sapiens
acttaccatttgct

SEQ ID NO: 5355944 - DNA, 20 bp, Homo sapiens
acttacccagatgttgcttt

SEQ ID NO: 5355945 - DNA, 23 bp, Homo sapiens
acttacccaggtgggtcccggct

SEQ ID NO: 5355946 - DNA, 20 bp, Homo sapiens
acttaccccgagacctcact

SEQ ID NO: 5355947 - DNA, 20 bp, Homo sapiens
acttacccttctacaaaaga

SEQ ID NO: 5355948 - DNA, 17 bp, Homo sapiens
acttacctcaaattaag

SEQ ID NO: 5355949 - DNA, 20 bp, Homo sapiens
acttacctgagttgaagagg

SEQ ID NO: 5355950 - DNA, 17 bp, Homo sapiens
acttacctgcttgagct

SEQ ID NO: 5355951 - DNA, 13 bp, Homo sapiens
acttacctggcag

SEQ ID NO: 5355952 - DNA, 22 bp, Homo sapiens
acttacgccctgttcccttcct

SEQ ID NO: 5355953 - DNA, 22 bp, Homo sapiens
acttacggtgcacagtaatatg

SEQ ID NO: 5355954 - DNA, 22 bp, Homo sapiens
acttacggttttaaatgtgttg

SEQ ID NO: 5355955 - DNA, 15 bp, Homo sapiens
acttacgtaaaacat

SEQ ID NO: 5355956 - DNA, 17 bp, Homo sapiens
acttacgtaaaacattt

SEQ ID NO: 5355957 - DNA, 17 bp, Homo sapiens
acttactaaaatatata

SEQ ID NO: 5355958 - DNA, 22 bp, Homo sapiens
acttactaaaatatatatagaa

SEQ ID NO: 5355959 - DNA, 16 bp, Homo sapiens
acttactataatggtt

SEQ ID NO: 5355960 - DNA, 22 bp, Homo sapiens
acttactataatggttggaact

SEQ ID NO: 5355961 - DNA, 16 bp, Homo sapiens
acttactcccattttc

SEQ ID NO: 5355962 - DNA, 13 bp, Homo sapiens
acttactctaaga

SEQ ID NO: 5355963 - DNA, 15 bp, Homo sapiens
acttactcttacacc

SEQ ID NO: 5355964 - DNA, 13 bp, Homo sapiens
acttactgcattg

SEQ ID NO: 5355965 - DNA, 20 bp, Homo sapiens
acttactgcctgaccttgga

SEQ ID NO: 5355966 - DNA, 18 bp, Homo sapiens
acttactgcgactaaact

SEQ ID NO: 5355967 - DNA, 17 bp, Homo sapiens
acttactgtaagacatt

SEQ ID NO: 5355968 - DNA, 16 bp, Homo sapiens
acttactgtacatgaa

SEQ ID NO: 5355969 - DNA, 15 bp, Homo sapiens
acttactgtatatgt

SEQ ID NO: 5355970 - DNA, 16 bp, Homo sapiens
acttactgtatatgta

SEQ ID NO: 5355971 - DNA, 21 bp, Homo sapiens
acttactgtccaccagtttat

SEQ ID NO: 5355972 - DNA, 22 bp, Homo sapiens
acttacttaccctcacctgtca

SEQ ID NO: 5355973 - DNA, 22 bp, Homo sapiens
acttacttagagatgctactgt

SEQ ID NO: 5355974 - DNA, 18 bp, Homo sapiens
acttacttgatgattttt

SEQ ID NO: 5355975 - DNA, 15 bp, Homo sapiens
acttacttgcttatt

SEQ ID NO: 5355976 - DNA, 15 bp, Homo sapiens
acttactttaatgcg

SEQ ID NO: 5355977 - DNA, 13 bp, Homo sapiens
acttactttttct

SEQ ID NO: 5355978 - DNA, 21 bp, Homo sapiens
acttactttttctggtctcta

SEQ ID NO: 5355979 - DNA, 23 bp, Homo sapiens
acttagaaaagtggtgtaaactt

SEQ ID NO: 5355980 - DNA, 16 bp, Homo sapiens
acttagaaaccaaatt

SEQ ID NO: 5355981 - DNA, 12 bp, Homo sapiens
acttagaaactg

SEQ ID NO: 5355982 - DNA, 19 bp, Homo sapiens
acttagaaagcaggggcta

SEQ ID NO: 5355983 - DNA, 18 bp, Homo sapiens
acttagaaagtaagagct

SEQ ID NO: 5355984 - DNA, 18 bp, Homo sapiens
acttagaacctttctgtg

SEQ ID NO: 5355985 - DNA, 19 bp, Homo sapiens
acttagaagtagtatgtta

SEQ ID NO: 5355986 - DNA, 16 bp, Homo sapiens
acttagaataaaattg

SEQ ID NO: 5355987 - DNA, 18 bp, Homo sapiens
acttagaataaaattgta

SEQ ID NO: 5355988 - DNA, 21 bp, Homo sapiens
acttagaatgccataaaattg

SEQ ID NO: 5355989 - DNA, 19 bp, Homo sapiens
acttagacctatactgaaa

SEQ ID NO: 5355990 - DNA, 14 bp, Homo sapiens
acttagacctgcca

SEQ ID NO: 5355991 - DNA, 22 bp, Homo sapiens
acttagagctttttttttttaa

SEQ ID NO: 5355992 - DNA, 13 bp, Homo sapiens
acttagaggaaat

SEQ ID NO: 5355993 - DNA, 19 bp, Homo sapiens
acttagaggcaacaggatt

SEQ ID NO: 5355994 - DNA, 17 bp, Homo sapiens
acttagagtttctgttt

SEQ ID NO: 5355995 - DNA, 20 bp, Homo sapiens
acttagagtttctgtttgat

SEQ ID NO: 5355996 - DNA, 20 bp, Homo sapiens
acttagatattaaaatttgg

SEQ ID NO: 5355997 - DNA, 17 bp, Homo sapiens
acttagatatttcatgt

SEQ ID NO: 5355998 - DNA, 21 bp, Homo sapiens
acttagatctgagccctccct

SEQ ID NO: 5355999 - DNA, 18 bp, Homo sapiens
acttagatgttaaatgtt

SEQ ID NO: 5356000 - DNA, 16 bp, Homo sapiens
acttagattgtgttcc

SEQ ID NO: 5356001 - DNA, 21 bp, Homo sapiens
acttagattttacatgaagta

SEQ ID NO: 5356002 - DNA, 24 bp, Homo sapiens
acttagattttacatgaagtattt

SEQ ID NO: 5356003 - DNA, 17 bp, Homo sapiens
acttagcaaaaagtggg

SEQ ID NO: 5356004 - DNA, 22 bp, Homo sapiens
acttagcacttcagggcagatt

SEQ ID NO: 5356005 - DNA, 23 bp, Homo sapiens
acttagcagcaactgaagacaat

SEQ ID NO: 5356006 - DNA, 19 bp, Homo sapiens
acttagcatcctaagaaat

SEQ ID NO: 5356007 - DNA, 23 bp, Homo sapiens
acttagcatgcacaaagtgtatt

SEQ ID NO: 5356008 - DNA, 22 bp, Homo sapiens
acttagccagttcaaagtgtat

SEQ ID NO: 5356009 - DNA, 14 bp, Homo sapiens
acttagccatgatg

SEQ ID NO: 5356010 - DNA, 16 bp, Homo sapiens
acttagccattgaaat

SEQ ID NO: 5356011 - DNA, 22 bp, Homo sapiens
acttagccatttttcaaagcaa

SEQ ID NO: 5356012 - DNA, 13 bp, Homo sapiens
acttagcccaaga

SEQ ID NO: 5356013 - DNA, 22 bp, Homo sapiens
acttagcccaagaggtctgagc

SEQ ID NO: 5356014 - DNA, 23 bp, Homo sapiens
acttagccgcaccctgcacctgc

SEQ ID NO: 5356015 - DNA, 12 bp, Homo sapiens
acttagcctgag

SEQ ID NO: 5356016 - DNA, 15 bp, Homo sapiens
acttagcctgagtca

SEQ ID NO: 5356017 - DNA, 17 bp, Homo sapiens
acttagcgtcaagacat

SEQ ID NO: 5356018 - DNA, 16 bp, Homo sapiens
acttagctagttttat

SEQ ID NO: 5356019 - DNA, 11 bp, Homo sapiens
acttagctcag

SEQ ID NO: 5356020 - DNA, 15 bp, Homo sapiens
acttagctcaggtgc

SEQ ID NO: 5356021 - DNA, 17 bp, Homo sapiens
acttagctggccaagga

SEQ ID NO: 5356022 - DNA, 16 bp, Homo sapiens
acttagctgtactata

SEQ ID NO: 5356023 - DNA, 17 bp, Homo sapiens
acttagcttatcaattt

SEQ ID NO: 5356024 - DNA, 21 bp, Homo sapiens
acttagcttgaaggatctgtt

SEQ ID NO: 5356025 - DNA, 13 bp, Homo sapiens
acttagctttatt

SEQ ID NO: 5356026 - DNA, 21 bp, Homo sapiens
acttagcttttgatgtctcca

SEQ ID NO: 5356027 - DNA, 14 bp, Homo sapiens
acttaggaagaaat

SEQ ID NO: 5356028 - DNA, 17 bp, Homo sapiens
acttaggagaagtcttc

SEQ ID NO: 5356029 - DNA, 16 bp, Homo sapiens
acttaggcattaacat

SEQ ID NO: 5356030 - DNA, 20 bp, Homo sapiens
acttaggcattaacatgttt

SEQ ID NO: 5356031 - DNA, 14 bp, Homo sapiens
acttaggctttgta

SEQ ID NO: 5356032 - DNA, 15 bp, Homo sapiens
acttagggagtgtgc

SEQ ID NO: 5356033 - DNA, 16 bp, Homo sapiens
acttagggagtgtgcc

SEQ ID NO: 5356034 - DNA, 23 bp, Homo sapiens
acttagggcaccaggggtttctc

SEQ ID NO: 5356035 - DNA, 18 bp, Homo sapiens
acttaggttattttgctt

SEQ ID NO: 5356036 - DNA, 16 bp, Homo sapiens
acttaggttttgtcca

SEQ ID NO: 5356037 - DNA, 20 bp, Homo sapiens
acttagtaggtcctcaataa

SEQ ID NO: 5356038 - DNA, 17 bp, Homo sapiens
acttagtatattttctt

SEQ ID NO: 5356039 - DNA, 12 bp, Homo sapiens
acttagtatttt

SEQ ID NO: 5356040 - DNA, 17 bp, Homo sapiens
acttagtcaataagaaa

SEQ ID NO: 5356041 - DNA, 19 bp, Homo sapiens
acttagtggtatgtctctt

SEQ ID NO: 5356042 - DNA, 22 bp, Homo sapiens
acttagtgtttagcattaaaaa

SEQ ID NO: 5356043 - DNA, 19 bp, Homo sapiens
acttagttaaaattgattt

SEQ ID NO: 5356044 - DNA, 21 bp, Homo sapiens
acttagttaaaattgatttct

SEQ ID NO: 5356045 - DNA, 15 bp, Homo sapiens
acttagtttgtgaat

SEQ ID NO: 5356046 - DNA, 13 bp, Homo sapiens
acttagttttgca

SEQ ID NO: 5356047 - DNA, 23 bp, Homo sapiens
acttagtttttaaaatttatttg

SEQ ID NO: 5356048 - DNA, 23 bp, Homo sapiens
acttagtttttatctttgaccaa

SEQ ID NO: 5356049 - DNA, 18 bp, Homo sapiens
acttataaagtagaaatg

SEQ ID NO: 5356050 - DNA, 22 bp, Homo sapiens
acttataaggtgttttctgtgt

SEQ ID NO: 5356051 - DNA, 23 bp, Homo sapiens
acttataatttccaaactgttgt

SEQ ID NO: 5356052 - DNA, 17 bp, Homo sapiens
acttataattttcctaa

SEQ ID NO: 5356053 - DNA, 15 bp, Homo sapiens
acttataccaaaggg

SEQ ID NO: 5356054 - DNA, 15 bp, Homo sapiens
acttatactgtaggt

SEQ ID NO: 5356055 - DNA, 14 bp, Homo sapiens
acttatagtacatg

SEQ ID NO: 5356056 - DNA, 19 bp, Homo sapiens
acttatagttaatattttg

SEQ ID NO: 5356057 - DNA, 17 bp, Homo sapiens
acttatatatttgaaag

SEQ ID NO: 5356058 - DNA, 15 bp, Homo sapiens
acttatatatttgat

SEQ ID NO: 5356059 - DNA, 18 bp, Homo sapiens
acttatatgctgaattga

SEQ ID NO: 5356060 - DNA, 22 bp, Homo sapiens
acttatattaatagtaatttgt

SEQ ID NO: 5356061 - DNA, 22 bp, Homo sapiens
acttatattctgcagaaaatta

SEQ ID NO: 5356062 - DNA, 13 bp, Homo sapiens
acttatattgaag

SEQ ID NO: 5356063 - DNA, 17 bp, Homo sapiens
acttatattgtaagaaa

SEQ ID NO: 5356064 - DNA, 18 bp, Homo sapiens
acttatattgtaagaaat

SEQ ID NO: 5356065 - DNA, 23 bp, Homo sapiens
acttatattttcgtatgaaaatg

SEQ ID NO: 5356066 - DNA, 19 bp, Homo sapiens
acttatatttttaataaaa

SEQ ID NO: 5356067 - DNA, 20 bp, Homo sapiens
acttatcaaaaatgcaaatt

SEQ ID NO: 5356068 - DNA, 14 bp, Homo sapiens
acttatcaaatcat

SEQ ID NO: 5356069 - DNA, 17 bp, Homo sapiens
acttatcaaatcattca

SEQ ID NO: 5356070 - DNA, 20 bp, Homo sapiens
acttatcaaatcattcaaaa

SEQ ID NO: 5356071 - DNA, 13 bp, Homo sapiens
acttatcacattt

SEQ ID NO: 5356072 - DNA, 16 bp, Homo sapiens
acttatcatttttgta

SEQ ID NO: 5356073 - DNA, 20 bp, Homo sapiens
acttatcatttttgtataaa

SEQ ID NO: 5356074 - DNA, 15 bp, Homo sapiens
acttatccctctcca

SEQ ID NO: 5356075 - DNA, 18 bp, Homo sapiens
acttatcctaaaacaaat

SEQ ID NO: 5356076 - DNA, 19 bp, Homo sapiens
acttatcctaaaacaaata

SEQ ID NO: 5356077 - DNA, 18 bp, Homo sapiens
acttatctcactgtttta

SEQ ID NO: 5356078 - DNA, 23 bp, Homo sapiens
acttatctcgaatttgaagagat

SEQ ID NO: 5356079 - DNA, 19 bp, Homo sapiens
acttatctctcaaaacaat

SEQ ID NO: 5356080 - DNA, 20 bp, Homo sapiens
acttatctctcaaaacaata

SEQ ID NO: 5356081 - DNA, 16 bp, Homo sapiens
acttatctgatcagaa

SEQ ID NO: 5356082 - DNA, 20 bp, Homo sapiens
acttatcttacaaagtgtat

SEQ ID NO: 5356083 - DNA, 14 bp, Homo sapiens
acttatcttatgcc

SEQ ID NO: 5356084 - DNA, 14 bp, Homo sapiens
acttatcttctgga

SEQ ID NO: 5356085 - DNA, 15 bp, Homo sapiens
acttatgaaacttga

SEQ ID NO: 5356086 - DNA, 20 bp, Homo sapiens
acttatgaatgatttgcata

SEQ ID NO: 5356087 - DNA, 13 bp, Homo sapiens
acttatgaatgtt

SEQ ID NO: 5356088 - DNA, 23 bp, Homo sapiens
acttatgacctcttcctttagga

SEQ ID NO: 5356089 - DNA, 21 bp, Homo sapiens
acttatgcaagatatttttga

SEQ ID NO: 5356090 - DNA, 17 bp, Homo sapiens
acttatgcatagatata

SEQ ID NO: 5356091 - DNA, 17 bp, Homo sapiens
acttatgctgctgtgaa

SEQ ID NO: 5356092 - DNA, 19 bp, Homo sapiens
acttatgctgctgtgaatt

SEQ ID NO: 5356093 - DNA, 17 bp, Homo sapiens
acttatggactgttttg

SEQ ID NO: 5356094 - DNA, 20 bp, Homo sapiens
acttatggtaatcagttttg

SEQ ID NO: 5356095 - DNA, 13 bp, Homo sapiens
acttatgtacttg

SEQ ID NO: 5356096 - DNA, 18 bp, Homo sapiens
acttcctgcctcagtctg

SEQ ID NO: 5356097 - DNA, 14 bp, Homo sapiens
acttcctgcctggt

SEQ ID NO: 5356098 - DNA, 18 bp, Homo sapiens
acttcctgcctggtctcc

SEQ ID NO: 5356099 - DNA, 21 bp, Homo sapiens
acttcctgcctggtctcctgc

SEQ ID NO: 5356100 - DNA, 16 bp, Homo sapiens
acttcctgctgcaccc

SEQ ID NO: 5356101 - DNA, 19 bp, Homo sapiens
acttcctgctgcaccctgc

SEQ ID NO: 5356102 - DNA, 22 bp, Homo sapiens
acttcctgctgcaccctgcgcc

SEQ ID NO: 5356103 - DNA, 16 bp, Homo sapiens
acttcctgcttcctca

SEQ ID NO: 5356104 - DNA, 9 bp, Homo sapiens
acttcctgg

SEQ ID NO: 5356105 - DNA, 22 bp, Homo sapiens
acttcctggattttctttctat

SEQ ID NO: 5356106 - DNA, 23 bp, Homo sapiens
acttcctggattttctttctatg

SEQ ID NO: 5356107 - DNA, 13 bp, Homo sapiens
acttcctggcctc

SEQ ID NO: 5356108 - DNA, 14 bp, Homo sapiens
acttcctggcctct

SEQ ID NO: 5356109 - DNA, 11 bp, Homo sapiens
acttcctggga

SEQ ID NO: 5356110 - DNA, 23 bp, Homo sapiens
acttcctggggatgtcatagcca

SEQ ID NO: 5356111 - DNA, 23 bp, Homo sapiens
acttcctggtgaggcccagcctg

SEQ ID NO: 5356112 - DNA, 14 bp, Homo sapiens
acttcctgtccaga

SEQ ID NO: 5356113 - DNA, 15 bp, Homo sapiens
acttcctgtccttgt

SEQ ID NO: 5356114 - DNA, 21 bp, Homo sapiens
acttcctgtgcctttcctatc

SEQ ID NO: 5356115 - DNA, 16 bp, Homo sapiens
acttcctgtggcctga

SEQ ID NO: 5356116 - DNA, 17 bp, Homo sapiens
acttcctgtggcctgaa

SEQ ID NO: 5356117 - DNA, 21 bp, Homo sapiens
acttcctgtttgggcccctct

SEQ ID NO: 5356118 - DNA, 12 bp, Homo sapiens
acttccttaaca

SEQ ID NO: 5356119 - DNA, 14 bp, Homo sapiens
acttccttaacagc

SEQ ID NO: 5356120 - DNA, 21 bp, Homo sapiens
acttccttataaaaattctag

SEQ ID NO: 5356121 - DNA, 16 bp, Homo sapiens
acttccttatttctga

SEQ ID NO: 5356122 - DNA, 21 bp, Homo sapiens
acttccttcagcatctcactt

SEQ ID NO: 5356123 - DNA, 15 bp, Homo sapiens
acttccttgcccctg

SEQ ID NO: 5356124 - DNA, 23 bp, Homo sapiens
acttcctttcctactgtcctgga

SEQ ID NO: 5356125 - DNA, 22 bp, Homo sapiens
acttcctttgcccttcctcctg

SEQ ID NO: 5356126 - DNA, 18 bp, Homo sapiens
acttcctttgtgtttata

SEQ ID NO: 5356127 - DNA, 15 bp, Homo sapiens
acttcgaatatatct

SEQ ID NO: 5356128 - DNA, 19 bp, Homo sapiens
acttcgaattagtttgcac

SEQ ID NO: 5356129 - DNA, 22 bp, Homo sapiens
acttcgaattagtttgcacttc

SEQ ID NO: 5356130 - DNA, 14 bp, Homo sapiens
acttcgactgtgac

SEQ ID NO: 5356131 - DNA, 19 bp, Homo sapiens
acttcgcagccccgggcgg

SEQ ID NO: 5356132 - DNA, 20 bp, Homo sapiens
acttcgcatcaaaagacaat

SEQ ID NO: 5356133 - DNA, 22 bp, Homo sapiens
acttcgcatcaaaagacaattc

SEQ ID NO: 5356134 - DNA, 24 bp, Homo sapiens
acttcgcatcaaaagacaattctt

SEQ ID NO: 5356135 - DNA, 16 bp, Homo sapiens
acttcgctagaaaaaa

SEQ ID NO: 5356136 - DNA, 18 bp, Homo sapiens
acttcgctattcccaggc

SEQ ID NO: 5356137 - DNA, 20 bp, Homo sapiens
acttcgctattcccaggcag

SEQ ID NO: 5356138 - DNA, 22 bp, Homo sapiens
acttcgctattcccaggcaggg

SEQ ID NO: 5356139 - DNA, 21 bp, Homo sapiens
acttcgctgtcccccaacact

SEQ ID NO: 5356140 - DNA, 20 bp, Homo sapiens
acttcggataattttcattt

SEQ ID NO: 5356141 - DNA, 21 bp, Homo sapiens
acttcggataattttcatttt

SEQ ID NO: 5356142 - DNA, 21 bp, Homo sapiens
acttcggatttattccctttt

SEQ ID NO: 5356143 - DNA, 19 bp, Homo sapiens
acttcgggaaggtgtctgg

SEQ ID NO: 5356144 - DNA, 15 bp, Homo sapiens
acttcgtaagaacat

SEQ ID NO: 5356145 - DNA, 19 bp, Homo sapiens
acttcgtaagaacatgtta

SEQ ID NO: 5356146 - DNA, 22 bp, Homo sapiens
acttcgtgggatctgcccctcc

SEQ ID NO: 5356147 - DNA, 23 bp, Homo sapiens
acttcgtgggatctgcccctccc

SEQ ID NO: 5356148 - DNA, 17 bp, Homo sapiens
acttcgtttaatgaatg

SEQ ID NO: 5356149 - DNA, 20 bp, Homo sapiens
acttcgttttggttaagttg

SEQ ID NO: 5356150 - DNA, 14 bp, Homo sapiens
acttctaaaactgt

SEQ ID NO: 5356151 - DNA, 15 bp, Homo sapiens
acttctaaaataaat

SEQ ID NO: 5356152 - DNA, 22 bp, Homo sapiens
acttctaaacacttcattcttt

SEQ ID NO: 5356153 - DNA, 19 bp, Homo sapiens
acttctaaatcagaaatag

SEQ ID NO: 5356154 - DNA, 16 bp, Homo sapiens
acttctaaatgaagtg

SEQ ID NO: 5356155 - DNA, 21 bp, Homo sapiens
acttctaactccactggctcc

SEQ ID NO: 5356156 - DNA, 19 bp, Homo sapiens
acttctaagactttactta

SEQ ID NO: 5356157 - DNA, 13 bp, Homo sapiens
acttctaagtaaa

SEQ ID NO: 5356158 - DNA, 23 bp, Homo sapiens
acttctaagtaaaaccacagcag

SEQ ID NO: 5356159 - DNA, 19 bp, Homo sapiens
acttctaagttgagtatat

SEQ ID NO: 5356160 - DNA, 23 bp, Homo sapiens
acttctaagttgagtatattata

SEQ ID NO: 5356161 - DNA, 15 bp, Homo sapiens
acttctaatatattt

SEQ ID NO: 5356162 - DNA, 13 bp, Homo sapiens
acttctaatctta

SEQ ID NO: 5356163 - DNA, 14 bp, Homo sapiens
acttctaattgcca

SEQ ID NO: 5356164 - DNA, 13 bp, Homo sapiens
acttctaatttat

SEQ ID NO: 5356165 - DNA, 18 bp, Homo sapiens
acttctacccagatggaa

SEQ ID NO: 5356166 - DNA, 22 bp, Homo sapiens
acttctacccagatggaaaaat

SEQ ID NO: 5356167 - DNA, 22 bp, Homo sapiens
acttctacctacatatttgtat

SEQ ID NO: 5356168 - DNA, 21 bp, Homo sapiens
acttctagagggagaagactg

SEQ ID NO: 5356169 - DNA, 18 bp, Homo sapiens
acttctagatctcagcca

SEQ ID NO: 5356170 - DNA, 13 bp, Homo sapiens
acttctagcagaa

SEQ ID NO: 5356171 - DNA, 12 bp, Homo sapiens
acttctagctca

SEQ ID NO: 5356172 - DNA, 14 bp, Homo sapiens
acttctagctgtct

SEQ ID NO: 5356173 - DNA, 15 bp, Homo sapiens
acttctagctgtctg

SEQ ID NO: 5356174 - DNA, 13 bp, Homo sapiens
acttctataaagt

SEQ ID NO: 5356175 - DNA, 16 bp, Homo sapiens
acttctatatatacaa

SEQ ID NO: 5356176 - DNA, 17 bp, Homo sapiens
acttctatattttaata

SEQ ID NO: 5356177 - DNA, 19 bp, Homo sapiens
acttctatattttaataga

SEQ ID NO: 5356178 - DNA, 21 bp, Homo sapiens
acttctatattttaatagaaa

SEQ ID NO: 5356179 - DNA, 23 bp, Homo sapiens
acttctatcatttttgagcaact

SEQ ID NO: 5356180 - DNA, 13 bp, Homo sapiens
acttctatcctgt

SEQ ID NO: 5356181 - DNA, 20 bp, Homo sapiens
acttctatgttggtttcagt

SEQ ID NO: 5356182 - DNA, 17 bp, Homo sapiens
acttctatttaatgctt

SEQ ID NO: 5356183 - DNA, 14 bp, Homo sapiens
acttctatttagcc

SEQ ID NO: 5356184 - DNA, 23 bp, Homo sapiens
acttctatttagccagcgtttat

SEQ ID NO: 5356185 - DNA, 17 bp, Homo sapiens
acttctatttatttatt

SEQ ID NO: 5356186 - DNA, 22 bp, Homo sapiens
acttctcaaacctgtttaaata

SEQ ID NO: 5356187 - DNA, 17 bp, Homo sapiens
acttctcaaagagaatt

SEQ ID NO: 5356188 - DNA, 14 bp, Homo sapiens
acttctcacttcct

SEQ ID NO: 5356189 - DNA, 15 bp, Homo sapiens
acttctcacttccta

SEQ ID NO: 5356190 - DNA, 14 bp, Homo sapiens
acttctcaggaaat

SEQ ID NO: 5356191 - DNA, 15 bp, Homo sapiens
acttctcagtcccct

SEQ ID NO: 5356192 - DNA, 19 bp, Homo sapiens
acttctcatcacacacatg

SEQ ID NO: 5356193 - DNA, 15 bp, Homo sapiens
acttctcatcttaaa

SEQ ID NO: 5356194 - DNA, 17 bp, Homo sapiens
acttctcatcttaaaaa

SEQ ID NO: 5356195 - DNA, 14 bp, Homo sapiens
acttctcatttatg

SEQ ID NO: 5356196 - DNA, 15 bp, Homo sapiens
acttctcatttatgt

SEQ ID NO: 5356197 - DNA, 15 bp, Homo sapiens
acttctccagcctag

SEQ ID NO: 5356198 - DNA, 14 bp, Homo sapiens
acttctccaggcag

SEQ ID NO: 5356199 - DNA, 16 bp, Homo sapiens
acttctccaggtctca

SEQ ID NO: 5356200 - DNA, 18 bp, Homo sapiens
acttctcccccgccctgc

SEQ ID NO: 5356201 - DNA, 21 bp, Homo sapiens
acttctcccccgccctgcccc

SEQ ID NO: 5356202 - DNA, 15 bp, Homo sapiens
acttctcccctgccc

SEQ ID NO: 5356203 - DNA, 16 bp, Homo sapiens
acttctcccctgggtc

SEQ ID NO: 5356204 - DNA, 20 bp, Homo sapiens
acttctcctgctgctcctgt

SEQ ID NO: 5356205 - DNA, 19 bp, Homo sapiens
acttctcggaattcataat

SEQ ID NO: 5356206 - DNA, 22 bp, Homo sapiens
acttctcggaattcataataaa

SEQ ID NO: 5356207 - DNA, 22 bp, Homo sapiens
acttctcgtagatgctgcctag

SEQ ID NO: 5356208 - DNA, 19 bp, Homo sapiens
acttctctaatagaaaagt

SEQ ID NO: 5356209 - DNA, 11 bp, Homo sapiens
acttctctcca

SEQ ID NO: 5356210 - DNA, 17 bp, Homo sapiens
acttctctgaatcagaa

SEQ ID NO: 5356211 - DNA, 13 bp, Homo sapiens
acttctctgctgc

SEQ ID NO: 5356212 - DNA, 14 bp, Homo sapiens
acttctctgctgcc

SEQ ID NO: 5356213 - DNA, 15 bp, Homo sapiens
acttctctgctgcct

SEQ ID NO: 5356214 - DNA, 18 bp, Homo sapiens
acttctctgctgcctctg

SEQ ID NO: 5356215 - DNA, 14 bp, Homo sapiens
acttctctgtgtgc

SEQ ID NO: 5356216 - DNA, 18 bp, Homo sapiens
acttctcttaagtggtct

SEQ ID NO: 5356217 - DNA, 21 bp, Homo sapiens
acttctcttattctttacaaa

SEQ ID NO: 5356218 - DNA, 15 bp, Homo sapiens
acttctcttcccata

SEQ ID NO: 5356219 - DNA, 14 bp, Homo sapiens
acttctcttctgag

SEQ ID NO: 5356220 - DNA, 19 bp, Homo sapiens
acttctcttctgagcctct

SEQ ID NO: 5356221 - DNA, 14 bp, Homo sapiens
acttctcttgcttt

SEQ ID NO: 5356222 - DNA, 16 bp, Homo sapiens
acttctcttgctttct

SEQ ID NO: 5356223 - DNA, 14 bp, Homo sapiens
acttctctttctta

SEQ ID NO: 5356224 - DNA, 16 bp, Homo sapiens
acttctctttgcctca

SEQ ID NO: 5356225 - DNA, 18 bp, Homo sapiens
acttctgaactttggaag

SEQ ID NO: 5356226 - DNA, 15 bp, Homo sapiens
acttctgacaaaggt

SEQ ID NO: 5356227 - DNA, 18 bp, Homo sapiens
acttctgacttactgtca

SEQ ID NO: 5356228 - DNA, 14 bp, Homo sapiens
acttctgactttac

SEQ ID NO: 5356229 - DNA, 12 bp, Homo sapiens
acttctgagatc

SEQ ID NO: 5356230 - DNA, 15 bp, Homo sapiens
acttctgagccccag

SEQ ID NO: 5356231 - DNA, 13 bp, Homo sapiens
acttctgagtaat

SEQ ID NO: 5356232 - DNA, 21 bp, Homo sapiens
acttctgagtaattaataaag

SEQ ID NO: 5356233 - DNA, 23 bp, Homo sapiens
acttctgagtgaagcaaaaacta

SEQ ID NO: 5356234 - DNA, 21 bp, Homo sapiens
acttctgataatttattgtct

SEQ ID NO: 5356235 - DNA, 19 bp, Homo sapiens
acttctgatgtttattaaa

SEQ ID NO: 5356236 - DNA, 18 bp, Homo sapiens
acttctgcaacaagcatg

SEQ ID NO: 5356237 - DNA, 19 bp, Homo sapiens
acttctgcaacaagcatgc

SEQ ID NO: 5356238 - DNA, 20 bp, Homo sapiens
acttctgccccagctttatc

SEQ ID NO: 5356239 - DNA, 13 bp, Homo sapiens
acttctgcctgga

SEQ ID NO: 5356240 - DNA, 18 bp, Homo sapiens
acttctgcgggctccctc

SEQ ID NO: 5356241 - DNA, 13 bp, Homo sapiens
acttctggaaggc

SEQ ID NO: 5356242 - DNA, 20 bp, Homo sapiens
acttctggaaggctggctga

SEQ ID NO: 5356243 - DNA, 22 bp, Homo sapiens
acttctggaaggctggctgagt

SEQ ID NO: 5356244 - DNA, 17 bp, Homo sapiens
acttctggaatactgaa

SEQ ID NO: 5356245 - DNA, 18 bp, Homo sapiens
acttctggaatactgaaa

SEQ ID NO: 5356246 - DNA, 14 bp, Homo sapiens
acttctggcctcca

SEQ ID NO: 5356247 - DNA, 16 bp, Homo sapiens
acttctggcctccagc

SEQ ID NO: 5356248 - DNA, 19 bp, Homo sapiens
acttctggcctccagcctt

SEQ ID NO: 5356249 - DNA, 16 bp, Homo sapiens
acttctggctccctct

SEQ ID NO: 5356250 - DNA, 17 bp, Homo sapiens
acttctggggccacctc

SEQ ID NO: 5356251 - DNA, 16 bp, Homo sapiens
acttctggggccagcc

SEQ ID NO: 5356252 - DNA, 22 bp, Homo sapiens
acttctggggccagcccctccc

SEQ ID NO: 5356253 - DNA, 22 bp, Homo sapiens
acttctgggtcatgcactgagg

SEQ ID NO: 5356254 - DNA, 16 bp, Homo sapiens
acttctgggtggggca

SEQ ID NO: 5356255 - DNA, 15 bp, Homo sapiens
acttctggtcccctg

SEQ ID NO: 5356256 - DNA, 15 bp, Homo sapiens
acttctggtgctgct

SEQ ID NO: 5356257 - DNA, 15 bp, Homo sapiens
acttctggttgtatt

SEQ ID NO: 5356258 - DNA, 21 bp, Homo sapiens
acttctgtaattgtgtggatt

SEQ ID NO: 5356259 - DNA, 15 bp, Homo sapiens
acttctgtatgcatc

SEQ ID NO: 5356260 - DNA, 20 bp, Homo sapiens
acttctgtgagacccccaca

SEQ ID NO: 5356261 - DNA, 13 bp, Homo sapiens
acttctgtggcaa

SEQ ID NO: 5356262 - DNA, 12 bp, Homo sapiens
acttctgtgggc

SEQ ID NO: 5356263 - DNA, 21 bp, Homo sapiens
acttctgtgggcatggccgct

SEQ ID NO: 5356264 - DNA, 22 bp, Homo sapiens
acttctgtgtagacatggttct

SEQ ID NO: 5356265 - DNA, 14 bp, Homo sapiens
acttctgtgttcat

SEQ ID NO: 5356266 - DNA, 15 bp, Homo sapiens
acttctgtgttcatt

SEQ ID NO: 5356267 - DNA, 12 bp, Homo sapiens
acttctgtttgg

SEQ ID NO: 5356268 - DNA, 16 bp, Homo sapiens
acttctgttttcaatc

SEQ ID NO: 5356269 - DNA, 16 bp, Homo sapiens
acttcttaaaagttgt

SEQ ID NO: 5356270 - DNA, 13 bp, Homo sapiens
acttcttaaaatt

SEQ ID NO: 5356271 - DNA, 16 bp, Homo sapiens
acttcttaaaggcctg

SEQ ID NO: 5356272 - DNA, 12 bp, Homo sapiens
acttcttaaata

SEQ ID NO: 5356273 - DNA, 16 bp, Homo sapiens
acttcttaaatatctt

SEQ ID NO: 5356274 - DNA, 18 bp, Homo sapiens
acttggcctcagctggct

SEQ ID NO: 5356275 - DNA, 17 bp, Homo sapiens
acttggctacacaggga

SEQ ID NO: 5356276 - DNA, 19 bp, Homo sapiens
acttggctcacactcgaca

SEQ ID NO: 5356277 - DNA, 18 bp, Homo sapiens
acttggctcgaatctctg

SEQ ID NO: 5356278 - DNA, 20 bp, Homo sapiens
acttggctcgaatctctgtg

SEQ ID NO: 5356279 - DNA, 22 bp, Homo sapiens
acttggctcgaatctctgtgcc

SEQ ID NO: 5356280 - DNA, 17 bp, Homo sapiens
acttggctggaatttct

SEQ ID NO: 5356281 - DNA, 21 bp, Homo sapiens
acttggctggaatttctgctg

SEQ ID NO: 5356282 - DNA, 15 bp, Homo sapiens
acttggctggggagg

SEQ ID NO: 5356283 - DNA, 20 bp, Homo sapiens
acttggctggggaggaccag

SEQ ID NO: 5356284 - DNA, 23 bp, Homo sapiens
acttggctgtccttccccttccc

SEQ ID NO: 5356285 - DNA, 23 bp, Homo sapiens
acttggctgtctgaccagagaat

SEQ ID NO: 5356286 - DNA, 13 bp, Homo sapiens
acttggctttcat

SEQ ID NO: 5356287 - DNA, 22 bp, Homo sapiens
acttgggaaacagagaaccctg

SEQ ID NO: 5356288 - DNA, 14 bp, Homo sapiens
acttgggaaatttt

SEQ ID NO: 5356289 - DNA, 15 bp, Homo sapiens
acttgggagcagtcc

SEQ ID NO: 5356290 - DNA, 13 bp, Homo sapiens
acttgggagcctg

SEQ ID NO: 5356291 - DNA, 19 bp, Homo sapiens
acttgggagcctgaggcag

SEQ ID NO: 5356292 - DNA, 20 bp, Homo sapiens
acttgggagctgctgggcta

SEQ ID NO: 5356293 - DNA, 18 bp, Homo sapiens
acttgggagctttaaaga

SEQ ID NO: 5356294 - DNA, 19 bp, Homo sapiens
acttgggagctttaaagag

SEQ ID NO: 5356295 - DNA, 14 bp, Homo sapiens
acttgggagggggc

SEQ ID NO: 5356296 - DNA, 17 bp, Homo sapiens
acttgggattctgactc

SEQ ID NO: 5356297 - DNA, 17 bp, Homo sapiens
acttgggcaccagcttc

SEQ ID NO: 5356298 - DNA, 17 bp, Homo sapiens
acttgggcacccccagc

SEQ ID NO: 5356299 - DNA, 19 bp, Homo sapiens
acttgggccatcggggggt

SEQ ID NO: 5356300 - DNA, 19 bp, Homo sapiens
acttgggcccaggaggtca

SEQ ID NO: 5356301 - DNA, 19 bp, Homo sapiens
acttgggcgctctgccctc

SEQ ID NO: 5356302 - DNA, 21 bp, Homo sapiens
acttgggctccgctgtgcccg

SEQ ID NO: 5356303 - DNA, 23 bp, Homo sapiens
acttgggctctctctagctcccc

SEQ ID NO: 5356304 - DNA, 15 bp, Homo sapiens
acttgggctggcacc

SEQ ID NO: 5356305 - DNA, 16 bp, Homo sapiens
acttggggaaggggcc

SEQ ID NO: 5356306 - DNA, 18 bp, Homo sapiens
acttggggaaggggcctg

SEQ ID NO: 5356307 - DNA, 23 bp, Homo sapiens
acttggggaaggggcctgggctg

SEQ ID NO: 5356308 - DNA, 18 bp, Homo sapiens
acttggggacaccccaga

SEQ ID NO: 5356309 - DNA, 19 bp, Homo sapiens
acttggggacataatttca

SEQ ID NO: 5356310 - DNA, 19 bp, Homo sapiens
acttggggatttctggtca

SEQ ID NO: 5356311 - DNA, 14 bp, Homo sapiens
acttggggcctctg

SEQ ID NO: 5356312 - DNA, 15 bp, Homo sapiens
acttgggggctcagc

SEQ ID NO: 5356313 - DNA, 21 bp, Homo sapiens
acttgggggctcagcaaggcc

SEQ ID NO: 5356314 - DNA, 22 bp, Homo sapiens
acttgggggctcagcaaggcca

SEQ ID NO: 5356315 - DNA, 19 bp, Homo sapiens
acttgggggttcaggcccg

SEQ ID NO: 5356316 - DNA, 19 bp, Homo sapiens
acttgggtcacatgactct

SEQ ID NO: 5356317 - DNA, 21 bp, Homo sapiens
acttgggtccaggcctactcc

SEQ ID NO: 5356318 - DNA, 15 bp, Homo sapiens
acttgggtcttccct

SEQ ID NO: 5356319 - DNA, 21 bp, Homo sapiens
acttggtacagttgcaggagc

SEQ ID NO: 5356320 - DNA, 13 bp, Homo sapiens
acttggtagagtt

SEQ ID NO: 5356321 - DNA, 20 bp, Homo sapiens
acttggtcacagccaggcgc

SEQ ID NO: 5356322 - DNA, 19 bp, Homo sapiens
acttggtccaactgcaact

SEQ ID NO: 5356323 - DNA, 22 bp, Homo sapiens
acttggtcccgtggatgctctt

SEQ ID NO: 5356324 - DNA, 19 bp, Homo sapiens
acttggtctgccaggcccc

SEQ ID NO: 5356325 - DNA, 15 bp, Homo sapiens
acttggtctgtgaga

SEQ ID NO: 5356326 - DNA, 21 bp, Homo sapiens
acttggtcttttttctgggtc

SEQ ID NO: 5356327 - DNA, 21 bp, Homo sapiens
acttggtgtcctttccctcca

SEQ ID NO: 5356328 - DNA, 22 bp, Homo sapiens
acttggtgtcctttccctccac

SEQ ID NO: 5356329 - DNA, 13 bp, Homo sapiens
acttggttataca

SEQ ID NO: 5356330 - DNA, 14 bp, Homo sapiens
acttggttatacat

SEQ ID NO: 5356331 - DNA, 15 bp, Homo sapiens
acttggttatacatg

SEQ ID NO: 5356332 - DNA, 16 bp, Homo sapiens
acttggttctgcttca

SEQ ID NO: 5356333 - DNA, 22 bp, Homo sapiens
acttggttgggtcagatttatt

SEQ ID NO: 5356334 - DNA, 13 bp, Homo sapiens
acttggttttatg

SEQ ID NO: 5356335 - DNA, 17 bp, Homo sapiens
acttggttttatggtta

SEQ ID NO: 5356336 - DNA, 16 bp, Homo sapiens
acttggtttttaaaaa

SEQ ID NO: 5356337 - DNA, 21 bp, Homo sapiens
acttgtaaaaagggggctgca

SEQ ID NO: 5356338 - DNA, 14 bp, Homo sapiens
acttgtaaaatgct

SEQ ID NO: 5356339 - DNA, 15 bp, Homo sapiens
acttgtaaacttgaa

SEQ ID NO: 5356340 - DNA, 17 bp, Homo sapiens
acttgtaaataaataga

SEQ ID NO: 5356341 - DNA, 12 bp, Homo sapiens
acttgtaaatat

SEQ ID NO: 5356342 - DNA, 15 bp, Homo sapiens
acttgtaaatataaa

SEQ ID NO: 5356343 - DNA, 17 bp, Homo sapiens
acttgtaatatttttat

SEQ ID NO: 5356344 - DNA, 21 bp, Homo sapiens
acttgtaatggtctctgaaaa

SEQ ID NO: 5356345 - DNA, 15 bp, Homo sapiens
acttgtaattatgga

SEQ ID NO: 5356346 - DNA, 18 bp, Homo sapiens
acttgtaatttttttaat

SEQ ID NO: 5356347 - DNA, 20 bp, Homo sapiens
acttgtacaaaataaacaaa

SEQ ID NO: 5356348 - DNA, 17 bp, Homo sapiens
acttgtacaaacagtat

SEQ ID NO: 5356349 - DNA, 19 bp, Homo sapiens
acttgtacaaacagtattt

SEQ ID NO: 5356350 - DNA, 22 bp, Homo sapiens
acttgtacaaacagtatttctg

SEQ ID NO: 5356351 - DNA, 15 bp, Homo sapiens
acttgtacagttgac

SEQ ID NO: 5356352 - DNA, 18 bp, Homo sapiens
acttgtacccacaggtga

SEQ ID NO: 5356353 - DNA, 21 bp, Homo sapiens
acttgtacgagacagaaaaag

SEQ ID NO: 5356354 - DNA, 22 bp, Homo sapiens
acttgtacgctcacttgcccca

SEQ ID NO: 5356355 - DNA, 18 bp, Homo sapiens
acttgtactatgttaata

SEQ ID NO: 5356356 - DNA, 23 bp, Homo sapiens
acttgtacttacactgaaatcca

SEQ ID NO: 5356357 - DNA, 16 bp, Homo sapiens
acttgtagaaatctgt

SEQ ID NO: 5356358 - DNA, 18 bp, Homo sapiens
acttgtagaaatctgtaa

SEQ ID NO: 5356359 - DNA, 19 bp, Homo sapiens
acttgtagaaatctgtaat

SEQ ID NO: 5356360 - DNA, 14 bp, Homo sapiens
acttgtagattcag

SEQ ID NO: 5356361 - DNA, 13 bp, Homo sapiens
acttgtagatttg

SEQ ID NO: 5356362 - DNA, 15 bp, Homo sapiens
acttgtagatttgat

SEQ ID NO: 5356363 - DNA, 18 bp, Homo sapiens
acttgtagatttgatttt

SEQ ID NO: 5356364 - DNA, 16 bp, Homo sapiens
acttgtagctgtaaaa

SEQ ID NO: 5356365 - DNA, 20 bp, Homo sapiens
acttgtaggaatctgccttc

SEQ ID NO: 5356366 - DNA, 22 bp, Homo sapiens
acttgtaggacttttaaacaaa

SEQ ID NO: 5356367 - DNA, 14 bp, Homo sapiens
acttgtaggataag

SEQ ID NO: 5356368 - DNA, 19 bp, Homo sapiens
acttgtataaatgtatata

SEQ ID NO: 5356369 - DNA, 21 bp, Homo sapiens
acttgtataaatgtatataca

SEQ ID NO: 5356370 - DNA, 18 bp, Homo sapiens
acttgtataagtagaatt

SEQ ID NO: 5356371 - DNA, 14 bp, Homo sapiens
acttgtatatatgg

SEQ ID NO: 5356372 - DNA, 23 bp, Homo sapiens
acttgtatatatggatcagagga

SEQ ID NO: 5356373 - DNA, 14 bp, Homo sapiens
acttgtatattcca

SEQ ID NO: 5356374 - DNA, 19 bp, Homo sapiens
acttgtatattctatttta

SEQ ID NO: 5356375 - DNA, 20 bp, Homo sapiens
acttgtatattctattttac

SEQ ID NO: 5356376 - DNA, 17 bp, Homo sapiens
acttgtatatttgtaca

SEQ ID NO: 5356377 - DNA, 20 bp, Homo sapiens
acttgtatccaggcctggga

SEQ ID NO: 5356378 - DNA, 16 bp, Homo sapiens
acttgtatctgaagac

SEQ ID NO: 5356379 - DNA, 22 bp, Homo sapiens
acttgtatctgtccgtggaaaa

SEQ ID NO: 5356380 - DNA, 14 bp, Homo sapiens
acttgtattatgtg

SEQ ID NO: 5356381 - DNA, 15 bp, Homo sapiens
acttgtattatgtgt

SEQ ID NO: 5356382 - DNA, 22 bp, Homo sapiens
acttgtattgactttatgttgt

SEQ ID NO: 5356383 - DNA, 10 bp, Homo sapiens
acttgtattt

SEQ ID NO: 5356384 - DNA, 22 bp, Homo sapiens
acttgtatttccaaacctggtt

SEQ ID NO: 5356385 - DNA, 17 bp, Homo sapiens
acttgtattttcttaat

SEQ ID NO: 5356386 - DNA, 21 bp, Homo sapiens
acttgtattttcttaatatac

SEQ ID NO: 5356387 - DNA, 23 bp, Homo sapiens
acttgtattttcttaatatacaa

SEQ ID NO: 5356388 - DNA, 15 bp, Homo sapiens
acttgtcaaagaagg

SEQ ID NO: 5356389 - DNA, 16 bp, Homo sapiens
acttgtcaaagaaggt

SEQ ID NO: 5356390 - DNA, 18 bp, Homo sapiens
acttgtcaagaatgagaa

SEQ ID NO: 5356391 - DNA, 20 bp, Homo sapiens
acttgtcaaggaatgttatc

SEQ ID NO: 5356392 - DNA, 17 bp, Homo sapiens
acttgtcaatatttaaa

SEQ ID NO: 5356393 - DNA, 22 bp, Homo sapiens
acttgtcactatgctatttctg

SEQ ID NO: 5356394 - DNA, 22 bp, Homo sapiens
acttgtcactgacacaaaggaa

SEQ ID NO: 5356395 - DNA, 16 bp, Homo sapiens
acttgtcacttgcatg

SEQ ID NO: 5356396 - DNA, 16 bp, Homo sapiens
acttgtcagcctcaga

SEQ ID NO: 5356397 - DNA, 21 bp, Homo sapiens
acttgtcaggagtgtgtgtga

SEQ ID NO: 5356398 - DNA, 22 bp, Homo sapiens
acttgtcatagactcctttgct

SEQ ID NO: 5356399 - DNA, 17 bp, Homo sapiens
acttgtcatatcactaa

SEQ ID NO: 5356400 - DNA, 20 bp, Homo sapiens
acttgtcatatgtagccttc

SEQ ID NO: 5356401 - DNA, 22 bp, Homo sapiens
acttgtccaattaatgaagttg

SEQ ID NO: 5356402 - DNA, 18 bp, Homo sapiens
acttgtcccactatctgg

SEQ ID NO: 5356403 - DNA, 17 bp, Homo sapiens
acttgtccccaaatccg

SEQ ID NO: 5356404 - DNA, 13 bp, Homo sapiens
acttgtcctcagc

SEQ ID NO: 5356405 - DNA, 21 bp, Homo sapiens
acttgtccttagcctggacct

SEQ ID NO: 5356406 - DNA, 23 bp, Homo sapiens
acttgtccttttgtaccatggtg

SEQ ID NO: 5356407 - DNA, 16 bp, Homo sapiens
acttgtctattacctg

SEQ ID NO: 5356408 - DNA, 15 bp, Homo sapiens
acttgtctcatttta

SEQ ID NO: 5356409 - DNA, 16 bp, Homo sapiens
acttgtctcctttctg

SEQ ID NO: 5356410 - DNA, 12 bp, Homo sapiens
acttgtctgagg

SEQ ID NO: 5356411 - DNA, 16 bp, Homo sapiens
acttgtctgaggcctc

SEQ ID NO: 5356412 - DNA, 20 bp, Homo sapiens
acttgtctgaggcctcatcc

SEQ ID NO: 5356413 - DNA, 13 bp, Homo sapiens
acttgtctgcctc

SEQ ID NO: 5356414 - DNA, 16 bp, Homo sapiens
acttgtctggctttgg

SEQ ID NO: 5356415 - DNA, 20 bp, Homo sapiens
acttgtctgggaattgtgtg

SEQ ID NO: 5356416 - DNA, 12 bp, Homo sapiens
acttgtctgtca

SEQ ID NO: 5356417 - DNA, 15 bp, Homo sapiens
acttgtctgtcaaat

SEQ ID NO: 5356418 - DNA, 18 bp, Homo sapiens
acttgtctgtcaaatgtt

SEQ ID NO: 5356419 - DNA, 15 bp, Homo sapiens
acttgtcttgctctt

SEQ ID NO: 5356420 - DNA, 17 bp, Homo sapiens
acttgtcttgctcttag

SEQ ID NO: 5356421 - DNA, 13 bp, Homo sapiens
acttgtctttctg

SEQ ID NO: 5356422 - DNA, 13 bp, Homo sapiens
acttgtctttgat

SEQ ID NO: 5356423 - DNA, 18 bp, Homo sapiens
acttgtgaaacacagctg

SEQ ID NO: 5356424 - DNA, 21 bp, Homo sapiens
acttgtgaactccatcattca

SEQ ID NO: 5356425 - DNA, 13 bp, Homo sapiens
acttgtgaatgct

SEQ ID NO: 5356426 - DNA, 14 bp, Homo sapiens
acttgtgacttttg

SEQ ID NO: 5356427 - DNA, 15 bp, Homo sapiens
acttgtgagcatcag

SEQ ID NO: 5356428 - DNA, 20 bp, Homo sapiens
acttgtgattatttattatt

SEQ ID NO: 5356429 - DNA, 14 bp, Homo sapiens
acttgtgattggct

SEQ ID NO: 5356430 - DNA, 17 bp, Homo sapiens
acttgtgcacaggcaga

SEQ ID NO: 5356431 - DNA, 16 bp, Homo sapiens
acttgtgcacttagta

SEQ ID NO: 5356432 - DNA, 18 bp, Homo sapiens
acttgtgccaacactcaa

SEQ ID NO: 5356433 - DNA, 20 bp, Homo sapiens
acttgtgccctccctgtcct

SEQ ID NO: 5356434 - DNA, 21 bp, Homo sapiens
acttgtgctttcagttagcct

SEQ ID NO: 5356435 - DNA, 14 bp, Homo sapiens
acttgtggacacag

SEQ ID NO: 5356436 - DNA, 19 bp, Homo sapiens
acttgtggactaaaagata

SEQ ID NO: 5356437 - DNA, 19 bp, Homo sapiens
acttgtggcaatttgaatt

SEQ ID NO: 5356438 - DNA, 12 bp, Homo sapiens
acttgtggcctt

SEQ ID NO: 5356439 - DNA, 13 bp, Homo sapiens
acttgtgggcttc

SEQ ID NO: 5356440 - DNA, 17 bp, Homo sapiens
acttgtggggctaaggc

SEQ ID NO: 5356441 - DNA, 13 bp, Homo sapiens
acttgtgggtcct

SEQ ID NO: 5356442 - DNA, 17 bp, Homo sapiens
acttgtggtgtgaccat

SEQ ID NO: 5356443 - DNA, 23 bp, Homo sapiens
acttgtggtgtgaccatgttcat

SEQ ID NO: 5356444 - DNA, 16 bp, Homo sapiens
acttgtggttgaatta

SEQ ID NO: 5356445 - DNA, 21 bp, Homo sapiens
acttgtgtaaatacaattttg

SEQ ID NO: 5356446 - DNA, 21 bp, Homo sapiens
acttgtgtactgataaaatac

SEQ ID NO: 5356447 - DNA, 12 bp, Homo sapiens
acttgtgtatat

SEQ ID NO: 5356448 - DNA, 17 bp, Homo sapiens
acttgtgtatgatccaa

SEQ ID NO: 5356449 - DNA, 20 bp, Homo sapiens
acttgtgtcaaccactaaag

SEQ ID NO: 5356450 - DNA, 21 bp, Homo sapiens
acttttaataaagtatgaata

SEQ ID NO: 5356451 - DNA, 23 bp, Homo sapiens
acttttaataaagtatgaatatt

SEQ ID NO: 5356452 - DNA, 14 bp, Homo sapiens
acttttaatcaagt

SEQ ID NO: 5356453 - DNA, 15 bp, Homo sapiens
acttttaatcagtga

SEQ ID NO: 5356454 - DNA, 18 bp, Homo sapiens
acttttaatgaacaaatg

SEQ ID NO: 5356455 - DNA, 21 bp, Homo sapiens
acttttacaagtaacaaaaat

SEQ ID NO: 5356456 - DNA, 23 bp, Homo sapiens
acttttacagaatgcattaaaaa

SEQ ID NO: 5356457 - DNA, 15 bp, Homo sapiens
acttttactctgcct

SEQ ID NO: 5356458 - DNA, 13 bp, Homo sapiens
acttttagaaact

SEQ ID NO: 5356459 - DNA, 17 bp, Homo sapiens
acttttagaaatgcata

SEQ ID NO: 5356460 - DNA, 18 bp, Homo sapiens
acttttagaaatgcatat

SEQ ID NO: 5356461 - DNA, 20 bp, Homo sapiens
acttttagacagtggtaaat

SEQ ID NO: 5356462 - DNA, 20 bp, Homo sapiens
acttttagcggtttgcaaac

SEQ ID NO: 5356463 - DNA, 22 bp, Homo sapiens
acttttaggatgggggagaggg

SEQ ID NO: 5356464 - DNA, 14 bp, Homo sapiens
acttttagtggttc

SEQ ID NO: 5356465 - DNA, 22 bp, Homo sapiens
acttttagtggttctgtgcctc

SEQ ID NO: 5356466 - DNA, 22 bp, Homo sapiens
acttttataaactttacctttt

SEQ ID NO: 5356467 - DNA, 17 bp, Homo sapiens
acttttataaattaaat

SEQ ID NO: 5356468 - DNA, 18 bp, Homo sapiens
acttttataaattaaata

SEQ ID NO: 5356469 - DNA, 21 bp, Homo sapiens
acttttatctattctgagaaa

SEQ ID NO: 5356470 - DNA, 16 bp, Homo sapiens
acttttatgaagtttt

SEQ ID NO: 5356471 - DNA, 23 bp, Homo sapiens
acttttatgatacttgaaaatta

SEQ ID NO: 5356472 - DNA, 19 bp, Homo sapiens
acttttatgatgtatattt

SEQ ID NO: 5356473 - DNA, 21 bp, Homo sapiens
acttttatgcgcaaatacaaa

SEQ ID NO: 5356474 - DNA, 13 bp, Homo sapiens
acttttatgtttt

SEQ ID NO: 5356475 - DNA, 22 bp, Homo sapiens
acttttattatgggtatgtgtt

SEQ ID NO: 5356476 - DNA, 16 bp, Homo sapiens
acttttattgagctct

SEQ ID NO: 5356477 - DNA, 23 bp, Homo sapiens
acttttatttccagtgaaatcag

SEQ ID NO: 5356478 - DNA, 15 bp, Homo sapiens
acttttatttgcaac

SEQ ID NO: 5356479 - DNA, 18 bp, Homo sapiens
acttttatttgcaacatt

SEQ ID NO: 5356480 - DNA, 18 bp, Homo sapiens
acttttattttacacaga

SEQ ID NO: 5356481 - DNA, 22 bp, Homo sapiens
acttttattttcattgtgattt

SEQ ID NO: 5356482 - DNA, 22 bp, Homo sapiens
acttttcaaaataaagcttttg

SEQ ID NO: 5356483 - DNA, 19 bp, Homo sapiens
acttttcaaggcacattga

SEQ ID NO: 5356484 - DNA, 17 bp, Homo sapiens
acttttcaatgtgattc

SEQ ID NO: 5356485 - DNA, 19 bp, Homo sapiens
acttttcacactgtcttcc

SEQ ID NO: 5356486 - DNA, 14 bp, Homo sapiens
acttttcagactga

SEQ ID NO: 5356487 - DNA, 20 bp, Homo sapiens
acttttcataacctagcctt

SEQ ID NO: 5356488 - DNA, 21 bp, Homo sapiens
acttttcatctaacgtgcatt

SEQ ID NO: 5356489 - DNA, 13 bp, Homo sapiens
acttttcattact

SEQ ID NO: 5356490 - DNA, 17 bp, Homo sapiens
acttttcattccctgta

SEQ ID NO: 5356491 - DNA, 14 bp, Homo sapiens
acttttcattctct

SEQ ID NO: 5356492 - DNA, 15 bp, Homo sapiens
acttttcatttcaga

SEQ ID NO: 5356493 - DNA, 16 bp, Homo sapiens
acttttcatttcagat

SEQ ID NO: 5356494 - DNA, 18 bp, Homo sapiens
acttttcatttcagattt

SEQ ID NO: 5356495 - DNA, 19 bp, Homo sapiens
acttttcatttcagatttt

SEQ ID NO: 5356496 - DNA, 21 bp, Homo sapiens
acttttccaacatacaattta

SEQ ID NO: 5356497 - DNA, 16 bp, Homo sapiens
acttttccaagccctt

SEQ ID NO: 5356498 - DNA, 14 bp, Homo sapiens
acttttccagtatt

SEQ ID NO: 5356499 - DNA, 16 bp, Homo sapiens
acttttccagtatttt

SEQ ID NO: 5356500 - DNA, 21 bp, Homo sapiens
acttttccattgaccagctct

SEQ ID NO: 5356501 - DNA, 20 bp, Homo sapiens
acttttcctcttagaagaat

SEQ ID NO: 5356502 - DNA, 15 bp, Homo sapiens
acttttccttgcata

SEQ ID NO: 5356503 - DNA, 22 bp, Homo sapiens
acttttccttgcatacaaacaa

SEQ ID NO: 5356504 - DNA, 19 bp, Homo sapiens
acttttcctttgaatcctc

SEQ ID NO: 5356505 - DNA, 20 bp, Homo sapiens
acttttccttttcttaaaac

SEQ ID NO: 5356506 - DNA, 17 bp, Homo sapiens
acttttcgttaacattg

SEQ ID NO: 5356507 - DNA, 15 bp, Homo sapiens
acttttctaagaaaa

SEQ ID NO: 5356508 - DNA, 16 bp, Homo sapiens
acttttctaagaaaag

SEQ ID NO: 5356509 - DNA, 10 bp, Homo sapiens
acttttctag

SEQ ID NO: 5356510 - DNA, 20 bp, Homo sapiens
acttttctagttaacttttt

SEQ ID NO: 5356511 - DNA, 12 bp, Homo sapiens
acttttctcaat

SEQ ID NO: 5356512 - DNA, 12 bp, Homo sapiens
acttttctcttt

SEQ ID NO: 5356513 - DNA, 12 bp, Homo sapiens
acttttctgata

SEQ ID NO: 5356514 - DNA, 12 bp, Homo sapiens
acttttctgatt

SEQ ID NO: 5356515 - DNA, 13 bp, Homo sapiens
acttttctgccaa

SEQ ID NO: 5356516 - DNA, 15 bp, Homo sapiens
acttttctggttcca

SEQ ID NO: 5356517 - DNA, 19 bp, Homo sapiens
acttttctggttccaaacc

SEQ ID NO: 5356518 - DNA, 11 bp, Homo sapiens
acttttctgta

SEQ ID NO: 5356519 - DNA, 18 bp, Homo sapiens
acttttctgtcttacaag

SEQ ID NO: 5356520 - DNA, 13 bp, Homo sapiens
acttttctgttta

SEQ ID NO: 5356521 - DNA, 12 bp, Homo sapiens
acttttcttaag

SEQ ID NO: 5356522 - DNA, 12 bp, Homo sapiens
acttttcttctt

SEQ ID NO: 5356523 - DNA, 13 bp, Homo sapiens
acttttcttcttc

SEQ ID NO: 5356524 - DNA, 16 bp, Homo sapiens
acttttctttttaaat

SEQ ID NO: 5356525 - DNA, 17 bp, Homo sapiens
acttttctttttaaatg

SEQ ID NO: 5356526 - DNA, 11 bp, Homo sapiens
acttttgaaaa

SEQ ID NO: 5356527 - DNA, 16 bp, Homo sapiens
acttttgaaaaaggat

SEQ ID NO: 5356528 - DNA, 13 bp, Homo sapiens
acttttgaaaaga

SEQ ID NO: 5356529 - DNA, 15 bp, Homo sapiens
acttttgaaaatcaa

SEQ ID NO: 5356530 - DNA, 22 bp, Homo sapiens
acttttgaaaatcaagatgaga

SEQ ID NO: 5356531 - DNA, 17 bp, Homo sapiens
acttttgaaataaagta

SEQ ID NO: 5356532 - DNA, 15 bp, Homo sapiens
acttttgaaatttaa

SEQ ID NO: 5356533 - DNA, 22 bp, Homo sapiens
acttttgaagaacaaaaggctt

SEQ ID NO: 5356534 - DNA, 22 bp, Homo sapiens
acttttgaagaggcctaagtca

SEQ ID NO: 5356535 - DNA, 18 bp, Homo sapiens
acttttgatgacttcagt

SEQ ID NO: 5356536 - DNA, 19 bp, Homo sapiens
acttttgatgtttgaagtt

SEQ ID NO: 5356537 - DNA, 12 bp, Homo sapiens
acttttgcacat

SEQ ID NO: 5356538 - DNA, 18 bp, Homo sapiens
acttttgcacatatattt

SEQ ID NO: 5356539 - DNA, 22 bp, Homo sapiens
acttttgctgtaatgttaatat

SEQ ID NO: 5356540 - DNA, 17 bp, Homo sapiens
acttttgcttacctttt

SEQ ID NO: 5356541 - DNA, 13 bp, Homo sapiens
acttttgcttggt

SEQ ID NO: 5356542 - DNA, 14 bp, Homo sapiens
acttttggaatcat

SEQ ID NO: 5356543 - DNA, 23 bp, Homo sapiens
acttttggaatctagaagaaatg

SEQ ID NO: 5356544 - DNA, 20 bp, Homo sapiens
acttttggataatatccact

SEQ ID NO: 5356545 - DNA, 17 bp, Homo sapiens
acttttggattttatgg

SEQ ID NO: 5356546 - DNA, 13 bp, Homo sapiens
acttttgggaggt

SEQ ID NO: 5356547 - DNA, 15 bp, Homo sapiens
acttttgggatttgt

SEQ ID NO: 5356548 - DNA, 21 bp, Homo sapiens
acttttgggatttgttgaaat

SEQ ID NO: 5356549 - DNA, 20 bp, Homo sapiens
acttttgggggttggatggg

SEQ ID NO: 5356550 - DNA, 18 bp, Homo sapiens
acttttggtttttatatt

SEQ ID NO: 5356551 - DNA, 21 bp, Homo sapiens
acttttgtaaagaaatttact

SEQ ID NO: 5356552 - DNA, 13 bp, Homo sapiens
acttttgtaaata

SEQ ID NO: 5356553 - DNA, 18 bp, Homo sapiens
acttttgtaaatattctt

SEQ ID NO: 5356554 - DNA, 17 bp, Homo sapiens
acttttgtaagacaaag

SEQ ID NO: 5356555 - DNA, 12 bp, Homo sapiens
acttttgtaatt

SEQ ID NO: 5356556 - DNA, 16 bp, Homo sapiens
acttttgtaatttgaa

SEQ ID NO: 5356557 - DNA, 13 bp, Homo sapiens
acttttgtacatc

SEQ ID NO: 5356558 - DNA, 20 bp, Homo sapiens
acttttgtacatctggctta

SEQ ID NO: 5356559 - DNA, 21 bp, Homo sapiens
acttttgtaccagtgtgaata

SEQ ID NO: 5356560 - DNA, 17 bp, Homo sapiens
acttttgtactgaattt

SEQ ID NO: 5356561 - DNA, 18 bp, Homo sapiens
acttttgtactgaatttt

SEQ ID NO: 5356562 - DNA, 19 bp, Homo sapiens
acttttgtagtcttatgaa

SEQ ID NO: 5356563 - DNA, 20 bp, Homo sapiens
acttttgtagtcttatgaat

SEQ ID NO: 5356564 - DNA, 21 bp, Homo sapiens
acttttgtagtcttatgaata

SEQ ID NO: 5356565 - DNA, 19 bp, Homo sapiens
acttttgtgtattctgtgg

SEQ ID NO: 5356566 - DNA, 12 bp, Homo sapiens
acttttgttaaa

SEQ ID NO: 5356567 - DNA, 16 bp, Homo sapiens
acttttgttaacagta

SEQ ID NO: 5356568 - DNA, 16 bp, Homo sapiens
acttttgttctcttct

SEQ ID NO: 5356569 - DNA, 13 bp, Homo sapiens
acttttgttctgc

SEQ ID NO: 5356570 - DNA, 16 bp, Homo sapiens
acttttgttctgcttt

SEQ ID NO: 5356571 - DNA, 21 bp, Homo sapiens
acttttgttctgctttatctt

SEQ ID NO: 5356572 - DNA, 23 bp, Homo sapiens
acttttgttcttggtttgtaaat

SEQ ID NO: 5356573 - DNA, 12 bp, Homo sapiens
acttttgtttaa

SEQ ID NO: 5356574 - DNA, 13 bp, Homo sapiens
acttttgtttcag

SEQ ID NO: 5356575 - DNA, 22 bp, Homo sapiens
actttttaaaaaactattttat

SEQ ID NO: 5356576 - DNA, 16 bp, Homo sapiens
actttttaaaaataac

SEQ ID NO: 5356577 - DNA, 18 bp, Homo sapiens
actttttaaaaataactg

SEQ ID NO: 5356578 - DNA, 14 bp, Homo sapiens
actttttaaaatac

SEQ ID NO: 5356579 - DNA, 16 bp, Homo sapiens
actttttaaaatataa

SEQ ID NO: 5356580 - DNA, 16 bp, Homo sapiens
actttttaaaattctg

SEQ ID NO: 5356581 - DNA, 15 bp, Homo sapiens
actttttaacatggt

SEQ ID NO: 5356582 - DNA, 15 bp, Homo sapiens
actttttaacattct

SEQ ID NO: 5356583 - DNA, 19 bp, Homo sapiens
actttttaactattaagag

SEQ ID NO: 5356584 - DNA, 18 bp, Homo sapiens
actttttaattcaccaaa

SEQ ID NO: 5356585 - DNA, 16 bp, Homo sapiens
actttttaatttttaa

SEQ ID NO: 5356586 - DNA, 10 bp, Homo sapiens
actttttagc

SEQ ID NO: 5356587 - DNA, 17 bp, Homo sapiens
actttttagtcttttac

SEQ ID NO: 5356588 - DNA, 19 bp, Homo sapiens
actttttataatgtggatt

SEQ ID NO: 5356589 - DNA, 18 bp, Homo sapiens
actttttatactccatac

SEQ ID NO: 5356590 - DNA, 16 bp, Homo sapiens
actttttatattctca

SEQ ID NO: 5356591 - DNA, 21 bp, Homo sapiens
actttttatattttatacatt

SEQ ID NO: 5356592 - DNA, 14 bp, Homo sapiens
actttttattcaat

SEQ ID NO: 5356593 - DNA, 12 bp, Homo sapiens
actttttattgc

SEQ ID NO: 5356594 - DNA, 13 bp, Homo sapiens
actttttattgca

SEQ ID NO: 5356595 - DNA, 14 bp, Homo sapiens
actttttattgcat

SEQ ID NO: 5356596 - DNA, 20 bp, Homo sapiens
actttttattgcatggtgtg

SEQ ID NO: 5356597 - DNA, 15 bp, Homo sapiens
actttttattgcctt

SEQ ID NO: 5356598 - DNA, 16 bp, Homo sapiens
actttttattgccttc

SEQ ID NO: 5356599 - DNA, 15 bp, Homo sapiens
actttttatttctaa

SEQ ID NO: 5356600 - DNA, 15 bp, Homo sapiens
actttttcaagattg

SEQ ID NO: 5356601 - DNA, 15 bp, Homo sapiens
actttttcaatggtt

SEQ ID NO: 5356602 - DNA, 18 bp, Homo sapiens
actttttcacataagcca

SEQ ID NO: 5356603 - DNA, 13 bp, Homo sapiens
actttttcatttg

SEQ ID NO: 5356604 - DNA, 13 bp, Homo sapiens
actttttccagaa

SEQ ID NO: 5356605 - DNA, 21 bp, Homo sapiens
actttttccagaatttgaata

SEQ ID NO: 5356606 - DNA, 14 bp, Homo sapiens
actttttccagcaa

SEQ ID NO: 5356607 - DNA, 20 bp, Homo sapiens
actttttccagcaaaatgga

SEQ ID NO: 5356608 - DNA, 17 bp, Homo sapiens
actttttccatttggca

SEQ ID NO: 5356609 - DNA, 16 bp, Homo sapiens
actttttcccctgcaa

SEQ ID NO: 5356610 - DNA, 19 bp, Homo sapiens
actttttccttactgtgca

SEQ ID NO: 5356611 - DNA, 18 bp, Homo sapiens
actttttccttcctgccc

SEQ ID NO: 5356612 - DNA, 23 bp, Homo sapiens
actttttccttcctgccctgtac

SEQ ID NO: 5356613 - DNA, 19 bp, Homo sapiens
actttttctaagctgtttc

SEQ ID NO: 5356614 - DNA, 17 bp, Homo sapiens
actttttctaggtggca

SEQ ID NO: 5356615 - DNA, 13 bp, Homo sapiens
actttttcttaaa

SEQ ID NO: 5356616 - DNA, 13 bp, Homo sapiens
actttttcttatt

SEQ ID NO: 5356617 - DNA, 13 bp, Homo sapiens
actttttctttga

SEQ ID NO: 5356618 - DNA, 17 bp, Homo sapiens
actttttgaactaagaa

SEQ ID NO: 5356619 - DNA, 20 bp, Homo sapiens
actttttgaacttttcattc

SEQ ID NO: 5356620 - DNA, 14 bp, Homo sapiens
actttttgaattct

SEQ ID NO: 5356621 - DNA, 15 bp, Homo sapiens
actttttgaggcaaa

SEQ ID NO: 5356622 - DNA, 21 bp, Homo sapiens
actttttgcaccttattttct

SEQ ID NO: 5356623 - DNA, 17 bp, Homo sapiens
actttttgcagctttct

SEQ ID NO: 5356624 - DNA, 23 bp, Homo sapiens
actttttgctgttagttataaaa

SEQ ID NO: 5356625 - DNA, 14 bp, Homo sapiens
actttttggaattg

SEQ ID NO: 5356626 - DNA, 17 bp, Homo sapiens
actttttggaattgtct

SEQ ID NO: 5356627 - DNA, 19 bp, Homo sapiens
actttttggtaatatatat

SEQ ID NO: 5356628 - DNA, 14 bp, Homo sapiens
actttttggtggat

SEQ ID NO: 5356629 - DNA, 15 bp, Homo sapiens
agaaaattaaaagaa

SEQ ID NO: 5356630 - DNA, 14 bp, Homo sapiens
agaaaattaaaata

SEQ ID NO: 5356631 - DNA, 16 bp, Homo sapiens
agaaaattaaaataac

SEQ ID NO: 5356632 - DNA, 18 bp, Homo sapiens
agaaaattaaacacaaag

SEQ ID NO: 5356633 - DNA, 18 bp, Homo sapiens
agaaaattaaactacaga

SEQ ID NO: 5356634 - DNA, 17 bp, Homo sapiens
agaaaattaattatatt

SEQ ID NO: 5356635 - DNA, 12 bp, Homo sapiens
agaaaattatat

SEQ ID NO: 5356636 - DNA, 16 bp, Homo sapiens
agaaaattatattctg

SEQ ID NO: 5356637 - DNA, 17 bp, Homo sapiens
agaaaattcaattgtaa

SEQ ID NO: 5356638 - DNA, 14 bp, Homo sapiens
agaaaattccctgg

SEQ ID NO: 5356639 - DNA, 16 bp, Homo sapiens
agaaaattcctataag

SEQ ID NO: 5356640 - DNA, 18 bp, Homo sapiens
agaaaattctcaagtgat

SEQ ID NO: 5356641 - DNA, 14 bp, Homo sapiens
agaaaattctcctg

SEQ ID NO: 5356642 - DNA, 14 bp, Homo sapiens
agaaaattctctca

SEQ ID NO: 5356643 - DNA, 20 bp, Homo sapiens
agaaaattctctcaagactt

SEQ ID NO: 5356644 - DNA, 16 bp, Homo sapiens
agaaaattctgtgcct

SEQ ID NO: 5356645 - DNA, 14 bp, Homo sapiens
agaaaattgaaaca

SEQ ID NO: 5356646 - DNA, 13 bp, Homo sapiens
agaaaattgaatt

SEQ ID NO: 5356647 - DNA, 14 bp, Homo sapiens
agaaaattgaattt

SEQ ID NO: 5356648 - DNA, 16 bp, Homo sapiens
agaaaattgaatttaa

SEQ ID NO: 5356649 - DNA, 17 bp, Homo sapiens
agaaaattgaatttaac

SEQ ID NO: 5356650 - DNA, 23 bp, Homo sapiens
agaaaattgaggtttggaagagt

SEQ ID NO: 5356651 - DNA, 13 bp, Homo sapiens
agaaaattgagtt

SEQ ID NO: 5356652 - DNA, 14 bp, Homo sapiens
agaaaattgcatga

SEQ ID NO: 5356653 - DNA, 13 bp, Homo sapiens
agaaaattgccaa

SEQ ID NO: 5356654 - DNA, 18 bp, Homo sapiens
agaaaattgccaaaatat

SEQ ID NO: 5356655 - DNA, 17 bp, Homo sapiens
agaaaattgcctttaaa

SEQ ID NO: 5356656 - DNA, 20 bp, Homo sapiens
agaaaattgcctttaaaact

SEQ ID NO: 5356657 - DNA, 14 bp, Homo sapiens
agaaaattgctgtg

SEQ ID NO: 5356658 - DNA, 18 bp, Homo sapiens
agaaaattgctgtgcctc

SEQ ID NO: 5356659 - DNA, 13 bp, Homo sapiens
agaaaatttaaaa

SEQ ID NO: 5356660 - DNA, 21 bp, Homo sapiens
agaaaatttacaaaatttatt

SEQ ID NO: 5356661 - DNA, 23 bp, Homo sapiens
agaaaatttagccctttaaaacg

SEQ ID NO: 5356662 - DNA, 14 bp, Homo sapiens
agaaaatttgcaac

SEQ ID NO: 5356663 - DNA, 23 bp, Homo sapiens
agaaaatttgcaacatataaagt

SEQ ID NO: 5356664 - DNA, 21 bp, Homo sapiens
agaaaatttgccaatctttcc

SEQ ID NO: 5356665 - DNA, 11 bp, Homo sapiens
agaaaatttta

SEQ ID NO: 5356666 - DNA, 17 bp, Homo sapiens
agaaaattttgtaaaac

SEQ ID NO: 5356667 - DNA, 22 bp, Homo sapiens
agaaaattttgtaaaacaatgc

SEQ ID NO: 5356668 - DNA, 20 bp, Homo sapiens
agaaaattttttttcaaaaa

SEQ ID NO: 5356669 - DNA, 17 bp, Homo sapiens
agaaacaaaaagagctt

SEQ ID NO: 5356670 - DNA, 19 bp, Homo sapiens
agaaacaaaaatcaaactt

SEQ ID NO: 5356671 - DNA, 17 bp, Homo sapiens
agaaacaaaatgaaaaa

SEQ ID NO: 5356672 - DNA, 19 bp, Homo sapiens
agaaacaaaatgaaaaaaa

SEQ ID NO: 5356673 - DNA, 23 bp, Homo sapiens
agaaacaaaatgaaaaaaaaagg

SEQ ID NO: 5356674 - DNA, 15 bp, Homo sapiens
agaaacaaacaaaag

SEQ ID NO: 5356675 - DNA, 12 bp, Homo sapiens
agaaacaaaccc

SEQ ID NO: 5356676 - DNA, 13 bp, Homo sapiens
agaaacaaacttt

SEQ ID NO: 5356677 - DNA, 19 bp, Homo sapiens
agaaacaaagcaaatttca

SEQ ID NO: 5356678 - DNA, 14 bp, Homo sapiens
agaaacaaagggga

SEQ ID NO: 5356679 - DNA, 22 bp, Homo sapiens
agaaacaaaggggatgcccagt

SEQ ID NO: 5356680 - DNA, 15 bp, Homo sapiens
agaaacaaagtaatc

SEQ ID NO: 5356681 - DNA, 12 bp, Homo sapiens
agaaacaacaaa

SEQ ID NO: 5356682 - DNA, 16 bp, Homo sapiens
agaaacaacactgtag

SEQ ID NO: 5356683 - DNA, 15 bp, Homo sapiens
agaaacaacagggga

SEQ ID NO: 5356684 - DNA, 15 bp, Homo sapiens
agaaacaactgccaa

SEQ ID NO: 5356685 - DNA, 16 bp, Homo sapiens
agaaacaagctgtgca

SEQ ID NO: 5356686 - DNA, 16 bp, Homo sapiens
agaaacaagtattttg

SEQ ID NO: 5356687 - DNA, 17 bp, Homo sapiens
agaaacaatactgttct

SEQ ID NO: 5356688 - DNA, 19 bp, Homo sapiens
agaaacaatgtctggggac

SEQ ID NO: 5356689 - DNA, 21 bp, Homo sapiens
agaaacaatgtctggggacag

SEQ ID NO: 5356690 - DNA, 12 bp, Homo sapiens
agaaacaatgtt

SEQ ID NO: 5356691 - DNA, 23 bp, Homo sapiens
agaaacacaaatgtaaaataagt

SEQ ID NO: 5356692 - DNA, 16 bp, Homo sapiens
agaaacacaactatat

SEQ ID NO: 5356693 - DNA, 15 bp, Homo sapiens
agaaacacactgagg

SEQ ID NO: 5356694 - DNA, 17 bp, Homo sapiens
agaaacacactgaggca

SEQ ID NO: 5356695 - DNA, 19 bp, Homo sapiens
agaaacacactgaggcagg

SEQ ID NO: 5356696 - DNA, 22 bp, Homo sapiens
agaaacacactgaggcagggaa

SEQ ID NO: 5356697 - DNA, 20 bp, Homo sapiens
agaaacacagcatgcattta

SEQ ID NO: 5356698 - DNA, 19 bp, Homo sapiens
agaaacacagggttttgta

SEQ ID NO: 5356699 - DNA, 20 bp, Homo sapiens
agaaacacataattaacact

SEQ ID NO: 5356700 - DNA, 13 bp, Homo sapiens
agaaacacattct

SEQ ID NO: 5356701 - DNA, 19 bp, Homo sapiens
agaaacacattcttattaa

SEQ ID NO: 5356702 - DNA, 16 bp, Homo sapiens
agaaacaccacttaat

SEQ ID NO: 5356703 - DNA, 21 bp, Homo sapiens
agaaacaccacttaatcttct

SEQ ID NO: 5356704 - DNA, 19 bp, Homo sapiens
agaaacacctagatcagaa

SEQ ID NO: 5356705 - DNA, 18 bp, Homo sapiens
agaaacacggagtttcca

SEQ ID NO: 5356706 - DNA, 20 bp, Homo sapiens
agaaacacggagtttccatt

SEQ ID NO: 5356707 - DNA, 12 bp, Homo sapiens
agaaacactaaa

SEQ ID NO: 5356708 - DNA, 18 bp, Homo sapiens
agaaacactatttgtgac

SEQ ID NO: 5356709 - DNA, 13 bp, Homo sapiens
agaaacactcaag

SEQ ID NO: 5356710 - DNA, 17 bp, Homo sapiens
agaaacactgaaaagaa

SEQ ID NO: 5356711 - DNA, 18 bp, Homo sapiens
agaaacactgaagccatt

SEQ ID NO: 5356712 - DNA, 22 bp, Homo sapiens
agaaacactgcaaattttaact

SEQ ID NO: 5356713 - DNA, 15 bp, Homo sapiens
agaaacactttctct

SEQ ID NO: 5356714 - DNA, 15 bp, Homo sapiens
agaaacagaagaaaa

SEQ ID NO: 5356715 - DNA, 16 bp, Homo sapiens
agaaacagaagaaaaa

SEQ ID NO: 5356716 - DNA, 23 bp, Homo sapiens
agaaacagacagaaagagacaca

SEQ ID NO: 5356717 - DNA, 14 bp, Homo sapiens
agaaacagatacca

SEQ ID NO: 5356718 - DNA, 11 bp, Homo sapiens
agaaacagatt

SEQ ID NO: 5356719 - DNA, 13 bp, Homo sapiens
agaaacagccagc

SEQ ID NO: 5356720 - DNA, 13 bp, Homo sapiens
agaaacagctcag

SEQ ID NO: 5356721 - DNA, 17 bp, Homo sapiens
agaaacagctgcttctc

SEQ ID NO: 5356722 - DNA, 23 bp, Homo sapiens
agaaacagctgcttctcccccca

SEQ ID NO: 5356723 - DNA, 17 bp, Homo sapiens
agaaacagctttcaagt

SEQ ID NO: 5356724 - DNA, 20 bp, Homo sapiens
agaaacagctttcaagtgcc

SEQ ID NO: 5356725 - DNA, 13 bp, Homo sapiens
agaaacaggccca

SEQ ID NO: 5356726 - DNA, 17 bp, Homo sapiens
agaaacaggcccagaga

SEQ ID NO: 5356727 - DNA, 16 bp, Homo sapiens
agaaacaggctctgag

SEQ ID NO: 5356728 - DNA, 18 bp, Homo sapiens
agaaacagggacaaagaa

SEQ ID NO: 5356729 - DNA, 21 bp, Homo sapiens
agaaacagggggaaaatgttt

SEQ ID NO: 5356730 - DNA, 17 bp, Homo sapiens
agaaacagtattttctt

SEQ ID NO: 5356731 - DNA, 12 bp, Homo sapiens
agaaacagtgag

SEQ ID NO: 5356732 - DNA, 20 bp, Homo sapiens
agaaacagtgggagccctga

SEQ ID NO: 5356733 - DNA, 21 bp, Homo sapiens
agaaacagtgggagccctgac

SEQ ID NO: 5356734 - DNA, 12 bp, Homo sapiens
agaaacagtgtg

SEQ ID NO: 5356735 - DNA, 14 bp, Homo sapiens
agaaacagtgtgca

SEQ ID NO: 5356736 - DNA, 16 bp, Homo sapiens
agaaacataaataaaa

SEQ ID NO: 5356737 - DNA, 17 bp, Homo sapiens
agaaacataaataaaat

SEQ ID NO: 5356738 - DNA, 22 bp, Homo sapiens
agaaacataaataaaatgacca

SEQ ID NO: 5356739 - DNA, 13 bp, Homo sapiens
agaaacataattt

SEQ ID NO: 5356740 - DNA, 22 bp, Homo sapiens
agaaacataattttttttttct

SEQ ID NO: 5356741 - DNA, 23 bp, Homo sapiens
agaaacatagtaattagtagaaa

SEQ ID NO: 5356742 - DNA, 17 bp, Homo sapiens
agaaacatgaattattt

SEQ ID NO: 5356743 - DNA, 17 bp, Homo sapiens
agaaacatgacactgac

SEQ ID NO: 5356744 - DNA, 13 bp, Homo sapiens
agaaacattgtaa

SEQ ID NO: 5356745 - DNA, 14 bp, Homo sapiens
agaaacattgtaaa

SEQ ID NO: 5356746 - DNA, 18 bp, Homo sapiens
agaaacattgtaaatatt

SEQ ID NO: 5356747 - DNA, 17 bp, Homo sapiens
agaaacattgttaatat

SEQ ID NO: 5356748 - DNA, 15 bp, Homo sapiens
agaaacatttagatt

SEQ ID NO: 5356749 - DNA, 17 bp, Homo sapiens
agaaacatttagattta

SEQ ID NO: 5356750 - DNA, 17 bp, Homo sapiens
agaaacatttatctttg

SEQ ID NO: 5356751 - DNA, 19 bp, Homo sapiens
agaaaccaagtgggctggt

SEQ ID NO: 5356752 - DNA, 18 bp, Homo sapiens
agaaaccaatcaagataa

SEQ ID NO: 5356753 - DNA, 22 bp, Homo sapiens
agaaaccacagtcttcccagca

SEQ ID NO: 5356754 - DNA, 18 bp, Homo sapiens
agaaaccagctcatgtgt

SEQ ID NO: 5356755 - DNA, 13 bp, Homo sapiens
agaaaccagcttc

SEQ ID NO: 5356756 - DNA, 14 bp, Homo sapiens
agaaaccagcttcc

SEQ ID NO: 5356757 - DNA, 20 bp, Homo sapiens
agaaaccagcttccttcaga

SEQ ID NO: 5356758 - DNA, 21 bp, Homo sapiens
agaaaccagcttccttcagag

SEQ ID NO: 5356759 - DNA, 15 bp, Homo sapiens
agaaaccagtatgga

SEQ ID NO: 5356760 - DNA, 15 bp, Homo sapiens
agaaaccatgacaaa

SEQ ID NO: 5356761 - DNA, 23 bp, Homo sapiens
agaaaccatgacaaacctagctt

SEQ ID NO: 5356762 - DNA, 20 bp, Homo sapiens
agaaaccattgttcagaaga

SEQ ID NO: 5356763 - DNA, 20 bp, Homo sapiens
agaaaccatttttaatgaga

SEQ ID NO: 5356764 - DNA, 17 bp, Homo sapiens
agaaacccaagctcctc

SEQ ID NO: 5356765 - DNA, 17 bp, Homo sapiens
agaaacccaccagccta

SEQ ID NO: 5356766 - DNA, 22 bp, Homo sapiens
agaaacccacgacctgtcctgt

SEQ ID NO: 5356767 - DNA, 12 bp, Homo sapiens
agaaacccagag

SEQ ID NO: 5356768 - DNA, 12 bp, Homo sapiens
agaaacccaggg

SEQ ID NO: 5356769 - DNA, 15 bp, Homo sapiens
agaaaccccaagcag

SEQ ID NO: 5356770 - DNA, 16 bp, Homo sapiens
agaaaccccacttcca

SEQ ID NO: 5356771 - DNA, 22 bp, Homo sapiens
agaaacccctgacaccttttca

SEQ ID NO: 5356772 - DNA, 19 bp, Homo sapiens
agaaacccctggggaccat

SEQ ID NO: 5356773 - DNA, 18 bp, Homo sapiens
agaaacccggcttcctgt

SEQ ID NO: 5356774 - DNA, 17 bp, Homo sapiens
agaaaccgtaattttat

SEQ ID NO: 5356775 - DNA, 18 bp, Homo sapiens
agaaaccgtaattttatt

SEQ ID NO: 5356776 - DNA, 16 bp, Homo sapiens
agaaacctactgccca

SEQ ID NO: 5356777 - DNA, 18 bp, Homo sapiens
agaaacctatctcaggga

SEQ ID NO: 5356778 - DNA, 19 bp, Homo sapiens
agaaacctatctcagggag

SEQ ID NO: 5356779 - DNA, 20 bp, Homo sapiens
agaaacctatctcagggagg

SEQ ID NO: 5356780 - DNA, 18 bp, Homo sapiens
agaaacctattaagtcat

SEQ ID NO: 5356781 - DNA, 19 bp, Homo sapiens
agaaacctattaagtcatc

SEQ ID NO: 5356782 - DNA, 18 bp, Homo sapiens
agaaacctcattggccag

SEQ ID NO: 5356783 - DNA, 21 bp, Homo sapiens
agaaacctccatcctgccagg

SEQ ID NO: 5356784 - DNA, 22 bp, Homo sapiens
agaaacctccatcctgccagga

SEQ ID NO: 5356785 - DNA, 22 bp, Homo sapiens
agaaacctgactcaattatttg

SEQ ID NO: 5356786 - DNA, 21 bp, Homo sapiens
agaaacctgcatgaaagcatt

SEQ ID NO: 5356787 - DNA, 22 bp, Homo sapiens
agaaacctgcatgaaagcattc

SEQ ID NO: 5356788 - DNA, 23 bp, Homo sapiens
agaaacctggggtgaatacttat

SEQ ID NO: 5356789 - DNA, 14 bp, Homo sapiens
agaaacctgtatct

SEQ ID NO: 5356790 - DNA, 15 bp, Homo sapiens
agaaacctgtatctt

SEQ ID NO: 5356791 - DNA, 16 bp, Homo sapiens
agaaacctgtatcttt

SEQ ID NO: 5356792 - DNA, 19 bp, Homo sapiens
agaaacctgtatctttcta

SEQ ID NO: 5356793 - DNA, 18 bp, Homo sapiens
agaaacctgttgaagatt

SEQ ID NO: 5356794 - DNA, 16 bp, Homo sapiens
agaaaccttattgtac

SEQ ID NO: 5356795 - DNA, 23 bp, Homo sapiens
agaaaccttccaatgcttctgtt

SEQ ID NO: 5356796 - DNA, 20 bp, Homo sapiens
agaaaccttccagagaacac

SEQ ID NO: 5356797 - DNA, 15 bp, Homo sapiens
agaaaccttgcaaac

SEQ ID NO: 5356798 - DNA, 15 bp, Homo sapiens
agaaaccttgctctc

SEQ ID NO: 5356799 - DNA, 22 bp, Homo sapiens
agaaaccttttaaaaaaataat

SEQ ID NO: 5356800 - DNA, 23 bp, Homo sapiens
agaaaccttttaaaaaaataata

SEQ ID NO: 5356801 - DNA, 23 bp, Homo sapiens
agaaaccttttatttttatttct

SEQ ID NO: 5356802 - DNA, 19 bp, Homo sapiens
agaaacgcaacaagaaact

SEQ ID NO: 5356803 - DNA, 15 bp, Homo sapiens
agaaacgcatccagc

SEQ ID NO: 5356804 - DNA, 15 bp, Homo sapiens
agaaacgcctgcccc

SEQ ID NO: 5356805 - DNA, 19 bp, Homo sapiens
agaaacggaatagtgtggg

SEQ ID NO: 5356806 - DNA, 21 bp, Homo sapiens
agaaacggtatgacttaattt

SEQ ID NO: 5356807 - DNA, 19 bp, Homo sapiens
agaaattggtaccttgcac

SEQ ID NO: 5356808 - DNA, 15 bp, Homo sapiens
agaaattgtccttga

SEQ ID NO: 5356809 - DNA, 19 bp, Homo sapiens
agaaattgtccttgaagct

SEQ ID NO: 5356810 - DNA, 23 bp, Homo sapiens
agaaattgtccttgaagcttgta

SEQ ID NO: 5356811 - DNA, 16 bp, Homo sapiens
agaaattgtgccaaag

SEQ ID NO: 5356812 - DNA, 17 bp, Homo sapiens
agaaattgtgtgtgcaa

SEQ ID NO: 5356813 - DNA, 21 bp, Homo sapiens
agaaatttaaaagcagagcat

SEQ ID NO: 5356814 - DNA, 24 bp, Homo sapiens
agaaatttaaactataagcaagaa

SEQ ID NO: 5356815 - DNA, 17 bp, Homo sapiens
agaaatttaattcatgt

SEQ ID NO: 5356816 - DNA, 22 bp, Homo sapiens
agaaatttaattcatgtttctt

SEQ ID NO: 5356817 - DNA, 14 bp, Homo sapiens
agaaatttactata

SEQ ID NO: 5356818 - DNA, 15 bp, Homo sapiens
agaaatttactatat

SEQ ID NO: 5356819 - DNA, 20 bp, Homo sapiens
agaaatttatgaagcagatt

SEQ ID NO: 5356820 - DNA, 13 bp, Homo sapiens
agaaatttatttc

SEQ ID NO: 5356821 - DNA, 15 bp, Homo sapiens
agaaatttatttcct

SEQ ID NO: 5356822 - DNA, 19 bp, Homo sapiens
agaaatttcaggttgttgg

SEQ ID NO: 5356823 - DNA, 12 bp, Homo sapiens
agaaatttgaaa

SEQ ID NO: 5356824 - DNA, 18 bp, Homo sapiens
agaaatttgaaaaaactt

SEQ ID NO: 5356825 - DNA, 20 bp, Homo sapiens
agaaatttgtggttgcatgt

SEQ ID NO: 5356826 - DNA, 22 bp, Homo sapiens
agaaattttacaataggtgctt

SEQ ID NO: 5356827 - DNA, 15 bp, Homo sapiens
agaaattttatctct

SEQ ID NO: 5356828 - DNA, 13 bp, Homo sapiens
agaaattttcaag

SEQ ID NO: 5356829 - DNA, 13 bp, Homo sapiens
agaaattttctac

SEQ ID NO: 5356830 - DNA, 19 bp, Homo sapiens
agaaattttgaagtcagag

SEQ ID NO: 5356831 - DNA, 18 bp, Homo sapiens
agaaatttttcagatgct

SEQ ID NO: 5356832 - DNA, 17 bp, Homo sapiens
agaaattttttcatgca

SEQ ID NO: 5356833 - DNA, 13 bp, Homo sapiens
agaacaaaaacta

SEQ ID NO: 5356834 - DNA, 16 bp, Homo sapiens
agaacaaaaactatta

SEQ ID NO: 5356835 - DNA, 22 bp, Homo sapiens
agaacaaaaagaaatcttgtct

SEQ ID NO: 5356836 - DNA, 22 bp, Homo sapiens
agaacaaaacagtcctttaaat

SEQ ID NO: 5356837 - DNA, 23 bp, Homo sapiens
agaacaaaacagtcctttaaatt

SEQ ID NO: 5356838 - DNA, 20 bp, Homo sapiens
agaacaaaacctcttctgta

SEQ ID NO: 5356839 - DNA, 16 bp, Homo sapiens
agaacaaacaaaactt

SEQ ID NO: 5356840 - DNA, 20 bp, Homo sapiens
agaacaaacacctccccagc

SEQ ID NO: 5356841 - DNA, 14 bp, Homo sapiens
agaacaaacagaaa

SEQ ID NO: 5356842 - DNA, 15 bp, Homo sapiens
agaacaaacctctat

SEQ ID NO: 5356843 - DNA, 19 bp, Homo sapiens
agaacaaacctctatatgt

SEQ ID NO: 5356844 - DNA, 18 bp, Homo sapiens
agaacaaagagtgaaata

SEQ ID NO: 5356845 - DNA, 17 bp, Homo sapiens
agaacaaagctgttaaa

SEQ ID NO: 5356846 - DNA, 18 bp, Homo sapiens
agaacaaagctgttaaac

SEQ ID NO: 5356847 - DNA, 22 bp, Homo sapiens
agaacaaaggacagagtatgaa

SEQ ID NO: 5356848 - DNA, 20 bp, Homo sapiens
agaacaaaggggcttaatta

SEQ ID NO: 5356849 - DNA, 14 bp, Homo sapiens
agaacaaatacact

SEQ ID NO: 5356850 - DNA, 15 bp, Homo sapiens
agaacaaatgaagac

SEQ ID NO: 5356851 - DNA, 20 bp, Homo sapiens
agaacaaatgtgtttttcta

SEQ ID NO: 5356852 - DNA, 15 bp, Homo sapiens
agaacaacaggcagg

SEQ ID NO: 5356853 - DNA, 18 bp, Homo sapiens
agaacaacttgctactta

SEQ ID NO: 5356854 - DNA, 14 bp, Homo sapiens
agaacaagaaatgg

SEQ ID NO: 5356855 - DNA, 13 bp, Homo sapiens
agaacaagagacc

SEQ ID NO: 5356856 - DNA, 21 bp, Homo sapiens
agaacaagagacccctgtctg

SEQ ID NO: 5356857 - DNA, 12 bp, Homo sapiens
agaacaagcaaa

SEQ ID NO: 5356858 - DNA, 16 bp, Homo sapiens
agaacaagccagagcc

SEQ ID NO: 5356859 - DNA, 17 bp, Homo sapiens
agaacaaggtagttttt

SEQ ID NO: 5356860 - DNA, 21 bp, Homo sapiens
agaacaagtcacagctgcagc

SEQ ID NO: 5356861 - DNA, 19 bp, Homo sapiens
agaacaagttgttaaaaca

SEQ ID NO: 5356862 - DNA, 22 bp, Homo sapiens
agaacaagttttggcagccatg

SEQ ID NO: 5356863 - DNA, 15 bp, Homo sapiens
agaacaataatgaga

SEQ ID NO: 5356864 - DNA, 20 bp, Homo sapiens
agaacaataatgagagcaaa

SEQ ID NO: 5356865 - DNA, 22 bp, Homo sapiens
agaacaataatgagagcaaatg

SEQ ID NO: 5356866 - DNA, 21 bp, Homo sapiens
agaacaatagctattgcatgt

SEQ ID NO: 5356867 - DNA, 19 bp, Homo sapiens
agaacaataggtaaagcta

SEQ ID NO: 5356868 - DNA, 17 bp, Homo sapiens
agaacaatattgacttt

SEQ ID NO: 5356869 - DNA, 17 bp, Homo sapiens
agaacaatctggatttc

SEQ ID NO: 5356870 - DNA, 17 bp, Homo sapiens
agaacaatgggaggctg

SEQ ID NO: 5356871 - DNA, 15 bp, Homo sapiens
agaacaatgtgctat

SEQ ID NO: 5356872 - DNA, 16 bp, Homo sapiens
agaacaattatgtttc

SEQ ID NO: 5356873 - DNA, 23 bp, Homo sapiens
agaacaattcacagtatgagaag

SEQ ID NO: 5356874 - DNA, 13 bp, Homo sapiens
agaacaattgtcc

SEQ ID NO: 5356875 - DNA, 18 bp, Homo sapiens
agaacacaaaacttgaaa

SEQ ID NO: 5356876 - DNA, 11 bp, Homo sapiens
agaacacaaga

SEQ ID NO: 5356877 - DNA, 20 bp, Homo sapiens
agaacacaagccacgcctgc

SEQ ID NO: 5356878 - DNA, 12 bp, Homo sapiens
agaacacacaca

SEQ ID NO: 5356879 - DNA, 14 bp, Homo sapiens
agaacacacacact

SEQ ID NO: 5356880 - DNA, 15 bp, Homo sapiens
agaacacacacactt

SEQ ID NO: 5356881 - DNA, 18 bp, Homo sapiens
agaacacacagactttct

SEQ ID NO: 5356882 - DNA, 20 bp, Homo sapiens
agaacacagcaattcctcag

SEQ ID NO: 5356883 - DNA, 15 bp, Homo sapiens
agaacacagcatgtg

SEQ ID NO: 5356884 - DNA, 16 bp, Homo sapiens
agaacacagcatgtgc

SEQ ID NO: 5356885 - DNA, 18 bp, Homo sapiens
agaacacagcatgtgcca

SEQ ID NO: 5356886 - DNA, 21 bp, Homo sapiens
agaacacagccgattcacctg

SEQ ID NO: 5356887 - DNA, 18 bp, Homo sapiens
agaacacccactggccag

SEQ ID NO: 5356888 - DNA, 15 bp, Homo sapiens
agaacacccctgtgc

SEQ ID NO: 5356889 - DNA, 20 bp, Homo sapiens
agaacacctgacaacttctg

SEQ ID NO: 5356890 - DNA, 16 bp, Homo sapiens
agaacacgttgccagg

SEQ ID NO: 5356891 - DNA, 14 bp, Homo sapiens
agaacactaacctg

SEQ ID NO: 5356892 - DNA, 15 bp, Homo sapiens
agaacactaattcat

SEQ ID NO: 5356893 - DNA, 14 bp, Homo sapiens
agaacactgagata

SEQ ID NO: 5356894 - DNA, 13 bp, Homo sapiens
agaacactgccaa

SEQ ID NO: 5356895 - DNA, 22 bp, Homo sapiens
agaacactgtagctacattttc

SEQ ID NO: 5356896 - DNA, 17 bp, Homo sapiens
agaacactgtgaaaaca

SEQ ID NO: 5356897 - DNA, 12 bp, Homo sapiens
agaacagaaaac

SEQ ID NO: 5356898 - DNA, 15 bp, Homo sapiens
agaacagaaaacaac

SEQ ID NO: 5356899 - DNA, 16 bp, Homo sapiens
agaacagaaaacaaca

SEQ ID NO: 5356900 - DNA, 11 bp, Homo sapiens
agaacagaaat

SEQ ID NO: 5356901 - DNA, 17 bp, Homo sapiens
agaacagaaatatataa

SEQ ID NO: 5356902 - DNA, 21 bp, Homo sapiens
agaacagaaatatataaaaat

SEQ ID NO: 5356903 - DNA, 18 bp, Homo sapiens
agaacagacgttaccaat

SEQ ID NO: 5356904 - DNA, 19 bp, Homo sapiens
agaacagatctccaaagct

SEQ ID NO: 5356905 - DNA, 20 bp, Homo sapiens
agaacagcaagtatgaacca

SEQ ID NO: 5356906 - DNA, 18 bp, Homo sapiens
agaacagcagactcagct

SEQ ID NO: 5356907 - DNA, 17 bp, Homo sapiens
agaacagcaggcccacc

SEQ ID NO: 5356908 - DNA, 15 bp, Homo sapiens
agaacagcattgtcc

SEQ ID NO: 5356909 - DNA, 12 bp, Homo sapiens
agaacagccccg

SEQ ID NO: 5356910 - DNA, 18 bp, Homo sapiens
agaacagccccggggccc

SEQ ID NO: 5356911 - DNA, 18 bp, Homo sapiens
agaacagccgctcctgtc

SEQ ID NO: 5356912 - DNA, 23 bp, Homo sapiens
agaacagccgctcctgtctgcca

SEQ ID NO: 5356913 - DNA, 22 bp, Homo sapiens
agaacagcgggtacttatttct

SEQ ID NO: 5356914 - DNA, 21 bp, Homo sapiens
agaacaggaggtgtgaatgca

SEQ ID NO: 5356915 - DNA, 16 bp, Homo sapiens
agaacaggcaagtgaa

SEQ ID NO: 5356916 - DNA, 19 bp, Homo sapiens
agaacaggcagaaatataa

SEQ ID NO: 5356917 - DNA, 20 bp, Homo sapiens
agaacaggcagaaatataaa

SEQ ID NO: 5356918 - DNA, 16 bp, Homo sapiens
agaacaggctggttct

SEQ ID NO: 5356919 - DNA, 19 bp, Homo sapiens
agaacagggaaaataggca

SEQ ID NO: 5356920 - DNA, 13 bp, Homo sapiens
agaacagggatgc

SEQ ID NO: 5356921 - DNA, 18 bp, Homo sapiens
agaacagggtttctcagc

SEQ ID NO: 5356922 - DNA, 12 bp, Homo sapiens
agaacaggtttt

SEQ ID NO: 5356923 - DNA, 21 bp, Homo sapiens
agaacaggtttttttgtttgt

SEQ ID NO: 5356924 - DNA, 17 bp, Homo sapiens
agaacagtattgggcag

SEQ ID NO: 5356925 - DNA, 19 bp, Homo sapiens
agaacagtattgggcagga

SEQ ID NO: 5356926 - DNA, 22 bp, Homo sapiens
agaacagtattgggcaggagga

SEQ ID NO: 5356927 - DNA, 21 bp, Homo sapiens
agaacagtcatgtatgcaagt

SEQ ID NO: 5356928 - DNA, 19 bp, Homo sapiens
agaacagtctgaaatacct

SEQ ID NO: 5356929 - DNA, 20 bp, Homo sapiens
agaacagtctgaaatacctt

SEQ ID NO: 5356930 - DNA, 16 bp, Homo sapiens
agaacagtgaaaggta

SEQ ID NO: 5356931 - DNA, 22 bp, Homo sapiens
agaacagtgggcgttgggagcc

SEQ ID NO: 5356932 - DNA, 22 bp, Homo sapiens
agaacagtgttgaaattggaaa

SEQ ID NO: 5356933 - DNA, 15 bp, Homo sapiens
agaacagtgtttgat

SEQ ID NO: 5356934 - DNA, 16 bp, Homo sapiens
agaacagtgtttgatt

SEQ ID NO: 5356935 - DNA, 21 bp, Homo sapiens
agaacagtttcatcaggacca

SEQ ID NO: 5356936 - DNA, 17 bp, Homo sapiens
agaacataaaggtaaaa

SEQ ID NO: 5356937 - DNA, 13 bp, Homo sapiens
agaacatacactg

SEQ ID NO: 5356938 - DNA, 18 bp, Homo sapiens
agaacatacactgtgaac

SEQ ID NO: 5356939 - DNA, 17 bp, Homo sapiens
agaacatacatgataca

SEQ ID NO: 5356940 - DNA, 14 bp, Homo sapiens
agaacatactgatt

SEQ ID NO: 5356941 - DNA, 19 bp, Homo sapiens
agaacatagacagaagaaa

SEQ ID NO: 5356942 - DNA, 19 bp, Homo sapiens
agaacatcataaaattttt

SEQ ID NO: 5356943 - DNA, 20 bp, Homo sapiens
agaacatcattagaacaaag

SEQ ID NO: 5356944 - DNA, 17 bp, Homo sapiens
agaacatccttaaatgt

SEQ ID NO: 5356945 - DNA, 19 bp, Homo sapiens
agaacatctgccttgctgc

SEQ ID NO: 5356946 - DNA, 20 bp, Homo sapiens
agaacatctgccttgctgca

SEQ ID NO: 5356947 - DNA, 20 bp, Homo sapiens
agaacatctgtataccctct

SEQ ID NO: 5356948 - DNA, 18 bp, Homo sapiens
agaacatctgtcctgtga

SEQ ID NO: 5356949 - DNA, 14 bp, Homo sapiens
agaacatgaaatgc

SEQ ID NO: 5356950 - DNA, 15 bp, Homo sapiens
agaacatgaatctct

SEQ ID NO: 5356951 - DNA, 22 bp, Homo sapiens
agaacatgaggataacttcctt

SEQ ID NO: 5356952 - DNA, 23 bp, Homo sapiens
agaacatgaggataacttccttg

SEQ ID NO: 5356953 - DNA, 15 bp, Homo sapiens
agaacatgagtgctg

SEQ ID NO: 5356954 - DNA, 21 bp, Homo sapiens
agaacatgagtttatgggaat

SEQ ID NO: 5356955 - DNA, 16 bp, Homo sapiens
agaacatgcaagaatt

SEQ ID NO: 5356956 - DNA, 20 bp, Homo sapiens
agaacatgcacatttatata

SEQ ID NO: 5356957 - DNA, 18 bp, Homo sapiens
agaacatgcagtttgaaa

SEQ ID NO: 5356958 - DNA, 22 bp, Homo sapiens
agaacatgcagtttgaaattct

SEQ ID NO: 5356959 - DNA, 14 bp, Homo sapiens
agaacatggacttg

SEQ ID NO: 5356960 - DNA, 16 bp, Homo sapiens
agaacatggacttgta

SEQ ID NO: 5356961 - DNA, 19 bp, Homo sapiens
agaacatggacttgtatat

SEQ ID NO: 5356962 - DNA, 18 bp, Homo sapiens
agaacatggtgtgtgtct

SEQ ID NO: 5356963 - DNA, 14 bp, Homo sapiens
agaacatgtagaaa

SEQ ID NO: 5356964 - DNA, 17 bp, Homo sapiens
agaacatgtagaaaaca

SEQ ID NO: 5356965 - DNA, 22 bp, Homo sapiens
agaacatgtgagaggtttgact

SEQ ID NO: 5356966 - DNA, 12 bp, Homo sapiens
agaacatgttaa

SEQ ID NO: 5356967 - DNA, 21 bp, Homo sapiens
agaacatgttaagataactta

SEQ ID NO: 5356968 - DNA, 16 bp, Homo sapiens
agaacatgttggtatt

SEQ ID NO: 5356969 - DNA, 20 bp, Homo sapiens
agaacatgttggtatttatc

SEQ ID NO: 5356970 - DNA, 21 bp, Homo sapiens
agaacatgttggtatttatct

SEQ ID NO: 5356971 - DNA, 22 bp, Homo sapiens
agaacatgttggtatttatcta

SEQ ID NO: 5356972 - DNA, 20 bp, Homo sapiens
agaacattaattatatgtat

SEQ ID NO: 5356973 - DNA, 16 bp, Homo sapiens
agaacattaggcccca

SEQ ID NO: 5356974 - DNA, 17 bp, Homo sapiens
agaacattaggccccag

SEQ ID NO: 5356975 - DNA, 19 bp, Homo sapiens
agaacattaggccccagca

SEQ ID NO: 5356976 - DNA, 13 bp, Homo sapiens
agaacattattca

SEQ ID NO: 5356977 - DNA, 17 bp, Homo sapiens
agaacattcacttttgt

SEQ ID NO: 5356978 - DNA, 17 bp, Homo sapiens
agaacattcagctctgg

SEQ ID NO: 5356979 - DNA, 21 bp, Homo sapiens
agaacattcagctctggagaa

SEQ ID NO: 5356980 - DNA, 17 bp, Homo sapiens
agaacattccatttgaa

SEQ ID NO: 5356981 - DNA, 17 bp, Homo sapiens
agaacattccatttgct

SEQ ID NO: 5356982 - DNA, 18 bp, Homo sapiens
agaacattccatttgctt

SEQ ID NO: 5356983 - DNA, 22 bp, Homo sapiens
agaacattcgaatctctgcccc

SEQ ID NO: 5356984 - DNA, 20 bp, Homo sapiens
agaagacaaagtctaaggaa

SEQ ID NO: 5356985 - DNA, 15 bp, Homo sapiens
agaagacaattgaca

SEQ ID NO: 5356986 - DNA, 15 bp, Homo sapiens
agaagacaccagagc

SEQ ID NO: 5356987 - DNA, 18 bp, Homo sapiens
agaagacaccagagcaga

SEQ ID NO: 5356988 - DNA, 23 bp, Homo sapiens
agaagacaccagagcagatgcag

SEQ ID NO: 5356989 - DNA, 13 bp, Homo sapiens
agaagacactaat

SEQ ID NO: 5356990 - DNA, 13 bp, Homo sapiens
agaagacaggctg

SEQ ID NO: 5356991 - DNA, 16 bp, Homo sapiens
agaagacatgaaccaa

SEQ ID NO: 5356992 - DNA, 19 bp, Homo sapiens
agaagacatggagactcct

SEQ ID NO: 5356993 - DNA, 10 bp, Homo sapiens
agaagacatt

SEQ ID NO: 5356994 - DNA, 15 bp, Homo sapiens
agaagacattctggt

SEQ ID NO: 5356995 - DNA, 11 bp, Homo sapiens
agaagacattt

SEQ ID NO: 5356996 - DNA, 15 bp, Homo sapiens
agaagacatttgcca

SEQ ID NO: 5356997 - DNA, 15 bp, Homo sapiens
agaagacattttgtt

SEQ ID NO: 5356998 - DNA, 20 bp, Homo sapiens
agaagaccagtcacagccat

SEQ ID NO: 5356999 - DNA, 17 bp, Homo sapiens
agaagacccctgcccaa

SEQ ID NO: 5357000 - DNA, 15 bp, Homo sapiens
agaagacctagctat

SEQ ID NO: 5357001 - DNA, 17 bp, Homo sapiens
agaagacctgagaatgt

SEQ ID NO: 5357002 - DNA, 22 bp, Homo sapiens
agaagacgggaggggaggcatt

SEQ ID NO: 5357003 - DNA, 18 bp, Homo sapiens
agaagacgtggtctagac

SEQ ID NO: 5357004 - DNA, 19 bp, Homo sapiens
agaagactctaccagactg

SEQ ID NO: 5357005 - DNA, 19 bp, Homo sapiens
agaagactgggctagggag

SEQ ID NO: 5357006 - DNA, 22 bp, Homo sapiens
agaagacttcaatattaaatga

SEQ ID NO: 5357007 - DNA, 21 bp, Homo sapiens
agaagacttctttgcaacaat

SEQ ID NO: 5357008 - DNA, 24 bp, Homo sapiens
agaagacttgatttttccgtccct

SEQ ID NO: 5357009 - DNA, 18 bp, Homo sapiens
agaagactttaattatat

SEQ ID NO: 5357010 - DNA, 19 bp, Homo sapiens
agaagactttaattatata

SEQ ID NO: 5357011 - DNA, 23 bp, Homo sapiens
agaagagaaaccatcctctccct

SEQ ID NO: 5357012 - DNA, 12 bp, Homo sapiens
agaagagaaagg

SEQ ID NO: 5357013 - DNA, 14 bp, Homo sapiens
agaagagaaagtac

SEQ ID NO: 5357014 - DNA, 17 bp, Homo sapiens
agaagagaaatacagct

SEQ ID NO: 5357015 - DNA, 19 bp, Homo sapiens
agaagagaaatacagctgg

SEQ ID NO: 5357016 - DNA, 13 bp, Homo sapiens
agaagagaaggaa

SEQ ID NO: 5357017 - DNA, 23 bp, Homo sapiens
agaagagaatgcacaaacagagg

SEQ ID NO: 5357018 - DNA, 18 bp, Homo sapiens
agaagagactctttgcat

SEQ ID NO: 5357019 - DNA, 21 bp, Homo sapiens
agaagagaggggaagaattta

SEQ ID NO: 5357020 - DNA, 22 bp, Homo sapiens
agaagagatgggcttgttttct

SEQ ID NO: 5357021 - DNA, 14 bp, Homo sapiens
agaagagccacagt

SEQ ID NO: 5357022 - DNA, 22 bp, Homo sapiens
agaagagccacagtgagggaga

SEQ ID NO: 5357023 - DNA, 11 bp, Homo sapiens
agaagagccat

SEQ ID NO: 5357024 - DNA, 13 bp, Homo sapiens
agaagagccccac

SEQ ID NO: 5357025 - DNA, 20 bp, Homo sapiens
agaagagccccactctcaga

SEQ ID NO: 5357026 - DNA, 17 bp, Homo sapiens
agaagagccctggacac

SEQ ID NO: 5357027 - DNA, 20 bp, Homo sapiens
agaagagccggagcctccag

SEQ ID NO: 5357028 - DNA, 20 bp, Homo sapiens
agaagagccttcacatgaaa

SEQ ID NO: 5357029 - DNA, 12 bp, Homo sapiens
agaagagcgcag

SEQ ID NO: 5357030 - DNA, 20 bp, Homo sapiens
agaagagcttgcacagccaa

SEQ ID NO: 5357031 - DNA, 13 bp, Homo sapiens
agaagaggaagaa

SEQ ID NO: 5357032 - DNA, 14 bp, Homo sapiens
agaagaggaagaaa

SEQ ID NO: 5357033 - DNA, 12 bp, Homo sapiens
agaagaggaagt

SEQ ID NO: 5357034 - DNA, 17 bp, Homo sapiens
agaagaggagaaaaaga

SEQ ID NO: 5357035 - DNA, 13 bp, Homo sapiens
agaagaggagcct

SEQ ID NO: 5357036 - DNA, 15 bp, Homo sapiens
agaagaggagcctca

SEQ ID NO: 5357037 - DNA, 17 bp, Homo sapiens
agaagaggagcctcaga

SEQ ID NO: 5357038 - DNA, 22 bp, Homo sapiens
agaagaggaggagggattctgg

SEQ ID NO: 5357039 - DNA, 15 bp, Homo sapiens
agaagaggagggacc

SEQ ID NO: 5357040 - DNA, 21 bp, Homo sapiens
agaagaggcatcctgcctggg

SEQ ID NO: 5357041 - DNA, 12 bp, Homo sapiens
agaagagggaga

SEQ ID NO: 5357042 - DNA, 13 bp, Homo sapiens
agaagagggagaa

SEQ ID NO: 5357043 - DNA, 20 bp, Homo sapiens
agaagagggagaaggagagg

SEQ ID NO: 5357044 - DNA, 22 bp, Homo sapiens
agaagagggagaaggagaggct

SEQ ID NO: 5357045 - DNA, 18 bp, Homo sapiens
agaagagggcctgtggga

SEQ ID NO: 5357046 - DNA, 24 bp, Homo sapiens
agaagagggcctgtgggagcctgc

SEQ ID NO: 5357047 - DNA, 15 bp, Homo sapiens
agaagaggggttttt

SEQ ID NO: 5357048 - DNA, 21 bp, Homo sapiens
agaagaggtggccccatatta

SEQ ID NO: 5357049 - DNA, 20 bp, Homo sapiens
agaagaggttgggcttccat

SEQ ID NO: 5357050 - DNA, 19 bp, Homo sapiens
agaagagtaacacttgaaa

SEQ ID NO: 5357051 - DNA, 14 bp, Homo sapiens
agaagagtattttt

SEQ ID NO: 5357052 - DNA, 14 bp, Homo sapiens
agaagagtcaggaa

SEQ ID NO: 5357053 - DNA, 15 bp, Homo sapiens
agaagagtctattgt

SEQ ID NO: 5357054 - DNA, 22 bp, Homo sapiens
agaagagtctttgattcaccaa

SEQ ID NO: 5357055 - DNA, 16 bp, Homo sapiens
agaagagtgccctgct

SEQ ID NO: 5357056 - DNA, 17 bp, Homo sapiens
agaagagtgccctgctt

SEQ ID NO: 5357057 - DNA, 22 bp, Homo sapiens
agaagagtgccctgctttgcaa

SEQ ID NO: 5357058 - DNA, 13 bp, Homo sapiens
agaagagtggcag

SEQ ID NO: 5357059 - DNA, 16 bp, Homo sapiens
agaagagttgaggaac

SEQ ID NO: 5357060 - DNA, 19 bp, Homo sapiens
agaagagttgtgcacgcag

SEQ ID NO: 5357061 - DNA, 14 bp, Homo sapiens
agaagagtttgcaa

SEQ ID NO: 5357062 - DNA, 20 bp, Homo sapiens
agaagagtttttattacaaa

SEQ ID NO: 5357063 - DNA, 12 bp, Homo sapiens
agaagataaaaa

SEQ ID NO: 5357064 - DNA, 18 bp, Homo sapiens
agaagataatcattgctt

SEQ ID NO: 5357065 - DNA, 13 bp, Homo sapiens
agaagatagcagg

SEQ ID NO: 5357066 - DNA, 16 bp, Homo sapiens
agaagatagctctctg

SEQ ID NO: 5357067 - DNA, 17 bp, Homo sapiens
agaagatagggaacact

SEQ ID NO: 5357068 - DNA, 18 bp, Homo sapiens
agaagatagggaacactc

SEQ ID NO: 5357069 - DNA, 16 bp, Homo sapiens
agaagatagttgtaaa

SEQ ID NO: 5357070 - DNA, 11 bp, Homo sapiens
agaagatatct

SEQ ID NO: 5357071 - DNA, 20 bp, Homo sapiens
agaagatcaacgcctcactg

SEQ ID NO: 5357072 - DNA, 16 bp, Homo sapiens
agaagatcacagcagg

SEQ ID NO: 5357073 - DNA, 20 bp, Homo sapiens
agaagatcacagcagggcct

SEQ ID NO: 5357074 - DNA, 16 bp, Homo sapiens
agaagatcattgccat

SEQ ID NO: 5357075 - DNA, 20 bp, Homo sapiens
agaagatcattggagtttag

SEQ ID NO: 5357076 - DNA, 17 bp, Homo sapiens
agaagatcctaaaacaa

SEQ ID NO: 5357077 - DNA, 18 bp, Homo sapiens
agaagatcggaacagctc

SEQ ID NO: 5357078 - DNA, 21 bp, Homo sapiens
agaagatctaccccagggaga

SEQ ID NO: 5357079 - DNA, 13 bp, Homo sapiens
agaagatctttgg

SEQ ID NO: 5357080 - DNA, 21 bp, Homo sapiens
agaagatgaaatttgataaac

SEQ ID NO: 5357081 - DNA, 13 bp, Homo sapiens
agaagatgaatac

SEQ ID NO: 5357082 - DNA, 14 bp, Homo sapiens
agaagatgaataca

SEQ ID NO: 5357083 - DNA, 13 bp, Homo sapiens
agaagatgaatgg

SEQ ID NO: 5357084 - DNA, 16 bp, Homo sapiens
agaagatgaatggtct

SEQ ID NO: 5357085 - DNA, 16 bp, Homo sapiens
agaagatgacttccca

SEQ ID NO: 5357086 - DNA, 13 bp, Homo sapiens
agaagatgagcct

SEQ ID NO: 5357087 - DNA, 13 bp, Homo sapiens
agaagatgagggt

SEQ ID NO: 5357088 - DNA, 14 bp, Homo sapiens
agaagatgccctcc

SEQ ID NO: 5357089 - DNA, 16 bp, Homo sapiens
agaagatggcactgtc

SEQ ID NO: 5357090 - DNA, 21 bp, Homo sapiens
agaagatggcactgtccaggg

SEQ ID NO: 5357091 - DNA, 19 bp, Homo sapiens
agaagatggttagaaccag

SEQ ID NO: 5357092 - DNA, 12 bp, Homo sapiens
agaagatgtgta

SEQ ID NO: 5357093 - DNA, 16 bp, Homo sapiens
agaagatgttaattac

SEQ ID NO: 5357094 - DNA, 22 bp, Homo sapiens
agaagatgttgaagaatacagt

SEQ ID NO: 5357095 - DNA, 23 bp, Homo sapiens
agaagatgttgaagaatacagtt

SEQ ID NO: 5357096 - DNA, 16 bp, Homo sapiens
agaagattacaaaagc

SEQ ID NO: 5357097 - DNA, 18 bp, Homo sapiens
agaagattacaaaagcaa

SEQ ID NO: 5357098 - DNA, 14 bp, Homo sapiens
agaagattccttct

SEQ ID NO: 5357099 - DNA, 16 bp, Homo sapiens
agaagattctatgtta

SEQ ID NO: 5357100 - DNA, 22 bp, Homo sapiens
agaagattctcgccccttccct

SEQ ID NO: 5357101 - DNA, 23 bp, Homo sapiens
agaagattctcgccccttccctc

SEQ ID NO: 5357102 - DNA, 16 bp, Homo sapiens
agaagatttagatgtt

SEQ ID NO: 5357103 - DNA, 19 bp, Homo sapiens
agaagatttgatgctggag

SEQ ID NO: 5357104 - DNA, 22 bp, Homo sapiens
agaagatttgatgctggagagg

SEQ ID NO: 5357105 - DNA, 18 bp, Homo sapiens
agaagattttgaaatttt

SEQ ID NO: 5357106 - DNA, 18 bp, Homo sapiens
agaagcaaaggcaggagg

SEQ ID NO: 5357107 - DNA, 18 bp, Homo sapiens
agaagcaaagttcaactt

SEQ ID NO: 5357108 - DNA, 17 bp, Homo sapiens
agaagcaacagaaaaaa

SEQ ID NO: 5357109 - DNA, 23 bp, Homo sapiens
agaagcaacctcagtaatttaga

SEQ ID NO: 5357110 - DNA, 14 bp, Homo sapiens
agaagcaagctgga

SEQ ID NO: 5357111 - DNA, 19 bp, Homo sapiens
agaagcaagctggatgcag

SEQ ID NO: 5357112 - DNA, 14 bp, Homo sapiens
agaagcaaggaagt

SEQ ID NO: 5357113 - DNA, 17 bp, Homo sapiens
agaagcaaggaagtaag

SEQ ID NO: 5357114 - DNA, 14 bp, Homo sapiens
agaagcaagggcaa

SEQ ID NO: 5357115 - DNA, 15 bp, Homo sapiens
agaagcaagggcaag

SEQ ID NO: 5357116 - DNA, 21 bp, Homo sapiens
agaagcaattatttaaagaaa

SEQ ID NO: 5357117 - DNA, 15 bp, Homo sapiens
agaagcacagctcct

SEQ ID NO: 5357118 - DNA, 21 bp, Homo sapiens
agaagcacagctcctgccagg

SEQ ID NO: 5357119 - DNA, 15 bp, Homo sapiens
agaagcaccagcaat

SEQ ID NO: 5357120 - DNA, 16 bp, Homo sapiens
agaagcaccccaccac

SEQ ID NO: 5357121 - DNA, 16 bp, Homo sapiens
agaagcacttctgctg

SEQ ID NO: 5357122 - DNA, 13 bp, Homo sapiens
agaagcagagaga

SEQ ID NO: 5357123 - DNA, 16 bp, Homo sapiens
agaagcagaggaagga

SEQ ID NO: 5357124 - DNA, 16 bp, Homo sapiens
agaagcagagggacaa

SEQ ID NO: 5357125 - DNA, 14 bp, Homo sapiens
agaagcagcagcta

SEQ ID NO: 5357126 - DNA, 22 bp, Homo sapiens
agaagcagcagctagaaagaga

SEQ ID NO: 5357127 - DNA, 13 bp, Homo sapiens
agaagcagctctt

SEQ ID NO: 5357128 - DNA, 15 bp, Homo sapiens
agaagcagcttcttt

SEQ ID NO: 5357129 - DNA, 16 bp, Homo sapiens
agaagcagcttctttt

SEQ ID NO: 5357130 - DNA, 21 bp, Homo sapiens
agaagcagcttcttttgtctc

SEQ ID NO: 5357131 - DNA, 15 bp, Homo sapiens
agaagcaggcagggc

SEQ ID NO: 5357132 - DNA, 14 bp, Homo sapiens
agaagcaggctgga

SEQ ID NO: 5357133 - DNA, 17 bp, Homo sapiens
agaagcagtgagccgca

SEQ ID NO: 5357134 - DNA, 13 bp, Homo sapiens
agaagcagttctc

SEQ ID NO: 5357135 - DNA, 17 bp, Homo sapiens
agaagcatattttgctg

SEQ ID NO: 5357136 - DNA, 19 bp, Homo sapiens
agaagcatattttgctggt

SEQ ID NO: 5357137 - DNA, 15 bp, Homo sapiens
agaagcatgaaaaag

SEQ ID NO: 5357138 - DNA, 21 bp, Homo sapiens
agaagcattaacttctctgga

SEQ ID NO: 5357139 - DNA, 15 bp, Homo sapiens
agaagcattccttct

SEQ ID NO: 5357140 - DNA, 17 bp, Homo sapiens
agaagcattccttcttt

SEQ ID NO: 5357141 - DNA, 22 bp, Homo sapiens
agaagcattccttctttgataa

SEQ ID NO: 5357142 - DNA, 18 bp, Homo sapiens
agaagcattgaaaacaaa

SEQ ID NO: 5357143 - DNA, 23 bp, Homo sapiens
agaagcattgaaaacaaagacat

SEQ ID NO: 5357144 - DNA, 13 bp, Homo sapiens
agaagcatttgta

SEQ ID NO: 5357145 - DNA, 19 bp, Homo sapiens
agaagcatttgtattttgt

SEQ ID NO: 5357146 - DNA, 16 bp, Homo sapiens
agaagccaagacagtg

SEQ ID NO: 5357147 - DNA, 13 bp, Homo sapiens
agaagccaagcct

SEQ ID NO: 5357148 - DNA, 15 bp, Homo sapiens
agaagccaagggaaa

SEQ ID NO: 5357149 - DNA, 20 bp, Homo sapiens
agaagccaagggacacagga

SEQ ID NO: 5357150 - DNA, 22 bp, Homo sapiens
agaagccaatctacaatctctt

SEQ ID NO: 5357151 - DNA, 11 bp, Homo sapiens
agaagccacag

SEQ ID NO: 5357152 - DNA, 17 bp, Homo sapiens
agaagccacaggcctga

SEQ ID NO: 5357153 - DNA, 18 bp, Homo sapiens
agaagccacaggcctgag

SEQ ID NO: 5357154 - DNA, 15 bp, Homo sapiens
agaagccacccttcc

SEQ ID NO: 5357155 - DNA, 17 bp, Homo sapiens
agaagccacccttccct

SEQ ID NO: 5357156 - DNA, 20 bp, Homo sapiens
agaagccacccttccctgcc

SEQ ID NO: 5357157 - DNA, 21 bp, Homo sapiens
agaagccacccttccctgcct

SEQ ID NO: 5357158 - DNA, 13 bp, Homo sapiens
agaagccagaagg

SEQ ID NO: 5357159 - DNA, 13 bp, Homo sapiens
agaagccagccac

SEQ ID NO: 5357160 - DNA, 13 bp, Homo sapiens
agaagccagcttg

SEQ ID NO: 5357161 - DNA, 22 bp, Homo sapiens
agaagccaggaatttcccagga

SEQ ID NO: 5357162 - DNA, 14 bp, Homo sapiens
agaagccaggaggc

SEQ ID NO: 5357163 - DNA, 13 bp, Homo sapiens
agaagtgacaggg

SEQ ID NO: 5357164 - DNA, 16 bp, Homo sapiens
agaagtgacattgcat

SEQ ID NO: 5357165 - DNA, 17 bp, Homo sapiens
agaagtgaccaaggagg

SEQ ID NO: 5357166 - DNA, 16 bp, Homo sapiens
agaagtgacggttcct

SEQ ID NO: 5357167 - DNA, 18 bp, Homo sapiens
agaagtgagaataggcag

SEQ ID NO: 5357168 - DNA, 21 bp, Homo sapiens
agaagtgagaataggcagccc

SEQ ID NO: 5357169 - DNA, 18 bp, Homo sapiens
agaagtgagcaaaaaaga

SEQ ID NO: 5357170 - DNA, 14 bp, Homo sapiens
agaagtgagcaagg

SEQ ID NO: 5357171 - DNA, 23 bp, Homo sapiens
agaagtgaggatgagacccagcc

SEQ ID NO: 5357172 - DNA, 13 bp, Homo sapiens
agaagtgaggcct

SEQ ID NO: 5357173 - DNA, 17 bp, Homo sapiens
agaagtgagggctgggc

SEQ ID NO: 5357174 - DNA, 22 bp, Homo sapiens
agaagtgagggctgggcagctg

SEQ ID NO: 5357175 - DNA, 21 bp, Homo sapiens
agaagtgagtttgtaaatatt

SEQ ID NO: 5357176 - DNA, 11 bp, Homo sapiens
agaagtgatat

SEQ ID NO: 5357177 - DNA, 17 bp, Homo sapiens
agaagtgatatggtgaa

SEQ ID NO: 5357178 - DNA, 18 bp, Homo sapiens
agaagtgatatggtgaag

SEQ ID NO: 5357179 - DNA, 21 bp, Homo sapiens
agaagtgattctgtccctcca

SEQ ID NO: 5357180 - DNA, 16 bp, Homo sapiens
agaagtgcatcctgat

SEQ ID NO: 5357181 - DNA, 23 bp, Homo sapiens
agaagtgcatctggagagaacag

SEQ ID NO: 5357182 - DNA, 15 bp, Homo sapiens
agaagtgcatttctg

SEQ ID NO: 5357183 - DNA, 15 bp, Homo sapiens
agaagtgccatctca

SEQ ID NO: 5357184 - DNA, 14 bp, Homo sapiens
agaagtgcccctgc

SEQ ID NO: 5357185 - DNA, 16 bp, Homo sapiens
agaagtgcccctgctg

SEQ ID NO: 5357186 - DNA, 17 bp, Homo sapiens
agaagtgcccttcctgc

SEQ ID NO: 5357187 - DNA, 22 bp, Homo sapiens
agaagtgcttaacgttttctta

SEQ ID NO: 5357188 - DNA, 14 bp, Homo sapiens
agaagtgctttata

SEQ ID NO: 5357189 - DNA, 16 bp, Homo sapiens
agaagtgctttatact

SEQ ID NO: 5357190 - DNA, 20 bp, Homo sapiens
agaagtggaaggataatgag

SEQ ID NO: 5357191 - DNA, 21 bp, Homo sapiens
agaagtggaatccagtgtggc

SEQ ID NO: 5357192 - DNA, 15 bp, Homo sapiens
agaagtggaccagga

SEQ ID NO: 5357193 - DNA, 13 bp, Homo sapiens
agaagtggcagga

SEQ ID NO: 5357194 - DNA, 16 bp, Homo sapiens
agaagtggcaggagga

SEQ ID NO: 5357195 - DNA, 17 bp, Homo sapiens
agaagtggccagggctt

SEQ ID NO: 5357196 - DNA, 19 bp, Homo sapiens
agaagtggctactgactac

SEQ ID NO: 5357197 - DNA, 14 bp, Homo sapiens
agaagtgggagcag

SEQ ID NO: 5357198 - DNA, 18 bp, Homo sapiens
agaagtgggagcagcttc

SEQ ID NO: 5357199 - DNA, 13 bp, Homo sapiens
agaagtgggagtg

SEQ ID NO: 5357200 - DNA, 19 bp, Homo sapiens
agaagtgggagtgggagag

SEQ ID NO: 5357201 - DNA, 17 bp, Homo sapiens
agaagtgggccaggaca

SEQ ID NO: 5357202 - DNA, 19 bp, Homo sapiens
agaagtggggaccccaccc

SEQ ID NO: 5357203 - DNA, 23 bp, Homo sapiens
agaagtggggaccccacccctca

SEQ ID NO: 5357204 - DNA, 19 bp, Homo sapiens
agaagtgggggcagcccag

SEQ ID NO: 5357205 - DNA, 16 bp, Homo sapiens
agaagtgggtggggac

SEQ ID NO: 5357206 - DNA, 17 bp, Homo sapiens
agaagtgtcaccctgtg

SEQ ID NO: 5357207 - DNA, 19 bp, Homo sapiens
agaagtgtcaccctgtggg

SEQ ID NO: 5357208 - DNA, 20 bp, Homo sapiens
agaagtgtcaccctgtgggt

SEQ ID NO: 5357209 - DNA, 15 bp, Homo sapiens
agaagtgtcatgttt

SEQ ID NO: 5357210 - DNA, 18 bp, Homo sapiens
agaagtgtcatgtttata

SEQ ID NO: 5357211 - DNA, 22 bp, Homo sapiens
agaagtgtgattgggaataaat

SEQ ID NO: 5357212 - DNA, 13 bp, Homo sapiens
agaagtgtgtttt

SEQ ID NO: 5357213 - DNA, 14 bp, Homo sapiens
agaagtgtgttttg

SEQ ID NO: 5357214 - DNA, 13 bp, Homo sapiens
agaagtgttgtaa

SEQ ID NO: 5357215 - DNA, 18 bp, Homo sapiens
agaagtgttgtaaaagat

SEQ ID NO: 5357216 - DNA, 22 bp, Homo sapiens
agaagtgtttgatggtgccaga

SEQ ID NO: 5357217 - DNA, 14 bp, Homo sapiens
agaagttaaagtca

SEQ ID NO: 5357218 - DNA, 13 bp, Homo sapiens
agaagttaacatc

SEQ ID NO: 5357219 - DNA, 15 bp, Homo sapiens
agaagttaagcagcc

SEQ ID NO: 5357220 - DNA, 19 bp, Homo sapiens
agaagttaagcagcctttc

SEQ ID NO: 5357221 - DNA, 20 bp, Homo sapiens
agaagttaagcagcctttct

SEQ ID NO: 5357222 - DNA, 15 bp, Homo sapiens
agaagttactgaatg

SEQ ID NO: 5357223 - DNA, 14 bp, Homo sapiens
agaagttactttgt

SEQ ID NO: 5357224 - DNA, 16 bp, Homo sapiens
agaagttactttgtaa

SEQ ID NO: 5357225 - DNA, 21 bp, Homo sapiens
agaagttcaaaccctgtatcc

SEQ ID NO: 5357226 - DNA, 19 bp, Homo sapiens
agaagttcaccagccctga

SEQ ID NO: 5357227 - DNA, 20 bp, Homo sapiens
agaagttccacttaacacat

SEQ ID NO: 5357228 - DNA, 14 bp, Homo sapiens
agaagttctcagaa

SEQ ID NO: 5357229 - DNA, 15 bp, Homo sapiens
agaagttctttgatt

SEQ ID NO: 5357230 - DNA, 20 bp, Homo sapiens
agaagttctttgattctgta

SEQ ID NO: 5357231 - DNA, 18 bp, Homo sapiens
agaagttgatatagaaca

SEQ ID NO: 5357232 - DNA, 15 bp, Homo sapiens
agaagttgccaagag

SEQ ID NO: 5357233 - DNA, 19 bp, Homo sapiens
agaagttgccaagagttct

SEQ ID NO: 5357234 - DNA, 17 bp, Homo sapiens
agaagttgccctccagg

SEQ ID NO: 5357235 - DNA, 18 bp, Homo sapiens
agaagttgccctccaggc

SEQ ID NO: 5357236 - DNA, 20 bp, Homo sapiens
agaagttgctaagtgtgctt

SEQ ID NO: 5357237 - DNA, 22 bp, Homo sapiens
agaagttggggacacatgtatt

SEQ ID NO: 5357238 - DNA, 17 bp, Homo sapiens
agaagttgtgaaactaa

SEQ ID NO: 5357239 - DNA, 15 bp, Homo sapiens
agaagttgtgctaaa

SEQ ID NO: 5357240 - DNA, 22 bp, Homo sapiens
agaagttgtgctaaaccaagtt

SEQ ID NO: 5357241 - DNA, 23 bp, Homo sapiens
agaagttgtgctaaaccaagtta

SEQ ID NO: 5357242 - DNA, 21 bp, Homo sapiens
agaagttgtggatttcagttt

SEQ ID NO: 5357243 - DNA, 14 bp, Homo sapiens
agaagttgtttgtc

SEQ ID NO: 5357244 - DNA, 22 bp, Homo sapiens
agaagtttaaagcatctgtaaa

SEQ ID NO: 5357245 - DNA, 16 bp, Homo sapiens
agaagtttaaggaata

SEQ ID NO: 5357246 - DNA, 23 bp, Homo sapiens
agaagtttaagtaagtaagtttc

SEQ ID NO: 5357247 - DNA, 16 bp, Homo sapiens
agaagtttagatttta

SEQ ID NO: 5357248 - DNA, 18 bp, Homo sapiens
agaagtttagattttaat

SEQ ID NO: 5357249 - DNA, 17 bp, Homo sapiens
agaagtttattctcatt

SEQ ID NO: 5357250 - DNA, 19 bp, Homo sapiens
agaagtttcagttgtcctt

SEQ ID NO: 5357251 - DNA, 16 bp, Homo sapiens
agaagtttcccttcct

SEQ ID NO: 5357252 - DNA, 18 bp, Homo sapiens
agaagtttcctggagttt

SEQ ID NO: 5357253 - DNA, 21 bp, Homo sapiens
agaagtttctgccgcagccct

SEQ ID NO: 5357254 - DNA, 23 bp, Homo sapiens
agaagtttctgccgcagccctgc

SEQ ID NO: 5357255 - DNA, 16 bp, Homo sapiens
agaagtttctggccct

SEQ ID NO: 5357256 - DNA, 12 bp, Homo sapiens
agaagtttcttc

SEQ ID NO: 5357257 - DNA, 19 bp, Homo sapiens
agaagtttctttaaagacg

SEQ ID NO: 5357258 - DNA, 20 bp, Homo sapiens
agaagtttgatattaaagga

SEQ ID NO: 5357259 - DNA, 16 bp, Homo sapiens
agaagtttgcactatc

SEQ ID NO: 5357260 - DNA, 21 bp, Homo sapiens
agaagtttgcactatctttca

SEQ ID NO: 5357261 - DNA, 20 bp, Homo sapiens
agaagtttgggaaaagcctt

SEQ ID NO: 5357262 - DNA, 23 bp, Homo sapiens
agaagtttgggaaaagccttctt

SEQ ID NO: 5357263 - DNA, 21 bp, Homo sapiens
agaagtttgtccatttgtaaa

SEQ ID NO: 5357264 - DNA, 21 bp, Homo sapiens
agaagtttgtggtataaaaag

SEQ ID NO: 5357265 - DNA, 13 bp, Homo sapiens
agaagtttgtgtc

SEQ ID NO: 5357266 - DNA, 11 bp, Homo sapiens
agaagtttttg

SEQ ID NO: 5357267 - DNA, 12 bp, Homo sapiens
agaagtttttgt

SEQ ID NO: 5357268 - DNA, 15 bp, Homo sapiens
agaagttttttactt

SEQ ID NO: 5357269 - DNA, 17 bp, Homo sapiens
agaagttttttactttg

SEQ ID NO: 5357270 - DNA, 20 bp, Homo sapiens
agaagttttttactttggtt

SEQ ID NO: 5357271 - DNA, 13 bp, Homo sapiens
agaataaaaactt

SEQ ID NO: 5357272 - DNA, 16 bp, Homo sapiens
agaataaaaatgtggt

SEQ ID NO: 5357273 - DNA, 13 bp, Homo sapiens
agaataaaaattg

SEQ ID NO: 5357274 - DNA, 11 bp, Homo sapiens
agaataaaagc

SEQ ID NO: 5357275 - DNA, 15 bp, Homo sapiens
agaataaaagctgtg

SEQ ID NO: 5357276 - DNA, 15 bp, Homo sapiens
agaataaaaggtagt

SEQ ID NO: 5357277 - DNA, 14 bp, Homo sapiens
agaataaaatatga

SEQ ID NO: 5357278 - DNA, 12 bp, Homo sapiens
agaataaaatta

SEQ ID NO: 5357279 - DNA, 23 bp, Homo sapiens
agaataaaattaggaacagtaaa

SEQ ID NO: 5357280 - DNA, 16 bp, Homo sapiens
agaataaaccaagaat

SEQ ID NO: 5357281 - DNA, 19 bp, Homo sapiens
agaataaaccggatcctgt

SEQ ID NO: 5357282 - DNA, 20 bp, Homo sapiens
agaataaaccggatcctgtt

SEQ ID NO: 5357283 - DNA, 15 bp, Homo sapiens
agaataaagcaattt

SEQ ID NO: 5357284 - DNA, 17 bp, Homo sapiens
agaataaagcaattttc

SEQ ID NO: 5357285 - DNA, 18 bp, Homo sapiens
agaataaagcaattttcc

SEQ ID NO: 5357286 - DNA, 12 bp, Homo sapiens
agaataaagcag

SEQ ID NO: 5357287 - DNA, 14 bp, Homo sapiens
agaataaagcagcc

SEQ ID NO: 5357288 - DNA, 20 bp, Homo sapiens
agaataaaggcagttttcta

SEQ ID NO: 5357289 - DNA, 21 bp, Homo sapiens
agaataaaggcagttttctaa

SEQ ID NO: 5357290 - DNA, 20 bp, Homo sapiens
agaataaataaagaagaaaa

SEQ ID NO: 5357291 - DNA, 13 bp, Homo sapiens
agaataaatgaat

SEQ ID NO: 5357292 - DNA, 13 bp, Homo sapiens
agaataaatgggt

SEQ ID NO: 5357293 - DNA, 12 bp, Homo sapiens
agaataaatgtt

SEQ ID NO: 5357294 - DNA, 18 bp, Homo sapiens
agaataaatgttttacaa

SEQ ID NO: 5357295 - DNA, 20 bp, Homo sapiens
agaataaatgttttacaact

SEQ ID NO: 5357296 - DNA, 15 bp, Homo sapiens
agaataaattgattt

SEQ ID NO: 5357297 - DNA, 22 bp, Homo sapiens
agaataaattggattattttct

SEQ ID NO: 5357298 - DNA, 15 bp, Homo sapiens
agaataaatttggga

SEQ ID NO: 5357299 - DNA, 17 bp, Homo sapiens
agaataacctttcagaa

SEQ ID NO: 5357300 - DNA, 17 bp, Homo sapiens
agaataactacctcctc

SEQ ID NO: 5357301 - DNA, 15 bp, Homo sapiens
agaataagaaaacaa

SEQ ID NO: 5357302 - DNA, 20 bp, Homo sapiens
agaataagaaaacaatcaca

SEQ ID NO: 5357303 - DNA, 13 bp, Homo sapiens
agaataagaattt

SEQ ID NO: 5357304 - DNA, 17 bp, Homo sapiens
agaataagaatttgcat

SEQ ID NO: 5357305 - DNA, 18 bp, Homo sapiens
agaataagaatttgcata

SEQ ID NO: 5357306 - DNA, 16 bp, Homo sapiens
agaataagagaaagaa

SEQ ID NO: 5357307 - DNA, 22 bp, Homo sapiens
agaataaggaggaggagggaga

SEQ ID NO: 5357308 - DNA, 16 bp, Homo sapiens
agaataaggcaggcat

SEQ ID NO: 5357309 - DNA, 15 bp, Homo sapiens
agaataaggcttttt

SEQ ID NO: 5357310 - DNA, 15 bp, Homo sapiens
agaataagtcatgtt

SEQ ID NO: 5357311 - DNA, 21 bp, Homo sapiens
agaataagtgctgtttgagat

SEQ ID NO: 5357312 - DNA, 15 bp, Homo sapiens
agaataagtgtcttt

SEQ ID NO: 5357313 - DNA, 12 bp, Homo sapiens
agaataagttat

SEQ ID NO: 5357314 - DNA, 16 bp, Homo sapiens
agaataagttattgca

SEQ ID NO: 5357315 - DNA, 20 bp, Homo sapiens
agaataagttattgcagttt

SEQ ID NO: 5357316 - DNA, 20 bp, Homo sapiens
agaataagttggagaaatgt

SEQ ID NO: 5357317 - DNA, 16 bp, Homo sapiens
agaataataaatattt

SEQ ID NO: 5357318 - DNA, 14 bp, Homo sapiens
agaataataagagg

SEQ ID NO: 5357319 - DNA, 16 bp, Homo sapiens
agaataataataaaaa

SEQ ID NO: 5357320 - DNA, 16 bp, Homo sapiens
agaataataattaacc

SEQ ID NO: 5357321 - DNA, 22 bp, Homo sapiens
agaataatatgctgccaaattt

SEQ ID NO: 5357322 - DNA, 17 bp, Homo sapiens
agaataatcaaatacat

SEQ ID NO: 5357323 - DNA, 17 bp, Homo sapiens
agaataatcacgctttc

SEQ ID NO: 5357324 - DNA, 21 bp, Homo sapiens
agaataatcacgctttcctga

SEQ ID NO: 5357325 - DNA, 20 bp, Homo sapiens
agaataatctcatcccccca

SEQ ID NO: 5357326 - DNA, 23 bp, Homo sapiens
agaataatctcatccccccaccc

SEQ ID NO: 5357327 - DNA, 13 bp, Homo sapiens
agaataatggaaa

SEQ ID NO: 5357328 - DNA, 15 bp, Homo sapiens
agaataatggaaaca

SEQ ID NO: 5357329 - DNA, 17 bp, Homo sapiens
agaataatggaaacatt

SEQ ID NO: 5357330 - DNA, 23 bp, Homo sapiens
agaataatggaaacattacagtt

SEQ ID NO: 5357331 - DNA, 15 bp, Homo sapiens
agaataattctttga

SEQ ID NO: 5357332 - DNA, 15 bp, Homo sapiens
agaataattgtgtac

SEQ ID NO: 5357333 - DNA, 22 bp, Homo sapiens
agaataattgtgtacaaagtag

SEQ ID NO: 5357334 - DNA, 17 bp, Homo sapiens
agaataatttatagtaa

SEQ ID NO: 5357335 - DNA, 21 bp, Homo sapiens
agaataatttcatactgaaat

SEQ ID NO: 5357336 - DNA, 14 bp, Homo sapiens
agaataatttctcc

SEQ ID NO: 5357337 - DNA, 22 bp, Homo sapiens
agaataatttggaatcagctat

SEQ ID NO: 5357338 - DNA, 14 bp, Homo sapiens
agaataattttatt

SEQ ID NO: 5357339 - DNA, 15 bp, Homo sapiens
agaatacaagatatt

SEQ ID NO: 5357340 - DNA, 23 bp, Homo sapiens
agaatacaagatattatgtataa

SEQ ID NO: 5357341 - DNA, 23 bp, Homo sapiens
agactagacaccttctgtgctca

SEQ ID NO: 5357342 - DNA, 14 bp, Homo sapiens
agactagagaaacc

SEQ ID NO: 5357343 - DNA, 18 bp, Homo sapiens
agactagagaataatttt

SEQ ID NO: 5357344 - DNA, 17 bp, Homo sapiens
agactagagcaaaataa

SEQ ID NO: 5357345 - DNA, 16 bp, Homo sapiens
agactagatgtagtat

SEQ ID NO: 5357346 - DNA, 13 bp, Homo sapiens
agactagatttca

SEQ ID NO: 5357347 - DNA, 16 bp, Homo sapiens
agactagatttcaagc

SEQ ID NO: 5357348 - DNA, 17 bp, Homo sapiens
agactagcaatctcttc

SEQ ID NO: 5357349 - DNA, 16 bp, Homo sapiens
agactagccagccagg

SEQ ID NO: 5357350 - DNA, 19 bp, Homo sapiens
agactagctaattagctct

SEQ ID NO: 5357351 - DNA, 21 bp, Homo sapiens
agactaggctctagtgttcag

SEQ ID NO: 5357352 - DNA, 17 bp, Homo sapiens
agactagggctgcaagt

SEQ ID NO: 5357353 - DNA, 14 bp, Homo sapiens
agactaggtttatt

SEQ ID NO: 5357354 - DNA, 15 bp, Homo sapiens
agactagtatcaagt

SEQ ID NO: 5357355 - DNA, 20 bp, Homo sapiens
agactagtcccttggataag

SEQ ID NO: 5357356 - DNA, 21 bp, Homo sapiens
agactagtgccgtagggagta

SEQ ID NO: 5357357 - DNA, 13 bp, Homo sapiens
agactagttctct

SEQ ID NO: 5357358 - DNA, 18 bp, Homo sapiens
agactagtttacaaagga

SEQ ID NO: 5357359 - DNA, 17 bp, Homo sapiens
agactagtttgttatta

SEQ ID NO: 5357360 - DNA, 18 bp, Homo sapiens
agactataaagcagtaga

SEQ ID NO: 5357361 - DNA, 12 bp, Homo sapiens
agactatataca

SEQ ID NO: 5357362 - DNA, 13 bp, Homo sapiens
agactatatacat

SEQ ID NO: 5357363 - DNA, 14 bp, Homo sapiens
agactatatacatg

SEQ ID NO: 5357364 - DNA, 15 bp, Homo sapiens
agactatatacatgt

SEQ ID NO: 5357365 - DNA, 20 bp, Homo sapiens
agactatatacatgtgtgta

SEQ ID NO: 5357366 - DNA, 16 bp, Homo sapiens
agactatccattttac

SEQ ID NO: 5357367 - DNA, 19 bp, Homo sapiens
agactatccattttacact

SEQ ID NO: 5357368 - DNA, 17 bp, Homo sapiens
agactatctaaatgttg

SEQ ID NO: 5357369 - DNA, 18 bp, Homo sapiens
agactatctaaatgttga

SEQ ID NO: 5357370 - DNA, 21 bp, Homo sapiens
agactatgcagcttggagaca

SEQ ID NO: 5357371 - DNA, 23 bp, Homo sapiens
agactatggaatgtcagtgttca

SEQ ID NO: 5357372 - DNA, 13 bp, Homo sapiens
agactatggcctc

SEQ ID NO: 5357373 - DNA, 22 bp, Homo sapiens
agactatggcctcgcctcccca

SEQ ID NO: 5357374 - DNA, 14 bp, Homo sapiens
agactatggtgctg

SEQ ID NO: 5357375 - DNA, 12 bp, Homo sapiens
agactatgtgtc

SEQ ID NO: 5357376 - DNA, 23 bp, Homo sapiens
agactatgtgtcatgatttcaat

SEQ ID NO: 5357377 - DNA, 16 bp, Homo sapiens
agactattaagagcaa

SEQ ID NO: 5357378 - DNA, 16 bp, Homo sapiens
agactattatgaaatc

SEQ ID NO: 5357379 - DNA, 12 bp, Homo sapiens
agactattcaaa

SEQ ID NO: 5357380 - DNA, 14 bp, Homo sapiens
agactattcaaaca

SEQ ID NO: 5357381 - DNA, 22 bp, Homo sapiens
agactattcatcaagaatgagg

SEQ ID NO: 5357382 - DNA, 23 bp, Homo sapiens
agactattcatcaagaatgagga

SEQ ID NO: 5357383 - DNA, 19 bp, Homo sapiens
agactattccttttctgta

SEQ ID NO: 5357384 - DNA, 20 bp, Homo sapiens
agactattgacatcagcatc

SEQ ID NO: 5357385 - DNA, 22 bp, Homo sapiens
agactatttaaacttataaatc

SEQ ID NO: 5357386 - DNA, 17 bp, Homo sapiens
agactatttaagtacta

SEQ ID NO: 5357387 - DNA, 17 bp, Homo sapiens
agactatttaccaggga

SEQ ID NO: 5357388 - DNA, 13 bp, Homo sapiens
agactatttcaaa

SEQ ID NO: 5357389 - DNA, 19 bp, Homo sapiens
agactatttcaaaatgtcc

SEQ ID NO: 5357390 - DNA, 23 bp, Homo sapiens
agactatttcaaaatgtccagat

SEQ ID NO: 5357391 - DNA, 13 bp, Homo sapiens
agactatttgcta

SEQ ID NO: 5357392 - DNA, 15 bp, Homo sapiens
agactatttgctaat

SEQ ID NO: 5357393 - DNA, 19 bp, Homo sapiens
agactatttgctaatgtat

SEQ ID NO: 5357394 - DNA, 14 bp, Homo sapiens
agactcaaaaaaac

SEQ ID NO: 5357395 - DNA, 14 bp, Homo sapiens
agactcaaaacact

SEQ ID NO: 5357396 - DNA, 23 bp, Homo sapiens
agactcaaatgttctaagtttct

SEQ ID NO: 5357397 - DNA, 15 bp, Homo sapiens
agactcaagacttat

SEQ ID NO: 5357398 - DNA, 19 bp, Homo sapiens
agactcaaggaagaataat

SEQ ID NO: 5357399 - DNA, 20 bp, Homo sapiens
agactcaaggaagaataatt

SEQ ID NO: 5357400 - DNA, 21 bp, Homo sapiens
agactcaaggttcccagagat

SEQ ID NO: 5357401 - DNA, 22 bp, Homo sapiens
agactcaaggttcccagagatg

SEQ ID NO: 5357402 - DNA, 20 bp, Homo sapiens
agactcaagtgatcctcctg

SEQ ID NO: 5357403 - DNA, 22 bp, Homo sapiens
agactcaatgtccccctcaccc

SEQ ID NO: 5357404 - DNA, 20 bp, Homo sapiens
agactcacaacctgaaccta

SEQ ID NO: 5357405 - DNA, 17 bp, Homo sapiens
agactcacactctctgc

SEQ ID NO: 5357406 - DNA, 20 bp, Homo sapiens
agactcacactctctgcagc

SEQ ID NO: 5357407 - DNA, 15 bp, Homo sapiens
agactcacaggaagg

SEQ ID NO: 5357408 - DNA, 16 bp, Homo sapiens
agactcacaggaagga

SEQ ID NO: 5357409 - DNA, 22 bp, Homo sapiens
agactcacaggaaggaggagcc

SEQ ID NO: 5357410 - DNA, 21 bp, Homo sapiens
agactcacggctgcacctgca

SEQ ID NO: 5357411 - DNA, 20 bp, Homo sapiens
agactcactgggaagctccc

SEQ ID NO: 5357412 - DNA, 14 bp, Homo sapiens
agactcacttgcca

SEQ ID NO: 5357413 - DNA, 14 bp, Homo sapiens
agactcagaggacc

SEQ ID NO: 5357414 - DNA, 19 bp, Homo sapiens
agactcagaggtccaggcc

SEQ ID NO: 5357415 - DNA, 20 bp, Homo sapiens
agactcagatgatgccagct

SEQ ID NO: 5357416 - DNA, 13 bp, Homo sapiens
agactcagcagag

SEQ ID NO: 5357417 - DNA, 15 bp, Homo sapiens
agactcagcctctgc

SEQ ID NO: 5357418 - DNA, 21 bp, Homo sapiens
agactcagcctctgctggaga

SEQ ID NO: 5357419 - DNA, 23 bp, Homo sapiens
agactcagcgctcctcctgtgtg

SEQ ID NO: 5357420 - DNA, 11 bp, Homo sapiens
agactcagctc

SEQ ID NO: 5357421 - DNA, 15 bp, Homo sapiens
agactcagctccaga

SEQ ID NO: 5357422 - DNA, 13 bp, Homo sapiens
agactcagctgct

SEQ ID NO: 5357423 - DNA, 19 bp, Homo sapiens
agactcaggagtctgccac

SEQ ID NO: 5357424 - DNA, 20 bp, Homo sapiens
agactcaggccaagaaacgt

SEQ ID NO: 5357425 - DNA, 23 bp, Homo sapiens
agactcaggccaagaaacgtctt

SEQ ID NO: 5357426 - DNA, 21 bp, Homo sapiens
agactcagggccccagcacta

SEQ ID NO: 5357427 - DNA, 23 bp, Homo sapiens
agactcaggttgtagtaaagaaa

SEQ ID NO: 5357428 - DNA, 22 bp, Homo sapiens
agactcaggttgtctgtagaga

SEQ ID NO: 5357429 - DNA, 21 bp, Homo sapiens
agactcagtggggaggggctg

SEQ ID NO: 5357430 - DNA, 12 bp, Homo sapiens
agactcagtgtt

SEQ ID NO: 5357431 - DNA, 12 bp, Homo sapiens
agactcagtttg

SEQ ID NO: 5357432 - DNA, 15 bp, Homo sapiens
agactcagtttgtca

SEQ ID NO: 5357433 - DNA, 16 bp, Homo sapiens
agactcagttttttgt

SEQ ID NO: 5357434 - DNA, 18 bp, Homo sapiens
agactcatcttactgtac

SEQ ID NO: 5357435 - DNA, 16 bp, Homo sapiens
agactcatcttttgaa

SEQ ID NO: 5357436 - DNA, 17 bp, Homo sapiens
agactcatcttttgaaa

SEQ ID NO: 5357437 - DNA, 17 bp, Homo sapiens
agactcattcttctgta

SEQ ID NO: 5357438 - DNA, 18 bp, Homo sapiens
agactcattcttctgtac

SEQ ID NO: 5357439 - DNA, 19 bp, Homo sapiens
agactccaaggagctactg

SEQ ID NO: 5357440 - DNA, 12 bp, Homo sapiens
agactccaccaa

SEQ ID NO: 5357441 - DNA, 16 bp, Homo sapiens
agactccaccaagcct

SEQ ID NO: 5357442 - DNA, 14 bp, Homo sapiens
agactccagaatct

SEQ ID NO: 5357443 - DNA, 19 bp, Homo sapiens
agactccagaatctgctgt

SEQ ID NO: 5357444 - DNA, 15 bp, Homo sapiens
agactccagcccctg

SEQ ID NO: 5357445 - DNA, 14 bp, Homo sapiens
agactccatagttt

SEQ ID NO: 5357446 - DNA, 13 bp, Homo sapiens
agactccatctca

SEQ ID NO: 5357447 - DNA, 14 bp, Homo sapiens
agactccatctcaa

SEQ ID NO: 5357448 - DNA, 16 bp, Homo sapiens
agactccatctcttct

SEQ ID NO: 5357449 - DNA, 13 bp, Homo sapiens
agactccatttca

SEQ ID NO: 5357450 - DNA, 18 bp, Homo sapiens
agactcccatgaagcctt

SEQ ID NO: 5357451 - DNA, 23 bp, Homo sapiens
agactcccatgaagccttttgaa

SEQ ID NO: 5357452 - DNA, 23 bp, Homo sapiens
agactcccattcctgaagaacca

SEQ ID NO: 5357453 - DNA, 18 bp, Homo sapiens
agactccctgatcccaga

SEQ ID NO: 5357454 - DNA, 22 bp, Homo sapiens
agactccctgatcccagacctg

SEQ ID NO: 5357455 - DNA, 16 bp, Homo sapiens
agactccgcctgaggc

SEQ ID NO: 5357456 - DNA, 15 bp, Homo sapiens
agactccggcctgta

SEQ ID NO: 5357457 - DNA, 15 bp, Homo sapiens
agactccggccttca

SEQ ID NO: 5357458 - DNA, 18 bp, Homo sapiens
agactccgtctcaaggaa

SEQ ID NO: 5357459 - DNA, 16 bp, Homo sapiens
agactcctcagcaccc

SEQ ID NO: 5357460 - DNA, 16 bp, Homo sapiens
agactcctcaggagag

SEQ ID NO: 5357461 - DNA, 18 bp, Homo sapiens
agactcctcaggagagac

SEQ ID NO: 5357462 - DNA, 23 bp, Homo sapiens
agactcctcctccaaaggccccc

SEQ ID NO: 5357463 - DNA, 18 bp, Homo sapiens
agactcctctcttctgac

SEQ ID NO: 5357464 - DNA, 16 bp, Homo sapiens
agactcctctgggcct

SEQ ID NO: 5357465 - DNA, 22 bp, Homo sapiens
agactcctgaggacagctgtcc

SEQ ID NO: 5357466 - DNA, 18 bp, Homo sapiens
agactcctgcaggcagcc

SEQ ID NO: 5357467 - DNA, 19 bp, Homo sapiens
agactcctgcaggcagcca

SEQ ID NO: 5357468 - DNA, 20 bp, Homo sapiens
agactcctgcaggcagccag

SEQ ID NO: 5357469 - DNA, 19 bp, Homo sapiens
agactcctgggcagccgtt

SEQ ID NO: 5357470 - DNA, 17 bp, Homo sapiens
agactccttcaacaatt

SEQ ID NO: 5357471 - DNA, 20 bp, Homo sapiens
agactccttgagagaccagg

SEQ ID NO: 5357472 - DNA, 16 bp, Homo sapiens
agactcctttcctctg

SEQ ID NO: 5357473 - DNA, 14 bp, Homo sapiens
agactcctttcctg

SEQ ID NO: 5357474 - DNA, 19 bp, Homo sapiens
agactcgagaactttcatt

SEQ ID NO: 5357475 - DNA, 15 bp, Homo sapiens
agactcgatgcaagt

SEQ ID NO: 5357476 - DNA, 13 bp, Homo sapiens
agactcggacttg

SEQ ID NO: 5357477 - DNA, 17 bp, Homo sapiens
agactcggggtgcttcc

SEQ ID NO: 5357478 - DNA, 21 bp, Homo sapiens
agactcgttctcgtgacccag

SEQ ID NO: 5357479 - DNA, 23 bp, Homo sapiens
agactcgttctcgtgacccagtg

SEQ ID NO: 5357480 - DNA, 23 bp, Homo sapiens
agactctaaaactatcagcagcg

SEQ ID NO: 5357481 - DNA, 13 bp, Homo sapiens
agactctaaatat

SEQ ID NO: 5357482 - DNA, 17 bp, Homo sapiens
agactctaagaaagaac

SEQ ID NO: 5357483 - DNA, 17 bp, Homo sapiens
agactctacagaggcca

SEQ ID NO: 5357484 - DNA, 13 bp, Homo sapiens
agactctaccaga

SEQ ID NO: 5357485 - DNA, 19 bp, Homo sapiens
agactctacccatattaca

SEQ ID NO: 5357486 - DNA, 22 bp, Homo sapiens
agactctagaaaaaagggctga

SEQ ID NO: 5357487 - DNA, 21 bp, Homo sapiens
agactctaggacataaattag

SEQ ID NO: 5357488 - DNA, 15 bp, Homo sapiens
agactctaggttata

SEQ ID NO: 5357489 - DNA, 17 bp, Homo sapiens
agactctagtatttatg

SEQ ID NO: 5357490 - DNA, 16 bp, Homo sapiens
agactctattttaatg

SEQ ID NO: 5357491 - DNA, 17 bp, Homo sapiens
agactctattttaatgt

SEQ ID NO: 5357492 - DNA, 20 bp, Homo sapiens
agactctattttaatgtata

SEQ ID NO: 5357493 - DNA, 12 bp, Homo sapiens
agactctcacag

SEQ ID NO: 5357494 - DNA, 11 bp, Homo sapiens
agactctcagg

SEQ ID NO: 5357495 - DNA, 20 bp, Homo sapiens
agactctccactgacctggt

SEQ ID NO: 5357496 - DNA, 19 bp, Homo sapiens
agactctcgcatcttccca

SEQ ID NO: 5357497 - DNA, 20 bp, Homo sapiens
agactctcgcatcttcccaa

SEQ ID NO: 5357498 - DNA, 23 bp, Homo sapiens
agactctcgcatcttcccaaccc

SEQ ID NO: 5357499 - DNA, 17 bp, Homo sapiens
agactctctcctctctc

SEQ ID NO: 5357500 - DNA, 21 bp, Homo sapiens
agactctctcctctctctccc

SEQ ID NO: 5357501 - DNA, 20 bp, Homo sapiens
agactctgaaatctcagaat

SEQ ID NO: 5357502 - DNA, 17 bp, Homo sapiens
agactctgagatgtgga

SEQ ID NO: 5357503 - DNA, 16 bp, Homo sapiens
agactctgcagccctc

SEQ ID NO: 5357504 - DNA, 20 bp, Homo sapiens
agactctgcagccctcggga

SEQ ID NO: 5357505 - DNA, 21 bp, Homo sapiens
agactctgccttaatttttga

SEQ ID NO: 5357506 - DNA, 14 bp, Homo sapiens
agactctgctctcc

SEQ ID NO: 5357507 - DNA, 14 bp, Homo sapiens
agactctggagcca

SEQ ID NO: 5357508 - DNA, 19 bp, Homo sapiens
agactctggagccaaggca

SEQ ID NO: 5357509 - DNA, 14 bp, Homo sapiens
agactctggtcttc

SEQ ID NO: 5357510 - DNA, 13 bp, Homo sapiens
agactctggtgtt

SEQ ID NO: 5357511 - DNA, 22 bp, Homo sapiens
agactctgtaaccacctctctg

SEQ ID NO: 5357512 - DNA, 23 bp, Homo sapiens
agactctgtaaccacctctctgt

SEQ ID NO: 5357513 - DNA, 18 bp, Homo sapiens
agactctgtctaaaaaac

SEQ ID NO: 5357514 - DNA, 20 bp, Homo sapiens
agactctgtctaaaaaacaa

SEQ ID NO: 5357515 - DNA, 13 bp, Homo sapiens
agactctgtctca

SEQ ID NO: 5357516 - DNA, 19 bp, Homo sapiens
agactctgtgatctaagca

SEQ ID NO: 5357517 - DNA, 16 bp, Homo sapiens
agactctgtggggcct

SEQ ID NO: 5357518 - DNA, 13 bp, Homo sapiens
agagaattcatgt

SEQ ID NO: 5357519 - DNA, 22 bp, Homo sapiens
agagaattctgttctaaaactc

SEQ ID NO: 5357520 - DNA, 15 bp, Homo sapiens
agagaattggctcaa

SEQ ID NO: 5357521 - DNA, 17 bp, Homo sapiens
agagaattgtatgtaac

SEQ ID NO: 5357522 - DNA, 19 bp, Homo sapiens
agagaattgtttgaacccg

SEQ ID NO: 5357523 - DNA, 22 bp, Homo sapiens
agagaatttctaccatttcaga

SEQ ID NO: 5357524 - DNA, 23 bp, Homo sapiens
agagaatttctaccatttcagag

SEQ ID NO: 5357525 - DNA, 13 bp, Homo sapiens
agagacaaaatat

SEQ ID NO: 5357526 - DNA, 18 bp, Homo sapiens
agagacaaactgtaaaaa

SEQ ID NO: 5357527 - DNA, 14 bp, Homo sapiens
agagacaaatagta

SEQ ID NO: 5357528 - DNA, 21 bp, Homo sapiens
agagacaactatcaattcttg

SEQ ID NO: 5357529 - DNA, 14 bp, Homo sapiens
agagacaagaagca

SEQ ID NO: 5357530 - DNA, 14 bp, Homo sapiens
agagacaagtaatt

SEQ ID NO: 5357531 - DNA, 18 bp, Homo sapiens
agagacaataaaacattc

SEQ ID NO: 5357532 - DNA, 19 bp, Homo sapiens
agagacaatagcattagaa

SEQ ID NO: 5357533 - DNA, 17 bp, Homo sapiens
agagacaatcacgggcg

SEQ ID NO: 5357534 - DNA, 16 bp, Homo sapiens
agagacaatctatttt

SEQ ID NO: 5357535 - DNA, 15 bp, Homo sapiens
agagacacaagcctt

SEQ ID NO: 5357536 - DNA, 18 bp, Homo sapiens
agagacacactgaagaag

SEQ ID NO: 5357537 - DNA, 13 bp, Homo sapiens
agagacacagaga

SEQ ID NO: 5357538 - DNA, 15 bp, Homo sapiens
agagacacagagatg

SEQ ID NO: 5357539 - DNA, 22 bp, Homo sapiens
agagacacatacagagtgggcc

SEQ ID NO: 5357540 - DNA, 23 bp, Homo sapiens
agagacacatacagagtgggccc

SEQ ID NO: 5357541 - DNA, 18 bp, Homo sapiens
agagacacctgcacctcc

SEQ ID NO: 5357542 - DNA, 16 bp, Homo sapiens
agagacactcccaggg

SEQ ID NO: 5357543 - DNA, 19 bp, Homo sapiens
agagacactcccccctcca

SEQ ID NO: 5357544 - DNA, 21 bp, Homo sapiens
agagacactcccccctccatt

SEQ ID NO: 5357545 - DNA, 15 bp, Homo sapiens
agagacactgagcca

SEQ ID NO: 5357546 - DNA, 15 bp, Homo sapiens
agagacactggtggg

SEQ ID NO: 5357547 - DNA, 24 bp, Homo sapiens
agagacagaaagcagaacagtgat

SEQ ID NO: 5357548 - DNA, 15 bp, Homo sapiens
agagacagaagcagg

SEQ ID NO: 5357549 - DNA, 17 bp, Homo sapiens
agagacagacttgagaa

SEQ ID NO: 5357550 - DNA, 13 bp, Homo sapiens
agagacagagagg

SEQ ID NO: 5357551 - DNA, 16 bp, Homo sapiens
agagacagagccccca

SEQ ID NO: 5357552 - DNA, 16 bp, Homo sapiens
agagacagaggatgtg

SEQ ID NO: 5357553 - DNA, 14 bp, Homo sapiens
agagacagagtgct

SEQ ID NO: 5357554 - DNA, 22 bp, Homo sapiens
agagacagatgctggtggagga

SEQ ID NO: 5357555 - DNA, 14 bp, Homo sapiens
agagacagcacagg

SEQ ID NO: 5357556 - DNA, 15 bp, Homo sapiens
agagacagcacaggc

SEQ ID NO: 5357557 - DNA, 16 bp, Homo sapiens
agagacagcacaggca

SEQ ID NO: 5357558 - DNA, 15 bp, Homo sapiens
agagacagcccagga

SEQ ID NO: 5357559 - DNA, 18 bp, Homo sapiens
agagacagcccaggatac

SEQ ID NO: 5357560 - DNA, 16 bp, Homo sapiens
agagacaggaaagaat

SEQ ID NO: 5357561 - DNA, 12 bp, Homo sapiens
agagacaggcag

SEQ ID NO: 5357562 - DNA, 16 bp, Homo sapiens
agagacaggcagctcg

SEQ ID NO: 5357563 - DNA, 22 bp, Homo sapiens
agagacaggcaggtgatctgct

SEQ ID NO: 5357564 - DNA, 18 bp, Homo sapiens
agagacaggcccaagaga

SEQ ID NO: 5357565 - DNA, 21 bp, Homo sapiens
agagacagggtctcactgtgt

SEQ ID NO: 5357566 - DNA, 12 bp, Homo sapiens
agagacagtcac

SEQ ID NO: 5357567 - DNA, 12 bp, Homo sapiens
agagacatatgg

SEQ ID NO: 5357568 - DNA, 15 bp, Homo sapiens
agagacatcagccct

SEQ ID NO: 5357569 - DNA, 23 bp, Homo sapiens
agagacatgagaaagggagagga

SEQ ID NO: 5357570 - DNA, 16 bp, Homo sapiens
agagacatggaagaga

SEQ ID NO: 5357571 - DNA, 19 bp, Homo sapiens
agagacatgggcctcccac

SEQ ID NO: 5357572 - DNA, 14 bp, Homo sapiens
agagacatggtatt

SEQ ID NO: 5357573 - DNA, 23 bp, Homo sapiens
agagacattaactcattagactg

SEQ ID NO: 5357574 - DNA, 15 bp, Homo sapiens
agagacatttcaaaa

SEQ ID NO: 5357575 - DNA, 14 bp, Homo sapiens
agagaccaaataat

SEQ ID NO: 5357576 - DNA, 16 bp, Homo sapiens
agagaccaagcttgtt

SEQ ID NO: 5357577 - DNA, 17 bp, Homo sapiens
agagaccacttccttaa

SEQ ID NO: 5357578 - DNA, 18 bp, Homo sapiens
agagaccacttccttaac

SEQ ID NO: 5357579 - DNA, 23 bp, Homo sapiens
agagaccacttccttaacagctg

SEQ ID NO: 5357580 - DNA, 14 bp, Homo sapiens
agagaccagccttt

SEQ ID NO: 5357581 - DNA, 15 bp, Homo sapiens
agagaccagcctttc

SEQ ID NO: 5357582 - DNA, 19 bp, Homo sapiens
agagaccaggcaaagcaag

SEQ ID NO: 5357583 - DNA, 16 bp, Homo sapiens
agagaccaggccctgg

SEQ ID NO: 5357584 - DNA, 18 bp, Homo sapiens
agagaccataagagaaac

SEQ ID NO: 5357585 - DNA, 19 bp, Homo sapiens
agagaccataagagaaacc

SEQ ID NO: 5357586 - DNA, 15 bp, Homo sapiens
agagaccatccctga

SEQ ID NO: 5357587 - DNA, 22 bp, Homo sapiens
agagaccatccctgaaggcccc

SEQ ID NO: 5357588 - DNA, 14 bp, Homo sapiens
agagaccattgcat

SEQ ID NO: 5357589 - DNA, 14 bp, Homo sapiens
agagacccaaggag

SEQ ID NO: 5357590 - DNA, 14 bp, Homo sapiens
agagacccagatct

SEQ ID NO: 5357591 - DNA, 15 bp, Homo sapiens
agagacccagatctc

SEQ ID NO: 5357592 - DNA, 13 bp, Homo sapiens
agagacccagctg

SEQ ID NO: 5357593 - DNA, 14 bp, Homo sapiens
agagacccagctgc

SEQ ID NO: 5357594 - DNA, 18 bp, Homo sapiens
agagacccagctgcagac

SEQ ID NO: 5357595 - DNA, 15 bp, Homo sapiens
agagaccccaggatc

SEQ ID NO: 5357596 - DNA, 20 bp, Homo sapiens
agagaccccttcctttcctc

SEQ ID NO: 5357597 - DNA, 23 bp, Homo sapiens
agagacccgggaaggaaggctct

SEQ ID NO: 5357598 - DNA, 21 bp, Homo sapiens
agagaccctctgccaccagag

SEQ ID NO: 5357599 - DNA, 14 bp, Homo sapiens
agagaccctgccaa

SEQ ID NO: 5357600 - DNA, 14 bp, Homo sapiens
agagaccctggcct

SEQ ID NO: 5357601 - DNA, 15 bp, Homo sapiens
agagaccctggcctc

SEQ ID NO: 5357602 - DNA, 16 bp, Homo sapiens
agagaccctggcctca

SEQ ID NO: 5357603 - DNA, 15 bp, Homo sapiens
agagaccgtcctcac

SEQ ID NO: 5357604 - DNA, 23 bp, Homo sapiens
agagaccgtcctcacccctgtcc

SEQ ID NO: 5357605 - DNA, 17 bp, Homo sapiens
agagacctacctcaggt

SEQ ID NO: 5357606 - DNA, 21 bp, Homo sapiens
agagacctcatcagccttggg

SEQ ID NO: 5357607 - DNA, 16 bp, Homo sapiens
agagacctcatcctgc

SEQ ID NO: 5357608 - DNA, 15 bp, Homo sapiens
agagacctgaagtgt

SEQ ID NO: 5357609 - DNA, 20 bp, Homo sapiens
agagacctgacccaacaccc

SEQ ID NO: 5357610 - DNA, 14 bp, Homo sapiens
agagacctgctcag

SEQ ID NO: 5357611 - DNA, 20 bp, Homo sapiens
agagacctgctccagatcct

SEQ ID NO: 5357612 - DNA, 14 bp, Homo sapiens
agagaccttctctt

SEQ ID NO: 5357613 - DNA, 20 bp, Homo sapiens
agagaccttctcttaggaca

SEQ ID NO: 5357614 - DNA, 13 bp, Homo sapiens
agagaccttttct

SEQ ID NO: 5357615 - DNA, 20 bp, Homo sapiens
agagaccttttctctcccat

SEQ ID NO: 5357616 - DNA, 16 bp, Homo sapiens
agagacgcaggaatgg

SEQ ID NO: 5357617 - DNA, 21 bp, Homo sapiens
agagacgccactccctgggac

SEQ ID NO: 5357618 - DNA, 17 bp, Homo sapiens
agagacgcccagcccca

SEQ ID NO: 5357619 - DNA, 19 bp, Homo sapiens
agagacgccctatttctat

SEQ ID NO: 5357620 - DNA, 13 bp, Homo sapiens
agagacggcagaa

SEQ ID NO: 5357621 - DNA, 20 bp, Homo sapiens
agagacggcagccccatcct

SEQ ID NO: 5357622 - DNA, 19 bp, Homo sapiens
agagacggcagcctgacct

SEQ ID NO: 5357623 - DNA, 15 bp, Homo sapiens
agagacggtgttttg

SEQ ID NO: 5357624 - DNA, 14 bp, Homo sapiens
agagactaatgttg

SEQ ID NO: 5357625 - DNA, 15 bp, Homo sapiens
agagactagacaaat

SEQ ID NO: 5357626 - DNA, 22 bp, Homo sapiens
agagactcagaggacccacctg

SEQ ID NO: 5357627 - DNA, 23 bp, Homo sapiens
agagactcagaggacccacctgg

SEQ ID NO: 5357628 - DNA, 18 bp, Homo sapiens
agagactcagcgctcctc

SEQ ID NO: 5357629 - DNA, 21 bp, Homo sapiens
agagactccaagattcaaaga

SEQ ID NO: 5357630 - DNA, 20 bp, Homo sapiens
agagactcccatgaagcctt

SEQ ID NO: 5357631 - DNA, 22 bp, Homo sapiens
agagactcccatgaagcctttt

SEQ ID NO: 5357632 - DNA, 18 bp, Homo sapiens
agagactcctgcaggcag

SEQ ID NO: 5357633 - DNA, 16 bp, Homo sapiens
agagactcgagtcccc

SEQ ID NO: 5357634 - DNA, 22 bp, Homo sapiens
agagactctttatttttctctt

SEQ ID NO: 5357635 - DNA, 16 bp, Homo sapiens
agagactgaaagcagc

SEQ ID NO: 5357636 - DNA, 19 bp, Homo sapiens
agagactgaaagcagcagc

SEQ ID NO: 5357637 - DNA, 14 bp, Homo sapiens
agagactgaaatta

SEQ ID NO: 5357638 - DNA, 22 bp, Homo sapiens
agagactgaatagatatgaaag

SEQ ID NO: 5357639 - DNA, 15 bp, Homo sapiens
agagactgagcagcc

SEQ ID NO: 5357640 - DNA, 14 bp, Homo sapiens
agagactgagggag

SEQ ID NO: 5357641 - DNA, 21 bp, Homo sapiens
agagactgatcatccaggcct

SEQ ID NO: 5357642 - DNA, 19 bp, Homo sapiens
agagactgcaagctgcttg

SEQ ID NO: 5357643 - DNA, 14 bp, Homo sapiens
agagactgcccacc

SEQ ID NO: 5357644 - DNA, 20 bp, Homo sapiens
agagactggcagccagggag

SEQ ID NO: 5357645 - DNA, 12 bp, Homo sapiens
agagactggcca

SEQ ID NO: 5357646 - DNA, 13 bp, Homo sapiens
agagactgggcct

SEQ ID NO: 5357647 - DNA, 19 bp, Homo sapiens
agagactggggcctggact

SEQ ID NO: 5357648 - DNA, 20 bp, Homo sapiens
agagactggttagtgatgca

SEQ ID NO: 5357649 - DNA, 18 bp, Homo sapiens
agagactggttttttcca

SEQ ID NO: 5357650 - DNA, 14 bp, Homo sapiens
agagactgtagatt

SEQ ID NO: 5357651 - DNA, 21 bp, Homo sapiens
agagactgtgaggcggcagct

SEQ ID NO: 5357652 - DNA, 16 bp, Homo sapiens
agagactgtgccatgg

SEQ ID NO: 5357653 - DNA, 17 bp, Homo sapiens
agagactgtttgaatgt

SEQ ID NO: 5357654 - DNA, 19 bp, Homo sapiens
agagactgtttgaatgttt

SEQ ID NO: 5357655 - DNA, 16 bp, Homo sapiens
agagacttaaaggaca

SEQ ID NO: 5357656 - DNA, 17 bp, Homo sapiens
agagacttctaaatcat

SEQ ID NO: 5357657 - DNA, 19 bp, Homo sapiens
agagacttggaagaggagg

SEQ ID NO: 5357658 - DNA, 20 bp, Homo sapiens
agagacttggaagaggagga

SEQ ID NO: 5357659 - DNA, 18 bp, Homo sapiens
agagacttggggaccaga

SEQ ID NO: 5357660 - DNA, 16 bp, Homo sapiens
agagacttgttttgga

SEQ ID NO: 5357661 - DNA, 17 bp, Homo sapiens
agagactttattgccta

SEQ ID NO: 5357662 - DNA, 18 bp, Homo sapiens
agagactttgtcacttat

SEQ ID NO: 5357663 - DNA, 16 bp, Homo sapiens
agagacttttaatcag

SEQ ID NO: 5357664 - DNA, 17 bp, Homo sapiens
agagacttttaatcaga

SEQ ID NO: 5357665 - DNA, 17 bp, Homo sapiens
agagacttttttctagt

SEQ ID NO: 5357666 - DNA, 13 bp, Homo sapiens
agagagaaaaaaa

SEQ ID NO: 5357667 - DNA, 13 bp, Homo sapiens
agagagaaaaaga

SEQ ID NO: 5357668 - DNA, 17 bp, Homo sapiens
agagagaaaaagagaga

SEQ ID NO: 5357669 - DNA, 19 bp, Homo sapiens
agagagaaaacttatttga

SEQ ID NO: 5357670 - DNA, 12 bp, Homo sapiens
agagagaaaata

SEQ ID NO: 5357671 - DNA, 13 bp, Homo sapiens
agagagaaaataa

SEQ ID NO: 5357672 - DNA, 14 bp, Homo sapiens
agagagaaaataaa

SEQ ID NO: 5357673 - DNA, 17 bp, Homo sapiens
agagagaaaataaaaag

SEQ ID NO: 5357674 - DNA, 22 bp, Homo sapiens
agagagaaagaagatagtgaga

SEQ ID NO: 5357675 - DNA, 13 bp, Homo sapiens
agagagaaagaat

SEQ ID NO: 5357676 - DNA, 21 bp, Homo sapiens
agagagaaagaatgagaaaga

SEQ ID NO: 5357677 - DNA, 15 bp, Homo sapiens
agagagaaagagaga

SEQ ID NO: 5357678 - DNA, 16 bp, Homo sapiens
agagagaaagccaggc

SEQ ID NO: 5357679 - DNA, 12 bp, Homo sapiens
agagagaaatct

SEQ ID NO: 5357680 - DNA, 20 bp, Homo sapiens
agagagaacaactactgtga

SEQ ID NO: 5357681 - DNA, 16 bp, Homo sapiens
agagagaacaggacta

SEQ ID NO: 5357682 - DNA, 14 bp, Homo sapiens
agagagaagagccc

SEQ ID NO: 5357683 - DNA, 12 bp, Homo sapiens
agagagaagcca

SEQ ID NO: 5357684 - DNA, 14 bp, Homo sapiens
agagagaagccagc

SEQ ID NO: 5357685 - DNA, 15 bp, Homo sapiens
agagagaagccagcc

SEQ ID NO: 5357686 - DNA, 23 bp, Homo sapiens
agagagaaggggcccaagagaga

SEQ ID NO: 5357687 - DNA, 13 bp, Homo sapiens
agagagaataaat

SEQ ID NO: 5357688 - DNA, 14 bp, Homo sapiens
agagagaataaatt

SEQ ID NO: 5357689 - DNA, 16 bp, Homo sapiens
agagagaatcagacct

SEQ ID NO: 5357690 - DNA, 14 bp, Homo sapiens
agagagacaagaag

SEQ ID NO: 5357691 - DNA, 13 bp, Homo sapiens
agagagacagaga

SEQ ID NO: 5357692 - DNA, 18 bp, Homo sapiens
agagagacagcacaggca

SEQ ID NO: 5357693 - DNA, 17 bp, Homo sapiens
agagagaccccaccgcc

SEQ ID NO: 5357694 - DNA, 23 bp, Homo sapiens
agagagaccctcactgctgggga

SEQ ID NO: 5357695 - DNA, 18 bp, Homo sapiens
agagagacctcatcctgc

SEQ ID NO: 5357696 - DNA, 19 bp, Homo sapiens
agagagacctcatcctgct

SEQ ID NO: 5357697 - DNA, 15 bp, Homo sapiens
agagcaggaggcccc

SEQ ID NO: 5357698 - DNA, 20 bp, Homo sapiens
agagcaggaggcccctggcc

SEQ ID NO: 5357699 - DNA, 22 bp, Homo sapiens
agagcaggaggcccctggccca

SEQ ID NO: 5357700 - DNA, 23 bp, Homo sapiens
agagcaggaggcccctggcccag

SEQ ID NO: 5357701 - DNA, 14 bp, Homo sapiens
agagcaggaggccg

SEQ ID NO: 5357702 - DNA, 19 bp, Homo sapiens
agagcaggatagctcttcc

SEQ ID NO: 5357703 - DNA, 23 bp, Homo sapiens
agagcaggatagctcttcctccc

SEQ ID NO: 5357704 - DNA, 18 bp, Homo sapiens
agagcaggcacatggagg

SEQ ID NO: 5357705 - DNA, 22 bp, Homo sapiens
agagcaggcaccagcagcagaa

SEQ ID NO: 5357706 - DNA, 12 bp, Homo sapiens
agagcaggcagg

SEQ ID NO: 5357707 - DNA, 21 bp, Homo sapiens
agagcaggcaggggcatctgt

SEQ ID NO: 5357708 - DNA, 13 bp, Homo sapiens
agagcaggccagg

SEQ ID NO: 5357709 - DNA, 13 bp, Homo sapiens
agagcaggctcag

SEQ ID NO: 5357710 - DNA, 17 bp, Homo sapiens
agagcaggctcagactc

SEQ ID NO: 5357711 - DNA, 22 bp, Homo sapiens
agagcagggattaacctctgca

SEQ ID NO: 5357712 - DNA, 22 bp, Homo sapiens
agagcagggccaaagcacagct

SEQ ID NO: 5357713 - DNA, 14 bp, Homo sapiens
agagcaggggagct

SEQ ID NO: 5357714 - DNA, 17 bp, Homo sapiens
agagcaggggctccagc

SEQ ID NO: 5357715 - DNA, 17 bp, Homo sapiens
agagcaggggctgctgg

SEQ ID NO: 5357716 - DNA, 19 bp, Homo sapiens
agagcaggggctgctgggg

SEQ ID NO: 5357717 - DNA, 20 bp, Homo sapiens
agagcaggggctgctggggg

SEQ ID NO: 5357718 - DNA, 18 bp, Homo sapiens
agagcaggtctgcaggcc

SEQ ID NO: 5357719 - DNA, 22 bp, Homo sapiens
agagcaggtctgcaggccacca

SEQ ID NO: 5357720 - DNA, 22 bp, Homo sapiens
agagcaggtgactgtgctgtgc

SEQ ID NO: 5357721 - DNA, 17 bp, Homo sapiens
agagcaggtgagatggg

SEQ ID NO: 5357722 - DNA, 15 bp, Homo sapiens
agagcaggttactaa

SEQ ID NO: 5357723 - DNA, 17 bp, Homo sapiens
agagcagtcagagtcca

SEQ ID NO: 5357724 - DNA, 19 bp, Homo sapiens
agagcagtctaaacagagt

SEQ ID NO: 5357725 - DNA, 13 bp, Homo sapiens
agagcagtgcttt

SEQ ID NO: 5357726 - DNA, 18 bp, Homo sapiens
agagcagtgggcaggtgg

SEQ ID NO: 5357727 - DNA, 17 bp, Homo sapiens
agagcagtggtaagaat

SEQ ID NO: 5357728 - DNA, 19 bp, Homo sapiens
agagcagtggtaagaatag

SEQ ID NO: 5357729 - DNA, 22 bp, Homo sapiens
agagcagtttctgtcctgctgg

SEQ ID NO: 5357730 - DNA, 21 bp, Homo sapiens
agagcatatttgccaataaag

SEQ ID NO: 5357731 - DNA, 22 bp, Homo sapiens
agagcatatttgccaataaagc

SEQ ID NO: 5357732 - DNA, 18 bp, Homo sapiens
agagcatcatgcctctga

SEQ ID NO: 5357733 - DNA, 20 bp, Homo sapiens
agagcatcatgcctctgagg

SEQ ID NO: 5357734 - DNA, 15 bp, Homo sapiens
agagcatccgtctcc

SEQ ID NO: 5357735 - DNA, 12 bp, Homo sapiens
agagcatcctga

SEQ ID NO: 5357736 - DNA, 23 bp, Homo sapiens
agagcatcctgataccattctat

SEQ ID NO: 5357737 - DNA, 16 bp, Homo sapiens
agagcatcggcctagg

SEQ ID NO: 5357738 - DNA, 16 bp, Homo sapiens
agagcatctcaggagg

SEQ ID NO: 5357739 - DNA, 16 bp, Homo sapiens
agagcatctctgcctc

SEQ ID NO: 5357740 - DNA, 16 bp, Homo sapiens
agagcatctgctctga

SEQ ID NO: 5357741 - DNA, 14 bp, Homo sapiens
agagcatctgtccc

SEQ ID NO: 5357742 - DNA, 14 bp, Homo sapiens
agagcatgatttga

SEQ ID NO: 5357743 - DNA, 19 bp, Homo sapiens
agagcatgatttgaaaaaa

SEQ ID NO: 5357744 - DNA, 20 bp, Homo sapiens
agagcatggatgcatttcaa

SEQ ID NO: 5357745 - DNA, 21 bp, Homo sapiens
agagcatggatgcatttcaaa

SEQ ID NO: 5357746 - DNA, 21 bp, Homo sapiens
agagcatgtgtcagagtgttg

SEQ ID NO: 5357747 - DNA, 14 bp, Homo sapiens
agagcattaaaata

SEQ ID NO: 5357748 - DNA, 20 bp, Homo sapiens
agagcattacgtgagccagg

SEQ ID NO: 5357749 - DNA, 22 bp, Homo sapiens
agagcattacgtgagccaggta

SEQ ID NO: 5357750 - DNA, 15 bp, Homo sapiens
agagcattagctggc

SEQ ID NO: 5357751 - DNA, 23 bp, Homo sapiens
agagcattataatcaccagggcc

SEQ ID NO: 5357752 - DNA, 16 bp, Homo sapiens
agagcattattcctgg

SEQ ID NO: 5357753 - DNA, 19 bp, Homo sapiens
agagcattattcctggtca

SEQ ID NO: 5357754 - DNA, 17 bp, Homo sapiens
agagcattccagtcagg

SEQ ID NO: 5357755 - DNA, 16 bp, Homo sapiens
agagcattctggggtg

SEQ ID NO: 5357756 - DNA, 18 bp, Homo sapiens
agagcatttaaggaaact

SEQ ID NO: 5357757 - DNA, 17 bp, Homo sapiens
agagcattttttatgat

SEQ ID NO: 5357758 - DNA, 19 bp, Homo sapiens
agagcattttttatgatat

SEQ ID NO: 5357759 - DNA, 10 bp, Homo sapiens
agagccaaac

SEQ ID NO: 5357760 - DNA, 16 bp, Homo sapiens
agagccaaacagagcc

SEQ ID NO: 5357761 - DNA, 17 bp, Homo sapiens
agagccaaacagagccc

SEQ ID NO: 5357762 - DNA, 19 bp, Homo sapiens
agagccaaacagagcccag

SEQ ID NO: 5357763 - DNA, 15 bp, Homo sapiens
agagccaacctcggc

SEQ ID NO: 5357764 - DNA, 20 bp, Homo sapiens
agagccaacctcggcttgtg

SEQ ID NO: 5357765 - DNA, 16 bp, Homo sapiens
agagccaacctggact

SEQ ID NO: 5357766 - DNA, 17 bp, Homo sapiens
agagccaacctggactt

SEQ ID NO: 5357767 - DNA, 21 bp, Homo sapiens
agagccaacctggacttcctg

SEQ ID NO: 5357768 - DNA, 22 bp, Homo sapiens
agagccaacctggacttcctgt

SEQ ID NO: 5357769 - DNA, 23 bp, Homo sapiens
agagccaacctggacttcctgtc

SEQ ID NO: 5357770 - DNA, 15 bp, Homo sapiens
agagccaagcactgc

SEQ ID NO: 5357771 - DNA, 23 bp, Homo sapiens
agagccaagccttaaactgtaca

SEQ ID NO: 5357772 - DNA, 14 bp, Homo sapiens
agagccaagctgca

SEQ ID NO: 5357773 - DNA, 15 bp, Homo sapiens
agagccaagctgcac

SEQ ID NO: 5357774 - DNA, 16 bp, Homo sapiens
agagccaagctgcaca

SEQ ID NO: 5357775 - DNA, 15 bp, Homo sapiens
agagccaaggccacc

SEQ ID NO: 5357776 - DNA, 22 bp, Homo sapiens
agagccaaggcctatgccacct

SEQ ID NO: 5357777 - DNA, 21 bp, Homo sapiens
agagccaagggggcagagggc

SEQ ID NO: 5357778 - DNA, 21 bp, Homo sapiens
agagccaagtagtcagtggaa

SEQ ID NO: 5357779 - DNA, 10 bp, Homo sapiens
agagccacaa

SEQ ID NO: 5357780 - DNA, 14 bp, Homo sapiens
agagccacaataag

SEQ ID NO: 5357781 - DNA, 14 bp, Homo sapiens
agagccacacatgg

SEQ ID NO: 5357782 - DNA, 20 bp, Homo sapiens
agagccacaggtctttatgt

SEQ ID NO: 5357783 - DNA, 15 bp, Homo sapiens
agagccaccaagagg

SEQ ID NO: 5357784 - DNA, 21 bp, Homo sapiens
agagccaccagggcactgtct

SEQ ID NO: 5357785 - DNA, 16 bp, Homo sapiens
agagccaccctgtgtt

SEQ ID NO: 5357786 - DNA, 18 bp, Homo sapiens
agagccacctgcaagatg

SEQ ID NO: 5357787 - DNA, 16 bp, Homo sapiens
agagccactgggcccc

SEQ ID NO: 5357788 - DNA, 18 bp, Homo sapiens
agagccactgggcccctg

SEQ ID NO: 5357789 - DNA, 20 bp, Homo sapiens
agagccactgggcccctgtc

SEQ ID NO: 5357790 - DNA, 23 bp, Homo sapiens
agagccactgggcccctgtcccc

SEQ ID NO: 5357791 - DNA, 22 bp, Homo sapiens
agagccactttcaagctgcact

SEQ ID NO: 5357792 - DNA, 17 bp, Homo sapiens
agagccagaagtaactt

SEQ ID NO: 5357793 - DNA, 13 bp, Homo sapiens
agagccagaccaa

SEQ ID NO: 5357794 - DNA, 16 bp, Homo sapiens
agagccagagaagtga

SEQ ID NO: 5357795 - DNA, 20 bp, Homo sapiens
agagccagagaagtgacagg

SEQ ID NO: 5357796 - DNA, 21 bp, Homo sapiens
agagccagagaagtgacaggg

SEQ ID NO: 5357797 - DNA, 19 bp, Homo sapiens
agagccagatgcaggacag

SEQ ID NO: 5357798 - DNA, 20 bp, Homo sapiens
agagccagatgcaggacagg

SEQ ID NO: 5357799 - DNA, 22 bp, Homo sapiens
agagccagccctccctgtcctc

SEQ ID NO: 5357800 - DNA, 17 bp, Homo sapiens
agagccagcctggctct

SEQ ID NO: 5357801 - DNA, 16 bp, Homo sapiens
agagccagcctgggac

SEQ ID NO: 5357802 - DNA, 19 bp, Homo sapiens
agagccagcggctccaact

SEQ ID NO: 5357803 - DNA, 21 bp, Homo sapiens
agagccagcggctccaactcc

SEQ ID NO: 5357804 - DNA, 21 bp, Homo sapiens
agagccagctaaggggtgggg

SEQ ID NO: 5357805 - DNA, 11 bp, Homo sapiens
agagccagctt

SEQ ID NO: 5357806 - DNA, 19 bp, Homo sapiens
agagccaggagaagctcag

SEQ ID NO: 5357807 - DNA, 22 bp, Homo sapiens
agagccaggatgcccagatgaa

SEQ ID NO: 5357808 - DNA, 20 bp, Homo sapiens
agagccaggctctgcctgga

SEQ ID NO: 5357809 - DNA, 12 bp, Homo sapiens
agagccagggca

SEQ ID NO: 5357810 - DNA, 16 bp, Homo sapiens
agagccagggcagggc

SEQ ID NO: 5357811 - DNA, 15 bp, Homo sapiens
agagccagggctgtc

SEQ ID NO: 5357812 - DNA, 22 bp, Homo sapiens
agagccaggggggtgaggagct

SEQ ID NO: 5357813 - DNA, 23 bp, Homo sapiens
agagccagtggcgggtgatggcc

SEQ ID NO: 5357814 - DNA, 15 bp, Homo sapiens
agagccatacataaa

SEQ ID NO: 5357815 - DNA, 22 bp, Homo sapiens
agagccatataagtttgaagga

SEQ ID NO: 5357816 - DNA, 13 bp, Homo sapiens
agagccatgaagc

SEQ ID NO: 5357817 - DNA, 16 bp, Homo sapiens
agagccatgaagcatt

SEQ ID NO: 5357818 - DNA, 17 bp, Homo sapiens
agagccatgaagcatta

SEQ ID NO: 5357819 - DNA, 14 bp, Homo sapiens
agagccatgccagg

SEQ ID NO: 5357820 - DNA, 13 bp, Homo sapiens
agagccatgggcc

SEQ ID NO: 5357821 - DNA, 17 bp, Homo sapiens
agagccatgggcctggg

SEQ ID NO: 5357822 - DNA, 20 bp, Homo sapiens
agagccatgggcctgggcct

SEQ ID NO: 5357823 - DNA, 18 bp, Homo sapiens
agagccatgtagaagctg

SEQ ID NO: 5357824 - DNA, 22 bp, Homo sapiens
agagccatgtcttctccctgga

SEQ ID NO: 5357825 - DNA, 22 bp, Homo sapiens
agagccattctggcactttaat

SEQ ID NO: 5357826 - DNA, 16 bp, Homo sapiens
agagccattttgtgaa

SEQ ID NO: 5357827 - DNA, 14 bp, Homo sapiens
agagcccaagtgcc

SEQ ID NO: 5357828 - DNA, 15 bp, Homo sapiens
agagcccaagtgcca

SEQ ID NO: 5357829 - DNA, 19 bp, Homo sapiens
agagcccaccagccagccc

SEQ ID NO: 5357830 - DNA, 13 bp, Homo sapiens
agagcccaccttg

SEQ ID NO: 5357831 - DNA, 13 bp, Homo sapiens
agagcccacgccc

SEQ ID NO: 5357832 - DNA, 16 bp, Homo sapiens
agagcccacgccccca

SEQ ID NO: 5357833 - DNA, 18 bp, Homo sapiens
agagcccacgcccccact

SEQ ID NO: 5357834 - DNA, 23 bp, Homo sapiens
agagcccactccatctggtagaa

SEQ ID NO: 5357835 - DNA, 15 bp, Homo sapiens
agagcccactgctca

SEQ ID NO: 5357836 - DNA, 18 bp, Homo sapiens
agagcccagagtcccccc

SEQ ID NO: 5357837 - DNA, 22 bp, Homo sapiens
agagcccagagtccccccactc

SEQ ID NO: 5357838 - DNA, 14 bp, Homo sapiens
agagcccagcccag

SEQ ID NO: 5357839 - DNA, 13 bp, Homo sapiens
agagcccagctcc

SEQ ID NO: 5357840 - DNA, 19 bp, Homo sapiens
agagcccagctcttgctct

SEQ ID NO: 5357841 - DNA, 22 bp, Homo sapiens
agagcccagctcttgctctctt

SEQ ID NO: 5357842 - DNA, 13 bp, Homo sapiens
agagcccaggagc

SEQ ID NO: 5357843 - DNA, 13 bp, Homo sapiens
agagcccaggctc

SEQ ID NO: 5357844 - DNA, 12 bp, Homo sapiens
agagcccagggg

SEQ ID NO: 5357845 - DNA, 14 bp, Homo sapiens
agagcccaggggag

SEQ ID NO: 5357846 - DNA, 15 bp, Homo sapiens
agagcccatgctcaa

SEQ ID NO: 5357847 - DNA, 20 bp, Homo sapiens
agagcccattaatcttgatc

SEQ ID NO: 5357848 - DNA, 16 bp, Homo sapiens
agagccccaagcagga

SEQ ID NO: 5357849 - DNA, 15 bp, Homo sapiens
agagccccacagccc

SEQ ID NO: 5357850 - DNA, 16 bp, Homo sapiens
agagccccactctcag

SEQ ID NO: 5357851 - DNA, 17 bp, Homo sapiens
agagccccactctcaga

SEQ ID NO: 5357852 - DNA, 20 bp, Homo sapiens
agagccccactctcagaggc

SEQ ID NO: 5357853 - DNA, 15 bp, Homo sapiens
agagccccagctgac

SEQ ID NO: 5357854 - DNA, 13 bp, Homo sapiens
agagcccccaagc

SEQ ID NO: 5357855 - DNA, 20 bp, Homo sapiens
agagcccccaagcctctgcc

SEQ ID NO: 5357856 - DNA, 15 bp, Homo sapiens
agagcccccaccttg

SEQ ID NO: 5357857 - DNA, 17 bp, Homo sapiens
agagcccccagccctgg

SEQ ID NO: 5357858 - DNA, 19 bp, Homo sapiens
agagcccccagccctggga

SEQ ID NO: 5357859 - DNA, 22 bp, Homo sapiens
agagcccccagccctgggaacc

SEQ ID NO: 5357860 - DNA, 22 bp, Homo sapiens
agagccccgcaaaacccactga

SEQ ID NO: 5357861 - DNA, 17 bp, Homo sapiens
agagccccgccccaccc

SEQ ID NO: 5357862 - DNA, 13 bp, Homo sapiens
agagcccctactg

SEQ ID NO: 5357863 - DNA, 19 bp, Homo sapiens
agagcccctactgtgggca

SEQ ID NO: 5357864 - DNA, 22 bp, Homo sapiens
agagcccctcctccagcccctg

SEQ ID NO: 5357865 - DNA, 23 bp, Homo sapiens
agagcccctcctccagcccctgt

SEQ ID NO: 5357866 - DNA, 16 bp, Homo sapiens
agagcccctggggcct

SEQ ID NO: 5357867 - DNA, 19 bp, Homo sapiens
agagcccctggggcctaga

SEQ ID NO: 5357868 - DNA, 22 bp, Homo sapiens
agagcccgaggaggtgtctcag

SEQ ID NO: 5357869 - DNA, 14 bp, Homo sapiens
agagcccggagctc

SEQ ID NO: 5357870 - DNA, 18 bp, Homo sapiens
agagcccggagctccggc

SEQ ID NO: 5357871 - DNA, 21 bp, Homo sapiens
agagcccggccccacctccct

SEQ ID NO: 5357872 - DNA, 22 bp, Homo sapiens
agagcccggccccacctccctg

SEQ ID NO: 5357873 - DNA, 21 bp, Homo sapiens
agaggcagcctctgcactccc

SEQ ID NO: 5357874 - DNA, 21 bp, Homo sapiens
agaggcagctaaggggcagga

SEQ ID NO: 5357875 - DNA, 17 bp, Homo sapiens
agaggcagctatctgca

SEQ ID NO: 5357876 - DNA, 17 bp, Homo sapiens
agaggcaggagtggcag

SEQ ID NO: 5357877 - DNA, 10 bp, Homo sapiens
agaggcaggg

SEQ ID NO: 5357878 - DNA, 16 bp, Homo sapiens
agaggcagggacctaa

SEQ ID NO: 5357879 - DNA, 11 bp, Homo sapiens
agaggcagggc

SEQ ID NO: 5357880 - DNA, 12 bp, Homo sapiens
agaggcagggcc

SEQ ID NO: 5357881 - DNA, 13 bp, Homo sapiens
agaggcagggccc

SEQ ID NO: 5357882 - DNA, 16 bp, Homo sapiens
agaggcagggccctgg

SEQ ID NO: 5357883 - DNA, 21 bp, Homo sapiens
agaggcagggtctcactctgt

SEQ ID NO: 5357884 - DNA, 13 bp, Homo sapiens
agaggcagtacct

SEQ ID NO: 5357885 - DNA, 13 bp, Homo sapiens
agaggcagtgaga

SEQ ID NO: 5357886 - DNA, 21 bp, Homo sapiens
agaggcagtgagactgcaggt

SEQ ID NO: 5357887 - DNA, 17 bp, Homo sapiens
agaggcagtgatgactt

SEQ ID NO: 5357888 - DNA, 21 bp, Homo sapiens
agaggcagtgatgacttgctg

SEQ ID NO: 5357889 - DNA, 14 bp, Homo sapiens
agaggcagtggcag

SEQ ID NO: 5357890 - DNA, 16 bp, Homo sapiens
agaggcatacacacag

SEQ ID NO: 5357891 - DNA, 17 bp, Homo sapiens
agaggcatcccaagacc

SEQ ID NO: 5357892 - DNA, 19 bp, Homo sapiens
agaggcatcctgcctgggt

SEQ ID NO: 5357893 - DNA, 21 bp, Homo sapiens
agaggcatcctgcctgggtgg

SEQ ID NO: 5357894 - DNA, 23 bp, Homo sapiens
agaggcatcctgcctgggtggga

SEQ ID NO: 5357895 - DNA, 24 bp, Homo sapiens
agaggcatgaacacacatggatgc

SEQ ID NO: 5357896 - DNA, 21 bp, Homo sapiens
agaggcatgggcttgctgtgg

SEQ ID NO: 5357897 - DNA, 10 bp, Homo sapiens
agaggcattg

SEQ ID NO: 5357898 - DNA, 16 bp, Homo sapiens
agaggcatttaaaatg

SEQ ID NO: 5357899 - DNA, 13 bp, Homo sapiens
agaggcatttccc

SEQ ID NO: 5357900 - DNA, 22 bp, Homo sapiens
agaggcatttgtcttagagaga

SEQ ID NO: 5357901 - DNA, 22 bp, Homo sapiens
agaggccaaattaatcttttaa

SEQ ID NO: 5357902 - DNA, 19 bp, Homo sapiens
agaggccaacactgtgggt

SEQ ID NO: 5357903 - DNA, 19 bp, Homo sapiens
agaggccaaggtattctat

SEQ ID NO: 5357904 - DNA, 17 bp, Homo sapiens
agaggccacctatgcca

SEQ ID NO: 5357905 - DNA, 17 bp, Homo sapiens
agaggccagccccaccc

SEQ ID NO: 5357906 - DNA, 18 bp, Homo sapiens
agaggccagccccaccca

SEQ ID NO: 5357907 - DNA, 17 bp, Homo sapiens
agaggccagtaggagac

SEQ ID NO: 5357908 - DNA, 14 bp, Homo sapiens
agaggccagttgat

SEQ ID NO: 5357909 - DNA, 16 bp, Homo sapiens
agaggccatggcagaa

SEQ ID NO: 5357910 - DNA, 17 bp, Homo sapiens
agaggccatgtctcctg

SEQ ID NO: 5357911 - DNA, 21 bp, Homo sapiens
agaggccattctttcccaaca

SEQ ID NO: 5357912 - DNA, 16 bp, Homo sapiens
agaggcccagccctca

SEQ ID NO: 5357913 - DNA, 17 bp, Homo sapiens
agaggcccagccctcag

SEQ ID NO: 5357914 - DNA, 12 bp, Homo sapiens
agaggcccaggc

SEQ ID NO: 5357915 - DNA, 13 bp, Homo sapiens
agaggcccaggca

SEQ ID NO: 5357916 - DNA, 18 bp, Homo sapiens
agaggcccaggctgccgt

SEQ ID NO: 5357917 - DNA, 14 bp, Homo sapiens
agaggcccagggag

SEQ ID NO: 5357918 - DNA, 20 bp, Homo sapiens
agaggccccaataccccatg

SEQ ID NO: 5357919 - DNA, 16 bp, Homo sapiens
agaggccccagcctcc

SEQ ID NO: 5357920 - DNA, 15 bp, Homo sapiens
agaggcccccaccct

SEQ ID NO: 5357921 - DNA, 21 bp, Homo sapiens
agaggcccccagcccagggct

SEQ ID NO: 5357922 - DNA, 18 bp, Homo sapiens
agaggccccttgctgctg

SEQ ID NO: 5357923 - DNA, 17 bp, Homo sapiens
agaggcccgcccgccca

SEQ ID NO: 5357924 - DNA, 20 bp, Homo sapiens
agaggcccgccctgcccggg

SEQ ID NO: 5357925 - DNA, 22 bp, Homo sapiens
agaggccctctggagtggccac

SEQ ID NO: 5357926 - DNA, 14 bp, Homo sapiens
agaggccctgccac

SEQ ID NO: 5357927 - DNA, 13 bp, Homo sapiens
agaggccctgccc

SEQ ID NO: 5357928 - DNA, 14 bp, Homo sapiens
agaggccctgcccc

SEQ ID NO: 5357929 - DNA, 17 bp, Homo sapiens
agaggccctgcccccac

SEQ ID NO: 5357930 - DNA, 11 bp, Homo sapiens
agaggccctgg

SEQ ID NO: 5357931 - DNA, 20 bp, Homo sapiens
agaggccctggacttcccaa

SEQ ID NO: 5357932 - DNA, 14 bp, Homo sapiens
agaggccctggagg

SEQ ID NO: 5357933 - DNA, 15 bp, Homo sapiens
agaggccctggaggt

SEQ ID NO: 5357934 - DNA, 15 bp, Homo sapiens
agaggccctggatca

SEQ ID NO: 5357935 - DNA, 17 bp, Homo sapiens
agaggccctggatcagc

SEQ ID NO: 5357936 - DNA, 20 bp, Homo sapiens
agaggccgaaggtgcctcag

SEQ ID NO: 5357937 - DNA, 21 bp, Homo sapiens
agaggccgaaggtgcctcaga

SEQ ID NO: 5357938 - DNA, 22 bp, Homo sapiens
agaggccgaaggtgcctcagac

SEQ ID NO: 5357939 - DNA, 18 bp, Homo sapiens
agaggccgagagctatgg

SEQ ID NO: 5357940 - DNA, 12 bp, Homo sapiens
agaggccgctgc

SEQ ID NO: 5357941 - DNA, 21 bp, Homo sapiens
agaggccgctgcagggtggca

SEQ ID NO: 5357942 - DNA, 17 bp, Homo sapiens
agaggccgctgcccctg

SEQ ID NO: 5357943 - DNA, 14 bp, Homo sapiens
agaggccgtggctg

SEQ ID NO: 5357944 - DNA, 17 bp, Homo sapiens
agaggccgtggctgctg

SEQ ID NO: 5357945 - DNA, 12 bp, Homo sapiens
agaggcctcagt

SEQ ID NO: 5357946 - DNA, 19 bp, Homo sapiens
agaggcctcatccagggcc

SEQ ID NO: 5357947 - DNA, 20 bp, Homo sapiens
agaggcctcatgcctgctga

SEQ ID NO: 5357948 - DNA, 22 bp, Homo sapiens
agaggcctccctggctgcctct

SEQ ID NO: 5357949 - DNA, 23 bp, Homo sapiens
agaggcctccctggctgcctctg

SEQ ID NO: 5357950 - DNA, 23 bp, Homo sapiens
agaggcctcctgtggcctgccag

SEQ ID NO: 5357951 - DNA, 21 bp, Homo sapiens
agaggcctcggctgtctcctg

SEQ ID NO: 5357952 - DNA, 23 bp, Homo sapiens
agaggcctgaaatcctggttcct

SEQ ID NO: 5357953 - DNA, 12 bp, Homo sapiens
agaggcctgccc

SEQ ID NO: 5357954 - DNA, 21 bp, Homo sapiens
agaggcctgcctccagggctg

SEQ ID NO: 5357955 - DNA, 10 bp, Homo sapiens
agaggcctgg

SEQ ID NO: 5357956 - DNA, 18 bp, Homo sapiens
agaggcctgggctgggaa

SEQ ID NO: 5357957 - DNA, 20 bp, Homo sapiens
agaggcctgggtgtgacctg

SEQ ID NO: 5357958 - DNA, 23 bp, Homo sapiens
agaggcctgggtgtgacctgaca

SEQ ID NO: 5357959 - DNA, 13 bp, Homo sapiens
agaggccttgggg

SEQ ID NO: 5357960 - DNA, 21 bp, Homo sapiens
agaggcctttaaccatggtgc

SEQ ID NO: 5357961 - DNA, 18 bp, Homo sapiens
agaggcgagtcaccctcc

SEQ ID NO: 5357962 - DNA, 16 bp, Homo sapiens
agaggcgcgtctgccc

SEQ ID NO: 5357963 - DNA, 21 bp, Homo sapiens
agaggcggaaaccttgcagca

SEQ ID NO: 5357964 - DNA, 23 bp, Homo sapiens
agaggcggaaaccttgcagcatt

SEQ ID NO: 5357965 - DNA, 12 bp, Homo sapiens
agaggcggcctc

SEQ ID NO: 5357966 - DNA, 17 bp, Homo sapiens
agaggcgggagaactga

SEQ ID NO: 5357967 - DNA, 14 bp, Homo sapiens
agaggcgggccagc

SEQ ID NO: 5357968 - DNA, 15 bp, Homo sapiens
agaggcgggccagcc

SEQ ID NO: 5357969 - DNA, 17 bp, Homo sapiens
agaggcggttgtaagag

SEQ ID NO: 5357970 - DNA, 22 bp, Homo sapiens
agaggcgtctcacatttttact

SEQ ID NO: 5357971 - DNA, 14 bp, Homo sapiens
agaggcgtcttgta

SEQ ID NO: 5357972 - DNA, 18 bp, Homo sapiens
agaggcgtgtgcaggccg

SEQ ID NO: 5357973 - DNA, 14 bp, Homo sapiens
agaggctactcttg

SEQ ID NO: 5357974 - DNA, 12 bp, Homo sapiens
agaggctagccc

SEQ ID NO: 5357975 - DNA, 14 bp, Homo sapiens
agaggctagcccca

SEQ ID NO: 5357976 - DNA, 16 bp, Homo sapiens
agaggctagccccagg

SEQ ID NO: 5357977 - DNA, 13 bp, Homo sapiens
agaggctatcctg

SEQ ID NO: 5357978 - DNA, 14 bp, Homo sapiens
agaggctcatggcc

SEQ ID NO: 5357979 - DNA, 16 bp, Homo sapiens
agaggctccctcctgt

SEQ ID NO: 5357980 - DNA, 14 bp, Homo sapiens
agaggctcctggag

SEQ ID NO: 5357981 - DNA, 15 bp, Homo sapiens
agaggctcctggagc

SEQ ID NO: 5357982 - DNA, 22 bp, Homo sapiens
agaggctcgttgactggctgtg

SEQ ID NO: 5357983 - DNA, 11 bp, Homo sapiens
agaggctctga

SEQ ID NO: 5357984 - DNA, 21 bp, Homo sapiens
agaggctctggacagcagaag

SEQ ID NO: 5357985 - DNA, 23 bp, Homo sapiens
agaggctctggacagcagaagcc

SEQ ID NO: 5357986 - DNA, 19 bp, Homo sapiens
agaggctctggggcagccc

SEQ ID NO: 5357987 - DNA, 13 bp, Homo sapiens
agaggctgagccc

SEQ ID NO: 5357988 - DNA, 16 bp, Homo sapiens
agaggctgagccctgt

SEQ ID NO: 5357989 - DNA, 17 bp, Homo sapiens
agaggctgagccctgta

SEQ ID NO: 5357990 - DNA, 13 bp, Homo sapiens
agaggctgaggca

SEQ ID NO: 5357991 - DNA, 21 bp, Homo sapiens
agaggctgaggctggcacagg

SEQ ID NO: 5357992 - DNA, 22 bp, Homo sapiens
agaggctgaggtgggcagatca

SEQ ID NO: 5357993 - DNA, 16 bp, Homo sapiens
agaggctgcacccctg

SEQ ID NO: 5357994 - DNA, 22 bp, Homo sapiens
agaggctgcacccctgggccag

SEQ ID NO: 5357995 - DNA, 13 bp, Homo sapiens
agaggctgcagaa

SEQ ID NO: 5357996 - DNA, 14 bp, Homo sapiens
agaggctgcccctc

SEQ ID NO: 5357997 - DNA, 16 bp, Homo sapiens
agaggctgcccctctc

SEQ ID NO: 5357998 - DNA, 18 bp, Homo sapiens
agaggctgcccctctcac

SEQ ID NO: 5357999 - DNA, 15 bp, Homo sapiens
agaggctgccctcct

SEQ ID NO: 5358000 - DNA, 15 bp, Homo sapiens
agaggctgcctcagc

SEQ ID NO: 5358001 - DNA, 22 bp, Homo sapiens
agaggctgcctctcccatcact

SEQ ID NO: 5358002 - DNA, 17 bp, Homo sapiens
agaggctgcttctctac

SEQ ID NO: 5358003 - DNA, 22 bp, Homo sapiens
agaggctggaaaagggctcaga

SEQ ID NO: 5358004 - DNA, 18 bp, Homo sapiens
agaggctggagacaggtg

SEQ ID NO: 5358005 - DNA, 16 bp, Homo sapiens
agaggctggatgactt

SEQ ID NO: 5358006 - DNA, 17 bp, Homo sapiens
agaggctggatgacttg

SEQ ID NO: 5358007 - DNA, 19 bp, Homo sapiens
agaggctggatgacttgct

SEQ ID NO: 5358008 - DNA, 19 bp, Homo sapiens
agaggctggcctctacatc

SEQ ID NO: 5358009 - DNA, 14 bp, Homo sapiens
agaggctgggagga

SEQ ID NO: 5358010 - DNA, 22 bp, Homo sapiens
agaggctgggaggttgggaggc

SEQ ID NO: 5358011 - DNA, 23 bp, Homo sapiens
agaggctgggaggttgggaggct

SEQ ID NO: 5358012 - DNA, 18 bp, Homo sapiens
agaggctgggctgggtgg

SEQ ID NO: 5358013 - DNA, 14 bp, Homo sapiens
agaggctgggttca

SEQ ID NO: 5358014 - DNA, 16 bp, Homo sapiens
agaggctggttccaga

SEQ ID NO: 5358015 - DNA, 16 bp, Homo sapiens
agaggctgtggctggt

SEQ ID NO: 5358016 - DNA, 17 bp, Homo sapiens
agaggctgtggtcagag

SEQ ID NO: 5358017 - DNA, 18 bp, Homo sapiens
agaggctgtgtccctgct

SEQ ID NO: 5358018 - DNA, 22 bp, Homo sapiens
agaggctgtgtccctgctgggg

SEQ ID NO: 5358019 - DNA, 20 bp, Homo sapiens
agaggctgtgtggccaacca

SEQ ID NO: 5358020 - DNA, 22 bp, Homo sapiens
agaggctgtgtggccaaccagg

SEQ ID NO: 5358021 - DNA, 22 bp, Homo sapiens
agaggcttatgagatctaatgt

SEQ ID NO: 5358022 - DNA, 15 bp, Homo sapiens
agaggcttccaagca

SEQ ID NO: 5358023 - DNA, 18 bp, Homo sapiens
agaggcttccaagcatta

SEQ ID NO: 5358024 - DNA, 21 bp, Homo sapiens
agaggcttccaagcattactt

SEQ ID NO: 5358025 - DNA, 20 bp, Homo sapiens
agaggcttccttcatttcct

SEQ ID NO: 5358026 - DNA, 19 bp, Homo sapiens
agaggcttctccgccagcc

SEQ ID NO: 5358027 - DNA, 23 bp, Homo sapiens
agaggcttctccgccagcctcct

SEQ ID NO: 5358028 - DNA, 14 bp, Homo sapiens
agaggcttcttcag

SEQ ID NO: 5358029 - DNA, 19 bp, Homo sapiens
agaggcttgtttacctttc

SEQ ID NO: 5358030 - DNA, 14 bp, Homo sapiens
agaggctttcaaat

SEQ ID NO: 5358031 - DNA, 18 bp, Homo sapiens
agaggctttcaaatgtac

SEQ ID NO: 5358032 - DNA, 16 bp, Homo sapiens
agagggaaaaggcagg

SEQ ID NO: 5358033 - DNA, 18 bp, Homo sapiens
agagggaaaggctgaaca

SEQ ID NO: 5358034 - DNA, 19 bp, Homo sapiens
agagggaacagggcggaga

SEQ ID NO: 5358035 - DNA, 15 bp, Homo sapiens
agagggaagaaaaga

SEQ ID NO: 5358036 - DNA, 23 bp, Homo sapiens
agagggaagaaaagagctttctt

SEQ ID NO: 5358037 - DNA, 15 bp, Homo sapiens
agagggaagagggag

SEQ ID NO: 5358038 - DNA, 17 bp, Homo sapiens
agagggaagagtgcatt

SEQ ID NO: 5358039 - DNA, 22 bp, Homo sapiens
agagggaagccagtcagggccc

SEQ ID NO: 5358040 - DNA, 15 bp, Homo sapiens
agagggaagccatgt

SEQ ID NO: 5358041 - DNA, 16 bp, Homo sapiens
agagggaagccatgtg

SEQ ID NO: 5358042 - DNA, 22 bp, Homo sapiens
agagggaagctgaggcccatgg

SEQ ID NO: 5358043 - DNA, 21 bp, Homo sapiens
agagggaaggggcctacaccc

SEQ ID NO: 5358044 - DNA, 21 bp, Homo sapiens
agagggaaggtgaccgcccag

SEQ ID NO: 5358045 - DNA, 19 bp, Homo sapiens
agagggaagtttaaaaccc

SEQ ID NO: 5358046 - DNA, 14 bp, Homo sapiens
agagggaatgtgaa

SEQ ID NO: 5358047 - DNA, 15 bp, Homo sapiens
agagggaatgtgaaa

SEQ ID NO: 5358048 - DNA, 18 bp, Homo sapiens
agagggaatgtgaaattt

SEQ ID NO: 5358049 - DNA, 16 bp, Homo sapiens
agagggacacatgccc

SEQ ID NO: 5358050 - DNA, 16 bp, Homo sapiens
agagggacagagcccg

SEQ ID NO: 5358051 - DNA, 19 bp, Homo sapiens
agagtgtcaaccagacaga

SEQ ID NO: 5358052 - DNA, 21 bp, Homo sapiens
agagtgtcaaccagacagagg

SEQ ID NO: 5358053 - DNA, 23 bp, Homo sapiens
agagtgtccccagagacatgcaa

SEQ ID NO: 5358054 - DNA, 15 bp, Homo sapiens
agagtgtctatggag

SEQ ID NO: 5358055 - DNA, 22 bp, Homo sapiens
agagtgtcttcacggcaggaca

SEQ ID NO: 5358056 - DNA, 15 bp, Homo sapiens
agagtgtctttccac

SEQ ID NO: 5358057 - DNA, 11 bp, Homo sapiens
agagtgtgacc

SEQ ID NO: 5358058 - DNA, 14 bp, Homo sapiens
agagtgtgaccaaa

SEQ ID NO: 5358059 - DNA, 19 bp, Homo sapiens
agagtgtgagcagggcttg

SEQ ID NO: 5358060 - DNA, 17 bp, Homo sapiens
agagtgtgcagactgat

SEQ ID NO: 5358061 - DNA, 14 bp, Homo sapiens
agagtgtgcctgaa

SEQ ID NO: 5358062 - DNA, 21 bp, Homo sapiens
agagtgtggaaaaaaaaagaa

SEQ ID NO: 5358063 - DNA, 17 bp, Homo sapiens
agagtgtggccttcgga

SEQ ID NO: 5358064 - DNA, 14 bp, Homo sapiens
agagtgtgtgggca

SEQ ID NO: 5358065 - DNA, 16 bp, Homo sapiens
agagtgtgtgggcagg

SEQ ID NO: 5358066 - DNA, 15 bp, Homo sapiens
agagtgtgtgtttgt

SEQ ID NO: 5358067 - DNA, 16 bp, Homo sapiens
agagtgtgtttttgca

SEQ ID NO: 5358068 - DNA, 20 bp, Homo sapiens
agagtgtgtttttgcactgt

SEQ ID NO: 5358069 - DNA, 23 bp, Homo sapiens
agagtgtgtttttgcactgtctg

SEQ ID NO: 5358070 - DNA, 14 bp, Homo sapiens
agagtgttcctgtt

SEQ ID NO: 5358071 - DNA, 14 bp, Homo sapiens
agagtgttgaaacg

SEQ ID NO: 5358072 - DNA, 20 bp, Homo sapiens
agagtgttttgaccagttta

SEQ ID NO: 5358073 - DNA, 16 bp, Homo sapiens
agagttaaaagcagca

SEQ ID NO: 5358074 - DNA, 18 bp, Homo sapiens
agagttaaaagcagcagc

SEQ ID NO: 5358075 - DNA, 14 bp, Homo sapiens
agagttaaaagtta

SEQ ID NO: 5358076 - DNA, 12 bp, Homo sapiens
agagttaaaata

SEQ ID NO: 5358077 - DNA, 22 bp, Homo sapiens
agagttaaaatgtttactgtaa

SEQ ID NO: 5358078 - DNA, 14 bp, Homo sapiens
agagttaaatggtc

SEQ ID NO: 5358079 - DNA, 21 bp, Homo sapiens
agagttaagaagctgttgtac

SEQ ID NO: 5358080 - DNA, 22 bp, Homo sapiens
agagttacaataaagtttacaa

SEQ ID NO: 5358081 - DNA, 11 bp, Homo sapiens
agagttacagt

SEQ ID NO: 5358082 - DNA, 13 bp, Homo sapiens
agagttagactgt

SEQ ID NO: 5358083 - DNA, 20 bp, Homo sapiens
agagttagctgataaggaaa

SEQ ID NO: 5358084 - DNA, 18 bp, Homo sapiens
agagttaggtttaacata

SEQ ID NO: 5358085 - DNA, 23 bp, Homo sapiens
agagttaggtttaacataaaggt

SEQ ID NO: 5358086 - DNA, 23 bp, Homo sapiens
agagttagtcgccctacagaaaa

SEQ ID NO: 5358087 - DNA, 19 bp, Homo sapiens
agagttagtttctttggga

SEQ ID NO: 5358088 - DNA, 17 bp, Homo sapiens
agagttatcttctttat

SEQ ID NO: 5358089 - DNA, 12 bp, Homo sapiens
agagttattcaa

SEQ ID NO: 5358090 - DNA, 18 bp, Homo sapiens
agagttattcaaatgaag

SEQ ID NO: 5358091 - DNA, 19 bp, Homo sapiens
agagttattgaatcttaat

SEQ ID NO: 5358092 - DNA, 17 bp, Homo sapiens
agagttatttaggcttt

SEQ ID NO: 5358093 - DNA, 14 bp, Homo sapiens
agagttcaagaaat

SEQ ID NO: 5358094 - DNA, 21 bp, Homo sapiens
agagttcaagaaataagtttt

SEQ ID NO: 5358095 - DNA, 16 bp, Homo sapiens
agagttcaagcctgtg

SEQ ID NO: 5358096 - DNA, 17 bp, Homo sapiens
agagttcaatggctgct

SEQ ID NO: 5358097 - DNA, 13 bp, Homo sapiens
agagttcacagga

SEQ ID NO: 5358098 - DNA, 13 bp, Homo sapiens
agagttcagactt

SEQ ID NO: 5358099 - DNA, 17 bp, Homo sapiens
agagttcagacttcgct

SEQ ID NO: 5358100 - DNA, 16 bp, Homo sapiens
agagttcagggaagat

SEQ ID NO: 5358101 - DNA, 22 bp, Homo sapiens
agagttcagtaagaccggaagc

SEQ ID NO: 5358102 - DNA, 14 bp, Homo sapiens
agagttcatagaaa

SEQ ID NO: 5358103 - DNA, 23 bp, Homo sapiens
agagttcattcaaaatgtccagc

SEQ ID NO: 5358104 - DNA, 22 bp, Homo sapiens
agagttccacaaatctatatta

SEQ ID NO: 5358105 - DNA, 19 bp, Homo sapiens
agagttccccatgcagaca

SEQ ID NO: 5358106 - DNA, 16 bp, Homo sapiens
agagttccggggagaa

SEQ ID NO: 5358107 - DNA, 17 bp, Homo sapiens
agagttccggggagaaa

SEQ ID NO: 5358108 - DNA, 16 bp, Homo sapiens
agagttccttctcact

SEQ ID NO: 5358109 - DNA, 20 bp, Homo sapiens
agagttctatccccaagctg

SEQ ID NO: 5358110 - DNA, 14 bp, Homo sapiens
agagttctgctcta

SEQ ID NO: 5358111 - DNA, 17 bp, Homo sapiens
agagttctggattcaaa

SEQ ID NO: 5358112 - DNA, 21 bp, Homo sapiens
agagttctttaggtgcctcct

SEQ ID NO: 5358113 - DNA, 20 bp, Homo sapiens
agagttctttttgaagtatt

SEQ ID NO: 5358114 - DNA, 12 bp, Homo sapiens
agagttgaacct

SEQ ID NO: 5358115 - DNA, 13 bp, Homo sapiens
agagttgaagaca

SEQ ID NO: 5358116 - DNA, 19 bp, Homo sapiens
agagttgacccctcctgaa

SEQ ID NO: 5358117 - DNA, 13 bp, Homo sapiens
agagttgagctct

SEQ ID NO: 5358118 - DNA, 22 bp, Homo sapiens
agagttgatactacagtttgtt

SEQ ID NO: 5358119 - DNA, 18 bp, Homo sapiens
agagttgccccgtctctg

SEQ ID NO: 5358120 - DNA, 23 bp, Homo sapiens
agagttgccccgtctctgttcca

SEQ ID NO: 5358121 - DNA, 15 bp, Homo sapiens
agagttgctcctcag

SEQ ID NO: 5358122 - DNA, 19 bp, Homo sapiens
agagttgctttgccagagc

SEQ ID NO: 5358123 - DNA, 20 bp, Homo sapiens
agagttgctttgccagagca

SEQ ID NO: 5358124 - DNA, 21 bp, Homo sapiens
agagttgctttgccagagcag

SEQ ID NO: 5358125 - DNA, 17 bp, Homo sapiens
agagttggcatgactct

SEQ ID NO: 5358126 - DNA, 16 bp, Homo sapiens
agagttggggaaggca

SEQ ID NO: 5358127 - DNA, 19 bp, Homo sapiens
agagttgggggccagcaca

SEQ ID NO: 5358128 - DNA, 19 bp, Homo sapiens
agagttgtaaatatataaa

SEQ ID NO: 5358129 - DNA, 22 bp, Homo sapiens
agagttgtaaatatataaatat

SEQ ID NO: 5358130 - DNA, 23 bp, Homo sapiens
agagttgtctgtccaggccctta

SEQ ID NO: 5358131 - DNA, 17 bp, Homo sapiens
agagttgttacattttt

SEQ ID NO: 5358132 - DNA, 16 bp, Homo sapiens
agagttgttctcaggg

SEQ ID NO: 5358133 - DNA, 19 bp, Homo sapiens
agagtttaaagagaaaagg

SEQ ID NO: 5358134 - DNA, 22 bp, Homo sapiens
agagtttaacacaagtcctgtg

SEQ ID NO: 5358135 - DNA, 15 bp, Homo sapiens
agagtttaacagata

SEQ ID NO: 5358136 - DNA, 19 bp, Homo sapiens
agagtttaacagatattta

SEQ ID NO: 5358137 - DNA, 14 bp, Homo sapiens
agagtttacaagaa

SEQ ID NO: 5358138 - DNA, 15 bp, Homo sapiens
agagtttacaagaaa

SEQ ID NO: 5358139 - DNA, 13 bp, Homo sapiens
agagtttacagtt

SEQ ID NO: 5358140 - DNA, 16 bp, Homo sapiens
agagtttagctggaaa

SEQ ID NO: 5358141 - DNA, 23 bp, Homo sapiens
agagtttagctgtaacagttctt

SEQ ID NO: 5358142 - DNA, 14 bp, Homo sapiens
agagtttagtcctt

SEQ ID NO: 5358143 - DNA, 16 bp, Homo sapiens
agagtttagttgtagc

SEQ ID NO: 5358144 - DNA, 19 bp, Homo sapiens
agagtttatacagtgtaca

SEQ ID NO: 5358145 - DNA, 20 bp, Homo sapiens
agagtttatacagtgtacat

SEQ ID NO: 5358146 - DNA, 23 bp, Homo sapiens
agagtttatacagtgtacatgta

SEQ ID NO: 5358147 - DNA, 21 bp, Homo sapiens
agagtttatttttttgatggc

SEQ ID NO: 5358148 - DNA, 13 bp, Homo sapiens
agagtttcaaaag

SEQ ID NO: 5358149 - DNA, 20 bp, Homo sapiens
agagtttcagtttgttggaa

SEQ ID NO: 5358150 - DNA, 21 bp, Homo sapiens
agagtttcagtttgttggaaa

SEQ ID NO: 5358151 - DNA, 13 bp, Homo sapiens
agagtttcctgaa

SEQ ID NO: 5358152 - DNA, 15 bp, Homo sapiens
agagtttctggatta

SEQ ID NO: 5358153 - DNA, 19 bp, Homo sapiens
agagtttcttaacttactt

SEQ ID NO: 5358154 - DNA, 17 bp, Homo sapiens
agagtttctttacattg

SEQ ID NO: 5358155 - DNA, 20 bp, Homo sapiens
agagtttgagacctgaatag

SEQ ID NO: 5358156 - DNA, 12 bp, Homo sapiens
agagtttgatca

SEQ ID NO: 5358157 - DNA, 17 bp, Homo sapiens
agagtttgccttataaa

SEQ ID NO: 5358158 - DNA, 23 bp, Homo sapiens
agagtttgtaaggtcatgctggt

SEQ ID NO: 5358159 - DNA, 14 bp, Homo sapiens
agagtttgtagtaa

SEQ ID NO: 5358160 - DNA, 23 bp, Homo sapiens
agagtttgtgtgtatttgtatta

SEQ ID NO: 5358161 - DNA, 18 bp, Homo sapiens
agagtttgtgtgttgtct

SEQ ID NO: 5358162 - DNA, 22 bp, Homo sapiens
agagtttgtgtgttgtcttgaa

SEQ ID NO: 5358163 - DNA, 17 bp, Homo sapiens
agagtttgttctgttct

SEQ ID NO: 5358164 - DNA, 13 bp, Homo sapiens
agagttttactaa

SEQ ID NO: 5358165 - DNA, 16 bp, Homo sapiens
agagttttactaagat

SEQ ID NO: 5358166 - DNA, 23 bp, Homo sapiens
agagttttatagcctggactgct

SEQ ID NO: 5358167 - DNA, 18 bp, Homo sapiens
agagttttattcctttcc

SEQ ID NO: 5358168 - DNA, 13 bp, Homo sapiens
agagttttctaac

SEQ ID NO: 5358169 - DNA, 22 bp, Homo sapiens
agagttttctttctttctgttt

SEQ ID NO: 5358170 - DNA, 17 bp, Homo sapiens
agagttttggatgcagt

SEQ ID NO: 5358171 - DNA, 19 bp, Homo sapiens
agagttttggatgcagtgc

SEQ ID NO: 5358172 - DNA, 20 bp, Homo sapiens
agagttttggatgcagtgct

SEQ ID NO: 5358173 - DNA, 21 bp, Homo sapiens
agagttttggatgcagtgctc

SEQ ID NO: 5358174 - DNA, 20 bp, Homo sapiens
agagttttgtcattcagagt

SEQ ID NO: 5358175 - DNA, 14 bp, Homo sapiens
agagttttgtcttg

SEQ ID NO: 5358176 - DNA, 22 bp, Homo sapiens
agagtttttatgcctttctctc

SEQ ID NO: 5358177 - DNA, 13 bp, Homo sapiens
agagtttttgtta

SEQ ID NO: 5358178 - DNA, 14 bp, Homo sapiens
agagttttttaaac

SEQ ID NO: 5358179 - DNA, 20 bp, Homo sapiens
agataaaaacaatatatgta

SEQ ID NO: 5358180 - DNA, 22 bp, Homo sapiens
agataaaaacaatatatgtaaa

SEQ ID NO: 5358181 - DNA, 13 bp, Homo sapiens
agataaaaagtgg

SEQ ID NO: 5358182 - DNA, 17 bp, Homo sapiens
agataaaaagtggaatt

SEQ ID NO: 5358183 - DNA, 18 bp, Homo sapiens
agataaaacgatctaaag

SEQ ID NO: 5358184 - DNA, 15 bp, Homo sapiens
agataaaagcttagg

SEQ ID NO: 5358185 - DNA, 23 bp, Homo sapiens
agataaaaggtggagtttctctg

SEQ ID NO: 5358186 - DNA, 14 bp, Homo sapiens
agataaacacaggc

SEQ ID NO: 5358187 - DNA, 21 bp, Homo sapiens
agataaacaccaacccaggaa

SEQ ID NO: 5358188 - DNA, 20 bp, Homo sapiens
agataaacagaaatgctctg

SEQ ID NO: 5358189 - DNA, 15 bp, Homo sapiens
agataaactgaaatt

SEQ ID NO: 5358190 - DNA, 11 bp, Homo sapiens
agataaagatg

SEQ ID NO: 5358191 - DNA, 21 bp, Homo sapiens
agataaagatgatattaagaa

SEQ ID NO: 5358192 - DNA, 13 bp, Homo sapiens
agataaagattgt

SEQ ID NO: 5358193 - DNA, 17 bp, Homo sapiens
agataaagatttcttga

SEQ ID NO: 5358194 - DNA, 13 bp, Homo sapiens
agataaagccaga

SEQ ID NO: 5358195 - DNA, 19 bp, Homo sapiens
agataaagcttaggtcaaa

SEQ ID NO: 5358196 - DNA, 18 bp, Homo sapiens
agataaagtaagcctagg

SEQ ID NO: 5358197 - DNA, 19 bp, Homo sapiens
agataaagtcaaatgccaa

SEQ ID NO: 5358198 - DNA, 22 bp, Homo sapiens
agataaagtcctgaacctttca

SEQ ID NO: 5358199 - DNA, 13 bp, Homo sapiens
agataaagtggtt

SEQ ID NO: 5358200 - DNA, 14 bp, Homo sapiens
agataaatagaact

SEQ ID NO: 5358201 - DNA, 15 bp, Homo sapiens
agataaatagaacta

SEQ ID NO: 5358202 - DNA, 14 bp, Homo sapiens
agataaatattata

SEQ ID NO: 5358203 - DNA, 14 bp, Homo sapiens
agataaatatttat

SEQ ID NO: 5358204 - DNA, 16 bp, Homo sapiens
agataaatgattcaaa

SEQ ID NO: 5358205 - DNA, 18 bp, Homo sapiens
agataaatgctttaaata

SEQ ID NO: 5358206 - DNA, 22 bp, Homo sapiens
agataaatttcaattagattta

SEQ ID NO: 5358207 - DNA, 15 bp, Homo sapiens
agataacaactgtga

SEQ ID NO: 5358208 - DNA, 21 bp, Homo sapiens
agataacaagatctttcagga

SEQ ID NO: 5358209 - DNA, 22 bp, Homo sapiens
agataacagcctcttgcccgtc

SEQ ID NO: 5358210 - DNA, 12 bp, Homo sapiens
agataacatttt

SEQ ID NO: 5358211 - DNA, 21 bp, Homo sapiens
agataaccagctgtaacacag

SEQ ID NO: 5358212 - DNA, 15 bp, Homo sapiens
agataaccatattca

SEQ ID NO: 5358213 - DNA, 21 bp, Homo sapiens
agataaccccaagacagtctt

SEQ ID NO: 5358214 - DNA, 18 bp, Homo sapiens
agataacccttattccat

SEQ ID NO: 5358215 - DNA, 21 bp, Homo sapiens
agataacctaataattgtatc

SEQ ID NO: 5358216 - DNA, 14 bp, Homo sapiens
agataacggctctc

SEQ ID NO: 5358217 - DNA, 21 bp, Homo sapiens
agataacggctctccagacct

SEQ ID NO: 5358218 - DNA, 22 bp, Homo sapiens
agataactctttggatagcatg

SEQ ID NO: 5358219 - DNA, 18 bp, Homo sapiens
agataactgaaaattatt

SEQ ID NO: 5358220 - DNA, 22 bp, Homo sapiens
agataactgaaaattatttaaa

SEQ ID NO: 5358221 - DNA, 14 bp, Homo sapiens
agataactgagaat

SEQ ID NO: 5358222 - DNA, 14 bp, Homo sapiens
agataactgctctt

SEQ ID NO: 5358223 - DNA, 15 bp, Homo sapiens
agataactgctcttt

SEQ ID NO: 5358224 - DNA, 18 bp, Homo sapiens
agataactgctcttttac

SEQ ID NO: 5358225 - DNA, 20 bp, Homo sapiens
agataactgttatttataat

SEQ ID NO: 5358226 - DNA, 16 bp, Homo sapiens
agataacttaaataat

SEQ ID NO: 5358227 - DNA, 18 bp, Homo sapiens
agataacttaaataattt

SEQ ID NO: 5358228 - DNA, 15 bp, Homo sapiens
agatcactgaacttt

SEQ ID NO: 5358229 - DNA, 16 bp, Homo sapiens
agatcactgaactttt

SEQ ID NO: 5358230 - DNA, 17 bp, Homo sapiens
agatcactgaattggaa

SEQ ID NO: 5358231 - DNA, 14 bp, Homo sapiens
agatcactgtagtt

SEQ ID NO: 5358232 - DNA, 22 bp, Homo sapiens
agatcactgtagtttagttctg

SEQ ID NO: 5358233 - DNA, 16 bp, Homo sapiens
agatcactgtttagat

SEQ ID NO: 5358234 - DNA, 18 bp, Homo sapiens
agatcactgtttagattt

SEQ ID NO: 5358235 - DNA, 16 bp, Homo sapiens
agatcacttgtcctct

SEQ ID NO: 5358236 - DNA, 19 bp, Homo sapiens
agatcacttgtcctcttgc

SEQ ID NO: 5358237 - DNA, 18 bp, Homo sapiens
agatcactttctcagttt

SEQ ID NO: 5358238 - DNA, 21 bp, Homo sapiens
agatcagaaaaatggagcaaa

SEQ ID NO: 5358239 - DNA, 20 bp, Homo sapiens
agatcagaacattcagctct

SEQ ID NO: 5358240 - DNA, 21 bp, Homo sapiens
agatcagaacattcagctctg

SEQ ID NO: 5358241 - DNA, 22 bp, Homo sapiens
agatcagaacattcagctctgg

SEQ ID NO: 5358242 - DNA, 23 bp, Homo sapiens
agatcagaacattcagctctgga

SEQ ID NO: 5358243 - DNA, 13 bp, Homo sapiens
agatcagactctc

SEQ ID NO: 5358244 - DNA, 12 bp, Homo sapiens
agatcagagagc

SEQ ID NO: 5358245 - DNA, 18 bp, Homo sapiens
agatcagatgctccaaga

SEQ ID NO: 5358246 - DNA, 23 bp, Homo sapiens
agatcagcagcgtgcacatctgc

SEQ ID NO: 5358247 - DNA, 18 bp, Homo sapiens
agatcagcagtggcagga

SEQ ID NO: 5358248 - DNA, 23 bp, Homo sapiens
agatcagcatccaaaagcaggaa

SEQ ID NO: 5358249 - DNA, 15 bp, Homo sapiens
agatcagcattcaaa

SEQ ID NO: 5358250 - DNA, 14 bp, Homo sapiens
agatcagccacgga

SEQ ID NO: 5358251 - DNA, 21 bp, Homo sapiens
agatcagccacggagcctgga

SEQ ID NO: 5358252 - DNA, 12 bp, Homo sapiens
agatcagccaga

SEQ ID NO: 5358253 - DNA, 17 bp, Homo sapiens
agatcagccattaaaat

SEQ ID NO: 5358254 - DNA, 19 bp, Homo sapiens
agatcagccattaaaataa

SEQ ID NO: 5358255 - DNA, 22 bp, Homo sapiens
agatcagccattaaaataaaac

SEQ ID NO: 5358256 - DNA, 17 bp, Homo sapiens
agatcaggaagagaagg

SEQ ID NO: 5358257 - DNA, 19 bp, Homo sapiens
agatcaggagaaactcggg

SEQ ID NO: 5358258 - DNA, 16 bp, Homo sapiens
agatcaggagtgacag

SEQ ID NO: 5358259 - DNA, 21 bp, Homo sapiens
agatcaggctagccctgccct

SEQ ID NO: 5358260 - DNA, 12 bp, Homo sapiens
agatcagggata

SEQ ID NO: 5358261 - DNA, 17 bp, Homo sapiens
agatcagggcctgcccc

SEQ ID NO: 5358262 - DNA, 11 bp, Homo sapiens
agatcaggttt

SEQ ID NO: 5358263 - DNA, 15 bp, Homo sapiens
agatcagttttccta

SEQ ID NO: 5358264 - DNA, 22 bp, Homo sapiens
agatcagttttcctagtctttg

SEQ ID NO: 5358265 - DNA, 18 bp, Homo sapiens
agatcatagatttctgat

SEQ ID NO: 5358266 - DNA, 19 bp, Homo sapiens
agatcatagatttctgatt

SEQ ID NO: 5358267 - DNA, 20 bp, Homo sapiens
agatcatagatttctgattt

SEQ ID NO: 5358268 - DNA, 14 bp, Homo sapiens
agatcataggaagt

SEQ ID NO: 5358269 - DNA, 22 bp, Homo sapiens
agatcataggaagtggctggtc

SEQ ID NO: 5358270 - DNA, 19 bp, Homo sapiens
agatcatagttttatttat

SEQ ID NO: 5358271 - DNA, 20 bp, Homo sapiens
agatcatagttttatttata

SEQ ID NO: 5358272 - DNA, 16 bp, Homo sapiens
agatcatatacgtgaa

SEQ ID NO: 5358273 - DNA, 20 bp, Homo sapiens
agatcatatggtaggaccct

SEQ ID NO: 5358274 - DNA, 21 bp, Homo sapiens
agatcatccgtctgtgtgggg

SEQ ID NO: 5358275 - DNA, 13 bp, Homo sapiens
agatcatcctttc

SEQ ID NO: 5358276 - DNA, 15 bp, Homo sapiens
agatcatcctttcca

SEQ ID NO: 5358277 - DNA, 16 bp, Homo sapiens
agatcatcctttccag

SEQ ID NO: 5358278 - DNA, 18 bp, Homo sapiens
agatcatcctttccagca

SEQ ID NO: 5358279 - DNA, 21 bp, Homo sapiens
agatcatctccaaatcttgcc

SEQ ID NO: 5358280 - DNA, 18 bp, Homo sapiens
agatcatcttgaatattt

SEQ ID NO: 5358281 - DNA, 20 bp, Homo sapiens
agatcatggacctggtgccc

SEQ ID NO: 5358282 - DNA, 13 bp, Homo sapiens
agatcatggcagc

SEQ ID NO: 5358283 - DNA, 17 bp, Homo sapiens
agatcatggcagcatga

SEQ ID NO: 5358284 - DNA, 11 bp, Homo sapiens
agatcatgggt

SEQ ID NO: 5358285 - DNA, 14 bp, Homo sapiens
agatcattaaaaaa

SEQ ID NO: 5358286 - DNA, 19 bp, Homo sapiens
agatcattatcttcatgtt

SEQ ID NO: 5358287 - DNA, 16 bp, Homo sapiens
agatcattcagtgttt

SEQ ID NO: 5358288 - DNA, 15 bp, Homo sapiens
agatcattgccatca

SEQ ID NO: 5358289 - DNA, 17 bp, Homo sapiens
agatcatttagttgggt

SEQ ID NO: 5358290 - DNA, 16 bp, Homo sapiens
agatcatttggagctc

SEQ ID NO: 5358291 - DNA, 16 bp, Homo sapiens
agatcattttgaaatt

SEQ ID NO: 5358292 - DNA, 19 bp, Homo sapiens
agatcattttttgtctatt

SEQ ID NO: 5358293 - DNA, 13 bp, Homo sapiens
agatccaaagact

SEQ ID NO: 5358294 - DNA, 19 bp, Homo sapiens
agatccaaatgctgtgcaa

SEQ ID NO: 5358295 - DNA, 19 bp, Homo sapiens
agatccaaggcagggaaag

SEQ ID NO: 5358296 - DNA, 18 bp, Homo sapiens
agatccaaggccgcggcc

SEQ ID NO: 5358297 - DNA, 14 bp, Homo sapiens
agatccacccaaat

SEQ ID NO: 5358298 - DNA, 15 bp, Homo sapiens
agatccacccaaata

SEQ ID NO: 5358299 - DNA, 12 bp, Homo sapiens
agatccaccccc

SEQ ID NO: 5358300 - DNA, 21 bp, Homo sapiens
agatccaccctcaaatgtcag

SEQ ID NO: 5358301 - DNA, 13 bp, Homo sapiens
agatccacctgca

SEQ ID NO: 5358302 - DNA, 19 bp, Homo sapiens
agatccacgtgtggcctcc

SEQ ID NO: 5358303 - DNA, 13 bp, Homo sapiens
agatccagactgt

SEQ ID NO: 5358304 - DNA, 15 bp, Homo sapiens
agatccagactgtaa

SEQ ID NO: 5358305 - DNA, 21 bp, Homo sapiens
agatccagactgtaagatgtt

SEQ ID NO: 5358306 - DNA, 18 bp, Homo sapiens
agatccagagaggctgga

SEQ ID NO: 5358307 - DNA, 20 bp, Homo sapiens
agatccagatccagactgta

SEQ ID NO: 5358308 - DNA, 23 bp, Homo sapiens
agatccagcacaactcagtctgt

SEQ ID NO: 5358309 - DNA, 23 bp, Homo sapiens
agatccagcccaaacctgggaag

SEQ ID NO: 5358310 - DNA, 14 bp, Homo sapiens
agatccagcctggg

SEQ ID NO: 5358311 - DNA, 16 bp, Homo sapiens
agatccaggaacacat

SEQ ID NO: 5358312 - DNA, 19 bp, Homo sapiens
agatccaggaacacatgca

SEQ ID NO: 5358313 - DNA, 20 bp, Homo sapiens
agatccaggaacacatgcac

SEQ ID NO: 5358314 - DNA, 13 bp, Homo sapiens
agatccaggacta

SEQ ID NO: 5358315 - DNA, 14 bp, Homo sapiens
agatccaggagctc

SEQ ID NO: 5358316 - DNA, 15 bp, Homo sapiens
agatccaggagctcc

SEQ ID NO: 5358317 - DNA, 16 bp, Homo sapiens
agatccagggactgaa

SEQ ID NO: 5358318 - DNA, 21 bp, Homo sapiens
agatccagtgcagttgtgatt

SEQ ID NO: 5358319 - DNA, 14 bp, Homo sapiens
agatccatcctttt

SEQ ID NO: 5358320 - DNA, 19 bp, Homo sapiens
agatccatccttttgcttc

SEQ ID NO: 5358321 - DNA, 20 bp, Homo sapiens
agatccatccttttgcttca

SEQ ID NO: 5358322 - DNA, 22 bp, Homo sapiens
agatccatccttttgcttcatc

SEQ ID NO: 5358323 - DNA, 16 bp, Homo sapiens
agatccatttaaaaca

SEQ ID NO: 5358324 - DNA, 19 bp, Homo sapiens
agatccatttgcctttctg

SEQ ID NO: 5358325 - DNA, 20 bp, Homo sapiens
agatccatttgcctttctgg

SEQ ID NO: 5358326 - DNA, 22 bp, Homo sapiens
agatccatttgcctttctggga

SEQ ID NO: 5358327 - DNA, 21 bp, Homo sapiens
agatccatttggacaaaatgg

SEQ ID NO: 5358328 - DNA, 10 bp, Homo sapiens
agatcccaaa

SEQ ID NO: 5358329 - DNA, 21 bp, Homo sapiens
agatcccaagatggagaggaa

SEQ ID NO: 5358330 - DNA, 15 bp, Homo sapiens
agatcccaagtcaaa

SEQ ID NO: 5358331 - DNA, 17 bp, Homo sapiens
agatcccaagtcaaaca

SEQ ID NO: 5358332 - DNA, 16 bp, Homo sapiens
agatcccactggaaga

SEQ ID NO: 5358333 - DNA, 17 bp, Homo sapiens
agatcccagagttattt

SEQ ID NO: 5358334 - DNA, 17 bp, Homo sapiens
agatcccagcccaccct

SEQ ID NO: 5358335 - DNA, 18 bp, Homo sapiens
agatcccagcccaccctg

SEQ ID NO: 5358336 - DNA, 16 bp, Homo sapiens
agatcccaggcccctg

SEQ ID NO: 5358337 - DNA, 12 bp, Homo sapiens
agatcccagggt

SEQ ID NO: 5358338 - DNA, 23 bp, Homo sapiens
agatcccagggtacactcttctc

SEQ ID NO: 5358339 - DNA, 19 bp, Homo sapiens
agatcccatccatcagctc

SEQ ID NO: 5358340 - DNA, 20 bp, Homo sapiens
agatcccatccatcagctcc

SEQ ID NO: 5358341 - DNA, 22 bp, Homo sapiens
agatcccatccatcagctccct

SEQ ID NO: 5358342 - DNA, 23 bp, Homo sapiens
agatcccatgggttgtgtgttta

SEQ ID NO: 5358343 - DNA, 21 bp, Homo sapiens
agatccccaagaccccctggg

SEQ ID NO: 5358344 - DNA, 15 bp, Homo sapiens
agatccccagcccct

SEQ ID NO: 5358345 - DNA, 20 bp, Homo sapiens
agatccccagcccctcctcc

SEQ ID NO: 5358346 - DNA, 21 bp, Homo sapiens
agatccccagcccctcctccc

SEQ ID NO: 5358347 - DNA, 18 bp, Homo sapiens
agatccccagctttctcc

SEQ ID NO: 5358348 - DNA, 15 bp, Homo sapiens
agatccccattcttt

SEQ ID NO: 5358349 - DNA, 16 bp, Homo sapiens
agatccccattctttc

SEQ ID NO: 5358350 - DNA, 13 bp, Homo sapiens
agatcccccagaa

SEQ ID NO: 5358351 - DNA, 14 bp, Homo sapiens
agatcccccagact

SEQ ID NO: 5358352 - DNA, 13 bp, Homo sapiens
agatccccgccac

SEQ ID NO: 5358353 - DNA, 23 bp, Homo sapiens
agatccccggggctggggcccag

SEQ ID NO: 5358354 - DNA, 15 bp, Homo sapiens
agatcccctcagaag

SEQ ID NO: 5358355 - DNA, 23 bp, Homo sapiens
agatcccgtctccgaagaaaaga

SEQ ID NO: 5358356 - DNA, 15 bp, Homo sapiens
agatccctcggtcag

SEQ ID NO: 5358357 - DNA, 20 bp, Homo sapiens
agatccctcggtcagcaccg

SEQ ID NO: 5358358 - DNA, 21 bp, Homo sapiens
agatccgcatgtgtctgtatt

SEQ ID NO: 5358359 - DNA, 14 bp, Homo sapiens
agatccgccctggg

SEQ ID NO: 5358360 - DNA, 17 bp, Homo sapiens
agatccgccctgggctc

SEQ ID NO: 5358361 - DNA, 15 bp, Homo sapiens
agatccgtgaattct

SEQ ID NO: 5358362 - DNA, 16 bp, Homo sapiens
agatcctaaaacaaaa

SEQ ID NO: 5358363 - DNA, 22 bp, Homo sapiens
agatcctaaaacaaaagctcat

SEQ ID NO: 5358364 - DNA, 13 bp, Homo sapiens
agatcctaaactc

SEQ ID NO: 5358365 - DNA, 16 bp, Homo sapiens
agatcctaactgagaa

SEQ ID NO: 5358366 - DNA, 21 bp, Homo sapiens
agatcctaagggtcgaaagct

SEQ ID NO: 5358367 - DNA, 16 bp, Homo sapiens
agatcctaaggtccaa

SEQ ID NO: 5358368 - DNA, 18 bp, Homo sapiens
agatcctacttctctgag

SEQ ID NO: 5358369 - DNA, 19 bp, Homo sapiens
agatcctacttctctgagt

SEQ ID NO: 5358370 - DNA, 21 bp, Homo sapiens
agatcctacttctctgagtca

SEQ ID NO: 5358371 - DNA, 18 bp, Homo sapiens
agatcctagatcctaagg

SEQ ID NO: 5358372 - DNA, 21 bp, Homo sapiens
agatcctagggcacttctagt

SEQ ID NO: 5358373 - DNA, 17 bp, Homo sapiens
agatcctaggtgctgga

SEQ ID NO: 5358374 - DNA, 13 bp, Homo sapiens
agatcctcctcat

SEQ ID NO: 5358375 - DNA, 22 bp, Homo sapiens
agatcctccttccaggccccag

SEQ ID NO: 5358376 - DNA, 14 bp, Homo sapiens
agatcctctctggg

SEQ ID NO: 5358377 - DNA, 17 bp, Homo sapiens
agatcctctgctgactc

SEQ ID NO: 5358378 - DNA, 14 bp, Homo sapiens
agatcctcttctca

SEQ ID NO: 5358379 - DNA, 17 bp, Homo sapiens
agatcctcttctcaaag

SEQ ID NO: 5358380 - DNA, 20 bp, Homo sapiens
agatcctcttgccacatctt

SEQ ID NO: 5358381 - DNA, 19 bp, Homo sapiens
agatcctctttactctggg

SEQ ID NO: 5358382 - DNA, 20 bp, Homo sapiens
agatcctctttccccactga

SEQ ID NO: 5358383 - DNA, 13 bp, Homo sapiens
agatcctgagctc

SEQ ID NO: 5358384 - DNA, 20 bp, Homo sapiens
agatcctgatcttaagaggc

SEQ ID NO: 5358385 - DNA, 21 bp, Homo sapiens
agatcctgatcttaagaggct

SEQ ID NO: 5358386 - DNA, 22 bp, Homo sapiens
agatcctgatcttaagaggctg

SEQ ID NO: 5358387 - DNA, 21 bp, Homo sapiens
agatcctgcaccccagcattc

SEQ ID NO: 5358388 - DNA, 12 bp, Homo sapiens
agatcctgctgc

SEQ ID NO: 5358389 - DNA, 11 bp, Homo sapiens
agatcctggaa

SEQ ID NO: 5358390 - DNA, 13 bp, Homo sapiens
agatcctggagtg

SEQ ID NO: 5358391 - DNA, 15 bp, Homo sapiens
agatcctgtgaggag

SEQ ID NO: 5358392 - DNA, 20 bp, Homo sapiens
agatcctgttacttgcttca

SEQ ID NO: 5358393 - DNA, 16 bp, Homo sapiens
agatcctgtttcagct

SEQ ID NO: 5358394 - DNA, 23 bp, Homo sapiens
agatccttcacaggcagtgcatg

SEQ ID NO: 5358395 - DNA, 11 bp, Homo sapiens
agatccttcca

SEQ ID NO: 5358396 - DNA, 20 bp, Homo sapiens
agatccttgtttcaaacaca

SEQ ID NO: 5358397 - DNA, 14 bp, Homo sapiens
agatcctttaaaaa

SEQ ID NO: 5358398 - DNA, 14 bp, Homo sapiens
agatcctttcaaaa

SEQ ID NO: 5358399 - DNA, 13 bp, Homo sapiens
agatccttttcca

SEQ ID NO: 5358400 - DNA, 21 bp, Homo sapiens
agatccttttccatcccactc

SEQ ID NO: 5358401 - DNA, 17 bp, Homo sapiens
agatcctttttccatca

SEQ ID NO: 5358402 - DNA, 21 bp, Homo sapiens
agatcctttttccatcatttt

SEQ ID NO: 5358403 - DNA, 13 bp, Homo sapiens
agatcgacagaca

SEQ ID NO: 5358404 - DNA, 14 bp, Homo sapiens
agatcgacagacag

SEQ ID NO: 5358405 - DNA, 21 bp, Homo sapiens
agatcgacagacagccaggta

SEQ ID NO: 5358406 - DNA, 16 bp, Homo sapiens
agatgcgtttgcctcc

SEQ ID NO: 5358407 - DNA, 16 bp, Homo sapiens
agatgctaaaattctt

SEQ ID NO: 5358408 - DNA, 16 bp, Homo sapiens
agatgctactaagaaa

SEQ ID NO: 5358409 - DNA, 23 bp, Homo sapiens
agatgctactggacttgaatggt

SEQ ID NO: 5358410 - DNA, 15 bp, Homo sapiens
agatgctactgtcag

SEQ ID NO: 5358411 - DNA, 20 bp, Homo sapiens
agatgctactgtcagtgtcc

SEQ ID NO: 5358412 - DNA, 22 bp, Homo sapiens
agatgctacttcccactgtatg

SEQ ID NO: 5358413 - DNA, 15 bp, Homo sapiens
agatgctagaactcc

SEQ ID NO: 5358414 - DNA, 16 bp, Homo sapiens
agatgctagagcctct

SEQ ID NO: 5358415 - DNA, 17 bp, Homo sapiens
agatgctagagcctctg

SEQ ID NO: 5358416 - DNA, 19 bp, Homo sapiens
agatgctagcacatgccct

SEQ ID NO: 5358417 - DNA, 21 bp, Homo sapiens
agatgctagcgcgttgcctgt

SEQ ID NO: 5358418 - DNA, 15 bp, Homo sapiens
agatgctattaagaa

SEQ ID NO: 5358419 - DNA, 15 bp, Homo sapiens
agatgctcactttat

SEQ ID NO: 5358420 - DNA, 16 bp, Homo sapiens
agatgctcatctgagc

SEQ ID NO: 5358421 - DNA, 13 bp, Homo sapiens
agatgctccaaga

SEQ ID NO: 5358422 - DNA, 18 bp, Homo sapiens
agatgctccaagattcta

SEQ ID NO: 5358423 - DNA, 19 bp, Homo sapiens
agatgctccagcaacacag

SEQ ID NO: 5358424 - DNA, 20 bp, Homo sapiens
agatgctccttgggcccttt

SEQ ID NO: 5358425 - DNA, 12 bp, Homo sapiens
agatgctctctg

SEQ ID NO: 5358426 - DNA, 15 bp, Homo sapiens
agatgctctctgagg

SEQ ID NO: 5358427 - DNA, 20 bp, Homo sapiens
agatgctctctgaggcaagg

SEQ ID NO: 5358428 - DNA, 21 bp, Homo sapiens
agatgctctctgaggcaaggc

SEQ ID NO: 5358429 - DNA, 15 bp, Homo sapiens
agatgctcttctgtg

SEQ ID NO: 5358430 - DNA, 16 bp, Homo sapiens
agatgctgaaaatgtc

SEQ ID NO: 5358431 - DNA, 18 bp, Homo sapiens
agatgctgaaacaggaga

SEQ ID NO: 5358432 - DNA, 22 bp, Homo sapiens
agatgctgaaacaggagagaaa

SEQ ID NO: 5358433 - DNA, 23 bp, Homo sapiens
agatgctgaaggtgagaggaaat

SEQ ID NO: 5358434 - DNA, 20 bp, Homo sapiens
agatgctgaatatctgttca

SEQ ID NO: 5358435 - DNA, 14 bp, Homo sapiens
agatgctgatgttc

SEQ ID NO: 5358436 - DNA, 15 bp, Homo sapiens
agatgctgatgttca

SEQ ID NO: 5358437 - DNA, 16 bp, Homo sapiens
agatgctgatgttcag

SEQ ID NO: 5358438 - DNA, 21 bp, Homo sapiens
agatgctgatgttcagtgtaa

SEQ ID NO: 5358439 - DNA, 13 bp, Homo sapiens
agatgctgcctag

SEQ ID NO: 5358440 - DNA, 17 bp, Homo sapiens
agatgctggagaagaga

SEQ ID NO: 5358441 - DNA, 20 bp, Homo sapiens
agatgctggcccagggccca

SEQ ID NO: 5358442 - DNA, 21 bp, Homo sapiens
agatgctggcccagggcccag

SEQ ID NO: 5358443 - DNA, 13 bp, Homo sapiens
agatgctggcccc

SEQ ID NO: 5358444 - DNA, 18 bp, Homo sapiens
agatgctggcctcttggc

SEQ ID NO: 5358445 - DNA, 16 bp, Homo sapiens
agatgctgggagggct

SEQ ID NO: 5358446 - DNA, 21 bp, Homo sapiens
agatgctgggagggctgaacc

SEQ ID NO: 5358447 - DNA, 22 bp, Homo sapiens
agatgctgggctgtctctccct

SEQ ID NO: 5358448 - DNA, 18 bp, Homo sapiens
agatgctgggttggtgca

SEQ ID NO: 5358449 - DNA, 15 bp, Homo sapiens
agatgctggtggagg

SEQ ID NO: 5358450 - DNA, 23 bp, Homo sapiens
agatgctggtggaggaagggctg

SEQ ID NO: 5358451 - DNA, 22 bp, Homo sapiens
agatgctgtaacttaaaatagg

SEQ ID NO: 5358452 - DNA, 17 bp, Homo sapiens
agatgctgtcggcacca

SEQ ID NO: 5358453 - DNA, 20 bp, Homo sapiens
agatgctgtgagtctttggt

SEQ ID NO: 5358454 - DNA, 18 bp, Homo sapiens
agatgctgtgtaacagaa

SEQ ID NO: 5358455 - DNA, 21 bp, Homo sapiens
agatgcttaggtgaaggcaga

SEQ ID NO: 5358456 - DNA, 18 bp, Homo sapiens
agatgcttctcactgcca

SEQ ID NO: 5358457 - DNA, 12 bp, Homo sapiens
agatgcttctgg

SEQ ID NO: 5358458 - DNA, 15 bp, Homo sapiens
agatgcttctgggag

SEQ ID NO: 5358459 - DNA, 16 bp, Homo sapiens
agatgcttctgggaga

SEQ ID NO: 5358460 - DNA, 20 bp, Homo sapiens
agatgcttggagcaatcaga

SEQ ID NO: 5358461 - DNA, 21 bp, Homo sapiens
agatgcttggttgtgttgagg

SEQ ID NO: 5358462 - DNA, 16 bp, Homo sapiens
agatgctttgcccagg

SEQ ID NO: 5358463 - DNA, 17 bp, Homo sapiens
agatgctttgcccaggc

SEQ ID NO: 5358464 - DNA, 17 bp, Homo sapiens
agatgctttgtgactta

SEQ ID NO: 5358465 - DNA, 16 bp, Homo sapiens
agatgcttttctgtct

SEQ ID NO: 5358466 - DNA, 19 bp, Homo sapiens
agatgcttttctgtctctg

SEQ ID NO: 5358467 - DNA, 19 bp, Homo sapiens
agatggaaaaaaaaaacaa

SEQ ID NO: 5358468 - DNA, 21 bp, Homo sapiens
agatggaaaaataacaactat

SEQ ID NO: 5358469 - DNA, 20 bp, Homo sapiens
agatggaaacaatgtggagt

SEQ ID NO: 5358470 - DNA, 10 bp, Homo sapiens
agatggaaag

SEQ ID NO: 5358471 - DNA, 17 bp, Homo sapiens
agatggaaagaaagcac

SEQ ID NO: 5358472 - DNA, 13 bp, Homo sapiens
agatggaaataca

SEQ ID NO: 5358473 - DNA, 14 bp, Homo sapiens
agatggaaatacag

SEQ ID NO: 5358474 - DNA, 21 bp, Homo sapiens
agatggaaccgcaggaagctg

SEQ ID NO: 5358475 - DNA, 16 bp, Homo sapiens
agatggaagcttccag

SEQ ID NO: 5358476 - DNA, 13 bp, Homo sapiens
agatggaagcttg

SEQ ID NO: 5358477 - DNA, 17 bp, Homo sapiens
agatggaatagaaaaga

SEQ ID NO: 5358478 - DNA, 21 bp, Homo sapiens
agatggaatagaaaagatgag

SEQ ID NO: 5358479 - DNA, 22 bp, Homo sapiens
agatggaatagaaaagatgaga

SEQ ID NO: 5358480 - DNA, 13 bp, Homo sapiens
agatggaatatca

SEQ ID NO: 5358481 - DNA, 12 bp, Homo sapiens
agatggacacac

SEQ ID NO: 5358482 - DNA, 17 bp, Homo sapiens
agatggacagtttgttt

SEQ ID NO: 5358483 - DNA, 18 bp, Homo sapiens
agatggacagtttgtttc

SEQ ID NO: 5358484 - DNA, 20 bp, Homo sapiens
agatggacagtttgtttcct

SEQ ID NO: 5358485 - DNA, 19 bp, Homo sapiens
agatggaccagtagacaac

SEQ ID NO: 5358486 - DNA, 14 bp, Homo sapiens
agatggacccctcc

SEQ ID NO: 5358487 - DNA, 15 bp, Homo sapiens
agatggacgcaggcc

SEQ ID NO: 5358488 - DNA, 21 bp, Homo sapiens
agatggacgtcgaggaccggg

SEQ ID NO: 5358489 - DNA, 15 bp, Homo sapiens
agatggactcaggat

SEQ ID NO: 5358490 - DNA, 17 bp, Homo sapiens
agatggactcaggatcc

SEQ ID NO: 5358491 - DNA, 12 bp, Homo sapiens
agatggactggg

SEQ ID NO: 5358492 - DNA, 16 bp, Homo sapiens
agatggactgggagga

SEQ ID NO: 5358493 - DNA, 22 bp, Homo sapiens
agatggactgggaggaggggga

SEQ ID NO: 5358494 - DNA, 13 bp, Homo sapiens
agatggacttgaa

SEQ ID NO: 5358495 - DNA, 19 bp, Homo sapiens
agatggagaaacaacaaat

SEQ ID NO: 5358496 - DNA, 23 bp, Homo sapiens
agatggagaaacaacaaataagt

SEQ ID NO: 5358497 - DNA, 22 bp, Homo sapiens
agatggagacaccctctggggg

SEQ ID NO: 5358498 - DNA, 23 bp, Homo sapiens
agatggagacaccctctgggggt

SEQ ID NO: 5358499 - DNA, 17 bp, Homo sapiens
agatggagaggctgagg

SEQ ID NO: 5358500 - DNA, 15 bp, Homo sapiens
agatggagcaaatgt

SEQ ID NO: 5358501 - DNA, 16 bp, Homo sapiens
agatggagcaagtgag

SEQ ID NO: 5358502 - DNA, 22 bp, Homo sapiens
agatggagcccataggccaccc

SEQ ID NO: 5358503 - DNA, 16 bp, Homo sapiens
agatggagggcttggc

SEQ ID NO: 5358504 - DNA, 17 bp, Homo sapiens
agatggagggcttggcc

SEQ ID NO: 5358505 - DNA, 21 bp, Homo sapiens
agatggagtctcactcttgtc

SEQ ID NO: 5358506 - DNA, 17 bp, Homo sapiens
agatggatattagatgc

SEQ ID NO: 5358507 - DNA, 12 bp, Homo sapiens
agatggatgaat

SEQ ID NO: 5358508 - DNA, 14 bp, Homo sapiens
agatggatgaatta

SEQ ID NO: 5358509 - DNA, 19 bp, Homo sapiens
agatggatggacagacaga

SEQ ID NO: 5358510 - DNA, 17 bp, Homo sapiens
agatggattaaagactt

SEQ ID NO: 5358511 - DNA, 18 bp, Homo sapiens
agatggattctcagatat

SEQ ID NO: 5358512 - DNA, 13 bp, Homo sapiens
agatggattctcc

SEQ ID NO: 5358513 - DNA, 18 bp, Homo sapiens
agatggattctccactca

SEQ ID NO: 5358514 - DNA, 18 bp, Homo sapiens
agatggatttgacacact

SEQ ID NO: 5358515 - DNA, 16 bp, Homo sapiens
agatggcaaatgacca

SEQ ID NO: 5358516 - DNA, 16 bp, Homo sapiens
agatggcacctgtggc

SEQ ID NO: 5358517 - DNA, 15 bp, Homo sapiens
agatggcactgtcca

SEQ ID NO: 5358518 - DNA, 15 bp, Homo sapiens
agatggcagagccat

SEQ ID NO: 5358519 - DNA, 13 bp, Homo sapiens
agatggcagatgc

SEQ ID NO: 5358520 - DNA, 18 bp, Homo sapiens
agatggcagatgcacatg

SEQ ID NO: 5358521 - DNA, 13 bp, Homo sapiens
agatggcagcttt

SEQ ID NO: 5358522 - DNA, 15 bp, Homo sapiens
agatggcagggctga

SEQ ID NO: 5358523 - DNA, 16 bp, Homo sapiens
agatggcagggctgag

SEQ ID NO: 5358524 - DNA, 21 bp, Homo sapiens
agatggcagggctgaggatgg

SEQ ID NO: 5358525 - DNA, 22 bp, Homo sapiens
agatggccagtttgaagcctgt

SEQ ID NO: 5358526 - DNA, 14 bp, Homo sapiens
agatggccatgctc

SEQ ID NO: 5358527 - DNA, 13 bp, Homo sapiens
agatggcccaagg

SEQ ID NO: 5358528 - DNA, 17 bp, Homo sapiens
agatggcccccagctgg

SEQ ID NO: 5358529 - DNA, 15 bp, Homo sapiens
agatggcctttgctt

SEQ ID NO: 5358530 - DNA, 18 bp, Homo sapiens
agatggcgaccaccaaag

SEQ ID NO: 5358531 - DNA, 20 bp, Homo sapiens
agatggcgagcatcctggcc

SEQ ID NO: 5358532 - DNA, 15 bp, Homo sapiens
agatggcgcacccgg

SEQ ID NO: 5358533 - DNA, 19 bp, Homo sapiens
agatggcgcatagtgtgct

SEQ ID NO: 5358534 - DNA, 20 bp, Homo sapiens
agatggcggtgatcagcaga

SEQ ID NO: 5358535 - DNA, 21 bp, Homo sapiens
agatggctcagagggggactg

SEQ ID NO: 5358536 - DNA, 14 bp, Homo sapiens
agatggctcccagg

SEQ ID NO: 5358537 - DNA, 23 bp, Homo sapiens
agatggctcccaggggctccctc

SEQ ID NO: 5358538 - DNA, 19 bp, Homo sapiens
agatggctccctgggctgg

SEQ ID NO: 5358539 - DNA, 22 bp, Homo sapiens
agatggctccctgggctggcat

SEQ ID NO: 5358540 - DNA, 16 bp, Homo sapiens
agatggctccttggga

SEQ ID NO: 5358541 - DNA, 19 bp, Homo sapiens
agatggctccttgggatga

SEQ ID NO: 5358542 - DNA, 22 bp, Homo sapiens
agatggctgactttgctctttc

SEQ ID NO: 5358543 - DNA, 12 bp, Homo sapiens
agatggctgctg

SEQ ID NO: 5358544 - DNA, 13 bp, Homo sapiens
agatggctgctgc

SEQ ID NO: 5358545 - DNA, 21 bp, Homo sapiens
agatggctggaaggggtccag

SEQ ID NO: 5358546 - DNA, 21 bp, Homo sapiens
agatggctgtgaaaattacac

SEQ ID NO: 5358547 - DNA, 23 bp, Homo sapiens
agatggctgtgcctctgcctgtc

SEQ ID NO: 5358548 - DNA, 14 bp, Homo sapiens
agatggctgtggca

SEQ ID NO: 5358549 - DNA, 20 bp, Homo sapiens
agatggcttatttgtataat

SEQ ID NO: 5358550 - DNA, 14 bp, Homo sapiens
agatggcttatttt

SEQ ID NO: 5358551 - DNA, 22 bp, Homo sapiens
agatggcttccgtgagacacaa

SEQ ID NO: 5358552 - DNA, 23 bp, Homo sapiens
agatggcttcggagggccgcagg

SEQ ID NO: 5358553 - DNA, 14 bp, Homo sapiens
agatggcttttgtt

SEQ ID NO: 5358554 - DNA, 18 bp, Homo sapiens
agatgggaatgaagcttg

SEQ ID NO: 5358555 - DNA, 18 bp, Homo sapiens
agatgggaatgaggtggg

SEQ ID NO: 5358556 - DNA, 15 bp, Homo sapiens
agatgggactgggag

SEQ ID NO: 5358557 - DNA, 13 bp, Homo sapiens
agatgggagctcc

SEQ ID NO: 5358558 - DNA, 20 bp, Homo sapiens
agatgggaggagaccagcgg

SEQ ID NO: 5358559 - DNA, 14 bp, Homo sapiens
agatgggaggtgga

SEQ ID NO: 5358560 - DNA, 14 bp, Homo sapiens
agatgggcacatga

SEQ ID NO: 5358561 - DNA, 15 bp, Homo sapiens
agatgggcacatgag

SEQ ID NO: 5358562 - DNA, 18 bp, Homo sapiens
agatgggcacatgaggag

SEQ ID NO: 5358563 - DNA, 21 bp, Homo sapiens
agatgggcacatgaggagggt

SEQ ID NO: 5358564 - DNA, 22 bp, Homo sapiens
agatgggcatcttttgtattaa

SEQ ID NO: 5358565 - DNA, 22 bp, Homo sapiens
agatgggccggcccccttcctg

SEQ ID NO: 5358566 - DNA, 18 bp, Homo sapiens
agatgggccttttcttga

SEQ ID NO: 5358567 - DNA, 16 bp, Homo sapiens
agatgggcttgttttc

SEQ ID NO: 5358568 - DNA, 18 bp, Homo sapiens
agatgggcttgttttctt

SEQ ID NO: 5358569 - DNA, 20 bp, Homo sapiens
agatggggagggcgcttttg

SEQ ID NO: 5358570 - DNA, 20 bp, Homo sapiens
agatggggagggtgccctcc

SEQ ID NO: 5358571 - DNA, 19 bp, Homo sapiens
agatggggataaaatgact

SEQ ID NO: 5358572 - DNA, 21 bp, Homo sapiens
agatggggcatataataaaga

SEQ ID NO: 5358573 - DNA, 14 bp, Homo sapiens
agatggggcctctg

SEQ ID NO: 5358574 - DNA, 13 bp, Homo sapiens
agatggggcctgg

SEQ ID NO: 5358575 - DNA, 16 bp, Homo sapiens
agatggggcctgggct

SEQ ID NO: 5358576 - DNA, 18 bp, Homo sapiens
agatggggcctgggctgt

SEQ ID NO: 5358577 - DNA, 23 bp, Homo sapiens
agatggggcgggggtgtgtctgt

SEQ ID NO: 5358578 - DNA, 22 bp, Homo sapiens
agatgggggcagggctgtgctt

SEQ ID NO: 5358579 - DNA, 19 bp, Homo sapiens
agatgggggcttcttcctc

SEQ ID NO: 5358580 - DNA, 20 bp, Homo sapiens
agatgggggcttcttcctca

SEQ ID NO: 5358581 - DNA, 23 bp, Homo sapiens
agatggggtctcgctctgtcacc

SEQ ID NO: 5358582 - DNA, 16 bp, Homo sapiens
agatggggtctgtaaa

SEQ ID NO: 5358583 - DNA, 13 bp, Homo sapiens
agattcagcagtg

SEQ ID NO: 5358584 - DNA, 18 bp, Homo sapiens
agattcaggagctcagtt

SEQ ID NO: 5358585 - DNA, 18 bp, Homo sapiens
agattcaggccagcccag

SEQ ID NO: 5358586 - DNA, 20 bp, Homo sapiens
agattcagggagaatgttgt

SEQ ID NO: 5358587 - DNA, 17 bp, Homo sapiens
agattcaggggaagggc

SEQ ID NO: 5358588 - DNA, 18 bp, Homo sapiens
agattcaggtatgttgcc

SEQ ID NO: 5358589 - DNA, 15 bp, Homo sapiens
agattcagtcttgcc

SEQ ID NO: 5358590 - DNA, 21 bp, Homo sapiens
agattcagttttcccactttt

SEQ ID NO: 5358591 - DNA, 19 bp, Homo sapiens
agattcataaagtaatgat

SEQ ID NO: 5358592 - DNA, 12 bp, Homo sapiens
agattcataaat

SEQ ID NO: 5358593 - DNA, 13 bp, Homo sapiens
agattcatattta

SEQ ID NO: 5358594 - DNA, 16 bp, Homo sapiens
agattcatatttactt

SEQ ID NO: 5358595 - DNA, 22 bp, Homo sapiens
agattcatctatggagggcaga

SEQ ID NO: 5358596 - DNA, 17 bp, Homo sapiens
agattcatgaaaatgta

SEQ ID NO: 5358597 - DNA, 18 bp, Homo sapiens
agattcatgatttataaa

SEQ ID NO: 5358598 - DNA, 16 bp, Homo sapiens
agattcattttctaga

SEQ ID NO: 5358599 - DNA, 17 bp, Homo sapiens
agattcattttctagat

SEQ ID NO: 5358600 - DNA, 12 bp, Homo sapiens
agattcattttt

SEQ ID NO: 5358601 - DNA, 17 bp, Homo sapiens
agattcatttttctttc

SEQ ID NO: 5358602 - DNA, 17 bp, Homo sapiens
agattccacacaaaatg

SEQ ID NO: 5358603 - DNA, 20 bp, Homo sapiens
agattccacacaaaatgtca

SEQ ID NO: 5358604 - DNA, 14 bp, Homo sapiens
agattccacaggac

SEQ ID NO: 5358605 - DNA, 21 bp, Homo sapiens
agattccagaacgccctgtgt

SEQ ID NO: 5358606 - DNA, 19 bp, Homo sapiens
agattccattttatacaag

SEQ ID NO: 5358607 - DNA, 12 bp, Homo sapiens
agattcccagag

SEQ ID NO: 5358608 - DNA, 16 bp, Homo sapiens
agattcccagagcaaa

SEQ ID NO: 5358609 - DNA, 12 bp, Homo sapiens
agattcccagct

SEQ ID NO: 5358610 - DNA, 13 bp, Homo sapiens
agattcccaggag

SEQ ID NO: 5358611 - DNA, 15 bp, Homo sapiens
agattcccaggagtt

SEQ ID NO: 5358612 - DNA, 17 bp, Homo sapiens
agattcccaggccaggc

SEQ ID NO: 5358613 - DNA, 20 bp, Homo sapiens
agattcccaggccagggctg

SEQ ID NO: 5358614 - DNA, 24 bp, Homo sapiens
agattccccattgcctcctccttc

SEQ ID NO: 5358615 - DNA, 18 bp, Homo sapiens
agattccggatcctaagc

SEQ ID NO: 5358616 - DNA, 24 bp, Homo sapiens
agattccggatcctaagcatctaa

SEQ ID NO: 5358617 - DNA, 15 bp, Homo sapiens
agattcctacttaaa

SEQ ID NO: 5358618 - DNA, 16 bp, Homo sapiens
agattcctacttaaac

SEQ ID NO: 5358619 - DNA, 18 bp, Homo sapiens
agattcctacttaaacaa

SEQ ID NO: 5358620 - DNA, 12 bp, Homo sapiens
agattcctatta

SEQ ID NO: 5358621 - DNA, 20 bp, Homo sapiens
agattcctcttgcctctctc

SEQ ID NO: 5358622 - DNA, 21 bp, Homo sapiens
agattcctcttgcctctctca

SEQ ID NO: 5358623 - DNA, 14 bp, Homo sapiens
agattcctgggcct

SEQ ID NO: 5358624 - DNA, 14 bp, Homo sapiens
agattcctgtcctt

SEQ ID NO: 5358625 - DNA, 18 bp, Homo sapiens
agattcctgttgtgtaat

SEQ ID NO: 5358626 - DNA, 22 bp, Homo sapiens
agattcctgttgtgtaataaca

SEQ ID NO: 5358627 - DNA, 22 bp, Homo sapiens
agattcctttggccactgtatt

SEQ ID NO: 5358628 - DNA, 16 bp, Homo sapiens
agattcgctgtcccct

SEQ ID NO: 5358629 - DNA, 18 bp, Homo sapiens
agattcgctgtcccctca

SEQ ID NO: 5358630 - DNA, 15 bp, Homo sapiens
agattctaaaacatt

SEQ ID NO: 5358631 - DNA, 17 bp, Homo sapiens
agattctaaagattcta

SEQ ID NO: 5358632 - DNA, 12 bp, Homo sapiens
agattctaaagg

SEQ ID NO: 5358633 - DNA, 13 bp, Homo sapiens
agattctaaaggt

SEQ ID NO: 5358634 - DNA, 12 bp, Homo sapiens
agattctaacgg

SEQ ID NO: 5358635 - DNA, 14 bp, Homo sapiens
agattctaatgatg

SEQ ID NO: 5358636 - DNA, 19 bp, Homo sapiens
agattctacatattcttta

SEQ ID NO: 5358637 - DNA, 15 bp, Homo sapiens
agattctactttgaa

SEQ ID NO: 5358638 - DNA, 12 bp, Homo sapiens
agattctagatc

SEQ ID NO: 5358639 - DNA, 14 bp, Homo sapiens
agattctagatcag

SEQ ID NO: 5358640 - DNA, 15 bp, Homo sapiens
agattctagcacatc

SEQ ID NO: 5358641 - DNA, 15 bp, Homo sapiens
agattctatagttct

SEQ ID NO: 5358642 - DNA, 19 bp, Homo sapiens
agattctatagttctagac

SEQ ID NO: 5358643 - DNA, 22 bp, Homo sapiens
agattctatattattatatata

SEQ ID NO: 5358644 - DNA, 17 bp, Homo sapiens
agattctatcctcatct

SEQ ID NO: 5358645 - DNA, 23 bp, Homo sapiens
agattctatgttaatattttatg

SEQ ID NO: 5358646 - DNA, 17 bp, Homo sapiens
agattctattaaaagcc

SEQ ID NO: 5358647 - DNA, 21 bp, Homo sapiens
agattctcattcacgggacta

SEQ ID NO: 5358648 - DNA, 17 bp, Homo sapiens
agattctcccttgctct

SEQ ID NO: 5358649 - DNA, 14 bp, Homo sapiens
agattctctgccca

SEQ ID NO: 5358650 - DNA, 15 bp, Homo sapiens
agattctctgcccag

SEQ ID NO: 5358651 - DNA, 17 bp, Homo sapiens
agattctctgcccagcc

SEQ ID NO: 5358652 - DNA, 21 bp, Homo sapiens
agattctctggctgtaaggct

SEQ ID NO: 5358653 - DNA, 23 bp, Homo sapiens
agattctctggctgtaaggctct

SEQ ID NO: 5358654 - DNA, 17 bp, Homo sapiens
agattctctgtgtctaa

SEQ ID NO: 5358655 - DNA, 20 bp, Homo sapiens
agattctctgtgtctaagat

SEQ ID NO: 5358656 - DNA, 16 bp, Homo sapiens
agattctctttaaaaa

SEQ ID NO: 5358657 - DNA, 18 bp, Homo sapiens
agattctctttaaaaaag

SEQ ID NO: 5358658 - DNA, 20 bp, Homo sapiens
agattctctttaaaaaagac

SEQ ID NO: 5358659 - DNA, 14 bp, Homo sapiens
agattctgaattgg

SEQ ID NO: 5358660 - DNA, 16 bp, Homo sapiens
agattctgacatttat

SEQ ID NO: 5358661 - DNA, 17 bp, Homo sapiens
agattctgacatttata

SEQ ID NO: 5358662 - DNA, 21 bp, Homo sapiens
agattctgagcaaaggccctg

SEQ ID NO: 5358663 - DNA, 24 bp, Homo sapiens
agattctgatttgccactgatatt

SEQ ID NO: 5358664 - DNA, 18 bp, Homo sapiens
agattctgcctatgtaaa

SEQ ID NO: 5358665 - DNA, 20 bp, Homo sapiens
agattctgcctatgtaaaat

SEQ ID NO: 5358666 - DNA, 16 bp, Homo sapiens
agattctgcctctctg

SEQ ID NO: 5358667 - DNA, 18 bp, Homo sapiens
agattctgggaaaggtgc

SEQ ID NO: 5358668 - DNA, 20 bp, Homo sapiens
agattctgggaaaggtgctc

SEQ ID NO: 5358669 - DNA, 22 bp, Homo sapiens
agattctgggaaaggtgctcaa

SEQ ID NO: 5358670 - DNA, 19 bp, Homo sapiens
agattctggtccctggaaa

SEQ ID NO: 5358671 - DNA, 20 bp, Homo sapiens
agattctggtccctggaaat

SEQ ID NO: 5358672 - DNA, 22 bp, Homo sapiens
agattctgtgatcttttaaagt

SEQ ID NO: 5358673 - DNA, 15 bp, Homo sapiens
agattctgtgggcag

SEQ ID NO: 5358674 - DNA, 19 bp, Homo sapiens
agattctgtgggcagctgg

SEQ ID NO: 5358675 - DNA, 21 bp, Homo sapiens
agattctgtgggcagctggct

SEQ ID NO: 5358676 - DNA, 13 bp, Homo sapiens
agattctgtgtat

SEQ ID NO: 5358677 - DNA, 19 bp, Homo sapiens
agattctgtgtcagagccc

SEQ ID NO: 5358678 - DNA, 15 bp, Homo sapiens
agattctgttgcata

SEQ ID NO: 5358679 - DNA, 13 bp, Homo sapiens
agattcttaattc

SEQ ID NO: 5358680 - DNA, 22 bp, Homo sapiens
agattcttcactggtgagacaa

SEQ ID NO: 5358681 - DNA, 12 bp, Homo sapiens
agattcttcagc

SEQ ID NO: 5358682 - DNA, 14 bp, Homo sapiens
agattcttccatta

SEQ ID NO: 5358683 - DNA, 23 bp, Homo sapiens
agattcttcccattctccatttg

SEQ ID NO: 5358684 - DNA, 16 bp, Homo sapiens
agattcttctgtgttt

SEQ ID NO: 5358685 - DNA, 18 bp, Homo sapiens
agattcttgaagaatgaa

SEQ ID NO: 5358686 - DNA, 12 bp, Homo sapiens
agattcttgcat

SEQ ID NO: 5358687 - DNA, 17 bp, Homo sapiens
agattcttgctgtgacc

SEQ ID NO: 5358688 - DNA, 17 bp, Homo sapiens
agattctttaaggagat

SEQ ID NO: 5358689 - DNA, 18 bp, Homo sapiens
agattctttaaggagata

SEQ ID NO: 5358690 - DNA, 19 bp, Homo sapiens
agattctttaaggagatag

SEQ ID NO: 5358691 - DNA, 19 bp, Homo sapiens
agattctttatatctgaac

SEQ ID NO: 5358692 - DNA, 12 bp, Homo sapiens
agattctttccc

SEQ ID NO: 5358693 - DNA, 18 bp, Homo sapiens
agattctttcctgaggct

SEQ ID NO: 5358694 - DNA, 19 bp, Homo sapiens
agattctttcctgaggctg

SEQ ID NO: 5358695 - DNA, 21 bp, Homo sapiens
agattctttcctgaggctggg

SEQ ID NO: 5358696 - DNA, 13 bp, Homo sapiens
agattctttttct

SEQ ID NO: 5358697 - DNA, 20 bp, Homo sapiens
agattgaaaacttttctcag

SEQ ID NO: 5358698 - DNA, 16 bp, Homo sapiens
agattgaaaagtgtcc

SEQ ID NO: 5358699 - DNA, 14 bp, Homo sapiens
agattgaaaatctt

SEQ ID NO: 5358700 - DNA, 16 bp, Homo sapiens
agattgaaaccattcc

SEQ ID NO: 5358701 - DNA, 12 bp, Homo sapiens
agattgaaattt

SEQ ID NO: 5358702 - DNA, 20 bp, Homo sapiens
agattgaacctgaatattgc

SEQ ID NO: 5358703 - DNA, 15 bp, Homo sapiens
agattgaagaatctg

SEQ ID NO: 5358704 - DNA, 12 bp, Homo sapiens
agattgacaagg

SEQ ID NO: 5358705 - DNA, 16 bp, Homo sapiens
agattgacagcatata

SEQ ID NO: 5358706 - DNA, 22 bp, Homo sapiens
agattgaccttaccaagttggt

SEQ ID NO: 5358707 - DNA, 17 bp, Homo sapiens
agattgacgacaagtgc

SEQ ID NO: 5358708 - DNA, 17 bp, Homo sapiens
agattgactaactcaaa

SEQ ID NO: 5358709 - DNA, 17 bp, Homo sapiens
agattgacttcagaaac

SEQ ID NO: 5358710 - DNA, 14 bp, Homo sapiens
agattgagaaatgt

SEQ ID NO: 5358711 - DNA, 14 bp, Homo sapiens
agattgagaagcca

SEQ ID NO: 5358712 - DNA, 15 bp, Homo sapiens
agattgagaagccat

SEQ ID NO: 5358713 - DNA, 22 bp, Homo sapiens
agattgagaagttttgtacaga

SEQ ID NO: 5358714 - DNA, 20 bp, Homo sapiens
agattgagacctacaggctg

SEQ ID NO: 5358715 - DNA, 13 bp, Homo sapiens
agattgaggcctg

SEQ ID NO: 5358716 - DNA, 23 bp, Homo sapiens
agattgatagaaaatccttcagc

SEQ ID NO: 5358717 - DNA, 21 bp, Homo sapiens
agattgcaaagggacattgaa

SEQ ID NO: 5358718 - DNA, 17 bp, Homo sapiens
agattgcaacaggctgg

SEQ ID NO: 5358719 - DNA, 20 bp, Homo sapiens
agattgcaaggaaggaaaca

SEQ ID NO: 5358720 - DNA, 16 bp, Homo sapiens
agattgcaccactgca

SEQ ID NO: 5358721 - DNA, 23 bp, Homo sapiens
agattgcaccactgcactccagc

SEQ ID NO: 5358722 - DNA, 19 bp, Homo sapiens
agattgcagaaaattctgt

SEQ ID NO: 5358723 - DNA, 21 bp, Homo sapiens
agattgcctcttgaattaaaa

SEQ ID NO: 5358724 - DNA, 21 bp, Homo sapiens
agattgcgccattgcactcca

SEQ ID NO: 5358725 - DNA, 16 bp, Homo sapiens
agattgcgtggacccc

SEQ ID NO: 5358726 - DNA, 16 bp, Homo sapiens
agattgctacacacac

SEQ ID NO: 5358727 - DNA, 16 bp, Homo sapiens
agattgctctgcccca

SEQ ID NO: 5358728 - DNA, 17 bp, Homo sapiens
agattgctctgccccac

SEQ ID NO: 5358729 - DNA, 19 bp, Homo sapiens
agattgctgaaaaagtaga

SEQ ID NO: 5358730 - DNA, 14 bp, Homo sapiens
agattgctgcttct

SEQ ID NO: 5358731 - DNA, 12 bp, Homo sapiens
agattgcttctc

SEQ ID NO: 5358732 - DNA, 14 bp, Homo sapiens
agattgcttctgta

SEQ ID NO: 5358733 - DNA, 15 bp, Homo sapiens
agattgcttctgtag

SEQ ID NO: 5358734 - DNA, 14 bp, Homo sapiens
agattggaaaaggg

SEQ ID NO: 5358735 - DNA, 16 bp, Homo sapiens
agattggaaagacagg

SEQ ID NO: 5358736 - DNA, 22 bp, Homo sapiens
agattggaaggagacacagatg

SEQ ID NO: 5358737 - DNA, 23 bp, Homo sapiens
agattggacataactgacttagt

SEQ ID NO: 5358738 - DNA, 23 bp, Homo sapiens
agattggagaaacccttgaaaag

SEQ ID NO: 5358739 - DNA, 19 bp, Homo sapiens
agattggagctgaagacct

SEQ ID NO: 5358740 - DNA, 16 bp, Homo sapiens
agattggatttgctgt

SEQ ID NO: 5358741 - DNA, 15 bp, Homo sapiens
agattggcatggctt

SEQ ID NO: 5358742 - DNA, 23 bp, Homo sapiens
agattggcatggctttatttgtt

SEQ ID NO: 5358743 - DNA, 16 bp, Homo sapiens
agattggccagtgaga

SEQ ID NO: 5358744 - DNA, 22 bp, Homo sapiens
agattggccagtgagaagctga

SEQ ID NO: 5358745 - DNA, 14 bp, Homo sapiens
agattggctcacac

SEQ ID NO: 5358746 - DNA, 19 bp, Homo sapiens
agattggctcacactgaga

SEQ ID NO: 5358747 - DNA, 16 bp, Homo sapiens
agattggcttgtctca

SEQ ID NO: 5358748 - DNA, 21 bp, Homo sapiens
agattggcttgtctcacgcag

SEQ ID NO: 5358749 - DNA, 14 bp, Homo sapiens
agattgggataagg

SEQ ID NO: 5358750 - DNA, 20 bp, Homo sapiens
agattgggccgcctctcctc

SEQ ID NO: 5358751 - DNA, 14 bp, Homo sapiens
agattgggctggct

SEQ ID NO: 5358752 - DNA, 17 bp, Homo sapiens
agattgggctggctctg

SEQ ID NO: 5358753 - DNA, 15 bp, Homo sapiens
agattgggtgccagc

SEQ ID NO: 5358754 - DNA, 15 bp, Homo sapiens
agattggtgttcgtt

SEQ ID NO: 5358755 - DNA, 14 bp, Homo sapiens
agattggttctgtt

SEQ ID NO: 5358756 - DNA, 15 bp, Homo sapiens
agattgtaaactaaa

SEQ ID NO: 5358757 - DNA, 16 bp, Homo sapiens
agattgtaaactaaag

SEQ ID NO: 5358758 - DNA, 21 bp, Homo sapiens
agattgtaaaggtaggtgcat

SEQ ID NO: 5358759 - DNA, 13 bp, Homo sapiens
agattgtactgtt

SEQ ID NO: 5358760 - DNA, 21 bp, Homo sapiens
agattgtactgttcatacagt

SEQ ID NO: 5358761 - DNA, 13 bp, Homo sapiens
agcaagccttcct

SEQ ID NO: 5358762 - DNA, 12 bp, Homo sapiens
agcaagcctttg

SEQ ID NO: 5358763 - DNA, 21 bp, Homo sapiens
agcaagcctttgacctgttca

SEQ ID NO: 5358764 - DNA, 16 bp, Homo sapiens
agcaagcgaaagagca

SEQ ID NO: 5358765 - DNA, 16 bp, Homo sapiens
agcaagcgttattttg

SEQ ID NO: 5358766 - DNA, 15 bp, Homo sapiens
agcaagctcccaagg

SEQ ID NO: 5358767 - DNA, 13 bp, Homo sapiens
agcaagctctgcc

SEQ ID NO: 5358768 - DNA, 19 bp, Homo sapiens
agcaagctctgccctggct

SEQ ID NO: 5358769 - DNA, 14 bp, Homo sapiens
agcaagctgcccag

SEQ ID NO: 5358770 - DNA, 16 bp, Homo sapiens
agcaagctgcccagcc

SEQ ID NO: 5358771 - DNA, 22 bp, Homo sapiens
agcaagcttacacaagaagtga

SEQ ID NO: 5358772 - DNA, 14 bp, Homo sapiens
agcaagctttggtt

SEQ ID NO: 5358773 - DNA, 21 bp, Homo sapiens
agcaaggaagatatacatgaa

SEQ ID NO: 5358774 - DNA, 13 bp, Homo sapiens
agcaaggacattg

SEQ ID NO: 5358775 - DNA, 22 bp, Homo sapiens
agcaaggacattgccccaagat

SEQ ID NO: 5358776 - DNA, 17 bp, Homo sapiens
agcaaggagaaaatata

SEQ ID NO: 5358777 - DNA, 14 bp, Homo sapiens
agcaaggagattta

SEQ ID NO: 5358778 - DNA, 22 bp, Homo sapiens
agcaaggcaagaagtgggattc

SEQ ID NO: 5358779 - DNA, 17 bp, Homo sapiens
agcaaggcacaggctcc

SEQ ID NO: 5358780 - DNA, 13 bp, Homo sapiens
agcaaggcagagc

SEQ ID NO: 5358781 - DNA, 15 bp, Homo sapiens
agcaaggcagagcct

SEQ ID NO: 5358782 - DNA, 12 bp, Homo sapiens
agcaaggccacc

SEQ ID NO: 5358783 - DNA, 12 bp, Homo sapiens
agcaaggcccga

SEQ ID NO: 5358784 - DNA, 14 bp, Homo sapiens
agcaaggcccgagc

SEQ ID NO: 5358785 - DNA, 20 bp, Homo sapiens
agcaaggcccgagcagctga

SEQ ID NO: 5358786 - DNA, 11 bp, Homo sapiens
agcaaggcctt

SEQ ID NO: 5358787 - DNA, 22 bp, Homo sapiens
agcaaggccttggtggagcagc

SEQ ID NO: 5358788 - DNA, 24 bp, Homo sapiens
agcaaggccttggtggagcagcca

SEQ ID NO: 5358789 - DNA, 19 bp, Homo sapiens
agcaaggctgctaagtgga

SEQ ID NO: 5358790 - DNA, 14 bp, Homo sapiens
agcaaggctgctgc

SEQ ID NO: 5358791 - DNA, 15 bp, Homo sapiens
agcaagggaacagaa

SEQ ID NO: 5358792 - DNA, 15 bp, Homo sapiens
agcaagggagaaaag

SEQ ID NO: 5358793 - DNA, 21 bp, Homo sapiens
agcaagggagaaaagagaaac

SEQ ID NO: 5358794 - DNA, 16 bp, Homo sapiens
agcaaggggctctgcc

SEQ ID NO: 5358795 - DNA, 16 bp, Homo sapiens
agcaagggtgatggga

SEQ ID NO: 5358796 - DNA, 20 bp, Homo sapiens
agcaagggtgatgggaaagc

SEQ ID NO: 5358797 - DNA, 15 bp, Homo sapiens
agcaaggtctcagac

SEQ ID NO: 5358798 - DNA, 15 bp, Homo sapiens
agcaaggtgagaaat

SEQ ID NO: 5358799 - DNA, 19 bp, Homo sapiens
agcaaggtggagtggatgc

SEQ ID NO: 5358800 - DNA, 19 bp, Homo sapiens
agcaaggtgtggaggctcc

SEQ ID NO: 5358801 - DNA, 20 bp, Homo sapiens
agcaaggtgtggaggctcct

SEQ ID NO: 5358802 - DNA, 21 bp, Homo sapiens
agcaaggtgtggaggctcctg

SEQ ID NO: 5358803 - DNA, 17 bp, Homo sapiens
agcaaggtgtttaagta

SEQ ID NO: 5358804 - DNA, 22 bp, Homo sapiens
agcaaggtttcctttcagccct

SEQ ID NO: 5358805 - DNA, 19 bp, Homo sapiens
agcaaggtttcgtggcagc

SEQ ID NO: 5358806 - DNA, 22 bp, Homo sapiens
agcaagtacagcggctcccctc

SEQ ID NO: 5358807 - DNA, 17 bp, Homo sapiens
agcaagtagagcagagt

SEQ ID NO: 5358808 - DNA, 20 bp, Homo sapiens
agcaagtagataaatatttg

SEQ ID NO: 5358809 - DNA, 14 bp, Homo sapiens
agcaagtcacctta

SEQ ID NO: 5358810 - DNA, 20 bp, Homo sapiens
agcaagtcccagacaaggag

SEQ ID NO: 5358811 - DNA, 20 bp, Homo sapiens
agcaagtcccttcagactgg

SEQ ID NO: 5358812 - DNA, 15 bp, Homo sapiens
agcaagtccttaggc

SEQ ID NO: 5358813 - DNA, 14 bp, Homo sapiens
agcaagtctgcagg

SEQ ID NO: 5358814 - DNA, 20 bp, Homo sapiens
agcaagtcttaacaaaccaa

SEQ ID NO: 5358815 - DNA, 12 bp, Homo sapiens
agcaagtgaact

SEQ ID NO: 5358816 - DNA, 21 bp, Homo sapiens
agcaagtgaactcatcccttg

SEQ ID NO: 5358817 - DNA, 16 bp, Homo sapiens
agcaagtgagaccctg

SEQ ID NO: 5358818 - DNA, 24 bp, Homo sapiens
agcaagtgagagagatgggagctc

SEQ ID NO: 5358819 - DNA, 14 bp, Homo sapiens
agcaagtgagagct

SEQ ID NO: 5358820 - DNA, 15 bp, Homo sapiens
agcaagtgagagctg

SEQ ID NO: 5358821 - DNA, 16 bp, Homo sapiens
agcaagtgagcagaga

SEQ ID NO: 5358822 - DNA, 16 bp, Homo sapiens
agcaagtgagcagatg

SEQ ID NO: 5358823 - DNA, 21 bp, Homo sapiens
agcaagtgaggccggagagga

SEQ ID NO: 5358824 - DNA, 21 bp, Homo sapiens
agcaagtgagtctggtggagg

SEQ ID NO: 5358825 - DNA, 16 bp, Homo sapiens
agcaagtgctgagtct

SEQ ID NO: 5358826 - DNA, 15 bp, Homo sapiens
agcaagtgtgaatac

SEQ ID NO: 5358827 - DNA, 16 bp, Homo sapiens
agcaagtgttcactgc

SEQ ID NO: 5358828 - DNA, 14 bp, Homo sapiens
agcaagttctagaa

SEQ ID NO: 5358829 - DNA, 17 bp, Homo sapiens
agcaagtttcaccttgg

SEQ ID NO: 5358830 - DNA, 19 bp, Homo sapiens
agcaagtttcatcagccct

SEQ ID NO: 5358831 - DNA, 15 bp, Homo sapiens
agcaataaaactgct

SEQ ID NO: 5358832 - DNA, 16 bp, Homo sapiens
agcaataaaactgcta

SEQ ID NO: 5358833 - DNA, 15 bp, Homo sapiens
agcaataaaattttt

SEQ ID NO: 5358834 - DNA, 19 bp, Homo sapiens
agcaataacattcccactg

SEQ ID NO: 5358835 - DNA, 22 bp, Homo sapiens
agcaataacattcccactgcca

SEQ ID NO: 5358836 - DNA, 23 bp, Homo sapiens
agcaataactccaagcagactcc

SEQ ID NO: 5358837 - DNA, 17 bp, Homo sapiens
agcaataactgaaaatg

SEQ ID NO: 5358838 - DNA, 14 bp, Homo sapiens
agcaataacttcta

SEQ ID NO: 5358839 - DNA, 18 bp, Homo sapiens
agcaataacttctatgtt

SEQ ID NO: 5358840 - DNA, 14 bp, Homo sapiens
agcaataagaaatg

SEQ ID NO: 5358841 - DNA, 20 bp, Homo sapiens
agcaataagctggactagtg

SEQ ID NO: 5358842 - DNA, 19 bp, Homo sapiens
agcaataagttcattaaac

SEQ ID NO: 5358843 - DNA, 16 bp, Homo sapiens
agcaataagttgaatg

SEQ ID NO: 5358844 - DNA, 11 bp, Homo sapiens
agcaataatta

SEQ ID NO: 5358845 - DNA, 14 bp, Homo sapiens
agcaataattgttt

SEQ ID NO: 5358846 - DNA, 12 bp, Homo sapiens
agcaataatttc

SEQ ID NO: 5358847 - DNA, 16 bp, Homo sapiens
agcaataatttctgta

SEQ ID NO: 5358848 - DNA, 14 bp, Homo sapiens
agcaatacaacttt

SEQ ID NO: 5358849 - DNA, 21 bp, Homo sapiens
agcaatacgtttgtgcagaat

SEQ ID NO: 5358850 - DNA, 22 bp, Homo sapiens
agcaatacgtttgtgcagaatc

SEQ ID NO: 5358851 - DNA, 19 bp, Homo sapiens
agcaatactcatcagagca

SEQ ID NO: 5358852 - DNA, 22 bp, Homo sapiens
agcaatactgccgctgccccca

SEQ ID NO: 5358853 - DNA, 17 bp, Homo sapiens
agcaatacttggagggc

SEQ ID NO: 5358854 - DNA, 22 bp, Homo sapiens
agcaatacttggagggcccagc

SEQ ID NO: 5358855 - DNA, 12 bp, Homo sapiens
agcaatagaaac

SEQ ID NO: 5358856 - DNA, 14 bp, Homo sapiens
agcaatagaaacaa

SEQ ID NO: 5358857 - DNA, 23 bp, Homo sapiens
agcaatatattaccagcaagaat

SEQ ID NO: 5358858 - DNA, 13 bp, Homo sapiens
agcaatatatttg

SEQ ID NO: 5358859 - DNA, 15 bp, Homo sapiens
agcaatatatttgta

SEQ ID NO: 5358860 - DNA, 15 bp, Homo sapiens
agcaatatcagttat

SEQ ID NO: 5358861 - DNA, 13 bp, Homo sapiens
agcaatatctgct

SEQ ID NO: 5358862 - DNA, 21 bp, Homo sapiens
agcaatattcttggagattga

SEQ ID NO: 5358863 - DNA, 15 bp, Homo sapiens
agcaatattgcctgt

SEQ ID NO: 5358864 - DNA, 13 bp, Homo sapiens
agcaatatttata

SEQ ID NO: 5358865 - DNA, 15 bp, Homo sapiens
agcaatatttatgga

SEQ ID NO: 5358866 - DNA, 22 bp, Homo sapiens
agcaatatttccctggaattta

SEQ ID NO: 5358867 - DNA, 12 bp, Homo sapiens
agcaatattttg

SEQ ID NO: 5358868 - DNA, 15 bp, Homo sapiens
agcaatcacaaaggc

SEQ ID NO: 5358869 - DNA, 14 bp, Homo sapiens
agcaatcactgggc

SEQ ID NO: 5358870 - DNA, 15 bp, Homo sapiens
agcaatcactgggcc

SEQ ID NO: 5358871 - DNA, 19 bp, Homo sapiens
agcaatcactgggcccaga

SEQ ID NO: 5358872 - DNA, 22 bp, Homo sapiens
agcaatcagcaaacacaataag

SEQ ID NO: 5358873 - DNA, 13 bp, Homo sapiens
agcaatcatttta

SEQ ID NO: 5358874 - DNA, 15 bp, Homo sapiens
agcaatcctcccact

SEQ ID NO: 5358875 - DNA, 13 bp, Homo sapiens
agcaatcctcctg

SEQ ID NO: 5358876 - DNA, 15 bp, Homo sapiens
agcaatcctcctgcc

SEQ ID NO: 5358877 - DNA, 21 bp, Homo sapiens
agcaatcctcctgcctcagcc

SEQ ID NO: 5358878 - DNA, 23 bp, Homo sapiens
agcaatcctcctgcctcagcctt

SEQ ID NO: 5358879 - DNA, 15 bp, Homo sapiens
agcaatctccttact

SEQ ID NO: 5358880 - DNA, 18 bp, Homo sapiens
agcaatctcttcattatt

SEQ ID NO: 5358881 - DNA, 19 bp, Homo sapiens
agcaatctgcattttaaca

SEQ ID NO: 5358882 - DNA, 13 bp, Homo sapiens
agcaatcttgctg

SEQ ID NO: 5358883 - DNA, 19 bp, Homo sapiens
agcaatcttgctgtgaaac

SEQ ID NO: 5358884 - DNA, 12 bp, Homo sapiens
agcaatcttggc

SEQ ID NO: 5358885 - DNA, 13 bp, Homo sapiens
agcaatctttgaa

SEQ ID NO: 5358886 - DNA, 19 bp, Homo sapiens
agcaatctttgaaataaaa

SEQ ID NO: 5358887 - DNA, 13 bp, Homo sapiens
agcaatgaagaac

SEQ ID NO: 5358888 - DNA, 20 bp, Homo sapiens
agcaatgacatctcaggggc

SEQ ID NO: 5358889 - DNA, 21 bp, Homo sapiens
agcaatgatgacccactaaag

SEQ ID NO: 5358890 - DNA, 18 bp, Homo sapiens
agcaatgatgtccagaag

SEQ ID NO: 5358891 - DNA, 20 bp, Homo sapiens
agcaatgatgtccagaagaa

SEQ ID NO: 5358892 - DNA, 20 bp, Homo sapiens
agcaatgcccgtaatgctta

SEQ ID NO: 5358893 - DNA, 15 bp, Homo sapiens
agcaatgccctgcct

SEQ ID NO: 5358894 - DNA, 20 bp, Homo sapiens
agcaatgccctgccttgctg

SEQ ID NO: 5358895 - DNA, 14 bp, Homo sapiens
agcaatgctgtgaa

SEQ ID NO: 5358896 - DNA, 19 bp, Homo sapiens
agcaatgcttttaatgaat

SEQ ID NO: 5358897 - DNA, 15 bp, Homo sapiens
agcaatggccagagc

SEQ ID NO: 5358898 - DNA, 17 bp, Homo sapiens
agcaatggccagagcct

SEQ ID NO: 5358899 - DNA, 19 bp, Homo sapiens
agcaatggccagagcctct

SEQ ID NO: 5358900 - DNA, 16 bp, Homo sapiens
agcaatgggactggag

SEQ ID NO: 5358901 - DNA, 21 bp, Homo sapiens
agcaatgggactggagtcaga

SEQ ID NO: 5358902 - DNA, 17 bp, Homo sapiens
agcaatgggggcctccg

SEQ ID NO: 5358903 - DNA, 16 bp, Homo sapiens
agcaatgggtcttagc

SEQ ID NO: 5358904 - DNA, 18 bp, Homo sapiens
agcaatgggtcttagctc

SEQ ID NO: 5358905 - DNA, 23 bp, Homo sapiens
agcaatggtaactgcacctgggc

SEQ ID NO: 5358906 - DNA, 18 bp, Homo sapiens
agcaatgttggtttttta

SEQ ID NO: 5358907 - DNA, 19 bp, Homo sapiens
agcaatgttggttttttat

SEQ ID NO: 5358908 - DNA, 21 bp, Homo sapiens
agcaatgttggttttttataa

SEQ ID NO: 5358909 - DNA, 20 bp, Homo sapiens
agcaatgtttttctcaaaaa

SEQ ID NO: 5358910 - DNA, 17 bp, Homo sapiens
agcaattaaagacattt

SEQ ID NO: 5358911 - DNA, 22 bp, Homo sapiens
agcaattaaagacatttaaaat

SEQ ID NO: 5358912 - DNA, 14 bp, Homo sapiens
agcaattaaatgat

SEQ ID NO: 5358913 - DNA, 17 bp, Homo sapiens
agcaattaaatgatatt

SEQ ID NO: 5358914 - DNA, 21 bp, Homo sapiens
agcaattaaatgatattgggt

SEQ ID NO: 5358915 - DNA, 20 bp, Homo sapiens
agcaattactacaaatggat

SEQ ID NO: 5358916 - DNA, 15 bp, Homo sapiens
agcaattagcagaag

SEQ ID NO: 5358917 - DNA, 18 bp, Homo sapiens
agcaattagcagaagtga

SEQ ID NO: 5358918 - DNA, 15 bp, Homo sapiens
agcaattatattgtc

SEQ ID NO: 5358919 - DNA, 20 bp, Homo sapiens
agcaattcacgctgtctctt

SEQ ID NO: 5358920 - DNA, 17 bp, Homo sapiens
agcaattcatggttcaa

SEQ ID NO: 5358921 - DNA, 17 bp, Homo sapiens
agcaattcatttcactt

SEQ ID NO: 5358922 - DNA, 14 bp, Homo sapiens
agcaattccaggct

SEQ ID NO: 5358923 - DNA, 15 bp, Homo sapiens
agcaattccaggctg

SEQ ID NO: 5358924 - DNA, 20 bp, Homo sapiens
agcaattccatgctataaaa

SEQ ID NO: 5358925 - DNA, 23 bp, Homo sapiens
agcaattctacccagagccttct

SEQ ID NO: 5358926 - DNA, 15 bp, Homo sapiens
agcaattctcctaag

SEQ ID NO: 5358927 - DNA, 18 bp, Homo sapiens
agcaattctcctgcctca

SEQ ID NO: 5358928 - DNA, 20 bp, Homo sapiens
agcaattctcctgcctcagc

SEQ ID NO: 5358929 - DNA, 23 bp, Homo sapiens
agcaattctcctgcctcagcctc

SEQ ID NO: 5358930 - DNA, 15 bp, Homo sapiens
agcaattctgactgt

SEQ ID NO: 5358931 - DNA, 22 bp, Homo sapiens
agcaattgcgaccttaatttaa

SEQ ID NO: 5358932 - DNA, 17 bp, Homo sapiens
agcaattgctgcatctt

SEQ ID NO: 5358933 - DNA, 13 bp, Homo sapiens
agcaattggcagc

SEQ ID NO: 5358934 - DNA, 23 bp, Homo sapiens
agcaattgtgtggtcagtggctc

SEQ ID NO: 5358935 - DNA, 17 bp, Homo sapiens
agcaatttaaatgttat

SEQ ID NO: 5358936 - DNA, 23 bp, Homo sapiens
agcaatttaatattttgcacagt

SEQ ID NO: 5358937 - DNA, 24 bp, Homo sapiens
agcaatttaatattttgcacagtt

SEQ ID NO: 5358938 - DNA, 13 bp, Homo sapiens
agcaatttacctg

SEQ ID NO: 5358939 - DNA, 17 bp, Homo sapiens
agcactacctaagtaat

SEQ ID NO: 5358940 - DNA, 17 bp, Homo sapiens
agcactactctgtgcca

SEQ ID NO: 5358941 - DNA, 19 bp, Homo sapiens
agcactactgggtgtcatt

SEQ ID NO: 5358942 - DNA, 18 bp, Homo sapiens
agcactagacatgtcatg

SEQ ID NO: 5358943 - DNA, 19 bp, Homo sapiens
agcactagacatgtcatgg

SEQ ID NO: 5358944 - DNA, 17 bp, Homo sapiens
agcactagatcatggga

SEQ ID NO: 5358945 - DNA, 16 bp, Homo sapiens
agcactagcattcagg

SEQ ID NO: 5358946 - DNA, 20 bp, Homo sapiens
agcactagccaaacctcacc

SEQ ID NO: 5358947 - DNA, 15 bp, Homo sapiens
agcactaggcaccca

SEQ ID NO: 5358948 - DNA, 23 bp, Homo sapiens
agcactaggttcaattccctgaa

SEQ ID NO: 5358949 - DNA, 18 bp, Homo sapiens
agcactagtttgattatt

SEQ ID NO: 5358950 - DNA, 22 bp, Homo sapiens
agcactagtttgattattatgt

SEQ ID NO: 5358951 - DNA, 23 bp, Homo sapiens
agcactagtttgattattatgtt

SEQ ID NO: 5358952 - DNA, 23 bp, Homo sapiens
agcactattctttgtattaccaa

SEQ ID NO: 5358953 - DNA, 22 bp, Homo sapiens
agcactattttatatttaaaaa

SEQ ID NO: 5358954 - DNA, 22 bp, Homo sapiens
agcactcaataaagtgggcttt

SEQ ID NO: 5358955 - DNA, 16 bp, Homo sapiens
agcactcacacaggac

SEQ ID NO: 5358956 - DNA, 13 bp, Homo sapiens
agcactcacatgc

SEQ ID NO: 5358957 - DNA, 14 bp, Homo sapiens
agcactcacatgct

SEQ ID NO: 5358958 - DNA, 12 bp, Homo sapiens
agcactcagcct

SEQ ID NO: 5358959 - DNA, 13 bp, Homo sapiens
agcactcagcctc

SEQ ID NO: 5358960 - DNA, 19 bp, Homo sapiens
agcactcaggctctccatt

SEQ ID NO: 5358961 - DNA, 20 bp, Homo sapiens
agcactcagtctagtgaaga

SEQ ID NO: 5358962 - DNA, 22 bp, Homo sapiens
agcactccatcactgagagccc

SEQ ID NO: 5358963 - DNA, 20 bp, Homo sapiens
agcactcccaagtctacaga

SEQ ID NO: 5358964 - DNA, 15 bp, Homo sapiens
agcactcccagggcc

SEQ ID NO: 5358965 - DNA, 12 bp, Homo sapiens
agcactcccctt

SEQ ID NO: 5358966 - DNA, 15 bp, Homo sapiens
agcactccccttgcc

SEQ ID NO: 5358967 - DNA, 17 bp, Homo sapiens
agcactcccgctgcaca

SEQ ID NO: 5358968 - DNA, 22 bp, Homo sapiens
agcactcccttaggcattattt

SEQ ID NO: 5358969 - DNA, 20 bp, Homo sapiens
agcactccgcatcacctcac

SEQ ID NO: 5358970 - DNA, 22 bp, Homo sapiens
agcactccgcatcacctcacca

SEQ ID NO: 5358971 - DNA, 19 bp, Homo sapiens
agcactcctccctgatgta

SEQ ID NO: 5358972 - DNA, 20 bp, Homo sapiens
agcactcctccctgatgtac

SEQ ID NO: 5358973 - DNA, 12 bp, Homo sapiens
agcactcctctg

SEQ ID NO: 5358974 - DNA, 17 bp, Homo sapiens
agcactcctctgtctct

SEQ ID NO: 5358975 - DNA, 18 bp, Homo sapiens
agcactcctgatttttat

SEQ ID NO: 5358976 - DNA, 16 bp, Homo sapiens
agcactcctgcttaat

SEQ ID NO: 5358977 - DNA, 20 bp, Homo sapiens
agcactcctgcttaatcttc

SEQ ID NO: 5358978 - DNA, 20 bp, Homo sapiens
agcactcgagaccatcctgg

SEQ ID NO: 5358979 - DNA, 19 bp, Homo sapiens
agcactcgctagcagtggc

SEQ ID NO: 5358980 - DNA, 24 bp, Homo sapiens
agcactcgctagcagtggcaggca

SEQ ID NO: 5358981 - DNA, 20 bp, Homo sapiens
agcactcggggtccctggag

SEQ ID NO: 5358982 - DNA, 14 bp, Homo sapiens
agcactcgtgtgca

SEQ ID NO: 5358983 - DNA, 15 bp, Homo sapiens
agcactctcacccca

SEQ ID NO: 5358984 - DNA, 11 bp, Homo sapiens
agcactctcag

SEQ ID NO: 5358985 - DNA, 22 bp, Homo sapiens
agcactctctaaatcttccttg

SEQ ID NO: 5358986 - DNA, 18 bp, Homo sapiens
agcactctctgcagtcct

SEQ ID NO: 5358987 - DNA, 20 bp, Homo sapiens
agcactctctgcagtcctcc

SEQ ID NO: 5358988 - DNA, 23 bp, Homo sapiens
agcactctgagtttaccatttgt

SEQ ID NO: 5358989 - DNA, 14 bp, Homo sapiens
agcactctggactc

SEQ ID NO: 5358990 - DNA, 14 bp, Homo sapiens
agcactgaaacatt

SEQ ID NO: 5358991 - DNA, 12 bp, Homo sapiens
agcactgacact

SEQ ID NO: 5358992 - DNA, 18 bp, Homo sapiens
agcactgacagatttcca

SEQ ID NO: 5358993 - DNA, 22 bp, Homo sapiens
agcactgacctgtcatgccccc

SEQ ID NO: 5358994 - DNA, 16 bp, Homo sapiens
agcactgacttctaag

SEQ ID NO: 5358995 - DNA, 19 bp, Homo sapiens
agcactgacttctaagtaa

SEQ ID NO: 5358996 - DNA, 12 bp, Homo sapiens
agcactgagcaa

SEQ ID NO: 5358997 - DNA, 21 bp, Homo sapiens
agcactgagctcacatgggac

SEQ ID NO: 5358998 - DNA, 22 bp, Homo sapiens
agcactgagggtggcactcaac

SEQ ID NO: 5358999 - DNA, 16 bp, Homo sapiens
agcactgatagtcctt

SEQ ID NO: 5359000 - DNA, 21 bp, Homo sapiens
agcactgatagtcctttttcc

SEQ ID NO: 5359001 - DNA, 19 bp, Homo sapiens
agcactgcacctgcctcca

SEQ ID NO: 5359002 - DNA, 20 bp, Homo sapiens
agcactgcatgtcagagcac

SEQ ID NO: 5359003 - DNA, 21 bp, Homo sapiens
agcactgcatgtcagagcact

SEQ ID NO: 5359004 - DNA, 14 bp, Homo sapiens
agcactgccaccag

SEQ ID NO: 5359005 - DNA, 12 bp, Homo sapiens
agcactgccagg

SEQ ID NO: 5359006 - DNA, 14 bp, Homo sapiens
agcactgccaggag

SEQ ID NO: 5359007 - DNA, 15 bp, Homo sapiens
agcactgccaggagg

SEQ ID NO: 5359008 - DNA, 19 bp, Homo sapiens
agcactgccattagactga

SEQ ID NO: 5359009 - DNA, 18 bp, Homo sapiens
agcactgcccatcccacc

SEQ ID NO: 5359010 - DNA, 19 bp, Homo sapiens
agcactgccccacatgcat

SEQ ID NO: 5359011 - DNA, 21 bp, Homo sapiens
agcactgccccacatgcatgt

SEQ ID NO: 5359012 - DNA, 12 bp, Homo sapiens
agcactgcctct

SEQ ID NO: 5359013 - DNA, 20 bp, Homo sapiens
agcactgcctctatgccctg

SEQ ID NO: 5359014 - DNA, 23 bp, Homo sapiens
agcactgcctctatgccctgcag

SEQ ID NO: 5359015 - DNA, 14 bp, Homo sapiens
agcactgcctgcca

SEQ ID NO: 5359016 - DNA, 19 bp, Homo sapiens
agcactgcctgctcccatc

SEQ ID NO: 5359017 - DNA, 20 bp, Homo sapiens
agcactgcctgctcccatcc

SEQ ID NO: 5359018 - DNA, 22 bp, Homo sapiens
agcactgctaggcgagtgccag

SEQ ID NO: 5359019 - DNA, 18 bp, Homo sapiens
agcactgctcacgtctct

SEQ ID NO: 5359020 - DNA, 12 bp, Homo sapiens
agcactgctcca

SEQ ID NO: 5359021 - DNA, 14 bp, Homo sapiens
agcactgctgcctc

SEQ ID NO: 5359022 - DNA, 17 bp, Homo sapiens
agcactgcttgaggaaa

SEQ ID NO: 5359023 - DNA, 19 bp, Homo sapiens
agcactggaaccacctgga

SEQ ID NO: 5359024 - DNA, 16 bp, Homo sapiens
agcactggaggcctct

SEQ ID NO: 5359025 - DNA, 16 bp, Homo sapiens
agcactggagtgcagg

SEQ ID NO: 5359026 - DNA, 17 bp, Homo sapiens
agcactggagtgcaggg

SEQ ID NO: 5359027 - DNA, 14 bp, Homo sapiens
agcactggccagag

SEQ ID NO: 5359028 - DNA, 16 bp, Homo sapiens
agcactggccagagag

SEQ ID NO: 5359029 - DNA, 17 bp, Homo sapiens
agcactggcctgcacgg

SEQ ID NO: 5359030 - DNA, 21 bp, Homo sapiens
agcactggccttgcctccagg

SEQ ID NO: 5359031 - DNA, 14 bp, Homo sapiens
agcactggctctct

SEQ ID NO: 5359032 - DNA, 18 bp, Homo sapiens
agcactggctctctccag

SEQ ID NO: 5359033 - DNA, 15 bp, Homo sapiens
agcactgggaagctg

SEQ ID NO: 5359034 - DNA, 16 bp, Homo sapiens
agcactgggctcccgg

SEQ ID NO: 5359035 - DNA, 23 bp, Homo sapiens
agcactggggaaaaataaacaat

SEQ ID NO: 5359036 - DNA, 20 bp, Homo sapiens
agcactggggtgggggtgga

SEQ ID NO: 5359037 - DNA, 23 bp, Homo sapiens
agcactggtgaactgagctgggc

SEQ ID NO: 5359038 - DNA, 15 bp, Homo sapiens
agcactgtaaacttc

SEQ ID NO: 5359039 - DNA, 12 bp, Homo sapiens
agcactgtatac

SEQ ID NO: 5359040 - DNA, 13 bp, Homo sapiens
agcactgtccctt

SEQ ID NO: 5359041 - DNA, 16 bp, Homo sapiens
agcactgtcccttgcc

SEQ ID NO: 5359042 - DNA, 19 bp, Homo sapiens
agcactgtcccttgcctca

SEQ ID NO: 5359043 - DNA, 15 bp, Homo sapiens
agcactgtgaagacc

SEQ ID NO: 5359044 - DNA, 18 bp, Homo sapiens
agcactgtgaagacccag

SEQ ID NO: 5359045 - DNA, 23 bp, Homo sapiens
agcactgtgatgctttatgcaac

SEQ ID NO: 5359046 - DNA, 23 bp, Homo sapiens
agcactgtgctaataacagtgca

SEQ ID NO: 5359047 - DNA, 22 bp, Homo sapiens
agcactgtgtttatatgtcttg

SEQ ID NO: 5359048 - DNA, 20 bp, Homo sapiens
agcactgttccagcctgccc

SEQ ID NO: 5359049 - DNA, 19 bp, Homo sapiens
agcactgttctgggactcc

SEQ ID NO: 5359050 - DNA, 22 bp, Homo sapiens
agcactgttctgggactccagg

SEQ ID NO: 5359051 - DNA, 23 bp, Homo sapiens
agcactgttctgggactccaggt

SEQ ID NO: 5359052 - DNA, 15 bp, Homo sapiens
agcactgttgagaag

SEQ ID NO: 5359053 - DNA, 21 bp, Homo sapiens
agcactgttgatgtatctgag

SEQ ID NO: 5359054 - DNA, 20 bp, Homo sapiens
agcactgttttctagtgtat

SEQ ID NO: 5359055 - DNA, 16 bp, Homo sapiens
agcactgtttttccat

SEQ ID NO: 5359056 - DNA, 23 bp, Homo sapiens
agcacttaaacagaagcagaggc

SEQ ID NO: 5359057 - DNA, 16 bp, Homo sapiens
agcacttaaagttttt

SEQ ID NO: 5359058 - DNA, 15 bp, Homo sapiens
agcacttaagagaat

SEQ ID NO: 5359059 - DNA, 15 bp, Homo sapiens
agcacttaagtgtta

SEQ ID NO: 5359060 - DNA, 17 bp, Homo sapiens
agcacttacgtaaaaca

SEQ ID NO: 5359061 - DNA, 19 bp, Homo sapiens
agcacttagacctgccagc

SEQ ID NO: 5359062 - DNA, 17 bp, Homo sapiens
agcacttcacacagaca

SEQ ID NO: 5359063 - DNA, 14 bp, Homo sapiens
agcacttcccagga

SEQ ID NO: 5359064 - DNA, 15 bp, Homo sapiens
agcacttcccaggat

SEQ ID NO: 5359065 - DNA, 15 bp, Homo sapiens
agcacttctgctgca

SEQ ID NO: 5359066 - DNA, 16 bp, Homo sapiens
agcacttctgctgcat

SEQ ID NO: 5359067 - DNA, 21 bp, Homo sapiens
agcacttctttcctctccaat

SEQ ID NO: 5359068 - DNA, 15 bp, Homo sapiens
agcacttcttttcca

SEQ ID NO: 5359069 - DNA, 17 bp, Homo sapiens
agcacttgcgtcctgca

SEQ ID NO: 5359070 - DNA, 19 bp, Homo sapiens
agcacttgcgtcctgcaga

SEQ ID NO: 5359071 - DNA, 13 bp, Homo sapiens
agcacttggactc

SEQ ID NO: 5359072 - DNA, 18 bp, Homo sapiens
agcacttggactcttgct

SEQ ID NO: 5359073 - DNA, 21 bp, Homo sapiens
agcacttggactcttgctctt

SEQ ID NO: 5359074 - DNA, 23 bp, Homo sapiens
agcacttggagccaagggttcag

SEQ ID NO: 5359075 - DNA, 14 bp, Homo sapiens
agcacttggccctt

SEQ ID NO: 5359076 - DNA, 15 bp, Homo sapiens
agcacttggcccttc

SEQ ID NO: 5359077 - DNA, 13 bp, Homo sapiens
agcacttgtatat

SEQ ID NO: 5359078 - DNA, 22 bp, Homo sapiens
agcacttgtctcattttaatgt

SEQ ID NO: 5359079 - DNA, 20 bp, Homo sapiens
agcacttgttccttctgctt

SEQ ID NO: 5359080 - DNA, 19 bp, Homo sapiens
agcacttgttttaaaatgc

SEQ ID NO: 5359081 - DNA, 20 bp, Homo sapiens
agcactttaaaaaatttttt

SEQ ID NO: 5359082 - DNA, 23 bp, Homo sapiens
agcactttaaaaacaggccagcc

SEQ ID NO: 5359083 - DNA, 23 bp, Homo sapiens
agcactttaaagaggctgtgtgg

SEQ ID NO: 5359084 - DNA, 18 bp, Homo sapiens
agcactttaacacagtgt

SEQ ID NO: 5359085 - DNA, 18 bp, Homo sapiens
agcactttacgctgtctg

SEQ ID NO: 5359086 - DNA, 15 bp, Homo sapiens
agcactttctgtagt

SEQ ID NO: 5359087 - DNA, 19 bp, Homo sapiens
agcactttgaaaatatttc

SEQ ID NO: 5359088 - DNA, 22 bp, Homo sapiens
agcactttgaaaatatttctat

SEQ ID NO: 5359089 - DNA, 21 bp, Homo sapiens
agcactttgaaatacctcatg

SEQ ID NO: 5359090 - DNA, 21 bp, Homo sapiens
agcactttgagaggctgaggt

SEQ ID NO: 5359091 - DNA, 11 bp, Homo sapiens
agcactttgat

SEQ ID NO: 5359092 - DNA, 15 bp, Homo sapiens
agcactttgcactta

SEQ ID NO: 5359093 - DNA, 16 bp, Homo sapiens
agcactttgcacttaa

SEQ ID NO: 5359094 - DNA, 12 bp, Homo sapiens
agcactttggga

SEQ ID NO: 5359095 - DNA, 15 bp, Homo sapiens
agcactttgggaagc

SEQ ID NO: 5359096 - DNA, 22 bp, Homo sapiens
agcactttgggaagctgaggca

SEQ ID NO: 5359097 - DNA, 14 bp, Homo sapiens
agcactttgggagg

SEQ ID NO: 5359098 - DNA, 15 bp, Homo sapiens
agcactttgggaggc

SEQ ID NO: 5359099 - DNA, 18 bp, Homo sapiens
agcactttgggaggccaa

SEQ ID NO: 5359100 - DNA, 20 bp, Homo sapiens
agcactttgggaggccgagg

SEQ ID NO: 5359101 - DNA, 22 bp, Homo sapiens
agcactttgggaggccgaggca

SEQ ID NO: 5359102 - DNA, 22 bp, Homo sapiens
agcactttgggaggccgaggtg

SEQ ID NO: 5359103 - DNA, 16 bp, Homo sapiens
agcactttgggaggct

SEQ ID NO: 5359104 - DNA, 18 bp, Homo sapiens
agcactttgggaggctga

SEQ ID NO: 5359105 - DNA, 19 bp, Homo sapiens
agcactttgggaggctgag

SEQ ID NO: 5359106 - DNA, 14 bp, Homo sapiens
agcacttttaaaaa

SEQ ID NO: 5359107 - DNA, 16 bp, Homo sapiens
agcacttttaaaaaaa

SEQ ID NO: 5359108 - DNA, 14 bp, Homo sapiens
agcacttttgttat

SEQ ID NO: 5359109 - DNA, 15 bp, Homo sapiens
agcacttttgttatt

SEQ ID NO: 5359110 - DNA, 20 bp, Homo sapiens
agcacttttgttattccatc

SEQ ID NO: 5359111 - DNA, 14 bp, Homo sapiens
agcactttttaaaa

SEQ ID NO: 5359112 - DNA, 22 bp, Homo sapiens
agcagaaaaacaggcacaggct

SEQ ID NO: 5359113 - DNA, 21 bp, Homo sapiens
agcagaaaacaagagaaagaa

SEQ ID NO: 5359114 - DNA, 15 bp, Homo sapiens
agcagaaaagtgctt

SEQ ID NO: 5359115 - DNA, 19 bp, Homo sapiens
agcagctaactccgagagc

SEQ ID NO: 5359116 - DNA, 21 bp, Homo sapiens
agcagctagctctttggtcta

SEQ ID NO: 5359117 - DNA, 16 bp, Homo sapiens
agcagctagctgcttt

SEQ ID NO: 5359118 - DNA, 20 bp, Homo sapiens
agcagctagctgcttttctg

SEQ ID NO: 5359119 - DNA, 14 bp, Homo sapiens
agcagctaggactg

SEQ ID NO: 5359120 - DNA, 17 bp, Homo sapiens
agcagctatctctcagt

SEQ ID NO: 5359121 - DNA, 19 bp, Homo sapiens
agcagctattttaagccat

SEQ ID NO: 5359122 - DNA, 14 bp, Homo sapiens
agcagctcaggcac

SEQ ID NO: 5359123 - DNA, 19 bp, Homo sapiens
agcagctcaggcgcagccc

SEQ ID NO: 5359124 - DNA, 21 bp, Homo sapiens
agcagctcaggcgcagcccta

SEQ ID NO: 5359125 - DNA, 21 bp, Homo sapiens
agcagctcatagaattttgag

SEQ ID NO: 5359126 - DNA, 23 bp, Homo sapiens
agcagctcatagaattttgagta

SEQ ID NO: 5359127 - DNA, 11 bp, Homo sapiens
agcagctccaa

SEQ ID NO: 5359128 - DNA, 14 bp, Homo sapiens
agcagctccaacct

SEQ ID NO: 5359129 - DNA, 16 bp, Homo sapiens
agcagctccaacctgg

SEQ ID NO: 5359130 - DNA, 17 bp, Homo sapiens
agcagctccaacctgga

SEQ ID NO: 5359131 - DNA, 18 bp, Homo sapiens
agcagctccaacctggag

SEQ ID NO: 5359132 - DNA, 16 bp, Homo sapiens
agcagctccaccactg

SEQ ID NO: 5359133 - DNA, 20 bp, Homo sapiens
agcagctccaccactgtgca

SEQ ID NO: 5359134 - DNA, 15 bp, Homo sapiens
agcagctccccagga

SEQ ID NO: 5359135 - DNA, 15 bp, Homo sapiens
agcagctccgcctgg

SEQ ID NO: 5359136 - DNA, 19 bp, Homo sapiens
agcagctccgcctggcacc

SEQ ID NO: 5359137 - DNA, 12 bp, Homo sapiens
agcagctctccc

SEQ ID NO: 5359138 - DNA, 23 bp, Homo sapiens
agcagctgaaatatgctggctgg

SEQ ID NO: 5359139 - DNA, 18 bp, Homo sapiens
agcagctgaacagccaaa

SEQ ID NO: 5359140 - DNA, 17 bp, Homo sapiens
agcagctgaagccagct

SEQ ID NO: 5359141 - DNA, 17 bp, Homo sapiens
agcagctgagcagggcc

SEQ ID NO: 5359142 - DNA, 19 bp, Homo sapiens
agcagctgagcagggccgg

SEQ ID NO: 5359143 - DNA, 22 bp, Homo sapiens
agcagctgattcagcagtgcct

SEQ ID NO: 5359144 - DNA, 13 bp, Homo sapiens
agcagctgcaccc

SEQ ID NO: 5359145 - DNA, 11 bp, Homo sapiens
agcagctgcta

SEQ ID NO: 5359146 - DNA, 10 bp, Homo sapiens
agcagctgga

SEQ ID NO: 5359147 - DNA, 18 bp, Homo sapiens
agcagctggactacccac

SEQ ID NO: 5359148 - DNA, 20 bp, Homo sapiens
agcagctggcactgacagcc

SEQ ID NO: 5359149 - DNA, 21 bp, Homo sapiens
agcagctggcactgacagcct

SEQ ID NO: 5359150 - DNA, 16 bp, Homo sapiens
agcagctgggcactgg

SEQ ID NO: 5359151 - DNA, 13 bp, Homo sapiens
agcagctgggccg

SEQ ID NO: 5359152 - DNA, 14 bp, Homo sapiens
agcagctgggccgg

SEQ ID NO: 5359153 - DNA, 18 bp, Homo sapiens
agcagctgggccggccag

SEQ ID NO: 5359154 - DNA, 13 bp, Homo sapiens
agcagctggtcaa

SEQ ID NO: 5359155 - DNA, 17 bp, Homo sapiens
agcagctggtcttttct

SEQ ID NO: 5359156 - DNA, 19 bp, Homo sapiens
agcagctggtgccccacct

SEQ ID NO: 5359157 - DNA, 20 bp, Homo sapiens
agcagctggtgccccacctg

SEQ ID NO: 5359158 - DNA, 22 bp, Homo sapiens
agcagctggtgccccacctgcc

SEQ ID NO: 5359159 - DNA, 15 bp, Homo sapiens
agcagctgtgctgca

SEQ ID NO: 5359160 - DNA, 24 bp, Homo sapiens
agcagctgttcaacaagagtaaat

SEQ ID NO: 5359161 - DNA, 22 bp, Homo sapiens
agcagcttataatgggctctcc

SEQ ID NO: 5359162 - DNA, 14 bp, Homo sapiens
agcagcttattgtt

SEQ ID NO: 5359163 - DNA, 16 bp, Homo sapiens
agcagcttcagttgtt

SEQ ID NO: 5359164 - DNA, 16 bp, Homo sapiens
agcagcttccttctgg

SEQ ID NO: 5359165 - DNA, 15 bp, Homo sapiens
agcagcttctccagg

SEQ ID NO: 5359166 - DNA, 22 bp, Homo sapiens
agcagcttctgtcctcttctgt

SEQ ID NO: 5359167 - DNA, 16 bp, Homo sapiens
agcagcttcttgggct

SEQ ID NO: 5359168 - DNA, 19 bp, Homo sapiens
agcagcttcttgggctgag

SEQ ID NO: 5359169 - DNA, 21 bp, Homo sapiens
agcagcttggctgagccccct

SEQ ID NO: 5359170 - DNA, 23 bp, Homo sapiens
agcagcttggctgagccccctct

SEQ ID NO: 5359171 - DNA, 14 bp, Homo sapiens
agcagcttggggag

SEQ ID NO: 5359172 - DNA, 21 bp, Homo sapiens
agcagctttagaatcccagcc

SEQ ID NO: 5359173 - DNA, 23 bp, Homo sapiens
agcagctttgggatcccaccctg

SEQ ID NO: 5359174 - DNA, 21 bp, Homo sapiens
agcagctttgtctctgtcaca

SEQ ID NO: 5359175 - DNA, 20 bp, Homo sapiens
agcagctttttattccctgc

SEQ ID NO: 5359176 - DNA, 21 bp, Homo sapiens
agcagcttttttttcccccct

SEQ ID NO: 5359177 - DNA, 14 bp, Homo sapiens
agcaggaacagaga

SEQ ID NO: 5359178 - DNA, 15 bp, Homo sapiens
agcaggaacagagac

SEQ ID NO: 5359179 - DNA, 19 bp, Homo sapiens
agcaggaacagagactctg

SEQ ID NO: 5359180 - DNA, 19 bp, Homo sapiens
agcaggaactgagccagaa

SEQ ID NO: 5359181 - DNA, 16 bp, Homo sapiens
agcaggaagcaaggcc

SEQ ID NO: 5359182 - DNA, 20 bp, Homo sapiens
agcaggaagcaaggccagcc

SEQ ID NO: 5359183 - DNA, 21 bp, Homo sapiens
agcaggaagccatagatgctg

SEQ ID NO: 5359184 - DNA, 12 bp, Homo sapiens
agcaggaagctc

SEQ ID NO: 5359185 - DNA, 19 bp, Homo sapiens
agcaggaaggatggcaagc

SEQ ID NO: 5359186 - DNA, 16 bp, Homo sapiens
agcaggaaggcctggg

SEQ ID NO: 5359187 - DNA, 11 bp, Homo sapiens
agcaggaaggg

SEQ ID NO: 5359188 - DNA, 12 bp, Homo sapiens
agcaggaataaa

SEQ ID NO: 5359189 - DNA, 14 bp, Homo sapiens
agcaggaattatgt

SEQ ID NO: 5359190 - DNA, 13 bp, Homo sapiens
agcaggacccagt

SEQ ID NO: 5359191 - DNA, 21 bp, Homo sapiens
agcaggacctactaggagagg

SEQ ID NO: 5359192 - DNA, 12 bp, Homo sapiens
agcaggacctgg

SEQ ID NO: 5359193 - DNA, 13 bp, Homo sapiens
agcaggacctggc

SEQ ID NO: 5359194 - DNA, 17 bp, Homo sapiens
agcaggacctggcatca

SEQ ID NO: 5359195 - DNA, 17 bp, Homo sapiens
agcaggacctgtgcttt

SEQ ID NO: 5359196 - DNA, 21 bp, Homo sapiens
agcaggacctgtgctttgaga

SEQ ID NO: 5359197 - DNA, 15 bp, Homo sapiens
agcaggactccaggc

SEQ ID NO: 5359198 - DNA, 16 bp, Homo sapiens
agcaggactcccacct

SEQ ID NO: 5359199 - DNA, 22 bp, Homo sapiens
agcaggactgatgtctcctaag

SEQ ID NO: 5359200 - DNA, 21 bp, Homo sapiens
agcaggacttgctaaagcact

SEQ ID NO: 5359201 - DNA, 12 bp, Homo sapiens
agcaggagacga

SEQ ID NO: 5359202 - DNA, 15 bp, Homo sapiens
agcaggagagaaatt

SEQ ID NO: 5359203 - DNA, 23 bp, Homo sapiens
agcaggagagaggctctggggca

SEQ ID NO: 5359204 - DNA, 16 bp, Homo sapiens
agcaggagcagctgtg

SEQ ID NO: 5359205 - DNA, 13 bp, Homo sapiens
agcaggagcccct

SEQ ID NO: 5359206 - DNA, 12 bp, Homo sapiens
agcaggaggaac

SEQ ID NO: 5359207 - DNA, 14 bp, Homo sapiens
agcaggaggcacag

SEQ ID NO: 5359208 - DNA, 17 bp, Homo sapiens
agcaggaggccaataaa

SEQ ID NO: 5359209 - DNA, 18 bp, Homo sapiens
agcaggaggccaataaaa

SEQ ID NO: 5359210 - DNA, 21 bp, Homo sapiens
agcaggaggccaataaaaagt

SEQ ID NO: 5359211 - DNA, 22 bp, Homo sapiens
agcaggaggccaataaaaagtt

SEQ ID NO: 5359212 - DNA, 14 bp, Homo sapiens
agcaggaggccagg

SEQ ID NO: 5359213 - DNA, 16 bp, Homo sapiens
agcaggaggcccctgg

SEQ ID NO: 5359214 - DNA, 12 bp, Homo sapiens
agcaggaggccg

SEQ ID NO: 5359215 - DNA, 16 bp, Homo sapiens
agcaggaggcctagga

SEQ ID NO: 5359216 - DNA, 20 bp, Homo sapiens
agcaggaggctttctgggct

SEQ ID NO: 5359217 - DNA, 22 bp, Homo sapiens
agcaggaggctttctgggctct

SEQ ID NO: 5359218 - DNA, 15 bp, Homo sapiens
agcaggagggaagga

SEQ ID NO: 5359219 - DNA, 18 bp, Homo sapiens
agcaggagggaaggacag

SEQ ID NO: 5359220 - DNA, 20 bp, Homo sapiens
agcaggagggactctgtctg

SEQ ID NO: 5359221 - DNA, 13 bp, Homo sapiens
agcaggaggtgcc

SEQ ID NO: 5359222 - DNA, 13 bp, Homo sapiens
agcaggagtggtg

SEQ ID NO: 5359223 - DNA, 18 bp, Homo sapiens
agcaggagtggtgcagac

SEQ ID NO: 5359224 - DNA, 21 bp, Homo sapiens
agcaggatagttgctccgcct

SEQ ID NO: 5359225 - DNA, 20 bp, Homo sapiens
agcaggatgaattttctgca

SEQ ID NO: 5359226 - DNA, 24 bp, Homo sapiens
agcaggatgaattttctgcagctg

SEQ ID NO: 5359227 - DNA, 14 bp, Homo sapiens
agcaggatgccctg

SEQ ID NO: 5359228 - DNA, 18 bp, Homo sapiens
agcaggatgggctgagct

SEQ ID NO: 5359229 - DNA, 15 bp, Homo sapiens
agcaggatgtgcctg

SEQ ID NO: 5359230 - DNA, 14 bp, Homo sapiens
agcaggcacaggac

SEQ ID NO: 5359231 - DNA, 16 bp, Homo sapiens
agcaggcacatggagg

SEQ ID NO: 5359232 - DNA, 20 bp, Homo sapiens
agcaggcacgggtggtcccc

SEQ ID NO: 5359233 - DNA, 15 bp, Homo sapiens
agcaggcagagcggg

SEQ ID NO: 5359234 - DNA, 17 bp, Homo sapiens
agcaggcagagcgggga

SEQ ID NO: 5359235 - DNA, 21 bp, Homo sapiens
agcaggcagagcggggaggtg

SEQ ID NO: 5359236 - DNA, 10 bp, Homo sapiens
agcaggcagc

SEQ ID NO: 5359237 - DNA, 15 bp, Homo sapiens
agcaggcagccagca

SEQ ID NO: 5359238 - DNA, 17 bp, Homo sapiens
agcaggcagccagcatc

SEQ ID NO: 5359239 - DNA, 19 bp, Homo sapiens
agcaggcagccagcatctg

SEQ ID NO: 5359240 - DNA, 16 bp, Homo sapiens
agcaggcagcgccaag

SEQ ID NO: 5359241 - DNA, 11 bp, Homo sapiens
agcaggcaggg

SEQ ID NO: 5359242 - DNA, 14 bp, Homo sapiens
agcaggcagggctg

SEQ ID NO: 5359243 - DNA, 18 bp, Homo sapiens
agcaggcagggctgggcc

SEQ ID NO: 5359244 - DNA, 13 bp, Homo sapiens
agcaggcaggtgg

SEQ ID NO: 5359245 - DNA, 17 bp, Homo sapiens
agcaggcagtggggctg

SEQ ID NO: 5359246 - DNA, 22 bp, Homo sapiens
agcaggcagtggggctggaagc

SEQ ID NO: 5359247 - DNA, 14 bp, Homo sapiens
agcaggcattgctt

SEQ ID NO: 5359248 - DNA, 18 bp, Homo sapiens
agcaggccaaggtctgag

SEQ ID NO: 5359249 - DNA, 18 bp, Homo sapiens
agcaggccacgctcaggc

SEQ ID NO: 5359250 - DNA, 16 bp, Homo sapiens
agcaggccactagtga

SEQ ID NO: 5359251 - DNA, 14 bp, Homo sapiens
agcaggccagagaa

SEQ ID NO: 5359252 - DNA, 18 bp, Homo sapiens
agcaggccaggtccagag

SEQ ID NO: 5359253 - DNA, 16 bp, Homo sapiens
agcaggcccaatgctg

SEQ ID NO: 5359254 - DNA, 13 bp, Homo sapiens
agcaggcccagct

SEQ ID NO: 5359255 - DNA, 15 bp, Homo sapiens
agcaggcccagctgg

SEQ ID NO: 5359256 - DNA, 16 bp, Homo sapiens
agcaggcccagctggg

SEQ ID NO: 5359257 - DNA, 13 bp, Homo sapiens
agcaggcccagga

SEQ ID NO: 5359258 - DNA, 15 bp, Homo sapiens
agcaggcccaggaga

SEQ ID NO: 5359259 - DNA, 20 bp, Homo sapiens
agcaggcccgacagagagat

SEQ ID NO: 5359260 - DNA, 16 bp, Homo sapiens
agcaggccctgggcct

SEQ ID NO: 5359261 - DNA, 21 bp, Homo sapiens
agcaggccctgggcctccacc

SEQ ID NO: 5359262 - DNA, 19 bp, Homo sapiens
agcaggccgccctcggact

SEQ ID NO: 5359263 - DNA, 14 bp, Homo sapiens
agcaggccggaacc

SEQ ID NO: 5359264 - DNA, 23 bp, Homo sapiens
agcaggccggaaccacagggcca

SEQ ID NO: 5359265 - DNA, 14 bp, Homo sapiens
agcaggcctccctg

SEQ ID NO: 5359266 - DNA, 16 bp, Homo sapiens
agcaggcctctgggac

SEQ ID NO: 5359267 - DNA, 18 bp, Homo sapiens
agcaggcctgttgctttt

SEQ ID NO: 5359268 - DNA, 12 bp, Homo sapiens
agcaggccttgc

SEQ ID NO: 5359269 - DNA, 21 bp, Homo sapiens
agcaggccttttgatattaaa

SEQ ID NO: 5359270 - DNA, 12 bp, Homo sapiens
agcaggcgggct

SEQ ID NO: 5359271 - DNA, 22 bp, Homo sapiens
agcaggcggggaggaggctgcc

SEQ ID NO: 5359272 - DNA, 19 bp, Homo sapiens
agcaggctcctcagccctc

SEQ ID NO: 5359273 - DNA, 21 bp, Homo sapiens
agcaggctcctcagccctctc

SEQ ID NO: 5359274 - DNA, 18 bp, Homo sapiens
agcaggctcctggctgtg

SEQ ID NO: 5359275 - DNA, 20 bp, Homo sapiens
agcaggctcctggctgtgcc

SEQ ID NO: 5359276 - DNA, 16 bp, Homo sapiens
agcaggctctcaggcc

SEQ ID NO: 5359277 - DNA, 19 bp, Homo sapiens
agcaggctctcaggccagc

SEQ ID NO: 5359278 - DNA, 21 bp, Homo sapiens
agcaggctctcaggccagctg

SEQ ID NO: 5359279 - DNA, 13 bp, Homo sapiens
agcaggctgccag

SEQ ID NO: 5359280 - DNA, 14 bp, Homo sapiens
agcaggctgccagt

SEQ ID NO: 5359281 - DNA, 18 bp, Homo sapiens
agcaggctgccagtgcct

SEQ ID NO: 5359282 - DNA, 14 bp, Homo sapiens
agcaggctggcagc

SEQ ID NO: 5359283 - DNA, 20 bp, Homo sapiens
agcagggaaaatatatatct

SEQ ID NO: 5359284 - DNA, 21 bp, Homo sapiens
agcagggaaaatgcagcaggg

SEQ ID NO: 5359285 - DNA, 19 bp, Homo sapiens
agcagggaaagctccacgg

SEQ ID NO: 5359286 - DNA, 17 bp, Homo sapiens
agcagggaaggctggtc

SEQ ID NO: 5359287 - DNA, 18 bp, Homo sapiens
agcagggaaggtgaagat

SEQ ID NO: 5359288 - DNA, 14 bp, Homo sapiens
agcagggacacccc

SEQ ID NO: 5359289 - DNA, 16 bp, Homo sapiens
agcagggaccgggcgc

SEQ ID NO: 5359290 - DNA, 23 bp, Homo sapiens
agcagggaccgggcgcagccctc

SEQ ID NO: 5359291 - DNA, 11 bp, Homo sapiens
agcagggagga

SEQ ID NO: 5359292 - DNA, 19 bp, Homo sapiens
agcagggagttagcactga

SEQ ID NO: 5359293 - DNA, 17 bp, Homo sapiens
agcagggatctgccccc

SEQ ID NO: 5359294 - DNA, 21 bp, Homo sapiens
agcatcagaggtttgcttcct

SEQ ID NO: 5359295 - DNA, 13 bp, Homo sapiens
agcatcagcaaga

SEQ ID NO: 5359296 - DNA, 21 bp, Homo sapiens
agcatcagcacagctctcctc

SEQ ID NO: 5359297 - DNA, 23 bp, Homo sapiens
agcatcagcacagctctcctcct

SEQ ID NO: 5359298 - DNA, 16 bp, Homo sapiens
agcatcagcgtggcag

SEQ ID NO: 5359299 - DNA, 14 bp, Homo sapiens
agcatcaggccagg

SEQ ID NO: 5359300 - DNA, 16 bp, Homo sapiens
agcatcaggccaggcc

SEQ ID NO: 5359301 - DNA, 17 bp, Homo sapiens
agcatcaggccaggccc

SEQ ID NO: 5359302 - DNA, 19 bp, Homo sapiens
agcatcaggccaggccctc

SEQ ID NO: 5359303 - DNA, 20 bp, Homo sapiens
agcatcaggccaggccctct

SEQ ID NO: 5359304 - DNA, 16 bp, Homo sapiens
agcatcaggcctagag

SEQ ID NO: 5359305 - DNA, 21 bp, Homo sapiens
agcatcaggcctagaggcctg

SEQ ID NO: 5359306 - DNA, 18 bp, Homo sapiens
agcatcagggggaagaag

SEQ ID NO: 5359307 - DNA, 13 bp, Homo sapiens
agcatcagtcccc

SEQ ID NO: 5359308 - DNA, 16 bp, Homo sapiens
agcatcatgcctctga

SEQ ID NO: 5359309 - DNA, 19 bp, Homo sapiens
agcatcattatttatgtat

SEQ ID NO: 5359310 - DNA, 21 bp, Homo sapiens
agcatcattatttgcagagac

SEQ ID NO: 5359311 - DNA, 14 bp, Homo sapiens
agcatcattcagca

SEQ ID NO: 5359312 - DNA, 13 bp, Homo sapiens
agcatcattgtaa

SEQ ID NO: 5359313 - DNA, 19 bp, Homo sapiens
agcatcattttgcattcaa

SEQ ID NO: 5359314 - DNA, 18 bp, Homo sapiens
agcatccaaaagcaggaa

SEQ ID NO: 5359315 - DNA, 21 bp, Homo sapiens
agcatccaaaagcaggaaccc

SEQ ID NO: 5359316 - DNA, 22 bp, Homo sapiens
agcatccaaggaacttcatgct

SEQ ID NO: 5359317 - DNA, 24 bp, Homo sapiens
agcatccaaggaacttcatgcttg

SEQ ID NO: 5359318 - DNA, 17 bp, Homo sapiens
agcatccacctccttct

SEQ ID NO: 5359319 - DNA, 17 bp, Homo sapiens
agcatccaccttggctc

SEQ ID NO: 5359320 - DNA, 17 bp, Homo sapiens
agcatccagacctgagc

SEQ ID NO: 5359321 - DNA, 12 bp, Homo sapiens
agcatccaggct

SEQ ID NO: 5359322 - DNA, 15 bp, Homo sapiens
agcatccaggctggc

SEQ ID NO: 5359323 - DNA, 17 bp, Homo sapiens
agcatccagtgtgagat

SEQ ID NO: 5359324 - DNA, 20 bp, Homo sapiens
agcatccagttggcttttta

SEQ ID NO: 5359325 - DNA, 12 bp, Homo sapiens
agcatcccagcc

SEQ ID NO: 5359326 - DNA, 13 bp, Homo sapiens
agcatcccagcct

SEQ ID NO: 5359327 - DNA, 14 bp, Homo sapiens
agcatcccagcctc

SEQ ID NO: 5359328 - DNA, 19 bp, Homo sapiens
agcatcccatctcagaaga

SEQ ID NO: 5359329 - DNA, 12 bp, Homo sapiens
agcatcccccaa

SEQ ID NO: 5359330 - DNA, 14 bp, Homo sapiens
agcatccccctcct

SEQ ID NO: 5359331 - DNA, 19 bp, Homo sapiens
agcatccccctcctctccc

SEQ ID NO: 5359332 - DNA, 18 bp, Homo sapiens
agcatccccttgaactct

SEQ ID NO: 5359333 - DNA, 19 bp, Homo sapiens
agcatcccggaggaaatct

SEQ ID NO: 5359334 - DNA, 20 bp, Homo sapiens
agcatccctaattcttcata

SEQ ID NO: 5359335 - DNA, 21 bp, Homo sapiens
agcatccctaattcttcatag

SEQ ID NO: 5359336 - DNA, 14 bp, Homo sapiens
agcatcccttccca

SEQ ID NO: 5359337 - DNA, 20 bp, Homo sapiens
agcatccggcatgagggctg

SEQ ID NO: 5359338 - DNA, 17 bp, Homo sapiens
agcatccgtctcccctc

SEQ ID NO: 5359339 - DNA, 23 bp, Homo sapiens
agcatccgtgtatttggctgggc

SEQ ID NO: 5359340 - DNA, 17 bp, Homo sapiens
agcatcctaagaaatat

SEQ ID NO: 5359341 - DNA, 19 bp, Homo sapiens
agcatcctaagaaatatgt

SEQ ID NO: 5359342 - DNA, 16 bp, Homo sapiens
agcatcctccaaaact

SEQ ID NO: 5359343 - DNA, 13 bp, Homo sapiens
agcatcctccaca

SEQ ID NO: 5359344 - DNA, 16 bp, Homo sapiens
agcatcctccacatcc

SEQ ID NO: 5359345 - DNA, 19 bp, Homo sapiens
agcatcctccccaccagag

SEQ ID NO: 5359346 - DNA, 23 bp, Homo sapiens
agcatcctccccaccagagctgc

SEQ ID NO: 5359347 - DNA, 16 bp, Homo sapiens
agcatcctcctcctgg

SEQ ID NO: 5359348 - DNA, 16 bp, Homo sapiens
agcatcctgagccccg

SEQ ID NO: 5359349 - DNA, 23 bp, Homo sapiens
agcatcctgagccccgccctctt

SEQ ID NO: 5359350 - DNA, 21 bp, Homo sapiens
agcatcctgattattgaatgt

SEQ ID NO: 5359351 - DNA, 22 bp, Homo sapiens
agcatcctgcaaggtgaaacga

SEQ ID NO: 5359352 - DNA, 19 bp, Homo sapiens
agcatcctgcttcctaggc

SEQ ID NO: 5359353 - DNA, 14 bp, Homo sapiens
agcatcctggaaat

SEQ ID NO: 5359354 - DNA, 15 bp, Homo sapiens
agcatcctggaaatt

SEQ ID NO: 5359355 - DNA, 23 bp, Homo sapiens
agcatcctggaaatttgtgtgct

SEQ ID NO: 5359356 - DNA, 13 bp, Homo sapiens
agcatcctggaat

SEQ ID NO: 5359357 - DNA, 21 bp, Homo sapiens
agcatccttttctgcagaggg

SEQ ID NO: 5359358 - DNA, 23 bp, Homo sapiens
agcatcggacaagacccccagca

SEQ ID NO: 5359359 - DNA, 14 bp, Homo sapiens
agcatcggcctagg

SEQ ID NO: 5359360 - DNA, 19 bp, Homo sapiens
agcatcggcctagggcccc

SEQ ID NO: 5359361 - DNA, 18 bp, Homo sapiens
agcatcgggagcacccag

SEQ ID NO: 5359362 - DNA, 15 bp, Homo sapiens
agcatcgggggcctg

SEQ ID NO: 5359363 - DNA, 20 bp, Homo sapiens
agcatcgtctcatgtaaaat

SEQ ID NO: 5359364 - DNA, 19 bp, Homo sapiens
agcatcgtgacccttcagg

SEQ ID NO: 5359365 - DNA, 18 bp, Homo sapiens
agcatcgtgtgggtccct

SEQ ID NO: 5359366 - DNA, 22 bp, Homo sapiens
agcatctaaactttaatatgta

SEQ ID NO: 5359367 - DNA, 12 bp, Homo sapiens
agcatctaagtt

SEQ ID NO: 5359368 - DNA, 20 bp, Homo sapiens
agcatctaagttataagact

SEQ ID NO: 5359369 - DNA, 18 bp, Homo sapiens
agcatctagtttccctgg

SEQ ID NO: 5359370 - DNA, 22 bp, Homo sapiens
agcatctagtttccctggtgcc

SEQ ID NO: 5359371 - DNA, 16 bp, Homo sapiens
agcatctcaaatgttt

SEQ ID NO: 5359372 - DNA, 19 bp, Homo sapiens
agcatctcaaatgttttct

SEQ ID NO: 5359373 - DNA, 17 bp, Homo sapiens
agcatctccaagcagct

SEQ ID NO: 5359374 - DNA, 13 bp, Homo sapiens
agcatctcccagt

SEQ ID NO: 5359375 - DNA, 17 bp, Homo sapiens
agcatctctaccttctc

SEQ ID NO: 5359376 - DNA, 19 bp, Homo sapiens
agcatctctaccttctccc

SEQ ID NO: 5359377 - DNA, 22 bp, Homo sapiens
agcatctctaccttctccccag

SEQ ID NO: 5359378 - DNA, 12 bp, Homo sapiens
agcatctctgtg

SEQ ID NO: 5359379 - DNA, 15 bp, Homo sapiens
agcatctctgtgtac

SEQ ID NO: 5359380 - DNA, 20 bp, Homo sapiens
agcatctctgtgtacccact

SEQ ID NO: 5359381 - DNA, 22 bp, Homo sapiens
agcatctcttcttccctgtcag

SEQ ID NO: 5359382 - DNA, 14 bp, Homo sapiens
agcatctgaccatc

SEQ ID NO: 5359383 - DNA, 21 bp, Homo sapiens
agcatctgaccatctgtgact

SEQ ID NO: 5359384 - DNA, 22 bp, Homo sapiens
agcatctgagaaggccctgtgc

SEQ ID NO: 5359385 - DNA, 21 bp, Homo sapiens
agcatctgccacaaaaatgtt

SEQ ID NO: 5359386 - DNA, 14 bp, Homo sapiens
agcatctgccccag

SEQ ID NO: 5359387 - DNA, 16 bp, Homo sapiens
agcatctgccccaggt

SEQ ID NO: 5359388 - DNA, 14 bp, Homo sapiens
agcatctgctctga

SEQ ID NO: 5359389 - DNA, 13 bp, Homo sapiens
agcatctgctctt

SEQ ID NO: 5359390 - DNA, 17 bp, Homo sapiens
agcatctggaagagcta

SEQ ID NO: 5359391 - DNA, 19 bp, Homo sapiens
agcatctggctaaggcatc

SEQ ID NO: 5359392 - DNA, 12 bp, Homo sapiens
agcatctggctg

SEQ ID NO: 5359393 - DNA, 20 bp, Homo sapiens
agcatctggctgtctagaat

SEQ ID NO: 5359394 - DNA, 22 bp, Homo sapiens
agcatctggctgtctagaatgt

SEQ ID NO: 5359395 - DNA, 13 bp, Homo sapiens
agcatctgggcct

SEQ ID NO: 5359396 - DNA, 23 bp, Homo sapiens
agcatctgggccttggcctggag

SEQ ID NO: 5359397 - DNA, 13 bp, Homo sapiens
agcatctgtacaa

SEQ ID NO: 5359398 - DNA, 13 bp, Homo sapiens
agcatctgtccca

SEQ ID NO: 5359399 - DNA, 19 bp, Homo sapiens
agcatctgtcccactggga

SEQ ID NO: 5359400 - DNA, 15 bp, Homo sapiens
agcatctgtccccct

SEQ ID NO: 5359401 - DNA, 20 bp, Homo sapiens
agcatcttcacttctaaatg

SEQ ID NO: 5359402 - DNA, 23 bp, Homo sapiens
agcatcttcacttctaaatgcat

SEQ ID NO: 5359403 - DNA, 13 bp, Homo sapiens
agcatcttcctct

SEQ ID NO: 5359404 - DNA, 22 bp, Homo sapiens
agcatcttgccagcctcaggct

SEQ ID NO: 5359405 - DNA, 13 bp, Homo sapiens
agcatctttcata

SEQ ID NO: 5359406 - DNA, 14 bp, Homo sapiens
agcatctttcatat

SEQ ID NO: 5359407 - DNA, 21 bp, Homo sapiens
agcatctttgaatacaaagaa

SEQ ID NO: 5359408 - DNA, 15 bp, Homo sapiens
agcatctttgccctt

SEQ ID NO: 5359409 - DNA, 23 bp, Homo sapiens
agcatcttttccatcctgaggtg

SEQ ID NO: 5359410 - DNA, 13 bp, Homo sapiens
agcatgaaaaagc

SEQ ID NO: 5359411 - DNA, 14 bp, Homo sapiens
agcatgaaaaagca

SEQ ID NO: 5359412 - DNA, 21 bp, Homo sapiens
agcatgaaaggcttttaaatt

SEQ ID NO: 5359413 - DNA, 14 bp, Homo sapiens
agcatgaaatgtga

SEQ ID NO: 5359414 - DNA, 17 bp, Homo sapiens
agcatgaacgccaagga

SEQ ID NO: 5359415 - DNA, 20 bp, Homo sapiens
agcatgaacgtggattgtat

SEQ ID NO: 5359416 - DNA, 22 bp, Homo sapiens
agcatgaacgtggattgtattt

SEQ ID NO: 5359417 - DNA, 23 bp, Homo sapiens
agcatgaataaaacactcatccc

SEQ ID NO: 5359418 - DNA, 16 bp, Homo sapiens
agcatgaatatttctt

SEQ ID NO: 5359419 - DNA, 14 bp, Homo sapiens
agcatgaattggaa

SEQ ID NO: 5359420 - DNA, 16 bp, Homo sapiens
agcatgaatttgtaat

SEQ ID NO: 5359421 - DNA, 20 bp, Homo sapiens
agcatgaatttttttcatct

SEQ ID NO: 5359422 - DNA, 13 bp, Homo sapiens
agcatgacaaaaa

SEQ ID NO: 5359423 - DNA, 14 bp, Homo sapiens
agcatgacaaaaat

SEQ ID NO: 5359424 - DNA, 21 bp, Homo sapiens
agcatgacaaaaattattttt

SEQ ID NO: 5359425 - DNA, 19 bp, Homo sapiens
agcatgacaaaagtgacag

SEQ ID NO: 5359426 - DNA, 20 bp, Homo sapiens
agcatgacaacttttaaaga

SEQ ID NO: 5359427 - DNA, 20 bp, Homo sapiens
agcatgacaagccccaggca

SEQ ID NO: 5359428 - DNA, 14 bp, Homo sapiens
agcatgacagcctg

SEQ ID NO: 5359429 - DNA, 14 bp, Homo sapiens
agcatgacatttct

SEQ ID NO: 5359430 - DNA, 15 bp, Homo sapiens
agcatgacatttctt

SEQ ID NO: 5359431 - DNA, 23 bp, Homo sapiens
agcatgacctgtgaccagcactg

SEQ ID NO: 5359432 - DNA, 14 bp, Homo sapiens
agcatgaccttttg

SEQ ID NO: 5359433 - DNA, 22 bp, Homo sapiens
agcatgaccttttggcctttgt

SEQ ID NO: 5359434 - DNA, 20 bp, Homo sapiens
agcatgactttagatgggaa

SEQ ID NO: 5359435 - DNA, 17 bp, Homo sapiens
agcatgagacatcatgg

SEQ ID NO: 5359436 - DNA, 15 bp, Homo sapiens
agcatgagactttct

SEQ ID NO: 5359437 - DNA, 16 bp, Homo sapiens
agcatgagactttctg

SEQ ID NO: 5359438 - DNA, 17 bp, Homo sapiens
agcatgagaggaggcag

SEQ ID NO: 5359439 - DNA, 20 bp, Homo sapiens
agcatgagagggatgaggca

SEQ ID NO: 5359440 - DNA, 20 bp, Homo sapiens
agcatgaggtgttgtgcatt

SEQ ID NO: 5359441 - DNA, 14 bp, Homo sapiens
agcatgagttctgc

SEQ ID NO: 5359442 - DNA, 19 bp, Homo sapiens
agcatgagttctgcacata

SEQ ID NO: 5359443 - DNA, 22 bp, Homo sapiens
agcatgataccaggcccaggag

SEQ ID NO: 5359444 - DNA, 18 bp, Homo sapiens
agcatgatcttgttaatg

SEQ ID NO: 5359445 - DNA, 20 bp, Homo sapiens
agcatgatcttgttaatgca

SEQ ID NO: 5359446 - DNA, 20 bp, Homo sapiens
agcatgatcttgttactgtg

SEQ ID NO: 5359447 - DNA, 17 bp, Homo sapiens
agcatgatgggaaaata

SEQ ID NO: 5359448 - DNA, 20 bp, Homo sapiens
agcatgatttatactcattt

SEQ ID NO: 5359449 - DNA, 18 bp, Homo sapiens
agcatgattttaagaggc

SEQ ID NO: 5359450 - DNA, 12 bp, Homo sapiens
agcatgcaagct

SEQ ID NO: 5359451 - DNA, 13 bp, Homo sapiens
agcatgcacaaag

SEQ ID NO: 5359452 - DNA, 19 bp, Homo sapiens
agcatgcacaaagtgtatt

SEQ ID NO: 5359453 - DNA, 18 bp, Homo sapiens
agcatgcacactgagaat

SEQ ID NO: 5359454 - DNA, 13 bp, Homo sapiens
agcatgcacatgc

SEQ ID NO: 5359455 - DNA, 23 bp, Homo sapiens
agcatgcagcgaattcagaaaga

SEQ ID NO: 5359456 - DNA, 14 bp, Homo sapiens
agcatgcataaatc

SEQ ID NO: 5359457 - DNA, 16 bp, Homo sapiens
agcatgcataaatcaa

SEQ ID NO: 5359458 - DNA, 15 bp, Homo sapiens
agcatgcatctgttt

SEQ ID NO: 5359459 - DNA, 20 bp, Homo sapiens
agcatgcatttagcatgagt

SEQ ID NO: 5359460 - DNA, 23 bp, Homo sapiens
agcatgcatttagcatgagttct

SEQ ID NO: 5359461 - DNA, 13 bp, Homo sapiens
agcatgcattttc

SEQ ID NO: 5359462 - DNA, 14 bp, Homo sapiens
agcatgcattttct

SEQ ID NO: 5359463 - DNA, 17 bp, Homo sapiens
agcatgccaacaagaat

SEQ ID NO: 5359464 - DNA, 17 bp, Homo sapiens
agcatgccaatttctct

SEQ ID NO: 5359465 - DNA, 19 bp, Homo sapiens
agcatgcccaaatataaca

SEQ ID NO: 5359466 - DNA, 15 bp, Homo sapiens
agcatgccccaccca

SEQ ID NO: 5359467 - DNA, 16 bp, Homo sapiens
agcatgccccttggct

SEQ ID NO: 5359468 - DNA, 18 bp, Homo sapiens
agcatgccctgagctctc

SEQ ID NO: 5359469 - DNA, 20 bp, Homo sapiens
agcatgcctgtcctttcagt

SEQ ID NO: 5359470 - DNA, 15 bp, Homo sapiens
agcatgccttcaaat

SEQ ID NO: 5359471 - DNA, 17 bp, Homo sapiens
agccaagaagtgaggcc

SEQ ID NO: 5359472 - DNA, 19 bp, Homo sapiens
agccaagacagtggcagca

SEQ ID NO: 5359473 - DNA, 19 bp, Homo sapiens
agccaagagcgcaccattg

SEQ ID NO: 5359474 - DNA, 14 bp, Homo sapiens
agccaagagctctt

SEQ ID NO: 5359475 - DNA, 15 bp, Homo sapiens
agccaagagctcttc

SEQ ID NO: 5359476 - DNA, 22 bp, Homo sapiens
agccaagatcgcaccactgcac

SEQ ID NO: 5359477 - DNA, 19 bp, Homo sapiens
agccaagatcgcgccactg

SEQ ID NO: 5359478 - DNA, 20 bp, Homo sapiens
agccaagattgcgccactgc

SEQ ID NO: 5359479 - DNA, 22 bp, Homo sapiens
agccaagattttcctcttgtga

SEQ ID NO: 5359480 - DNA, 16 bp, Homo sapiens
agccaagcacagtggt

SEQ ID NO: 5359481 - DNA, 18 bp, Homo sapiens
agccaagcacagtggtgg

SEQ ID NO: 5359482 - DNA, 13 bp, Homo sapiens
agccaagcactgc

SEQ ID NO: 5359483 - DNA, 14 bp, Homo sapiens
agccaagcactgct

SEQ ID NO: 5359484 - DNA, 16 bp, Homo sapiens
agccaagcactgctca

SEQ ID NO: 5359485 - DNA, 15 bp, Homo sapiens
agccaagcctgactt

SEQ ID NO: 5359486 - DNA, 22 bp, Homo sapiens
agccaagcctggagtaggcctg

SEQ ID NO: 5359487 - DNA, 17 bp, Homo sapiens
agccaagccttaaactg

SEQ ID NO: 5359488 - DNA, 21 bp, Homo sapiens
agccaagccttaaactgtaca

SEQ ID NO: 5359489 - DNA, 17 bp, Homo sapiens
agccaagctccttggga

SEQ ID NO: 5359490 - DNA, 13 bp, Homo sapiens
agccaagctgcac

SEQ ID NO: 5359491 - DNA, 18 bp, Homo sapiens
agccaagctgcacaattt

SEQ ID NO: 5359492 - DNA, 16 bp, Homo sapiens
agccaagctggcacaa

SEQ ID NO: 5359493 - DNA, 21 bp, Homo sapiens
agccaagctggcacaaaagac

SEQ ID NO: 5359494 - DNA, 13 bp, Homo sapiens
agccaagctgggg

SEQ ID NO: 5359495 - DNA, 15 bp, Homo sapiens
agccaagctggggca

SEQ ID NO: 5359496 - DNA, 16 bp, Homo sapiens
agccaagctgtgttca

SEQ ID NO: 5359497 - DNA, 21 bp, Homo sapiens
agccaagcttcaaccctcagc

SEQ ID NO: 5359498 - DNA, 12 bp, Homo sapiens
agccaaggaggc

SEQ ID NO: 5359499 - DNA, 19 bp, Homo sapiens
agccaaggaggcctgggga

SEQ ID NO: 5359500 - DNA, 20 bp, Homo sapiens
agccaaggagtcactgagac

SEQ ID NO: 5359501 - DNA, 22 bp, Homo sapiens
agccaaggatagaagctgcagt

SEQ ID NO: 5359502 - DNA, 19 bp, Homo sapiens
agccaaggcagaggggagc

SEQ ID NO: 5359503 - DNA, 21 bp, Homo sapiens
agccaaggctctgtttatgct

SEQ ID NO: 5359504 - DNA, 16 bp, Homo sapiens
agccaagggaaagggg

SEQ ID NO: 5359505 - DNA, 20 bp, Homo sapiens
agccaagggacacaggagac

SEQ ID NO: 5359506 - DNA, 16 bp, Homo sapiens
agccaagggagggaag

SEQ ID NO: 5359507 - DNA, 23 bp, Homo sapiens
agccaagggagggaagggccacc

SEQ ID NO: 5359508 - DNA, 16 bp, Homo sapiens
agccaagggcctcggg

SEQ ID NO: 5359509 - DNA, 15 bp, Homo sapiens
agccaagggcctctt

SEQ ID NO: 5359510 - DNA, 19 bp, Homo sapiens
agccaagggctaggctctt

SEQ ID NO: 5359511 - DNA, 23 bp, Homo sapiens
agccaaggggctgcgctagcagc

SEQ ID NO: 5359512 - DNA, 16 bp, Homo sapiens
agccaaggggcttcag

SEQ ID NO: 5359513 - DNA, 19 bp, Homo sapiens
agccaaggggtctgctcct

SEQ ID NO: 5359514 - DNA, 21 bp, Homo sapiens
agccaaggggtctgctcctgt

SEQ ID NO: 5359515 - DNA, 18 bp, Homo sapiens
agccaagggttcagagac

SEQ ID NO: 5359516 - DNA, 19 bp, Homo sapiens
agccaaggtgctaaaagga

SEQ ID NO: 5359517 - DNA, 19 bp, Homo sapiens
agccaaggtgggctgagcc

SEQ ID NO: 5359518 - DNA, 22 bp, Homo sapiens
agccaaggtgggctgagccctg

SEQ ID NO: 5359519 - DNA, 18 bp, Homo sapiens
agccaaggtgtcatttat

SEQ ID NO: 5359520 - DNA, 19 bp, Homo sapiens
agccaagtagctttgggca

SEQ ID NO: 5359521 - DNA, 13 bp, Homo sapiens
agccaagtcatgg

SEQ ID NO: 5359522 - DNA, 18 bp, Homo sapiens
agccaagtgccaaatgct

SEQ ID NO: 5359523 - DNA, 14 bp, Homo sapiens
agccaagtgccttc

SEQ ID NO: 5359524 - DNA, 15 bp, Homo sapiens
agccaagtgccttcc

SEQ ID NO: 5359525 - DNA, 13 bp, Homo sapiens
agccaagtggggt

SEQ ID NO: 5359526 - DNA, 16 bp, Homo sapiens
agccaagtggggtgct

SEQ ID NO: 5359527 - DNA, 20 bp, Homo sapiens
agccaagtggggtgctggga

SEQ ID NO: 5359528 - DNA, 19 bp, Homo sapiens
agccaagtgtcttttaaac

SEQ ID NO: 5359529 - DNA, 23 bp, Homo sapiens
agccaagttatattgaatatatc

SEQ ID NO: 5359530 - DNA, 16 bp, Homo sapiens
agccaagttcaaagaa

SEQ ID NO: 5359531 - DNA, 16 bp, Homo sapiens
agccaagttttaaata

SEQ ID NO: 5359532 - DNA, 15 bp, Homo sapiens
agccaagttttataa

SEQ ID NO: 5359533 - DNA, 19 bp, Homo sapiens
agccaataaataatattat

SEQ ID NO: 5359534 - DNA, 20 bp, Homo sapiens
agccaatactgagtgcctgc

SEQ ID NO: 5359535 - DNA, 14 bp, Homo sapiens
agccaatatttttc

SEQ ID NO: 5359536 - DNA, 20 bp, Homo sapiens
agccaatcccctccttgggc

SEQ ID NO: 5359537 - DNA, 23 bp, Homo sapiens
agccaatccctcaccttctgagt

SEQ ID NO: 5359538 - DNA, 21 bp, Homo sapiens
agccaatctggacacttcttt

SEQ ID NO: 5359539 - DNA, 22 bp, Homo sapiens
agccaatctggacacttcttta

SEQ ID NO: 5359540 - DNA, 13 bp, Homo sapiens
agccaatgcttac

SEQ ID NO: 5359541 - DNA, 19 bp, Homo sapiens
agccaatggcccggcccct

SEQ ID NO: 5359542 - DNA, 16 bp, Homo sapiens
agccaatgtctcctcc

SEQ ID NO: 5359543 - DNA, 14 bp, Homo sapiens
agccaattagactt

SEQ ID NO: 5359544 - DNA, 16 bp, Homo sapiens
agccaattcagacagg

SEQ ID NO: 5359545 - DNA, 15 bp, Homo sapiens
agccaatttcccgga

SEQ ID NO: 5359546 - DNA, 15 bp, Homo sapiens
agccaatttttctgc

SEQ ID NO: 5359547 - DNA, 23 bp, Homo sapiens
agccaatttttctgcactgagca

SEQ ID NO: 5359548 - DNA, 21 bp, Homo sapiens
agccacaaagccccccagctc

SEQ ID NO: 5359549 - DNA, 22 bp, Homo sapiens
agccacaaagccccccagctcc

SEQ ID NO: 5359550 - DNA, 23 bp, Homo sapiens
agccacaaagccccccagctccc

SEQ ID NO: 5359551 - DNA, 18 bp, Homo sapiens
agccacaagtcttccaga

SEQ ID NO: 5359552 - DNA, 17 bp, Homo sapiens
agccacacaaacgttta

SEQ ID NO: 5359553 - DNA, 22 bp, Homo sapiens
agccacacaagggtcctttctc

SEQ ID NO: 5359554 - DNA, 10 bp, Homo sapiens
agccacacac

SEQ ID NO: 5359555 - DNA, 16 bp, Homo sapiens
agccacacacacagaa

SEQ ID NO: 5359556 - DNA, 18 bp, Homo sapiens
agccacacacacagaaaa

SEQ ID NO: 5359557 - DNA, 19 bp, Homo sapiens
agccacacacacagaaaat

SEQ ID NO: 5359558 - DNA, 13 bp, Homo sapiens
agccacacagagc

SEQ ID NO: 5359559 - DNA, 14 bp, Homo sapiens
agccacacagagcc

SEQ ID NO: 5359560 - DNA, 15 bp, Homo sapiens
agccacacagagcct

SEQ ID NO: 5359561 - DNA, 14 bp, Homo sapiens
agccacacagccca

SEQ ID NO: 5359562 - DNA, 15 bp, Homo sapiens
agccacacccaggca

SEQ ID NO: 5359563 - DNA, 16 bp, Homo sapiens
agccacacggagaggc

SEQ ID NO: 5359564 - DNA, 20 bp, Homo sapiens
agccacacggagaggccact

SEQ ID NO: 5359565 - DNA, 21 bp, Homo sapiens
agccacactctgggctccaga

SEQ ID NO: 5359566 - DNA, 15 bp, Homo sapiens
agccacactgaaccc

SEQ ID NO: 5359567 - DNA, 12 bp, Homo sapiens
agccacactggg

SEQ ID NO: 5359568 - DNA, 17 bp, Homo sapiens
agccacacttctcagga

SEQ ID NO: 5359569 - DNA, 17 bp, Homo sapiens
agccacagaagccagga

SEQ ID NO: 5359570 - DNA, 20 bp, Homo sapiens
agccacagaagccaggagca

SEQ ID NO: 5359571 - DNA, 17 bp, Homo sapiens
agccacagaccacctgc

SEQ ID NO: 5359572 - DNA, 18 bp, Homo sapiens
agccacagaccacctgct

SEQ ID NO: 5359573 - DNA, 15 bp, Homo sapiens
agccacagacccctg

SEQ ID NO: 5359574 - DNA, 13 bp, Homo sapiens
agccacagcactc

SEQ ID NO: 5359575 - DNA, 12 bp, Homo sapiens
agccacagcaga

SEQ ID NO: 5359576 - DNA, 12 bp, Homo sapiens
agccacagccca

SEQ ID NO: 5359577 - DNA, 18 bp, Homo sapiens
agccacagcccaggcctc

SEQ ID NO: 5359578 - DNA, 13 bp, Homo sapiens
agccacagcctgt

SEQ ID NO: 5359579 - DNA, 19 bp, Homo sapiens
agccacagctgctgttctc

SEQ ID NO: 5359580 - DNA, 23 bp, Homo sapiens
agccacagctgctgttctcagga

SEQ ID NO: 5359581 - DNA, 19 bp, Homo sapiens
agccacaggaacggccctg

SEQ ID NO: 5359582 - DNA, 20 bp, Homo sapiens
agccacaggaacggccctgc

SEQ ID NO: 5359583 - DNA, 12 bp, Homo sapiens
agccacaggacc

SEQ ID NO: 5359584 - DNA, 15 bp, Homo sapiens
agccacaggaccacc

SEQ ID NO: 5359585 - DNA, 24 bp, Homo sapiens
agccacaggactgagccctctcac

SEQ ID NO: 5359586 - DNA, 21 bp, Homo sapiens
agccacaggccccttttgtgg

SEQ ID NO: 5359587 - DNA, 22 bp, Homo sapiens
agccacaggcctgagatttcat

SEQ ID NO: 5359588 - DNA, 14 bp, Homo sapiens
agccacaggcctgg

SEQ ID NO: 5359589 - DNA, 14 bp, Homo sapiens
agccacagggtgag

SEQ ID NO: 5359590 - DNA, 16 bp, Homo sapiens
agccacagggtgagca

SEQ ID NO: 5359591 - DNA, 22 bp, Homo sapiens
agccacagggtgagcactctgg

SEQ ID NO: 5359592 - DNA, 14 bp, Homo sapiens
agccacagtggggc

SEQ ID NO: 5359593 - DNA, 17 bp, Homo sapiens
agccacatattgagatg

SEQ ID NO: 5359594 - DNA, 23 bp, Homo sapiens
agccacatcatctttatctcctg

SEQ ID NO: 5359595 - DNA, 23 bp, Homo sapiens
agccacatccctttgaaacaaga

SEQ ID NO: 5359596 - DNA, 19 bp, Homo sapiens
agccacatgccccaggctc

SEQ ID NO: 5359597 - DNA, 23 bp, Homo sapiens
agccacatgggaggaaggcccag

SEQ ID NO: 5359598 - DNA, 21 bp, Homo sapiens
agccacatgtacactacattt

SEQ ID NO: 5359599 - DNA, 14 bp, Homo sapiens
agccacattatttc

SEQ ID NO: 5359600 - DNA, 18 bp, Homo sapiens
agccacattcctgatgct

SEQ ID NO: 5359601 - DNA, 21 bp, Homo sapiens
agccacatttggaatactttt

SEQ ID NO: 5359602 - DNA, 22 bp, Homo sapiens
agccacatttggaatacttttt

SEQ ID NO: 5359603 - DNA, 16 bp, Homo sapiens
agccaccaaggctgcc

SEQ ID NO: 5359604 - DNA, 18 bp, Homo sapiens
agccaccaaggctgcctg

SEQ ID NO: 5359605 - DNA, 19 bp, Homo sapiens
agccaccaaggctgcctgc

SEQ ID NO: 5359606 - DNA, 17 bp, Homo sapiens
agccaccacacctggct

SEQ ID NO: 5359607 - DNA, 19 bp, Homo sapiens
agccaccaccctcaggtgc

SEQ ID NO: 5359608 - DNA, 11 bp, Homo sapiens
agccaccaccg

SEQ ID NO: 5359609 - DNA, 14 bp, Homo sapiens
agccaccacctgga

SEQ ID NO: 5359610 - DNA, 16 bp, Homo sapiens
agccaccacctggatg

SEQ ID NO: 5359611 - DNA, 17 bp, Homo sapiens
agccaccacgtccagct

SEQ ID NO: 5359612 - DNA, 19 bp, Homo sapiens
agccaccactcctgcctgc

SEQ ID NO: 5359613 - DNA, 22 bp, Homo sapiens
agccaccagacttggcctccag

SEQ ID NO: 5359614 - DNA, 14 bp, Homo sapiens
agccaccagatgtg

SEQ ID NO: 5359615 - DNA, 14 bp, Homo sapiens
agccaccagtggac

SEQ ID NO: 5359616 - DNA, 21 bp, Homo sapiens
agccaccagtggacctagcct

SEQ ID NO: 5359617 - DNA, 23 bp, Homo sapiens
agccaccagtggacctagcctgg

SEQ ID NO: 5359618 - DNA, 20 bp, Homo sapiens
agccaccagtgtcctccaag

SEQ ID NO: 5359619 - DNA, 14 bp, Homo sapiens
agccaccagttctc

SEQ ID NO: 5359620 - DNA, 13 bp, Homo sapiens
agccaccatcttt

SEQ ID NO: 5359621 - DNA, 19 bp, Homo sapiens
agccaccatgtatgtggaa

SEQ ID NO: 5359622 - DNA, 14 bp, Homo sapiens
agccacccaaagca

SEQ ID NO: 5359623 - DNA, 14 bp, Homo sapiens
agccacccaagcct

SEQ ID NO: 5359624 - DNA, 18 bp, Homo sapiens
agccacccaagcctgctg

SEQ ID NO: 5359625 - DNA, 21 bp, Homo sapiens
agccacccaagcctgctggct

SEQ ID NO: 5359626 - DNA, 22 bp, Homo sapiens
agccaccccatgagctcggggt

SEQ ID NO: 5359627 - DNA, 15 bp, Homo sapiens
agccacccccaggca

SEQ ID NO: 5359628 - DNA, 23 bp, Homo sapiens
agccacccctcctctagctctgg

SEQ ID NO: 5359629 - DNA, 18 bp, Homo sapiens
agccacccggatctccag

SEQ ID NO: 5359630 - DNA, 24 bp, Homo sapiens
agccacccggatctccaggcccag

SEQ ID NO: 5359631 - DNA, 20 bp, Homo sapiens
agccaccctaactgagctgc

SEQ ID NO: 5359632 - DNA, 14 bp, Homo sapiens
agccaccctcccag

SEQ ID NO: 5359633 - DNA, 18 bp, Homo sapiens
agccaccctcccagctct

SEQ ID NO: 5359634 - DNA, 14 bp, Homo sapiens
agccaccctgagga

SEQ ID NO: 5359635 - DNA, 19 bp, Homo sapiens
agccaccctgaggagtctg

SEQ ID NO: 5359636 - DNA, 15 bp, Homo sapiens
agccaccctgcccag

SEQ ID NO: 5359637 - DNA, 14 bp, Homo sapiens
agccacccttccct

SEQ ID NO: 5359638 - DNA, 17 bp, Homo sapiens
agccacccttccctgcc

SEQ ID NO: 5359639 - DNA, 18 bp, Homo sapiens
agccaccctttctggcac

SEQ ID NO: 5359640 - DNA, 19 bp, Homo sapiens
agccaccctttctggcacg

SEQ ID NO: 5359641 - DNA, 19 bp, Homo sapiens
agccaccgcagctgctgcc

SEQ ID NO: 5359642 - DNA, 17 bp, Homo sapiens
agccaccgcgagggcct

SEQ ID NO: 5359643 - DNA, 18 bp, Homo sapiens
agccaccgtgcccggcca

SEQ ID NO: 5359644 - DNA, 21 bp, Homo sapiens
agccaccgtgcccggccaagt

SEQ ID NO: 5359645 - DNA, 19 bp, Homo sapiens
agccaccgtgcctggccag

SEQ ID NO: 5359646 - DNA, 21 bp, Homo sapiens
agccacctccacccccaagaa

SEQ ID NO: 5359647 - DNA, 22 bp, Homo sapiens
agccacctccacccccaagaaa

SEQ ID NO: 5359648 - DNA, 15 bp, Homo sapiens
agccagggagagccc

SEQ ID NO: 5359649 - DNA, 19 bp, Homo sapiens
agccagggagagcccagga

SEQ ID NO: 5359650 - DNA, 20 bp, Homo sapiens
agccagggagagcccaggag

SEQ ID NO: 5359651 - DNA, 21 bp, Homo sapiens
agccagggagagcccaggagc

SEQ ID NO: 5359652 - DNA, 22 bp, Homo sapiens
agccagggagagcccaggagct

SEQ ID NO: 5359653 - DNA, 23 bp, Homo sapiens
agccagggatggggccacagcca

SEQ ID NO: 5359654 - DNA, 19 bp, Homo sapiens
agccagggcagaggaatgt

SEQ ID NO: 5359655 - DNA, 14 bp, Homo sapiens
agccagggcagggc

SEQ ID NO: 5359656 - DNA, 21 bp, Homo sapiens
agccagggcagggcgagctgc

SEQ ID NO: 5359657 - DNA, 16 bp, Homo sapiens
agccagggcagggctt

SEQ ID NO: 5359658 - DNA, 13 bp, Homo sapiens
agccagggccagg

SEQ ID NO: 5359659 - DNA, 15 bp, Homo sapiens
agccagggcccagag

SEQ ID NO: 5359660 - DNA, 21 bp, Homo sapiens
agccagggcccgggaagcaaa

SEQ ID NO: 5359661 - DNA, 22 bp, Homo sapiens
agccagggctatgggagcagct

SEQ ID NO: 5359662 - DNA, 14 bp, Homo sapiens
agccagggctgcta

SEQ ID NO: 5359663 - DNA, 21 bp, Homo sapiens
agccagggctgctagacggag

SEQ ID NO: 5359664 - DNA, 12 bp, Homo sapiens
agccagggctgg

SEQ ID NO: 5359665 - DNA, 13 bp, Homo sapiens
agccagggctgga

SEQ ID NO: 5359666 - DNA, 21 bp, Homo sapiens
agccagggctggggttgccag

SEQ ID NO: 5359667 - DNA, 23 bp, Homo sapiens
agccagggctggggttgccagag

SEQ ID NO: 5359668 - DNA, 18 bp, Homo sapiens
agccaggggagcagaggg

SEQ ID NO: 5359669 - DNA, 17 bp, Homo sapiens
agccaggggctgctcat

SEQ ID NO: 5359670 - DNA, 17 bp, Homo sapiens
agccaggggtgtcccag

SEQ ID NO: 5359671 - DNA, 12 bp, Homo sapiens
agccagggtctc

SEQ ID NO: 5359672 - DNA, 16 bp, Homo sapiens
agccagggtctctccc

SEQ ID NO: 5359673 - DNA, 21 bp, Homo sapiens
agccagggtctctccctcagg

SEQ ID NO: 5359674 - DNA, 22 bp, Homo sapiens
agccagggtctctccctcaggt

SEQ ID NO: 5359675 - DNA, 20 bp, Homo sapiens
agccagggtgagagtctggg

SEQ ID NO: 5359676 - DNA, 15 bp, Homo sapiens
agccagggttccaga

SEQ ID NO: 5359677 - DNA, 19 bp, Homo sapiens
agccagggttccagacagg

SEQ ID NO: 5359678 - DNA, 23 bp, Homo sapiens
agccaggtaatgagggactggaa

SEQ ID NO: 5359679 - DNA, 17 bp, Homo sapiens
agccaggtacaggagag

SEQ ID NO: 5359680 - DNA, 19 bp, Homo sapiens
agccaggtacaggagaggc

SEQ ID NO: 5359681 - DNA, 18 bp, Homo sapiens
agccaggtccccctgcag

SEQ ID NO: 5359682 - DNA, 19 bp, Homo sapiens
agccaggtccccctgcagc

SEQ ID NO: 5359683 - DNA, 20 bp, Homo sapiens
agccaggtccccctgcagct

SEQ ID NO: 5359684 - DNA, 15 bp, Homo sapiens
agccaggtccctctc

SEQ ID NO: 5359685 - DNA, 12 bp, Homo sapiens
agccaggtctcc

SEQ ID NO: 5359686 - DNA, 18 bp, Homo sapiens
agccaggtctcctgggaa

SEQ ID NO: 5359687 - DNA, 15 bp, Homo sapiens
agccaggtctgactc

SEQ ID NO: 5359688 - DNA, 14 bp, Homo sapiens
agccaggtgccttg

SEQ ID NO: 5359689 - DNA, 18 bp, Homo sapiens
agccaggtgccttggagg

SEQ ID NO: 5359690 - DNA, 19 bp, Homo sapiens
agccaggtggcacctgcag

SEQ ID NO: 5359691 - DNA, 18 bp, Homo sapiens
agccaggtgtcctgactg

SEQ ID NO: 5359692 - DNA, 22 bp, Homo sapiens
agccaggtgtcctgactgtcct

SEQ ID NO: 5359693 - DNA, 23 bp, Homo sapiens
agccaggttagcctttgccctgt

SEQ ID NO: 5359694 - DNA, 18 bp, Homo sapiens
agccaggttccacagagg

SEQ ID NO: 5359695 - DNA, 23 bp, Homo sapiens
agccagtaaatgggggtgcattt

SEQ ID NO: 5359696 - DNA, 13 bp, Homo sapiens
agccagtaatcct

SEQ ID NO: 5359697 - DNA, 15 bp, Homo sapiens
agccagtaatcttta

SEQ ID NO: 5359698 - DNA, 16 bp, Homo sapiens
agccagtaatctttat

SEQ ID NO: 5359699 - DNA, 21 bp, Homo sapiens
agccagtaatctttatactgg

SEQ ID NO: 5359700 - DNA, 16 bp, Homo sapiens
agccagtcaggcaggg

SEQ ID NO: 5359701 - DNA, 13 bp, Homo sapiens
agccagtcagggc

SEQ ID NO: 5359702 - DNA, 14 bp, Homo sapiens
agccagtcagggcc

SEQ ID NO: 5359703 - DNA, 14 bp, Homo sapiens
agccagtcccaggg

SEQ ID NO: 5359704 - DNA, 12 bp, Homo sapiens
agccagtctcag

SEQ ID NO: 5359705 - DNA, 17 bp, Homo sapiens
agccagtctcagagacc

SEQ ID NO: 5359706 - DNA, 14 bp, Homo sapiens
agccagtctcctat

SEQ ID NO: 5359707 - DNA, 23 bp, Homo sapiens
agccagtctcctatacccagcag

SEQ ID NO: 5359708 - DNA, 13 bp, Homo sapiens
agccagtctgcgt

SEQ ID NO: 5359709 - DNA, 12 bp, Homo sapiens
agccagtcttaa

SEQ ID NO: 5359710 - DNA, 17 bp, Homo sapiens
agccagtcttgcctagg

SEQ ID NO: 5359711 - DNA, 13 bp, Homo sapiens
agccagtgaagga

SEQ ID NO: 5359712 - DNA, 18 bp, Homo sapiens
agccagtgacctgaggaa

SEQ ID NO: 5359713 - DNA, 21 bp, Homo sapiens
agccagtgacctttgacctcg

SEQ ID NO: 5359714 - DNA, 16 bp, Homo sapiens
agccagtgactccagg

SEQ ID NO: 5359715 - DNA, 17 bp, Homo sapiens
agccagtgactccagga

SEQ ID NO: 5359716 - DNA, 22 bp, Homo sapiens
agccagtgactccaggagagga

SEQ ID NO: 5359717 - DNA, 12 bp, Homo sapiens
agccagtgactt

SEQ ID NO: 5359718 - DNA, 13 bp, Homo sapiens
agccagtgacttt

SEQ ID NO: 5359719 - DNA, 15 bp, Homo sapiens
agccagtgccctgag

SEQ ID NO: 5359720 - DNA, 23 bp, Homo sapiens
agccagtgccctgagccagggtc

SEQ ID NO: 5359721 - DNA, 15 bp, Homo sapiens
agccagtggcacagg

SEQ ID NO: 5359722 - DNA, 20 bp, Homo sapiens
agccagtgtctaggcactga

SEQ ID NO: 5359723 - DNA, 23 bp, Homo sapiens
agccagtgtgcccaaaagccatg

SEQ ID NO: 5359724 - DNA, 18 bp, Homo sapiens
agccagttaaggaaagaa

SEQ ID NO: 5359725 - DNA, 20 bp, Homo sapiens
agccagttacctttgctgtc

SEQ ID NO: 5359726 - DNA, 23 bp, Homo sapiens
agccagttacctttgctgtcact

SEQ ID NO: 5359727 - DNA, 15 bp, Homo sapiens
agccagttctgacag

SEQ ID NO: 5359728 - DNA, 20 bp, Homo sapiens
agccagttctggggcccgcc

SEQ ID NO: 5359729 - DNA, 22 bp, Homo sapiens
agccagttctggggcccgcctg

SEQ ID NO: 5359730 - DNA, 18 bp, Homo sapiens
agccagttggatctctgg

SEQ ID NO: 5359731 - DNA, 21 bp, Homo sapiens
agccagttggcttctgtgcct

SEQ ID NO: 5359732 - DNA, 15 bp, Homo sapiens
agccagttggtgggg

SEQ ID NO: 5359733 - DNA, 20 bp, Homo sapiens
agccagttggtggggccagg

SEQ ID NO: 5359734 - DNA, 21 bp, Homo sapiens
agccagttggtggggccaggc

SEQ ID NO: 5359735 - DNA, 23 bp, Homo sapiens
agccagttggtggggccaggcca

SEQ ID NO: 5359736 - DNA, 16 bp, Homo sapiens
agccagttttcatttt

SEQ ID NO: 5359737 - DNA, 17 bp, Homo sapiens
agccataaaaaggaaca

SEQ ID NO: 5359738 - DNA, 19 bp, Homo sapiens
agccataacgtgcccccag

SEQ ID NO: 5359739 - DNA, 14 bp, Homo sapiens
agccataacttgaa

SEQ ID NO: 5359740 - DNA, 12 bp, Homo sapiens
agccataataat

SEQ ID NO: 5359741 - DNA, 22 bp, Homo sapiens
agccataattttgcatactgaa

SEQ ID NO: 5359742 - DNA, 14 bp, Homo sapiens
agccatacacatgg

SEQ ID NO: 5359743 - DNA, 21 bp, Homo sapiens
agccatacataaaagaaataa

SEQ ID NO: 5359744 - DNA, 15 bp, Homo sapiens
agccataccagggtg

SEQ ID NO: 5359745 - DNA, 16 bp, Homo sapiens
agccataccagggtga

SEQ ID NO: 5359746 - DNA, 20 bp, Homo sapiens
agccatactgcgtccaccct

SEQ ID NO: 5359747 - DNA, 19 bp, Homo sapiens
agccatacttatctctctg

SEQ ID NO: 5359748 - DNA, 16 bp, Homo sapiens
agccatagaccctgag

SEQ ID NO: 5359749 - DNA, 18 bp, Homo sapiens
agccatagagatatttaa

SEQ ID NO: 5359750 - DNA, 18 bp, Homo sapiens
agccatagccccaggccc

SEQ ID NO: 5359751 - DNA, 14 bp, Homo sapiens
agccataggccctt

SEQ ID NO: 5359752 - DNA, 21 bp, Homo sapiens
agccatagggggctgcacggg

SEQ ID NO: 5359753 - DNA, 10 bp, Homo sapiens
agccatagtg

SEQ ID NO: 5359754 - DNA, 20 bp, Homo sapiens
agccatatgacaatttcaaa

SEQ ID NO: 5359755 - DNA, 18 bp, Homo sapiens
agccatattaattgcctg

SEQ ID NO: 5359756 - DNA, 23 bp, Homo sapiens
agccatattaattgcctgttaaa

SEQ ID NO: 5359757 - DNA, 17 bp, Homo sapiens
agccatattcacacctc

SEQ ID NO: 5359758 - DNA, 13 bp, Homo sapiens
agccatattccag

SEQ ID NO: 5359759 - DNA, 19 bp, Homo sapiens
agccatattctaaattcac

SEQ ID NO: 5359760 - DNA, 16 bp, Homo sapiens
agccatatttgtaaaa

SEQ ID NO: 5359761 - DNA, 18 bp, Homo sapiens
agccatatttttttctgt

SEQ ID NO: 5359762 - DNA, 20 bp, Homo sapiens
agccatatttttttctgtaa

SEQ ID NO: 5359763 - DNA, 16 bp, Homo sapiens
agccatcaaaatgctt

SEQ ID NO: 5359764 - DNA, 18 bp, Homo sapiens
agccatcaacaagagttg

SEQ ID NO: 5359765 - DNA, 17 bp, Homo sapiens
agccatcaagagactga

SEQ ID NO: 5359766 - DNA, 13 bp, Homo sapiens
agccatcaagcac

SEQ ID NO: 5359767 - DNA, 18 bp, Homo sapiens
agccatcaattttaacat

SEQ ID NO: 5359768 - DNA, 14 bp, Homo sapiens
agccatcaccctca

SEQ ID NO: 5359769 - DNA, 15 bp, Homo sapiens
agccatcaccctcac

SEQ ID NO: 5359770 - DNA, 19 bp, Homo sapiens
agccatcacctaggactga

SEQ ID NO: 5359771 - DNA, 15 bp, Homo sapiens
agccatcacctcaga

SEQ ID NO: 5359772 - DNA, 18 bp, Homo sapiens
agccatcacctcagatgg

SEQ ID NO: 5359773 - DNA, 22 bp, Homo sapiens
agccatcacctcagatggcagc

SEQ ID NO: 5359774 - DNA, 14 bp, Homo sapiens
agccatcaccttag

SEQ ID NO: 5359775 - DNA, 18 bp, Homo sapiens
agccatcactagaagaaa

SEQ ID NO: 5359776 - DNA, 19 bp, Homo sapiens
agccatcactagaagaaaa

SEQ ID NO: 5359777 - DNA, 19 bp, Homo sapiens
agccatcacttctccccgc

SEQ ID NO: 5359778 - DNA, 15 bp, Homo sapiens
agccatcagatgagg

SEQ ID NO: 5359779 - DNA, 19 bp, Homo sapiens
agccatcagccatggccct

SEQ ID NO: 5359780 - DNA, 15 bp, Homo sapiens
agccatcatgccttg

SEQ ID NO: 5359781 - DNA, 18 bp, Homo sapiens
agccatccaaagaaacac

SEQ ID NO: 5359782 - DNA, 14 bp, Homo sapiens
agccatccaccctg

SEQ ID NO: 5359783 - DNA, 14 bp, Homo sapiens
agccatcccagcct

SEQ ID NO: 5359784 - DNA, 14 bp, Homo sapiens
agccatcccttggg

SEQ ID NO: 5359785 - DNA, 17 bp, Homo sapiens
agccatcccttggggaa

SEQ ID NO: 5359786 - DNA, 21 bp, Homo sapiens
agccatccctttttttacatt

SEQ ID NO: 5359787 - DNA, 16 bp, Homo sapiens
agccatccgcagactg

SEQ ID NO: 5359788 - DNA, 15 bp, Homo sapiens
agccatcctccctcc

SEQ ID NO: 5359789 - DNA, 14 bp, Homo sapiens
agccatcctgccct

SEQ ID NO: 5359790 - DNA, 14 bp, Homo sapiens
agccatcggaagag

SEQ ID NO: 5359791 - DNA, 17 bp, Homo sapiens
agccatcggaagagagg

SEQ ID NO: 5359792 - DNA, 20 bp, Homo sapiens
agccatcggaagagagggct

SEQ ID NO: 5359793 - DNA, 22 bp, Homo sapiens
agccatcgtcctgggactcgga

SEQ ID NO: 5359794 - DNA, 23 bp, Homo sapiens
agccatctaaagtaaaaagggaa

SEQ ID NO: 5359795 - DNA, 14 bp, Homo sapiens
agccatctactgga

SEQ ID NO: 5359796 - DNA, 12 bp, Homo sapiens
agccatctcaga

SEQ ID NO: 5359797 - DNA, 23 bp, Homo sapiens
agccatctcatgaggggagagga

SEQ ID NO: 5359798 - DNA, 16 bp, Homo sapiens
agccatctgaagccac

SEQ ID NO: 5359799 - DNA, 14 bp, Homo sapiens
agccatctgcccag

SEQ ID NO: 5359800 - DNA, 18 bp, Homo sapiens
agccatctgcccaggggt

SEQ ID NO: 5359801 - DNA, 23 bp, Homo sapiens
agccatcttcccgcctcagcctc

SEQ ID NO: 5359802 - DNA, 22 bp, Homo sapiens
agccatgaaatcaactcagtgg

SEQ ID NO: 5359803 - DNA, 23 bp, Homo sapiens
agccatgaccagttctggccagg

SEQ ID NO: 5359804 - DNA, 24 bp, Homo sapiens
agccatgactagggtcctcaggca

SEQ ID NO: 5359805 - DNA, 14 bp, Homo sapiens
agccatgagaatgt

SEQ ID NO: 5359806 - DNA, 13 bp, Homo sapiens
agccatgaggagc

SEQ ID NO: 5359807 - DNA, 23 bp, Homo sapiens
agccatgaggagcgtggactctg

SEQ ID NO: 5359808 - DNA, 16 bp, Homo sapiens
agccatgaggaggcag

SEQ ID NO: 5359809 - DNA, 18 bp, Homo sapiens
agccatgaggagttgctg

SEQ ID NO: 5359810 - DNA, 20 bp, Homo sapiens
agccatgaggagttgctgtt

SEQ ID NO: 5359811 - DNA, 21 bp, Homo sapiens
agccatgatcgagccactgca

SEQ ID NO: 5359812 - DNA, 22 bp, Homo sapiens
agccatgatcgagccactgcac

SEQ ID NO: 5359813 - DNA, 14 bp, Homo sapiens
agccatgatctgca

SEQ ID NO: 5359814 - DNA, 15 bp, Homo sapiens
agccatgatttccca

SEQ ID NO: 5359815 - DNA, 21 bp, Homo sapiens
agccatgatttcccactgcac

SEQ ID NO: 5359816 - DNA, 20 bp, Homo sapiens
agccatgatttgtcccagcc

SEQ ID NO: 5359817 - DNA, 17 bp, Homo sapiens
agccatgattttctaaa

SEQ ID NO: 5359818 - DNA, 15 bp, Homo sapiens
agccatgccaataaa

SEQ ID NO: 5359819 - DNA, 16 bp, Homo sapiens
agccatgccaataaag

SEQ ID NO: 5359820 - DNA, 17 bp, Homo sapiens
agccatgccagctggcc

SEQ ID NO: 5359821 - DNA, 15 bp, Homo sapiens
agccatgcccaggac

SEQ ID NO: 5359822 - DNA, 15 bp, Homo sapiens
agccatgcccgcatt

SEQ ID NO: 5359823 - DNA, 14 bp, Homo sapiens
agccatgcctcatg

SEQ ID NO: 5359824 - DNA, 15 bp, Homo sapiens
agccatgcctcatgc

SEQ ID NO: 5359825 - DNA, 20 bp, Homo sapiens
agcccgccttggctttctcc

SEQ ID NO: 5359826 - DNA, 15 bp, Homo sapiens
agcccgcggggacat

SEQ ID NO: 5359827 - DNA, 15 bp, Homo sapiens
agcccgcgtctgtgc

SEQ ID NO: 5359828 - DNA, 15 bp, Homo sapiens
agcccgcgtgctgga

SEQ ID NO: 5359829 - DNA, 23 bp, Homo sapiens
agcccgctaggctcgccttccct

SEQ ID NO: 5359830 - DNA, 15 bp, Homo sapiens
agcccgctctctggc

SEQ ID NO: 5359831 - DNA, 16 bp, Homo sapiens
agcccgctctctggct

SEQ ID NO: 5359832 - DNA, 15 bp, Homo sapiens
agcccgcttcaagct

SEQ ID NO: 5359833 - DNA, 17 bp, Homo sapiens
agcccgcttcaagctct

SEQ ID NO: 5359834 - DNA, 20 bp, Homo sapiens
agcccgcttcaagctctctg

SEQ ID NO: 5359835 - DNA, 24 bp, Homo sapiens
agcccgcttcaagctctctgttgc

SEQ ID NO: 5359836 - DNA, 15 bp, Homo sapiens
agcccgcttgctcgc

SEQ ID NO: 5359837 - DNA, 21 bp, Homo sapiens
agcccgcttgctcgcttgctg

SEQ ID NO: 5359838 - DNA, 22 bp, Homo sapiens
agcccgcttttgttcttcccca

SEQ ID NO: 5359839 - DNA, 16 bp, Homo sapiens
agcccggaaactccac

SEQ ID NO: 5359840 - DNA, 20 bp, Homo sapiens
agcccggaccttggcagccc

SEQ ID NO: 5359841 - DNA, 13 bp, Homo sapiens
agcccggactgac

SEQ ID NO: 5359842 - DNA, 15 bp, Homo sapiens
agcccggactgacca

SEQ ID NO: 5359843 - DNA, 16 bp, Homo sapiens
agcccggactgaccaa

SEQ ID NO: 5359844 - DNA, 20 bp, Homo sapiens
agcccggactgaccaaatca

SEQ ID NO: 5359845 - DNA, 20 bp, Homo sapiens
agcccggagctccggcctgc

SEQ ID NO: 5359846 - DNA, 16 bp, Homo sapiens
agcccggatgcccacc

SEQ ID NO: 5359847 - DNA, 10 bp, Homo sapiens
agcccggcca

SEQ ID NO: 5359848 - DNA, 19 bp, Homo sapiens
agcccggccaaggacactg

SEQ ID NO: 5359849 - DNA, 17 bp, Homo sapiens
agcccggccagggcctg

SEQ ID NO: 5359850 - DNA, 18 bp, Homo sapiens
agcccggccagggcctgg

SEQ ID NO: 5359851 - DNA, 14 bp, Homo sapiens
agcccggccgctcc

SEQ ID NO: 5359852 - DNA, 19 bp, Homo sapiens
agcccggcctgctcccagc

SEQ ID NO: 5359853 - DNA, 21 bp, Homo sapiens
agcccggcctgctcccagcag

SEQ ID NO: 5359854 - DNA, 16 bp, Homo sapiens
agcccggcgcccctgc

SEQ ID NO: 5359855 - DNA, 21 bp, Homo sapiens
agcccggcgcccctgccacct

SEQ ID NO: 5359856 - DNA, 12 bp, Homo sapiens
agcccggctcct

SEQ ID NO: 5359857 - DNA, 21 bp, Homo sapiens
agcccggctcggcccagcacc

SEQ ID NO: 5359858 - DNA, 22 bp, Homo sapiens
agcccggctcggcccagcaccc

SEQ ID NO: 5359859 - DNA, 19 bp, Homo sapiens
agcccggctgctgcttgga

SEQ ID NO: 5359860 - DNA, 18 bp, Homo sapiens
agcccgggagctttgaga

SEQ ID NO: 5359861 - DNA, 22 bp, Homo sapiens
agcccgggagctttgagacagg

SEQ ID NO: 5359862 - DNA, 13 bp, Homo sapiens
agcccgggctctg

SEQ ID NO: 5359863 - DNA, 13 bp, Homo sapiens
agcccgggctgcc

SEQ ID NO: 5359864 - DNA, 14 bp, Homo sapiens
agcccgggctgcct

SEQ ID NO: 5359865 - DNA, 15 bp, Homo sapiens
agcccggtaagagca

SEQ ID NO: 5359866 - DNA, 16 bp, Homo sapiens
agcccggtgttcagtg

SEQ ID NO: 5359867 - DNA, 15 bp, Homo sapiens
agcccgtcaccctta

SEQ ID NO: 5359868 - DNA, 14 bp, Homo sapiens
agcccgtcaggcca

SEQ ID NO: 5359869 - DNA, 16 bp, Homo sapiens
agcccgtcctcctcta

SEQ ID NO: 5359870 - DNA, 19 bp, Homo sapiens
agcccgtcgcgctggacag

SEQ ID NO: 5359871 - DNA, 16 bp, Homo sapiens
agcccgtgccaccccc

SEQ ID NO: 5359872 - DNA, 17 bp, Homo sapiens
agcccgtgccaccccca

SEQ ID NO: 5359873 - DNA, 13 bp, Homo sapiens
agcccgtgtcctg

SEQ ID NO: 5359874 - DNA, 16 bp, Homo sapiens
agcccgtgtggcccct

SEQ ID NO: 5359875 - DNA, 17 bp, Homo sapiens
agcccgtgtggcccctt

SEQ ID NO: 5359876 - DNA, 19 bp, Homo sapiens
agccctaaatctagactca

SEQ ID NO: 5359877 - DNA, 17 bp, Homo sapiens
agccctaaccccttcca

SEQ ID NO: 5359878 - DNA, 18 bp, Homo sapiens
agccctaaccccttccag

SEQ ID NO: 5359879 - DNA, 20 bp, Homo sapiens
agccctaagcctgtccccag

SEQ ID NO: 5359880 - DNA, 21 bp, Homo sapiens
agccctaagcctgtccccaga

SEQ ID NO: 5359881 - DNA, 22 bp, Homo sapiens
agccctaagcctgtccccagac

SEQ ID NO: 5359882 - DNA, 24 bp, Homo sapiens
agccctaagcctgtccccagacca

SEQ ID NO: 5359883 - DNA, 22 bp, Homo sapiens
agccctaagtaaatctaaatta

SEQ ID NO: 5359884 - DNA, 18 bp, Homo sapiens
agccctaagtggctgcct

SEQ ID NO: 5359885 - DNA, 20 bp, Homo sapiens
agccctaagtggctgccttc

SEQ ID NO: 5359886 - DNA, 15 bp, Homo sapiens
agccctacagagctg

SEQ ID NO: 5359887 - DNA, 15 bp, Homo sapiens
agccctacatcttca

SEQ ID NO: 5359888 - DNA, 18 bp, Homo sapiens
agccctacatcttcagct

SEQ ID NO: 5359889 - DNA, 22 bp, Homo sapiens
agccctacatcttcagctccca

SEQ ID NO: 5359890 - DNA, 13 bp, Homo sapiens
agccctactccct

SEQ ID NO: 5359891 - DNA, 20 bp, Homo sapiens
agccctactccctgcagatg

SEQ ID NO: 5359892 - DNA, 21 bp, Homo sapiens
agccctactccctgcagatgc

SEQ ID NO: 5359893 - DNA, 17 bp, Homo sapiens
agccctagccctcagcc

SEQ ID NO: 5359894 - DNA, 14 bp, Homo sapiens
agccctagcggctg

SEQ ID NO: 5359895 - DNA, 19 bp, Homo sapiens
agccctagggtgctctgaa

SEQ ID NO: 5359896 - DNA, 18 bp, Homo sapiens
agccctagtgggagccca

SEQ ID NO: 5359897 - DNA, 20 bp, Homo sapiens
agccctagtgggagcccagc

SEQ ID NO: 5359898 - DNA, 22 bp, Homo sapiens
agccctatctatgtcctggaag

SEQ ID NO: 5359899 - DNA, 14 bp, Homo sapiens
agccctcaaagtga

SEQ ID NO: 5359900 - DNA, 17 bp, Homo sapiens
agccctcaattgtgaaa

SEQ ID NO: 5359901 - DNA, 22 bp, Homo sapiens
agccctcaccacagccttctaa

SEQ ID NO: 5359902 - DNA, 23 bp, Homo sapiens
agccctcacccctggttctcatc

SEQ ID NO: 5359903 - DNA, 17 bp, Homo sapiens
agccctcaccctggggc

SEQ ID NO: 5359904 - DNA, 15 bp, Homo sapiens
agccctcacctctga

SEQ ID NO: 5359905 - DNA, 17 bp, Homo sapiens
agccctcacctctgagg

SEQ ID NO: 5359906 - DNA, 19 bp, Homo sapiens
agccctcacctctgaggac

SEQ ID NO: 5359907 - DNA, 24 bp, Homo sapiens
agccctcagaacccttggcttgcc

SEQ ID NO: 5359908 - DNA, 18 bp, Homo sapiens
agccctcagacatttata

SEQ ID NO: 5359909 - DNA, 17 bp, Homo sapiens
agccctcagactgtcag

SEQ ID NO: 5359910 - DNA, 17 bp, Homo sapiens
agccctcagatcccagg

SEQ ID NO: 5359911 - DNA, 20 bp, Homo sapiens
agccctcagatcccagggta

SEQ ID NO: 5359912 - DNA, 21 bp, Homo sapiens
agccctcagatcccagggtac

SEQ ID NO: 5359913 - DNA, 16 bp, Homo sapiens
agccctcaggccagtg

SEQ ID NO: 5359914 - DNA, 21 bp, Homo sapiens
agccctcaggccagtgccagg

SEQ ID NO: 5359915 - DNA, 23 bp, Homo sapiens
agccctcaggccagtgccaggac

SEQ ID NO: 5359916 - DNA, 16 bp, Homo sapiens
agccctcaggctcccc

SEQ ID NO: 5359917 - DNA, 17 bp, Homo sapiens
agccctcaggctcccca

SEQ ID NO: 5359918 - DNA, 18 bp, Homo sapiens
agccctcaggctccccag

SEQ ID NO: 5359919 - DNA, 19 bp, Homo sapiens
agccctcaggctccccaga

SEQ ID NO: 5359920 - DNA, 20 bp, Homo sapiens
agccctcaggctccccagaa

SEQ ID NO: 5359921 - DNA, 23 bp, Homo sapiens
agccctcagtcagttcccggagc

SEQ ID NO: 5359922 - DNA, 12 bp, Homo sapiens
agccctcatccc

SEQ ID NO: 5359923 - DNA, 17 bp, Homo sapiens
agccctcatcccacttc

SEQ ID NO: 5359924 - DNA, 17 bp, Homo sapiens
agccctccacattttca

SEQ ID NO: 5359925 - DNA, 22 bp, Homo sapiens
agccctccacgtcagtgccatc

SEQ ID NO: 5359926 - DNA, 20 bp, Homo sapiens
agccctccacttctggtata

SEQ ID NO: 5359927 - DNA, 12 bp, Homo sapiens
agccctccaggc

SEQ ID NO: 5359928 - DNA, 14 bp, Homo sapiens
agccctccaggcct

SEQ ID NO: 5359929 - DNA, 17 bp, Homo sapiens
agccctccatggtcctg

SEQ ID NO: 5359930 - DNA, 22 bp, Homo sapiens
agccctcccactttgctgttcc

SEQ ID NO: 5359931 - DNA, 18 bp, Homo sapiens
agccctccccacctgctc

SEQ ID NO: 5359932 - DNA, 21 bp, Homo sapiens
agccctccccacctgctcacc

SEQ ID NO: 5359933 - DNA, 15 bp, Homo sapiens
agccctccccaggaa

SEQ ID NO: 5359934 - DNA, 23 bp, Homo sapiens
agccctccccatctcggggctgc

SEQ ID NO: 5359935 - DNA, 20 bp, Homo sapiens
agccctccccatggagccag

SEQ ID NO: 5359936 - DNA, 21 bp, Homo sapiens
agccctccccatggagccagc

SEQ ID NO: 5359937 - DNA, 14 bp, Homo sapiens
agccctccccccag

SEQ ID NO: 5359938 - DNA, 16 bp, Homo sapiens
agccctcccccttccc

SEQ ID NO: 5359939 - DNA, 20 bp, Homo sapiens
agccctcccccttccccttc

SEQ ID NO: 5359940 - DNA, 21 bp, Homo sapiens
agccctcccccttccccttct

SEQ ID NO: 5359941 - DNA, 22 bp, Homo sapiens
agccctcccccttccccttctg

SEQ ID NO: 5359942 - DNA, 14 bp, Homo sapiens
agccctccctcttc

SEQ ID NO: 5359943 - DNA, 22 bp, Homo sapiens
agccctccctcttcccagcaca

SEQ ID NO: 5359944 - DNA, 12 bp, Homo sapiens
agccctccctgc

SEQ ID NO: 5359945 - DNA, 13 bp, Homo sapiens
agccctccctgcc

SEQ ID NO: 5359946 - DNA, 17 bp, Homo sapiens
agccctccctggctgtg

SEQ ID NO: 5359947 - DNA, 14 bp, Homo sapiens
agccctccctgtcc

SEQ ID NO: 5359948 - DNA, 15 bp, Homo sapiens
agccctccctgtcct

SEQ ID NO: 5359949 - DNA, 16 bp, Homo sapiens
agccctccctgtcctc

SEQ ID NO: 5359950 - DNA, 19 bp, Homo sapiens
agccctccctgtcctcctc

SEQ ID NO: 5359951 - DNA, 21 bp, Homo sapiens
agccctccctgtcctcctcgg

SEQ ID NO: 5359952 - DNA, 19 bp, Homo sapiens
agccctccgaccctcatgg

SEQ ID NO: 5359953 - DNA, 19 bp, Homo sapiens
agccctccgccagccctgt

SEQ ID NO: 5359954 - DNA, 24 bp, Homo sapiens
agccctccgccattctcaagccct

SEQ ID NO: 5359955 - DNA, 16 bp, Homo sapiens
agccctccgccttcac

SEQ ID NO: 5359956 - DNA, 13 bp, Homo sapiens
agccctcctcacc

SEQ ID NO: 5359957 - DNA, 19 bp, Homo sapiens
agccctcctccccagagct

SEQ ID NO: 5359958 - DNA, 12 bp, Homo sapiens
agccctcctgag

SEQ ID NO: 5359959 - DNA, 14 bp, Homo sapiens
agccctcctggaat

SEQ ID NO: 5359960 - DNA, 11 bp, Homo sapiens
agccctccttc

SEQ ID NO: 5359961 - DNA, 13 bp, Homo sapiens
agccctccttcca

SEQ ID NO: 5359962 - DNA, 18 bp, Homo sapiens
agccctccttcttgccct

SEQ ID NO: 5359963 - DNA, 16 bp, Homo sapiens
agccctccttgccacc

SEQ ID NO: 5359964 - DNA, 12 bp, Homo sapiens
agccctcctttg

SEQ ID NO: 5359965 - DNA, 21 bp, Homo sapiens
agccctcgaaccaaggcagcc

SEQ ID NO: 5359966 - DNA, 14 bp, Homo sapiens
agccctcggcctcc

SEQ ID NO: 5359967 - DNA, 15 bp, Homo sapiens
agccctcggcctcca

SEQ ID NO: 5359968 - DNA, 17 bp, Homo sapiens
agccctcggcctccaga

SEQ ID NO: 5359969 - DNA, 16 bp, Homo sapiens
agccctcggcctccga

SEQ ID NO: 5359970 - DNA, 16 bp, Homo sapiens
agccctctagggcagg

SEQ ID NO: 5359971 - DNA, 13 bp, Homo sapiens
agccctctcactc

SEQ ID NO: 5359972 - DNA, 18 bp, Homo sapiens
agccctctcactccagcc

SEQ ID NO: 5359973 - DNA, 20 bp, Homo sapiens
agccctctcactccagccaa

SEQ ID NO: 5359974 - DNA, 22 bp, Homo sapiens
agccctctcactccagccaaag

SEQ ID NO: 5359975 - DNA, 16 bp, Homo sapiens
agccctctcactgtgt

SEQ ID NO: 5359976 - DNA, 19 bp, Homo sapiens
agccctctcactgtgtccc

SEQ ID NO: 5359977 - DNA, 20 bp, Homo sapiens
agccctctcagatcacccca

SEQ ID NO: 5359978 - DNA, 20 bp, Homo sapiens
agccctctccaaatcaagga

SEQ ID NO: 5359979 - DNA, 16 bp, Homo sapiens
agccctctccacccag

SEQ ID NO: 5359980 - DNA, 18 bp, Homo sapiens
agccctctccacccagag

SEQ ID NO: 5359981 - DNA, 20 bp, Homo sapiens
agccctctccacccagaggt

SEQ ID NO: 5359982 - DNA, 12 bp, Homo sapiens
agccctctccct

SEQ ID NO: 5359983 - DNA, 13 bp, Homo sapiens
agccctctccctc

SEQ ID NO: 5359984 - DNA, 13 bp, Homo sapiens
agccctctcttgc

SEQ ID NO: 5359985 - DNA, 15 bp, Homo sapiens
agccctctcttgcca

SEQ ID NO: 5359986 - DNA, 19 bp, Homo sapiens
agccctctgtggccaggag

SEQ ID NO: 5359987 - DNA, 21 bp, Homo sapiens
agccctcttcaggggtcacct

SEQ ID NO: 5359988 - DNA, 23 bp, Homo sapiens
agccctcttcaggggtcacctcc

SEQ ID NO: 5359989 - DNA, 19 bp, Homo sapiens
agccctcttccatcatgtc

SEQ ID NO: 5359990 - DNA, 15 bp, Homo sapiens
agccctcttgcccag

SEQ ID NO: 5359991 - DNA, 23 bp, Homo sapiens
agccctcttgcccgcacccctcc

SEQ ID NO: 5359992 - DNA, 20 bp, Homo sapiens
agccctcttgggggcactgc

SEQ ID NO: 5359993 - DNA, 15 bp, Homo sapiens
agccctctttctctc

SEQ ID NO: 5359994 - DNA, 19 bp, Homo sapiens
agccctctttctctctgtg

SEQ ID NO: 5359995 - DNA, 23 bp, Homo sapiens
agccctctttctctctgtgtggc

SEQ ID NO: 5359996 - DNA, 24 bp, Homo sapiens
agccctctttctctctgtgtggca

SEQ ID NO: 5359997 - DNA, 13 bp, Homo sapiens
agccctgaccctg

SEQ ID NO: 5359998 - DNA, 15 bp, Homo sapiens
agccctgaccctgtg

SEQ ID NO: 5359999 - DNA, 12 bp, Homo sapiens
agccctgacctt

SEQ ID NO: 5360000 - DNA, 16 bp, Homo sapiens
agccctgaccttggct

SEQ ID NO: 5360001 - DNA, 19 bp, Homo sapiens
agccctgacgcaatgaaaa

SEQ ID NO: 5360002 - DNA, 16 bp, Homo sapiens
agccgtaggacccagt

SEQ ID NO: 5360003 - DNA, 20 bp, Homo sapiens
agccgtagggtggcactggg

SEQ ID NO: 5360004 - DNA, 16 bp, Homo sapiens
agccgtcagccaaatg

SEQ ID NO: 5360005 - DNA, 18 bp, Homo sapiens
agccgtccaacttaaaaa

SEQ ID NO: 5360006 - DNA, 16 bp, Homo sapiens
agccgtcccaggccac

SEQ ID NO: 5360007 - DNA, 19 bp, Homo sapiens
agccgtctgactccagagt

SEQ ID NO: 5360008 - DNA, 24 bp, Homo sapiens
agccgtctgactccagagtctgag

SEQ ID NO: 5360009 - DNA, 15 bp, Homo sapiens
agccgtgcaggactc

SEQ ID NO: 5360010 - DNA, 16 bp, Homo sapiens
agccgtgcaggactct

SEQ ID NO: 5360011 - DNA, 16 bp, Homo sapiens
agccgtgcctgtagcc

SEQ ID NO: 5360012 - DNA, 21 bp, Homo sapiens
agccgtgcctttctctggctc

SEQ ID NO: 5360013 - DNA, 20 bp, Homo sapiens
agccgtggccggggtccagg

SEQ ID NO: 5360014 - DNA, 13 bp, Homo sapiens
agccgtggcttcc

SEQ ID NO: 5360015 - DNA, 15 bp, Homo sapiens
agccgtggtccctga

SEQ ID NO: 5360016 - DNA, 14 bp, Homo sapiens
agccgtgtgtgcat

SEQ ID NO: 5360017 - DNA, 21 bp, Homo sapiens
agccgtgtgtgcatgtgccga

SEQ ID NO: 5360018 - DNA, 12 bp, Homo sapiens
agccgtgtttta

SEQ ID NO: 5360019 - DNA, 20 bp, Homo sapiens
agccgttgaatctgggaggg

SEQ ID NO: 5360020 - DNA, 21 bp, Homo sapiens
agccgttgaatctgggaggga

SEQ ID NO: 5360021 - DNA, 20 bp, Homo sapiens
agccgtttgaatatatttta

SEQ ID NO: 5360022 - DNA, 15 bp, Homo sapiens
agccgttttcctcat

SEQ ID NO: 5360023 - DNA, 21 bp, Homo sapiens
agcctaaaacgaatggtcttt

SEQ ID NO: 5360024 - DNA, 13 bp, Homo sapiens
agcctaaaattaa

SEQ ID NO: 5360025 - DNA, 13 bp, Homo sapiens
agcctaaaattac

SEQ ID NO: 5360026 - DNA, 14 bp, Homo sapiens
agcctaaagaccat

SEQ ID NO: 5360027 - DNA, 16 bp, Homo sapiens
agcctaaagggcaggg

SEQ ID NO: 5360028 - DNA, 19 bp, Homo sapiens
agcctaaatctaatcaggt

SEQ ID NO: 5360029 - DNA, 12 bp, Homo sapiens
agcctaaatgat

SEQ ID NO: 5360030 - DNA, 22 bp, Homo sapiens
agcctaaatgccttagaaatgt

SEQ ID NO: 5360031 - DNA, 13 bp, Homo sapiens
agcctaagaagaa

SEQ ID NO: 5360032 - DNA, 14 bp, Homo sapiens
agcctaagaagaag

SEQ ID NO: 5360033 - DNA, 15 bp, Homo sapiens
agcctaagaagaagg

SEQ ID NO: 5360034 - DNA, 17 bp, Homo sapiens
agcctaagaagaaggcc

SEQ ID NO: 5360035 - DNA, 18 bp, Homo sapiens
agcctaagaagaaggcca

SEQ ID NO: 5360036 - DNA, 20 bp, Homo sapiens
agcctaagaagaaggccaga

SEQ ID NO: 5360037 - DNA, 16 bp, Homo sapiens
agcctaagaagctctg

SEQ ID NO: 5360038 - DNA, 13 bp, Homo sapiens
agcctaagggaga

SEQ ID NO: 5360039 - DNA, 12 bp, Homo sapiens
agcctaagggat

SEQ ID NO: 5360040 - DNA, 16 bp, Homo sapiens
agcctaagggatcctg

SEQ ID NO: 5360041 - DNA, 15 bp, Homo sapiens
agcctaatattcatg

SEQ ID NO: 5360042 - DNA, 12 bp, Homo sapiens
agcctaatgaaa

SEQ ID NO: 5360043 - DNA, 19 bp, Homo sapiens
agcctaatgagagtgcact

SEQ ID NO: 5360044 - DNA, 20 bp, Homo sapiens
agcctaatgagagtgcactg

SEQ ID NO: 5360045 - DNA, 16 bp, Homo sapiens
agcctaattgtcacat

SEQ ID NO: 5360046 - DNA, 16 bp, Homo sapiens
agcctacaagctggca

SEQ ID NO: 5360047 - DNA, 17 bp, Homo sapiens
agcctacactgccagcc

SEQ ID NO: 5360048 - DNA, 21 bp, Homo sapiens
agcctacactgccagccgcca

SEQ ID NO: 5360049 - DNA, 18 bp, Homo sapiens
agcctacagaagggcagt

SEQ ID NO: 5360050 - DNA, 23 bp, Homo sapiens
agcctacattctccagttgatta

SEQ ID NO: 5360051 - DNA, 16 bp, Homo sapiens
agcctaccatgtgaaa

SEQ ID NO: 5360052 - DNA, 14 bp, Homo sapiens
agcctaccccctga

SEQ ID NO: 5360053 - DNA, 18 bp, Homo sapiens
agcctacccctcctgcgc

SEQ ID NO: 5360054 - DNA, 19 bp, Homo sapiens
agcctaccgctggccctgc

SEQ ID NO: 5360055 - DNA, 20 bp, Homo sapiens
agcctaccgctggccctgcc

SEQ ID NO: 5360056 - DNA, 17 bp, Homo sapiens
agcctaccgtatttcag

SEQ ID NO: 5360057 - DNA, 14 bp, Homo sapiens
agcctacctctcca

SEQ ID NO: 5360058 - DNA, 19 bp, Homo sapiens
agcctaccttcaccaccta

SEQ ID NO: 5360059 - DNA, 16 bp, Homo sapiens
agcctacgctgaagat

SEQ ID NO: 5360060 - DNA, 14 bp, Homo sapiens
agcctactatttaa

SEQ ID NO: 5360061 - DNA, 22 bp, Homo sapiens
agcctactgtctccttcccact

SEQ ID NO: 5360062 - DNA, 23 bp, Homo sapiens
agcctactgtctccttcccactg

SEQ ID NO: 5360063 - DNA, 15 bp, Homo sapiens
agcctagaggaggaa

SEQ ID NO: 5360064 - DNA, 15 bp, Homo sapiens
agcctagagtgaggg

SEQ ID NO: 5360065 - DNA, 15 bp, Homo sapiens
agcctagatgtttta

SEQ ID NO: 5360066 - DNA, 17 bp, Homo sapiens
agcctagcacagcagct

SEQ ID NO: 5360067 - DNA, 12 bp, Homo sapiens
agcctagccacc

SEQ ID NO: 5360068 - DNA, 13 bp, Homo sapiens
agcctagccacct

SEQ ID NO: 5360069 - DNA, 14 bp, Homo sapiens
agcctagccacctc

SEQ ID NO: 5360070 - DNA, 15 bp, Homo sapiens
agcctagccacctcc

SEQ ID NO: 5360071 - DNA, 20 bp, Homo sapiens
agcctagccgacctcagcct

SEQ ID NO: 5360072 - DNA, 13 bp, Homo sapiens
agcctagcggagc

SEQ ID NO: 5360073 - DNA, 20 bp, Homo sapiens
agcctagcggagcccagcct

SEQ ID NO: 5360074 - DNA, 22 bp, Homo sapiens
agcctagctaccttctctaccc

SEQ ID NO: 5360075 - DNA, 12 bp, Homo sapiens
agcctagctcct

SEQ ID NO: 5360076 - DNA, 19 bp, Homo sapiens
agcctaggaccactcagcc

SEQ ID NO: 5360077 - DNA, 21 bp, Homo sapiens
agcctaggacgccaacttctc

SEQ ID NO: 5360078 - DNA, 17 bp, Homo sapiens
agcctaggaggactggg

SEQ ID NO: 5360079 - DNA, 22 bp, Homo sapiens
agcctaggcaacaagagtgaaa

SEQ ID NO: 5360080 - DNA, 14 bp, Homo sapiens
agcctaggccgccc

SEQ ID NO: 5360081 - DNA, 18 bp, Homo sapiens
agcctagggtgagggtga

SEQ ID NO: 5360082 - DNA, 15 bp, Homo sapiens
agcctaggtgacaga

SEQ ID NO: 5360083 - DNA, 16 bp, Homo sapiens
agcctagtaggagctg

SEQ ID NO: 5360084 - DNA, 23 bp, Homo sapiens
agcctagtgaaggcttctctctg

SEQ ID NO: 5360085 - DNA, 15 bp, Homo sapiens
agcctagtggcttgt

SEQ ID NO: 5360086 - DNA, 17 bp, Homo sapiens
agcctagttcatccaat

SEQ ID NO: 5360087 - DNA, 23 bp, Homo sapiens
agcctagttcatccaatcctcac

SEQ ID NO: 5360088 - DNA, 17 bp, Homo sapiens
agcctatagtaaatgtg

SEQ ID NO: 5360089 - DNA, 18 bp, Homo sapiens
agcctatatttacagtga

SEQ ID NO: 5360090 - DNA, 19 bp, Homo sapiens
agcctatatttcctcttct

SEQ ID NO: 5360091 - DNA, 19 bp, Homo sapiens
agcctatcaaaggaaatga

SEQ ID NO: 5360092 - DNA, 19 bp, Homo sapiens
agcctatcaggtgcccctc

SEQ ID NO: 5360093 - DNA, 20 bp, Homo sapiens
agcctatgatattccccatt

SEQ ID NO: 5360094 - DNA, 11 bp, Homo sapiens
agcctatggca

SEQ ID NO: 5360095 - DNA, 16 bp, Homo sapiens
agcctatgtctggcag

SEQ ID NO: 5360096 - DNA, 16 bp, Homo sapiens
agcctatgttgtggtc

SEQ ID NO: 5360097 - DNA, 15 bp, Homo sapiens
agcctatttttatat

SEQ ID NO: 5360098 - DNA, 20 bp, Homo sapiens
agcctcaaaaacgccctcaa

SEQ ID NO: 5360099 - DNA, 21 bp, Homo sapiens
agcctcaaaaacgccctcaag

SEQ ID NO: 5360100 - DNA, 23 bp, Homo sapiens
agcctcaaagtcccttgagactc

SEQ ID NO: 5360101 - DNA, 20 bp, Homo sapiens
agcctcaacctccccggctc

SEQ ID NO: 5360102 - DNA, 15 bp, Homo sapiens
agcctcaacctcctg

SEQ ID NO: 5360103 - DNA, 16 bp, Homo sapiens
agcctcaactcactag

SEQ ID NO: 5360104 - DNA, 17 bp, Homo sapiens
agcctcaaggccctcgg

SEQ ID NO: 5360105 - DNA, 21 bp, Homo sapiens
agcctcaatttcctcatctgg

SEQ ID NO: 5360106 - DNA, 15 bp, Homo sapiens
agcctcaatttctga

SEQ ID NO: 5360107 - DNA, 22 bp, Homo sapiens
agcctcaattttggtttttctc

SEQ ID NO: 5360108 - DNA, 15 bp, Homo sapiens
agcctcacagaagaa

SEQ ID NO: 5360109 - DNA, 16 bp, Homo sapiens
agcctcacagatgctg

SEQ ID NO: 5360110 - DNA, 17 bp, Homo sapiens
agcctcacagatgctgg

SEQ ID NO: 5360111 - DNA, 22 bp, Homo sapiens
agcctcacagatgctggcctct

SEQ ID NO: 5360112 - DNA, 14 bp, Homo sapiens
agcctcacagcagt

SEQ ID NO: 5360113 - DNA, 22 bp, Homo sapiens
agcctcacagcagtgagactgg

SEQ ID NO: 5360114 - DNA, 12 bp, Homo sapiens
agcctcacccct

SEQ ID NO: 5360115 - DNA, 14 bp, Homo sapiens
agcctcacccctgc

SEQ ID NO: 5360116 - DNA, 18 bp, Homo sapiens
agcctcacccctgcaggc

SEQ ID NO: 5360117 - DNA, 20 bp, Homo sapiens
agcctcacccctgcccctgt

SEQ ID NO: 5360118 - DNA, 20 bp, Homo sapiens
agcctcacccggtgacctct

SEQ ID NO: 5360119 - DNA, 17 bp, Homo sapiens
agcctcaccctgcatag

SEQ ID NO: 5360120 - DNA, 14 bp, Homo sapiens
agcctcacccttgc

SEQ ID NO: 5360121 - DNA, 11 bp, Homo sapiens
agcctcacctt

SEQ ID NO: 5360122 - DNA, 23 bp, Homo sapiens
agcctcactattacttgaacttt

SEQ ID NO: 5360123 - DNA, 13 bp, Homo sapiens
agcctcactccat

SEQ ID NO: 5360124 - DNA, 21 bp, Homo sapiens
agcctcactccatttcccact

SEQ ID NO: 5360125 - DNA, 20 bp, Homo sapiens
agcctcacttcctttgccct

SEQ ID NO: 5360126 - DNA, 16 bp, Homo sapiens
agcctcacttgaatgt

SEQ ID NO: 5360127 - DNA, 17 bp, Homo sapiens
agcctcacttgaatgtg

SEQ ID NO: 5360128 - DNA, 23 bp, Homo sapiens
agcctcacttttaatgaacaaat

SEQ ID NO: 5360129 - DNA, 18 bp, Homo sapiens
agcctcagaaagggattg

SEQ ID NO: 5360130 - DNA, 12 bp, Homo sapiens
agcctcagaaga

SEQ ID NO: 5360131 - DNA, 13 bp, Homo sapiens
agcctcagaagaa

SEQ ID NO: 5360132 - DNA, 15 bp, Homo sapiens
agcctcagaagcctt

SEQ ID NO: 5360133 - DNA, 23 bp, Homo sapiens
agcctcagaagccttcttgctgc

SEQ ID NO: 5360134 - DNA, 20 bp, Homo sapiens
agcctcagaaggccccagag

SEQ ID NO: 5360135 - DNA, 23 bp, Homo sapiens
agcctcagaaggccccagagaga

SEQ ID NO: 5360136 - DNA, 18 bp, Homo sapiens
agcctcagaccccaggtc

SEQ ID NO: 5360137 - DNA, 20 bp, Homo sapiens
agcctcagagatctcccttc

SEQ ID NO: 5360138 - DNA, 21 bp, Homo sapiens
agcctcagagatctcccttct

SEQ ID NO: 5360139 - DNA, 23 bp, Homo sapiens
agcctcagagcatttaaggaaac

SEQ ID NO: 5360140 - DNA, 24 bp, Homo sapiens
agcctcagagcatttaaggaaact

SEQ ID NO: 5360141 - DNA, 21 bp, Homo sapiens
agcctcagaggccttgggagc

SEQ ID NO: 5360142 - DNA, 18 bp, Homo sapiens
agcctcagagtcctgccg

SEQ ID NO: 5360143 - DNA, 19 bp, Homo sapiens
agcctcagagtcctgccga

SEQ ID NO: 5360144 - DNA, 14 bp, Homo sapiens
agcctcagattcct

SEQ ID NO: 5360145 - DNA, 12 bp, Homo sapiens
agcctcagcagc

SEQ ID NO: 5360146 - DNA, 15 bp, Homo sapiens
agcctcagcagcaaa

SEQ ID NO: 5360147 - DNA, 14 bp, Homo sapiens
agcctcagcatcct

SEQ ID NO: 5360148 - DNA, 15 bp, Homo sapiens
agcctcagcatcctg

SEQ ID NO: 5360149 - DNA, 19 bp, Homo sapiens
agcctcagcatcctggcac

SEQ ID NO: 5360150 - DNA, 14 bp, Homo sapiens
agcctcagccacaa

SEQ ID NO: 5360151 - DNA, 19 bp, Homo sapiens
agcctcagcccaacttctt

SEQ ID NO: 5360152 - DNA, 16 bp, Homo sapiens
agcctcagctacccac

SEQ ID NO: 5360153 - DNA, 11 bp, Homo sapiens
agcctcagctc

SEQ ID NO: 5360154 - DNA, 12 bp, Homo sapiens
agcctcagctca

SEQ ID NO: 5360155 - DNA, 15 bp, Homo sapiens
agcctcagctcagcc

SEQ ID NO: 5360156 - DNA, 16 bp, Homo sapiens
agcctcaggactggga

SEQ ID NO: 5360157 - DNA, 18 bp, Homo sapiens
agcctcaggactgggagc

SEQ ID NO: 5360158 - DNA, 19 bp, Homo sapiens
agcctcaggactgggagcc

SEQ ID NO: 5360159 - DNA, 21 bp, Homo sapiens
agcctcaggactgggagcccc

SEQ ID NO: 5360160 - DNA, 23 bp, Homo sapiens
agcctcaggactgggagccccca

SEQ ID NO: 5360161 - DNA, 11 bp, Homo sapiens
agcctcaggcc

SEQ ID NO: 5360162 - DNA, 16 bp, Homo sapiens
agcctcaggcctggcc

SEQ ID NO: 5360163 - DNA, 19 bp, Homo sapiens
agcctcaggcctggccctt

SEQ ID NO: 5360164 - DNA, 12 bp, Homo sapiens
agcctcagggct

SEQ ID NO: 5360165 - DNA, 23 bp, Homo sapiens
agcctcagtccctccctcctggc

SEQ ID NO: 5360166 - DNA, 16 bp, Homo sapiens
agcctcagtcctcccc

SEQ ID NO: 5360167 - DNA, 17 bp, Homo sapiens
agcctcagtcctcccct

SEQ ID NO: 5360168 - DNA, 20 bp, Homo sapiens
agcctcagtctccctccctt

SEQ ID NO: 5360169 - DNA, 22 bp, Homo sapiens
agcctcagtctccctcccttgg

SEQ ID NO: 5360170 - DNA, 18 bp, Homo sapiens
agcctcagtgccacttga

SEQ ID NO: 5360171 - DNA, 17 bp, Homo sapiens
agcctcatactcctggg

SEQ ID NO: 5360172 - DNA, 15 bp, Homo sapiens
agcctcatcatcaga

SEQ ID NO: 5360173 - DNA, 17 bp, Homo sapiens
agcctcatcatcagagc

SEQ ID NO: 5360174 - DNA, 18 bp, Homo sapiens
agcctcatccgaggcagg

SEQ ID NO: 5360175 - DNA, 20 bp, Homo sapiens
agcctcatcctccccaggac

SEQ ID NO: 5360176 - DNA, 21 bp, Homo sapiens
agcctcatcctccccaggacc

SEQ ID NO: 5360177 - DNA, 19 bp, Homo sapiens
agcctcatgggagtcaggg

SEQ ID NO: 5360178 - DNA, 15 bp, Homo sapiens
agcctcatgttctct

SEQ ID NO: 5360179 - DNA, 17 bp, Homo sapiens
agcctcatgttctcttc

SEQ ID NO: 5360180 - DNA, 22 bp, Homo sapiens
agcctgcccaagcccaggccac

SEQ ID NO: 5360181 - DNA, 14 bp, Homo sapiens
agcctgcccacctc

SEQ ID NO: 5360182 - DNA, 16 bp, Homo sapiens
agcctgcccacctctc

SEQ ID NO: 5360183 - DNA, 20 bp, Homo sapiens
agcctgcccacctctccctg

SEQ ID NO: 5360184 - DNA, 22 bp, Homo sapiens
agcctgcccacctctccctgca

SEQ ID NO: 5360185 - DNA, 18 bp, Homo sapiens
agcctgccccagcgctga

SEQ ID NO: 5360186 - DNA, 20 bp, Homo sapiens
agcctgccccagctgggctg

SEQ ID NO: 5360187 - DNA, 20 bp, Homo sapiens
agcctgccccggccactctg

SEQ ID NO: 5360188 - DNA, 21 bp, Homo sapiens
agcctgccccggccactctgt

SEQ ID NO: 5360189 - DNA, 21 bp, Homo sapiens
agcctgcccgctgcaatgcct

SEQ ID NO: 5360190 - DNA, 21 bp, Homo sapiens
agcctgccctcactccctctg

SEQ ID NO: 5360191 - DNA, 18 bp, Homo sapiens
agcctgccctccagctgc

SEQ ID NO: 5360192 - DNA, 17 bp, Homo sapiens
agcctgcccttgtctga

SEQ ID NO: 5360193 - DNA, 17 bp, Homo sapiens
agcctgcctaaccaggc

SEQ ID NO: 5360194 - DNA, 19 bp, Homo sapiens
agcctgcctaaccaggccc

SEQ ID NO: 5360195 - DNA, 20 bp, Homo sapiens
agcctgcctaaccaggccca

SEQ ID NO: 5360196 - DNA, 19 bp, Homo sapiens
agcctgcctcagtggcagc

SEQ ID NO: 5360197 - DNA, 19 bp, Homo sapiens
agcctgcctcttctctact

SEQ ID NO: 5360198 - DNA, 12 bp, Homo sapiens
agcctgcctgaa

SEQ ID NO: 5360199 - DNA, 14 bp, Homo sapiens
agcctgcctggagc

SEQ ID NO: 5360200 - DNA, 14 bp, Homo sapiens
agcctgcctgggag

SEQ ID NO: 5360201 - DNA, 15 bp, Homo sapiens
agcctgccttgccca

SEQ ID NO: 5360202 - DNA, 18 bp, Homo sapiens
agcctgcgcctgctgcat

SEQ ID NO: 5360203 - DNA, 20 bp, Homo sapiens
agcctgcgcctgctgcatgc

SEQ ID NO: 5360204 - DNA, 16 bp, Homo sapiens
agcctgcgctcggcag

SEQ ID NO: 5360205 - DNA, 18 bp, Homo sapiens
agcctgcgctcggcagga

SEQ ID NO: 5360206 - DNA, 21 bp, Homo sapiens
agcctgcggctgccgggcggg

SEQ ID NO: 5360207 - DNA, 14 bp, Homo sapiens
agcctgcggctgct

SEQ ID NO: 5360208 - DNA, 15 bp, Homo sapiens
agcctgcggctgctg

SEQ ID NO: 5360209 - DNA, 17 bp, Homo sapiens
agcctgcggctgctggc

SEQ ID NO: 5360210 - DNA, 20 bp, Homo sapiens
agcctgcggctgctggcaca

SEQ ID NO: 5360211 - DNA, 16 bp, Homo sapiens
agcctgcgggaagctg

SEQ ID NO: 5360212 - DNA, 22 bp, Homo sapiens
agcctgcgggaagctgaccttt

SEQ ID NO: 5360213 - DNA, 18 bp, Homo sapiens
agcctgcggggcagcagg

SEQ ID NO: 5360214 - DNA, 15 bp, Homo sapiens
agcctgcgtggctga

SEQ ID NO: 5360215 - DNA, 16 bp, Homo sapiens
agcctgcgtggctgac

SEQ ID NO: 5360216 - DNA, 19 bp, Homo sapiens
agcctgcgtggctgacccc

SEQ ID NO: 5360217 - DNA, 14 bp, Homo sapiens
agcctgctaaggaa

SEQ ID NO: 5360218 - DNA, 21 bp, Homo sapiens
agcctgctaaggaacaatgcc

SEQ ID NO: 5360219 - DNA, 13 bp, Homo sapiens
agcctgctagcta

SEQ ID NO: 5360220 - DNA, 17 bp, Homo sapiens
agcctgctagctagctc

SEQ ID NO: 5360221 - DNA, 16 bp, Homo sapiens
agcctgctccagctgt

SEQ ID NO: 5360222 - DNA, 17 bp, Homo sapiens
agcctgctccagctgtt

SEQ ID NO: 5360223 - DNA, 19 bp, Homo sapiens
agcctgctccagctgttca

SEQ ID NO: 5360224 - DNA, 21 bp, Homo sapiens
agcctgctcccccaccccctc

SEQ ID NO: 5360225 - DNA, 11 bp, Homo sapiens
agcctgctcct

SEQ ID NO: 5360226 - DNA, 14 bp, Homo sapiens
agcctgctccttcc

SEQ ID NO: 5360227 - DNA, 15 bp, Homo sapiens
agcctgctctcccta

SEQ ID NO: 5360228 - DNA, 14 bp, Homo sapiens
agcctgctctgcca

SEQ ID NO: 5360229 - DNA, 15 bp, Homo sapiens
agcctgctctgccac

SEQ ID NO: 5360230 - DNA, 17 bp, Homo sapiens
agcctgctctttgaact

SEQ ID NO: 5360231 - DNA, 18 bp, Homo sapiens
agcctgctgacagacact

SEQ ID NO: 5360232 - DNA, 12 bp, Homo sapiens
agcctgctgatt

SEQ ID NO: 5360233 - DNA, 17 bp, Homo sapiens
agcctgctgctctcagg

SEQ ID NO: 5360234 - DNA, 18 bp, Homo sapiens
agcctgctggcacccacc

SEQ ID NO: 5360235 - DNA, 13 bp, Homo sapiens
agcctgctggcag

SEQ ID NO: 5360236 - DNA, 17 bp, Homo sapiens
agcctgctggcagggcc

SEQ ID NO: 5360237 - DNA, 18 bp, Homo sapiens
agcctgctggcagggcca

SEQ ID NO: 5360238 - DNA, 23 bp, Homo sapiens
agcctgctggcagggccagggca

SEQ ID NO: 5360239 - DNA, 12 bp, Homo sapiens
agcctgctggct

SEQ ID NO: 5360240 - DNA, 15 bp, Homo sapiens
agcctgctggctgcg

SEQ ID NO: 5360241 - DNA, 19 bp, Homo sapiens
agcctgctggctgcggccc

SEQ ID NO: 5360242 - DNA, 13 bp, Homo sapiens
agcctgctggggc

SEQ ID NO: 5360243 - DNA, 14 bp, Homo sapiens
agcctgctggggct

SEQ ID NO: 5360244 - DNA, 17 bp, Homo sapiens
agcctgctggggctaag

SEQ ID NO: 5360245 - DNA, 14 bp, Homo sapiens
agcctgctgtgggg

SEQ ID NO: 5360246 - DNA, 14 bp, Homo sapiens
agcctgctgtgtcc

SEQ ID NO: 5360247 - DNA, 23 bp, Homo sapiens
agcctgctgtgtccttcctccac

SEQ ID NO: 5360248 - DNA, 16 bp, Homo sapiens
agcctgcttcccacaa

SEQ ID NO: 5360249 - DNA, 18 bp, Homo sapiens
agcctgcttcccacaact

SEQ ID NO: 5360250 - DNA, 23 bp, Homo sapiens
agcctgcttgggcgctcggtctc

SEQ ID NO: 5360251 - DNA, 21 bp, Homo sapiens
agcctgctttggcctttcctt

SEQ ID NO: 5360252 - DNA, 14 bp, Homo sapiens
agcctggaagcact

SEQ ID NO: 5360253 - DNA, 14 bp, Homo sapiens
agcctggaagccat

SEQ ID NO: 5360254 - DNA, 24 bp, Homo sapiens
agcctggaaggtggaagttgcagt

SEQ ID NO: 5360255 - DNA, 16 bp, Homo sapiens
agcctggaccactcct

SEQ ID NO: 5360256 - DNA, 19 bp, Homo sapiens
agcctggaccactcctcat

SEQ ID NO: 5360257 - DNA, 15 bp, Homo sapiens
agcctggacctctga

SEQ ID NO: 5360258 - DNA, 16 bp, Homo sapiens
agcctggacctctgac

SEQ ID NO: 5360259 - DNA, 18 bp, Homo sapiens
agcctggacctctgacag

SEQ ID NO: 5360260 - DNA, 23 bp, Homo sapiens
agcctggactctaagctggagct

SEQ ID NO: 5360261 - DNA, 18 bp, Homo sapiens
agcctggactctgcccca

SEQ ID NO: 5360262 - DNA, 19 bp, Homo sapiens
agcctggagacccacccca

SEQ ID NO: 5360263 - DNA, 24 bp, Homo sapiens
agcctggagacccaccccacctgc

SEQ ID NO: 5360264 - DNA, 17 bp, Homo sapiens
agcctggagaggcctgg

SEQ ID NO: 5360265 - DNA, 18 bp, Homo sapiens
agcctggagaggcctggg

SEQ ID NO: 5360266 - DNA, 13 bp, Homo sapiens
agcctggagcccc

SEQ ID NO: 5360267 - DNA, 14 bp, Homo sapiens
agcctggagcccct

SEQ ID NO: 5360268 - DNA, 15 bp, Homo sapiens
agcctggagcccctg

SEQ ID NO: 5360269 - DNA, 20 bp, Homo sapiens
agcctggagcccctgtgtgg

SEQ ID NO: 5360270 - DNA, 17 bp, Homo sapiens
agcctggagccctggag

SEQ ID NO: 5360271 - DNA, 22 bp, Homo sapiens
agcctggagcggagcttgcctg

SEQ ID NO: 5360272 - DNA, 16 bp, Homo sapiens
agcctggagctttcct

SEQ ID NO: 5360273 - DNA, 23 bp, Homo sapiens
agcctggaggccgggtgctcagg

SEQ ID NO: 5360274 - DNA, 17 bp, Homo sapiens
agcctggagtaggcctg

SEQ ID NO: 5360275 - DNA, 20 bp, Homo sapiens
agcctggatagccttgaaaa

SEQ ID NO: 5360276 - DNA, 21 bp, Homo sapiens
agcctggatagccttgaaaac

SEQ ID NO: 5360277 - DNA, 10 bp, Homo sapiens
agcctggatg

SEQ ID NO: 5360278 - DNA, 11 bp, Homo sapiens
agcctggatgc

SEQ ID NO: 5360279 - DNA, 13 bp, Homo sapiens
agcctggatgcca

SEQ ID NO: 5360280 - DNA, 15 bp, Homo sapiens
agcctggatgccatc

SEQ ID NO: 5360281 - DNA, 15 bp, Homo sapiens
agcctggatggcccc

SEQ ID NO: 5360282 - DNA, 17 bp, Homo sapiens
agcctggcaacagagca

SEQ ID NO: 5360283 - DNA, 18 bp, Homo sapiens
agcctggcaacagagcga

SEQ ID NO: 5360284 - DNA, 13 bp, Homo sapiens
agcctggcacagg

SEQ ID NO: 5360285 - DNA, 17 bp, Homo sapiens
agcctggcacagggcag

SEQ ID NO: 5360286 - DNA, 16 bp, Homo sapiens
agcctggcacccaccg

SEQ ID NO: 5360287 - DNA, 11 bp, Homo sapiens
agcctggcagg

SEQ ID NO: 5360288 - DNA, 15 bp, Homo sapiens
agcctggcaggggat

SEQ ID NO: 5360289 - DNA, 17 bp, Homo sapiens
agcctggcaggtcccct

SEQ ID NO: 5360290 - DNA, 23 bp, Homo sapiens
agcctggcatcagtttaggcctt

SEQ ID NO: 5360291 - DNA, 12 bp, Homo sapiens
agcctggccacc

SEQ ID NO: 5360292 - DNA, 14 bp, Homo sapiens
agcctggccaccag

SEQ ID NO: 5360293 - DNA, 13 bp, Homo sapiens
agcctggccagac

SEQ ID NO: 5360294 - DNA, 15 bp, Homo sapiens
agcctggccagacac

SEQ ID NO: 5360295 - DNA, 12 bp, Homo sapiens
agcctggccagg

SEQ ID NO: 5360296 - DNA, 17 bp, Homo sapiens
agcctggccaggcaggg

SEQ ID NO: 5360297 - DNA, 20 bp, Homo sapiens
agcctggccaggcagggaga

SEQ ID NO: 5360298 - DNA, 15 bp, Homo sapiens
agcctggccatcccc

SEQ ID NO: 5360299 - DNA, 18 bp, Homo sapiens
agcctggccatgtcctca

SEQ ID NO: 5360300 - DNA, 12 bp, Homo sapiens
agcctggcccag

SEQ ID NO: 5360301 - DNA, 14 bp, Homo sapiens
agcctggcccagct

SEQ ID NO: 5360302 - DNA, 16 bp, Homo sapiens
agcctggcccagctcc

SEQ ID NO: 5360303 - DNA, 18 bp, Homo sapiens
agcctggccccaaatgtt

SEQ ID NO: 5360304 - DNA, 14 bp, Homo sapiens
agcctggccccaag

SEQ ID NO: 5360305 - DNA, 13 bp, Homo sapiens
agcctggccccag

SEQ ID NO: 5360306 - DNA, 16 bp, Homo sapiens
agcctggccccatggt

SEQ ID NO: 5360307 - DNA, 16 bp, Homo sapiens
agcctggccctgaagc

SEQ ID NO: 5360308 - DNA, 23 bp, Homo sapiens
agcctggccggttaacatctttt

SEQ ID NO: 5360309 - DNA, 15 bp, Homo sapiens
agcctggcctcctgc

SEQ ID NO: 5360310 - DNA, 17 bp, Homo sapiens
agcctggcctcctgcct

SEQ ID NO: 5360311 - DNA, 12 bp, Homo sapiens
agcctggcctgc

SEQ ID NO: 5360312 - DNA, 23 bp, Homo sapiens
agcctggcctgtggctgccctcc

SEQ ID NO: 5360313 - DNA, 15 bp, Homo sapiens
agcctggcggggcag

SEQ ID NO: 5360314 - DNA, 19 bp, Homo sapiens
agcctggcggggcaggagg

SEQ ID NO: 5360315 - DNA, 22 bp, Homo sapiens
agcctggcggggcaggaggcct

SEQ ID NO: 5360316 - DNA, 20 bp, Homo sapiens
agcctggctcccacaggcag

SEQ ID NO: 5360317 - DNA, 17 bp, Homo sapiens
agcctggctcccaggac

SEQ ID NO: 5360318 - DNA, 18 bp, Homo sapiens
agcctggctcccaggaca

SEQ ID NO: 5360319 - DNA, 17 bp, Homo sapiens
agcctggctctgccccg

SEQ ID NO: 5360320 - DNA, 12 bp, Homo sapiens
agcctggctctt

SEQ ID NO: 5360321 - DNA, 15 bp, Homo sapiens
agcctggctggtcct

SEQ ID NO: 5360322 - DNA, 11 bp, Homo sapiens
agcctggctgt

SEQ ID NO: 5360323 - DNA, 17 bp, Homo sapiens
agcctggcttagaaggc

SEQ ID NO: 5360324 - DNA, 19 bp, Homo sapiens
agcctggcttagaaggcac

SEQ ID NO: 5360325 - DNA, 18 bp, Homo sapiens
agcctggcttcaaattgt

SEQ ID NO: 5360326 - DNA, 12 bp, Homo sapiens
agcctggcttct

SEQ ID NO: 5360327 - DNA, 21 bp, Homo sapiens
agcctggcttctggagccctt

SEQ ID NO: 5360328 - DNA, 19 bp, Homo sapiens
agcctggcttcttatcctt

SEQ ID NO: 5360329 - DNA, 16 bp, Homo sapiens
agcctggcttttctgg

SEQ ID NO: 5360330 - DNA, 20 bp, Homo sapiens
agcctggcttttctggctgg

SEQ ID NO: 5360331 - DNA, 22 bp, Homo sapiens
agcctggcttttctggctgggg

SEQ ID NO: 5360332 - DNA, 19 bp, Homo sapiens
agcctgggaaagcccctgc

SEQ ID NO: 5360333 - DNA, 15 bp, Homo sapiens
agcctgggacacaca

SEQ ID NO: 5360334 - DNA, 17 bp, Homo sapiens
agcctgggaccagggca

SEQ ID NO: 5360335 - DNA, 16 bp, Homo sapiens
agcctgggactcccag

SEQ ID NO: 5360336 - DNA, 19 bp, Homo sapiens
agcctgggactcccagtga

SEQ ID NO: 5360337 - DNA, 17 bp, Homo sapiens
agcctgggagcccagag

SEQ ID NO: 5360338 - DNA, 12 bp, Homo sapiens
agcctgggaggt

SEQ ID NO: 5360339 - DNA, 22 bp, Homo sapiens
agcctgggataggggcagagga

SEQ ID NO: 5360340 - DNA, 21 bp, Homo sapiens
agcctgggcaacagagcaaga

SEQ ID NO: 5360341 - DNA, 23 bp, Homo sapiens
agcctgggcaacgagtgaaactc

SEQ ID NO: 5360342 - DNA, 18 bp, Homo sapiens
agcctgggcaatgtgata

SEQ ID NO: 5360343 - DNA, 21 bp, Homo sapiens
agcctgggcagaaatgtgctg

SEQ ID NO: 5360344 - DNA, 17 bp, Homo sapiens
agcctgggcagcatagc

SEQ ID NO: 5360345 - DNA, 17 bp, Homo sapiens
agcctgggcagccaggc

SEQ ID NO: 5360346 - DNA, 21 bp, Homo sapiens
agcctgggcagccaggctgcc

SEQ ID NO: 5360347 - DNA, 17 bp, Homo sapiens
agcctgggccactggca

SEQ ID NO: 5360348 - DNA, 19 bp, Homo sapiens
agcctgggccactggcatc

SEQ ID NO: 5360349 - DNA, 23 bp, Homo sapiens
agcctgggccactggcatctctg

SEQ ID NO: 5360350 - DNA, 13 bp, Homo sapiens
agcctgggccagg

SEQ ID NO: 5360351 - DNA, 14 bp, Homo sapiens
agcctgggccagga

SEQ ID NO: 5360352 - DNA, 19 bp, Homo sapiens
agcctgggcccatctccct

SEQ ID NO: 5360353 - DNA, 20 bp, Homo sapiens
agcctgggcccatctccctg

SEQ ID NO: 5360354 - DNA, 22 bp, Homo sapiens
agcctgggcccatctccctgct

SEQ ID NO: 5360355 - DNA, 14 bp, Homo sapiens
agcctgggcccctc

SEQ ID NO: 5360356 - DNA, 12 bp, Homo sapiens
agcctgggccta

SEQ ID NO: 5360357 - DNA, 19 bp, Homo sapiens
agcctgggcctatggagag

SEQ ID NO: 5360358 - DNA, 22 bp, Homo sapiens
agcctgggcctatggagagccc

SEQ ID NO: 5360359 - DNA, 17 bp, Homo sapiens
agcctttggtgaataac

SEQ ID NO: 5360360 - DNA, 11 bp, Homo sapiens
agcctttgtag

SEQ ID NO: 5360361 - DNA, 12 bp, Homo sapiens
agcctttgtagg

SEQ ID NO: 5360362 - DNA, 15 bp, Homo sapiens
agcctttgtatcttt

SEQ ID NO: 5360363 - DNA, 22 bp, Homo sapiens
agcctttgtcactagtctttga

SEQ ID NO: 5360364 - DNA, 22 bp, Homo sapiens
agcctttgttccccactggagc

SEQ ID NO: 5360365 - DNA, 23 bp, Homo sapiens
agcctttgttccccactggagca

SEQ ID NO: 5360366 - DNA, 13 bp, Homo sapiens
agccttttaaatc

SEQ ID NO: 5360367 - DNA, 15 bp, Homo sapiens
agccttttaactgtg

SEQ ID NO: 5360368 - DNA, 17 bp, Homo sapiens
agccttttatactgatt

SEQ ID NO: 5360369 - DNA, 19 bp, Homo sapiens
agccttttatctgcagaac

SEQ ID NO: 5360370 - DNA, 23 bp, Homo sapiens
agccttttatgtattttccaagt

SEQ ID NO: 5360371 - DNA, 14 bp, Homo sapiens
agccttttcagcag

SEQ ID NO: 5360372 - DNA, 24 bp, Homo sapiens
agccttttcagcaggttccagtgc

SEQ ID NO: 5360373 - DNA, 16 bp, Homo sapiens
agccttttccataaag

SEQ ID NO: 5360374 - DNA, 18 bp, Homo sapiens
agccttttccctctttgg

SEQ ID NO: 5360375 - DNA, 13 bp, Homo sapiens
agccttttcttat

SEQ ID NO: 5360376 - DNA, 18 bp, Homo sapiens
agccttttgctttatgct

SEQ ID NO: 5360377 - DNA, 23 bp, Homo sapiens
agccttttgtttcccttgctttg

SEQ ID NO: 5360378 - DNA, 22 bp, Homo sapiens
agcctttttaaaacacatgttt

SEQ ID NO: 5360379 - DNA, 12 bp, Homo sapiens
agcctttttcac

SEQ ID NO: 5360380 - DNA, 16 bp, Homo sapiens
agccttttttccccag

SEQ ID NO: 5360381 - DNA, 17 bp, Homo sapiens
agccttttttccccaga

SEQ ID NO: 5360382 - DNA, 19 bp, Homo sapiens
agccttttttccccagact

SEQ ID NO: 5360383 - DNA, 23 bp, Homo sapiens
agcgaaaaaatcaggtggctttt

SEQ ID NO: 5360384 - DNA, 17 bp, Homo sapiens
agcgaaataaaaatggc

SEQ ID NO: 5360385 - DNA, 18 bp, Homo sapiens
agcgaaataaaaatggca

SEQ ID NO: 5360386 - DNA, 15 bp, Homo sapiens
agcgaaattgtcttt

SEQ ID NO: 5360387 - DNA, 15 bp, Homo sapiens
agcgaacatcttcat

SEQ ID NO: 5360388 - DNA, 18 bp, Homo sapiens
agcgaacatgcctgattt

SEQ ID NO: 5360389 - DNA, 22 bp, Homo sapiens
agcgaacatgcctgattttaaa

SEQ ID NO: 5360390 - DNA, 21 bp, Homo sapiens
agcgaacgtatttctccagac

SEQ ID NO: 5360391 - DNA, 22 bp, Homo sapiens
agcgaacgtatttctccagacc

SEQ ID NO: 5360392 - DNA, 16 bp, Homo sapiens
agcgaactagaagaaa

SEQ ID NO: 5360393 - DNA, 13 bp, Homo sapiens
agcgaactgacat

SEQ ID NO: 5360394 - DNA, 16 bp, Homo sapiens
agcgaactgcactgct

SEQ ID NO: 5360395 - DNA, 22 bp, Homo sapiens
agcgaacttcacataggaaggg

SEQ ID NO: 5360396 - DNA, 14 bp, Homo sapiens
agcgaagcagagag

SEQ ID NO: 5360397 - DNA, 20 bp, Homo sapiens
agcgaagtctcatgggaagc

SEQ ID NO: 5360398 - DNA, 19 bp, Homo sapiens
agcgaagtctttgccttct

SEQ ID NO: 5360399 - DNA, 13 bp, Homo sapiens
agcgaattttaaa

SEQ ID NO: 5360400 - DNA, 16 bp, Homo sapiens
agcgaattttaaaaga

SEQ ID NO: 5360401 - DNA, 14 bp, Homo sapiens
agcgacaaagatga

SEQ ID NO: 5360402 - DNA, 15 bp, Homo sapiens
agcgacaaagatgat

SEQ ID NO: 5360403 - DNA, 15 bp, Homo sapiens
agcgacacaggctgc

SEQ ID NO: 5360404 - DNA, 18 bp, Homo sapiens
agcgacacaggctgccgc

SEQ ID NO: 5360405 - DNA, 19 bp, Homo sapiens
agcgacacaggctgccgct

SEQ ID NO: 5360406 - DNA, 17 bp, Homo sapiens
agcgacacttgaatgta

SEQ ID NO: 5360407 - DNA, 13 bp, Homo sapiens
agcgacagagcag

SEQ ID NO: 5360408 - DNA, 18 bp, Homo sapiens
agcgacagcattttaagg

SEQ ID NO: 5360409 - DNA, 13 bp, Homo sapiens
agcgacagtgaga

SEQ ID NO: 5360410 - DNA, 23 bp, Homo sapiens
agcgacagtgtgggacctgcccc

SEQ ID NO: 5360411 - DNA, 19 bp, Homo sapiens
agcgacatagcccatccct

SEQ ID NO: 5360412 - DNA, 21 bp, Homo sapiens
agcgacatcccagtagtgttt

SEQ ID NO: 5360413 - DNA, 17 bp, Homo sapiens
agcgacatctctgactt

SEQ ID NO: 5360414 - DNA, 20 bp, Homo sapiens
agcgacatctctgactttct

SEQ ID NO: 5360415 - DNA, 17 bp, Homo sapiens
agcgaccacccctgcct

SEQ ID NO: 5360416 - DNA, 21 bp, Homo sapiens
agcgaccacccctgcctccac

SEQ ID NO: 5360417 - DNA, 22 bp, Homo sapiens
agcgaccagcaggctcctcagc

SEQ ID NO: 5360418 - DNA, 13 bp, Homo sapiens
agcgaccccagac

SEQ ID NO: 5360419 - DNA, 14 bp, Homo sapiens
agcgaccctggctc

SEQ ID NO: 5360420 - DNA, 14 bp, Homo sapiens
agcgaccgccccct

SEQ ID NO: 5360421 - DNA, 16 bp, Homo sapiens
agcgaccgccccctcc

SEQ ID NO: 5360422 - DNA, 17 bp, Homo sapiens
agcgaccgccccctcct

SEQ ID NO: 5360423 - DNA, 21 bp, Homo sapiens
agcgacctaaacagctgcttt

SEQ ID NO: 5360424 - DNA, 19 bp, Homo sapiens
agcgacctcaagtgtcctg

SEQ ID NO: 5360425 - DNA, 18 bp, Homo sapiens
agcgacctctctgcctct

SEQ ID NO: 5360426 - DNA, 17 bp, Homo sapiens
agcgacggctcctcccc

SEQ ID NO: 5360427 - DNA, 19 bp, Homo sapiens
agcgacggctcctccccga

SEQ ID NO: 5360428 - DNA, 12 bp, Homo sapiens
agcgactaaact

SEQ ID NO: 5360429 - DNA, 13 bp, Homo sapiens
agcgactcccagc

SEQ ID NO: 5360430 - DNA, 19 bp, Homo sapiens
agcgactccgttggccact

SEQ ID NO: 5360431 - DNA, 21 bp, Homo sapiens
agcgactccgttggccactcc

SEQ ID NO: 5360432 - DNA, 15 bp, Homo sapiens
agcgactggatgctc

SEQ ID NO: 5360433 - DNA, 21 bp, Homo sapiens
agcgacttttgttctcttctg

SEQ ID NO: 5360434 - DNA, 19 bp, Homo sapiens
agcgagaaccaggctgctg

SEQ ID NO: 5360435 - DNA, 15 bp, Homo sapiens
agcgagactccatct

SEQ ID NO: 5360436 - DNA, 15 bp, Homo sapiens
agcgagagagtttca

SEQ ID NO: 5360437 - DNA, 15 bp, Homo sapiens
agcgagaggcagcaa

SEQ ID NO: 5360438 - DNA, 14 bp, Homo sapiens
agcgagcacagtat

SEQ ID NO: 5360439 - DNA, 15 bp, Homo sapiens
agcgagcatccccca

SEQ ID NO: 5360440 - DNA, 16 bp, Homo sapiens
agcgagccacaggaac

SEQ ID NO: 5360441 - DNA, 14 bp, Homo sapiens
agcgagcccagagt

SEQ ID NO: 5360442 - DNA, 14 bp, Homo sapiens
agcgagcctggcag

SEQ ID NO: 5360443 - DNA, 13 bp, Homo sapiens
agcgagcctgtgc

SEQ ID NO: 5360444 - DNA, 15 bp, Homo sapiens
agcgagcctgtgcct

SEQ ID NO: 5360445 - DNA, 12 bp, Homo sapiens
agcgaggaaaaa

SEQ ID NO: 5360446 - DNA, 16 bp, Homo sapiens
agcgaggaaaaacaac

SEQ ID NO: 5360447 - DNA, 21 bp, Homo sapiens
agcgaggaaaaacaacaaata

SEQ ID NO: 5360448 - DNA, 13 bp, Homo sapiens
agcgaggaaagga

SEQ ID NO: 5360449 - DNA, 19 bp, Homo sapiens
agcgaggaggcgcggcctc

SEQ ID NO: 5360450 - DNA, 23 bp, Homo sapiens
agcgaggcacccttactggctta

SEQ ID NO: 5360451 - DNA, 24 bp, Homo sapiens
agcgaggctgagcctacagatgaa

SEQ ID NO: 5360452 - DNA, 15 bp, Homo sapiens
agcgaggctgggctg

SEQ ID NO: 5360453 - DNA, 14 bp, Homo sapiens
agcgagggcagctg

SEQ ID NO: 5360454 - DNA, 14 bp, Homo sapiens
agcgaggtcagagg

SEQ ID NO: 5360455 - DNA, 21 bp, Homo sapiens
agcgaggtgggagaggcctca

SEQ ID NO: 5360456 - DNA, 12 bp, Homo sapiens
agcgagtaaagt

SEQ ID NO: 5360457 - DNA, 13 bp, Homo sapiens
agcgagtcatttc

SEQ ID NO: 5360458 - DNA, 15 bp, Homo sapiens
agcgagtctggagac

SEQ ID NO: 5360459 - DNA, 17 bp, Homo sapiens
agcgagtctggagacca

SEQ ID NO: 5360460 - DNA, 21 bp, Homo sapiens
agcgagtctggagaccaggac

SEQ ID NO: 5360461 - DNA, 17 bp, Homo sapiens
agcgagtgacagaaggc

SEQ ID NO: 5360462 - DNA, 14 bp, Homo sapiens
agcgagtgctctca

SEQ ID NO: 5360463 - DNA, 22 bp, Homo sapiens
agcgagtggagtctgccaccca

SEQ ID NO: 5360464 - DNA, 15 bp, Homo sapiens
agcgagtggatgctg

SEQ ID NO: 5360465 - DNA, 21 bp, Homo sapiens
agcgagttgtggaaagcctct

SEQ ID NO: 5360466 - DNA, 20 bp, Homo sapiens
agcgatatacagatgaaaat

SEQ ID NO: 5360467 - DNA, 16 bp, Homo sapiens
agcgatccaggggaag

SEQ ID NO: 5360468 - DNA, 19 bp, Homo sapiens
agcgatctctccactgtgc

SEQ ID NO: 5360469 - DNA, 18 bp, Homo sapiens
agcgatggcaggcctgac

SEQ ID NO: 5360470 - DNA, 16 bp, Homo sapiens
agcgatgtatgcagct

SEQ ID NO: 5360471 - DNA, 18 bp, Homo sapiens
agcgatgtatgcagctat

SEQ ID NO: 5360472 - DNA, 20 bp, Homo sapiens
agcgatgtgcaggaagaaaa

SEQ ID NO: 5360473 - DNA, 23 bp, Homo sapiens
agcgattattatctaaagtgtgt

SEQ ID NO: 5360474 - DNA, 22 bp, Homo sapiens
agcgattattgatcaaaatcaa

SEQ ID NO: 5360475 - DNA, 20 bp, Homo sapiens
agcgattccctctcccaggc

SEQ ID NO: 5360476 - DNA, 19 bp, Homo sapiens
agcgattcctgccaagtag

SEQ ID NO: 5360477 - DNA, 21 bp, Homo sapiens
agcgattctcctgcctcagcc

SEQ ID NO: 5360478 - DNA, 15 bp, Homo sapiens
agcgattctcctgtc

SEQ ID NO: 5360479 - DNA, 16 bp, Homo sapiens
agcgattctcctgtct

SEQ ID NO: 5360480 - DNA, 19 bp, Homo sapiens
agcgattcttgtgcctcag

SEQ ID NO: 5360481 - DNA, 20 bp, Homo sapiens
agcgattcttgtgcctcagc

SEQ ID NO: 5360482 - DNA, 18 bp, Homo sapiens
agcgattcttgtgcctcg

SEQ ID NO: 5360483 - DNA, 20 bp, Homo sapiens
agcgattgattgatgtacag

SEQ ID NO: 5360484 - DNA, 14 bp, Homo sapiens
agcgatttgaaaca

SEQ ID NO: 5360485 - DNA, 22 bp, Homo sapiens
agcgcaaagtgctagccactgg

SEQ ID NO: 5360486 - DNA, 19 bp, Homo sapiens
agcgcaagccacagcctgt

SEQ ID NO: 5360487 - DNA, 14 bp, Homo sapiens
agcgcaaggcactt

SEQ ID NO: 5360488 - DNA, 14 bp, Homo sapiens
agcgcactcttcat

SEQ ID NO: 5360489 - DNA, 23 bp, Homo sapiens
agcgcacttgatggtcaggaagt

SEQ ID NO: 5360490 - DNA, 16 bp, Homo sapiens
agcgcagagcgggctc

SEQ ID NO: 5360491 - DNA, 16 bp, Homo sapiens
agcgcagcagagatgg

SEQ ID NO: 5360492 - DNA, 16 bp, Homo sapiens
agcgcagcccccacgc

SEQ ID NO: 5360493 - DNA, 19 bp, Homo sapiens
agcgcagccgagccccagg

SEQ ID NO: 5360494 - DNA, 22 bp, Homo sapiens
agcgcagccgagccccaggagc

SEQ ID NO: 5360495 - DNA, 20 bp, Homo sapiens
agcgcagcgcctccaccctg

SEQ ID NO: 5360496 - DNA, 14 bp, Homo sapiens
agcgcaggctgcag

SEQ ID NO: 5360497 - DNA, 15 bp, Homo sapiens
agcgcaggctgcaga

SEQ ID NO: 5360498 - DNA, 17 bp, Homo sapiens
agcgcaggctgcagagc

SEQ ID NO: 5360499 - DNA, 19 bp, Homo sapiens
agcgcaggctgcagagccc

SEQ ID NO: 5360500 - DNA, 23 bp, Homo sapiens
agcgcagggaggatgccacagcc

SEQ ID NO: 5360501 - DNA, 13 bp, Homo sapiens
agcgcagggctgg

SEQ ID NO: 5360502 - DNA, 17 bp, Homo sapiens
agcgcagggctggcacg

SEQ ID NO: 5360503 - DNA, 19 bp, Homo sapiens
agcgcaggtttagtttact

SEQ ID NO: 5360504 - DNA, 23 bp, Homo sapiens
agcgcagttttttttttcttgtc

SEQ ID NO: 5360505 - DNA, 15 bp, Homo sapiens
agcgcatggcgcccc

SEQ ID NO: 5360506 - DNA, 19 bp, Homo sapiens
agcgcatggcgccccgggc

SEQ ID NO: 5360507 - DNA, 22 bp, Homo sapiens
agcgcatggcgccccgggccgc

SEQ ID NO: 5360508 - DNA, 18 bp, Homo sapiens
agcgcattgttttgcatc

SEQ ID NO: 5360509 - DNA, 16 bp, Homo sapiens
agcgccaagcaacctg

SEQ ID NO: 5360510 - DNA, 15 bp, Homo sapiens
agcgccaagtgcgtg

SEQ ID NO: 5360511 - DNA, 14 bp, Homo sapiens
agcgccacccgccc

SEQ ID NO: 5360512 - DNA, 21 bp, Homo sapiens
agcgccaccgtgggagaggag

SEQ ID NO: 5360513 - DNA, 21 bp, Homo sapiens
agcgccactgtccgctgtctc

SEQ ID NO: 5360514 - DNA, 23 bp, Homo sapiens
agcgccactgtccgctgtctccc

SEQ ID NO: 5360515 - DNA, 13 bp, Homo sapiens
agcgccagaaaga

SEQ ID NO: 5360516 - DNA, 18 bp, Homo sapiens
agcgccagcctgtcccat

SEQ ID NO: 5360517 - DNA, 15 bp, Homo sapiens
agcgccagctccttg

SEQ ID NO: 5360518 - DNA, 12 bp, Homo sapiens
agcgccaggctg

SEQ ID NO: 5360519 - DNA, 17 bp, Homo sapiens
agcgccaggctggagat

SEQ ID NO: 5360520 - DNA, 12 bp, Homo sapiens
agcgccagggcc

SEQ ID NO: 5360521 - DNA, 15 bp, Homo sapiens
agcgccagggcccag

SEQ ID NO: 5360522 - DNA, 17 bp, Homo sapiens
agcgccagggcccaggc

SEQ ID NO: 5360523 - DNA, 21 bp, Homo sapiens
agcgccagggcccaggccatg

SEQ ID NO: 5360524 - DNA, 16 bp, Homo sapiens
agcgccatgtgtgtca

SEQ ID NO: 5360525 - DNA, 22 bp, Homo sapiens
agcgcccaaaggacgcactgag

SEQ ID NO: 5360526 - DNA, 13 bp, Homo sapiens
agcgcccacccag

SEQ ID NO: 5360527 - DNA, 17 bp, Homo sapiens
agcgcccacccaggtcc

SEQ ID NO: 5360528 - DNA, 14 bp, Homo sapiens
agcgcccagctcct

SEQ ID NO: 5360529 - DNA, 16 bp, Homo sapiens
agcgcccagctcctga

SEQ ID NO: 5360530 - DNA, 13 bp, Homo sapiens
agcgcccaggcct

SEQ ID NO: 5360531 - DNA, 14 bp, Homo sapiens
agcgcccagttggg

SEQ ID NO: 5360532 - DNA, 15 bp, Homo sapiens
agcgcccccactcct

SEQ ID NO: 5360533 - DNA, 18 bp, Homo sapiens
agcgcccccactcctcct

SEQ ID NO: 5360534 - DNA, 19 bp, Homo sapiens
agcgcccccactcctcctc

SEQ ID NO: 5360535 - DNA, 20 bp, Homo sapiens
agcgcccccactcctcctcc

SEQ ID NO: 5360536 - DNA, 15 bp, Homo sapiens
agcgcccccaggcct

SEQ ID NO: 5360537 - DNA, 14 bp, Homo sapiens
agctaggcagggag

SEQ ID NO: 5360538 - DNA, 19 bp, Homo sapiens
agctaggcagggagggggc

SEQ ID NO: 5360539 - DNA, 13 bp, Homo sapiens
agctaggcagggt

SEQ ID NO: 5360540 - DNA, 15 bp, Homo sapiens
agctaggccccagag

SEQ ID NO: 5360541 - DNA, 19 bp, Homo sapiens
agctaggccccagaggccc

SEQ ID NO: 5360542 - DNA, 23 bp, Homo sapiens
agctaggccccagaggccctgga

SEQ ID NO: 5360543 - DNA, 16 bp, Homo sapiens
agctaggcctggccag

SEQ ID NO: 5360544 - DNA, 13 bp, Homo sapiens
agctaggctgtgg

SEQ ID NO: 5360545 - DNA, 14 bp, Homo sapiens
agctagggctgctg

SEQ ID NO: 5360546 - DNA, 15 bp, Homo sapiens
agctagggctgctgc

SEQ ID NO: 5360547 - DNA, 17 bp, Homo sapiens
agctagggctgctgctt

SEQ ID NO: 5360548 - DNA, 19 bp, Homo sapiens
agctagtaatatattctga

SEQ ID NO: 5360549 - DNA, 15 bp, Homo sapiens
agctagtagcaatgt

SEQ ID NO: 5360550 - DNA, 16 bp, Homo sapiens
agctagtagcaatgtg

SEQ ID NO: 5360551 - DNA, 18 bp, Homo sapiens
agctagtcctagtgaacc

SEQ ID NO: 5360552 - DNA, 16 bp, Homo sapiens
agctagtcttttgctt

SEQ ID NO: 5360553 - DNA, 19 bp, Homo sapiens
agctagtcttttgcttttg

SEQ ID NO: 5360554 - DNA, 19 bp, Homo sapiens
agctagtgaagaccagagc

SEQ ID NO: 5360555 - DNA, 18 bp, Homo sapiens
agctagtgacccacatgc

SEQ ID NO: 5360556 - DNA, 18 bp, Homo sapiens
agctagtgccaaataatt

SEQ ID NO: 5360557 - DNA, 21 bp, Homo sapiens
agctagtgccaaataattgat

SEQ ID NO: 5360558 - DNA, 12 bp, Homo sapiens
agctagtgcctt

SEQ ID NO: 5360559 - DNA, 18 bp, Homo sapiens
agctagtgtacctcctct

SEQ ID NO: 5360560 - DNA, 19 bp, Homo sapiens
agctagtgtacctcctctc

SEQ ID NO: 5360561 - DNA, 22 bp, Homo sapiens
agctagtgtacctcctctcagt

SEQ ID NO: 5360562 - DNA, 18 bp, Homo sapiens
agctagtgtctcctctct

SEQ ID NO: 5360563 - DNA, 22 bp, Homo sapiens
agctagtgttaatccagagaac

SEQ ID NO: 5360564 - DNA, 14 bp, Homo sapiens
agctagtgtttcta

SEQ ID NO: 5360565 - DNA, 14 bp, Homo sapiens
agctagttagctca

SEQ ID NO: 5360566 - DNA, 14 bp, Homo sapiens
agctagttatgtga

SEQ ID NO: 5360567 - DNA, 15 bp, Homo sapiens
agctagttgaatact

SEQ ID NO: 5360568 - DNA, 18 bp, Homo sapiens
agctagttgaatacttga

SEQ ID NO: 5360569 - DNA, 20 bp, Homo sapiens
agctagttgaatacttgaac

SEQ ID NO: 5360570 - DNA, 23 bp, Homo sapiens
agctagttgaatacttgaaccat

SEQ ID NO: 5360571 - DNA, 18 bp, Homo sapiens
agctagttggttgaattt

SEQ ID NO: 5360572 - DNA, 20 bp, Homo sapiens
agctagttggttgaattttt

SEQ ID NO: 5360573 - DNA, 19 bp, Homo sapiens
agctagtttaaaattatta

SEQ ID NO: 5360574 - DNA, 12 bp, Homo sapiens
agctagttttct

SEQ ID NO: 5360575 - DNA, 19 bp, Homo sapiens
agctataaaagcccatgct

SEQ ID NO: 5360576 - DNA, 16 bp, Homo sapiens
agctataaattatatt

SEQ ID NO: 5360577 - DNA, 13 bp, Homo sapiens
agctataacattt

SEQ ID NO: 5360578 - DNA, 13 bp, Homo sapiens
agctatacagttt

SEQ ID NO: 5360579 - DNA, 19 bp, Homo sapiens
agctatacagttttcctaa

SEQ ID NO: 5360580 - DNA, 14 bp, Homo sapiens
agctatacctgcac

SEQ ID NO: 5360581 - DNA, 23 bp, Homo sapiens
agctatacctgcacgttcataac

SEQ ID NO: 5360582 - DNA, 18 bp, Homo sapiens
agctatagacccgaggaa

SEQ ID NO: 5360583 - DNA, 16 bp, Homo sapiens
agctatagtgaagaat

SEQ ID NO: 5360584 - DNA, 17 bp, Homo sapiens
agctatagtgaagaata

SEQ ID NO: 5360585 - DNA, 16 bp, Homo sapiens
agctatagttgcagcc

SEQ ID NO: 5360586 - DNA, 21 bp, Homo sapiens
agctatagttgcagcccaagg

SEQ ID NO: 5360587 - DNA, 14 bp, Homo sapiens
agctatatccatgt

SEQ ID NO: 5360588 - DNA, 20 bp, Homo sapiens
agctatatcctgatgctgga

SEQ ID NO: 5360589 - DNA, 17 bp, Homo sapiens
agctatatctatatata

SEQ ID NO: 5360590 - DNA, 19 bp, Homo sapiens
agctatatctatatataat

SEQ ID NO: 5360591 - DNA, 19 bp, Homo sapiens
agctatattagctgaaaca

SEQ ID NO: 5360592 - DNA, 16 bp, Homo sapiens
agctatcaagaggctg

SEQ ID NO: 5360593 - DNA, 19 bp, Homo sapiens
agctatcaagaggctgaga

SEQ ID NO: 5360594 - DNA, 22 bp, Homo sapiens
agctatcaatcaccttgcattt

SEQ ID NO: 5360595 - DNA, 15 bp, Homo sapiens
agctatcacctagca

SEQ ID NO: 5360596 - DNA, 13 bp, Homo sapiens
agctatcagtgct

SEQ ID NO: 5360597 - DNA, 21 bp, Homo sapiens
agctatcatcaacacaatgat

SEQ ID NO: 5360598 - DNA, 14 bp, Homo sapiens
agctatcatttctt

SEQ ID NO: 5360599 - DNA, 19 bp, Homo sapiens
agctatcatttcttttcca

SEQ ID NO: 5360600 - DNA, 14 bp, Homo sapiens
agctatcctttcaa

SEQ ID NO: 5360601 - DNA, 16 bp, Homo sapiens
agctatctaaagtttg

SEQ ID NO: 5360602 - DNA, 13 bp, Homo sapiens
agctatctgcctg

SEQ ID NO: 5360603 - DNA, 22 bp, Homo sapiens
agctatctggtcaacctcctgg

SEQ ID NO: 5360604 - DNA, 18 bp, Homo sapiens
agctatcttcatgtaaat

SEQ ID NO: 5360605 - DNA, 21 bp, Homo sapiens
agctatgaagagctagagaaa

SEQ ID NO: 5360606 - DNA, 22 bp, Homo sapiens
agctatgaagtgctgggcaagt

SEQ ID NO: 5360607 - DNA, 13 bp, Homo sapiens
agctatgaatgtt

SEQ ID NO: 5360608 - DNA, 17 bp, Homo sapiens
agctatgaatgttacta

SEQ ID NO: 5360609 - DNA, 20 bp, Homo sapiens
agctatgagagatgtgtcca

SEQ ID NO: 5360610 - DNA, 16 bp, Homo sapiens
agctatgagggtcccc

SEQ ID NO: 5360611 - DNA, 14 bp, Homo sapiens
agctatgagttgaa

SEQ ID NO: 5360612 - DNA, 20 bp, Homo sapiens
agctatgagttgaaatgttc

SEQ ID NO: 5360613 - DNA, 21 bp, Homo sapiens
agctatgataagattgaaatt

SEQ ID NO: 5360614 - DNA, 15 bp, Homo sapiens
agctatgatatgtgc

SEQ ID NO: 5360615 - DNA, 18 bp, Homo sapiens
agctatgattatgccact

SEQ ID NO: 5360616 - DNA, 17 bp, Homo sapiens
agctatgcacaccaaat

SEQ ID NO: 5360617 - DNA, 18 bp, Homo sapiens
agctatggaaggtcttgc

SEQ ID NO: 5360618 - DNA, 17 bp, Homo sapiens
agctatggccccagggt

SEQ ID NO: 5360619 - DNA, 19 bp, Homo sapiens
agctatggtgtcataggct

SEQ ID NO: 5360620 - DNA, 18 bp, Homo sapiens
agctatgtcaagaggctg

SEQ ID NO: 5360621 - DNA, 22 bp, Homo sapiens
agctatgtcactaccctcctgt

SEQ ID NO: 5360622 - DNA, 21 bp, Homo sapiens
agctatgtctctagcagtgag

SEQ ID NO: 5360623 - DNA, 16 bp, Homo sapiens
agctatgtttttaaag

SEQ ID NO: 5360624 - DNA, 17 bp, Homo sapiens
agctatgtttttaaagt

SEQ ID NO: 5360625 - DNA, 13 bp, Homo sapiens
agctattaaaact

SEQ ID NO: 5360626 - DNA, 15 bp, Homo sapiens
agctattaaaatgta

SEQ ID NO: 5360627 - DNA, 15 bp, Homo sapiens
agctattaagaaaat

SEQ ID NO: 5360628 - DNA, 20 bp, Homo sapiens
agctattactggatctctta

SEQ ID NO: 5360629 - DNA, 21 bp, Homo sapiens
agctattactgtctggtttta

SEQ ID NO: 5360630 - DNA, 17 bp, Homo sapiens
agctattacttggcaaa

SEQ ID NO: 5360631 - DNA, 18 bp, Homo sapiens
agctattagccaggatca

SEQ ID NO: 5360632 - DNA, 22 bp, Homo sapiens
agctattagccaggatcatggt

SEQ ID NO: 5360633 - DNA, 18 bp, Homo sapiens
agctattagcggctcctc

SEQ ID NO: 5360634 - DNA, 15 bp, Homo sapiens
agctattcacctcag

SEQ ID NO: 5360635 - DNA, 15 bp, Homo sapiens
agctattcaggaggc

SEQ ID NO: 5360636 - DNA, 20 bp, Homo sapiens
agctattcaggaggctgagg

SEQ ID NO: 5360637 - DNA, 19 bp, Homo sapiens
agctattcagtaataactc

SEQ ID NO: 5360638 - DNA, 21 bp, Homo sapiens
agctattcagttggtaagctt

SEQ ID NO: 5360639 - DNA, 19 bp, Homo sapiens
agctattcccttctgatct

SEQ ID NO: 5360640 - DNA, 12 bp, Homo sapiens
agctattctttg

SEQ ID NO: 5360641 - DNA, 16 bp, Homo sapiens
agctattgatgtttcc

SEQ ID NO: 5360642 - DNA, 23 bp, Homo sapiens
agctattgatgtttccagaaaat

SEQ ID NO: 5360643 - DNA, 13 bp, Homo sapiens
agctattgcatgt

SEQ ID NO: 5360644 - DNA, 18 bp, Homo sapiens
agctattgcatgtaaaat

SEQ ID NO: 5360645 - DNA, 22 bp, Homo sapiens
agctattgcatgtaaaatgcag

SEQ ID NO: 5360646 - DNA, 17 bp, Homo sapiens
agctattgccaaccagt

SEQ ID NO: 5360647 - DNA, 23 bp, Homo sapiens
agctattggaatttttttttcct

SEQ ID NO: 5360648 - DNA, 22 bp, Homo sapiens
agctattgggagcaatctggaa

SEQ ID NO: 5360649 - DNA, 22 bp, Homo sapiens
agctatttaagtggactgtatt

SEQ ID NO: 5360650 - DNA, 22 bp, Homo sapiens
agctatttagtgatatatttta

SEQ ID NO: 5360651 - DNA, 22 bp, Homo sapiens
agctatttatgggcccctggca

SEQ ID NO: 5360652 - DNA, 14 bp, Homo sapiens
agctatttcatcta

SEQ ID NO: 5360653 - DNA, 20 bp, Homo sapiens
agctatttccattccagaat

SEQ ID NO: 5360654 - DNA, 13 bp, Homo sapiens
agctatttccttc

SEQ ID NO: 5360655 - DNA, 19 bp, Homo sapiens
agctatttccttccagcct

SEQ ID NO: 5360656 - DNA, 18 bp, Homo sapiens
agctatttcctttgcgca

SEQ ID NO: 5360657 - DNA, 22 bp, Homo sapiens
agctatttctcatcaattctct

SEQ ID NO: 5360658 - DNA, 17 bp, Homo sapiens
agctattttaagccatc

SEQ ID NO: 5360659 - DNA, 13 bp, Homo sapiens
agctattttagaa

SEQ ID NO: 5360660 - DNA, 17 bp, Homo sapiens
agctattttagaaagct

SEQ ID NO: 5360661 - DNA, 19 bp, Homo sapiens
agctattttagaaagctaa

SEQ ID NO: 5360662 - DNA, 12 bp, Homo sapiens
agctattttcca

SEQ ID NO: 5360663 - DNA, 13 bp, Homo sapiens
agctattttccag

SEQ ID NO: 5360664 - DNA, 14 bp, Homo sapiens
agctattttcctct

SEQ ID NO: 5360665 - DNA, 17 bp, Homo sapiens
agctattttcctctggc

SEQ ID NO: 5360666 - DNA, 21 bp, Homo sapiens
agctattttccttgcttttct

SEQ ID NO: 5360667 - DNA, 17 bp, Homo sapiens
agctattttctgaccaa

SEQ ID NO: 5360668 - DNA, 17 bp, Homo sapiens
agctattttggtttagt

SEQ ID NO: 5360669 - DNA, 13 bp, Homo sapiens
agctattttgtga

SEQ ID NO: 5360670 - DNA, 10 bp, Homo sapiens
agctattttt

SEQ ID NO: 5360671 - DNA, 16 bp, Homo sapiens
agctatttttactaga

SEQ ID NO: 5360672 - DNA, 15 bp, Homo sapiens
agctatttttataca

SEQ ID NO: 5360673 - DNA, 17 bp, Homo sapiens
agctatttttatacact

SEQ ID NO: 5360674 - DNA, 20 bp, Homo sapiens
agctatttttatacactgta

SEQ ID NO: 5360675 - DNA, 22 bp, Homo sapiens
agctatttttttcctaagacat

SEQ ID NO: 5360676 - DNA, 13 bp, Homo sapiens
agctcaaaaatac

SEQ ID NO: 5360677 - DNA, 23 bp, Homo sapiens
agctcaaaggtttggaaggagca

SEQ ID NO: 5360678 - DNA, 18 bp, Homo sapiens
agctcaaatctctgttac

SEQ ID NO: 5360679 - DNA, 22 bp, Homo sapiens
agctcaaatgtatatttaactt

SEQ ID NO: 5360680 - DNA, 21 bp, Homo sapiens
agctcaaattccgagtgcaga

SEQ ID NO: 5360681 - DNA, 18 bp, Homo sapiens
agctcaacggtctggcag

SEQ ID NO: 5360682 - DNA, 19 bp, Homo sapiens
agctcaacggtctggcagg

SEQ ID NO: 5360683 - DNA, 12 bp, Homo sapiens
agctcaactaaa

SEQ ID NO: 5360684 - DNA, 21 bp, Homo sapiens
agctcaactcacagcttctcc

SEQ ID NO: 5360685 - DNA, 14 bp, Homo sapiens
agctcaactctctt

SEQ ID NO: 5360686 - DNA, 14 bp, Homo sapiens
agctcaactgttgc

SEQ ID NO: 5360687 - DNA, 17 bp, Homo sapiens
agctcaactgttgccag

SEQ ID NO: 5360688 - DNA, 17 bp, Homo sapiens
agctcaagcattctgtt

SEQ ID NO: 5360689 - DNA, 21 bp, Homo sapiens
agctcaagcccttggggaggg

SEQ ID NO: 5360690 - DNA, 17 bp, Homo sapiens
agctcaaggcaatgggc

SEQ ID NO: 5360691 - DNA, 12 bp, Homo sapiens
agctcaaggtca

SEQ ID NO: 5360692 - DNA, 23 bp, Homo sapiens
agctcaagtcttccctgatcaag

SEQ ID NO: 5360693 - DNA, 11 bp, Homo sapiens
agctcaagttt

SEQ ID NO: 5360694 - DNA, 13 bp, Homo sapiens
agctcaagtttaa

SEQ ID NO: 5360695 - DNA, 19 bp, Homo sapiens
agctcaagtttaaaagcca

SEQ ID NO: 5360696 - DNA, 12 bp, Homo sapiens
agctcaataaaa

SEQ ID NO: 5360697 - DNA, 17 bp, Homo sapiens
agctcaatactctctga

SEQ ID NO: 5360698 - DNA, 13 bp, Homo sapiens
agctcaatgagca

SEQ ID NO: 5360699 - DNA, 14 bp, Homo sapiens
agctcaatgagcat

SEQ ID NO: 5360700 - DNA, 15 bp, Homo sapiens
agctcaatgagcatg

SEQ ID NO: 5360701 - DNA, 23 bp, Homo sapiens
agctcaatgagcatgtttagact

SEQ ID NO: 5360702 - DNA, 16 bp, Homo sapiens
agctcaattgttaatg

SEQ ID NO: 5360703 - DNA, 18 bp, Homo sapiens
agctcaattgttaatgtg

SEQ ID NO: 5360704 - DNA, 20 bp, Homo sapiens
agctcaattgttaatgtgat

SEQ ID NO: 5360705 - DNA, 17 bp, Homo sapiens
agctcacaagcccaggc

SEQ ID NO: 5360706 - DNA, 19 bp, Homo sapiens
agctcacaagcccaggctg

SEQ ID NO: 5360707 - DNA, 21 bp, Homo sapiens
agctcacaagccgtgttttat

SEQ ID NO: 5360708 - DNA, 15 bp, Homo sapiens
agctcacaaggcagc

SEQ ID NO: 5360709 - DNA, 14 bp, Homo sapiens
agctcacacagcag

SEQ ID NO: 5360710 - DNA, 16 bp, Homo sapiens
agctcacacatgagat

SEQ ID NO: 5360711 - DNA, 21 bp, Homo sapiens
agctcacaccctaccttcccc

SEQ ID NO: 5360712 - DNA, 22 bp, Homo sapiens
agctcacaccctaccttcccca

SEQ ID NO: 5360713 - DNA, 13 bp, Homo sapiens
agctcacacctgt

SEQ ID NO: 5360714 - DNA, 14 bp, Homo sapiens
agctcacacctgtc

SEQ ID NO: 5360715 - DNA, 15 bp, Homo sapiens
agctcctgaccaaag

SEQ ID NO: 5360716 - DNA, 19 bp, Homo sapiens
agctcctgaccagttgcag

SEQ ID NO: 5360717 - DNA, 13 bp, Homo sapiens
agctcctgacctt

SEQ ID NO: 5360718 - DNA, 18 bp, Homo sapiens
agctcctgagtagctggg

SEQ ID NO: 5360719 - DNA, 17 bp, Homo sapiens
agctcctgatcagaggc

SEQ ID NO: 5360720 - DNA, 21 bp, Homo sapiens
agctcctgccacatggagccc

SEQ ID NO: 5360721 - DNA, 15 bp, Homo sapiens
agctcctgccccgcc

SEQ ID NO: 5360722 - DNA, 19 bp, Homo sapiens
agctcctgccccgccggcc

SEQ ID NO: 5360723 - DNA, 15 bp, Homo sapiens
agctcctgctacttc

SEQ ID NO: 5360724 - DNA, 16 bp, Homo sapiens
agctcctgctcattgt

SEQ ID NO: 5360725 - DNA, 18 bp, Homo sapiens
agctcctgctgcggagga

SEQ ID NO: 5360726 - DNA, 20 bp, Homo sapiens
agctcctggaccaggcccat

SEQ ID NO: 5360727 - DNA, 13 bp, Homo sapiens
agctcctggccag

SEQ ID NO: 5360728 - DNA, 23 bp, Homo sapiens
agctcctgggaaggctactcacc

SEQ ID NO: 5360729 - DNA, 14 bp, Homo sapiens
agctcctgggaccc

SEQ ID NO: 5360730 - DNA, 16 bp, Homo sapiens
agctcctgggaccctt

SEQ ID NO: 5360731 - DNA, 18 bp, Homo sapiens
agctcctgggacccttgg

SEQ ID NO: 5360732 - DNA, 20 bp, Homo sapiens
agctcctgggacccttggct

SEQ ID NO: 5360733 - DNA, 14 bp, Homo sapiens
agctcctgggcagc

SEQ ID NO: 5360734 - DNA, 17 bp, Homo sapiens
agctcctggggagctcc

SEQ ID NO: 5360735 - DNA, 22 bp, Homo sapiens
agctcctggggcgtccaggccg

SEQ ID NO: 5360736 - DNA, 22 bp, Homo sapiens
agctcctggtcttgagatgtct

SEQ ID NO: 5360737 - DNA, 20 bp, Homo sapiens
agctcctgtcccctgctaca

SEQ ID NO: 5360738 - DNA, 24 bp, Homo sapiens
agctcctgtcccctgctacaccta

SEQ ID NO: 5360739 - DNA, 13 bp, Homo sapiens
agctcctgtccct

SEQ ID NO: 5360740 - DNA, 17 bp, Homo sapiens
agctcctgtccctaccc

SEQ ID NO: 5360741 - DNA, 20 bp, Homo sapiens
agctcctgtccctacccact

SEQ ID NO: 5360742 - DNA, 22 bp, Homo sapiens
agctcctgtccctacccactct

SEQ ID NO: 5360743 - DNA, 16 bp, Homo sapiens
agctcctgtcctccca

SEQ ID NO: 5360744 - DNA, 16 bp, Homo sapiens
agctccttaaggctct

SEQ ID NO: 5360745 - DNA, 22 bp, Homo sapiens
agctccttaaggctcttttgta

SEQ ID NO: 5360746 - DNA, 21 bp, Homo sapiens
agctccttattggaaggtatt

SEQ ID NO: 5360747 - DNA, 15 bp, Homo sapiens
agctccttcatgctt

SEQ ID NO: 5360748 - DNA, 19 bp, Homo sapiens
agctccttcctggagactg

SEQ ID NO: 5360749 - DNA, 15 bp, Homo sapiens
agctccttcctgttt

SEQ ID NO: 5360750 - DNA, 17 bp, Homo sapiens
agctccttcctgtttgt

SEQ ID NO: 5360751 - DNA, 17 bp, Homo sapiens
agctccttgacctatga

SEQ ID NO: 5360752 - DNA, 15 bp, Homo sapiens
agctccttggagcag

SEQ ID NO: 5360753 - DNA, 11 bp, Homo sapiens
agctccttggc

SEQ ID NO: 5360754 - DNA, 17 bp, Homo sapiens
agctccttggctgcagc

SEQ ID NO: 5360755 - DNA, 19 bp, Homo sapiens
agctccttggctgcagcca

SEQ ID NO: 5360756 - DNA, 20 bp, Homo sapiens
agctccttggctgcagccat

SEQ ID NO: 5360757 - DNA, 12 bp, Homo sapiens
agctccttggga

SEQ ID NO: 5360758 - DNA, 17 bp, Homo sapiens
agctccttgggaggaag

SEQ ID NO: 5360759 - DNA, 23 bp, Homo sapiens
agctccttgggaggaagcagaat

SEQ ID NO: 5360760 - DNA, 15 bp, Homo sapiens
agctccttgggaggc

SEQ ID NO: 5360761 - DNA, 22 bp, Homo sapiens
agctccttgggaggccccactg

SEQ ID NO: 5360762 - DNA, 20 bp, Homo sapiens
agctccttggggcagggcct

SEQ ID NO: 5360763 - DNA, 18 bp, Homo sapiens
agctccttggttccctct

SEQ ID NO: 5360764 - DNA, 20 bp, Homo sapiens
agctccttggttttgcctct

SEQ ID NO: 5360765 - DNA, 23 bp, Homo sapiens
agctccttggttttgcctcttta

SEQ ID NO: 5360766 - DNA, 20 bp, Homo sapiens
agctccttgtgagtgtgtgc

SEQ ID NO: 5360767 - DNA, 16 bp, Homo sapiens
agctcctttctcctgt

SEQ ID NO: 5360768 - DNA, 20 bp, Homo sapiens
agctcctttctgtcctggag

SEQ ID NO: 5360769 - DNA, 17 bp, Homo sapiens
agctccttttgtcccca

SEQ ID NO: 5360770 - DNA, 19 bp, Homo sapiens
agctcgaattaagaatatg

SEQ ID NO: 5360771 - DNA, 17 bp, Homo sapiens
agctcgagcaaaattca

SEQ ID NO: 5360772 - DNA, 19 bp, Homo sapiens
agctcgaggcccccgacca

SEQ ID NO: 5360773 - DNA, 13 bp, Homo sapiens
agctcgatccaaa

SEQ ID NO: 5360774 - DNA, 22 bp, Homo sapiens
agctcgatgtggtcacagctgt

SEQ ID NO: 5360775 - DNA, 19 bp, Homo sapiens
agctcgcacccccctgttc

SEQ ID NO: 5360776 - DNA, 22 bp, Homo sapiens
agctcgcacccccctgttctaa

SEQ ID NO: 5360777 - DNA, 22 bp, Homo sapiens
agctcgcattctcttgtgttcg

SEQ ID NO: 5360778 - DNA, 20 bp, Homo sapiens
agctcgccccacctccacct

SEQ ID NO: 5360779 - DNA, 21 bp, Homo sapiens
agctcgccccacctccacctg

SEQ ID NO: 5360780 - DNA, 12 bp, Homo sapiens
agctcgcccctc

SEQ ID NO: 5360781 - DNA, 13 bp, Homo sapiens
agctcgctcttgg

SEQ ID NO: 5360782 - DNA, 14 bp, Homo sapiens
agctcggggctggg

SEQ ID NO: 5360783 - DNA, 22 bp, Homo sapiens
agctcggggctgggggctgcag

SEQ ID NO: 5360784 - DNA, 16 bp, Homo sapiens
agctcggggtccacca

SEQ ID NO: 5360785 - DNA, 15 bp, Homo sapiens
agctcgggtctccct

SEQ ID NO: 5360786 - DNA, 14 bp, Homo sapiens
agctcggtggaccc

SEQ ID NO: 5360787 - DNA, 22 bp, Homo sapiens
agctcggttaagtacccgaggc

SEQ ID NO: 5360788 - DNA, 16 bp, Homo sapiens
agctcgtagaaacaag

SEQ ID NO: 5360789 - DNA, 22 bp, Homo sapiens
agctcgtccccattgcttaagc

SEQ ID NO: 5360790 - DNA, 16 bp, Homo sapiens
agctcgtcctcactgg

SEQ ID NO: 5360791 - DNA, 18 bp, Homo sapiens
agctcgtgtatcctgggg

SEQ ID NO: 5360792 - DNA, 13 bp, Homo sapiens
agctcgtgtgctt

SEQ ID NO: 5360793 - DNA, 20 bp, Homo sapiens
agctcgttcctacctggctg

SEQ ID NO: 5360794 - DNA, 14 bp, Homo sapiens
agctctaaaatctg

SEQ ID NO: 5360795 - DNA, 15 bp, Homo sapiens
agctctaaagcagag

SEQ ID NO: 5360796 - DNA, 16 bp, Homo sapiens
agctctaaagcagaga

SEQ ID NO: 5360797 - DNA, 19 bp, Homo sapiens
agctctaaagtagcaactg

SEQ ID NO: 5360798 - DNA, 20 bp, Homo sapiens
agctctaagagcaattctgg

SEQ ID NO: 5360799 - DNA, 22 bp, Homo sapiens
agctctaataaaacagctgtct

SEQ ID NO: 5360800 - DNA, 20 bp, Homo sapiens
agctctaatgtttgcatata

SEQ ID NO: 5360801 - DNA, 20 bp, Homo sapiens
agctctacaggcctgcagcc

SEQ ID NO: 5360802 - DNA, 16 bp, Homo sapiens
agctctaccctgctcc

SEQ ID NO: 5360803 - DNA, 20 bp, Homo sapiens
agctctaccctgctccctgc

SEQ ID NO: 5360804 - DNA, 16 bp, Homo sapiens
agctctactgccctcc

SEQ ID NO: 5360805 - DNA, 17 bp, Homo sapiens
agctctactgccctccc

SEQ ID NO: 5360806 - DNA, 18 bp, Homo sapiens
agctctactgccctcccc

SEQ ID NO: 5360807 - DNA, 17 bp, Homo sapiens
agctctactgcctcaac

SEQ ID NO: 5360808 - DNA, 13 bp, Homo sapiens
agctctagaatct

SEQ ID NO: 5360809 - DNA, 19 bp, Homo sapiens
agctctagacaaccctgca

SEQ ID NO: 5360810 - DNA, 13 bp, Homo sapiens
agctctagcctct

SEQ ID NO: 5360811 - DNA, 19 bp, Homo sapiens
agctctaggctgttctgta

SEQ ID NO: 5360812 - DNA, 22 bp, Homo sapiens
agctctaggctgttctgtagct

SEQ ID NO: 5360813 - DNA, 22 bp, Homo sapiens
agctctataattgttttgctac

SEQ ID NO: 5360814 - DNA, 17 bp, Homo sapiens
agctctatcaccaagga

SEQ ID NO: 5360815 - DNA, 22 bp, Homo sapiens
agctctatcaccaaggagccaa

SEQ ID NO: 5360816 - DNA, 18 bp, Homo sapiens
agctctattatattcggt

SEQ ID NO: 5360817 - DNA, 16 bp, Homo sapiens
agctctcaaatgtgac

SEQ ID NO: 5360818 - DNA, 15 bp, Homo sapiens
agctctcacagacat

SEQ ID NO: 5360819 - DNA, 23 bp, Homo sapiens
agctctcagcaagtgcccagtgg

SEQ ID NO: 5360820 - DNA, 12 bp, Homo sapiens
agctctcagcca

SEQ ID NO: 5360821 - DNA, 19 bp, Homo sapiens
agctctcaggccgagagcc

SEQ ID NO: 5360822 - DNA, 17 bp, Homo sapiens
agctctcagggctgtct

SEQ ID NO: 5360823 - DNA, 17 bp, Homo sapiens
agctctcagttgcagcc

SEQ ID NO: 5360824 - DNA, 23 bp, Homo sapiens
agctctcatctgaggcatccagc

SEQ ID NO: 5360825 - DNA, 22 bp, Homo sapiens
agctctcatgctgcccctgcct

SEQ ID NO: 5360826 - DNA, 13 bp, Homo sapiens
agctctccagctc

SEQ ID NO: 5360827 - DNA, 14 bp, Homo sapiens
agctctccagctcc

SEQ ID NO: 5360828 - DNA, 17 bp, Homo sapiens
agctctccaggccaggt

SEQ ID NO: 5360829 - DNA, 18 bp, Homo sapiens
agctctccaggccaggtg

SEQ ID NO: 5360830 - DNA, 21 bp, Homo sapiens
agctctccaggccaggtggga

SEQ ID NO: 5360831 - DNA, 15 bp, Homo sapiens
agctctccaggcccc

SEQ ID NO: 5360832 - DNA, 17 bp, Homo sapiens
agctctcccagtgaact

SEQ ID NO: 5360833 - DNA, 15 bp, Homo sapiens
agctctcccctcaga

SEQ ID NO: 5360834 - DNA, 20 bp, Homo sapiens
agctctcccctcctgctggg

SEQ ID NO: 5360835 - DNA, 11 bp, Homo sapiens
agctctccctc

SEQ ID NO: 5360836 - DNA, 14 bp, Homo sapiens
agctctccctctgg

SEQ ID NO: 5360837 - DNA, 16 bp, Homo sapiens
agctctccctctggcc

SEQ ID NO: 5360838 - DNA, 14 bp, Homo sapiens
agctctccgagctc

SEQ ID NO: 5360839 - DNA, 20 bp, Homo sapiens
agctctccgagctctggtgc

SEQ ID NO: 5360840 - DNA, 14 bp, Homo sapiens
agctctcctccagc

SEQ ID NO: 5360841 - DNA, 22 bp, Homo sapiens
agctctcctccagccctgggca

SEQ ID NO: 5360842 - DNA, 16 bp, Homo sapiens
agctctcctcctccat

SEQ ID NO: 5360843 - DNA, 18 bp, Homo sapiens
agctctcctgggccaggg

SEQ ID NO: 5360844 - DNA, 21 bp, Homo sapiens
agctctcctgggccagggtct

SEQ ID NO: 5360845 - DNA, 18 bp, Homo sapiens
agctctcgaggaaagtgg

SEQ ID NO: 5360846 - DNA, 11 bp, Homo sapiens
agctctctcag

SEQ ID NO: 5360847 - DNA, 14 bp, Homo sapiens
agctctctcagacc

SEQ ID NO: 5360848 - DNA, 16 bp, Homo sapiens
agctctctcagaccct

SEQ ID NO: 5360849 - DNA, 14 bp, Homo sapiens
agctctctctagaa

SEQ ID NO: 5360850 - DNA, 22 bp, Homo sapiens
agctctctgacgcttgtgacag

SEQ ID NO: 5360851 - DNA, 11 bp, Homo sapiens
agctctctgca

SEQ ID NO: 5360852 - DNA, 13 bp, Homo sapiens
agctctctgccct

SEQ ID NO: 5360853 - DNA, 16 bp, Homo sapiens
agctctctgccctgtg

SEQ ID NO: 5360854 - DNA, 18 bp, Homo sapiens
agctctctgccctgtgta

SEQ ID NO: 5360855 - DNA, 19 bp, Homo sapiens
agctctctgccctgtgtac

SEQ ID NO: 5360856 - DNA, 12 bp, Homo sapiens
agctctctgctg

SEQ ID NO: 5360857 - DNA, 13 bp, Homo sapiens
agctctctgctga

SEQ ID NO: 5360858 - DNA, 14 bp, Homo sapiens
agctctctgctgag

SEQ ID NO: 5360859 - DNA, 15 bp, Homo sapiens
agctctctgggcctg

SEQ ID NO: 5360860 - DNA, 21 bp, Homo sapiens
agctctctgtataaacattaa

SEQ ID NO: 5360861 - DNA, 12 bp, Homo sapiens
agctctcttcct

SEQ ID NO: 5360862 - DNA, 19 bp, Homo sapiens
agctctcttcttactcatt

SEQ ID NO: 5360863 - DNA, 16 bp, Homo sapiens
agctctcttgccgagg

SEQ ID NO: 5360864 - DNA, 21 bp, Homo sapiens
agctctcttgccgaggagcca

SEQ ID NO: 5360865 - DNA, 19 bp, Homo sapiens
agctctctttggaatgaac

SEQ ID NO: 5360866 - DNA, 18 bp, Homo sapiens
agctctgaaaccagtgtt

SEQ ID NO: 5360867 - DNA, 19 bp, Homo sapiens
agctctgaaaccagtgtta

SEQ ID NO: 5360868 - DNA, 23 bp, Homo sapiens
agctctgaacaaacactgaatca

SEQ ID NO: 5360869 - DNA, 15 bp, Homo sapiens
agctctgaagggagg

SEQ ID NO: 5360870 - DNA, 21 bp, Homo sapiens
agctctgaagtcacatcacag

SEQ ID NO: 5360871 - DNA, 22 bp, Homo sapiens
agctctgaagttaaaatgattt

SEQ ID NO: 5360872 - DNA, 15 bp, Homo sapiens
agctctgaatagtta

SEQ ID NO: 5360873 - DNA, 17 bp, Homo sapiens
agctctgaatagttaaa

SEQ ID NO: 5360874 - DNA, 21 bp, Homo sapiens
agctctgaatctgataggaaa

SEQ ID NO: 5360875 - DNA, 23 bp, Homo sapiens
agctctgaatctgataggaaaag

SEQ ID NO: 5360876 - DNA, 18 bp, Homo sapiens
agctctgaatgctatttg

SEQ ID NO: 5360877 - DNA, 19 bp, Homo sapiens
agctctgaatgctatttgt

SEQ ID NO: 5360878 - DNA, 19 bp, Homo sapiens
agctctgaattcaggtccc

SEQ ID NO: 5360879 - DNA, 14 bp, Homo sapiens
agctctgacatccc

SEQ ID NO: 5360880 - DNA, 15 bp, Homo sapiens
agctctgacatccct

SEQ ID NO: 5360881 - DNA, 17 bp, Homo sapiens
agctctgacatcccttc

SEQ ID NO: 5360882 - DNA, 18 bp, Homo sapiens
agctctgacatcccttcc

SEQ ID NO: 5360883 - DNA, 19 bp, Homo sapiens
agctctgacatcccttcct

SEQ ID NO: 5360884 - DNA, 20 bp, Homo sapiens
agctctgacatcccttcctg

SEQ ID NO: 5360885 - DNA, 22 bp, Homo sapiens
agctctgaccacttgaggcctg

SEQ ID NO: 5360886 - DNA, 16 bp, Homo sapiens
agctctgacccacagc

SEQ ID NO: 5360887 - DNA, 21 bp, Homo sapiens
agctctgacccacagcctcca

SEQ ID NO: 5360888 - DNA, 14 bp, Homo sapiens
agctctgaccctga

SEQ ID NO: 5360889 - DNA, 19 bp, Homo sapiens
agctctgactgaaggggct

SEQ ID NO: 5360890 - DNA, 19 bp, Homo sapiens
agctctgagaggccctgga

SEQ ID NO: 5360891 - DNA, 21 bp, Homo sapiens
agctctgagaggccctggatc

SEQ ID NO: 5360892 - DNA, 19 bp, Homo sapiens
agctgcaccatcacacatg

SEQ ID NO: 5360893 - DNA, 21 bp, Homo sapiens
agctgcaccccttcctgggca

SEQ ID NO: 5360894 - DNA, 22 bp, Homo sapiens
agctgcaccctcaggcaggtgg

SEQ ID NO: 5360895 - DNA, 16 bp, Homo sapiens
agctgcacctgccagc

SEQ ID NO: 5360896 - DNA, 18 bp, Homo sapiens
agctgcacctgccagcct

SEQ ID NO: 5360897 - DNA, 17 bp, Homo sapiens
agctgcactgatgctgc

SEQ ID NO: 5360898 - DNA, 19 bp, Homo sapiens
agctgcactgatgctgccc

SEQ ID NO: 5360899 - DNA, 13 bp, Homo sapiens
agctgcactgttt

SEQ ID NO: 5360900 - DNA, 14 bp, Homo sapiens
agctgcactgttta

SEQ ID NO: 5360901 - DNA, 23 bp, Homo sapiens
agctgcagaaccagtccctctga

SEQ ID NO: 5360902 - DNA, 17 bp, Homo sapiens
agctgcagaagggtggg

SEQ ID NO: 5360903 - DNA, 23 bp, Homo sapiens
agctgcagagagcacctggtggg

SEQ ID NO: 5360904 - DNA, 13 bp, Homo sapiens
agctgcagagcca

SEQ ID NO: 5360905 - DNA, 13 bp, Homo sapiens
agctgcagcctgg

SEQ ID NO: 5360906 - DNA, 15 bp, Homo sapiens
agctgcagcctggct

SEQ ID NO: 5360907 - DNA, 22 bp, Homo sapiens
agctgcagcctggctggtcctc

SEQ ID NO: 5360908 - DNA, 17 bp, Homo sapiens
agctgcagctgagcctg

SEQ ID NO: 5360909 - DNA, 19 bp, Homo sapiens
agctgcagctgagcctgag

SEQ ID NO: 5360910 - DNA, 13 bp, Homo sapiens
agctgcagctggg

SEQ ID NO: 5360911 - DNA, 14 bp, Homo sapiens
agctgcagctgggc

SEQ ID NO: 5360912 - DNA, 15 bp, Homo sapiens
agctgcagctgggcc

SEQ ID NO: 5360913 - DNA, 11 bp, Homo sapiens
agctgcagctt

SEQ ID NO: 5360914 - DNA, 13 bp, Homo sapiens
agctgcagcttcc

SEQ ID NO: 5360915 - DNA, 15 bp, Homo sapiens
agctgcagcttcctg

SEQ ID NO: 5360916 - DNA, 14 bp, Homo sapiens
agctgcagcttggg

SEQ ID NO: 5360917 - DNA, 20 bp, Homo sapiens
agctgcaggaatcaaaaatt

SEQ ID NO: 5360918 - DNA, 22 bp, Homo sapiens
agctgcaggaatcacccctctg

SEQ ID NO: 5360919 - DNA, 18 bp, Homo sapiens
agctgcagggcacgggga

SEQ ID NO: 5360920 - DNA, 22 bp, Homo sapiens
agctgcagggcacggggacctg

SEQ ID NO: 5360921 - DNA, 18 bp, Homo sapiens
agctgcaggggcctctgt

SEQ ID NO: 5360922 - DNA, 16 bp, Homo sapiens
agctgcaggtgcccat

SEQ ID NO: 5360923 - DNA, 17 bp, Homo sapiens
agctgcaggtgcccatt

SEQ ID NO: 5360924 - DNA, 18 bp, Homo sapiens
agctgcagttagcacaga

SEQ ID NO: 5360925 - DNA, 20 bp, Homo sapiens
agctgcagttagcacagagg

SEQ ID NO: 5360926 - DNA, 17 bp, Homo sapiens
agctgcatatcttcatc

SEQ ID NO: 5360927 - DNA, 19 bp, Homo sapiens
agctgcatcctccaagaat

SEQ ID NO: 5360928 - DNA, 18 bp, Homo sapiens
agctgcatctgtctgaat

SEQ ID NO: 5360929 - DNA, 20 bp, Homo sapiens
agctgcatggacgcctggct

SEQ ID NO: 5360930 - DNA, 21 bp, Homo sapiens
agctgcatggacgcctggctc

SEQ ID NO: 5360931 - DNA, 24 bp, Homo sapiens
agctgcatggacgcctggctccag

SEQ ID NO: 5360932 - DNA, 15 bp, Homo sapiens
agctgcatggagcct

SEQ ID NO: 5360933 - DNA, 18 bp, Homo sapiens
agctgcatggagcctgga

SEQ ID NO: 5360934 - DNA, 14 bp, Homo sapiens
agctgcatggcaca

SEQ ID NO: 5360935 - DNA, 23 bp, Homo sapiens
agctgcatgtggcttttttaaaa

SEQ ID NO: 5360936 - DNA, 19 bp, Homo sapiens
agctgcatttcacatgcct

SEQ ID NO: 5360937 - DNA, 22 bp, Homo sapiens
agctgcatttcacatgccttgc

SEQ ID NO: 5360938 - DNA, 17 bp, Homo sapiens
agctgccaaccctcccg

SEQ ID NO: 5360939 - DNA, 14 bp, Homo sapiens
agctgccaagcact

SEQ ID NO: 5360940 - DNA, 14 bp, Homo sapiens
agctgccaagtgct

SEQ ID NO: 5360941 - DNA, 13 bp, Homo sapiens
agctgccacagag

SEQ ID NO: 5360942 - DNA, 21 bp, Homo sapiens
agctgccacagagaagtttgt

SEQ ID NO: 5360943 - DNA, 17 bp, Homo sapiens
agctgccacattgattt

SEQ ID NO: 5360944 - DNA, 16 bp, Homo sapiens
agctgccacccctctt

SEQ ID NO: 5360945 - DNA, 20 bp, Homo sapiens
agctgccacccctcttctgc

SEQ ID NO: 5360946 - DNA, 22 bp, Homo sapiens
agctgccacccctcttctgctc

SEQ ID NO: 5360947 - DNA, 11 bp, Homo sapiens
agctgccactg

SEQ ID NO: 5360948 - DNA, 18 bp, Homo sapiens
agctgccactgggcacct

SEQ ID NO: 5360949 - DNA, 24 bp, Homo sapiens
agctgccactgggcacctgcgcac

SEQ ID NO: 5360950 - DNA, 18 bp, Homo sapiens
agctgccagaatcaggtt

SEQ ID NO: 5360951 - DNA, 13 bp, Homo sapiens
agctgccagccca

SEQ ID NO: 5360952 - DNA, 13 bp, Homo sapiens
agctgccagccgg

SEQ ID NO: 5360953 - DNA, 19 bp, Homo sapiens
agctgccagccttcccttc

SEQ ID NO: 5360954 - DNA, 23 bp, Homo sapiens
agctgccaggagcacggctctgt

SEQ ID NO: 5360955 - DNA, 18 bp, Homo sapiens
agctgccaggcggccctg

SEQ ID NO: 5360956 - DNA, 22 bp, Homo sapiens
agctgccaggcggccctgggga

SEQ ID NO: 5360957 - DNA, 13 bp, Homo sapiens
agctgccagggaa

SEQ ID NO: 5360958 - DNA, 22 bp, Homo sapiens
agctgccagggaagacagagca

SEQ ID NO: 5360959 - DNA, 23 bp, Homo sapiens
agctgccagggaagacagagcag

SEQ ID NO: 5360960 - DNA, 19 bp, Homo sapiens
agctgccagtgctggtcac

SEQ ID NO: 5360961 - DNA, 22 bp, Homo sapiens
agctgccagtggggtcgtgagg

SEQ ID NO: 5360962 - DNA, 19 bp, Homo sapiens
agctgccatccttgctgca

SEQ ID NO: 5360963 - DNA, 12 bp, Homo sapiens
agctgcccagac

SEQ ID NO: 5360964 - DNA, 17 bp, Homo sapiens
agctgcccagacacatg

SEQ ID NO: 5360965 - DNA, 21 bp, Homo sapiens
agctgcccagacacatgggct

SEQ ID NO: 5360966 - DNA, 21 bp, Homo sapiens
agctgcccagcccctcctccc

SEQ ID NO: 5360967 - DNA, 23 bp, Homo sapiens
agctgcccagcccctcctccctg

SEQ ID NO: 5360968 - DNA, 15 bp, Homo sapiens
agctgcccagccctg

SEQ ID NO: 5360969 - DNA, 17 bp, Homo sapiens
agctgcccagccctggc

SEQ ID NO: 5360970 - DNA, 20 bp, Homo sapiens
agctgcccatcccagtccct

SEQ ID NO: 5360971 - DNA, 22 bp, Homo sapiens
agctgcccatcccagtccctcg

SEQ ID NO: 5360972 - DNA, 14 bp, Homo sapiens
agctgcccccagag

SEQ ID NO: 5360973 - DNA, 19 bp, Homo sapiens
agctgcccccagagccaca

SEQ ID NO: 5360974 - DNA, 19 bp, Homo sapiens
agctgccccggcccctccc

SEQ ID NO: 5360975 - DNA, 20 bp, Homo sapiens
agctgccccggggaggggcg

SEQ ID NO: 5360976 - DNA, 13 bp, Homo sapiens
agctgcccctccc

SEQ ID NO: 5360977 - DNA, 20 bp, Homo sapiens
agctgcccctcctggagcag

SEQ ID NO: 5360978 - DNA, 21 bp, Homo sapiens
agctgcccctcctggagcaga

SEQ ID NO: 5360979 - DNA, 14 bp, Homo sapiens
agctgcccctgctg

SEQ ID NO: 5360980 - DNA, 15 bp, Homo sapiens
agctgcccctgctgc

SEQ ID NO: 5360981 - DNA, 15 bp, Homo sapiens
agctgcccctggcac

SEQ ID NO: 5360982 - DNA, 14 bp, Homo sapiens
agctgcccctggct

SEQ ID NO: 5360983 - DNA, 21 bp, Homo sapiens
agctgcccggcgcctgccctg

SEQ ID NO: 5360984 - DNA, 22 bp, Homo sapiens
agctgccctagctgaccccgag

SEQ ID NO: 5360985 - DNA, 22 bp, Homo sapiens
agctgccctccttgtccaccca

SEQ ID NO: 5360986 - DNA, 19 bp, Homo sapiens
agctgccctctcctgggca

SEQ ID NO: 5360987 - DNA, 20 bp, Homo sapiens
agctgccctctcctgggcag

SEQ ID NO: 5360988 - DNA, 16 bp, Homo sapiens
agctgccctgctgcca

SEQ ID NO: 5360989 - DNA, 17 bp, Homo sapiens
agctgccctgctgccac

SEQ ID NO: 5360990 - DNA, 19 bp, Homo sapiens
agctgccctggctgtgatg

SEQ ID NO: 5360991 - DNA, 22 bp, Homo sapiens
agctgcccttgcagggtgggtg

SEQ ID NO: 5360992 - DNA, 17 bp, Homo sapiens
agctgccgcaaggccct

SEQ ID NO: 5360993 - DNA, 18 bp, Homo sapiens
agctgccgcaaggccctg

SEQ ID NO: 5360994 - DNA, 20 bp, Homo sapiens
agctgccgcaaggccctgtc

SEQ ID NO: 5360995 - DNA, 15 bp, Homo sapiens
agctgccggcagtgc

SEQ ID NO: 5360996 - DNA, 18 bp, Homo sapiens
agctgccgggcctgattt

SEQ ID NO: 5360997 - DNA, 19 bp, Homo sapiens
agctgccggtcgccctttg

SEQ ID NO: 5360998 - DNA, 22 bp, Homo sapiens
agctgcctacctaatgaggact

SEQ ID NO: 5360999 - DNA, 17 bp, Homo sapiens
agctgcctaggcagcca

SEQ ID NO: 5361000 - DNA, 15 bp, Homo sapiens
agctgcctccagcct

SEQ ID NO: 5361001 - DNA, 23 bp, Homo sapiens
agctgcctccagcctggtggccc

SEQ ID NO: 5361002 - DNA, 17 bp, Homo sapiens
agctgcctccccaatcc

SEQ ID NO: 5361003 - DNA, 16 bp, Homo sapiens
agctgcctcccctcct

SEQ ID NO: 5361004 - DNA, 20 bp, Homo sapiens
agctgcctcccctcctctgc

SEQ ID NO: 5361005 - DNA, 23 bp, Homo sapiens
agctgcctcccctcctctgcttg

SEQ ID NO: 5361006 - DNA, 17 bp, Homo sapiens
agctgcctccgggcctc

SEQ ID NO: 5361007 - DNA, 22 bp, Homo sapiens
agctgcctccgggcctcggcct

SEQ ID NO: 5361008 - DNA, 23 bp, Homo sapiens
agctgcctccgggcctcggcctg

SEQ ID NO: 5361009 - DNA, 18 bp, Homo sapiens
agctgcctcctgcgccct

SEQ ID NO: 5361010 - DNA, 19 bp, Homo sapiens
agctgcctcctgcgccctg

SEQ ID NO: 5361011 - DNA, 18 bp, Homo sapiens
agctgcctcctggtctct

SEQ ID NO: 5361012 - DNA, 20 bp, Homo sapiens
agctgcctctcggtggccag

SEQ ID NO: 5361013 - DNA, 18 bp, Homo sapiens
agctgcctctgacagcag

SEQ ID NO: 5361014 - DNA, 21 bp, Homo sapiens
agctgcctctgacagcagcct

SEQ ID NO: 5361015 - DNA, 15 bp, Homo sapiens
agctgcctctgctcc

SEQ ID NO: 5361016 - DNA, 17 bp, Homo sapiens
agctgcctctgctccct

SEQ ID NO: 5361017 - DNA, 16 bp, Homo sapiens
agctgcctctgggcca

SEQ ID NO: 5361018 - DNA, 15 bp, Homo sapiens
agctgcctgaaacag

SEQ ID NO: 5361019 - DNA, 19 bp, Homo sapiens
agctgcctgaaacagccat

SEQ ID NO: 5361020 - DNA, 13 bp, Homo sapiens
agctgcctgcagc

SEQ ID NO: 5361021 - DNA, 14 bp, Homo sapiens
agctgcctgcagca

SEQ ID NO: 5361022 - DNA, 23 bp, Homo sapiens
agctgcctgctctgcagcccaca

SEQ ID NO: 5361023 - DNA, 12 bp, Homo sapiens
agctgcctgctt

SEQ ID NO: 5361024 - DNA, 13 bp, Homo sapiens
agctgcctggaga

SEQ ID NO: 5361025 - DNA, 19 bp, Homo sapiens
agctgcctggagagggtct

SEQ ID NO: 5361026 - DNA, 13 bp, Homo sapiens
agctgcctggatg

SEQ ID NO: 5361027 - DNA, 20 bp, Homo sapiens
agctgcctggatgagaaaca

SEQ ID NO: 5361028 - DNA, 12 bp, Homo sapiens
agctgcctggcc

SEQ ID NO: 5361029 - DNA, 23 bp, Homo sapiens
agctgcctggcggggttggccct

SEQ ID NO: 5361030 - DNA, 17 bp, Homo sapiens
agctgcctgggcccgga

SEQ ID NO: 5361031 - DNA, 18 bp, Homo sapiens
agctgcctgtagttagga

SEQ ID NO: 5361032 - DNA, 20 bp, Homo sapiens
agctgcctgtagttaggaaa

SEQ ID NO: 5361033 - DNA, 22 bp, Homo sapiens
agctgcctgtagttaggaaata

SEQ ID NO: 5361034 - DNA, 23 bp, Homo sapiens
agctgcctgtagttaggaaataa

SEQ ID NO: 5361035 - DNA, 18 bp, Homo sapiens
agctgcctgtgccatgcc

SEQ ID NO: 5361036 - DNA, 22 bp, Homo sapiens
agctgcctgtgccatgcccaag

SEQ ID NO: 5361037 - DNA, 21 bp, Homo sapiens
agctgcctgtgcctgccatgg

SEQ ID NO: 5361038 - DNA, 14 bp, Homo sapiens
agctgcctgttcag

SEQ ID NO: 5361039 - DNA, 20 bp, Homo sapiens
agctgcctgttcagctccag

SEQ ID NO: 5361040 - DNA, 13 bp, Homo sapiens
agctgccttagct

SEQ ID NO: 5361041 - DNA, 18 bp, Homo sapiens
agctgccttagcttcagg

SEQ ID NO: 5361042 - DNA, 20 bp, Homo sapiens
agctgccttagcttcaggaa

SEQ ID NO: 5361043 - DNA, 23 bp, Homo sapiens
agctgccttagcttcaggaacct

SEQ ID NO: 5361044 - DNA, 12 bp, Homo sapiens
agctgccttccc

SEQ ID NO: 5361045 - DNA, 16 bp, Homo sapiens
agctgccttccctagc

SEQ ID NO: 5361046 - DNA, 20 bp, Homo sapiens
agctgccttggctcagacat

SEQ ID NO: 5361047 - DNA, 20 bp, Homo sapiens
agctgcctttcgtgatctta

SEQ ID NO: 5361048 - DNA, 12 bp, Homo sapiens
agctgccttttt

SEQ ID NO: 5361049 - DNA, 13 bp, Homo sapiens
agctgcggccagg

SEQ ID NO: 5361050 - DNA, 14 bp, Homo sapiens
agctgcggccaggc

SEQ ID NO: 5361051 - DNA, 16 bp, Homo sapiens
agctgcgggctgaggg

SEQ ID NO: 5361052 - DNA, 15 bp, Homo sapiens
agctgcgggctgggt

SEQ ID NO: 5361053 - DNA, 13 bp, Homo sapiens
agctgcgggggca

SEQ ID NO: 5361054 - DNA, 18 bp, Homo sapiens
agctgcggtgtctccctg

SEQ ID NO: 5361055 - DNA, 17 bp, Homo sapiens
agctgcgttctgagggc

SEQ ID NO: 5361056 - DNA, 13 bp, Homo sapiens
agctgctacaaag

SEQ ID NO: 5361057 - DNA, 15 bp, Homo sapiens
agctgctacaaagaa

SEQ ID NO: 5361058 - DNA, 20 bp, Homo sapiens
agctgctacaaagaagacat

SEQ ID NO: 5361059 - DNA, 21 bp, Homo sapiens
agctgctacaaagaagacatg

SEQ ID NO: 5361060 - DNA, 20 bp, Homo sapiens
agctgctactagctctttga

SEQ ID NO: 5361061 - DNA, 21 bp, Homo sapiens
agctgctaggggaaggactgg

SEQ ID NO: 5361062 - DNA, 15 bp, Homo sapiens
agctgctatatattt

SEQ ID NO: 5361063 - DNA, 18 bp, Homo sapiens
agctgctatatattttaa

SEQ ID NO: 5361064 - DNA, 15 bp, Homo sapiens
agctgctatccaatg

SEQ ID NO: 5361065 - DNA, 18 bp, Homo sapiens
agctgctatccccatctc

SEQ ID NO: 5361066 - DNA, 19 bp, Homo sapiens
agctgctatccccatctcc

SEQ ID NO: 5361067 - DNA, 11 bp, Homo sapiens
agctgctcact

SEQ ID NO: 5361068 - DNA, 16 bp, Homo sapiens
agctgtggctccctcc

SEQ ID NO: 5361069 - DNA, 21 bp, Homo sapiens
agctgtggctggaggagctgg

SEQ ID NO: 5361070 - DNA, 23 bp, Homo sapiens
agctgtggctggaggagctggcc

SEQ ID NO: 5361071 - DNA, 17 bp, Homo sapiens
agctgtggctgggggga

SEQ ID NO: 5361072 - DNA, 18 bp, Homo sapiens
agctgtgggcggctcctg

SEQ ID NO: 5361073 - DNA, 23 bp, Homo sapiens
agctgtgggcggctcctggtgct

SEQ ID NO: 5361074 - DNA, 17 bp, Homo sapiens
agctgtggggagctggt

SEQ ID NO: 5361075 - DNA, 19 bp, Homo sapiens
agctgtggtcccacccagg

SEQ ID NO: 5361076 - DNA, 18 bp, Homo sapiens
agctgtggtgtgaaaatg

SEQ ID NO: 5361077 - DNA, 16 bp, Homo sapiens
agctgtgtatctgttt

SEQ ID NO: 5361078 - DNA, 16 bp, Homo sapiens
agctgtgtccttcggg

SEQ ID NO: 5361079 - DNA, 15 bp, Homo sapiens
agctgtgtccttgca

SEQ ID NO: 5361080 - DNA, 20 bp, Homo sapiens
agctgtgtccttgcacctgc

SEQ ID NO: 5361081 - DNA, 21 bp, Homo sapiens
agctgtgtccttgcacctgca

SEQ ID NO: 5361082 - DNA, 24 bp, Homo sapiens
agctgtgtccttgcacctgcatcc

SEQ ID NO: 5361083 - DNA, 11 bp, Homo sapiens
agctgtgtctc

SEQ ID NO: 5361084 - DNA, 13 bp, Homo sapiens
agctgtgtctctg

SEQ ID NO: 5361085 - DNA, 14 bp, Homo sapiens
agctgtgtctgagc

SEQ ID NO: 5361086 - DNA, 15 bp, Homo sapiens
agctgtgtctgccaa

SEQ ID NO: 5361087 - DNA, 22 bp, Homo sapiens
agctgtgtctgccaaacacatt

SEQ ID NO: 5361088 - DNA, 23 bp, Homo sapiens
agctgtgtgacatttggagaggg

SEQ ID NO: 5361089 - DNA, 23 bp, Homo sapiens
agctgtgtgcctgcctgggagac

SEQ ID NO: 5361090 - DNA, 14 bp, Homo sapiens
agctgtgtggcagt

SEQ ID NO: 5361091 - DNA, 21 bp, Homo sapiens
agctgtgtgttttcaatcctt

SEQ ID NO: 5361092 - DNA, 18 bp, Homo sapiens
agctgtgttaactgttca

SEQ ID NO: 5361093 - DNA, 13 bp, Homo sapiens
agctgtgttactt

SEQ ID NO: 5361094 - DNA, 21 bp, Homo sapiens
agctgtgttacttgaagtaac

SEQ ID NO: 5361095 - DNA, 14 bp, Homo sapiens
agctgtgttattat

SEQ ID NO: 5361096 - DNA, 14 bp, Homo sapiens
agctgtgttcacag

SEQ ID NO: 5361097 - DNA, 17 bp, Homo sapiens
agctgtgttcacagacc

SEQ ID NO: 5361098 - DNA, 16 bp, Homo sapiens
agctgtgttcatccag

SEQ ID NO: 5361099 - DNA, 22 bp, Homo sapiens
agctgtgttcatccagctactt

SEQ ID NO: 5361100 - DNA, 18 bp, Homo sapiens
agctgtgttgaaacagaa

SEQ ID NO: 5361101 - DNA, 14 bp, Homo sapiens
agctgtgtttctta

SEQ ID NO: 5361102 - DNA, 21 bp, Homo sapiens
agctgtgttttgtctgagcct

SEQ ID NO: 5361103 - DNA, 19 bp, Homo sapiens
agctgttaccattcacaat

SEQ ID NO: 5361104 - DNA, 19 bp, Homo sapiens
agctgttactgtcttcagt

SEQ ID NO: 5361105 - DNA, 18 bp, Homo sapiens
agctgttagttgctgttt

SEQ ID NO: 5361106 - DNA, 14 bp, Homo sapiens
agctgttatgctgt

SEQ ID NO: 5361107 - DNA, 15 bp, Homo sapiens
agctgttatgctgtt

SEQ ID NO: 5361108 - DNA, 17 bp, Homo sapiens
agctgttattcttgtta

SEQ ID NO: 5361109 - DNA, 19 bp, Homo sapiens
agctgttatttctattttt

SEQ ID NO: 5361110 - DNA, 19 bp, Homo sapiens
agctgttatttcttccctg

SEQ ID NO: 5361111 - DNA, 23 bp, Homo sapiens
agctgttattttgcatatatgtt

SEQ ID NO: 5361112 - DNA, 19 bp, Homo sapiens
agctgttcaacaagagtaa

SEQ ID NO: 5361113 - DNA, 21 bp, Homo sapiens
agctgttcaacaagagtaaat

SEQ ID NO: 5361114 - DNA, 19 bp, Homo sapiens
agctgttcacagccagact

SEQ ID NO: 5361115 - DNA, 14 bp, Homo sapiens
agctgttcagctgg

SEQ ID NO: 5361116 - DNA, 13 bp, Homo sapiens
agctgttcctgtg

SEQ ID NO: 5361117 - DNA, 20 bp, Homo sapiens
agctgttccttggtcctagt

SEQ ID NO: 5361118 - DNA, 17 bp, Homo sapiens
agctgttcgctcctccc

SEQ ID NO: 5361119 - DNA, 17 bp, Homo sapiens
agctgttctaatggatt

SEQ ID NO: 5361120 - DNA, 15 bp, Homo sapiens
agctgttctcattcc

SEQ ID NO: 5361121 - DNA, 21 bp, Homo sapiens
agctgttctcattcctgttct

SEQ ID NO: 5361122 - DNA, 22 bp, Homo sapiens
agctgttctcattcctgttctt

SEQ ID NO: 5361123 - DNA, 15 bp, Homo sapiens
agctgttctctgctt

SEQ ID NO: 5361124 - DNA, 15 bp, Homo sapiens
agctgttctgtccct

SEQ ID NO: 5361125 - DNA, 20 bp, Homo sapiens
agctgttctgtcccttggag

SEQ ID NO: 5361126 - DNA, 18 bp, Homo sapiens
agctgttctgtcttccca

SEQ ID NO: 5361127 - DNA, 14 bp, Homo sapiens
agctgttcttcctg

SEQ ID NO: 5361128 - DNA, 15 bp, Homo sapiens
agctgttcttcctgg

SEQ ID NO: 5361129 - DNA, 16 bp, Homo sapiens
agctgttcttgaaagc

SEQ ID NO: 5361130 - DNA, 17 bp, Homo sapiens
agctgttcttgaaagcc

SEQ ID NO: 5361131 - DNA, 15 bp, Homo sapiens
agctgttctttttga

SEQ ID NO: 5361132 - DNA, 19 bp, Homo sapiens
agctgttcttttttgtact

SEQ ID NO: 5361133 - DNA, 13 bp, Homo sapiens
agctgttgaccag

SEQ ID NO: 5361134 - DNA, 18 bp, Homo sapiens
agctgttgaccaggcacc

SEQ ID NO: 5361135 - DNA, 20 bp, Homo sapiens
agctgttgactctagtactg

SEQ ID NO: 5361136 - DNA, 15 bp, Homo sapiens
agctgttgagaaaac

SEQ ID NO: 5361137 - DNA, 16 bp, Homo sapiens
agctgttgagctgttt

SEQ ID NO: 5361138 - DNA, 18 bp, Homo sapiens
agctgttgatctttcact

SEQ ID NO: 5361139 - DNA, 16 bp, Homo sapiens
agctgttgcagatgaa

SEQ ID NO: 5361140 - DNA, 20 bp, Homo sapiens
agctgttgcagatgaaatgt

SEQ ID NO: 5361141 - DNA, 14 bp, Homo sapiens
agctgttgcaggca

SEQ ID NO: 5361142 - DNA, 17 bp, Homo sapiens
agctgttgcaggcagtg

SEQ ID NO: 5361143 - DNA, 20 bp, Homo sapiens
agctgttgcaggcagtgtct

SEQ ID NO: 5361144 - DNA, 22 bp, Homo sapiens
agctgttgcaggcagtgtctta

SEQ ID NO: 5361145 - DNA, 14 bp, Homo sapiens
agctgttggaagaa

SEQ ID NO: 5361146 - DNA, 16 bp, Homo sapiens
agctgttgtaaagaat

SEQ ID NO: 5361147 - DNA, 23 bp, Homo sapiens
agctgttgtacatttatgattta

SEQ ID NO: 5361148 - DNA, 19 bp, Homo sapiens
agctgttgtctcttctcct

SEQ ID NO: 5361149 - DNA, 20 bp, Homo sapiens
agctgttgtgagctttgaag

SEQ ID NO: 5361150 - DNA, 16 bp, Homo sapiens
agctgtttactaggga

SEQ ID NO: 5361151 - DNA, 23 bp, Homo sapiens
agctgtttactgacatggtgctg

SEQ ID NO: 5361152 - DNA, 22 bp, Homo sapiens
agctgtttatttattcactgta

SEQ ID NO: 5361153 - DNA, 14 bp, Homo sapiens
agctgtttcaaagt

SEQ ID NO: 5361154 - DNA, 15 bp, Homo sapiens
agctgtttcaaagtt

SEQ ID NO: 5361155 - DNA, 21 bp, Homo sapiens
agctgtttccagttgttactg

SEQ ID NO: 5361156 - DNA, 14 bp, Homo sapiens
agctgtttctcatg

SEQ ID NO: 5361157 - DNA, 22 bp, Homo sapiens
agctgtttctcatgaagctaat

SEQ ID NO: 5361158 - DNA, 14 bp, Homo sapiens
agctgtttgaaatg

SEQ ID NO: 5361159 - DNA, 21 bp, Homo sapiens
agctgtttggatacagctgct

SEQ ID NO: 5361160 - DNA, 24 bp, Homo sapiens
agctgtttggttttaaaatactgt

SEQ ID NO: 5361161 - DNA, 14 bp, Homo sapiens
agctgttttggaac

SEQ ID NO: 5361162 - DNA, 18 bp, Homo sapiens
agctgttttgtgtatatt

SEQ ID NO: 5361163 - DNA, 23 bp, Homo sapiens
agctgttttgttgacattctgaa

SEQ ID NO: 5361164 - DNA, 13 bp, Homo sapiens
agcttaaaaaaag

SEQ ID NO: 5361165 - DNA, 17 bp, Homo sapiens
agcttaaaaaaaggaaa

SEQ ID NO: 5361166 - DNA, 18 bp, Homo sapiens
agcttaaaaaaaggaaaa

SEQ ID NO: 5361167 - DNA, 13 bp, Homo sapiens
agcttaaaaagag

SEQ ID NO: 5361168 - DNA, 13 bp, Homo sapiens
agcttaaaacact

SEQ ID NO: 5361169 - DNA, 16 bp, Homo sapiens
agcttaaaactttgaa

SEQ ID NO: 5361170 - DNA, 20 bp, Homo sapiens
agcttaaaataaacagttgt

SEQ ID NO: 5361171 - DNA, 13 bp, Homo sapiens
agcttaaaataag

SEQ ID NO: 5361172 - DNA, 16 bp, Homo sapiens
agcttaaaataagtga

SEQ ID NO: 5361173 - DNA, 15 bp, Homo sapiens
agcttaaaatacaag

SEQ ID NO: 5361174 - DNA, 21 bp, Homo sapiens
agcttaaacccatacaatgta

SEQ ID NO: 5361175 - DNA, 22 bp, Homo sapiens
agcttaaacccatacaatgtat

SEQ ID NO: 5361176 - DNA, 23 bp, Homo sapiens
agcttaaacccatacaatgtatg

SEQ ID NO: 5361177 - DNA, 17 bp, Homo sapiens
agcttaaactgaatttg

SEQ ID NO: 5361178 - DNA, 16 bp, Homo sapiens
agcttaaagagcacag

SEQ ID NO: 5361179 - DNA, 17 bp, Homo sapiens
agcttaaataaattcaa

SEQ ID NO: 5361180 - DNA, 19 bp, Homo sapiens
agcttaaataaattcaaac

SEQ ID NO: 5361181 - DNA, 22 bp, Homo sapiens
agcttaaataacaaaactgtgc

SEQ ID NO: 5361182 - DNA, 16 bp, Homo sapiens
agcttaaataggaaag

SEQ ID NO: 5361183 - DNA, 22 bp, Homo sapiens
agcttaaattcttcaagaaaga

SEQ ID NO: 5361184 - DNA, 23 bp, Homo sapiens
agcttaaattgcttttgttgtga

SEQ ID NO: 5361185 - DNA, 24 bp, Homo sapiens
agcttaaattgcttttgttgtgac

SEQ ID NO: 5361186 - DNA, 22 bp, Homo sapiens
agcttaacattgacttcttggt

SEQ ID NO: 5361187 - DNA, 12 bp, Homo sapiens
agcttaacattt

SEQ ID NO: 5361188 - DNA, 20 bp, Homo sapiens
agcttaacatttcatgtagt

SEQ ID NO: 5361189 - DNA, 14 bp, Homo sapiens
agcttaactttata

SEQ ID NO: 5361190 - DNA, 17 bp, Homo sapiens
agcttaagagtccaact

SEQ ID NO: 5361191 - DNA, 22 bp, Homo sapiens
agcttaagagtccaactcactt

SEQ ID NO: 5361192 - DNA, 16 bp, Homo sapiens
agcttaagccactgcc

SEQ ID NO: 5361193 - DNA, 20 bp, Homo sapiens
agcttaagccactgcctctc

SEQ ID NO: 5361194 - DNA, 21 bp, Homo sapiens
agcttaagccactgcctctcc

SEQ ID NO: 5361195 - DNA, 21 bp, Homo sapiens
agcttaagggaatatgcattg

SEQ ID NO: 5361196 - DNA, 21 bp, Homo sapiens
agcttaatagccctccccctc

SEQ ID NO: 5361197 - DNA, 12 bp, Homo sapiens
agcttaatagct

SEQ ID NO: 5361198 - DNA, 13 bp, Homo sapiens
agcttaatatatt

SEQ ID NO: 5361199 - DNA, 15 bp, Homo sapiens
agcttaatcttaatg

SEQ ID NO: 5361200 - DNA, 12 bp, Homo sapiens
agcttaatgtct

SEQ ID NO: 5361201 - DNA, 16 bp, Homo sapiens
agcttaattctccttc

SEQ ID NO: 5361202 - DNA, 17 bp, Homo sapiens
agcttaattctccttcc

SEQ ID NO: 5361203 - DNA, 19 bp, Homo sapiens
agcttaatttttaaaaaca

SEQ ID NO: 5361204 - DNA, 19 bp, Homo sapiens
agcttacactgaggactgt

SEQ ID NO: 5361205 - DNA, 13 bp, Homo sapiens
agcttacaggaag

SEQ ID NO: 5361206 - DNA, 14 bp, Homo sapiens
agcttacaggagcc

SEQ ID NO: 5361207 - DNA, 16 bp, Homo sapiens
agcttacaggagccag

SEQ ID NO: 5361208 - DNA, 12 bp, Homo sapiens
agcttacccaag

SEQ ID NO: 5361209 - DNA, 20 bp, Homo sapiens
agcttacccaagctgtggca

SEQ ID NO: 5361210 - DNA, 21 bp, Homo sapiens
agcttacccttggtttgcaca

SEQ ID NO: 5361211 - DNA, 17 bp, Homo sapiens
agcttacctcccacctt

SEQ ID NO: 5361212 - DNA, 21 bp, Homo sapiens
agcttacctgaacaggaatcc

SEQ ID NO: 5361213 - DNA, 17 bp, Homo sapiens
agcttacctgacacaag

SEQ ID NO: 5361214 - DNA, 15 bp, Homo sapiens
agcttacctgggcac

SEQ ID NO: 5361215 - DNA, 13 bp, Homo sapiens
agcttactacagt

SEQ ID NO: 5361216 - DNA, 19 bp, Homo sapiens
agcttactataaatgatat

SEQ ID NO: 5361217 - DNA, 23 bp, Homo sapiens
agcttactctctgcttccgttcc

SEQ ID NO: 5361218 - DNA, 21 bp, Homo sapiens
agcttactctgtccatttatc

SEQ ID NO: 5361219 - DNA, 17 bp, Homo sapiens
agcttagacctcagcct

SEQ ID NO: 5361220 - DNA, 19 bp, Homo sapiens
agcttagacctcagcctgt

SEQ ID NO: 5361221 - DNA, 20 bp, Homo sapiens
agcttagacctcagcctgtg

SEQ ID NO: 5361222 - DNA, 15 bp, Homo sapiens
agcttagactaaggc

SEQ ID NO: 5361223 - DNA, 18 bp, Homo sapiens
agcttagagttcttcttt

SEQ ID NO: 5361224 - DNA, 22 bp, Homo sapiens
agcttagagttggccatattta

SEQ ID NO: 5361225 - DNA, 15 bp, Homo sapiens
agcttagatttcata

SEQ ID NO: 5361226 - DNA, 17 bp, Homo sapiens
agcttagattttctgta

SEQ ID NO: 5361227 - DNA, 18 bp, Homo sapiens
agcttagattttctgtaa

SEQ ID NO: 5361228 - DNA, 14 bp, Homo sapiens
agcttagcaggaga

SEQ ID NO: 5361229 - DNA, 20 bp, Homo sapiens
agcttagccttgtgccctgc

SEQ ID NO: 5361230 - DNA, 15 bp, Homo sapiens
agcttagggccctgg

SEQ ID NO: 5361231 - DNA, 17 bp, Homo sapiens
agcttagggccctggag

SEQ ID NO: 5361232 - DNA, 19 bp, Homo sapiens
agcttagggccctggaggc

SEQ ID NO: 5361233 - DNA, 17 bp, Homo sapiens
agcttagggtctcaggg

SEQ ID NO: 5361234 - DNA, 18 bp, Homo sapiens
agcttagggtctcagggt

SEQ ID NO: 5361235 - DNA, 13 bp, Homo sapiens
agcttaggtcaaa

SEQ ID NO: 5361236 - DNA, 18 bp, Homo sapiens
agcttagtgagcagtgag

SEQ ID NO: 5361237 - DNA, 22 bp, Homo sapiens
agcttagtgagcagtgagcact

SEQ ID NO: 5361238 - DNA, 15 bp, Homo sapiens
agcttagtgtataca

SEQ ID NO: 5361239 - DNA, 13 bp, Homo sapiens
agcttagtgtctc

SEQ ID NO: 5361240 - DNA, 20 bp, Homo sapiens
agcttagttttttttaaaaa

SEQ ID NO: 5361241 - DNA, 23 bp, Homo sapiens
agcttataaaaataaagggaaga

SEQ ID NO: 5361242 - DNA, 20 bp, Homo sapiens
agcttataagagggcatata

SEQ ID NO: 5361243 - DNA, 20 bp, Homo sapiens
agcttatacgaaataattgt

SEQ ID NO: 5361244 - DNA, 16 bp, Homo sapiens
agctttagacagcaga

SEQ ID NO: 5361245 - DNA, 13 bp, Homo sapiens
agctttagaccct

SEQ ID NO: 5361246 - DNA, 20 bp, Homo sapiens
agctttagattgaaatttat

SEQ ID NO: 5361247 - DNA, 21 bp, Homo sapiens
agctttagattgaaatttatg

SEQ ID NO: 5361248 - DNA, 22 bp, Homo sapiens
agctttagattgaaatttatga

SEQ ID NO: 5361249 - DNA, 18 bp, Homo sapiens
agctttagtgaattaaat

SEQ ID NO: 5361250 - DNA, 17 bp, Homo sapiens
agctttataaagcagtt

SEQ ID NO: 5361251 - DNA, 21 bp, Homo sapiens
agctttataataaactgttta

SEQ ID NO: 5361252 - DNA, 14 bp, Homo sapiens
agctttatacgtgt

SEQ ID NO: 5361253 - DNA, 17 bp, Homo sapiens
agctttatatattgatt

SEQ ID NO: 5361254 - DNA, 15 bp, Homo sapiens
agctttatatgtaat

SEQ ID NO: 5361255 - DNA, 23 bp, Homo sapiens
agctttatcaccagagagggact

SEQ ID NO: 5361256 - DNA, 21 bp, Homo sapiens
agctttatccccgtttcttgc

SEQ ID NO: 5361257 - DNA, 22 bp, Homo sapiens
agctttatccccgtttcttgca

SEQ ID NO: 5361258 - DNA, 16 bp, Homo sapiens
agctttatctgtcaca

SEQ ID NO: 5361259 - DNA, 14 bp, Homo sapiens
agctttatctttgt

SEQ ID NO: 5361260 - DNA, 23 bp, Homo sapiens
agctttatctttgtgtaatctaa

SEQ ID NO: 5361261 - DNA, 14 bp, Homo sapiens
agctttatgtaata

SEQ ID NO: 5361262 - DNA, 23 bp, Homo sapiens
agctttatgttcatttgtttgtt

SEQ ID NO: 5361263 - DNA, 18 bp, Homo sapiens
agctttattatggcttgt

SEQ ID NO: 5361264 - DNA, 14 bp, Homo sapiens
agctttattgaagt

SEQ ID NO: 5361265 - DNA, 21 bp, Homo sapiens
agctttattgctgcattttaa

SEQ ID NO: 5361266 - DNA, 14 bp, Homo sapiens
agctttattgtgat

SEQ ID NO: 5361267 - DNA, 22 bp, Homo sapiens
agctttatttatagaaatgaca

SEQ ID NO: 5361268 - DNA, 19 bp, Homo sapiens
agctttatttatttctttg

SEQ ID NO: 5361269 - DNA, 13 bp, Homo sapiens
agctttatttcta

SEQ ID NO: 5361270 - DNA, 15 bp, Homo sapiens
agctttattttaaat

SEQ ID NO: 5361271 - DNA, 15 bp, Homo sapiens
agctttatttttctt

SEQ ID NO: 5361272 - DNA, 18 bp, Homo sapiens
agctttatttttcttttc

SEQ ID NO: 5361273 - DNA, 19 bp, Homo sapiens
agctttattttttaagtat

SEQ ID NO: 5361274 - DNA, 22 bp, Homo sapiens
agctttcaaaaattagtgaagt

SEQ ID NO: 5361275 - DNA, 15 bp, Homo sapiens
agctttcaaagcatt

SEQ ID NO: 5361276 - DNA, 16 bp, Homo sapiens
agctttcaagtgcctt

SEQ ID NO: 5361277 - DNA, 16 bp, Homo sapiens
agctttcagaatatgt

SEQ ID NO: 5361278 - DNA, 15 bp, Homo sapiens
agctttcagagccag

SEQ ID NO: 5361279 - DNA, 15 bp, Homo sapiens
agctttcatttgaca

SEQ ID NO: 5361280 - DNA, 17 bp, Homo sapiens
agctttccaaggaagca

SEQ ID NO: 5361281 - DNA, 16 bp, Homo sapiens
agctttccatgttgct

SEQ ID NO: 5361282 - DNA, 19 bp, Homo sapiens
agctttccatgttgctgcc

SEQ ID NO: 5361283 - DNA, 20 bp, Homo sapiens
agctttccatgttgctgcca

SEQ ID NO: 5361284 - DNA, 13 bp, Homo sapiens
agctttcccagag

SEQ ID NO: 5361285 - DNA, 22 bp, Homo sapiens
agctttccccatgtctcgactc

SEQ ID NO: 5361286 - DNA, 20 bp, Homo sapiens
agctttcccgcccagcctca

SEQ ID NO: 5361287 - DNA, 16 bp, Homo sapiens
agctttccctgcctct

SEQ ID NO: 5361288 - DNA, 12 bp, Homo sapiens
agctttccctgg

SEQ ID NO: 5361289 - DNA, 16 bp, Homo sapiens
agctttccctggctca

SEQ ID NO: 5361290 - DNA, 21 bp, Homo sapiens
agctttccggggaggagcctt

SEQ ID NO: 5361291 - DNA, 22 bp, Homo sapiens
agctttccggggaggagccttg

SEQ ID NO: 5361292 - DNA, 12 bp, Homo sapiens
agctttcctgcc

SEQ ID NO: 5361293 - DNA, 20 bp, Homo sapiens
agctttcctgccccaggcct

SEQ ID NO: 5361294 - DNA, 21 bp, Homo sapiens
agctttcctgccccaggcctg

SEQ ID NO: 5361295 - DNA, 22 bp, Homo sapiens
agctttcctgccccaggcctga

SEQ ID NO: 5361296 - DNA, 12 bp, Homo sapiens
agctttcctggg

SEQ ID NO: 5361297 - DNA, 13 bp, Homo sapiens
agctttcctgggt

SEQ ID NO: 5361298 - DNA, 15 bp, Homo sapiens
agctttcctgggtct

SEQ ID NO: 5361299 - DNA, 14 bp, Homo sapiens
agctttcctgggtg

SEQ ID NO: 5361300 - DNA, 14 bp, Homo sapiens
agctttcctggtcc

SEQ ID NO: 5361301 - DNA, 18 bp, Homo sapiens
agctttcctggtccctca

SEQ ID NO: 5361302 - DNA, 17 bp, Homo sapiens
agctttccttctgccct

SEQ ID NO: 5361303 - DNA, 18 bp, Homo sapiens
agctttccttctgccctt

SEQ ID NO: 5361304 - DNA, 19 bp, Homo sapiens
agctttcctttccttctgg

SEQ ID NO: 5361305 - DNA, 23 bp, Homo sapiens
agctttcctttccttctggctcc

SEQ ID NO: 5361306 - DNA, 11 bp, Homo sapiens
agctttctaac

SEQ ID NO: 5361307 - DNA, 16 bp, Homo sapiens
agctttctaatgttct

SEQ ID NO: 5361308 - DNA, 17 bp, Homo sapiens
agctttctaatgttcta

SEQ ID NO: 5361309 - DNA, 22 bp, Homo sapiens
agctttctagaagtttcccttc

SEQ ID NO: 5361310 - DNA, 11 bp, Homo sapiens
agctttctcaa

SEQ ID NO: 5361311 - DNA, 17 bp, Homo sapiens
agctttctcaatgtctt

SEQ ID NO: 5361312 - DNA, 21 bp, Homo sapiens
agctttctcctcatccatttc

SEQ ID NO: 5361313 - DNA, 23 bp, Homo sapiens
agctttctcctcatccatttctt

SEQ ID NO: 5361314 - DNA, 17 bp, Homo sapiens
agctttctcctctgcta

SEQ ID NO: 5361315 - DNA, 12 bp, Homo sapiens
agctttctcctt

SEQ ID NO: 5361316 - DNA, 19 bp, Homo sapiens
agctttctcgcgccctccc

SEQ ID NO: 5361317 - DNA, 17 bp, Homo sapiens
agctttctctcagaaat

SEQ ID NO: 5361318 - DNA, 13 bp, Homo sapiens
agctttctctgct

SEQ ID NO: 5361319 - DNA, 21 bp, Homo sapiens
agctttctctgcttcagcttg

SEQ ID NO: 5361320 - DNA, 18 bp, Homo sapiens
agctttctctttgttctt

SEQ ID NO: 5361321 - DNA, 12 bp, Homo sapiens
agctttctgaac

SEQ ID NO: 5361322 - DNA, 18 bp, Homo sapiens
agctttctgaacagctgg

SEQ ID NO: 5361323 - DNA, 22 bp, Homo sapiens
agctttctgaacagctggtgta

SEQ ID NO: 5361324 - DNA, 20 bp, Homo sapiens
agctttctgaccttcagctc

SEQ ID NO: 5361325 - DNA, 23 bp, Homo sapiens
agctttctgagcaagaggatttt

SEQ ID NO: 5361326 - DNA, 20 bp, Homo sapiens
agctttctgaggccctgagc

SEQ ID NO: 5361327 - DNA, 17 bp, Homo sapiens
agctttctgccttagcc

SEQ ID NO: 5361328 - DNA, 12 bp, Homo sapiens
agctttctgtat

SEQ ID NO: 5361329 - DNA, 16 bp, Homo sapiens
agctttctgtgcatgt

SEQ ID NO: 5361330 - DNA, 21 bp, Homo sapiens
agctttctgtgcatgtgcagg

SEQ ID NO: 5361331 - DNA, 15 bp, Homo sapiens
agctttcttctacaa

SEQ ID NO: 5361332 - DNA, 17 bp, Homo sapiens
agctttcttctacaacc

SEQ ID NO: 5361333 - DNA, 16 bp, Homo sapiens
agctttcttgctccct

SEQ ID NO: 5361334 - DNA, 13 bp, Homo sapiens
agctttcttgttt

SEQ ID NO: 5361335 - DNA, 14 bp, Homo sapiens
agctttcttgtttc

SEQ ID NO: 5361336 - DNA, 15 bp, Homo sapiens
agctttcttgtttct

SEQ ID NO: 5361337 - DNA, 14 bp, Homo sapiens
agctttctttcaca

SEQ ID NO: 5361338 - DNA, 21 bp, Homo sapiens
agctttctttgcacttaaaaa

SEQ ID NO: 5361339 - DNA, 22 bp, Homo sapiens
agctttctttttaaagcttttg

SEQ ID NO: 5361340 - DNA, 18 bp, Homo sapiens
agctttgaaaattcagtg

SEQ ID NO: 5361341 - DNA, 22 bp, Homo sapiens
agctttgaaactccatgcaaac

SEQ ID NO: 5361342 - DNA, 22 bp, Homo sapiens
agctttgaaggccgaaggcagt

SEQ ID NO: 5361343 - DNA, 20 bp, Homo sapiens
agctttgaatacccccagag

SEQ ID NO: 5361344 - DNA, 21 bp, Homo sapiens
agctttgaatacccccagaga

SEQ ID NO: 5361345 - DNA, 17 bp, Homo sapiens
agctttgacactggaat

SEQ ID NO: 5361346 - DNA, 22 bp, Homo sapiens
agctttgacactggaatgagtt

SEQ ID NO: 5361347 - DNA, 21 bp, Homo sapiens
agctttgactcaggagcctgt

SEQ ID NO: 5361348 - DNA, 17 bp, Homo sapiens
agctttgagaagccttc

SEQ ID NO: 5361349 - DNA, 15 bp, Homo sapiens
agctttgaggctggc

SEQ ID NO: 5361350 - DNA, 22 bp, Homo sapiens
agctttgaggtggaagagggct

SEQ ID NO: 5361351 - DNA, 15 bp, Homo sapiens
agctttgataattgt

SEQ ID NO: 5361352 - DNA, 16 bp, Homo sapiens
agctttgcagccaagg

SEQ ID NO: 5361353 - DNA, 13 bp, Homo sapiens
agctttgcagtga

SEQ ID NO: 5361354 - DNA, 18 bp, Homo sapiens
agctttgcatgttccact

SEQ ID NO: 5361355 - DNA, 22 bp, Homo sapiens
agctttgcatgttccactaacc

SEQ ID NO: 5361356 - DNA, 20 bp, Homo sapiens
agctttgccagctgctgctg

SEQ ID NO: 5361357 - DNA, 22 bp, Homo sapiens
agctttgctacaaatttatgca

SEQ ID NO: 5361358 - DNA, 20 bp, Homo sapiens
agctttgctccttcagttct

SEQ ID NO: 5361359 - DNA, 21 bp, Homo sapiens
agctttgctctttggtagaaa

SEQ ID NO: 5361360 - DNA, 12 bp, Homo sapiens
agctttgctgct

SEQ ID NO: 5361361 - DNA, 13 bp, Homo sapiens
agctttgctgctg

SEQ ID NO: 5361362 - DNA, 14 bp, Homo sapiens
agctttggaaagtt

SEQ ID NO: 5361363 - DNA, 19 bp, Homo sapiens
agctttggaaagttactgt

SEQ ID NO: 5361364 - DNA, 22 bp, Homo sapiens
agctttggaagtttagctctga

SEQ ID NO: 5361365 - DNA, 14 bp, Homo sapiens
agctttggacacac

SEQ ID NO: 5361366 - DNA, 20 bp, Homo sapiens
agctttggacacacacagct

SEQ ID NO: 5361367 - DNA, 19 bp, Homo sapiens
agctttggacctaatccaa

SEQ ID NO: 5361368 - DNA, 14 bp, Homo sapiens
agctttggacgcac

SEQ ID NO: 5361369 - DNA, 19 bp, Homo sapiens
agctttggacgcacacagc

SEQ ID NO: 5361370 - DNA, 20 bp, Homo sapiens
agctttggacgcacacagct

SEQ ID NO: 5361371 - DNA, 13 bp, Homo sapiens
agctttggccctc

SEQ ID NO: 5361372 - DNA, 14 bp, Homo sapiens
agctttggccctca

SEQ ID NO: 5361373 - DNA, 20 bp, Homo sapiens
agctttggccctcagtgggc

SEQ ID NO: 5361374 - DNA, 21 bp, Homo sapiens
agctttggctatgagggcctt

SEQ ID NO: 5361375 - DNA, 14 bp, Homo sapiens
agctttgggaaagc

SEQ ID NO: 5361376 - DNA, 21 bp, Homo sapiens
agctttgggatcccaccctgg

SEQ ID NO: 5361377 - DNA, 19 bp, Homo sapiens
agctttgggtgaccagcca

SEQ ID NO: 5361378 - DNA, 17 bp, Homo sapiens
agctttggtctgtgtgt

SEQ ID NO: 5361379 - DNA, 16 bp, Homo sapiens
agctttggttggtttt

SEQ ID NO: 5361380 - DNA, 18 bp, Homo sapiens
agctttgtagaaattaaa

SEQ ID NO: 5361381 - DNA, 16 bp, Homo sapiens
agctttgtcacttgcc

SEQ ID NO: 5361382 - DNA, 20 bp, Homo sapiens
agctttgtcccctgcttcag

SEQ ID NO: 5361383 - DNA, 19 bp, Homo sapiens
agctttgtcgtatttggca

SEQ ID NO: 5361384 - DNA, 13 bp, Homo sapiens
agctttgtctcca

SEQ ID NO: 5361385 - DNA, 20 bp, Homo sapiens
agctttgtctccaaagaaga

SEQ ID NO: 5361386 - DNA, 18 bp, Homo sapiens
agctttgtgtttactttt

SEQ ID NO: 5361387 - DNA, 13 bp, Homo sapiens
agctttgttgtcc

SEQ ID NO: 5361388 - DNA, 19 bp, Homo sapiens
agctttgtttcaaccaagt

SEQ ID NO: 5361389 - DNA, 15 bp, Homo sapiens
agctttgtttgttct

SEQ ID NO: 5361390 - DNA, 23 bp, Homo sapiens
agctttgtttgttgtcagctgaa

SEQ ID NO: 5361391 - DNA, 12 bp, Homo sapiens
agcttttaaaaa

SEQ ID NO: 5361392 - DNA, 16 bp, Homo sapiens
agcttttaaaaaatat

SEQ ID NO: 5361393 - DNA, 20 bp, Homo sapiens
agcttttaaaaaatatttta

SEQ ID NO: 5361394 - DNA, 21 bp, Homo sapiens
agcttttaaaaaatattttaa

SEQ ID NO: 5361395 - DNA, 16 bp, Homo sapiens
agcttttaaaaatgtt

SEQ ID NO: 5361396 - DNA, 17 bp, Homo sapiens
agcttttaaaaatgttt

SEQ ID NO: 5361397 - DNA, 16 bp, Homo sapiens
agcttttaaaccctat

SEQ ID NO: 5361398 - DNA, 15 bp, Homo sapiens
agcttttaagaaaaa

SEQ ID NO: 5361399 - DNA, 18 bp, Homo sapiens
agcttttaagaaaaacaa

SEQ ID NO: 5361400 - DNA, 19 bp, Homo sapiens
agcttttaagaaaaacaaa

SEQ ID NO: 5361401 - DNA, 16 bp, Homo sapiens
agcttttaataaaatt

SEQ ID NO: 5361402 - DNA, 23 bp, Homo sapiens
agcttttacagatccagaattta

SEQ ID NO: 5361403 - DNA, 17 bp, Homo sapiens
agcttttagtacccacc

SEQ ID NO: 5361404 - DNA, 17 bp, Homo sapiens
agcttttagttcagact

SEQ ID NO: 5361405 - DNA, 20 bp, Homo sapiens
agcttttatgtgatatgttt

SEQ ID NO: 5361406 - DNA, 23 bp, Homo sapiens
agcttttatgtgatatgttttaa

SEQ ID NO: 5361407 - DNA, 15 bp, Homo sapiens
agcttttattccttt

SEQ ID NO: 5361408 - DNA, 19 bp, Homo sapiens
agcttttattgtataaact

SEQ ID NO: 5361409 - DNA, 20 bp, Homo sapiens
agcttttatttggtgtgttc

SEQ ID NO: 5361410 - DNA, 16 bp, Homo sapiens
agcttttcaaacaaga

SEQ ID NO: 5361411 - DNA, 14 bp, Homo sapiens
agcttttcaccttt

SEQ ID NO: 5361412 - DNA, 22 bp, Homo sapiens
agcttttcacctttactttaga

SEQ ID NO: 5361413 - DNA, 17 bp, Homo sapiens
agcttttcacttcttaa

SEQ ID NO: 5361414 - DNA, 13 bp, Homo sapiens
agcttttcatcaa

SEQ ID NO: 5361415 - DNA, 18 bp, Homo sapiens
agcttttcatcaattctt

SEQ ID NO: 5361416 - DNA, 17 bp, Homo sapiens
agcttttcatggaagtg

SEQ ID NO: 5361417 - DNA, 14 bp, Homo sapiens
agcttttcattgct

SEQ ID NO: 5361418 - DNA, 15 bp, Homo sapiens
agcttttcattttaa

SEQ ID NO: 5361419 - DNA, 16 bp, Homo sapiens
agcttttcattttaat

SEQ ID NO: 5361420 - DNA, 17 bp, Homo sapiens
agcttttcattttaata

SEQ ID NO: 5361421 - DNA, 17 bp, Homo sapiens
aggaaactttttaattg

SEQ ID NO: 5361422 - DNA, 20 bp, Homo sapiens
aggaaactttttccaccttt

SEQ ID NO: 5361423 - DNA, 13 bp, Homo sapiens
aggaaagaaaagg

SEQ ID NO: 5361424 - DNA, 11 bp, Homo sapiens
aggaaagaaat

SEQ ID NO: 5361425 - DNA, 15 bp, Homo sapiens
aggaaagaaggagat

SEQ ID NO: 5361426 - DNA, 19 bp, Homo sapiens
aggaaagaagggggccctg

SEQ ID NO: 5361427 - DNA, 18 bp, Homo sapiens
aggaaagacaggctgagc

SEQ ID NO: 5361428 - DNA, 15 bp, Homo sapiens
aggaaagagaagctt

SEQ ID NO: 5361429 - DNA, 16 bp, Homo sapiens
aggaaagagagtttgt

SEQ ID NO: 5361430 - DNA, 23 bp, Homo sapiens
aggaaagagctaggaaccctgga

SEQ ID NO: 5361431 - DNA, 21 bp, Homo sapiens
aggaaagagggagcaggtgcc

SEQ ID NO: 5361432 - DNA, 17 bp, Homo sapiens
aggaaagatcccaagtc

SEQ ID NO: 5361433 - DNA, 15 bp, Homo sapiens
aggaaagatgtccca

SEQ ID NO: 5361434 - DNA, 16 bp, Homo sapiens
aggaaagatgtcccac

SEQ ID NO: 5361435 - DNA, 15 bp, Homo sapiens
aggaaagatttgtac

SEQ ID NO: 5361436 - DNA, 17 bp, Homo sapiens
aggaaagcaaaggagat

SEQ ID NO: 5361437 - DNA, 21 bp, Homo sapiens
aggaaagcaaggcagaaggcc

SEQ ID NO: 5361438 - DNA, 20 bp, Homo sapiens
aggaaagcaccgcagcatgt

SEQ ID NO: 5361439 - DNA, 21 bp, Homo sapiens
aggaaagcaccgcagcatgtg

SEQ ID NO: 5361440 - DNA, 22 bp, Homo sapiens
aggaaagcaccgcagcatgtgg

SEQ ID NO: 5361441 - DNA, 21 bp, Homo sapiens
aggaaagcagtgtgtccttgg

SEQ ID NO: 5361442 - DNA, 21 bp, Homo sapiens
aggaaagcatgcattgaaaaa

SEQ ID NO: 5361443 - DNA, 22 bp, Homo sapiens
aggaaagcatgtctctgcttcc

SEQ ID NO: 5361444 - DNA, 20 bp, Homo sapiens
aggaaagccccagcactaac

SEQ ID NO: 5361445 - DNA, 13 bp, Homo sapiens
aggaaagccctcc

SEQ ID NO: 5361446 - DNA, 20 bp, Homo sapiens
aggaaagcctcactgatata

SEQ ID NO: 5361447 - DNA, 21 bp, Homo sapiens
aggaaagcgtggttccaagaa

SEQ ID NO: 5361448 - DNA, 16 bp, Homo sapiens
aggaaagcgtttggaa

SEQ ID NO: 5361449 - DNA, 18 bp, Homo sapiens
aggaaaggaagacctcaa

SEQ ID NO: 5361450 - DNA, 20 bp, Homo sapiens
aggaaaggacggctgagcat

SEQ ID NO: 5361451 - DNA, 24 bp, Homo sapiens
aggaaaggacggctgagcatgtgg

SEQ ID NO: 5361452 - DNA, 14 bp, Homo sapiens
aggaaaggagatca

SEQ ID NO: 5361453 - DNA, 12 bp, Homo sapiens
aggaaaggagca

SEQ ID NO: 5361454 - DNA, 12 bp, Homo sapiens
aggaaaggcaga

SEQ ID NO: 5361455 - DNA, 14 bp, Homo sapiens
aggaaaggcagatg

SEQ ID NO: 5361456 - DNA, 18 bp, Homo sapiens
aggaaaggcatgtacaaa

SEQ ID NO: 5361457 - DNA, 24 bp, Homo sapiens
aggaaaggccagctggcagcagag

SEQ ID NO: 5361458 - DNA, 15 bp, Homo sapiens
aggaaaggctcattt

SEQ ID NO: 5361459 - DNA, 15 bp, Homo sapiens
aggaaaggctccagg

SEQ ID NO: 5361460 - DNA, 18 bp, Homo sapiens
aggaaaggctccaggagc

SEQ ID NO: 5361461 - DNA, 16 bp, Homo sapiens
aggaaagggaagcctg

SEQ ID NO: 5361462 - DNA, 17 bp, Homo sapiens
aggaaagggaagcctga

SEQ ID NO: 5361463 - DNA, 13 bp, Homo sapiens
aggaaagggaagg

SEQ ID NO: 5361464 - DNA, 22 bp, Homo sapiens
aggaaagggaggagtggaggtg

SEQ ID NO: 5361465 - DNA, 13 bp, Homo sapiens
aggaaagggctgg

SEQ ID NO: 5361466 - DNA, 13 bp, Homo sapiens
aggaaaggtagcc

SEQ ID NO: 5361467 - DNA, 20 bp, Homo sapiens
aggaaaggtctcagcttgta

SEQ ID NO: 5361468 - DNA, 23 bp, Homo sapiens
aggaaagtactgcatgatcttac

SEQ ID NO: 5361469 - DNA, 21 bp, Homo sapiens
aggaaagtatctctactttcc

SEQ ID NO: 5361470 - DNA, 22 bp, Homo sapiens
aggaaagtatctctactttcct

SEQ ID NO: 5361471 - DNA, 16 bp, Homo sapiens
aggaaagtcattggct

SEQ ID NO: 5361472 - DNA, 19 bp, Homo sapiens
aggaaagtcattggcttta

SEQ ID NO: 5361473 - DNA, 22 bp, Homo sapiens
aggaaagtcattggctttatcc

SEQ ID NO: 5361474 - DNA, 18 bp, Homo sapiens
aggaaagtgatatgcatt

SEQ ID NO: 5361475 - DNA, 19 bp, Homo sapiens
aggaaagtgcgttctccca

SEQ ID NO: 5361476 - DNA, 21 bp, Homo sapiens
aggaaagttcagagttttctg

SEQ ID NO: 5361477 - DNA, 15 bp, Homo sapiens
aggaaagttctatta

SEQ ID NO: 5361478 - DNA, 20 bp, Homo sapiens
aggaaagtttctttgaaaat

SEQ ID NO: 5361479 - DNA, 14 bp, Homo sapiens
aggaaataaaacct

SEQ ID NO: 5361480 - DNA, 16 bp, Homo sapiens
aggaaataaaaccttt

SEQ ID NO: 5361481 - DNA, 20 bp, Homo sapiens
aggaaataaaacctttcaaa

SEQ ID NO: 5361482 - DNA, 14 bp, Homo sapiens
aggaaataaacatt

SEQ ID NO: 5361483 - DNA, 16 bp, Homo sapiens
aggaaataaacattac

SEQ ID NO: 5361484 - DNA, 16 bp, Homo sapiens
aggaaataacagagag

SEQ ID NO: 5361485 - DNA, 20 bp, Homo sapiens
aggaaataacagagagaatg

SEQ ID NO: 5361486 - DNA, 14 bp, Homo sapiens
aggaaataacattg

SEQ ID NO: 5361487 - DNA, 15 bp, Homo sapiens
aggaaataagccgag

SEQ ID NO: 5361488 - DNA, 15 bp, Homo sapiens
aggaaatacacttct

SEQ ID NO: 5361489 - DNA, 22 bp, Homo sapiens
aggaaatactttgcataaatta

SEQ ID NO: 5361490 - DNA, 23 bp, Homo sapiens
aggaaatactttgcataaattaa

SEQ ID NO: 5361491 - DNA, 15 bp, Homo sapiens
aggaaatatactttt

SEQ ID NO: 5361492 - DNA, 20 bp, Homo sapiens
aggaaatatatatgtgtgtg

SEQ ID NO: 5361493 - DNA, 12 bp, Homo sapiens
aggaaatatatt

SEQ ID NO: 5361494 - DNA, 15 bp, Homo sapiens
aggaaatatttttca

SEQ ID NO: 5361495 - DNA, 14 bp, Homo sapiens
aggaaatcaaagtg

SEQ ID NO: 5361496 - DNA, 19 bp, Homo sapiens
aggaaatcaaagtgctatt

SEQ ID NO: 5361497 - DNA, 15 bp, Homo sapiens
aggaaatcaccgaaa

SEQ ID NO: 5361498 - DNA, 16 bp, Homo sapiens
aggaaatccagcccca

SEQ ID NO: 5361499 - DNA, 14 bp, Homo sapiens
aggaaatccagggt

SEQ ID NO: 5361500 - DNA, 17 bp, Homo sapiens
aggaaatccagggtggt

SEQ ID NO: 5361501 - DNA, 19 bp, Homo sapiens
aggaaatccagtagggaaa

SEQ ID NO: 5361502 - DNA, 20 bp, Homo sapiens
aggaaatccattgtttaaag

SEQ ID NO: 5361503 - DNA, 22 bp, Homo sapiens
aggaaatccccgggaagagtta

SEQ ID NO: 5361504 - DNA, 13 bp, Homo sapiens
aggaaatcccttc

SEQ ID NO: 5361505 - DNA, 18 bp, Homo sapiens
aggaaatccggtcagcca

SEQ ID NO: 5361506 - DNA, 19 bp, Homo sapiens
aggaaatctcctcttttgt

SEQ ID NO: 5361507 - DNA, 18 bp, Homo sapiens
aggaaatctgaagccttt

SEQ ID NO: 5361508 - DNA, 23 bp, Homo sapiens
aggaaatctgaagccttttcctg

SEQ ID NO: 5361509 - DNA, 16 bp, Homo sapiens
aggaaatctgaatgta

SEQ ID NO: 5361510 - DNA, 11 bp, Homo sapiens
aggaaatctgg

SEQ ID NO: 5361511 - DNA, 13 bp, Homo sapiens
aggaaatgaacat

SEQ ID NO: 5361512 - DNA, 17 bp, Homo sapiens
aggaaatgagtggccag

SEQ ID NO: 5361513 - DNA, 14 bp, Homo sapiens
aggaaatgccaaag

SEQ ID NO: 5361514 - DNA, 23 bp, Homo sapiens
aggaaatgctgacccatgggcag

SEQ ID NO: 5361515 - DNA, 21 bp, Homo sapiens
aggaaatggtttccatctgta

SEQ ID NO: 5361516 - DNA, 23 bp, Homo sapiens
aggaaatgtcacagaagcagcta

SEQ ID NO: 5361517 - DNA, 17 bp, Homo sapiens
aggaaatgtcctgcatg

SEQ ID NO: 5361518 - DNA, 14 bp, Homo sapiens
aggaaatgttattg

SEQ ID NO: 5361519 - DNA, 15 bp, Homo sapiens
aggaaatgttggaac

SEQ ID NO: 5361520 - DNA, 22 bp, Homo sapiens
aggaaatgttggaactctgtgc

SEQ ID NO: 5361521 - DNA, 23 bp, Homo sapiens
aggaaatgtttgagttttcaaag

SEQ ID NO: 5361522 - DNA, 20 bp, Homo sapiens
aggaaatgtttttaataaaa

SEQ ID NO: 5361523 - DNA, 19 bp, Homo sapiens
aggaaattaaagtcttcca

SEQ ID NO: 5361524 - DNA, 15 bp, Homo sapiens
aggaaattaaataat

SEQ ID NO: 5361525 - DNA, 17 bp, Homo sapiens
aggaaattagtcttttt

SEQ ID NO: 5361526 - DNA, 20 bp, Homo sapiens
aggaaattcagattgtttaa

SEQ ID NO: 5361527 - DNA, 16 bp, Homo sapiens
aggaaattctccactg

SEQ ID NO: 5361528 - DNA, 14 bp, Homo sapiens
aggaaatttttgca

SEQ ID NO: 5361529 - DNA, 17 bp, Homo sapiens
aggaaatttttgcatgt

SEQ ID NO: 5361530 - DNA, 22 bp, Homo sapiens
aggaaatttttgcatgtttaat

SEQ ID NO: 5361531 - DNA, 22 bp, Homo sapiens
aggaacaaaaaaaccacaaagg

SEQ ID NO: 5361532 - DNA, 16 bp, Homo sapiens
aggaacaaaaattaca

SEQ ID NO: 5361533 - DNA, 14 bp, Homo sapiens
aggaacaaacaggg

SEQ ID NO: 5361534 - DNA, 15 bp, Homo sapiens
aggaacaaagacagg

SEQ ID NO: 5361535 - DNA, 17 bp, Homo sapiens
aggaacaagacccccag

SEQ ID NO: 5361536 - DNA, 14 bp, Homo sapiens
aggaacaagactga

SEQ ID NO: 5361537 - DNA, 17 bp, Homo sapiens
aggaacaatctttgctg

SEQ ID NO: 5361538 - DNA, 23 bp, Homo sapiens
aggaacaatgccgcctgtcaata

SEQ ID NO: 5361539 - DNA, 16 bp, Homo sapiens
aggaacacccggaaag

SEQ ID NO: 5361540 - DNA, 19 bp, Homo sapiens
aggaacacccggaaagact

SEQ ID NO: 5361541 - DNA, 20 bp, Homo sapiens
aggaacacccggaaagactg

SEQ ID NO: 5361542 - DNA, 12 bp, Homo sapiens
aggaacacctga

SEQ ID NO: 5361543 - DNA, 15 bp, Homo sapiens
aggaacactctgaat

SEQ ID NO: 5361544 - DNA, 13 bp, Homo sapiens
aggaacactgaca

SEQ ID NO: 5361545 - DNA, 14 bp, Homo sapiens
aggaacactggaaa

SEQ ID NO: 5361546 - DNA, 19 bp, Homo sapiens
aggaacactggcttgaagg

SEQ ID NO: 5361547 - DNA, 22 bp, Homo sapiens
aggaacagccacaaaatacaca

SEQ ID NO: 5361548 - DNA, 12 bp, Homo sapiens
aggaacagccca

SEQ ID NO: 5361549 - DNA, 17 bp, Homo sapiens
aggaacaggtttaaaaa

SEQ ID NO: 5361550 - DNA, 14 bp, Homo sapiens
aggaacagtggctg

SEQ ID NO: 5361551 - DNA, 19 bp, Homo sapiens
aggaacatatgaaaataca

SEQ ID NO: 5361552 - DNA, 22 bp, Homo sapiens
aggaacatgacccgtacacacc

SEQ ID NO: 5361553 - DNA, 20 bp, Homo sapiens
aggaacatggagctgtcatc

SEQ ID NO: 5361554 - DNA, 14 bp, Homo sapiens
aggaacatgtaact

SEQ ID NO: 5361555 - DNA, 23 bp, Homo sapiens
aggaaccacaccaatgcaacatt

SEQ ID NO: 5361556 - DNA, 15 bp, Homo sapiens
aggaaccatggacct

SEQ ID NO: 5361557 - DNA, 22 bp, Homo sapiens
aggaacccagctctcagggctg

SEQ ID NO: 5361558 - DNA, 18 bp, Homo sapiens
aggaacccatcactgtgt

SEQ ID NO: 5361559 - DNA, 21 bp, Homo sapiens
aggaacccatcactgtgtctc

SEQ ID NO: 5361560 - DNA, 21 bp, Homo sapiens
aggaacccccacaaccccctc

SEQ ID NO: 5361561 - DNA, 15 bp, Homo sapiens
aggaacccccaccag

SEQ ID NO: 5361562 - DNA, 17 bp, Homo sapiens
aggaacccccaccagac

SEQ ID NO: 5361563 - DNA, 19 bp, Homo sapiens
aggaacccggtcccaggcc

SEQ ID NO: 5361564 - DNA, 22 bp, Homo sapiens
aggaaccctcaggccaccctcc

SEQ ID NO: 5361565 - DNA, 14 bp, Homo sapiens
aggaaccctggaga

SEQ ID NO: 5361566 - DNA, 20 bp, Homo sapiens
aggaaccctggagacagaag

SEQ ID NO: 5361567 - DNA, 15 bp, Homo sapiens
aggaaccctggaggt

SEQ ID NO: 5361568 - DNA, 14 bp, Homo sapiens
aggaaccgaggact

SEQ ID NO: 5361569 - DNA, 16 bp, Homo sapiens
aggaaccgaggcaggg

SEQ ID NO: 5361570 - DNA, 22 bp, Homo sapiens
aggaaccgcccagtgcaggtat

SEQ ID NO: 5361571 - DNA, 22 bp, Homo sapiens
aggaaccgtggtatgtctgcca

SEQ ID NO: 5361572 - DNA, 23 bp, Homo sapiens
aggaaccgtggtatgtctgccat

SEQ ID NO: 5361573 - DNA, 23 bp, Homo sapiens
aggaacctcgaagctgttctctg

SEQ ID NO: 5361574 - DNA, 20 bp, Homo sapiens
aggaacctcgagtactgtgg

SEQ ID NO: 5361575 - DNA, 17 bp, Homo sapiens
aggaacctctgatttat

SEQ ID NO: 5361576 - DNA, 18 bp, Homo sapiens
aggaacctctgatttatt

SEQ ID NO: 5361577 - DNA, 22 bp, Homo sapiens
aggaacctctgatttattttgt

SEQ ID NO: 5361578 - DNA, 14 bp, Homo sapiens
aggaaccttccttc

SEQ ID NO: 5361579 - DNA, 16 bp, Homo sapiens
aggaaccttctccctt

SEQ ID NO: 5361580 - DNA, 21 bp, Homo sapiens
aggaaccttctcccttcttgg

SEQ ID NO: 5361581 - DNA, 16 bp, Homo sapiens
aggaacgagcactggc

SEQ ID NO: 5361582 - DNA, 18 bp, Homo sapiens
aggaacgtggttcagaga

SEQ ID NO: 5361583 - DNA, 19 bp, Homo sapiens
aggaacgtggttcagagac

SEQ ID NO: 5361584 - DNA, 22 bp, Homo sapiens
aggaacgtggttcagagactgg

SEQ ID NO: 5361585 - DNA, 16 bp, Homo sapiens
aggaactagtaaacat

SEQ ID NO: 5361586 - DNA, 13 bp, Homo sapiens
aggaactcacata

SEQ ID NO: 5361587 - DNA, 14 bp, Homo sapiens
aggaactccaggac

SEQ ID NO: 5361588 - DNA, 14 bp, Homo sapiens
aggaactcccagca

SEQ ID NO: 5361589 - DNA, 21 bp, Homo sapiens
aggaactccccttcttcctgg

SEQ ID NO: 5361590 - DNA, 20 bp, Homo sapiens
aggaactcgcacctgtgctg

SEQ ID NO: 5361591 - DNA, 21 bp, Homo sapiens
aggaactcgcacctgtgctgg

SEQ ID NO: 5361592 - DNA, 17 bp, Homo sapiens
aggaactcgcctcagcc

SEQ ID NO: 5361593 - DNA, 13 bp, Homo sapiens
aggaactctagag

SEQ ID NO: 5361594 - DNA, 13 bp, Homo sapiens
aggaactctggct

SEQ ID NO: 5361595 - DNA, 15 bp, Homo sapiens
aggaactgaaaacca

SEQ ID NO: 5361596 - DNA, 20 bp, Homo sapiens
aggaactgcctgggccatgc

SEQ ID NO: 5361597 - DNA, 22 bp, Homo sapiens
aggaactgctgggcttggcagc

SEQ ID NO: 5361598 - DNA, 16 bp, Homo sapiens
aggaattcagtgcctt

SEQ ID NO: 5361599 - DNA, 14 bp, Homo sapiens
aggaattccctgga

SEQ ID NO: 5361600 - DNA, 22 bp, Homo sapiens
aggaattctaggcatcccaggg

SEQ ID NO: 5361601 - DNA, 15 bp, Homo sapiens
aggaattctcacagg

SEQ ID NO: 5361602 - DNA, 14 bp, Homo sapiens
aggaattctgtata

SEQ ID NO: 5361603 - DNA, 22 bp, Homo sapiens
aggaattctgtatagattagaa

SEQ ID NO: 5361604 - DNA, 16 bp, Homo sapiens
aggaattctttgcatt

SEQ ID NO: 5361605 - DNA, 18 bp, Homo sapiens
aggaattctttgcattcc

SEQ ID NO: 5361606 - DNA, 13 bp, Homo sapiens
aggaattgaagat

SEQ ID NO: 5361607 - DNA, 14 bp, Homo sapiens
aggaattgtttata

SEQ ID NO: 5361608 - DNA, 22 bp, Homo sapiens
aggaatttactttcttcaccaa

SEQ ID NO: 5361609 - DNA, 21 bp, Homo sapiens
aggaatttagaacctaacttt

SEQ ID NO: 5361610 - DNA, 18 bp, Homo sapiens
aggaatttagaccttttc

SEQ ID NO: 5361611 - DNA, 14 bp, Homo sapiens
aggaatttataaca

SEQ ID NO: 5361612 - DNA, 21 bp, Homo sapiens
aggaatttcccaggaccctga

SEQ ID NO: 5361613 - DNA, 12 bp, Homo sapiens
aggaatttcctc

SEQ ID NO: 5361614 - DNA, 17 bp, Homo sapiens
aggaatttcctcccaat

SEQ ID NO: 5361615 - DNA, 19 bp, Homo sapiens
aggaatttcttaacttctt

SEQ ID NO: 5361616 - DNA, 13 bp, Homo sapiens
aggaatttgaagc

SEQ ID NO: 5361617 - DNA, 15 bp, Homo sapiens
aggaatttgaagctc

SEQ ID NO: 5361618 - DNA, 19 bp, Homo sapiens
aggaatttgaagctgcagt

SEQ ID NO: 5361619 - DNA, 20 bp, Homo sapiens
aggaatttgagagttcacag

SEQ ID NO: 5361620 - DNA, 18 bp, Homo sapiens
aggaatttgatgattttc

SEQ ID NO: 5361621 - DNA, 16 bp, Homo sapiens
aggaatttgattgctt

SEQ ID NO: 5361622 - DNA, 19 bp, Homo sapiens
aggaatttgattgctttgc

SEQ ID NO: 5361623 - DNA, 17 bp, Homo sapiens
aggaatttgcatccagc

SEQ ID NO: 5361624 - DNA, 17 bp, Homo sapiens
aggaatttggctgcttc

SEQ ID NO: 5361625 - DNA, 23 bp, Homo sapiens
aggaatttgtacttcttattgca

SEQ ID NO: 5361626 - DNA, 13 bp, Homo sapiens
aggaatttgtatt

SEQ ID NO: 5361627 - DNA, 22 bp, Homo sapiens
aggaattttcattgttctataa

SEQ ID NO: 5361628 - DNA, 14 bp, Homo sapiens
aggaattttctaaa

SEQ ID NO: 5361629 - DNA, 13 bp, Homo sapiens
aggaattttgtaa

SEQ ID NO: 5361630 - DNA, 20 bp, Homo sapiens
aggaattttgtaaagtttct

SEQ ID NO: 5361631 - DNA, 23 bp, Homo sapiens
aggacaaaaagaccttctcccta

SEQ ID NO: 5361632 - DNA, 15 bp, Homo sapiens
aggacaaaaatataa

SEQ ID NO: 5361633 - DNA, 12 bp, Homo sapiens
aggacaaaactt

SEQ ID NO: 5361634 - DNA, 17 bp, Homo sapiens
aggacaaaacttcttgt

SEQ ID NO: 5361635 - DNA, 21 bp, Homo sapiens
aggacaaaacttcttgtcaga

SEQ ID NO: 5361636 - DNA, 14 bp, Homo sapiens
aggacaaaaggaat

SEQ ID NO: 5361637 - DNA, 13 bp, Homo sapiens
aggacaaaataaa

SEQ ID NO: 5361638 - DNA, 16 bp, Homo sapiens
aggacaaacagctcag

SEQ ID NO: 5361639 - DNA, 15 bp, Homo sapiens
aggacaaacagtgaa

SEQ ID NO: 5361640 - DNA, 17 bp, Homo sapiens
aggacaaagggagggag

SEQ ID NO: 5361641 - DNA, 19 bp, Homo sapiens
aggacaaagtgccaaagaa

SEQ ID NO: 5361642 - DNA, 22 bp, Homo sapiens
aggacaaagtgccaaagaaagt

SEQ ID NO: 5361643 - DNA, 19 bp, Homo sapiens
aggacaaataaaacatggc

SEQ ID NO: 5361644 - DNA, 15 bp, Homo sapiens
aggacaaataaagca

SEQ ID NO: 5361645 - DNA, 16 bp, Homo sapiens
aggacaaattagcatg

SEQ ID NO: 5361646 - DNA, 19 bp, Homo sapiens
aggacaaattagcatgcaa

SEQ ID NO: 5361647 - DNA, 23 bp, Homo sapiens
aggacaaattagcatgcaagctt

SEQ ID NO: 5361648 - DNA, 13 bp, Homo sapiens
aggacaacacttc

SEQ ID NO: 5361649 - DNA, 14 bp, Homo sapiens
aggacaacctgccc

SEQ ID NO: 5361650 - DNA, 15 bp, Homo sapiens
aggacaacctgcccc

SEQ ID NO: 5361651 - DNA, 18 bp, Homo sapiens
aggacaacctgcccctcc

SEQ ID NO: 5361652 - DNA, 22 bp, Homo sapiens
aggacaactttatgtagagaaa

SEQ ID NO: 5361653 - DNA, 16 bp, Homo sapiens
aggacaagaaggagag

SEQ ID NO: 5361654 - DNA, 15 bp, Homo sapiens
aggacaagaccctct

SEQ ID NO: 5361655 - DNA, 18 bp, Homo sapiens
aggacaagcaataactct

SEQ ID NO: 5361656 - DNA, 13 bp, Homo sapiens
aggacaagcacga

SEQ ID NO: 5361657 - DNA, 13 bp, Homo sapiens
aggacaagcatgg

SEQ ID NO: 5361658 - DNA, 18 bp, Homo sapiens
aggacaaggaaattcctc

SEQ ID NO: 5361659 - DNA, 16 bp, Homo sapiens
aggacaaggaagtggg

SEQ ID NO: 5361660 - DNA, 12 bp, Homo sapiens
aggacaaggctg

SEQ ID NO: 5361661 - DNA, 14 bp, Homo sapiens
aggacaaggctgtg

SEQ ID NO: 5361662 - DNA, 18 bp, Homo sapiens
aggacaaggctgtgccag

SEQ ID NO: 5361663 - DNA, 22 bp, Homo sapiens
aggacaaggctgtgccaggctg

SEQ ID NO: 5361664 - DNA, 16 bp, Homo sapiens
aggacaaggggtggaa

SEQ ID NO: 5361665 - DNA, 22 bp, Homo sapiens
aggacaaggggtggaagggcag

SEQ ID NO: 5361666 - DNA, 18 bp, Homo sapiens
aggacaaggtgcaggcag

SEQ ID NO: 5361667 - DNA, 23 bp, Homo sapiens
aggacaaggtgcaggcaggctgg

SEQ ID NO: 5361668 - DNA, 19 bp, Homo sapiens
aggacaagttacacctcca

SEQ ID NO: 5361669 - DNA, 18 bp, Homo sapiens
aggacaatcagtcccctc

SEQ ID NO: 5361670 - DNA, 20 bp, Homo sapiens
aggacaatgaaatactccag

SEQ ID NO: 5361671 - DNA, 16 bp, Homo sapiens
aggacaattactgtac

SEQ ID NO: 5361672 - DNA, 18 bp, Homo sapiens
aggacaattcatgaactt

SEQ ID NO: 5361673 - DNA, 23 bp, Homo sapiens
aggacacaagcacagttttaaga

SEQ ID NO: 5361674 - DNA, 20 bp, Homo sapiens
aggacacaccccacacccca

SEQ ID NO: 5361675 - DNA, 22 bp, Homo sapiens
aggacacaccccacaccccagc

SEQ ID NO: 5361676 - DNA, 13 bp, Homo sapiens
aggacacactaat

SEQ ID NO: 5361677 - DNA, 22 bp, Homo sapiens
aggacacactgaaaagcagcct

SEQ ID NO: 5361678 - DNA, 13 bp, Homo sapiens
aggacacagcaca

SEQ ID NO: 5361679 - DNA, 13 bp, Homo sapiens
aggacacagcagt

SEQ ID NO: 5361680 - DNA, 17 bp, Homo sapiens
aggacacagcagtattg

SEQ ID NO: 5361681 - DNA, 14 bp, Homo sapiens
aggacacaggcctg

SEQ ID NO: 5361682 - DNA, 15 bp, Homo sapiens
aggacacaggcctgt

SEQ ID NO: 5361683 - DNA, 16 bp, Homo sapiens
aggacacaggcctgtg

SEQ ID NO: 5361684 - DNA, 13 bp, Homo sapiens
aggacacatcccg

SEQ ID NO: 5361685 - DNA, 18 bp, Homo sapiens
aggacacatcccggcctc

SEQ ID NO: 5361686 - DNA, 12 bp, Homo sapiens
aggacacatttg

SEQ ID NO: 5361687 - DNA, 18 bp, Homo sapiens
aggacaccacacccagcc

SEQ ID NO: 5361688 - DNA, 20 bp, Homo sapiens
aggacaccacacccagcctc

SEQ ID NO: 5361689 - DNA, 20 bp, Homo sapiens
aggacaccagtgaaagaagc

SEQ ID NO: 5361690 - DNA, 22 bp, Homo sapiens
aggacaccagtgaaagaagcca

SEQ ID NO: 5361691 - DNA, 20 bp, Homo sapiens
aggacacccaggaatgaccc

SEQ ID NO: 5361692 - DNA, 12 bp, Homo sapiens
aggacacctgcc

SEQ ID NO: 5361693 - DNA, 14 bp, Homo sapiens
aggacacctgcccc

SEQ ID NO: 5361694 - DNA, 16 bp, Homo sapiens
aggacacctgccccag

SEQ ID NO: 5361695 - DNA, 19 bp, Homo sapiens
aggacacctgtactggaga

SEQ ID NO: 5361696 - DNA, 20 bp, Homo sapiens
aggacacctgtactggagag

SEQ ID NO: 5361697 - DNA, 22 bp, Homo sapiens
aggacacctgtactggagagca

SEQ ID NO: 5361698 - DNA, 17 bp, Homo sapiens
aggacacggaccctgtg

SEQ ID NO: 5361699 - DNA, 23 bp, Homo sapiens
aggacacgggcctgtccacaggc

SEQ ID NO: 5361700 - DNA, 16 bp, Homo sapiens
aggacacgtggcctgc

SEQ ID NO: 5361701 - DNA, 18 bp, Homo sapiens
aggacactaaccacgctg

SEQ ID NO: 5361702 - DNA, 23 bp, Homo sapiens
aggacactaaccacgctggacct

SEQ ID NO: 5361703 - DNA, 19 bp, Homo sapiens
aggacactaagaggaggca

SEQ ID NO: 5361704 - DNA, 16 bp, Homo sapiens
aggacactaccctgag

SEQ ID NO: 5361705 - DNA, 21 bp, Homo sapiens
aggacactgatgggtcctgct

SEQ ID NO: 5361706 - DNA, 14 bp, Homo sapiens
aggacactgccttt

SEQ ID NO: 5361707 - DNA, 21 bp, Homo sapiens
aggacactgcctttgctgcct

SEQ ID NO: 5361708 - DNA, 14 bp, Homo sapiens
aggacacttcctgc

SEQ ID NO: 5361709 - DNA, 15 bp, Homo sapiens
aggacacttcctgcc

SEQ ID NO: 5361710 - DNA, 13 bp, Homo sapiens
aggacagaaagga

SEQ ID NO: 5361711 - DNA, 23 bp, Homo sapiens
aggacagaaaggagagtggccat

SEQ ID NO: 5361712 - DNA, 19 bp, Homo sapiens
aggacagaacattgccttc

SEQ ID NO: 5361713 - DNA, 13 bp, Homo sapiens
aggacagaaggac

SEQ ID NO: 5361714 - DNA, 15 bp, Homo sapiens
aggacagaaggactg

SEQ ID NO: 5361715 - DNA, 16 bp, Homo sapiens
aggacagaaggctcct

SEQ ID NO: 5361716 - DNA, 19 bp, Homo sapiens
aggacagaaggctcctgcc

SEQ ID NO: 5361717 - DNA, 17 bp, Homo sapiens
aggacagaattctccca

SEQ ID NO: 5361718 - DNA, 16 bp, Homo sapiens
aggacagaccaaaaat

SEQ ID NO: 5361719 - DNA, 17 bp, Homo sapiens
aggacagaccaaaaatc

SEQ ID NO: 5361720 - DNA, 19 bp, Homo sapiens
aggacagactggccgggca

SEQ ID NO: 5361721 - DNA, 23 bp, Homo sapiens
aggacagactggccgggcaggcg

SEQ ID NO: 5361722 - DNA, 13 bp, Homo sapiens
aggacagagccag

SEQ ID NO: 5361723 - DNA, 15 bp, Homo sapiens
aggacagaggccggg

SEQ ID NO: 5361724 - DNA, 17 bp, Homo sapiens
aggacagaggccggggt

SEQ ID NO: 5361725 - DNA, 15 bp, Homo sapiens
aggacagaggcgagg

SEQ ID NO: 5361726 - DNA, 21 bp, Homo sapiens
aggacagagggagacagggct

SEQ ID NO: 5361727 - DNA, 22 bp, Homo sapiens
aggacagaggggtaagatgagg

SEQ ID NO: 5361728 - DNA, 23 bp, Homo sapiens
aggacagagggttttgattttaa

SEQ ID NO: 5361729 - DNA, 18 bp, Homo sapiens
aggacagagtgccctggg

SEQ ID NO: 5361730 - DNA, 21 bp, Homo sapiens
aggacagagttcacaggaggc

SEQ ID NO: 5361731 - DNA, 17 bp, Homo sapiens
aggacagcaaagcagca

SEQ ID NO: 5361732 - DNA, 23 bp, Homo sapiens
aggacagcaaagcagcagtgtcc

SEQ ID NO: 5361733 - DNA, 11 bp, Homo sapiens
aggacagcagc

SEQ ID NO: 5361734 - DNA, 15 bp, Homo sapiens
aggacagcagctggt

SEQ ID NO: 5361735 - DNA, 18 bp, Homo sapiens
aggacagcagctggtgcc

SEQ ID NO: 5361736 - DNA, 14 bp, Homo sapiens
aggacagccagcag

SEQ ID NO: 5361737 - DNA, 17 bp, Homo sapiens
aggacagcccctcctcc

SEQ ID NO: 5361738 - DNA, 22 bp, Homo sapiens
aggacagcctgcctctgccaca

SEQ ID NO: 5361739 - DNA, 13 bp, Homo sapiens
aggacagctctgg

SEQ ID NO: 5361740 - DNA, 12 bp, Homo sapiens
aggacagctctt

SEQ ID NO: 5361741 - DNA, 16 bp, Homo sapiens
aggacagctggctgct

SEQ ID NO: 5361742 - DNA, 15 bp, Homo sapiens
aggacagctgtcctc

SEQ ID NO: 5361743 - DNA, 18 bp, Homo sapiens
aggacaggaccagatttt

SEQ ID NO: 5361744 - DNA, 20 bp, Homo sapiens
aggacaggaccctcaggaat

SEQ ID NO: 5361745 - DNA, 16 bp, Homo sapiens
aggacaggagatgctg

SEQ ID NO: 5361746 - DNA, 12 bp, Homo sapiens
aggacaggagcc

SEQ ID NO: 5361747 - DNA, 21 bp, Homo sapiens
aggacaggaggaggagatggc

SEQ ID NO: 5361748 - DNA, 16 bp, Homo sapiens
aggacaggcagaaaga

SEQ ID NO: 5361749 - DNA, 15 bp, Homo sapiens
aggacaggcaggcca

SEQ ID NO: 5361750 - DNA, 17 bp, Homo sapiens
aggacaggcaggccaga

SEQ ID NO: 5361751 - DNA, 20 bp, Homo sapiens
aggacaggcgggaggaggtg

SEQ ID NO: 5361752 - DNA, 16 bp, Homo sapiens
aggacaggctgcggcc

SEQ ID NO: 5361753 - DNA, 20 bp, Homo sapiens
aggacaggctgcggcccctc

SEQ ID NO: 5361754 - DNA, 15 bp, Homo sapiens
aggacaggctggtgc

SEQ ID NO: 5361755 - DNA, 16 bp, Homo sapiens
aggacagggctggctc

SEQ ID NO: 5361756 - DNA, 18 bp, Homo sapiens
aggacagggctggctcct

SEQ ID NO: 5361757 - DNA, 20 bp, Homo sapiens
aggacagggctggctcctct

SEQ ID NO: 5361758 - DNA, 17 bp, Homo sapiens
aggacagtaaactcact

SEQ ID NO: 5361759 - DNA, 14 bp, Homo sapiens
aggacagtccctgc

SEQ ID NO: 5361760 - DNA, 16 bp, Homo sapiens
aggacagtccctgctg

SEQ ID NO: 5361761 - DNA, 18 bp, Homo sapiens
aggacagtccctgctggg

SEQ ID NO: 5361762 - DNA, 14 bp, Homo sapiens
aggacagtctggag

SEQ ID NO: 5361763 - DNA, 16 bp, Homo sapiens
aggacagtctggagaa

SEQ ID NO: 5361764 - DNA, 15 bp, Homo sapiens
aggacagtgcttcag

SEQ ID NO: 5361765 - DNA, 16 bp, Homo sapiens
aggacagtgcttcagc

SEQ ID NO: 5361766 - DNA, 18 bp, Homo sapiens
aggacagtgcttcagcct

SEQ ID NO: 5361767 - DNA, 20 bp, Homo sapiens
aggacagtgcttcagcctga

SEQ ID NO: 5361768 - DNA, 22 bp, Homo sapiens
aggacagtgggcaggaggcccc

SEQ ID NO: 5361769 - DNA, 19 bp, Homo sapiens
aggacagtgttcaaattct

SEQ ID NO: 5361770 - DNA, 14 bp, Homo sapiens
aggacagttcagag

SEQ ID NO: 5361771 - DNA, 19 bp, Homo sapiens
aggacagttgatggagccc

SEQ ID NO: 5361772 - DNA, 16 bp, Homo sapiens
aggacagttgattcaa

SEQ ID NO: 5361773 - DNA, 20 bp, Homo sapiens
aggacagttgggctatgtgt

SEQ ID NO: 5361774 - DNA, 18 bp, Homo sapiens
aggacagtttaggaccca

SEQ ID NO: 5361775 - DNA, 18 bp, Homo sapiens
aggacagtttatcctgtc

SEQ ID NO: 5361776 - DNA, 22 bp, Homo sapiens
aggacttgtgcctcttgggaga

SEQ ID NO: 5361777 - DNA, 23 bp, Homo sapiens
aggacttgtgcgccggcgccccg

SEQ ID NO: 5361778 - DNA, 16 bp, Homo sapiens
aggacttgttagatct

SEQ ID NO: 5361779 - DNA, 17 bp, Homo sapiens
aggactttagggatctg

SEQ ID NO: 5361780 - DNA, 21 bp, Homo sapiens
aggactttatagatcagccag

SEQ ID NO: 5361781 - DNA, 17 bp, Homo sapiens
aggactttctgaagcct

SEQ ID NO: 5361782 - DNA, 15 bp, Homo sapiens
aggactttcttctaa

SEQ ID NO: 5361783 - DNA, 14 bp, Homo sapiens
aggactttgaatta

SEQ ID NO: 5361784 - DNA, 19 bp, Homo sapiens
aggactttggtcacccaga

SEQ ID NO: 5361785 - DNA, 18 bp, Homo sapiens
aggactttgttaacttca

SEQ ID NO: 5361786 - DNA, 17 bp, Homo sapiens
aggacttttaaacaaaa

SEQ ID NO: 5361787 - DNA, 21 bp, Homo sapiens
aggacttttaaacaaaagtgt

SEQ ID NO: 5361788 - DNA, 19 bp, Homo sapiens
aggacttttctttgtggct

SEQ ID NO: 5361789 - DNA, 22 bp, Homo sapiens
aggacttttctttgtggcttcc

SEQ ID NO: 5361790 - DNA, 23 bp, Homo sapiens
aggacttttctttgtggcttcct

SEQ ID NO: 5361791 - DNA, 13 bp, Homo sapiens
aggacttttttga

SEQ ID NO: 5361792 - DNA, 16 bp, Homo sapiens
aggagaaaagaaatgc

SEQ ID NO: 5361793 - DNA, 19 bp, Homo sapiens
aggagaaacacattcttat

SEQ ID NO: 5361794 - DNA, 20 bp, Homo sapiens
aggagaaacacttgaacctg

SEQ ID NO: 5361795 - DNA, 13 bp, Homo sapiens
aggagaaactcta

SEQ ID NO: 5361796 - DNA, 16 bp, Homo sapiens
aggagaaactctagac

SEQ ID NO: 5361797 - DNA, 21 bp, Homo sapiens
aggagaaactctagactgcaa

SEQ ID NO: 5361798 - DNA, 23 bp, Homo sapiens
aggagaaactctagactgcaaga

SEQ ID NO: 5361799 - DNA, 13 bp, Homo sapiens
aggagaaactgag

SEQ ID NO: 5361800 - DNA, 17 bp, Homo sapiens
aggagaaactggaactc

SEQ ID NO: 5361801 - DNA, 18 bp, Homo sapiens
aggagaaagatgaaactg

SEQ ID NO: 5361802 - DNA, 20 bp, Homo sapiens
aggagaaagatgaaactgaa

SEQ ID NO: 5361803 - DNA, 18 bp, Homo sapiens
aggagaaagccgggggag

SEQ ID NO: 5361804 - DNA, 22 bp, Homo sapiens
aggagaaagccgggggaggggc

SEQ ID NO: 5361805 - DNA, 16 bp, Homo sapiens
aggagaaaggagccgg

SEQ ID NO: 5361806 - DNA, 13 bp, Homo sapiens
aggagaaatagct

SEQ ID NO: 5361807 - DNA, 16 bp, Homo sapiens
aggagaaatcaacagg

SEQ ID NO: 5361808 - DNA, 16 bp, Homo sapiens
aggagaaatttgataa

SEQ ID NO: 5361809 - DNA, 21 bp, Homo sapiens
aggagaaatttgataatgaca

SEQ ID NO: 5361810 - DNA, 14 bp, Homo sapiens
aggagaacaaatat

SEQ ID NO: 5361811 - DNA, 22 bp, Homo sapiens
aggagaacagtaggattgctgt

SEQ ID NO: 5361812 - DNA, 22 bp, Homo sapiens
aggagaaccaaatctggaagcc

SEQ ID NO: 5361813 - DNA, 14 bp, Homo sapiens
aggagaaccactac

SEQ ID NO: 5361814 - DNA, 16 bp, Homo sapiens
aggagaaccagattct

SEQ ID NO: 5361815 - DNA, 20 bp, Homo sapiens
aggagaactacttgaacctg

SEQ ID NO: 5361816 - DNA, 21 bp, Homo sapiens
aggagaactcatgttattttt

SEQ ID NO: 5361817 - DNA, 14 bp, Homo sapiens
aggagaactgtgct

SEQ ID NO: 5361818 - DNA, 16 bp, Homo sapiens
aggagaacttgaacaa

SEQ ID NO: 5361819 - DNA, 16 bp, Homo sapiens
aggagaacttgctgcc

SEQ ID NO: 5361820 - DNA, 16 bp, Homo sapiens
aggagaagaaggaaat

SEQ ID NO: 5361821 - DNA, 13 bp, Homo sapiens
aggagaagagaca

SEQ ID NO: 5361822 - DNA, 15 bp, Homo sapiens
aggagaagaggcatc

SEQ ID NO: 5361823 - DNA, 16 bp, Homo sapiens
aggagaagcagcctcc

SEQ ID NO: 5361824 - DNA, 11 bp, Homo sapiens
aggagaagcca

SEQ ID NO: 5361825 - DNA, 14 bp, Homo sapiens
aggagaagccagga

SEQ ID NO: 5361826 - DNA, 14 bp, Homo sapiens
aggagaagctcagc

SEQ ID NO: 5361827 - DNA, 16 bp, Homo sapiens
aggagaagctgatcca

SEQ ID NO: 5361828 - DNA, 15 bp, Homo sapiens
aggagaaggaaaaag

SEQ ID NO: 5361829 - DNA, 14 bp, Homo sapiens
aggagaaggagagg

SEQ ID NO: 5361830 - DNA, 13 bp, Homo sapiens
aggagaaggagga

SEQ ID NO: 5361831 - DNA, 14 bp, Homo sapiens
aggagaaggaggag

SEQ ID NO: 5361832 - DNA, 14 bp, Homo sapiens
aggagaaggcctgc

SEQ ID NO: 5361833 - DNA, 19 bp, Homo sapiens
aggagaaggcctgcccccc

SEQ ID NO: 5361834 - DNA, 20 bp, Homo sapiens
aggagaaggcctgcccccct

SEQ ID NO: 5361835 - DNA, 22 bp, Homo sapiens
aggagaaggcctgccccccttc

SEQ ID NO: 5361836 - DNA, 18 bp, Homo sapiens
aggagaaggctggagaag

SEQ ID NO: 5361837 - DNA, 22 bp, Homo sapiens
aggagaaggtcagcgagaagga

SEQ ID NO: 5361838 - DNA, 20 bp, Homo sapiens
aggagaagtattcctgttgc

SEQ ID NO: 5361839 - DNA, 22 bp, Homo sapiens
aggagaatagcagagagccaaa

SEQ ID NO: 5361840 - DNA, 14 bp, Homo sapiens
aggagaatcacctg

SEQ ID NO: 5361841 - DNA, 12 bp, Homo sapiens
aggagaatcact

SEQ ID NO: 5361842 - DNA, 20 bp, Homo sapiens
aggagaatcacttgaacctg

SEQ ID NO: 5361843 - DNA, 17 bp, Homo sapiens
aggagaatcatgtttct

SEQ ID NO: 5361844 - DNA, 19 bp, Homo sapiens
aggagaatcgcttgaaccg

SEQ ID NO: 5361845 - DNA, 21 bp, Homo sapiens
aggagaatcgcttgaacctgg

SEQ ID NO: 5361846 - DNA, 22 bp, Homo sapiens
aggagaatcgcttgaacctggg

SEQ ID NO: 5361847 - DNA, 20 bp, Homo sapiens
aggagaatcgtttgcacccg

SEQ ID NO: 5361848 - DNA, 22 bp, Homo sapiens
aggagaatctccgcttgtccaa

SEQ ID NO: 5361849 - DNA, 16 bp, Homo sapiens
aggagaatctcttgaa

SEQ ID NO: 5361850 - DNA, 22 bp, Homo sapiens
aggagaatggcatggcaggagt

SEQ ID NO: 5361851 - DNA, 23 bp, Homo sapiens
aggagaatggcatggcaggagtc

SEQ ID NO: 5361852 - DNA, 21 bp, Homo sapiens
aggagaatggggttcctgctg

SEQ ID NO: 5361853 - DNA, 15 bp, Homo sapiens
aggagaattaaactc

SEQ ID NO: 5361854 - DNA, 21 bp, Homo sapiens
aggagaattaggaaggccatg

SEQ ID NO: 5361855 - DNA, 20 bp, Homo sapiens
aggagaattgcttgaacctg

SEQ ID NO: 5361856 - DNA, 20 bp, Homo sapiens
aggagacaaacagcccttcc

SEQ ID NO: 5361857 - DNA, 14 bp, Homo sapiens
aggagacaaagcag

SEQ ID NO: 5361858 - DNA, 16 bp, Homo sapiens
aggagacaaagcagga

SEQ ID NO: 5361859 - DNA, 18 bp, Homo sapiens
aggagacaagaaatccag

SEQ ID NO: 5361860 - DNA, 17 bp, Homo sapiens
aggagacacagatggca

SEQ ID NO: 5361861 - DNA, 21 bp, Homo sapiens
aggagacacagatggcacctg

SEQ ID NO: 5361862 - DNA, 20 bp, Homo sapiens
aggagacacgacagcacaca

SEQ ID NO: 5361863 - DNA, 20 bp, Homo sapiens
aggagacacgtgtggcgggc

SEQ ID NO: 5361864 - DNA, 21 bp, Homo sapiens
aggagacactggtctcagagg

SEQ ID NO: 5361865 - DNA, 22 bp, Homo sapiens
aggagacactgtgctataaatc

SEQ ID NO: 5361866 - DNA, 12 bp, Homo sapiens
aggagacagaaa

SEQ ID NO: 5361867 - DNA, 17 bp, Homo sapiens
aggagacagacacacac

SEQ ID NO: 5361868 - DNA, 12 bp, Homo sapiens
aggagacagagc

SEQ ID NO: 5361869 - DNA, 13 bp, Homo sapiens
aggagacagagcc

SEQ ID NO: 5361870 - DNA, 14 bp, Homo sapiens
aggagacagagcca

SEQ ID NO: 5361871 - DNA, 13 bp, Homo sapiens
aggagacaggaag

SEQ ID NO: 5361872 - DNA, 13 bp, Homo sapiens
aggagacaggcag

SEQ ID NO: 5361873 - DNA, 11 bp, Homo sapiens
aggagacatat

SEQ ID NO: 5361874 - DNA, 14 bp, Homo sapiens
aggagacatatata

SEQ ID NO: 5361875 - DNA, 15 bp, Homo sapiens
aggagacatatatag

SEQ ID NO: 5361876 - DNA, 17 bp, Homo sapiens
aggagacatatcactgc

SEQ ID NO: 5361877 - DNA, 23 bp, Homo sapiens
aggagacattgctctatgtctgc

SEQ ID NO: 5361878 - DNA, 17 bp, Homo sapiens
aggagaccaaggcggga

SEQ ID NO: 5361879 - DNA, 18 bp, Homo sapiens
aggagaccacccccgagc

SEQ ID NO: 5361880 - DNA, 14 bp, Homo sapiens
aggagaccagaagt

SEQ ID NO: 5361881 - DNA, 16 bp, Homo sapiens
aggagaccagctcaga

SEQ ID NO: 5361882 - DNA, 23 bp, Homo sapiens
aggagaccagctcagaggcccag

SEQ ID NO: 5361883 - DNA, 17 bp, Homo sapiens
aggagacccaacaatga

SEQ ID NO: 5361884 - DNA, 22 bp, Homo sapiens
aggagacccctttgcaggactt

SEQ ID NO: 5361885 - DNA, 16 bp, Homo sapiens
aggagacccgccccag

SEQ ID NO: 5361886 - DNA, 22 bp, Homo sapiens
aggagaccctcccctgcctccg

SEQ ID NO: 5361887 - DNA, 12 bp, Homo sapiens
aggagaccctgg

SEQ ID NO: 5361888 - DNA, 22 bp, Homo sapiens
aggagacctgtatcaaactgct

SEQ ID NO: 5361889 - DNA, 20 bp, Homo sapiens
aggagaccttttcacaatgg

SEQ ID NO: 5361890 - DNA, 23 bp, Homo sapiens
aggagacgtccaccctgcagcca

SEQ ID NO: 5361891 - DNA, 13 bp, Homo sapiens
aggagactcacct

SEQ ID NO: 5361892 - DNA, 21 bp, Homo sapiens
aggagactcacctctgcctca

SEQ ID NO: 5361893 - DNA, 16 bp, Homo sapiens
aggagactcaggccca

SEQ ID NO: 5361894 - DNA, 19 bp, Homo sapiens
aggagactgaggcttagag

SEQ ID NO: 5361895 - DNA, 12 bp, Homo sapiens
aggagactgcgt

SEQ ID NO: 5361896 - DNA, 14 bp, Homo sapiens
aggagactgggcac

SEQ ID NO: 5361897 - DNA, 19 bp, Homo sapiens
aggagactgggcacccctg

SEQ ID NO: 5361898 - DNA, 18 bp, Homo sapiens
aggagactggtaggagga

SEQ ID NO: 5361899 - DNA, 20 bp, Homo sapiens
aggagactggtaggaggagg

SEQ ID NO: 5361900 - DNA, 20 bp, Homo sapiens
aggagactgtggagactgct

SEQ ID NO: 5361901 - DNA, 21 bp, Homo sapiens
aggagactgtggagactgctc

SEQ ID NO: 5361902 - DNA, 13 bp, Homo sapiens
aggagactgtggt

SEQ ID NO: 5361903 - DNA, 13 bp, Homo sapiens
aggagacttctgt

SEQ ID NO: 5361904 - DNA, 14 bp, Homo sapiens
aggagacttgtgaa

SEQ ID NO: 5361905 - DNA, 22 bp, Homo sapiens
aggagacttgtgaattcccaga

SEQ ID NO: 5361906 - DNA, 17 bp, Homo sapiens
aggagagaaaatatatg

SEQ ID NO: 5361907 - DNA, 12 bp, Homo sapiens
aggagagaagaa

SEQ ID NO: 5361908 - DNA, 13 bp, Homo sapiens
aggagagaagaat

SEQ ID NO: 5361909 - DNA, 14 bp, Homo sapiens
aggagagaaggaca

SEQ ID NO: 5361910 - DNA, 21 bp, Homo sapiens
aggagagaagtggccagggct

SEQ ID NO: 5361911 - DNA, 18 bp, Homo sapiens
aggagagaatgagagagt

SEQ ID NO: 5361912 - DNA, 19 bp, Homo sapiens
aggagagacccctcccctc

SEQ ID NO: 5361913 - DNA, 17 bp, Homo sapiens
aggagagaccttctctt

SEQ ID NO: 5361914 - DNA, 23 bp, Homo sapiens
aggagagactcccatgaagcctt

SEQ ID NO: 5361915 - DNA, 17 bp, Homo sapiens
aggagagactgaaagca

SEQ ID NO: 5361916 - DNA, 19 bp, Homo sapiens
aggagagactgaaagcagc

SEQ ID NO: 5361917 - DNA, 22 bp, Homo sapiens
aggagagactgaaagcagcagc

SEQ ID NO: 5361918 - DNA, 22 bp, Homo sapiens
aggagagactgagcagccgcca

SEQ ID NO: 5361919 - DNA, 16 bp, Homo sapiens
aggagagactggccag

SEQ ID NO: 5361920 - DNA, 14 bp, Homo sapiens
aggagagagaaagc

SEQ ID NO: 5361921 - DNA, 18 bp, Homo sapiens
aggagagagaaagccagg

SEQ ID NO: 5361922 - DNA, 20 bp, Homo sapiens
aggagagagatgctgctccc

SEQ ID NO: 5361923 - DNA, 22 bp, Homo sapiens
aggagagagatgctgctcccgc

SEQ ID NO: 5361924 - DNA, 21 bp, Homo sapiens
aggagagagccttgggagcca

SEQ ID NO: 5361925 - DNA, 21 bp, Homo sapiens
aggagagaggctctggggcag

SEQ ID NO: 5361926 - DNA, 15 bp, Homo sapiens
aggagagagggcaca

SEQ ID NO: 5361927 - DNA, 16 bp, Homo sapiens
aggagagagtcccaga

SEQ ID NO: 5361928 - DNA, 19 bp, Homo sapiens
aggagagataccttgaaaa

SEQ ID NO: 5361929 - DNA, 21 bp, Homo sapiens
aggagagataccttgaaaaag

SEQ ID NO: 5361930 - DNA, 11 bp, Homo sapiens
aggagagatga

SEQ ID NO: 5361931 - DNA, 17 bp, Homo sapiens
aggagagattatttaca

SEQ ID NO: 5361932 - DNA, 13 bp, Homo sapiens
aggagagcactgc

SEQ ID NO: 5361933 - DNA, 15 bp, Homo sapiens
aggagagcatctgct

SEQ ID NO: 5361934 - DNA, 14 bp, Homo sapiens
aggagagccactgg

SEQ ID NO: 5361935 - DNA, 14 bp, Homo sapiens
aggagagccagaga

SEQ ID NO: 5361936 - DNA, 22 bp, Homo sapiens
aggagagcccccaccagcagca

SEQ ID NO: 5361937 - DNA, 19 bp, Homo sapiens
aggagagccctctgctgct

SEQ ID NO: 5361938 - DNA, 12 bp, Homo sapiens
aggagagcctgc

SEQ ID NO: 5361939 - DNA, 16 bp, Homo sapiens
aggagagcctgctgca

SEQ ID NO: 5361940 - DNA, 15 bp, Homo sapiens
aggagagcctggggg

SEQ ID NO: 5361941 - DNA, 13 bp, Homo sapiens
aggagagcttcag

SEQ ID NO: 5361942 - DNA, 24 bp, Homo sapiens
aggagagcttcaggccccaggact

SEQ ID NO: 5361943 - DNA, 23 bp, Homo sapiens
aggagaggaaaaacgatcgctgt

SEQ ID NO: 5361944 - DNA, 17 bp, Homo sapiens
aggagaggaaaactatt

SEQ ID NO: 5361945 - DNA, 15 bp, Homo sapiens
aggagaggaaaagta

SEQ ID NO: 5361946 - DNA, 22 bp, Homo sapiens
aggagaggaaactactgccttt

SEQ ID NO: 5361947 - DNA, 15 bp, Homo sapiens
aggagaggaagattt

SEQ ID NO: 5361948 - DNA, 11 bp, Homo sapiens
aggagaggaga

SEQ ID NO: 5361949 - DNA, 15 bp, Homo sapiens
aggagaggagacaga

SEQ ID NO: 5361950 - DNA, 12 bp, Homo sapiens
aggagaggagag

SEQ ID NO: 5361951 - DNA, 14 bp, Homo sapiens
aggagaggagagag

SEQ ID NO: 5361952 - DNA, 15 bp, Homo sapiens
aggagaggagagagg

SEQ ID NO: 5361953 - DNA, 19 bp, Homo sapiens
aggagaggagagccagaga

SEQ ID NO: 5361954 - DNA, 18 bp, Homo sapiens
aggaggcagtggcttgga

SEQ ID NO: 5361955 - DNA, 17 bp, Homo sapiens
aggaggcagtttttgtt

SEQ ID NO: 5361956 - DNA, 19 bp, Homo sapiens
aggaggccaaactgtccct

SEQ ID NO: 5361957 - DNA, 22 bp, Homo sapiens
aggaggccaaactgtccctccc

SEQ ID NO: 5361958 - DNA, 17 bp, Homo sapiens
aggaggccaaccagccc

SEQ ID NO: 5361959 - DNA, 15 bp, Homo sapiens
aggaggccaataaaa

SEQ ID NO: 5361960 - DNA, 19 bp, Homo sapiens
aggaggccacgtgatgtgg

SEQ ID NO: 5361961 - DNA, 20 bp, Homo sapiens
aggaggccactttgagaggg

SEQ ID NO: 5361962 - DNA, 21 bp, Homo sapiens
aggaggccctggtcctggcct

SEQ ID NO: 5361963 - DNA, 20 bp, Homo sapiens
aggaggcccttgtcgtggga

SEQ ID NO: 5361964 - DNA, 13 bp, Homo sapiens
aggaggccgactg

SEQ ID NO: 5361965 - DNA, 20 bp, Homo sapiens
aggaggccgactgggctgct

SEQ ID NO: 5361966 - DNA, 22 bp, Homo sapiens
aggaggccgactgggctgctgg

SEQ ID NO: 5361967 - DNA, 23 bp, Homo sapiens
aggaggccgcctcctcggggctc

SEQ ID NO: 5361968 - DNA, 21 bp, Homo sapiens
aggaggcctccactccttcca

SEQ ID NO: 5361969 - DNA, 15 bp, Homo sapiens
aggaggcctgcacca

SEQ ID NO: 5361970 - DNA, 17 bp, Homo sapiens
aggaggcgaataaatgt

SEQ ID NO: 5361971 - DNA, 18 bp, Homo sapiens
aggaggcgaataaatgtt

SEQ ID NO: 5361972 - DNA, 19 bp, Homo sapiens
aggaggcgaataaatgttc

SEQ ID NO: 5361973 - DNA, 23 bp, Homo sapiens
aggaggcgcactttcctcctggc

SEQ ID NO: 5361974 - DNA, 22 bp, Homo sapiens
aggaggcgcagcccgaagccca

SEQ ID NO: 5361975 - DNA, 23 bp, Homo sapiens
aggaggcgcagcccgaagcccag

SEQ ID NO: 5361976 - DNA, 16 bp, Homo sapiens
aggaggcgcggcctcc

SEQ ID NO: 5361977 - DNA, 20 bp, Homo sapiens
aggaggcggaggttgcagta

SEQ ID NO: 5361978 - DNA, 20 bp, Homo sapiens
aggaggcggcagctcttctg

SEQ ID NO: 5361979 - DNA, 15 bp, Homo sapiens
aggaggcggcccggc

SEQ ID NO: 5361980 - DNA, 18 bp, Homo sapiens
aggaggcggggctctagg

SEQ ID NO: 5361981 - DNA, 12 bp, Homo sapiens
aggaggctccag

SEQ ID NO: 5361982 - DNA, 19 bp, Homo sapiens
aggaggctccagagggcac

SEQ ID NO: 5361983 - DNA, 17 bp, Homo sapiens
aggaggctccaggcagc

SEQ ID NO: 5361984 - DNA, 15 bp, Homo sapiens
aggaggctccggccc

SEQ ID NO: 5361985 - DNA, 15 bp, Homo sapiens
aggaggctgagacag

SEQ ID NO: 5361986 - DNA, 13 bp, Homo sapiens
aggaggctgaggc

SEQ ID NO: 5361987 - DNA, 19 bp, Homo sapiens
aggaggctgaggcaccaga

SEQ ID NO: 5361988 - DNA, 19 bp, Homo sapiens
aggaggctgaggcaggaga

SEQ ID NO: 5361989 - DNA, 16 bp, Homo sapiens
aggaggctgaggtggg

SEQ ID NO: 5361990 - DNA, 13 bp, Homo sapiens
aggaggctgcatg

SEQ ID NO: 5361991 - DNA, 19 bp, Homo sapiens
aggaggctgcatgctctgg

SEQ ID NO: 5361992 - DNA, 12 bp, Homo sapiens
aggaggctgcca

SEQ ID NO: 5361993 - DNA, 19 bp, Homo sapiens
aggaggctgccctgagggg

SEQ ID NO: 5361994 - DNA, 20 bp, Homo sapiens
aggaggctgccctgaggggc

SEQ ID NO: 5361995 - DNA, 21 bp, Homo sapiens
aggaggctgccctgaggggct

SEQ ID NO: 5361996 - DNA, 21 bp, Homo sapiens
aggaggctggaggaagggggg

SEQ ID NO: 5361997 - DNA, 13 bp, Homo sapiens
aggaggctggcag

SEQ ID NO: 5361998 - DNA, 24 bp, Homo sapiens
aggaggctggccaaggtgtccagg

SEQ ID NO: 5361999 - DNA, 13 bp, Homo sapiens
aggaggctggctg

SEQ ID NO: 5362000 - DNA, 14 bp, Homo sapiens
aggaggctggctgg

SEQ ID NO: 5362001 - DNA, 22 bp, Homo sapiens
aggaggctgggacgctctgctg

SEQ ID NO: 5362002 - DNA, 20 bp, Homo sapiens
aggaggcttggaaagcatca

SEQ ID NO: 5362003 - DNA, 19 bp, Homo sapiens
aggaggctttaagctccag

SEQ ID NO: 5362004 - DNA, 23 bp, Homo sapiens
aggaggctttctgggctctggac

SEQ ID NO: 5362005 - DNA, 17 bp, Homo sapiens
aggagggaatgattggt

SEQ ID NO: 5362006 - DNA, 19 bp, Homo sapiens
aggagggacaaaggagcct

SEQ ID NO: 5362007 - DNA, 20 bp, Homo sapiens
aggagggacaaaggagcctg

SEQ ID NO: 5362008 - DNA, 22 bp, Homo sapiens
aggagggacaaaggagcctgtg

SEQ ID NO: 5362009 - DNA, 15 bp, Homo sapiens
aggagggacaagaat

SEQ ID NO: 5362010 - DNA, 19 bp, Homo sapiens
aggagggacagtctcacca

SEQ ID NO: 5362011 - DNA, 23 bp, Homo sapiens
aggagggaccaccctccctgact

SEQ ID NO: 5362012 - DNA, 23 bp, Homo sapiens
aggagggacctactgaacccaga

SEQ ID NO: 5362013 - DNA, 13 bp, Homo sapiens
aggagggacttgg

SEQ ID NO: 5362014 - DNA, 15 bp, Homo sapiens
aggagggagaaagga

SEQ ID NO: 5362015 - DNA, 16 bp, Homo sapiens
aggagggagaaaggag

SEQ ID NO: 5362016 - DNA, 18 bp, Homo sapiens
aggagggagaaaggagaa

SEQ ID NO: 5362017 - DNA, 16 bp, Homo sapiens
aggagggagacactgg

SEQ ID NO: 5362018 - DNA, 13 bp, Homo sapiens
aggagggagactg

SEQ ID NO: 5362019 - DNA, 15 bp, Homo sapiens
aggagggagagccct

SEQ ID NO: 5362020 - DNA, 12 bp, Homo sapiens
aggagggagagg

SEQ ID NO: 5362021 - DNA, 21 bp, Homo sapiens
aggagggagcatcagtgccct

SEQ ID NO: 5362022 - DNA, 13 bp, Homo sapiens
aggagggagctgc

SEQ ID NO: 5362023 - DNA, 20 bp, Homo sapiens
aggagggagggtttctctcc

SEQ ID NO: 5362024 - DNA, 16 bp, Homo sapiens
aggagggatagagacg

SEQ ID NO: 5362025 - DNA, 13 bp, Homo sapiens
aggagggatgctg

SEQ ID NO: 5362026 - DNA, 15 bp, Homo sapiens
aggagggatgctgct

SEQ ID NO: 5362027 - DNA, 16 bp, Homo sapiens
aggagggcaagggcca

SEQ ID NO: 5362028 - DNA, 13 bp, Homo sapiens
aggagggcagagc

SEQ ID NO: 5362029 - DNA, 23 bp, Homo sapiens
aggagggcagagccatgggcctg

SEQ ID NO: 5362030 - DNA, 22 bp, Homo sapiens
aggagggcagagggagaatcca

SEQ ID NO: 5362031 - DNA, 13 bp, Homo sapiens
aggagggcaggca

SEQ ID NO: 5362032 - DNA, 15 bp, Homo sapiens
aggagggcaggcatc

SEQ ID NO: 5362033 - DNA, 13 bp, Homo sapiens
aggagggcccgga

SEQ ID NO: 5362034 - DNA, 15 bp, Homo sapiens
aggagggccctgagg

SEQ ID NO: 5362035 - DNA, 22 bp, Homo sapiens
aggagggccctgaggaataaag

SEQ ID NO: 5362036 - DNA, 15 bp, Homo sapiens
aggagggcctctggt

SEQ ID NO: 5362037 - DNA, 22 bp, Homo sapiens
aggagggcgtgactcacccaag

SEQ ID NO: 5362038 - DNA, 16 bp, Homo sapiens
aggagggcgttcttag

SEQ ID NO: 5362039 - DNA, 21 bp, Homo sapiens
aggagggcgttcttaggctgc

SEQ ID NO: 5362040 - DNA, 14 bp, Homo sapiens
aggaggggaagctg

SEQ ID NO: 5362041 - DNA, 16 bp, Homo sapiens
aggaggggaagctgca

SEQ ID NO: 5362042 - DNA, 18 bp, Homo sapiens
aggaggggaagctgggcc

SEQ ID NO: 5362043 - DNA, 19 bp, Homo sapiens
aggaggggaagctgggccc

SEQ ID NO: 5362044 - DNA, 22 bp, Homo sapiens
aggaggggacttgtaggaatct

SEQ ID NO: 5362045 - DNA, 12 bp, Homo sapiens
aggaggggagaa

SEQ ID NO: 5362046 - DNA, 19 bp, Homo sapiens
aggaggggagagacaggca

SEQ ID NO: 5362047 - DNA, 12 bp, Homo sapiens
aggaggggagca

SEQ ID NO: 5362048 - DNA, 13 bp, Homo sapiens
aggaggggagcaa

SEQ ID NO: 5362049 - DNA, 20 bp, Homo sapiens
aggaggggagcaaggctgct

SEQ ID NO: 5362050 - DNA, 16 bp, Homo sapiens
aggaggggcacctgcc

SEQ ID NO: 5362051 - DNA, 17 bp, Homo sapiens
aggaggggcacctgcca

SEQ ID NO: 5362052 - DNA, 19 bp, Homo sapiens
aggaggggcacctgccacc

SEQ ID NO: 5362053 - DNA, 23 bp, Homo sapiens
aggaggggcagcgcatgtgtgca

SEQ ID NO: 5362054 - DNA, 21 bp, Homo sapiens
aggaggggcccccctgccctg

SEQ ID NO: 5362055 - DNA, 23 bp, Homo sapiens
aggaggggcccccctgccctgtg

SEQ ID NO: 5362056 - DNA, 20 bp, Homo sapiens
aggaggggcccggtggcggc

SEQ ID NO: 5362057 - DNA, 16 bp, Homo sapiens
aggaggggcctgggca

SEQ ID NO: 5362058 - DNA, 19 bp, Homo sapiens
aggaggggcctgggcagcc

SEQ ID NO: 5362059 - DNA, 21 bp, Homo sapiens
aggaggggctgcagcagaggc

SEQ ID NO: 5362060 - DNA, 23 bp, Homo sapiens
aggaggggctgcagcagaggcct

SEQ ID NO: 5362061 - DNA, 16 bp, Homo sapiens
aggaggggctgtaaaa

SEQ ID NO: 5362062 - DNA, 13 bp, Homo sapiens
aggagggggagaa

SEQ ID NO: 5362063 - DNA, 19 bp, Homo sapiens
aggagggggagtggagggg

SEQ ID NO: 5362064 - DNA, 17 bp, Homo sapiens
aggagggggccgggcgc

SEQ ID NO: 5362065 - DNA, 18 bp, Homo sapiens
aggagggggcctcattgt

SEQ ID NO: 5362066 - DNA, 16 bp, Homo sapiens
aggaggggggagggaa

SEQ ID NO: 5362067 - DNA, 20 bp, Homo sapiens
aggagggggtcgtggagagc

SEQ ID NO: 5362068 - DNA, 16 bp, Homo sapiens
aggaggggtaaatata

SEQ ID NO: 5362069 - DNA, 13 bp, Homo sapiens
aggaggggtctgc

SEQ ID NO: 5362070 - DNA, 17 bp, Homo sapiens
aggaggggtctgcctcc

SEQ ID NO: 5362071 - DNA, 21 bp, Homo sapiens
aggaggggtctgcctcccacg

SEQ ID NO: 5362072 - DNA, 21 bp, Homo sapiens
aggaggggtctggacatgtgg

SEQ ID NO: 5362073 - DNA, 22 bp, Homo sapiens
aggaggggtggtgtccttctcc

SEQ ID NO: 5362074 - DNA, 19 bp, Homo sapiens
aggaggggtgttaaaacat

SEQ ID NO: 5362075 - DNA, 17 bp, Homo sapiens
aggagggtacagctggg

SEQ ID NO: 5362076 - DNA, 16 bp, Homo sapiens
aggagggtgacgccca

SEQ ID NO: 5362077 - DNA, 21 bp, Homo sapiens
aggagggtgacgcccagctcc

SEQ ID NO: 5362078 - DNA, 16 bp, Homo sapiens
aggagggtgcccctgg

SEQ ID NO: 5362079 - DNA, 14 bp, Homo sapiens
aggagggtggagga

SEQ ID NO: 5362080 - DNA, 21 bp, Homo sapiens
aggagggtggaggaaggtgct

SEQ ID NO: 5362081 - DNA, 22 bp, Homo sapiens
aggagggtggaggaaggtgctg

SEQ ID NO: 5362082 - DNA, 14 bp, Homo sapiens
aggagggtgggaag

SEQ ID NO: 5362083 - DNA, 23 bp, Homo sapiens
aggagggttgggcgtgctacctg

SEQ ID NO: 5362084 - DNA, 21 bp, Homo sapiens
aggaggtaacatagatgcctg

SEQ ID NO: 5362085 - DNA, 22 bp, Homo sapiens
aggaggtaagaggtattggatt

SEQ ID NO: 5362086 - DNA, 15 bp, Homo sapiens
aggaggtacaaaagt

SEQ ID NO: 5362087 - DNA, 17 bp, Homo sapiens
aggaggtacaaaagtta

SEQ ID NO: 5362088 - DNA, 14 bp, Homo sapiens
aggaggtagtttct

SEQ ID NO: 5362089 - DNA, 18 bp, Homo sapiens
aggaggtatctagcaatg

SEQ ID NO: 5362090 - DNA, 21 bp, Homo sapiens
aggaggtcaagatcagcctgg

SEQ ID NO: 5362091 - DNA, 16 bp, Homo sapiens
aggaggtcaagcctgc

SEQ ID NO: 5362092 - DNA, 24 bp, Homo sapiens
aggaggtcaagcctgcagcgagct

SEQ ID NO: 5362093 - DNA, 18 bp, Homo sapiens
aggaggtcccaggaagtc

SEQ ID NO: 5362094 - DNA, 14 bp, Homo sapiens
aggaggtcctcctc

SEQ ID NO: 5362095 - DNA, 15 bp, Homo sapiens
aggaggtccttggag

SEQ ID NO: 5362096 - DNA, 14 bp, Homo sapiens
aggaggtctctaag

SEQ ID NO: 5362097 - DNA, 15 bp, Homo sapiens
aggaggtctctaaga

SEQ ID NO: 5362098 - DNA, 20 bp, Homo sapiens
aggaggtgaaatccctgcct

SEQ ID NO: 5362099 - DNA, 22 bp, Homo sapiens
aggaggtgaaatccctgcctca

SEQ ID NO: 5362100 - DNA, 15 bp, Homo sapiens
aggaggtgagagtgg

SEQ ID NO: 5362101 - DNA, 13 bp, Homo sapiens
aggaggtgaggga

SEQ ID NO: 5362102 - DNA, 20 bp, Homo sapiens
aggaggtgcagtggaggggg

SEQ ID NO: 5362103 - DNA, 15 bp, Homo sapiens
aggaggtgccaacag

SEQ ID NO: 5362104 - DNA, 19 bp, Homo sapiens
aggaggtgcccgggcaggg

SEQ ID NO: 5362105 - DNA, 13 bp, Homo sapiens
aggaggtgcctga

SEQ ID NO: 5362106 - DNA, 20 bp, Homo sapiens
aggaggtggagaaaattgga

SEQ ID NO: 5362107 - DNA, 23 bp, Homo sapiens
aggaggtggcagccctgtaggga

SEQ ID NO: 5362108 - DNA, 13 bp, Homo sapiens
aggaggtggcttc

SEQ ID NO: 5362109 - DNA, 13 bp, Homo sapiens
aggaggtgggcca

SEQ ID NO: 5362110 - DNA, 14 bp, Homo sapiens
aggaggtgggggct

SEQ ID NO: 5362111 - DNA, 14 bp, Homo sapiens
aggaggtgtcccaa

SEQ ID NO: 5362112 - DNA, 16 bp, Homo sapiens
aggaggtgtcccaagc

SEQ ID NO: 5362113 - DNA, 23 bp, Homo sapiens
aggaggtgtctcaggctgcctga

SEQ ID NO: 5362114 - DNA, 24 bp, Homo sapiens
aggaggtgtctggggtgagggagt

SEQ ID NO: 5362115 - DNA, 15 bp, Homo sapiens
aggaggtgtggagtg

SEQ ID NO: 5362116 - DNA, 23 bp, Homo sapiens
aggaggtgtggagtggaggggtc

SEQ ID NO: 5362117 - DNA, 21 bp, Homo sapiens
aggaggttcgggattccctgg

SEQ ID NO: 5362118 - DNA, 22 bp, Homo sapiens
aggaggttcgggattccctggt

SEQ ID NO: 5362119 - DNA, 19 bp, Homo sapiens
aggaggttctgggcctctg

SEQ ID NO: 5362120 - DNA, 20 bp, Homo sapiens
aggaggttctgggcctctga

SEQ ID NO: 5362121 - DNA, 20 bp, Homo sapiens
aggaggttgagaatgcagtg

SEQ ID NO: 5362122 - DNA, 19 bp, Homo sapiens
aggaggttggagggaaagc

SEQ ID NO: 5362123 - DNA, 22 bp, Homo sapiens
aggaggttgggagggggttggg

SEQ ID NO: 5362124 - DNA, 19 bp, Homo sapiens
aggaggttggtgactgaaa

SEQ ID NO: 5362125 - DNA, 14 bp, Homo sapiens
aggagtaaaattca

SEQ ID NO: 5362126 - DNA, 17 bp, Homo sapiens
aggagtaagcccaagct

SEQ ID NO: 5362127 - DNA, 21 bp, Homo sapiens
aggagtaatctgtgtacaaag

SEQ ID NO: 5362128 - DNA, 20 bp, Homo sapiens
aggagtacccccagcccaag

SEQ ID NO: 5362129 - DNA, 22 bp, Homo sapiens
aggagtacccccagcccaagag

SEQ ID NO: 5362130 - DNA, 21 bp, Homo sapiens
aggatatccttatcagagcta

SEQ ID NO: 5362131 - DNA, 21 bp, Homo sapiens
aggatatcggcatttgtttct

SEQ ID NO: 5362132 - DNA, 18 bp, Homo sapiens
aggatatctgaaaatatt

SEQ ID NO: 5362133 - DNA, 19 bp, Homo sapiens
aggatatgattaatattat

SEQ ID NO: 5362134 - DNA, 17 bp, Homo sapiens
aggatatgcctgctctt

SEQ ID NO: 5362135 - DNA, 21 bp, Homo sapiens
aggatatgttcacacctagcg

SEQ ID NO: 5362136 - DNA, 23 bp, Homo sapiens
aggatatgttcacacctagcgtc

SEQ ID NO: 5362137 - DNA, 13 bp, Homo sapiens
aggatattaaaat

SEQ ID NO: 5362138 - DNA, 23 bp, Homo sapiens
aggatattacaatggccagccca

SEQ ID NO: 5362139 - DNA, 21 bp, Homo sapiens
aggatattgaatgtgaaacat

SEQ ID NO: 5362140 - DNA, 18 bp, Homo sapiens
aggatattgctaattgtg

SEQ ID NO: 5362141 - DNA, 19 bp, Homo sapiens
aggatatttaagaaaatac

SEQ ID NO: 5362142 - DNA, 15 bp, Homo sapiens
aggatatttcaaatg

SEQ ID NO: 5362143 - DNA, 17 bp, Homo sapiens
aggatcaattgtaatat

SEQ ID NO: 5362144 - DNA, 22 bp, Homo sapiens
aggatcaccccagcccccacag

SEQ ID NO: 5362145 - DNA, 20 bp, Homo sapiens
aggatcacctgaggtcagga

SEQ ID NO: 5362146 - DNA, 14 bp, Homo sapiens
aggatcactggagc

SEQ ID NO: 5362147 - DNA, 19 bp, Homo sapiens
aggatcactggagcccagg

SEQ ID NO: 5362148 - DNA, 20 bp, Homo sapiens
aggatcactggagcccagga

SEQ ID NO: 5362149 - DNA, 14 bp, Homo sapiens
aggatcacttaagc

SEQ ID NO: 5362150 - DNA, 17 bp, Homo sapiens
aggatcacttgagccca

SEQ ID NO: 5362151 - DNA, 19 bp, Homo sapiens
aggatcacttgagcccagg

SEQ ID NO: 5362152 - DNA, 14 bp, Homo sapiens
aggatcagaaagta

SEQ ID NO: 5362153 - DNA, 22 bp, Homo sapiens
aggatcagaatggaaagaaact

SEQ ID NO: 5362154 - DNA, 17 bp, Homo sapiens
aggatcagccccgctcc

SEQ ID NO: 5362155 - DNA, 12 bp, Homo sapiens
aggatcaggctg

SEQ ID NO: 5362156 - DNA, 15 bp, Homo sapiens
aggatcagttaacta

SEQ ID NO: 5362157 - DNA, 22 bp, Homo sapiens
aggatcatatgaattgctgtct

SEQ ID NO: 5362158 - DNA, 20 bp, Homo sapiens
aggatcatcatttaaaaaaa

SEQ ID NO: 5362159 - DNA, 18 bp, Homo sapiens
aggatcatccctttggtt

SEQ ID NO: 5362160 - DNA, 12 bp, Homo sapiens
aggatccagaga

SEQ ID NO: 5362161 - DNA, 15 bp, Homo sapiens
aggatccagcctcac

SEQ ID NO: 5362162 - DNA, 17 bp, Homo sapiens
aggatccagggcagcag

SEQ ID NO: 5362163 - DNA, 18 bp, Homo sapiens
aggatccagggcagcagg

SEQ ID NO: 5362164 - DNA, 19 bp, Homo sapiens
aggatccagggcagcaggc

SEQ ID NO: 5362165 - DNA, 22 bp, Homo sapiens
aggatccccctctttgcacagc

SEQ ID NO: 5362166 - DNA, 16 bp, Homo sapiens
aggatcccgtcttcca

SEQ ID NO: 5362167 - DNA, 14 bp, Homo sapiens
aggatccctcctga

SEQ ID NO: 5362168 - DNA, 14 bp, Homo sapiens
aggatccgctgcca

SEQ ID NO: 5362169 - DNA, 15 bp, Homo sapiens
aggatccgctgccac

SEQ ID NO: 5362170 - DNA, 16 bp, Homo sapiens
aggatccggaaagaag

SEQ ID NO: 5362171 - DNA, 15 bp, Homo sapiens
aggatccgtgctgtc

SEQ ID NO: 5362172 - DNA, 20 bp, Homo sapiens
aggatcctattctcaccagg

SEQ ID NO: 5362173 - DNA, 21 bp, Homo sapiens
aggatcctcacaggagcagac

SEQ ID NO: 5362174 - DNA, 13 bp, Homo sapiens
aggatcctgagcc

SEQ ID NO: 5362175 - DNA, 14 bp, Homo sapiens
aggatcctgagcca

SEQ ID NO: 5362176 - DNA, 17 bp, Homo sapiens
aggatcctgagccagat

SEQ ID NO: 5362177 - DNA, 13 bp, Homo sapiens
aggatcctggaac

SEQ ID NO: 5362178 - DNA, 20 bp, Homo sapiens
aggatcctggaaccactgat

SEQ ID NO: 5362179 - DNA, 13 bp, Homo sapiens
aggatcctggaga

SEQ ID NO: 5362180 - DNA, 14 bp, Homo sapiens
aggatcctggcctg

SEQ ID NO: 5362181 - DNA, 12 bp, Homo sapiens
aggatcctggta

SEQ ID NO: 5362182 - DNA, 14 bp, Homo sapiens
aggatccttccctg

SEQ ID NO: 5362183 - DNA, 16 bp, Homo sapiens
aggatccttccctgta

SEQ ID NO: 5362184 - DNA, 23 bp, Homo sapiens
aggatcggactctgcccctggac

SEQ ID NO: 5362185 - DNA, 20 bp, Homo sapiens
aggatcggcttcctcagggg

SEQ ID NO: 5362186 - DNA, 14 bp, Homo sapiens
aggatctaaggctg

SEQ ID NO: 5362187 - DNA, 16 bp, Homo sapiens
aggatctagaatgtgt

SEQ ID NO: 5362188 - DNA, 14 bp, Homo sapiens
aggatctagagggg

SEQ ID NO: 5362189 - DNA, 23 bp, Homo sapiens
aggatctagcttcatgcctcagt

SEQ ID NO: 5362190 - DNA, 18 bp, Homo sapiens
aggatctatgcaattttt

SEQ ID NO: 5362191 - DNA, 20 bp, Homo sapiens
aggatctatgcaatttttaa

SEQ ID NO: 5362192 - DNA, 17 bp, Homo sapiens
aggatctcgcctggaaa

SEQ ID NO: 5362193 - DNA, 18 bp, Homo sapiens
aggatctcgcctggaaac

SEQ ID NO: 5362194 - DNA, 13 bp, Homo sapiens
aggatctctcagg

SEQ ID NO: 5362195 - DNA, 16 bp, Homo sapiens
aggatctctgaaacat

SEQ ID NO: 5362196 - DNA, 12 bp, Homo sapiens
aggatctcttga

SEQ ID NO: 5362197 - DNA, 18 bp, Homo sapiens
aggatctcttgagcctgg

SEQ ID NO: 5362198 - DNA, 21 bp, Homo sapiens
aggatctcttgagcctgggag

SEQ ID NO: 5362199 - DNA, 22 bp, Homo sapiens
aggatctcttgagcctgggagg

SEQ ID NO: 5362200 - DNA, 22 bp, Homo sapiens
aggatctgcaaacaatgaagaa

SEQ ID NO: 5362201 - DNA, 16 bp, Homo sapiens
aggatctgctccaaca

SEQ ID NO: 5362202 - DNA, 15 bp, Homo sapiens
aggatctgctgaggc

SEQ ID NO: 5362203 - DNA, 15 bp, Homo sapiens
aggatctgtccgaca

SEQ ID NO: 5362204 - DNA, 16 bp, Homo sapiens
aggatctgtgattggc

SEQ ID NO: 5362205 - DNA, 20 bp, Homo sapiens
aggatctgtttttaaaaatc

SEQ ID NO: 5362206 - DNA, 20 bp, Homo sapiens
aggatcttattttgtgaact

SEQ ID NO: 5362207 - DNA, 18 bp, Homo sapiens
aggatcttttgaacccag

SEQ ID NO: 5362208 - DNA, 17 bp, Homo sapiens
aggatcttttgtaaatg

SEQ ID NO: 5362209 - DNA, 14 bp, Homo sapiens
aggatgaaagaaag

SEQ ID NO: 5362210 - DNA, 14 bp, Homo sapiens
aggatgaaagacaa

SEQ ID NO: 5362211 - DNA, 15 bp, Homo sapiens
aggatgaacacaggc

SEQ ID NO: 5362212 - DNA, 22 bp, Homo sapiens
aggatgaagagaaggcacacag

SEQ ID NO: 5362213 - DNA, 22 bp, Homo sapiens
aggatgaaggcgtgcaaggggc

SEQ ID NO: 5362214 - DNA, 18 bp, Homo sapiens
aggatgaagggcccgaga

SEQ ID NO: 5362215 - DNA, 20 bp, Homo sapiens
aggatgaatgaggtcccagg

SEQ ID NO: 5362216 - DNA, 21 bp, Homo sapiens
aggatgaatgaggtcccaggc

SEQ ID NO: 5362217 - DNA, 22 bp, Homo sapiens
aggatgaatgaggtcccaggca

SEQ ID NO: 5362218 - DNA, 18 bp, Homo sapiens
aggatgaattctttcaat

SEQ ID NO: 5362219 - DNA, 19 bp, Homo sapiens
aggatgaattgtcacatct

SEQ ID NO: 5362220 - DNA, 16 bp, Homo sapiens
aggatgaattttctgc

SEQ ID NO: 5362221 - DNA, 23 bp, Homo sapiens
aggatgacaaaattctttctggt

SEQ ID NO: 5362222 - DNA, 15 bp, Homo sapiens
aggatgacaggctct

SEQ ID NO: 5362223 - DNA, 18 bp, Homo sapiens
aggatgacaggctctcct

SEQ ID NO: 5362224 - DNA, 22 bp, Homo sapiens
aggatgacctcagggctatgtg

SEQ ID NO: 5362225 - DNA, 20 bp, Homo sapiens
aggatgacctggataactta

SEQ ID NO: 5362226 - DNA, 13 bp, Homo sapiens
aggatgacttttt

SEQ ID NO: 5362227 - DNA, 18 bp, Homo sapiens
aggatgagagcccagagg

SEQ ID NO: 5362228 - DNA, 14 bp, Homo sapiens
aggatgagcagagc

SEQ ID NO: 5362229 - DNA, 23 bp, Homo sapiens
aggatgagccacagaaattgcat

SEQ ID NO: 5362230 - DNA, 22 bp, Homo sapiens
aggatgaggccccgccttttcc

SEQ ID NO: 5362231 - DNA, 21 bp, Homo sapiens
aggatgaggccgctagaggcc

SEQ ID NO: 5362232 - DNA, 23 bp, Homo sapiens
aggatgaggccgctagaggcctg

SEQ ID NO: 5362233 - DNA, 23 bp, Homo sapiens
aggatgaggtctcgaccctgtcc

SEQ ID NO: 5362234 - DNA, 24 bp, Homo sapiens
aggatgatgccagttacttgcttt

SEQ ID NO: 5362235 - DNA, 23 bp, Homo sapiens
aggatgatgtctttttattaaaa

SEQ ID NO: 5362236 - DNA, 20 bp, Homo sapiens
aggatgattgtacagaatca

SEQ ID NO: 5362237 - DNA, 22 bp, Homo sapiens
aggatgcaacaaatgtggccaa

SEQ ID NO: 5362238 - DNA, 21 bp, Homo sapiens
aggatgcacagtttgctattt

SEQ ID NO: 5362239 - DNA, 13 bp, Homo sapiens
aggatgcagaggg

SEQ ID NO: 5362240 - DNA, 12 bp, Homo sapiens
aggatgcatatt

SEQ ID NO: 5362241 - DNA, 13 bp, Homo sapiens
aggatgcatatta

SEQ ID NO: 5362242 - DNA, 18 bp, Homo sapiens
aggatgcatgcagggccc

SEQ ID NO: 5362243 - DNA, 12 bp, Homo sapiens
aggatgccacag

SEQ ID NO: 5362244 - DNA, 20 bp, Homo sapiens
aggatgccacagccccacag

SEQ ID NO: 5362245 - DNA, 12 bp, Homo sapiens
aggatgccagcc

SEQ ID NO: 5362246 - DNA, 13 bp, Homo sapiens
aggatgccagccc

SEQ ID NO: 5362247 - DNA, 15 bp, Homo sapiens
aggatgccagcccct

SEQ ID NO: 5362248 - DNA, 18 bp, Homo sapiens
aggatgccagcccctgcc

SEQ ID NO: 5362249 - DNA, 17 bp, Homo sapiens
aggatgccccgtccccc

SEQ ID NO: 5362250 - DNA, 13 bp, Homo sapiens
aggatgccctgtt

SEQ ID NO: 5362251 - DNA, 19 bp, Homo sapiens
aggatgcctgagccccctg

SEQ ID NO: 5362252 - DNA, 21 bp, Homo sapiens
aggatgccttagcatgtgact

SEQ ID NO: 5362253 - DNA, 15 bp, Homo sapiens
aggatgcgctgggac

SEQ ID NO: 5362254 - DNA, 22 bp, Homo sapiens
aggatgcggaaggattgcaatg

SEQ ID NO: 5362255 - DNA, 17 bp, Homo sapiens
aggatgctaaaccttag

SEQ ID NO: 5362256 - DNA, 15 bp, Homo sapiens
aggatgctaatggaa

SEQ ID NO: 5362257 - DNA, 16 bp, Homo sapiens
aggatgctctttccct

SEQ ID NO: 5362258 - DNA, 17 bp, Homo sapiens
aggatgctctttccctt

SEQ ID NO: 5362259 - DNA, 21 bp, Homo sapiens
aggatgctctttcccttttct

SEQ ID NO: 5362260 - DNA, 12 bp, Homo sapiens
aggatgctgaag

SEQ ID NO: 5362261 - DNA, 13 bp, Homo sapiens
aggatgctgaagt

SEQ ID NO: 5362262 - DNA, 20 bp, Homo sapiens
aggatgctgaagtacagtcc

SEQ ID NO: 5362263 - DNA, 13 bp, Homo sapiens
aggatgctgctgt

SEQ ID NO: 5362264 - DNA, 12 bp, Homo sapiens
aggatgctggcc

SEQ ID NO: 5362265 - DNA, 14 bp, Homo sapiens
aggatgcttctgct

SEQ ID NO: 5362266 - DNA, 21 bp, Homo sapiens
aggatgcttgattccagtggt

SEQ ID NO: 5362267 - DNA, 16 bp, Homo sapiens
aggatgcttgtacata

SEQ ID NO: 5362268 - DNA, 23 bp, Homo sapiens
aggatgctttcctgttcatgggg

SEQ ID NO: 5362269 - DNA, 22 bp, Homo sapiens
aggatggaaaaataaaacgcaa

SEQ ID NO: 5362270 - DNA, 14 bp, Homo sapiens
aggatggaacacgg

SEQ ID NO: 5362271 - DNA, 16 bp, Homo sapiens
aggatggaagaaagaa

SEQ ID NO: 5362272 - DNA, 20 bp, Homo sapiens
aggatggacgaacaggggcc

SEQ ID NO: 5362273 - DNA, 19 bp, Homo sapiens
aggatggagagaggggaat

SEQ ID NO: 5362274 - DNA, 17 bp, Homo sapiens
aggatggagccagctct

SEQ ID NO: 5362275 - DNA, 12 bp, Homo sapiens
aggatggagggg

SEQ ID NO: 5362276 - DNA, 13 bp, Homo sapiens
aggatggatggca

SEQ ID NO: 5362277 - DNA, 19 bp, Homo sapiens
aggatggatggcaccctgg

SEQ ID NO: 5362278 - DNA, 21 bp, Homo sapiens
aggatggatggcaccctggaa

SEQ ID NO: 5362279 - DNA, 22 bp, Homo sapiens
aggatggcaggacgtgggctgg

SEQ ID NO: 5362280 - DNA, 15 bp, Homo sapiens
aggatggccagtgtc

SEQ ID NO: 5362281 - DNA, 16 bp, Homo sapiens
aggatggccagtgtct

SEQ ID NO: 5362282 - DNA, 18 bp, Homo sapiens
aggatggccagtgtctgt

SEQ ID NO: 5362283 - DNA, 20 bp, Homo sapiens
aggatggccagtgtctgtcc

SEQ ID NO: 5362284 - DNA, 16 bp, Homo sapiens
aggatggcctggccag

SEQ ID NO: 5362285 - DNA, 18 bp, Homo sapiens
aggatggcctttccttcc

SEQ ID NO: 5362286 - DNA, 13 bp, Homo sapiens
aggatggcgcagg

SEQ ID NO: 5362287 - DNA, 22 bp, Homo sapiens
aggatggctaggaaagggaagc

SEQ ID NO: 5362288 - DNA, 20 bp, Homo sapiens
aggatgggaagaaaaaggaa

SEQ ID NO: 5362289 - DNA, 11 bp, Homo sapiens
aggatgggctc

SEQ ID NO: 5362290 - DNA, 16 bp, Homo sapiens
aggatgggctgagcta

SEQ ID NO: 5362291 - DNA, 13 bp, Homo sapiens
aggatggggaggg

SEQ ID NO: 5362292 - DNA, 15 bp, Homo sapiens
aggatggggaggggc

SEQ ID NO: 5362293 - DNA, 19 bp, Homo sapiens
aggatggggaggggctctg

SEQ ID NO: 5362294 - DNA, 22 bp, Homo sapiens
aggatggggaggggctctgcgt

SEQ ID NO: 5362295 - DNA, 17 bp, Homo sapiens
aggatgggggagagggg

SEQ ID NO: 5362296 - DNA, 14 bp, Homo sapiens
aggatgggtccaga

SEQ ID NO: 5362297 - DNA, 13 bp, Homo sapiens
aggatgggtcccc

SEQ ID NO: 5362298 - DNA, 22 bp, Homo sapiens
aggatggtctcgatctcctgac

SEQ ID NO: 5362299 - DNA, 23 bp, Homo sapiens
aggatggtcttgatctcctgagc

SEQ ID NO: 5362300 - DNA, 21 bp, Homo sapiens
aggatggtgcaggatggcttt

SEQ ID NO: 5362301 - DNA, 19 bp, Homo sapiens
aggatggtggggcccccag

SEQ ID NO: 5362302 - DNA, 22 bp, Homo sapiens
aggatggtggggcccccagcac

SEQ ID NO: 5362303 - DNA, 23 bp, Homo sapiens
aggatggtggggcccccagcacc

SEQ ID NO: 5362304 - DNA, 21 bp, Homo sapiens
aggatggtggttattttaaat

SEQ ID NO: 5362305 - DNA, 15 bp, Homo sapiens
aggatggtgtcctga

SEQ ID NO: 5362306 - DNA, 20 bp, Homo sapiens
aggatggttactgaggacca

SEQ ID NO: 5362307 - DNA, 22 bp, Homo sapiens
aggcacctgctcccacagaagg

SEQ ID NO: 5362308 - DNA, 13 bp, Homo sapiens
aggcacctgctgg

SEQ ID NO: 5362309 - DNA, 14 bp, Homo sapiens
aggcacctgctgga

SEQ ID NO: 5362310 - DNA, 13 bp, Homo sapiens
aggcacctggcct

SEQ ID NO: 5362311 - DNA, 18 bp, Homo sapiens
aggcacctgggctttctg

SEQ ID NO: 5362312 - DNA, 20 bp, Homo sapiens
aggcaccttcttaaaagaaa

SEQ ID NO: 5362313 - DNA, 14 bp, Homo sapiens
aggcacgaacccac

SEQ ID NO: 5362314 - DNA, 14 bp, Homo sapiens
aggcacgggtccct

SEQ ID NO: 5362315 - DNA, 14 bp, Homo sapiens
aggcacgtctcctg

SEQ ID NO: 5362316 - DNA, 17 bp, Homo sapiens
aggcacgtctcctgctg

SEQ ID NO: 5362317 - DNA, 18 bp, Homo sapiens
aggcactaagaggggctg

SEQ ID NO: 5362318 - DNA, 19 bp, Homo sapiens
aggcactaagaggggctgg

SEQ ID NO: 5362319 - DNA, 23 bp, Homo sapiens
aggcactagcctttggctctgga

SEQ ID NO: 5362320 - DNA, 20 bp, Homo sapiens
aggcactagtcaccgacagc

SEQ ID NO: 5362321 - DNA, 17 bp, Homo sapiens
aggcactcagtgagcct

SEQ ID NO: 5362322 - DNA, 22 bp, Homo sapiens
aggcactcagtgagcctcctgt

SEQ ID NO: 5362323 - DNA, 19 bp, Homo sapiens
aggcactcatgggtaataa

SEQ ID NO: 5362324 - DNA, 16 bp, Homo sapiens
aggcactccaaacctg

SEQ ID NO: 5362325 - DNA, 17 bp, Homo sapiens
aggcactctagattcca

SEQ ID NO: 5362326 - DNA, 15 bp, Homo sapiens
aggcactctcctgtc

SEQ ID NO: 5362327 - DNA, 14 bp, Homo sapiens
aggcactcttaaat

SEQ ID NO: 5362328 - DNA, 22 bp, Homo sapiens
aggcactgaacaggctggggcc

SEQ ID NO: 5362329 - DNA, 17 bp, Homo sapiens
aggcactgaagtgctta

SEQ ID NO: 5362330 - DNA, 13 bp, Homo sapiens
aggcactgccctg

SEQ ID NO: 5362331 - DNA, 22 bp, Homo sapiens
aggcactgcccttttcaggaag

SEQ ID NO: 5362332 - DNA, 13 bp, Homo sapiens
aggcactgcctga

SEQ ID NO: 5362333 - DNA, 22 bp, Homo sapiens
aggcactgccttctcctctctg

SEQ ID NO: 5362334 - DNA, 23 bp, Homo sapiens
aggcactgccttctcctctctgg

SEQ ID NO: 5362335 - DNA, 18 bp, Homo sapiens
aggcactgcgccacctgc

SEQ ID NO: 5362336 - DNA, 18 bp, Homo sapiens
aggcactgtcaggaatgg

SEQ ID NO: 5362337 - DNA, 12 bp, Homo sapiens
aggcactgtgaa

SEQ ID NO: 5362338 - DNA, 14 bp, Homo sapiens
aggcactgtggccc

SEQ ID NO: 5362339 - DNA, 22 bp, Homo sapiens
aggcactgttttatctctgtga

SEQ ID NO: 5362340 - DNA, 17 bp, Homo sapiens
aggcacttattgtaaat

SEQ ID NO: 5362341 - DNA, 18 bp, Homo sapiens
aggcacttattgtaaatt

SEQ ID NO: 5362342 - DNA, 15 bp, Homo sapiens
aggcacttcctcccc

SEQ ID NO: 5362343 - DNA, 17 bp, Homo sapiens
aggcacttcctcccctc

SEQ ID NO: 5362344 - DNA, 21 bp, Homo sapiens
aggcacttcctcccctcgccc

SEQ ID NO: 5362345 - DNA, 22 bp, Homo sapiens
aggcacttcctcccctcgccca

SEQ ID NO: 5362346 - DNA, 16 bp, Homo sapiens
aggcacttctgcctga

SEQ ID NO: 5362347 - DNA, 17 bp, Homo sapiens
aggcacttgaggctttc

SEQ ID NO: 5362348 - DNA, 13 bp, Homo sapiens
aggcactttagaa

SEQ ID NO: 5362349 - DNA, 20 bp, Homo sapiens
aggcactttagggctgtaaa

SEQ ID NO: 5362350 - DNA, 13 bp, Homo sapiens
aggcactttgaga

SEQ ID NO: 5362351 - DNA, 17 bp, Homo sapiens
aggcacttttattttca

SEQ ID NO: 5362352 - DNA, 20 bp, Homo sapiens
aggcagaaacctatctcagg

SEQ ID NO: 5362353 - DNA, 21 bp, Homo sapiens
aggcagaaacctatctcaggg

SEQ ID NO: 5362354 - DNA, 23 bp, Homo sapiens
aggcagaaacctatctcagggag

SEQ ID NO: 5362355 - DNA, 13 bp, Homo sapiens
aggcagaaagagt

SEQ ID NO: 5362356 - DNA, 21 bp, Homo sapiens
aggcagaaagatacagacatt

SEQ ID NO: 5362357 - DNA, 16 bp, Homo sapiens
aggcagaaagcaaaat

SEQ ID NO: 5362358 - DNA, 19 bp, Homo sapiens
aggcagaaagcagaggctg

SEQ ID NO: 5362359 - DNA, 21 bp, Homo sapiens
aggcagaaagcagaggctggc

SEQ ID NO: 5362360 - DNA, 12 bp, Homo sapiens
aggcagaaagga

SEQ ID NO: 5362361 - DNA, 13 bp, Homo sapiens
aggcagaaaggag

SEQ ID NO: 5362362 - DNA, 19 bp, Homo sapiens
aggcagaaatagttgtctg

SEQ ID NO: 5362363 - DNA, 20 bp, Homo sapiens
aggcagaaatagttgtctgt

SEQ ID NO: 5362364 - DNA, 23 bp, Homo sapiens
aggcagaaatagttgtctgtgct

SEQ ID NO: 5362365 - DNA, 17 bp, Homo sapiens
aggcagaaatataaaca

SEQ ID NO: 5362366 - DNA, 17 bp, Homo sapiens
aggcagaaccggtccca

SEQ ID NO: 5362367 - DNA, 22 bp, Homo sapiens
aggcagaaccggtcccagcctg

SEQ ID NO: 5362368 - DNA, 16 bp, Homo sapiens
aggcagaacctggtgg

SEQ ID NO: 5362369 - DNA, 21 bp, Homo sapiens
aggcagaacctggtggctgga

SEQ ID NO: 5362370 - DNA, 16 bp, Homo sapiens
aggcagaagaagctgg

SEQ ID NO: 5362371 - DNA, 20 bp, Homo sapiens
aggcagaagaagctgggagg

SEQ ID NO: 5362372 - DNA, 18 bp, Homo sapiens
aggcagaagcttggagga

SEQ ID NO: 5362373 - DNA, 19 bp, Homo sapiens
aggcagaagcttggaggag

SEQ ID NO: 5362374 - DNA, 17 bp, Homo sapiens
aggcagaaggaagcagg

SEQ ID NO: 5362375 - DNA, 13 bp, Homo sapiens
aggcagaaggcca

SEQ ID NO: 5362376 - DNA, 14 bp, Homo sapiens
aggcagaaggccag

SEQ ID NO: 5362377 - DNA, 15 bp, Homo sapiens
aggcagaaggccagg

SEQ ID NO: 5362378 - DNA, 20 bp, Homo sapiens
aggcagaatcctggccctct

SEQ ID NO: 5362379 - DNA, 21 bp, Homo sapiens
aggcagaatcctggccctctg

SEQ ID NO: 5362380 - DNA, 17 bp, Homo sapiens
aggcagaatggctgcac

SEQ ID NO: 5362381 - DNA, 16 bp, Homo sapiens
aggcagaatgtaactg

SEQ ID NO: 5362382 - DNA, 16 bp, Homo sapiens
aggcagacaaccttgt

SEQ ID NO: 5362383 - DNA, 14 bp, Homo sapiens
aggcagacaagagc

SEQ ID NO: 5362384 - DNA, 15 bp, Homo sapiens
aggcagacaagagct

SEQ ID NO: 5362385 - DNA, 17 bp, Homo sapiens
aggcagacaagagctgc

SEQ ID NO: 5362386 - DNA, 20 bp, Homo sapiens
aggcagacaagagctgctgt

SEQ ID NO: 5362387 - DNA, 20 bp, Homo sapiens
aggcagacacggatctgaga

SEQ ID NO: 5362388 - DNA, 21 bp, Homo sapiens
aggcagacagcagctcaggca

SEQ ID NO: 5362389 - DNA, 14 bp, Homo sapiens
aggcagacaggaag

SEQ ID NO: 5362390 - DNA, 20 bp, Homo sapiens
aggcagacaggaaggaagca

SEQ ID NO: 5362391 - DNA, 21 bp, Homo sapiens
aggcagacgaggcctttgctt

SEQ ID NO: 5362392 - DNA, 17 bp, Homo sapiens
aggcagactcgagggcc

SEQ ID NO: 5362393 - DNA, 21 bp, Homo sapiens
aggcagactctttatgcttgc

SEQ ID NO: 5362394 - DNA, 22 bp, Homo sapiens
aggcagactctttatgcttgca

SEQ ID NO: 5362395 - DNA, 23 bp, Homo sapiens
aggcagactttctacatgcaaat

SEQ ID NO: 5362396 - DNA, 13 bp, Homo sapiens
aggcagagaaaga

SEQ ID NO: 5362397 - DNA, 18 bp, Homo sapiens
aggcagagaaagaagaga

SEQ ID NO: 5362398 - DNA, 14 bp, Homo sapiens
aggcagagaaatct

SEQ ID NO: 5362399 - DNA, 14 bp, Homo sapiens
aggcagagaacaga

SEQ ID NO: 5362400 - DNA, 22 bp, Homo sapiens
aggcagagaatcatacttagca

SEQ ID NO: 5362401 - DNA, 18 bp, Homo sapiens
aggcagagaatctcttgg

SEQ ID NO: 5362402 - DNA, 20 bp, Homo sapiens
aggcagagaatctcttggga

SEQ ID NO: 5362403 - DNA, 11 bp, Homo sapiens
aggcagagagc

SEQ ID NO: 5362404 - DNA, 16 bp, Homo sapiens
aggcagagcggggagg

SEQ ID NO: 5362405 - DNA, 18 bp, Homo sapiens
aggcagagcggggaggtg

SEQ ID NO: 5362406 - DNA, 21 bp, Homo sapiens
aggcagagcggggaggtgcct

SEQ ID NO: 5362407 - DNA, 18 bp, Homo sapiens
aggcagagctgacgggag

SEQ ID NO: 5362408 - DNA, 20 bp, Homo sapiens
aggcagagctgacgggaggc

SEQ ID NO: 5362409 - DNA, 22 bp, Homo sapiens
aggcagagctgagggccctgtg

SEQ ID NO: 5362410 - DNA, 13 bp, Homo sapiens
aggcagagctgga

SEQ ID NO: 5362411 - DNA, 23 bp, Homo sapiens
aggcagagctggagcccccagca

SEQ ID NO: 5362412 - DNA, 23 bp, Homo sapiens
aggcagaggaatttggctgcttc

SEQ ID NO: 5362413 - DNA, 24 bp, Homo sapiens
aggcagaggcaactgacttcattt

SEQ ID NO: 5362414 - DNA, 22 bp, Homo sapiens
aggcagaggcccaggctgccgt

SEQ ID NO: 5362415 - DNA, 14 bp, Homo sapiens
aggcagaggcctgg

SEQ ID NO: 5362416 - DNA, 12 bp, Homo sapiens
aggcagaggctg

SEQ ID NO: 5362417 - DNA, 14 bp, Homo sapiens
aggcagaggctggc

SEQ ID NO: 5362418 - DNA, 18 bp, Homo sapiens
aggcagagggcctttgct

SEQ ID NO: 5362419 - DNA, 20 bp, Homo sapiens
aggcagaggttgcagtgagc

SEQ ID NO: 5362420 - DNA, 22 bp, Homo sapiens
aggcagaggttgcagtgagctg

SEQ ID NO: 5362421 - DNA, 13 bp, Homo sapiens
aggcagagtcttc

SEQ ID NO: 5362422 - DNA, 15 bp, Homo sapiens
aggcagagtgaaata

SEQ ID NO: 5362423 - DNA, 17 bp, Homo sapiens
aggcagagtgaaataaa

SEQ ID NO: 5362424 - DNA, 24 bp, Homo sapiens
aggcagagtgccccacctgccact

SEQ ID NO: 5362425 - DNA, 19 bp, Homo sapiens
aggcagagttctgtgaaga

SEQ ID NO: 5362426 - DNA, 17 bp, Homo sapiens
aggcagataactgctgt

SEQ ID NO: 5362427 - DNA, 18 bp, Homo sapiens
aggcagataagttggagc

SEQ ID NO: 5362428 - DNA, 11 bp, Homo sapiens
aggcagatcca

SEQ ID NO: 5362429 - DNA, 19 bp, Homo sapiens
aggcagatcctctggacac

SEQ ID NO: 5362430 - DNA, 21 bp, Homo sapiens
aggcagatctgtgccccatgc

SEQ ID NO: 5362431 - DNA, 15 bp, Homo sapiens
aggcagatctttaaa

SEQ ID NO: 5362432 - DNA, 18 bp, Homo sapiens
aggcagatggagatcaga

SEQ ID NO: 5362433 - DNA, 17 bp, Homo sapiens
aggcagatggccactgc

SEQ ID NO: 5362434 - DNA, 23 bp, Homo sapiens
aggcagattaataacagaaatac

SEQ ID NO: 5362435 - DNA, 24 bp, Homo sapiens
aggcagatttactgtcccaggagc

SEQ ID NO: 5362436 - DNA, 21 bp, Homo sapiens
aggcagcaaagaggggcgctg

SEQ ID NO: 5362437 - DNA, 15 bp, Homo sapiens
aggcagcaacaggac

SEQ ID NO: 5362438 - DNA, 17 bp, Homo sapiens
aggcagcaacaggacca

SEQ ID NO: 5362439 - DNA, 21 bp, Homo sapiens
aggcagcaacaggaccaggag

SEQ ID NO: 5362440 - DNA, 20 bp, Homo sapiens
aggcagcaaccattcatctt

SEQ ID NO: 5362441 - DNA, 16 bp, Homo sapiens
aggcagcaaggcccga

SEQ ID NO: 5362442 - DNA, 18 bp, Homo sapiens
aggcagcaaggcccgagc

SEQ ID NO: 5362443 - DNA, 23 bp, Homo sapiens
aggcagcaaggcccgagcagctg

SEQ ID NO: 5362444 - DNA, 20 bp, Homo sapiens
aggcagcaaggtggccacag

SEQ ID NO: 5362445 - DNA, 16 bp, Homo sapiens
aggcagcagtgggttc

SEQ ID NO: 5362446 - DNA, 21 bp, Homo sapiens
aggcagcagtgggttcaggcc

SEQ ID NO: 5362447 - DNA, 14 bp, Homo sapiens
aggcagcagtgtct

SEQ ID NO: 5362448 - DNA, 19 bp, Homo sapiens
aggcagcagtgtgaggcca

SEQ ID NO: 5362449 - DNA, 22 bp, Homo sapiens
aggcagcagtgtgaggccaggg

SEQ ID NO: 5362450 - DNA, 23 bp, Homo sapiens
aggcagcagtgtgaggccagggc

SEQ ID NO: 5362451 - DNA, 18 bp, Homo sapiens
aggcagcatgcttgggct

SEQ ID NO: 5362452 - DNA, 24 bp, Homo sapiens
aggcagcatgcttgggctgaccca

SEQ ID NO: 5362453 - DNA, 16 bp, Homo sapiens
aggcagccagacccag

SEQ ID NO: 5362454 - DNA, 17 bp, Homo sapiens
aggcagccagacccaga

SEQ ID NO: 5362455 - DNA, 12 bp, Homo sapiens
aggcagccagat

SEQ ID NO: 5362456 - DNA, 17 bp, Homo sapiens
aggcagccagatcccca

SEQ ID NO: 5362457 - DNA, 21 bp, Homo sapiens
aggcagccagatccccagggc

SEQ ID NO: 5362458 - DNA, 20 bp, Homo sapiens
aggcagccagcatctgggcc

SEQ ID NO: 5362459 - DNA, 15 bp, Homo sapiens
aggcagccagccgtg

SEQ ID NO: 5362460 - DNA, 14 bp, Homo sapiens
aggcagccaggcca

SEQ ID NO: 5362461 - DNA, 16 bp, Homo sapiens
aggcagccaggccaca

SEQ ID NO: 5362462 - DNA, 15 bp, Homo sapiens
aggcagccagtgaga

SEQ ID NO: 5362463 - DNA, 18 bp, Homo sapiens
aggcagccagtgccctga

SEQ ID NO: 5362464 - DNA, 20 bp, Homo sapiens
aggcagccagtgccctgagc

SEQ ID NO: 5362465 - DNA, 21 bp, Homo sapiens
aggcagccccattctgcctgc

SEQ ID NO: 5362466 - DNA, 23 bp, Homo sapiens
aggcagccctcacctctgaggac

SEQ ID NO: 5362467 - DNA, 14 bp, Homo sapiens
aggcagccctgcct

SEQ ID NO: 5362468 - DNA, 15 bp, Homo sapiens
aggcagccgaggcct

SEQ ID NO: 5362469 - DNA, 21 bp, Homo sapiens
aggcagccgaggcctggccaa

SEQ ID NO: 5362470 - DNA, 21 bp, Homo sapiens
aggcagcctagcctatgtctg

SEQ ID NO: 5362471 - DNA, 16 bp, Homo sapiens
aggcagcctccagagc

SEQ ID NO: 5362472 - DNA, 17 bp, Homo sapiens
aggcagcctcctttgtg

SEQ ID NO: 5362473 - DNA, 19 bp, Homo sapiens
aggcagcctcctttgtgtg

SEQ ID NO: 5362474 - DNA, 16 bp, Homo sapiens
aggcagcctctggggg

SEQ ID NO: 5362475 - DNA, 22 bp, Homo sapiens
aggcagcctctggggggtggcc

SEQ ID NO: 5362476 - DNA, 16 bp, Homo sapiens
aggcagcctgaacact

SEQ ID NO: 5362477 - DNA, 21 bp, Homo sapiens
aggcagcctgagagctggccc

SEQ ID NO: 5362478 - DNA, 16 bp, Homo sapiens
aggcagcctgcagacc

SEQ ID NO: 5362479 - DNA, 18 bp, Homo sapiens
aggcagcctgtgggtcct

SEQ ID NO: 5362480 - DNA, 15 bp, Homo sapiens
aggcagcgcagggct

SEQ ID NO: 5362481 - DNA, 21 bp, Homo sapiens
aggcagcgccaagtgcgtgcc

SEQ ID NO: 5362482 - DNA, 15 bp, Homo sapiens
aggcagttctgtgtc

SEQ ID NO: 5362483 - DNA, 22 bp, Homo sapiens
aggcagttgagaaaatttgaat

SEQ ID NO: 5362484 - DNA, 20 bp, Homo sapiens
aggcagttgcccagcctctt

SEQ ID NO: 5362485 - DNA, 18 bp, Homo sapiens
aggcagttgtcctgacct

SEQ ID NO: 5362486 - DNA, 19 bp, Homo sapiens
aggcagtttcagagatgga

SEQ ID NO: 5362487 - DNA, 14 bp, Homo sapiens
aggcagtttgcaaa

SEQ ID NO: 5362488 - DNA, 16 bp, Homo sapiens
aggcagttttgaaatg

SEQ ID NO: 5362489 - DNA, 22 bp, Homo sapiens
aggcataaagtcaggggttccc

SEQ ID NO: 5362490 - DNA, 18 bp, Homo sapiens
aggcataagatgacttag

SEQ ID NO: 5362491 - DNA, 21 bp, Homo sapiens
aggcatacaagggggtaactc

SEQ ID NO: 5362492 - DNA, 22 bp, Homo sapiens
aggcatacctgtcctagcagga

SEQ ID NO: 5362493 - DNA, 23 bp, Homo sapiens
aggcatacctgtcctagcaggat

SEQ ID NO: 5362494 - DNA, 16 bp, Homo sapiens
aggcatactctccagg

SEQ ID NO: 5362495 - DNA, 18 bp, Homo sapiens
aggcatactctccaggat

SEQ ID NO: 5362496 - DNA, 19 bp, Homo sapiens
aggcatactctccaggatt

SEQ ID NO: 5362497 - DNA, 15 bp, Homo sapiens
aggcatacttttcaa

SEQ ID NO: 5362498 - DNA, 23 bp, Homo sapiens
aggcatagagggagaggaagcac

SEQ ID NO: 5362499 - DNA, 14 bp, Homo sapiens
aggcatagagtgac

SEQ ID NO: 5362500 - DNA, 14 bp, Homo sapiens
aggcataggcctgg

SEQ ID NO: 5362501 - DNA, 15 bp, Homo sapiens
aggcataggcctggg

SEQ ID NO: 5362502 - DNA, 16 bp, Homo sapiens
aggcatagggaatatg

SEQ ID NO: 5362503 - DNA, 22 bp, Homo sapiens
aggcatatactttgtctttctg

SEQ ID NO: 5362504 - DNA, 20 bp, Homo sapiens
aggcatatcagtctctgagg

SEQ ID NO: 5362505 - DNA, 20 bp, Homo sapiens
aggcatatcttctatatctg

SEQ ID NO: 5362506 - DNA, 22 bp, Homo sapiens
aggcatatcttctatatctgaa

SEQ ID NO: 5362507 - DNA, 17 bp, Homo sapiens
aggcatatgcttcttta

SEQ ID NO: 5362508 - DNA, 22 bp, Homo sapiens
aggcatatggagaacatgtttt

SEQ ID NO: 5362509 - DNA, 23 bp, Homo sapiens
aggcatatgtttccccatctctg

SEQ ID NO: 5362510 - DNA, 21 bp, Homo sapiens
aggcatattccctgcacacac

SEQ ID NO: 5362511 - DNA, 20 bp, Homo sapiens
aggcatatttaacaaaattt

SEQ ID NO: 5362512 - DNA, 13 bp, Homo sapiens
aggcatatttcca

SEQ ID NO: 5362513 - DNA, 12 bp, Homo sapiens
aggcatatttta

SEQ ID NO: 5362514 - DNA, 21 bp, Homo sapiens
aggcatcactgattccctctc

SEQ ID NO: 5362515 - DNA, 22 bp, Homo sapiens
aggcatcactgattccctctcc

SEQ ID NO: 5362516 - DNA, 17 bp, Homo sapiens
aggcatcactttcctgg

SEQ ID NO: 5362517 - DNA, 12 bp, Homo sapiens
aggcatcaggaa

SEQ ID NO: 5362518 - DNA, 13 bp, Homo sapiens
aggcatcaggaat

SEQ ID NO: 5362519 - DNA, 19 bp, Homo sapiens
aggcatcagtccctatgta

SEQ ID NO: 5362520 - DNA, 18 bp, Homo sapiens
aggcatccaaaggctcct

SEQ ID NO: 5362521 - DNA, 13 bp, Homo sapiens
aggcatcccaaga

SEQ ID NO: 5362522 - DNA, 15 bp, Homo sapiens
aggcatcccagcctg

SEQ ID NO: 5362523 - DNA, 20 bp, Homo sapiens
aggcatcccagcctgggggc

SEQ ID NO: 5362524 - DNA, 13 bp, Homo sapiens
aggcatcccaggg

SEQ ID NO: 5362525 - DNA, 13 bp, Homo sapiens
aggcatcccatcc

SEQ ID NO: 5362526 - DNA, 17 bp, Homo sapiens
aggcatccccagtgcca

SEQ ID NO: 5362527 - DNA, 13 bp, Homo sapiens
aggcatcctctga

SEQ ID NO: 5362528 - DNA, 14 bp, Homo sapiens
aggcatcctctgac

SEQ ID NO: 5362529 - DNA, 15 bp, Homo sapiens
aggcatcctctgact

SEQ ID NO: 5362530 - DNA, 15 bp, Homo sapiens
aggcatcctgcctgg

SEQ ID NO: 5362531 - DNA, 18 bp, Homo sapiens
aggcatcctgcctgggtg

SEQ ID NO: 5362532 - DNA, 24 bp, Homo sapiens
aggcatcctgcctgggtgggacag

SEQ ID NO: 5362533 - DNA, 19 bp, Homo sapiens
aggcatcggggagccggga

SEQ ID NO: 5362534 - DNA, 17 bp, Homo sapiens
aggcatctacacagcct

SEQ ID NO: 5362535 - DNA, 22 bp, Homo sapiens
aggcatctacacagcctggact

SEQ ID NO: 5362536 - DNA, 23 bp, Homo sapiens
aggcatctacacagcctggactt

SEQ ID NO: 5362537 - DNA, 15 bp, Homo sapiens
aggcatctcctctcc

SEQ ID NO: 5362538 - DNA, 18 bp, Homo sapiens
aggcatctcctctcccca

SEQ ID NO: 5362539 - DNA, 21 bp, Homo sapiens
aggcatctccttgggctggga

SEQ ID NO: 5362540 - DNA, 21 bp, Homo sapiens
aggcatctctgtactttgctt

SEQ ID NO: 5362541 - DNA, 22 bp, Homo sapiens
aggcatctctgtactttgcttg

SEQ ID NO: 5362542 - DNA, 16 bp, Homo sapiens
aggcatctgagtgtga

SEQ ID NO: 5362543 - DNA, 15 bp, Homo sapiens
aggcatctgcatggg

SEQ ID NO: 5362544 - DNA, 18 bp, Homo sapiens
aggcatctgctgtaataa

SEQ ID NO: 5362545 - DNA, 16 bp, Homo sapiens
aggcatctgtaagaag

SEQ ID NO: 5362546 - DNA, 19 bp, Homo sapiens
aggcatctgttagcagagt

SEQ ID NO: 5362547 - DNA, 19 bp, Homo sapiens
aggcatgaaattcttccta

SEQ ID NO: 5362548 - DNA, 11 bp, Homo sapiens
aggcatgaagg

SEQ ID NO: 5362549 - DNA, 14 bp, Homo sapiens
aggcatgaccctgg

SEQ ID NO: 5362550 - DNA, 14 bp, Homo sapiens
aggcatgagaaaga

SEQ ID NO: 5362551 - DNA, 13 bp, Homo sapiens
aggcatgagccac

SEQ ID NO: 5362552 - DNA, 14 bp, Homo sapiens
aggcatgagccact

SEQ ID NO: 5362553 - DNA, 15 bp, Homo sapiens
aggcatgagccactg

SEQ ID NO: 5362554 - DNA, 15 bp, Homo sapiens
aggcatgcacatctg

SEQ ID NO: 5362555 - DNA, 16 bp, Homo sapiens
aggcatgcaccagtgc

SEQ ID NO: 5362556 - DNA, 20 bp, Homo sapiens
aggcatgcagctgcctgggg

SEQ ID NO: 5362557 - DNA, 18 bp, Homo sapiens
aggcatgcctctgatatg

SEQ ID NO: 5362558 - DNA, 20 bp, Homo sapiens
aggcatgcgaaatgttctca

SEQ ID NO: 5362559 - DNA, 23 bp, Homo sapiens
aggcatgctcccagcatttgtcc

SEQ ID NO: 5362560 - DNA, 15 bp, Homo sapiens
aggcatgctggagta

SEQ ID NO: 5362561 - DNA, 18 bp, Homo sapiens
aggcatgctggcctccca

SEQ ID NO: 5362562 - DNA, 16 bp, Homo sapiens
aggcatggaaaccaaa

SEQ ID NO: 5362563 - DNA, 19 bp, Homo sapiens
aggcatggaaagatgggga

SEQ ID NO: 5362564 - DNA, 18 bp, Homo sapiens
aggcatggacttctggat

SEQ ID NO: 5362565 - DNA, 13 bp, Homo sapiens
aggcatggagaca

SEQ ID NO: 5362566 - DNA, 16 bp, Homo sapiens
aggcatggcaattctg

SEQ ID NO: 5362567 - DNA, 17 bp, Homo sapiens
aggcatggcccagcctg

SEQ ID NO: 5362568 - DNA, 12 bp, Homo sapiens
aggcatggccct

SEQ ID NO: 5362569 - DNA, 16 bp, Homo sapiens
aggcatggccctgggc

SEQ ID NO: 5362570 - DNA, 12 bp, Homo sapiens
aggcatggcttc

SEQ ID NO: 5362571 - DNA, 15 bp, Homo sapiens
aggcatgggccacca

SEQ ID NO: 5362572 - DNA, 16 bp, Homo sapiens
aggcatgggcttgctg

SEQ ID NO: 5362573 - DNA, 20 bp, Homo sapiens
aggcatgggggcccaaaggg

SEQ ID NO: 5362574 - DNA, 21 bp, Homo sapiens
aggcatgggtgcaaggaaaat

SEQ ID NO: 5362575 - DNA, 12 bp, Homo sapiens
aggcatggtggc

SEQ ID NO: 5362576 - DNA, 16 bp, Homo sapiens
aggcatgtacaaaaat

SEQ ID NO: 5362577 - DNA, 17 bp, Homo sapiens
aggcatgtaggaccctg

SEQ ID NO: 5362578 - DNA, 18 bp, Homo sapiens
aggcatgtagggggagcc

SEQ ID NO: 5362579 - DNA, 16 bp, Homo sapiens
aggcatgtcagaggac

SEQ ID NO: 5362580 - DNA, 21 bp, Homo sapiens
aggcatgtcagaggaccccag

SEQ ID NO: 5362581 - DNA, 23 bp, Homo sapiens
aggcatgtcagaggaccccaggg

SEQ ID NO: 5362582 - DNA, 12 bp, Homo sapiens
aggcatgtcctg

SEQ ID NO: 5362583 - DNA, 20 bp, Homo sapiens
aggcatgtgatgagaggaaa

SEQ ID NO: 5362584 - DNA, 23 bp, Homo sapiens
aggcatgtgatgagaggaaatca

SEQ ID NO: 5362585 - DNA, 23 bp, Homo sapiens
aggcatgtgtcaccatgcccagc

SEQ ID NO: 5362586 - DNA, 17 bp, Homo sapiens
aggcatgtgtcccttcc

SEQ ID NO: 5362587 - DNA, 17 bp, Homo sapiens
aggcatgtgtgaaacat

SEQ ID NO: 5362588 - DNA, 16 bp, Homo sapiens
aggcatgttcagggat

SEQ ID NO: 5362589 - DNA, 12 bp, Homo sapiens
aggcatgttctc

SEQ ID NO: 5362590 - DNA, 17 bp, Homo sapiens
aggcatgttctctgagg

SEQ ID NO: 5362591 - DNA, 12 bp, Homo sapiens
aggcattaaatg

SEQ ID NO: 5362592 - DNA, 18 bp, Homo sapiens
aggcattaaatgcaaaaa

SEQ ID NO: 5362593 - DNA, 13 bp, Homo sapiens
aggcattaacaca

SEQ ID NO: 5362594 - DNA, 19 bp, Homo sapiens
aggcattaacacaaaggag

SEQ ID NO: 5362595 - DNA, 13 bp, Homo sapiens
aggcattaatgtt

SEQ ID NO: 5362596 - DNA, 21 bp, Homo sapiens
aggcattaatgtttctatctg

SEQ ID NO: 5362597 - DNA, 13 bp, Homo sapiens
aggcattccagct

SEQ ID NO: 5362598 - DNA, 18 bp, Homo sapiens
aggcattccccaggaggc

SEQ ID NO: 5362599 - DNA, 19 bp, Homo sapiens
aggcattccccaggaggcc

SEQ ID NO: 5362600 - DNA, 17 bp, Homo sapiens
aggcattcctgaaggga

SEQ ID NO: 5362601 - DNA, 17 bp, Homo sapiens
aggcattcggggaagct

SEQ ID NO: 5362602 - DNA, 14 bp, Homo sapiens
aggcattgcacaga

SEQ ID NO: 5362603 - DNA, 17 bp, Homo sapiens
aggcattgcactaaaag

SEQ ID NO: 5362604 - DNA, 19 bp, Homo sapiens
aggcattgcactaaaagtg

SEQ ID NO: 5362605 - DNA, 19 bp, Homo sapiens
aggcattgcaggaccttgg

SEQ ID NO: 5362606 - DNA, 13 bp, Homo sapiens
aggcattgccaag

SEQ ID NO: 5362607 - DNA, 14 bp, Homo sapiens
aggcattgccaagg

SEQ ID NO: 5362608 - DNA, 21 bp, Homo sapiens
aggcattgcctcggctggctc

SEQ ID NO: 5362609 - DNA, 18 bp, Homo sapiens
aggcattggcatctgctt

SEQ ID NO: 5362610 - DNA, 20 bp, Homo sapiens
aggcattggcatctgctttt

SEQ ID NO: 5362611 - DNA, 21 bp, Homo sapiens
aggcattgtttttaagaaaaa

SEQ ID NO: 5362612 - DNA, 19 bp, Homo sapiens
aggcatttcattatgcttt

SEQ ID NO: 5362613 - DNA, 12 bp, Homo sapiens
aggcatttccta

SEQ ID NO: 5362614 - DNA, 14 bp, Homo sapiens
aggcatttcctggg

SEQ ID NO: 5362615 - DNA, 17 bp, Homo sapiens
aggcatttcctgggtgg

SEQ ID NO: 5362616 - DNA, 21 bp, Homo sapiens
aggcatttgctaaggcagctg

SEQ ID NO: 5362617 - DNA, 21 bp, Homo sapiens
aggcatttggaacaacaaatc

SEQ ID NO: 5362618 - DNA, 18 bp, Homo sapiens
aggcatttggcatttatt

SEQ ID NO: 5362619 - DNA, 23 bp, Homo sapiens
aggcatttggtctcactacttga

SEQ ID NO: 5362620 - DNA, 20 bp, Homo sapiens
aggcatttgtcttagagaga

SEQ ID NO: 5362621 - DNA, 11 bp, Homo sapiens
aggcatttgtt

SEQ ID NO: 5362622 - DNA, 20 bp, Homo sapiens
aggcatttgttggtttatca

SEQ ID NO: 5362623 - DNA, 16 bp, Homo sapiens
aggcatttttgtaatg

SEQ ID NO: 5362624 - DNA, 17 bp, Homo sapiens
aggccaaaatcaagagt

SEQ ID NO: 5362625 - DNA, 16 bp, Homo sapiens
aggccaaacacccaag

SEQ ID NO: 5362626 - DNA, 17 bp, Homo sapiens
aggccaaacatggccag

SEQ ID NO: 5362627 - DNA, 20 bp, Homo sapiens
aggccaaactcacctgcccc

SEQ ID NO: 5362628 - DNA, 12 bp, Homo sapiens
aggccaaactgc

SEQ ID NO: 5362629 - DNA, 17 bp, Homo sapiens
aggccaaactgtccctc

SEQ ID NO: 5362630 - DNA, 22 bp, Homo sapiens
aggccaaactgtccctcccttg

SEQ ID NO: 5362631 - DNA, 19 bp, Homo sapiens
aggccaaagacaaatagta

SEQ ID NO: 5362632 - DNA, 21 bp, Homo sapiens
aggccaaagccccatgtgcct

SEQ ID NO: 5362633 - DNA, 22 bp, Homo sapiens
aggccaaagccccatgtgcctt

SEQ ID NO: 5362634 - DNA, 14 bp, Homo sapiens
aggccaaaggaagc

SEQ ID NO: 5362635 - DNA, 20 bp, Homo sapiens
aggccaaaggaagcacatgc

SEQ ID NO: 5362636 - DNA, 22 bp, Homo sapiens
aggccaaaggggacctggaagg

SEQ ID NO: 5362637 - DNA, 15 bp, Homo sapiens
aggccaaatattgat

SEQ ID NO: 5362638 - DNA, 17 bp, Homo sapiens
aggccaaattaatcttt

SEQ ID NO: 5362639 - DNA, 18 bp, Homo sapiens
aggccaacagcacctccc

SEQ ID NO: 5362640 - DNA, 22 bp, Homo sapiens
aggccaacccaaaataagcagg

SEQ ID NO: 5362641 - DNA, 17 bp, Homo sapiens
aggccaactgcctcctt

SEQ ID NO: 5362642 - DNA, 23 bp, Homo sapiens
aggccaactgcctccttgccagc

SEQ ID NO: 5362643 - DNA, 14 bp, Homo sapiens
aggccaagaaacgt

SEQ ID NO: 5362644 - DNA, 16 bp, Homo sapiens
aggccaagaatattgc

SEQ ID NO: 5362645 - DNA, 20 bp, Homo sapiens
aggccaagaatattgcaaaa

SEQ ID NO: 5362646 - DNA, 19 bp, Homo sapiens
aggccaagagtggccccac

SEQ ID NO: 5362647 - DNA, 12 bp, Homo sapiens
aggccaagcctg

SEQ ID NO: 5362648 - DNA, 17 bp, Homo sapiens
aggccaagcctgcagct

SEQ ID NO: 5362649 - DNA, 13 bp, Homo sapiens
aggccaaggactg

SEQ ID NO: 5362650 - DNA, 22 bp, Homo sapiens
aggccaaggactgactttgcca

SEQ ID NO: 5362651 - DNA, 13 bp, Homo sapiens
aggccaaggcagg

SEQ ID NO: 5362652 - DNA, 17 bp, Homo sapiens
aggccaaggcctcagga

SEQ ID NO: 5362653 - DNA, 15 bp, Homo sapiens
aggccaagggaccag

SEQ ID NO: 5362654 - DNA, 18 bp, Homo sapiens
aggccaaggtctgagcca

SEQ ID NO: 5362655 - DNA, 12 bp, Homo sapiens
aggccaaggtgc

SEQ ID NO: 5362656 - DNA, 18 bp, Homo sapiens
aggccaaggtgggaggat

SEQ ID NO: 5362657 - DNA, 16 bp, Homo sapiens
aggccaaggtgggcgg

SEQ ID NO: 5362658 - DNA, 19 bp, Homo sapiens
aggccaaggtgtcctacag

SEQ ID NO: 5362659 - DNA, 20 bp, Homo sapiens
aggccaaggtgtcctacaga

SEQ ID NO: 5362660 - DNA, 15 bp, Homo sapiens
aggccatctggagag

SEQ ID NO: 5362661 - DNA, 16 bp, Homo sapiens
aggccatctggagagc

SEQ ID NO: 5362662 - DNA, 21 bp, Homo sapiens
aggccatctgtaaatatccca

SEQ ID NO: 5362663 - DNA, 22 bp, Homo sapiens
aggccatctgtaaatatcccag

SEQ ID NO: 5362664 - DNA, 23 bp, Homo sapiens
aggccatctgtaaatatcccaga

SEQ ID NO: 5362665 - DNA, 15 bp, Homo sapiens
aggccatcttccagg

SEQ ID NO: 5362666 - DNA, 19 bp, Homo sapiens
aggccatcttccaggtggg

SEQ ID NO: 5362667 - DNA, 13 bp, Homo sapiens
aggccatgaaaaa

SEQ ID NO: 5362668 - DNA, 16 bp, Homo sapiens
aggccatgatggcctt

SEQ ID NO: 5362669 - DNA, 22 bp, Homo sapiens
aggccatgatgtcgttcatttt

SEQ ID NO: 5362670 - DNA, 19 bp, Homo sapiens
aggccatgattcgcccaaa

SEQ ID NO: 5362671 - DNA, 14 bp, Homo sapiens
aggccatgcccacc

SEQ ID NO: 5362672 - DNA, 23 bp, Homo sapiens
aggccatgcccaccgcccctgga

SEQ ID NO: 5362673 - DNA, 17 bp, Homo sapiens
aggccatggactctgtc

SEQ ID NO: 5362674 - DNA, 19 bp, Homo sapiens
aggccatggactctgtcct

SEQ ID NO: 5362675 - DNA, 16 bp, Homo sapiens
aggccatggagagctg

SEQ ID NO: 5362676 - DNA, 18 bp, Homo sapiens
aggccatggagagctgga

SEQ ID NO: 5362677 - DNA, 20 bp, Homo sapiens
aggccatggaggcagtagga

SEQ ID NO: 5362678 - DNA, 22 bp, Homo sapiens
aggccatggcatccctttttca

SEQ ID NO: 5362679 - DNA, 12 bp, Homo sapiens
aggccatggctc

SEQ ID NO: 5362680 - DNA, 17 bp, Homo sapiens
aggccatgggcctcctg

SEQ ID NO: 5362681 - DNA, 17 bp, Homo sapiens
aggccatggggcagcct

SEQ ID NO: 5362682 - DNA, 18 bp, Homo sapiens
aggccatggggcagcctc

SEQ ID NO: 5362683 - DNA, 19 bp, Homo sapiens
aggccatggggcagcctcc

SEQ ID NO: 5362684 - DNA, 20 bp, Homo sapiens
aggccatggggcagcctcca

SEQ ID NO: 5362685 - DNA, 21 bp, Homo sapiens
aggccatggggcagcctccag

SEQ ID NO: 5362686 - DNA, 20 bp, Homo sapiens
aggccatgtgcatagtttct

SEQ ID NO: 5362687 - DNA, 20 bp, Homo sapiens
aggccatgtggcctgcccag

SEQ ID NO: 5362688 - DNA, 20 bp, Homo sapiens
aggccatgttccaataaaca

SEQ ID NO: 5362689 - DNA, 13 bp, Homo sapiens
aggccattattgt

SEQ ID NO: 5362690 - DNA, 20 bp, Homo sapiens
aggccattccccgtctctgg

SEQ ID NO: 5362691 - DNA, 15 bp, Homo sapiens
aggccattccctgta

SEQ ID NO: 5362692 - DNA, 17 bp, Homo sapiens
aggccattccctgtagg

SEQ ID NO: 5362693 - DNA, 16 bp, Homo sapiens
aggccattctgccgcc

SEQ ID NO: 5362694 - DNA, 17 bp, Homo sapiens
aggccattctttcccaa

SEQ ID NO: 5362695 - DNA, 19 bp, Homo sapiens
aggccattctttcccaaca

SEQ ID NO: 5362696 - DNA, 22 bp, Homo sapiens
aggccattgggtttggggccat

SEQ ID NO: 5362697 - DNA, 20 bp, Homo sapiens
aggccattgtgaaccaatgc

SEQ ID NO: 5362698 - DNA, 16 bp, Homo sapiens
aggccatttgctgccc

SEQ ID NO: 5362699 - DNA, 18 bp, Homo sapiens
aggccatttgctgccctg

SEQ ID NO: 5362700 - DNA, 20 bp, Homo sapiens
aggccatttgctgccctggg

SEQ ID NO: 5362701 - DNA, 18 bp, Homo sapiens
aggccatttgttacagtt

SEQ ID NO: 5362702 - DNA, 18 bp, Homo sapiens
aggcccaaaccaggggga

SEQ ID NO: 5362703 - DNA, 12 bp, Homo sapiens
aggcccaaagcc

SEQ ID NO: 5362704 - DNA, 12 bp, Homo sapiens
aggcccaaatga

SEQ ID NO: 5362705 - DNA, 15 bp, Homo sapiens
aggcccaaatgatgg

SEQ ID NO: 5362706 - DNA, 18 bp, Homo sapiens
aggcccaaccaccagatg

SEQ ID NO: 5362707 - DNA, 18 bp, Homo sapiens
aggcccaactggttcagg

SEQ ID NO: 5362708 - DNA, 20 bp, Homo sapiens
aggcccaagagcagagtctg

SEQ ID NO: 5362709 - DNA, 11 bp, Homo sapiens
aggcccaagtc

SEQ ID NO: 5362710 - DNA, 15 bp, Homo sapiens
aggcccacacacagg

SEQ ID NO: 5362711 - DNA, 19 bp, Homo sapiens
aggcccacaggaggcaagc

SEQ ID NO: 5362712 - DNA, 21 bp, Homo sapiens
aggcccaccatcaccaccgcc

SEQ ID NO: 5362713 - DNA, 15 bp, Homo sapiens
aggcccactcagggg

SEQ ID NO: 5362714 - DNA, 15 bp, Homo sapiens
aggcccactccccag

SEQ ID NO: 5362715 - DNA, 12 bp, Homo sapiens
aggcccagaagg

SEQ ID NO: 5362716 - DNA, 21 bp, Homo sapiens
aggcccagaattgcagttcag

SEQ ID NO: 5362717 - DNA, 12 bp, Homo sapiens
aggcccagacct

SEQ ID NO: 5362718 - DNA, 19 bp, Homo sapiens
aggcccagacctggcctct

SEQ ID NO: 5362719 - DNA, 20 bp, Homo sapiens
aggcccagagagaagagccc

SEQ ID NO: 5362720 - DNA, 23 bp, Homo sapiens
aggcccagagagaagagccccac

SEQ ID NO: 5362721 - DNA, 16 bp, Homo sapiens
aggcccagagagctga

SEQ ID NO: 5362722 - DNA, 16 bp, Homo sapiens
aggcccagagggcctg

SEQ ID NO: 5362723 - DNA, 20 bp, Homo sapiens
aggcccagagggcctgcaag

SEQ ID NO: 5362724 - DNA, 10 bp, Homo sapiens
aggcccagca

SEQ ID NO: 5362725 - DNA, 13 bp, Homo sapiens
aggcccagcagac

SEQ ID NO: 5362726 - DNA, 15 bp, Homo sapiens
aggcccagcagagcc

SEQ ID NO: 5362727 - DNA, 23 bp, Homo sapiens
aggcccagcagagccgttcctgg

SEQ ID NO: 5362728 - DNA, 12 bp, Homo sapiens
aggcccagcatg

SEQ ID NO: 5362729 - DNA, 14 bp, Homo sapiens
aggcccagcatgca

SEQ ID NO: 5362730 - DNA, 18 bp, Homo sapiens
aggcccagcattgctggt

SEQ ID NO: 5362731 - DNA, 20 bp, Homo sapiens
aggcccagcattgctggttc

SEQ ID NO: 5362732 - DNA, 21 bp, Homo sapiens
aggcccagcattgctggttct

SEQ ID NO: 5362733 - DNA, 20 bp, Homo sapiens
aggcccagccagttggtggg

SEQ ID NO: 5362734 - DNA, 13 bp, Homo sapiens
aggcccagcccct

SEQ ID NO: 5362735 - DNA, 15 bp, Homo sapiens
aggcccagcccctag

SEQ ID NO: 5362736 - DNA, 16 bp, Homo sapiens
aggcccagcccctaga

SEQ ID NO: 5362737 - DNA, 19 bp, Homo sapiens
aggcccagcccctagaaac

SEQ ID NO: 5362738 - DNA, 15 bp, Homo sapiens
aggcccagcccctcc

SEQ ID NO: 5362739 - DNA, 21 bp, Homo sapiens
aggcccagccctccttcaggg

SEQ ID NO: 5362740 - DNA, 21 bp, Homo sapiens
aggcccagcctctctggctca

SEQ ID NO: 5362741 - DNA, 18 bp, Homo sapiens
aggcccagcctctgcccc

SEQ ID NO: 5362742 - DNA, 15 bp, Homo sapiens
aggcccagcctcttg

SEQ ID NO: 5362743 - DNA, 15 bp, Homo sapiens
aggcccagcctggcc

SEQ ID NO: 5362744 - DNA, 17 bp, Homo sapiens
aggcccagcctgtcctg

SEQ ID NO: 5362745 - DNA, 23 bp, Homo sapiens
aggcccagcgcggacatcccctg

SEQ ID NO: 5362746 - DNA, 17 bp, Homo sapiens
aggcccagcgcggccag

SEQ ID NO: 5362747 - DNA, 19 bp, Homo sapiens
aggcccagcgggcagatgg

SEQ ID NO: 5362748 - DNA, 20 bp, Homo sapiens
aggcccagctatggccccag

SEQ ID NO: 5362749 - DNA, 13 bp, Homo sapiens
aggcccagctgcc

SEQ ID NO: 5362750 - DNA, 17 bp, Homo sapiens
aggcccagctgccaggg

SEQ ID NO: 5362751 - DNA, 23 bp, Homo sapiens
aggcccagctgccagggaagaca

SEQ ID NO: 5362752 - DNA, 16 bp, Homo sapiens
aggcccagctgctccc

SEQ ID NO: 5362753 - DNA, 13 bp, Homo sapiens
aggcccagctggg

SEQ ID NO: 5362754 - DNA, 12 bp, Homo sapiens
aggcccaggaga

SEQ ID NO: 5362755 - DNA, 18 bp, Homo sapiens
aggcccaggagtccaggc

SEQ ID NO: 5362756 - DNA, 13 bp, Homo sapiens
aggcccaggcacc

SEQ ID NO: 5362757 - DNA, 14 bp, Homo sapiens
aggcccaggcacca

SEQ ID NO: 5362758 - DNA, 19 bp, Homo sapiens
aggcccaggcaccaccagg

SEQ ID NO: 5362759 - DNA, 21 bp, Homo sapiens
aggcccaggcaggcccagcct

SEQ ID NO: 5362760 - DNA, 22 bp, Homo sapiens
aggcccaggccagcccccccac

SEQ ID NO: 5362761 - DNA, 13 bp, Homo sapiens
aggcccaggcctc

SEQ ID NO: 5362762 - DNA, 17 bp, Homo sapiens
aggcccaggctgccgtc

SEQ ID NO: 5362763 - DNA, 12 bp, Homo sapiens
aggcccagggag

SEQ ID NO: 5362764 - DNA, 15 bp, Homo sapiens
aggcccagggaggca

SEQ ID NO: 5362765 - DNA, 19 bp, Homo sapiens
aggcccagggaggcagcgt

SEQ ID NO: 5362766 - DNA, 23 bp, Homo sapiens
aggcccaggggtggggcccatgg

SEQ ID NO: 5362767 - DNA, 23 bp, Homo sapiens
aggcccagtgacaaagactcctc

SEQ ID NO: 5362768 - DNA, 17 bp, Homo sapiens
aggcccagtgagatgca

SEQ ID NO: 5362769 - DNA, 17 bp, Homo sapiens
aggcccagttcaccctg

SEQ ID NO: 5362770 - DNA, 12 bp, Homo sapiens
aggcccatctca

SEQ ID NO: 5362771 - DNA, 17 bp, Homo sapiens
aggcccatgccaaggcc

SEQ ID NO: 5362772 - DNA, 17 bp, Homo sapiens
aggcccatgcccccttc

SEQ ID NO: 5362773 - DNA, 22 bp, Homo sapiens
aggcccatgcccccttcgctcc

SEQ ID NO: 5362774 - DNA, 13 bp, Homo sapiens
aggcccatggcca

SEQ ID NO: 5362775 - DNA, 15 bp, Homo sapiens
aggcccatggccaca

SEQ ID NO: 5362776 - DNA, 16 bp, Homo sapiens
aggcccatgggcagaa

SEQ ID NO: 5362777 - DNA, 23 bp, Homo sapiens
aggcccatgtatataagtactga

SEQ ID NO: 5362778 - DNA, 17 bp, Homo sapiens
aggcccattgctgacga

SEQ ID NO: 5362779 - DNA, 13 bp, Homo sapiens
aggccccaaagga

SEQ ID NO: 5362780 - DNA, 22 bp, Homo sapiens
aggccccaaaggaaaaagcaca

SEQ ID NO: 5362781 - DNA, 15 bp, Homo sapiens
aggccccaaccctgt

SEQ ID NO: 5362782 - DNA, 15 bp, Homo sapiens
aggccccacccctgt

SEQ ID NO: 5362783 - DNA, 16 bp, Homo sapiens
aggccccaccggccag

SEQ ID NO: 5362784 - DNA, 19 bp, Homo sapiens
aggccccaccggccaggcc

SEQ ID NO: 5362785 - DNA, 16 bp, Homo sapiens
aggccccacctgaagg

SEQ ID NO: 5362786 - DNA, 13 bp, Homo sapiens
aggccccaccttc

SEQ ID NO: 5362787 - DNA, 14 bp, Homo sapiens
aggccccacgccct

SEQ ID NO: 5362788 - DNA, 17 bp, Homo sapiens
aggccccacgccctctc

SEQ ID NO: 5362789 - DNA, 15 bp, Homo sapiens
aggccccactgatgc

SEQ ID NO: 5362790 - DNA, 21 bp, Homo sapiens
aggccccactgatgctgttct

SEQ ID NO: 5362791 - DNA, 13 bp, Homo sapiens
aggccccagagac

SEQ ID NO: 5362792 - DNA, 20 bp, Homo sapiens
aggccccagagactcagagg

SEQ ID NO: 5362793 - DNA, 14 bp, Homo sapiens
aggccccagagaga

SEQ ID NO: 5362794 - DNA, 19 bp, Homo sapiens
aggccccagagagaccctg

SEQ ID NO: 5362795 - DNA, 13 bp, Homo sapiens
aggccccagaggc

SEQ ID NO: 5362796 - DNA, 14 bp, Homo sapiens
aggccccagaggcc

SEQ ID NO: 5362797 - DNA, 15 bp, Homo sapiens
aggccccagaggccc

SEQ ID NO: 5362798 - DNA, 21 bp, Homo sapiens
aggccccagaggccctggagg

SEQ ID NO: 5362799 - DNA, 20 bp, Homo sapiens
aggccccagcaacacgtcat

SEQ ID NO: 5362800 - DNA, 12 bp, Homo sapiens
aggccccagcca

SEQ ID NO: 5362801 - DNA, 14 bp, Homo sapiens
aggccccagccaag

SEQ ID NO: 5362802 - DNA, 15 bp, Homo sapiens
aggccccagcctcca

SEQ ID NO: 5362803 - DNA, 14 bp, Homo sapiens
aggccccagctctg

SEQ ID NO: 5362804 - DNA, 15 bp, Homo sapiens
aggccccagctctga

SEQ ID NO: 5362805 - DNA, 16 bp, Homo sapiens
aggccccaggaagccg

SEQ ID NO: 5362806 - DNA, 18 bp, Homo sapiens
aggccccaggctgagagc

SEQ ID NO: 5362807 - DNA, 14 bp, Homo sapiens
aggccccagggaca

SEQ ID NO: 5362808 - DNA, 14 bp, Homo sapiens
aggccccaggggag

SEQ ID NO: 5362809 - DNA, 17 bp, Homo sapiens
aggccccatgacctcca

SEQ ID NO: 5362810 - DNA, 21 bp, Homo sapiens
aggcccccaaacatagcccct

SEQ ID NO: 5362811 - DNA, 21 bp, Homo sapiens
aggcccccaaattgccttcag

SEQ ID NO: 5362812 - DNA, 20 bp, Homo sapiens
aggcccccaacccctcctcc

SEQ ID NO: 5362813 - DNA, 22 bp, Homo sapiens
aggcccccaacccctcctccct

SEQ ID NO: 5362814 - DNA, 21 bp, Homo sapiens
aggcccccaacccctccttcc

SEQ ID NO: 5362815 - DNA, 16 bp, Homo sapiens
aggcccccaccacaca

SEQ ID NO: 5362816 - DNA, 17 bp, Homo sapiens
aggcccccacccttggg

SEQ ID NO: 5362817 - DNA, 20 bp, Homo sapiens
aggcccccacctctgtgacc

SEQ ID NO: 5362818 - DNA, 19 bp, Homo sapiens
aggcccccacctggctcac

SEQ ID NO: 5362819 - DNA, 13 bp, Homo sapiens
aggcccccacttg

SEQ ID NO: 5362820 - DNA, 17 bp, Homo sapiens
aggcccccacttgcctc

SEQ ID NO: 5362821 - DNA, 18 bp, Homo sapiens
aggcccccagcccagggc

SEQ ID NO: 5362822 - DNA, 22 bp, Homo sapiens
aggcccccagcccagggctcct

SEQ ID NO: 5362823 - DNA, 19 bp, Homo sapiens
aggcccccagcccctcctc

SEQ ID NO: 5362824 - DNA, 22 bp, Homo sapiens
aggcccccagcccctcctccct

SEQ ID NO: 5362825 - DNA, 15 bp, Homo sapiens
aggcccccaggtgcc

SEQ ID NO: 5362826 - DNA, 15 bp, Homo sapiens
aggcccccagtggga

SEQ ID NO: 5362827 - DNA, 18 bp, Homo sapiens
aggcccccatcatcctct

SEQ ID NO: 5362828 - DNA, 21 bp, Homo sapiens
aggcccccatcatcctctggc

SEQ ID NO: 5362829 - DNA, 23 bp, Homo sapiens
aggccccccagaaagctgccaga

SEQ ID NO: 5362830 - DNA, 21 bp, Homo sapiens
aggcccccccagaagcaagat

SEQ ID NO: 5362831 - DNA, 18 bp, Homo sapiens
aggccccccgcagcaccc

SEQ ID NO: 5362832 - DNA, 19 bp, Homo sapiens
aggccccccgcagcaccct

SEQ ID NO: 5362833 - DNA, 22 bp, Homo sapiens
aggcccccctctgcctttgagc

SEQ ID NO: 5362834 - DNA, 18 bp, Homo sapiens
aggcccccgccttggcct

SEQ ID NO: 5362835 - DNA, 22 bp, Homo sapiens
aggcccccgctggctcctccag

SEQ ID NO: 5362836 - DNA, 22 bp, Homo sapiens
aggcccccggaggcgcccacct

SEQ ID NO: 5362837 - DNA, 23 bp, Homo sapiens
aggccccctaggattccccctgc

SEQ ID NO: 5362838 - DNA, 12 bp, Homo sapiens
aggcctctggga

SEQ ID NO: 5362839 - DNA, 13 bp, Homo sapiens
aggcctctgggac

SEQ ID NO: 5362840 - DNA, 19 bp, Homo sapiens
aggcctctgggacccacag

SEQ ID NO: 5362841 - DNA, 12 bp, Homo sapiens
aggcctctgggc

SEQ ID NO: 5362842 - DNA, 18 bp, Homo sapiens
aggcctctggttgcctcc

SEQ ID NO: 5362843 - DNA, 19 bp, Homo sapiens
aggcctctggttgcctccc

SEQ ID NO: 5362844 - DNA, 15 bp, Homo sapiens
aggcctctgtgtcct

SEQ ID NO: 5362845 - DNA, 20 bp, Homo sapiens
aggcctctgtgtccttccct

SEQ ID NO: 5362846 - DNA, 15 bp, Homo sapiens
aggcctcttcctgtt

SEQ ID NO: 5362847 - DNA, 13 bp, Homo sapiens
aggcctcttgctg

SEQ ID NO: 5362848 - DNA, 16 bp, Homo sapiens
aggcctcttgctggtg

SEQ ID NO: 5362849 - DNA, 23 bp, Homo sapiens
aggcctcttggacctctgctctg

SEQ ID NO: 5362850 - DNA, 24 bp, Homo sapiens
aggcctcttggacctctgctctga

SEQ ID NO: 5362851 - DNA, 18 bp, Homo sapiens
aggcctcttttcctgaag

SEQ ID NO: 5362852 - DNA, 18 bp, Homo sapiens
aggcctgaaaggagccct

SEQ ID NO: 5362853 - DNA, 18 bp, Homo sapiens
aggcctgaaatgacattt

SEQ ID NO: 5362854 - DNA, 22 bp, Homo sapiens
aggcctgaaatgtttccaggca

SEQ ID NO: 5362855 - DNA, 23 bp, Homo sapiens
aggcctgaaatgtttccaggcat

SEQ ID NO: 5362856 - DNA, 20 bp, Homo sapiens
aggcctgaatcatgagcctg

SEQ ID NO: 5362857 - DNA, 19 bp, Homo sapiens
aggcctgacacaggccagc

SEQ ID NO: 5362858 - DNA, 15 bp, Homo sapiens
aggcctgaccagggg

SEQ ID NO: 5362859 - DNA, 16 bp, Homo sapiens
aggcctgactctcagc

SEQ ID NO: 5362860 - DNA, 17 bp, Homo sapiens
aggcctgactgccaagc

SEQ ID NO: 5362861 - DNA, 19 bp, Homo sapiens
aggcctgactgccaagcca

SEQ ID NO: 5362862 - DNA, 21 bp, Homo sapiens
aggcctgactgccaagccatg

SEQ ID NO: 5362863 - DNA, 17 bp, Homo sapiens
aggcctgacttctgctg

SEQ ID NO: 5362864 - DNA, 15 bp, Homo sapiens
aggcctgagacccag

SEQ ID NO: 5362865 - DNA, 21 bp, Homo sapiens
aggcctgagatttcatctgct

SEQ ID NO: 5362866 - DNA, 23 bp, Homo sapiens
aggcctgagatttcatctgctct

SEQ ID NO: 5362867 - DNA, 19 bp, Homo sapiens
aggcctgagcgctcctgcc

SEQ ID NO: 5362868 - DNA, 13 bp, Homo sapiens
aggcctgagctgc

SEQ ID NO: 5362869 - DNA, 16 bp, Homo sapiens
aggcctgagctgcttc

SEQ ID NO: 5362870 - DNA, 16 bp, Homo sapiens
aggcctgaggatgagc

SEQ ID NO: 5362871 - DNA, 17 bp, Homo sapiens
aggcctgaggatgagct

SEQ ID NO: 5362872 - DNA, 20 bp, Homo sapiens
aggcctgaggatgagctgga

SEQ ID NO: 5362873 - DNA, 17 bp, Homo sapiens
aggcctgaggcctgtgc

SEQ ID NO: 5362874 - DNA, 18 bp, Homo sapiens
aggcctgaggcctgtgcc

SEQ ID NO: 5362875 - DNA, 20 bp, Homo sapiens
aggcctgaggcctgtgcctg

SEQ ID NO: 5362876 - DNA, 14 bp, Homo sapiens
aggcctgaggctgc

SEQ ID NO: 5362877 - DNA, 16 bp, Homo sapiens
aggcctgaggctgctg

SEQ ID NO: 5362878 - DNA, 22 bp, Homo sapiens
aggcctgagggaagcccacccg

SEQ ID NO: 5362879 - DNA, 23 bp, Homo sapiens
aggcctgagggaagcccacccgc

SEQ ID NO: 5362880 - DNA, 17 bp, Homo sapiens
aggcctgagttagctgt

SEQ ID NO: 5362881 - DNA, 18 bp, Homo sapiens
aggcctgagttagctgtt

SEQ ID NO: 5362882 - DNA, 18 bp, Homo sapiens
aggcctgatcttgcctgt

SEQ ID NO: 5362883 - DNA, 20 bp, Homo sapiens
aggcctgatcttgcctgtct

SEQ ID NO: 5362884 - DNA, 15 bp, Homo sapiens
aggcctgatgctgcc

SEQ ID NO: 5362885 - DNA, 18 bp, Homo sapiens
aggcctgcaaaccttcct

SEQ ID NO: 5362886 - DNA, 21 bp, Homo sapiens
aggcctgcaaaccttcctggg

SEQ ID NO: 5362887 - DNA, 24 bp, Homo sapiens
aggcctgcacacaagcccacagca

SEQ ID NO: 5362888 - DNA, 13 bp, Homo sapiens
aggcctgcacagg

SEQ ID NO: 5362889 - DNA, 19 bp, Homo sapiens
aggcctgcagcccctaagt

SEQ ID NO: 5362890 - DNA, 13 bp, Homo sapiens
aggcctgcagggc

SEQ ID NO: 5362891 - DNA, 17 bp, Homo sapiens
aggcctgcagggcctct

SEQ ID NO: 5362892 - DNA, 20 bp, Homo sapiens
aggcctgcagggcctctgtc

SEQ ID NO: 5362893 - DNA, 17 bp, Homo sapiens
aggcctgcaggggcaag

SEQ ID NO: 5362894 - DNA, 18 bp, Homo sapiens
aggcctgccaatgccaca

SEQ ID NO: 5362895 - DNA, 20 bp, Homo sapiens
aggcctgccaatgccacagc

SEQ ID NO: 5362896 - DNA, 21 bp, Homo sapiens
aggcctgccaatgccacagcc

SEQ ID NO: 5362897 - DNA, 13 bp, Homo sapiens
aggcctgccagcc

SEQ ID NO: 5362898 - DNA, 15 bp, Homo sapiens
aggcctgcccccctt

SEQ ID NO: 5362899 - DNA, 17 bp, Homo sapiens
aggcctgccccccttcc

SEQ ID NO: 5362900 - DNA, 18 bp, Homo sapiens
aggcctgccccctgggct

SEQ ID NO: 5362901 - DNA, 19 bp, Homo sapiens
aggcctgccccctgggctg

SEQ ID NO: 5362902 - DNA, 17 bp, Homo sapiens
aggcctgcctccagggc

SEQ ID NO: 5362903 - DNA, 20 bp, Homo sapiens
aggcctgcctccagggctgg

SEQ ID NO: 5362904 - DNA, 21 bp, Homo sapiens
aggcctgcctccagggctgga

SEQ ID NO: 5362905 - DNA, 18 bp, Homo sapiens
aggcctgcctcccacttc

SEQ ID NO: 5362906 - DNA, 16 bp, Homo sapiens
aggcctgccttctcag

SEQ ID NO: 5362907 - DNA, 19 bp, Homo sapiens
aggcctgccttctcaggga

SEQ ID NO: 5362908 - DNA, 18 bp, Homo sapiens
aggcctgcgaccctgggg

SEQ ID NO: 5362909 - DNA, 19 bp, Homo sapiens
aggcctgcgaccctggggg

SEQ ID NO: 5362910 - DNA, 16 bp, Homo sapiens
aggcctgcgtgtgtct

SEQ ID NO: 5362911 - DNA, 21 bp, Homo sapiens
aggcctgcgtgtgtctgtgtt

SEQ ID NO: 5362912 - DNA, 15 bp, Homo sapiens
aggcctgctcaggga

SEQ ID NO: 5362913 - DNA, 14 bp, Homo sapiens
aggcctgctccctg

SEQ ID NO: 5362914 - DNA, 20 bp, Homo sapiens
aggcctgctgccagtgcagc

SEQ ID NO: 5362915 - DNA, 21 bp, Homo sapiens
aggcctgctggcatcaggtct

SEQ ID NO: 5362916 - DNA, 23 bp, Homo sapiens
aggcctgctggcatcaggtctgg

SEQ ID NO: 5362917 - DNA, 20 bp, Homo sapiens
aggcctgcttgactttccag

SEQ ID NO: 5362918 - DNA, 22 bp, Homo sapiens
aggcctgcttgactttccagaa

SEQ ID NO: 5362919 - DNA, 17 bp, Homo sapiens
aggcctgcttttgtgtc

SEQ ID NO: 5362920 - DNA, 21 bp, Homo sapiens
aggcctgcttttgtgtcccat

SEQ ID NO: 5362921 - DNA, 23 bp, Homo sapiens
aggcctgcttttgtgtcccattc

SEQ ID NO: 5362922 - DNA, 15 bp, Homo sapiens
aggcctggaaccagg

SEQ ID NO: 5362923 - DNA, 19 bp, Homo sapiens
aggcctggaaccagggagg

SEQ ID NO: 5362924 - DNA, 20 bp, Homo sapiens
aggcctggaaccagggagga

SEQ ID NO: 5362925 - DNA, 22 bp, Homo sapiens
aggcctggaaccagggaggaga

SEQ ID NO: 5362926 - DNA, 21 bp, Homo sapiens
aggcctggaagagctgagacc

SEQ ID NO: 5362927 - DNA, 14 bp, Homo sapiens
aggcctggacagct

SEQ ID NO: 5362928 - DNA, 16 bp, Homo sapiens
aggcctggaccgagat

SEQ ID NO: 5362929 - DNA, 14 bp, Homo sapiens
aggcctggcacagt

SEQ ID NO: 5362930 - DNA, 16 bp, Homo sapiens
aggcctggcacagtgt

SEQ ID NO: 5362931 - DNA, 21 bp, Homo sapiens
aggcctggcatcttctggaga

SEQ ID NO: 5362932 - DNA, 21 bp, Homo sapiens
aggcctggcatggcacctgtc

SEQ ID NO: 5362933 - DNA, 11 bp, Homo sapiens
aggcctggcca

SEQ ID NO: 5362934 - DNA, 14 bp, Homo sapiens
aggcctggccaatg

SEQ ID NO: 5362935 - DNA, 15 bp, Homo sapiens
aggcctggccagatg

SEQ ID NO: 5362936 - DNA, 17 bp, Homo sapiens
aggcctggccagatgca

SEQ ID NO: 5362937 - DNA, 21 bp, Homo sapiens
aggcctggccagatgcaccag

SEQ ID NO: 5362938 - DNA, 13 bp, Homo sapiens
aggcctggccagg

SEQ ID NO: 5362939 - DNA, 16 bp, Homo sapiens
aggcctggccaggcac

SEQ ID NO: 5362940 - DNA, 13 bp, Homo sapiens
aggcctggcccag

SEQ ID NO: 5362941 - DNA, 17 bp, Homo sapiens
aggcctggcccagccag

SEQ ID NO: 5362942 - DNA, 11 bp, Homo sapiens
aggcctggcct

SEQ ID NO: 5362943 - DNA, 15 bp, Homo sapiens
aggcctggcctcaac

SEQ ID NO: 5362944 - DNA, 16 bp, Homo sapiens
aggcctggcctcatct

SEQ ID NO: 5362945 - DNA, 21 bp, Homo sapiens
aggcctggcctcatctcagac

SEQ ID NO: 5362946 - DNA, 17 bp, Homo sapiens
aggcctggcctcggggc

SEQ ID NO: 5362947 - DNA, 13 bp, Homo sapiens
aggcctggcctct

SEQ ID NO: 5362948 - DNA, 14 bp, Homo sapiens
aggcctggcctctg

SEQ ID NO: 5362949 - DNA, 12 bp, Homo sapiens
aggcctggctca

SEQ ID NO: 5362950 - DNA, 12 bp, Homo sapiens
aggcctggctcc

SEQ ID NO: 5362951 - DNA, 19 bp, Homo sapiens
aggcctggctctggagccc

SEQ ID NO: 5362952 - DNA, 16 bp, Homo sapiens
aggcctgggagatgca

SEQ ID NO: 5362953 - DNA, 19 bp, Homo sapiens
aggcctgggagatgcagct

SEQ ID NO: 5362954 - DNA, 12 bp, Homo sapiens
aggcctgggagg

SEQ ID NO: 5362955 - DNA, 13 bp, Homo sapiens
aggcctgggaggg

SEQ ID NO: 5362956 - DNA, 14 bp, Homo sapiens
aggcctgggagggc

SEQ ID NO: 5362957 - DNA, 16 bp, Homo sapiens
aggcctgggagggcaa

SEQ ID NO: 5362958 - DNA, 17 bp, Homo sapiens
aggcctgggcaggaccc

SEQ ID NO: 5362959 - DNA, 15 bp, Homo sapiens
aggcctgggcagtgg

SEQ ID NO: 5362960 - DNA, 20 bp, Homo sapiens
aggcctgggctggttggaga

SEQ ID NO: 5362961 - DNA, 21 bp, Homo sapiens
aggcctgggggtgggggaggg

SEQ ID NO: 5362962 - DNA, 11 bp, Homo sapiens
aggcctggggt

SEQ ID NO: 5362963 - DNA, 18 bp, Homo sapiens
aggcctggggtgacccgg

SEQ ID NO: 5362964 - DNA, 20 bp, Homo sapiens
aggcctggggtgacccggca

SEQ ID NO: 5362965 - DNA, 16 bp, Homo sapiens
aggcctgggtctgtgt

SEQ ID NO: 5362966 - DNA, 19 bp, Homo sapiens
aggcctgggtctgtgtctc

SEQ ID NO: 5362967 - DNA, 21 bp, Homo sapiens
aggcctgggtctgtgtctctt

SEQ ID NO: 5362968 - DNA, 21 bp, Homo sapiens
aggcctgggtgatctgctgct

SEQ ID NO: 5362969 - DNA, 12 bp, Homo sapiens
aggcctgggtgc

SEQ ID NO: 5362970 - DNA, 13 bp, Homo sapiens
aggcctgggtgtg

SEQ ID NO: 5362971 - DNA, 14 bp, Homo sapiens
aggcctggtcagca

SEQ ID NO: 5362972 - DNA, 24 bp, Homo sapiens
aggcctggtctggagcccctatcc

SEQ ID NO: 5362973 - DNA, 16 bp, Homo sapiens
aggcctggtgccctgg

SEQ ID NO: 5362974 - DNA, 19 bp, Homo sapiens
aggcctggtgccctggccc

SEQ ID NO: 5362975 - DNA, 12 bp, Homo sapiens
aggcctgtccca

SEQ ID NO: 5362976 - DNA, 22 bp, Homo sapiens
aggcctgtcccaattctgcccg

SEQ ID NO: 5362977 - DNA, 16 bp, Homo sapiens
aggcctgtccctggcc

SEQ ID NO: 5362978 - DNA, 22 bp, Homo sapiens
aggcctgtccctggccatctct

SEQ ID NO: 5362979 - DNA, 16 bp, Homo sapiens
aggcctgtccctggga

SEQ ID NO: 5362980 - DNA, 20 bp, Homo sapiens
aggcctgtcccttgcctctg

SEQ ID NO: 5362981 - DNA, 21 bp, Homo sapiens
aggcctgtcctctacatacca

SEQ ID NO: 5362982 - DNA, 13 bp, Homo sapiens
aggcctgtctgtg

SEQ ID NO: 5362983 - DNA, 14 bp, Homo sapiens
aggcctgtctgtga

SEQ ID NO: 5362984 - DNA, 22 bp, Homo sapiens
aggcctgtctgtgacctgcatc

SEQ ID NO: 5362985 - DNA, 14 bp, Homo sapiens
aggcctgtgcccac

SEQ ID NO: 5362986 - DNA, 15 bp, Homo sapiens
aggcctgtgcccact

SEQ ID NO: 5362987 - DNA, 16 bp, Homo sapiens
aggcctgtgcccactc

SEQ ID NO: 5362988 - DNA, 21 bp, Homo sapiens
aggcctgtgcccactccctat

SEQ ID NO: 5362989 - DNA, 23 bp, Homo sapiens
aggcctgtgctgcatgcgacagc

SEQ ID NO: 5362990 - DNA, 20 bp, Homo sapiens
aggcctgtgtagctgtgacc

SEQ ID NO: 5362991 - DNA, 23 bp, Homo sapiens
aggcctgtgtagctgtgacctgc

SEQ ID NO: 5362992 - DNA, 22 bp, Homo sapiens
aggcctgtgtgtaagctgactg

SEQ ID NO: 5362993 - DNA, 15 bp, Homo sapiens
aggcctgttccctga

SEQ ID NO: 5362994 - DNA, 21 bp, Homo sapiens
aggcctgttccctgaggacct

SEQ ID NO: 5362995 - DNA, 22 bp, Homo sapiens
aggcctgttccctgaggacctg

SEQ ID NO: 5362996 - DNA, 22 bp, Homo sapiens
aggcctgttcccttgtggcttg

SEQ ID NO: 5362997 - DNA, 20 bp, Homo sapiens
aggcctgttgctatagagcc

SEQ ID NO: 5362998 - DNA, 14 bp, Homo sapiens
aggccttaacaaac

SEQ ID NO: 5362999 - DNA, 17 bp, Homo sapiens
aggccttaacacactgg

SEQ ID NO: 5363000 - DNA, 19 bp, Homo sapiens
aggccttaacacactggcc

SEQ ID NO: 5363001 - DNA, 21 bp, Homo sapiens
aggccttaacacactggccat

SEQ ID NO: 5363002 - DNA, 21 bp, Homo sapiens
aggccttaactatttcacatg

SEQ ID NO: 5363003 - DNA, 16 bp, Homo sapiens
aggccttagccatgat

SEQ ID NO: 5363004 - DNA, 19 bp, Homo sapiens
aggccttagccatgatctg

SEQ ID NO: 5363005 - DNA, 19 bp, Homo sapiens
aggccttagtacggctgct

SEQ ID NO: 5363006 - DNA, 22 bp, Homo sapiens
aggccttagtacggctgctgca

SEQ ID NO: 5363007 - DNA, 19 bp, Homo sapiens
aggccttatctccaagacc

SEQ ID NO: 5363008 - DNA, 16 bp, Homo sapiens
aggccttatctgaaag

SEQ ID NO: 5363009 - DNA, 18 bp, Homo sapiens
aggccttatctgaaaggc

SEQ ID NO: 5363010 - DNA, 18 bp, Homo sapiens
aggccttatgagggtcct

SEQ ID NO: 5363011 - DNA, 15 bp, Homo sapiens
aggccttcagaaaag

SEQ ID NO: 5363012 - DNA, 20 bp, Homo sapiens
aggccttcagtttatttcca

SEQ ID NO: 5363013 - DNA, 17 bp, Homo sapiens
aggccttcatcctcctc

SEQ ID NO: 5363014 - DNA, 17 bp, Homo sapiens
aggctaaaaacatttta

SEQ ID NO: 5363015 - DNA, 13 bp, Homo sapiens
aggctaaaatgtt

SEQ ID NO: 5363016 - DNA, 14 bp, Homo sapiens
aggctaaaatgttt

SEQ ID NO: 5363017 - DNA, 17 bp, Homo sapiens
aggctaaactggtgcat

SEQ ID NO: 5363018 - DNA, 20 bp, Homo sapiens
aggctaaagaagacacacag

SEQ ID NO: 5363019 - DNA, 15 bp, Homo sapiens
aggctaaataaagtc

SEQ ID NO: 5363020 - DNA, 14 bp, Homo sapiens
aggctaaatgtaaa

SEQ ID NO: 5363021 - DNA, 12 bp, Homo sapiens
aggctaaatgtt

SEQ ID NO: 5363022 - DNA, 21 bp, Homo sapiens
aggctaacttacagaaatgaa

SEQ ID NO: 5363023 - DNA, 13 bp, Homo sapiens
aggctaagaaaaa

SEQ ID NO: 5363024 - DNA, 16 bp, Homo sapiens
aggctaagaatagtgg

SEQ ID NO: 5363025 - DNA, 14 bp, Homo sapiens
aggctaagaccctg

SEQ ID NO: 5363026 - DNA, 23 bp, Homo sapiens
aggctaagatgagatttgccagc

SEQ ID NO: 5363027 - DNA, 19 bp, Homo sapiens
aggctaagcatggcctgga

SEQ ID NO: 5363028 - DNA, 14 bp, Homo sapiens
aggctaagcctgga

SEQ ID NO: 5363029 - DNA, 17 bp, Homo sapiens
aggctaagcctggacac

SEQ ID NO: 5363030 - DNA, 19 bp, Homo sapiens
aggctaaggcaggaaaatt

SEQ ID NO: 5363031 - DNA, 18 bp, Homo sapiens
aggctaaggcgtggagct

SEQ ID NO: 5363032 - DNA, 20 bp, Homo sapiens
aggctaaggcgtggagctgc

SEQ ID NO: 5363033 - DNA, 21 bp, Homo sapiens
aggctaagttcagttctgttt

SEQ ID NO: 5363034 - DNA, 17 bp, Homo sapiens
aggctaagttgggatct

SEQ ID NO: 5363035 - DNA, 18 bp, Homo sapiens
aggctaatcaataccctt

SEQ ID NO: 5363036 - DNA, 21 bp, Homo sapiens
aggctaatcaatacccttggc

SEQ ID NO: 5363037 - DNA, 17 bp, Homo sapiens
aggctaattagaggatg

SEQ ID NO: 5363038 - DNA, 20 bp, Homo sapiens
aggctaattagaggatgtgg

SEQ ID NO: 5363039 - DNA, 17 bp, Homo sapiens
aggctaattcagtgtca

SEQ ID NO: 5363040 - DNA, 12 bp, Homo sapiens
aggctaattttt

SEQ ID NO: 5363041 - DNA, 21 bp, Homo sapiens
aggctacaacaaaaatcacca

SEQ ID NO: 5363042 - DNA, 19 bp, Homo sapiens
aggctacaattttctccca

SEQ ID NO: 5363043 - DNA, 23 bp, Homo sapiens
aggctacaattttctcccaggaa

SEQ ID NO: 5363044 - DNA, 19 bp, Homo sapiens
aggctacactgacactggt

SEQ ID NO: 5363045 - DNA, 14 bp, Homo sapiens
aggctacagaacta

SEQ ID NO: 5363046 - DNA, 12 bp, Homo sapiens
aggctacagaga

SEQ ID NO: 5363047 - DNA, 15 bp, Homo sapiens
aggctacagagaagc

SEQ ID NO: 5363048 - DNA, 20 bp, Homo sapiens
aggctacagagaagccttca

SEQ ID NO: 5363049 - DNA, 12 bp, Homo sapiens
aggctacagggc

SEQ ID NO: 5363050 - DNA, 22 bp, Homo sapiens
aggctaccagaagaggggcagc

SEQ ID NO: 5363051 - DNA, 20 bp, Homo sapiens
aggctacccgctgtggccgg

SEQ ID NO: 5363052 - DNA, 17 bp, Homo sapiens
aggctacctcacctggg

SEQ ID NO: 5363053 - DNA, 21 bp, Homo sapiens
aggctacctcacctgggcagg

SEQ ID NO: 5363054 - DNA, 13 bp, Homo sapiens
aggctacctttgt

SEQ ID NO: 5363055 - DNA, 14 bp, Homo sapiens
aggctacctttgta

SEQ ID NO: 5363056 - DNA, 15 bp, Homo sapiens
aggctacctttgtat

SEQ ID NO: 5363057 - DNA, 14 bp, Homo sapiens
aggctactgccact

SEQ ID NO: 5363058 - DNA, 17 bp, Homo sapiens
aggctactgtaatgctg

SEQ ID NO: 5363059 - DNA, 20 bp, Homo sapiens
aggctactgtaatgctgcct

SEQ ID NO: 5363060 - DNA, 24 bp, Homo sapiens
aggctactgtaatgctgcctcagg

SEQ ID NO: 5363061 - DNA, 13 bp, Homo sapiens
aggctacttttca

SEQ ID NO: 5363062 - DNA, 21 bp, Homo sapiens
aggctagaaccacctgcctat

SEQ ID NO: 5363063 - DNA, 19 bp, Homo sapiens
aggctagaatggaaaactg

SEQ ID NO: 5363064 - DNA, 21 bp, Homo sapiens
aggctagaatggaaaactgcc

SEQ ID NO: 5363065 - DNA, 13 bp, Homo sapiens
aggctagacagaa

SEQ ID NO: 5363066 - DNA, 20 bp, Homo sapiens
aggctagagacagatgctgg

SEQ ID NO: 5363067 - DNA, 22 bp, Homo sapiens
aggctagagacagatgctggtg

SEQ ID NO: 5363068 - DNA, 13 bp, Homo sapiens
aggctagaggcat

SEQ ID NO: 5363069 - DNA, 16 bp, Homo sapiens
aggctagatgtatgta

SEQ ID NO: 5363070 - DNA, 13 bp, Homo sapiens
aggctagccccag

SEQ ID NO: 5363071 - DNA, 18 bp, Homo sapiens
aggctagctggagcctgg

SEQ ID NO: 5363072 - DNA, 15 bp, Homo sapiens
aggctaggccagcag

SEQ ID NO: 5363073 - DNA, 14 bp, Homo sapiens
aggctagtctcttc

SEQ ID NO: 5363074 - DNA, 21 bp, Homo sapiens
aggctagtcttgaatttctga

SEQ ID NO: 5363075 - DNA, 20 bp, Homo sapiens
aggctatcaacatgttattc

SEQ ID NO: 5363076 - DNA, 13 bp, Homo sapiens
aggctatcctgct

SEQ ID NO: 5363077 - DNA, 19 bp, Homo sapiens
aggctatcctgctgaaagt

SEQ ID NO: 5363078 - DNA, 19 bp, Homo sapiens
aggctatgaggaaactgag

SEQ ID NO: 5363079 - DNA, 16 bp, Homo sapiens
aggctatgccatgtgc

SEQ ID NO: 5363080 - DNA, 22 bp, Homo sapiens
aggctatggggatagatgtgtg

SEQ ID NO: 5363081 - DNA, 20 bp, Homo sapiens
aggctatggttgccacccca

SEQ ID NO: 5363082 - DNA, 19 bp, Homo sapiens
aggctatgtataaaataca

SEQ ID NO: 5363083 - DNA, 22 bp, Homo sapiens
aggctattataatatagaaaga

SEQ ID NO: 5363084 - DNA, 15 bp, Homo sapiens
aggctattcctgaga

SEQ ID NO: 5363085 - DNA, 22 bp, Homo sapiens
aggctattcctgagagctgcat

SEQ ID NO: 5363086 - DNA, 21 bp, Homo sapiens
aggctatttgtaaatctgcca

SEQ ID NO: 5363087 - DNA, 22 bp, Homo sapiens
aggctatttgtaaatctgccac

SEQ ID NO: 5363088 - DNA, 14 bp, Homo sapiens
aggctatttgttca

SEQ ID NO: 5363089 - DNA, 18 bp, Homo sapiens
aggctatttgttcagaga

SEQ ID NO: 5363090 - DNA, 17 bp, Homo sapiens
aggctattttctaaaga

SEQ ID NO: 5363091 - DNA, 18 bp, Homo sapiens
aggctattttctaaagac

SEQ ID NO: 5363092 - DNA, 23 bp, Homo sapiens
aggctcaaaaacttgatcacatg

SEQ ID NO: 5363093 - DNA, 15 bp, Homo sapiens
aggctcaaacaatga

SEQ ID NO: 5363094 - DNA, 17 bp, Homo sapiens
aggctcaacaataaaac

SEQ ID NO: 5363095 - DNA, 16 bp, Homo sapiens
aggctcaactagggag

SEQ ID NO: 5363096 - DNA, 13 bp, Homo sapiens
aggctcaagaggc

SEQ ID NO: 5363097 - DNA, 21 bp, Homo sapiens
aggctcaagaggcccagggag

SEQ ID NO: 5363098 - DNA, 16 bp, Homo sapiens
aggctcaagtttttat

SEQ ID NO: 5363099 - DNA, 16 bp, Homo sapiens
aggctcacccccttct

SEQ ID NO: 5363100 - DNA, 23 bp, Homo sapiens
aggctcacctttagaacaggaga

SEQ ID NO: 5363101 - DNA, 19 bp, Homo sapiens
aggctcactgccaggccag

SEQ ID NO: 5363102 - DNA, 20 bp, Homo sapiens
aggctcactgccaggccagc

SEQ ID NO: 5363103 - DNA, 21 bp, Homo sapiens
aggctcactgccaggccagcc

SEQ ID NO: 5363104 - DNA, 14 bp, Homo sapiens
aggctcactggtca

SEQ ID NO: 5363105 - DNA, 17 bp, Homo sapiens
aggctcagagactgcaa

SEQ ID NO: 5363106 - DNA, 13 bp, Homo sapiens
aggctcagagagg

SEQ ID NO: 5363107 - DNA, 13 bp, Homo sapiens
aggctcagagatg

SEQ ID NO: 5363108 - DNA, 24 bp, Homo sapiens
aggctcagagatgtgcacccatgg

SEQ ID NO: 5363109 - DNA, 13 bp, Homo sapiens
aggctcagcatgc

SEQ ID NO: 5363110 - DNA, 18 bp, Homo sapiens
aggctcagcatgcagaag

SEQ ID NO: 5363111 - DNA, 18 bp, Homo sapiens
aggctcagcccaccctcc

SEQ ID NO: 5363112 - DNA, 13 bp, Homo sapiens
aggctcagccttg

SEQ ID NO: 5363113 - DNA, 16 bp, Homo sapiens
aggctcaggagaagcc

SEQ ID NO: 5363114 - DNA, 19 bp, Homo sapiens
aggctcaggcacatacacc

SEQ ID NO: 5363115 - DNA, 15 bp, Homo sapiens
aggctcaggctgccc

SEQ ID NO: 5363116 - DNA, 16 bp, Homo sapiens
aggctcaggtccctgg

SEQ ID NO: 5363117 - DNA, 18 bp, Homo sapiens
aggctcagtggtgggaga

SEQ ID NO: 5363118 - DNA, 15 bp, Homo sapiens
aggctcatctaactc

SEQ ID NO: 5363119 - DNA, 20 bp, Homo sapiens
aggctcatggccctgtagtt

SEQ ID NO: 5363120 - DNA, 16 bp, Homo sapiens
aggctcatttaaaaca

SEQ ID NO: 5363121 - DNA, 19 bp, Homo sapiens
aggctcatttacttgaaat

SEQ ID NO: 5363122 - DNA, 12 bp, Homo sapiens
aggctcatttta

SEQ ID NO: 5363123 - DNA, 19 bp, Homo sapiens
aggctccaatggggcgggg

SEQ ID NO: 5363124 - DNA, 22 bp, Homo sapiens
aggctccaccccatccagttca

SEQ ID NO: 5363125 - DNA, 11 bp, Homo sapiens
aggctccactt

SEQ ID NO: 5363126 - DNA, 21 bp, Homo sapiens
aggctccacttggtctgtgag

SEQ ID NO: 5363127 - DNA, 13 bp, Homo sapiens
aggctccagacag

SEQ ID NO: 5363128 - DNA, 19 bp, Homo sapiens
aggctccagacaggaggag

SEQ ID NO: 5363129 - DNA, 14 bp, Homo sapiens
aggctccagcacat

SEQ ID NO: 5363130 - DNA, 18 bp, Homo sapiens
aggctccagctctggcac

SEQ ID NO: 5363131 - DNA, 20 bp, Homo sapiens
aggctccagctctggcacag

SEQ ID NO: 5363132 - DNA, 14 bp, Homo sapiens
aggctccaggactc

SEQ ID NO: 5363133 - DNA, 18 bp, Homo sapiens
aggctccaggactccact

SEQ ID NO: 5363134 - DNA, 14 bp, Homo sapiens
aggctccaggagca

SEQ ID NO: 5363135 - DNA, 14 bp, Homo sapiens
aggctccaggcagc

SEQ ID NO: 5363136 - DNA, 18 bp, Homo sapiens
aggctccatccttctccc

SEQ ID NO: 5363137 - DNA, 13 bp, Homo sapiens
aggctccatgcac

SEQ ID NO: 5363138 - DNA, 15 bp, Homo sapiens
aggctccatggggaa

SEQ ID NO: 5363139 - DNA, 16 bp, Homo sapiens
aggctccatggggaag

SEQ ID NO: 5363140 - DNA, 17 bp, Homo sapiens
aggctcccaaactcagg

SEQ ID NO: 5363141 - DNA, 17 bp, Homo sapiens
aggctcccactgcccct

SEQ ID NO: 5363142 - DNA, 18 bp, Homo sapiens
aggctcccactgcccctg

SEQ ID NO: 5363143 - DNA, 19 bp, Homo sapiens
aggctcccagacccagggc

SEQ ID NO: 5363144 - DNA, 21 bp, Homo sapiens
aggctcccatgtgagtccctg

SEQ ID NO: 5363145 - DNA, 16 bp, Homo sapiens
aggctccccagaactg

SEQ ID NO: 5363146 - DNA, 22 bp, Homo sapiens
aggctccccagaactggctggg

SEQ ID NO: 5363147 - DNA, 14 bp, Homo sapiens
aggctccccagggc

SEQ ID NO: 5363148 - DNA, 16 bp, Homo sapiens
aggctccccagggctc

SEQ ID NO: 5363149 - DNA, 17 bp, Homo sapiens
aggctccccagggctcc

SEQ ID NO: 5363150 - DNA, 13 bp, Homo sapiens
aggctccccgcct

SEQ ID NO: 5363151 - DNA, 15 bp, Homo sapiens
aggctccccgcctcc

SEQ ID NO: 5363152 - DNA, 18 bp, Homo sapiens
aggctccccgcctccact

SEQ ID NO: 5363153 - DNA, 14 bp, Homo sapiens
aggctcccctgagg

SEQ ID NO: 5363154 - DNA, 21 bp, Homo sapiens
aggctcccggggcctggacag

SEQ ID NO: 5363155 - DNA, 19 bp, Homo sapiens
aggctccctccctcccaga

SEQ ID NO: 5363156 - DNA, 23 bp, Homo sapiens
aggctccctccctcccagatcca

SEQ ID NO: 5363157 - DNA, 20 bp, Homo sapiens
aggctccctccctccctgct

SEQ ID NO: 5363158 - DNA, 13 bp, Homo sapiens
aggctccctcgcc

SEQ ID NO: 5363159 - DNA, 16 bp, Homo sapiens
aggctccctcgccctg

SEQ ID NO: 5363160 - DNA, 13 bp, Homo sapiens
aggctccctgagg

SEQ ID NO: 5363161 - DNA, 14 bp, Homo sapiens
aggctccctgaggt

SEQ ID NO: 5363162 - DNA, 13 bp, Homo sapiens
aggctccgccctt

SEQ ID NO: 5363163 - DNA, 15 bp, Homo sapiens
aggctccgcccttag

SEQ ID NO: 5363164 - DNA, 22 bp, Homo sapiens
aggctccgggcaccaggggcca

SEQ ID NO: 5363165 - DNA, 19 bp, Homo sapiens
aggctccgtgagcccttgg

SEQ ID NO: 5363166 - DNA, 15 bp, Homo sapiens
aggctcctcagccct

SEQ ID NO: 5363167 - DNA, 19 bp, Homo sapiens
aggctcctcagccctctct

SEQ ID NO: 5363168 - DNA, 13 bp, Homo sapiens
aggctcctccctc

SEQ ID NO: 5363169 - DNA, 20 bp, Homo sapiens
aggctcctccctctgcctca

SEQ ID NO: 5363170 - DNA, 14 bp, Homo sapiens
aggctcctccttgc

SEQ ID NO: 5363171 - DNA, 21 bp, Homo sapiens
aggctcctccttgcccagact

SEQ ID NO: 5363172 - DNA, 13 bp, Homo sapiens
aggctcctgagac

SEQ ID NO: 5363173 - DNA, 14 bp, Homo sapiens
aggctcctgagaca

SEQ ID NO: 5363174 - DNA, 14 bp, Homo sapiens
aggctcctgccacc

SEQ ID NO: 5363175 - DNA, 20 bp, Homo sapiens
aggctcctggctgtgcccag

SEQ ID NO: 5363176 - DNA, 14 bp, Homo sapiens
aggctcctgggagg

SEQ ID NO: 5363177 - DNA, 15 bp, Homo sapiens
aggctcctgggaggc

SEQ ID NO: 5363178 - DNA, 17 bp, Homo sapiens
aggctcctgggaggccc

SEQ ID NO: 5363179 - DNA, 21 bp, Homo sapiens
aggctcctgggaggccctggc

SEQ ID NO: 5363180 - DNA, 16 bp, Homo sapiens
aggctcctggtggggc

SEQ ID NO: 5363181 - DNA, 19 bp, Homo sapiens
aggctcctgtgctactttg

SEQ ID NO: 5363182 - DNA, 19 bp, Homo sapiens
aggctcctgtggtagtcct

SEQ ID NO: 5363183 - DNA, 22 bp, Homo sapiens
aggctcctgtggtagtcctccc

SEQ ID NO: 5363184 - DNA, 23 bp, Homo sapiens
aggctcctgtggtagtcctccca

SEQ ID NO: 5363185 - DNA, 22 bp, Homo sapiens
aggctccttagtttattgtggt

SEQ ID NO: 5363186 - DNA, 13 bp, Homo sapiens
aggctccttcctg

SEQ ID NO: 5363187 - DNA, 15 bp, Homo sapiens
aggctcgagcatgcc

SEQ ID NO: 5363188 - DNA, 21 bp, Homo sapiens
aggctcgagcatgcctggatg

SEQ ID NO: 5363189 - DNA, 13 bp, Homo sapiens
aggctcgagctcg

SEQ ID NO: 5363190 - DNA, 14 bp, Homo sapiens
aggctcgagctcgg

SEQ ID NO: 5363191 - DNA, 21 bp, Homo sapiens
aggctcgagctcggggctggg

SEQ ID NO: 5363192 - DNA, 20 bp, Homo sapiens
aggctgggtcctgccagctg

SEQ ID NO: 5363193 - DNA, 20 bp, Homo sapiens
aggctgggtcgccctggact

SEQ ID NO: 5363194 - DNA, 21 bp, Homo sapiens
aggctgggtcgccctggactg

SEQ ID NO: 5363195 - DNA, 23 bp, Homo sapiens
aggctgggtgaccgactacccca

SEQ ID NO: 5363196 - DNA, 18 bp, Homo sapiens
aggctgggtgcccacagc

SEQ ID NO: 5363197 - DNA, 16 bp, Homo sapiens
aggctgggtggccggc

SEQ ID NO: 5363198 - DNA, 23 bp, Homo sapiens
aggctgggtggccggccctgccc

SEQ ID NO: 5363199 - DNA, 14 bp, Homo sapiens
aggctgggttctga

SEQ ID NO: 5363200 - DNA, 17 bp, Homo sapiens
aggctggtctaaaactc

SEQ ID NO: 5363201 - DNA, 23 bp, Homo sapiens
aggctggtctcaaactcctgacc

SEQ ID NO: 5363202 - DNA, 18 bp, Homo sapiens
aggctggtctccctccag

SEQ ID NO: 5363203 - DNA, 21 bp, Homo sapiens
aggctggtctcgaactcctga

SEQ ID NO: 5363204 - DNA, 22 bp, Homo sapiens
aggctggtcttgaactgggctc

SEQ ID NO: 5363205 - DNA, 17 bp, Homo sapiens
aggctggtgccaggcgc

SEQ ID NO: 5363206 - DNA, 20 bp, Homo sapiens
aggctggtgctgtggccagg

SEQ ID NO: 5363207 - DNA, 23 bp, Homo sapiens
aggctggtgctgtggccagggtg

SEQ ID NO: 5363208 - DNA, 14 bp, Homo sapiens
aggctggtggccca

SEQ ID NO: 5363209 - DNA, 16 bp, Homo sapiens
aggctggtggccttgg

SEQ ID NO: 5363210 - DNA, 14 bp, Homo sapiens
aggctggtgggagg

SEQ ID NO: 5363211 - DNA, 21 bp, Homo sapiens
aggctggtgggctggccgctg

SEQ ID NO: 5363212 - DNA, 22 bp, Homo sapiens
aggctggttcggatttggggtg

SEQ ID NO: 5363213 - DNA, 20 bp, Homo sapiens
aggctggttttgatggctgg

SEQ ID NO: 5363214 - DNA, 18 bp, Homo sapiens
aggctgtaaattgaactt

SEQ ID NO: 5363215 - DNA, 12 bp, Homo sapiens
aggctgtaacta

SEQ ID NO: 5363216 - DNA, 15 bp, Homo sapiens
aggctgtaactactt

SEQ ID NO: 5363217 - DNA, 18 bp, Homo sapiens
aggctgtagaaaggggag

SEQ ID NO: 5363218 - DNA, 20 bp, Homo sapiens
aggctgtatcccatgagcct

SEQ ID NO: 5363219 - DNA, 16 bp, Homo sapiens
aggctgtattcagcaa

SEQ ID NO: 5363220 - DNA, 12 bp, Homo sapiens
aggctgtcaatt

SEQ ID NO: 5363221 - DNA, 19 bp, Homo sapiens
aggctgtcaattacaggaa

SEQ ID NO: 5363222 - DNA, 20 bp, Homo sapiens
aggctgtcaattacaggaag

SEQ ID NO: 5363223 - DNA, 12 bp, Homo sapiens
aggctgtcccaa

SEQ ID NO: 5363224 - DNA, 15 bp, Homo sapiens
aggctgtcccaagct

SEQ ID NO: 5363225 - DNA, 15 bp, Homo sapiens
aggctgtcctgtaca

SEQ ID NO: 5363226 - DNA, 21 bp, Homo sapiens
aggctgtcctgtacattgtgg

SEQ ID NO: 5363227 - DNA, 21 bp, Homo sapiens
aggctgtccttacccatctgc

SEQ ID NO: 5363228 - DNA, 22 bp, Homo sapiens
aggctgtctcagataaattatg

SEQ ID NO: 5363229 - DNA, 17 bp, Homo sapiens
aggctgtctggccaggc

SEQ ID NO: 5363230 - DNA, 12 bp, Homo sapiens
aggctgtctggg

SEQ ID NO: 5363231 - DNA, 14 bp, Homo sapiens
aggctgtctgtgcc

SEQ ID NO: 5363232 - DNA, 22 bp, Homo sapiens
aggctgtctgtgccatggcccc

SEQ ID NO: 5363233 - DNA, 17 bp, Homo sapiens
aggctgtcttctcccag

SEQ ID NO: 5363234 - DNA, 21 bp, Homo sapiens
aggctgtcttctcccagagca

SEQ ID NO: 5363235 - DNA, 13 bp, Homo sapiens
aggctgtgacctt

SEQ ID NO: 5363236 - DNA, 18 bp, Homo sapiens
aggctgtgactcttctct

SEQ ID NO: 5363237 - DNA, 22 bp, Homo sapiens
aggctgtgactcttctctcaac

SEQ ID NO: 5363238 - DNA, 18 bp, Homo sapiens
aggctgtgcagcgcagct

SEQ ID NO: 5363239 - DNA, 13 bp, Homo sapiens
aggctgtgccagg

SEQ ID NO: 5363240 - DNA, 14 bp, Homo sapiens
aggctgtgccaggc

SEQ ID NO: 5363241 - DNA, 17 bp, Homo sapiens
aggctgtgccaggctgg

SEQ ID NO: 5363242 - DNA, 20 bp, Homo sapiens
aggctgtgccaggctgggag

SEQ ID NO: 5363243 - DNA, 20 bp, Homo sapiens
aggctgtgctccctggttct

SEQ ID NO: 5363244 - DNA, 24 bp, Homo sapiens
aggctgtgctccctggttctgatg

SEQ ID NO: 5363245 - DNA, 14 bp, Homo sapiens
aggctgtgctccgc

SEQ ID NO: 5363246 - DNA, 16 bp, Homo sapiens
aggctgtgctcttcct

SEQ ID NO: 5363247 - DNA, 15 bp, Homo sapiens
aggctgtgcttacct

SEQ ID NO: 5363248 - DNA, 21 bp, Homo sapiens
aggctgtggagtagagtttgt

SEQ ID NO: 5363249 - DNA, 15 bp, Homo sapiens
aggctgtgggcctca

SEQ ID NO: 5363250 - DNA, 12 bp, Homo sapiens
aggctgtggggt

SEQ ID NO: 5363251 - DNA, 13 bp, Homo sapiens
aggctgtggggtg

SEQ ID NO: 5363252 - DNA, 14 bp, Homo sapiens
aggctgtggggtgg

SEQ ID NO: 5363253 - DNA, 20 bp, Homo sapiens
aggctgtggggtgggctgga

SEQ ID NO: 5363254 - DNA, 16 bp, Homo sapiens
aggctgtggtcagaga

SEQ ID NO: 5363255 - DNA, 19 bp, Homo sapiens
aggctgtggtgagggaaga

SEQ ID NO: 5363256 - DNA, 20 bp, Homo sapiens
aggctgtggtggctgtctct

SEQ ID NO: 5363257 - DNA, 21 bp, Homo sapiens
aggctgtggtggctgtctctg

SEQ ID NO: 5363258 - DNA, 17 bp, Homo sapiens
aggctgtgtaagatttg

SEQ ID NO: 5363259 - DNA, 19 bp, Homo sapiens
aggctgtgtaagatttgtt

SEQ ID NO: 5363260 - DNA, 22 bp, Homo sapiens
aggctgtgtccctcttctcttc

SEQ ID NO: 5363261 - DNA, 15 bp, Homo sapiens
aggctgtgtccctgc

SEQ ID NO: 5363262 - DNA, 16 bp, Homo sapiens
aggctgtgtccctgct

SEQ ID NO: 5363263 - DNA, 17 bp, Homo sapiens
aggctgtgtctctgcca

SEQ ID NO: 5363264 - DNA, 13 bp, Homo sapiens
aggctgtgtggcc

SEQ ID NO: 5363265 - DNA, 15 bp, Homo sapiens
aggctgtgtggccaa

SEQ ID NO: 5363266 - DNA, 18 bp, Homo sapiens
aggctgtgtggccaacca

SEQ ID NO: 5363267 - DNA, 20 bp, Homo sapiens
aggctgtgtggccaaccagg

SEQ ID NO: 5363268 - DNA, 16 bp, Homo sapiens
aggctgtgtgtcttct

SEQ ID NO: 5363269 - DNA, 20 bp, Homo sapiens
aggctgtgtgtcttctgccc

SEQ ID NO: 5363270 - DNA, 20 bp, Homo sapiens
aggctgtgtttagattgtat

SEQ ID NO: 5363271 - DNA, 19 bp, Homo sapiens
aggctgttattatgaagga

SEQ ID NO: 5363272 - DNA, 20 bp, Homo sapiens
aggctgttcccatgtagccc

SEQ ID NO: 5363273 - DNA, 14 bp, Homo sapiens
aggctgttcccttt

SEQ ID NO: 5363274 - DNA, 15 bp, Homo sapiens
aggctgttccctttg

SEQ ID NO: 5363275 - DNA, 19 bp, Homo sapiens
aggctgttccctttgcctt

SEQ ID NO: 5363276 - DNA, 13 bp, Homo sapiens
aggctgttctcag

SEQ ID NO: 5363277 - DNA, 14 bp, Homo sapiens
aggctgttctcagc

SEQ ID NO: 5363278 - DNA, 17 bp, Homo sapiens
aggctgttctccaggct

SEQ ID NO: 5363279 - DNA, 23 bp, Homo sapiens
aggctgttctcgaactcctgacc

SEQ ID NO: 5363280 - DNA, 20 bp, Homo sapiens
aggctgttctgcactgaaaa

SEQ ID NO: 5363281 - DNA, 20 bp, Homo sapiens
aggctgttggcgtgtcccag

SEQ ID NO: 5363282 - DNA, 15 bp, Homo sapiens
aggctgtttcttttt

SEQ ID NO: 5363283 - DNA, 14 bp, Homo sapiens
aggctgtttgcttc

SEQ ID NO: 5363284 - DNA, 17 bp, Homo sapiens
aggcttaagaactgctt

SEQ ID NO: 5363285 - DNA, 23 bp, Homo sapiens
aggcttaagaactgcttcatgtg

SEQ ID NO: 5363286 - DNA, 14 bp, Homo sapiens
aggcttaagagaga

SEQ ID NO: 5363287 - DNA, 19 bp, Homo sapiens
aggcttaattgactgaaat

SEQ ID NO: 5363288 - DNA, 21 bp, Homo sapiens
aggcttaattgactgaaatta

SEQ ID NO: 5363289 - DNA, 14 bp, Homo sapiens
aggcttacacccac

SEQ ID NO: 5363290 - DNA, 12 bp, Homo sapiens
aggcttagaccc

SEQ ID NO: 5363291 - DNA, 14 bp, Homo sapiens
aggcttagaccctc

SEQ ID NO: 5363292 - DNA, 21 bp, Homo sapiens
aggcttagaccctcatgctgc

SEQ ID NO: 5363293 - DNA, 22 bp, Homo sapiens
aggcttagaccctcatgctgcc

SEQ ID NO: 5363294 - DNA, 15 bp, Homo sapiens
aggcttaggcctctc

SEQ ID NO: 5363295 - DNA, 15 bp, Homo sapiens
aggcttaggtgccag

SEQ ID NO: 5363296 - DNA, 16 bp, Homo sapiens
aggcttaggtgccagg

SEQ ID NO: 5363297 - DNA, 17 bp, Homo sapiens
aggcttaggtgccaggc

SEQ ID NO: 5363298 - DNA, 17 bp, Homo sapiens
aggcttagtcactgaga

SEQ ID NO: 5363299 - DNA, 15 bp, Homo sapiens
aggcttagtttgtgt

SEQ ID NO: 5363300 - DNA, 14 bp, Homo sapiens
aggcttataaaaca

SEQ ID NO: 5363301 - DNA, 14 bp, Homo sapiens
aggcttatatttgt

SEQ ID NO: 5363302 - DNA, 20 bp, Homo sapiens
aggcttatttttaaaataaa

SEQ ID NO: 5363303 - DNA, 22 bp, Homo sapiens
aggcttcaatttattgcacaaa

SEQ ID NO: 5363304 - DNA, 17 bp, Homo sapiens
aggcttcaggttgcatt

SEQ ID NO: 5363305 - DNA, 19 bp, Homo sapiens
aggcttcaggttgcattgg

SEQ ID NO: 5363306 - DNA, 14 bp, Homo sapiens
aggcttccagagag

SEQ ID NO: 5363307 - DNA, 24 bp, Homo sapiens
aggcttccagaggagagtggcctg

SEQ ID NO: 5363308 - DNA, 14 bp, Homo sapiens
aggcttccagctca

SEQ ID NO: 5363309 - DNA, 17 bp, Homo sapiens
aggcttccagctcagtc

SEQ ID NO: 5363310 - DNA, 13 bp, Homo sapiens
aggcttccaggct

SEQ ID NO: 5363311 - DNA, 14 bp, Homo sapiens
aggcttccaggctc

SEQ ID NO: 5363312 - DNA, 18 bp, Homo sapiens
aggcttccaggctcttcc

SEQ ID NO: 5363313 - DNA, 19 bp, Homo sapiens
aggcttccaggctgagagc

SEQ ID NO: 5363314 - DNA, 19 bp, Homo sapiens
aggcttccatccccgtcca

SEQ ID NO: 5363315 - DNA, 13 bp, Homo sapiens
aggcttccccctt

SEQ ID NO: 5363316 - DNA, 21 bp, Homo sapiens
aggcttccctacacagggcct

SEQ ID NO: 5363317 - DNA, 21 bp, Homo sapiens
aggcttccctgacttgcttta

SEQ ID NO: 5363318 - DNA, 18 bp, Homo sapiens
aggcttcctgactgacac

SEQ ID NO: 5363319 - DNA, 20 bp, Homo sapiens
aggcttcctgactgacacag

SEQ ID NO: 5363320 - DNA, 22 bp, Homo sapiens
aggcttcctgactgacacaggc

SEQ ID NO: 5363321 - DNA, 23 bp, Homo sapiens
aggcttcctgactgacacaggcc

SEQ ID NO: 5363322 - DNA, 14 bp, Homo sapiens
aggcttcctgggtc

SEQ ID NO: 5363323 - DNA, 16 bp, Homo sapiens
aggcttcctgggtcct

SEQ ID NO: 5363324 - DNA, 18 bp, Homo sapiens
aggcttcggagtttctta

SEQ ID NO: 5363325 - DNA, 16 bp, Homo sapiens
aggcttcgtctcagaa

SEQ ID NO: 5363326 - DNA, 19 bp, Homo sapiens
aggcttcgtctcagaaggc

SEQ ID NO: 5363327 - DNA, 18 bp, Homo sapiens
aggcttctacctgcaggc

SEQ ID NO: 5363328 - DNA, 12 bp, Homo sapiens
aggcttctcacc

SEQ ID NO: 5363329 - DNA, 16 bp, Homo sapiens
aggcttctcacggcga

SEQ ID NO: 5363330 - DNA, 12 bp, Homo sapiens
aggcttctccac

SEQ ID NO: 5363331 - DNA, 14 bp, Homo sapiens
aggcttctccgcca

SEQ ID NO: 5363332 - DNA, 17 bp, Homo sapiens
aggcttctccgccagcc

SEQ ID NO: 5363333 - DNA, 19 bp, Homo sapiens
aggcttctccgccagcctc

SEQ ID NO: 5363334 - DNA, 21 bp, Homo sapiens
aggcttctccgccagcctcct

SEQ ID NO: 5363335 - DNA, 12 bp, Homo sapiens
aggcttctcctg

SEQ ID NO: 5363336 - DNA, 12 bp, Homo sapiens
aggcttctctcc

SEQ ID NO: 5363337 - DNA, 16 bp, Homo sapiens
aggcttctctctcacc

SEQ ID NO: 5363338 - DNA, 14 bp, Homo sapiens
aggcttctgcagtt

SEQ ID NO: 5363339 - DNA, 18 bp, Homo sapiens
aggcttctgctggggcct

SEQ ID NO: 5363340 - DNA, 16 bp, Homo sapiens
aggcttcttcagatca

SEQ ID NO: 5363341 - DNA, 22 bp, Homo sapiens
aggcttcttcagatcagtgctt

SEQ ID NO: 5363342 - DNA, 14 bp, Homo sapiens
aggcttcttgccca

SEQ ID NO: 5363343 - DNA, 16 bp, Homo sapiens
aggcttcttgcccaga

SEQ ID NO: 5363344 - DNA, 13 bp, Homo sapiens
aggcttgaagctg

SEQ ID NO: 5363345 - DNA, 15 bp, Homo sapiens
aggcttgagggaggg

SEQ ID NO: 5363346 - DNA, 16 bp, Homo sapiens
aggcttgagggagggc

SEQ ID NO: 5363347 - DNA, 17 bp, Homo sapiens
aggcttgagttttcatt

SEQ ID NO: 5363348 - DNA, 20 bp, Homo sapiens
aggcttgagttttcatttca

SEQ ID NO: 5363349 - DNA, 20 bp, Homo sapiens
aggcttgcattaaaagactg

SEQ ID NO: 5363350 - DNA, 13 bp, Homo sapiens
aggcttgcccagg

SEQ ID NO: 5363351 - DNA, 14 bp, Homo sapiens
aggcttgcccagga

SEQ ID NO: 5363352 - DNA, 16 bp, Homo sapiens
aggcttgcccaggagc

SEQ ID NO: 5363353 - DNA, 17 bp, Homo sapiens
aggcttgcccaggagca

SEQ ID NO: 5363354 - DNA, 13 bp, Homo sapiens
aggcttgcctcaa

SEQ ID NO: 5363355 - DNA, 17 bp, Homo sapiens
aggcttgcctgcaggca

SEQ ID NO: 5363356 - DNA, 15 bp, Homo sapiens
aggcttgcctgggct

SEQ ID NO: 5363357 - DNA, 19 bp, Homo sapiens
aggcttgctgagaggggct

SEQ ID NO: 5363358 - DNA, 20 bp, Homo sapiens
aggcttgctgagaggggctg

SEQ ID NO: 5363359 - DNA, 15 bp, Homo sapiens
aggcttgctgcagat

SEQ ID NO: 5363360 - DNA, 15 bp, Homo sapiens
aggcttgctgtatga

SEQ ID NO: 5363361 - DNA, 23 bp, Homo sapiens
aggcttgctgtatgacccctggc

SEQ ID NO: 5363362 - DNA, 17 bp, Homo sapiens
aggcttggaatgaattc

SEQ ID NO: 5363363 - DNA, 16 bp, Homo sapiens
aggcttggcggaggga

SEQ ID NO: 5363364 - DNA, 15 bp, Homo sapiens
aggcttgggcccagt

SEQ ID NO: 5363365 - DNA, 18 bp, Homo sapiens
aggcttgggcccagtagc

SEQ ID NO: 5363366 - DNA, 19 bp, Homo sapiens
aggcttgggcccagtagcc

SEQ ID NO: 5363367 - DNA, 22 bp, Homo sapiens
aggcttgggcccagtagcccca

SEQ ID NO: 5363368 - DNA, 16 bp, Homo sapiens
aggcttggggaaaatg

SEQ ID NO: 5363369 - DNA, 22 bp, Homo sapiens
aggcttggggaaaatggccatg

SEQ ID NO: 5363370 - DNA, 16 bp, Homo sapiens
agggactctgggctgt

SEQ ID NO: 5363371 - DNA, 18 bp, Homo sapiens
agggactctgggctgtgc

SEQ ID NO: 5363372 - DNA, 17 bp, Homo sapiens
agggactctgtctggcc

SEQ ID NO: 5363373 - DNA, 20 bp, Homo sapiens
agggactctgtctggccagg

SEQ ID NO: 5363374 - DNA, 14 bp, Homo sapiens
agggactgaagcca

SEQ ID NO: 5363375 - DNA, 20 bp, Homo sapiens
agggactgaggcaagcacaa

SEQ ID NO: 5363376 - DNA, 15 bp, Homo sapiens
agggactgcctctgc

SEQ ID NO: 5363377 - DNA, 16 bp, Homo sapiens
agggactgcctctgcc

SEQ ID NO: 5363378 - DNA, 15 bp, Homo sapiens
agggactgctgaccc

SEQ ID NO: 5363379 - DNA, 16 bp, Homo sapiens
agggactgctgaccca

SEQ ID NO: 5363380 - DNA, 18 bp, Homo sapiens
agggactgctgacccacc

SEQ ID NO: 5363381 - DNA, 16 bp, Homo sapiens
agggactggacagcca

SEQ ID NO: 5363382 - DNA, 19 bp, Homo sapiens
agggactggacagccaggg

SEQ ID NO: 5363383 - DNA, 14 bp, Homo sapiens
agggactggtccag

SEQ ID NO: 5363384 - DNA, 16 bp, Homo sapiens
agggactggtccaggc

SEQ ID NO: 5363385 - DNA, 20 bp, Homo sapiens
agggactggtccaggcatgg

SEQ ID NO: 5363386 - DNA, 18 bp, Homo sapiens
agggactgtatttctgtg

SEQ ID NO: 5363387 - DNA, 19 bp, Homo sapiens
agggactgtatttctgtgg

SEQ ID NO: 5363388 - DNA, 17 bp, Homo sapiens
agggactgtcagctgag

SEQ ID NO: 5363389 - DNA, 16 bp, Homo sapiens
agggactgtcctagcc

SEQ ID NO: 5363390 - DNA, 23 bp, Homo sapiens
agggactgtcctagccaggtctc

SEQ ID NO: 5363391 - DNA, 22 bp, Homo sapiens
agggactgtcgctgcttcgtgg

SEQ ID NO: 5363392 - DNA, 13 bp, Homo sapiens
agggacttagcaa

SEQ ID NO: 5363393 - DNA, 22 bp, Homo sapiens
agggacttcaggatcaagtcct

SEQ ID NO: 5363394 - DNA, 22 bp, Homo sapiens
agggacttctgcggggcctgag

SEQ ID NO: 5363395 - DNA, 23 bp, Homo sapiens
agggacttctgtcttcacaacag

SEQ ID NO: 5363396 - DNA, 14 bp, Homo sapiens
agggacttgaagtt

SEQ ID NO: 5363397 - DNA, 14 bp, Homo sapiens
agggacttgcctcc

SEQ ID NO: 5363398 - DNA, 17 bp, Homo sapiens
agggacttggacaggag

SEQ ID NO: 5363399 - DNA, 18 bp, Homo sapiens
agggacttggacaggagt

SEQ ID NO: 5363400 - DNA, 20 bp, Homo sapiens
agggacttggacaggagtca

SEQ ID NO: 5363401 - DNA, 17 bp, Homo sapiens
agggacttggctgtcct

SEQ ID NO: 5363402 - DNA, 18 bp, Homo sapiens
agggacttggctgtcctt

SEQ ID NO: 5363403 - DNA, 18 bp, Homo sapiens
agggactttgcctgccca

SEQ ID NO: 5363404 - DNA, 23 bp, Homo sapiens
agggactttggaattctgcttct

SEQ ID NO: 5363405 - DNA, 18 bp, Homo sapiens
agggactttgggctgtga

SEQ ID NO: 5363406 - DNA, 19 bp, Homo sapiens
agggacttttgtaaaatca

SEQ ID NO: 5363407 - DNA, 17 bp, Homo sapiens
agggagaaaatccaggt

SEQ ID NO: 5363408 - DNA, 20 bp, Homo sapiens
agggagaaactccaaagtcc

SEQ ID NO: 5363409 - DNA, 19 bp, Homo sapiens
agggagaacatgaatttgc

SEQ ID NO: 5363410 - DNA, 9 bp, Homo sapiens
agggagaag

SEQ ID NO: 5363411 - DNA, 16 bp, Homo sapiens
agggagaagaaatcca

SEQ ID NO: 5363412 - DNA, 15 bp, Homo sapiens
agggagaagacactg

SEQ ID NO: 5363413 - DNA, 21 bp, Homo sapiens
agggagaagactatattgtac

SEQ ID NO: 5363414 - DNA, 13 bp, Homo sapiens
agggagaagagaa

SEQ ID NO: 5363415 - DNA, 18 bp, Homo sapiens
agggagaagggagaacag

SEQ ID NO: 5363416 - DNA, 19 bp, Homo sapiens
agggagaataaaattccta

SEQ ID NO: 5363417 - DNA, 12 bp, Homo sapiens
agggagaatata

SEQ ID NO: 5363418 - DNA, 13 bp, Homo sapiens
agggagaatgcag

SEQ ID NO: 5363419 - DNA, 20 bp, Homo sapiens
agggagacaccagtggtgcg

SEQ ID NO: 5363420 - DNA, 15 bp, Homo sapiens
agggagacagaccac

SEQ ID NO: 5363421 - DNA, 12 bp, Homo sapiens
agggagacagag

SEQ ID NO: 5363422 - DNA, 19 bp, Homo sapiens
agggagacagagatgtgca

SEQ ID NO: 5363423 - DNA, 22 bp, Homo sapiens
agggagacagccaggtggcacc

SEQ ID NO: 5363424 - DNA, 14 bp, Homo sapiens
agggagacaggaac

SEQ ID NO: 5363425 - DNA, 15 bp, Homo sapiens
agggagacaggcctt

SEQ ID NO: 5363426 - DNA, 20 bp, Homo sapiens
agggagacagggctgctccc

SEQ ID NO: 5363427 - DNA, 22 bp, Homo sapiens
agggagacattgtttggatttc

SEQ ID NO: 5363428 - DNA, 16 bp, Homo sapiens
agggagacctggacac

SEQ ID NO: 5363429 - DNA, 22 bp, Homo sapiens
agggagacctggacacaggcct

SEQ ID NO: 5363430 - DNA, 21 bp, Homo sapiens
agggagacgccgggctagagc

SEQ ID NO: 5363431 - DNA, 20 bp, Homo sapiens
agggagacggtttccaggga

SEQ ID NO: 5363432 - DNA, 16 bp, Homo sapiens
agggagactcagcctt

SEQ ID NO: 5363433 - DNA, 16 bp, Homo sapiens
agggagactcctgggc

SEQ ID NO: 5363434 - DNA, 22 bp, Homo sapiens
agggagactgaccatcatgccc

SEQ ID NO: 5363435 - DNA, 20 bp, Homo sapiens
agggagacttgttctagaga

SEQ ID NO: 5363436 - DNA, 13 bp, Homo sapiens
agggagagactct

SEQ ID NO: 5363437 - DNA, 15 bp, Homo sapiens
agggagagagaagca

SEQ ID NO: 5363438 - DNA, 19 bp, Homo sapiens
agggagagagaagcaggca

SEQ ID NO: 5363439 - DNA, 13 bp, Homo sapiens
agggagagagaga

SEQ ID NO: 5363440 - DNA, 19 bp, Homo sapiens
agggagagagtagctgcag

SEQ ID NO: 5363441 - DNA, 14 bp, Homo sapiens
agggagagatgagt

SEQ ID NO: 5363442 - DNA, 15 bp, Homo sapiens
agggagagccagctc

SEQ ID NO: 5363443 - DNA, 14 bp, Homo sapiens
agggagagcccagg

SEQ ID NO: 5363444 - DNA, 12 bp, Homo sapiens
agggagagccct

SEQ ID NO: 5363445 - DNA, 14 bp, Homo sapiens
agggagagcggggc

SEQ ID NO: 5363446 - DNA, 19 bp, Homo sapiens
agggagagctcaccatgga

SEQ ID NO: 5363447 - DNA, 15 bp, Homo sapiens
agggagagctgggca

SEQ ID NO: 5363448 - DNA, 17 bp, Homo sapiens
agggagagctgggcaga

SEQ ID NO: 5363449 - DNA, 19 bp, Homo sapiens
agggagagctgggcagaca

SEQ ID NO: 5363450 - DNA, 12 bp, Homo sapiens
agggagaggaag

SEQ ID NO: 5363451 - DNA, 16 bp, Homo sapiens
agggagaggaagagaa

SEQ ID NO: 5363452 - DNA, 13 bp, Homo sapiens
agggagaggaagc

SEQ ID NO: 5363453 - DNA, 14 bp, Homo sapiens
agggagaggaagca

SEQ ID NO: 5363454 - DNA, 17 bp, Homo sapiens
agggagaggagtgactg

SEQ ID NO: 5363455 - DNA, 12 bp, Homo sapiens
agggagaggccg

SEQ ID NO: 5363456 - DNA, 13 bp, Homo sapiens
agggagaggcctc

SEQ ID NO: 5363457 - DNA, 20 bp, Homo sapiens
agggagaggctgtgtccctg

SEQ ID NO: 5363458 - DNA, 16 bp, Homo sapiens
agggagagggaagagg

SEQ ID NO: 5363459 - DNA, 20 bp, Homo sapiens
agggagaggtcaccagctgc

SEQ ID NO: 5363460 - DNA, 21 bp, Homo sapiens
agggagaggtcaccagctgct

SEQ ID NO: 5363461 - DNA, 16 bp, Homo sapiens
agggagaggtggagca

SEQ ID NO: 5363462 - DNA, 17 bp, Homo sapiens
agggagaggtggcagga

SEQ ID NO: 5363463 - DNA, 20 bp, Homo sapiens
agggagagtctcccagggag

SEQ ID NO: 5363464 - DNA, 22 bp, Homo sapiens
agggagataaaagaaccccaga

SEQ ID NO: 5363465 - DNA, 23 bp, Homo sapiens
agggagataaaagaaccccagac

SEQ ID NO: 5363466 - DNA, 22 bp, Homo sapiens
agggagatatttaagtataaaa

SEQ ID NO: 5363467 - DNA, 20 bp, Homo sapiens
agggagatgatccagagaca

SEQ ID NO: 5363468 - DNA, 17 bp, Homo sapiens
agggagatggagaaaat

SEQ ID NO: 5363469 - DNA, 23 bp, Homo sapiens
agggagatgtatttctaaatgtt

SEQ ID NO: 5363470 - DNA, 14 bp, Homo sapiens
agggagatgtgtga

SEQ ID NO: 5363471 - DNA, 22 bp, Homo sapiens
agggagcaacggcccatagcct

SEQ ID NO: 5363472 - DNA, 16 bp, Homo sapiens
agggagcaactctcca

SEQ ID NO: 5363473 - DNA, 18 bp, Homo sapiens
agggagcaagacagagac

SEQ ID NO: 5363474 - DNA, 16 bp, Homo sapiens
agggagcaagaggtgt

SEQ ID NO: 5363475 - DNA, 13 bp, Homo sapiens
agggagcaagccc

SEQ ID NO: 5363476 - DNA, 14 bp, Homo sapiens
agggagcaagccct

SEQ ID NO: 5363477 - DNA, 21 bp, Homo sapiens
agggagcaagtccttcccttt

SEQ ID NO: 5363478 - DNA, 17 bp, Homo sapiens
agggagcaatgggaggg

SEQ ID NO: 5363479 - DNA, 23 bp, Homo sapiens
agggagcagacttttaaagactt

SEQ ID NO: 5363480 - DNA, 20 bp, Homo sapiens
agggagcagagaaggccagg

SEQ ID NO: 5363481 - DNA, 16 bp, Homo sapiens
agggagcagatgactg

SEQ ID NO: 5363482 - DNA, 22 bp, Homo sapiens
agggagcaggccggaaccacag

SEQ ID NO: 5363483 - DNA, 20 bp, Homo sapiens
agggagcaggtgcccccagg

SEQ ID NO: 5363484 - DNA, 14 bp, Homo sapiens
agggagcagtggct

SEQ ID NO: 5363485 - DNA, 19 bp, Homo sapiens
agggagcatagaaggcagg

SEQ ID NO: 5363486 - DNA, 13 bp, Homo sapiens
agggagcatcccc

SEQ ID NO: 5363487 - DNA, 20 bp, Homo sapiens
agggagcatgagaggaggca

SEQ ID NO: 5363488 - DNA, 17 bp, Homo sapiens
agggagcattttcctcc

SEQ ID NO: 5363489 - DNA, 12 bp, Homo sapiens
agggagccaagg

SEQ ID NO: 5363490 - DNA, 14 bp, Homo sapiens
agggagccaaggga

SEQ ID NO: 5363491 - DNA, 17 bp, Homo sapiens
agggagccaagggatgg

SEQ ID NO: 5363492 - DNA, 15 bp, Homo sapiens
agggagcccctagga

SEQ ID NO: 5363493 - DNA, 17 bp, Homo sapiens
agggagcccctttgatg

SEQ ID NO: 5363494 - DNA, 17 bp, Homo sapiens
agggagccctgagcctg

SEQ ID NO: 5363495 - DNA, 15 bp, Homo sapiens
agggagccctgggcc

SEQ ID NO: 5363496 - DNA, 16 bp, Homo sapiens
agggagccctgggcca

SEQ ID NO: 5363497 - DNA, 21 bp, Homo sapiens
agggagccctgggccagggcg

SEQ ID NO: 5363498 - DNA, 22 bp, Homo sapiens
agggagcctccccatctgtcca

SEQ ID NO: 5363499 - DNA, 14 bp, Homo sapiens
agggagcctcccct

SEQ ID NO: 5363500 - DNA, 15 bp, Homo sapiens
agggagcctcctgcc

SEQ ID NO: 5363501 - DNA, 22 bp, Homo sapiens
agggagcctcctgcccagtccc

SEQ ID NO: 5363502 - DNA, 17 bp, Homo sapiens
agggagccttctgccac

SEQ ID NO: 5363503 - DNA, 18 bp, Homo sapiens
agggagcggaaagcagct

SEQ ID NO: 5363504 - DNA, 14 bp, Homo sapiens
agggagcggcatgg

SEQ ID NO: 5363505 - DNA, 16 bp, Homo sapiens
agggagctagccagag

SEQ ID NO: 5363506 - DNA, 17 bp, Homo sapiens
agggagctagccagagg

SEQ ID NO: 5363507 - DNA, 23 bp, Homo sapiens
agggagctagccagaggactgtg

SEQ ID NO: 5363508 - DNA, 22 bp, Homo sapiens
agggagctccaactcagaaggg

SEQ ID NO: 5363509 - DNA, 14 bp, Homo sapiens
agggagctctgggg

SEQ ID NO: 5363510 - DNA, 18 bp, Homo sapiens
agggagctgaggcctccc

SEQ ID NO: 5363511 - DNA, 19 bp, Homo sapiens
agggagctgaggcctccct

SEQ ID NO: 5363512 - DNA, 20 bp, Homo sapiens
agggagctgaggcctccctt

SEQ ID NO: 5363513 - DNA, 15 bp, Homo sapiens
agggagctgcagggg

SEQ ID NO: 5363514 - DNA, 12 bp, Homo sapiens
agggagctgctc

SEQ ID NO: 5363515 - DNA, 16 bp, Homo sapiens
agggagctggaacccg

SEQ ID NO: 5363516 - DNA, 15 bp, Homo sapiens
agggagctggctcca

SEQ ID NO: 5363517 - DNA, 14 bp, Homo sapiens
agggagctgggccc

SEQ ID NO: 5363518 - DNA, 15 bp, Homo sapiens
agggagctgggcccg

SEQ ID NO: 5363519 - DNA, 15 bp, Homo sapiens
agggagctgtattcc

SEQ ID NO: 5363520 - DNA, 16 bp, Homo sapiens
agggagcttcctggct

SEQ ID NO: 5363521 - DNA, 17 bp, Homo sapiens
agggagcttcctggctc

SEQ ID NO: 5363522 - DNA, 19 bp, Homo sapiens
agggaggaaagtttctttg

SEQ ID NO: 5363523 - DNA, 15 bp, Homo sapiens
agggaggaacacctg

SEQ ID NO: 5363524 - DNA, 15 bp, Homo sapiens
agggaggaagaagct

SEQ ID NO: 5363525 - DNA, 19 bp, Homo sapiens
agggaggaagaaggcagtg

SEQ ID NO: 5363526 - DNA, 13 bp, Homo sapiens
agggaggaagata

SEQ ID NO: 5363527 - DNA, 19 bp, Homo sapiens
agggaggaagatggctccc

SEQ ID NO: 5363528 - DNA, 18 bp, Homo sapiens
agggaggaaggaggccac

SEQ ID NO: 5363529 - DNA, 14 bp, Homo sapiens
agggaggaaggcct

SEQ ID NO: 5363530 - DNA, 15 bp, Homo sapiens
agggaggaaggcctt

SEQ ID NO: 5363531 - DNA, 21 bp, Homo sapiens
agggaggacgctctctggcct

SEQ ID NO: 5363532 - DNA, 23 bp, Homo sapiens
agggaggacgctctctggccttc

SEQ ID NO: 5363533 - DNA, 19 bp, Homo sapiens
agggaggacgggagctggg

SEQ ID NO: 5363534 - DNA, 14 bp, Homo sapiens
agggaggagcagca

SEQ ID NO: 5363535 - DNA, 19 bp, Homo sapiens
agggaggaggccacctctc

SEQ ID NO: 5363536 - DNA, 23 bp, Homo sapiens
agggaggaggccacctctccaag

SEQ ID NO: 5363537 - DNA, 12 bp, Homo sapiens
agggaggagggc

SEQ ID NO: 5363538 - DNA, 14 bp, Homo sapiens
agggaggagggccg

SEQ ID NO: 5363539 - DNA, 16 bp, Homo sapiens
agggaggatgccacag

SEQ ID NO: 5363540 - DNA, 18 bp, Homo sapiens
agggaggcaacactgctg

SEQ ID NO: 5363541 - DNA, 22 bp, Homo sapiens
agggaggcaacactgctgtcca

SEQ ID NO: 5363542 - DNA, 14 bp, Homo sapiens
agggaggcaagccc

SEQ ID NO: 5363543 - DNA, 21 bp, Homo sapiens
agggaggcacaaactctgcac

SEQ ID NO: 5363544 - DNA, 15 bp, Homo sapiens
agggaggcagagcgg

SEQ ID NO: 5363545 - DNA, 13 bp, Homo sapiens
agggaggcagcct

SEQ ID NO: 5363546 - DNA, 17 bp, Homo sapiens
agggaggcagcctccag

SEQ ID NO: 5363547 - DNA, 12 bp, Homo sapiens
agggaggcagcg

SEQ ID NO: 5363548 - DNA, 17 bp, Homo sapiens
agggaggcagcgtgggc

SEQ ID NO: 5363549 - DNA, 21 bp, Homo sapiens
agggaggcagcgtgggctctg

SEQ ID NO: 5363550 - DNA, 13 bp, Homo sapiens
agggaggcagtgg

SEQ ID NO: 5363551 - DNA, 22 bp, Homo sapiens
agggaggccacacgcactggtg

SEQ ID NO: 5363552 - DNA, 15 bp, Homo sapiens
agggaggccccaggg

SEQ ID NO: 5363553 - DNA, 16 bp, Homo sapiens
agggaggccgaagcta

SEQ ID NO: 5363554 - DNA, 13 bp, Homo sapiens
agggaggccgggc

SEQ ID NO: 5363555 - DNA, 16 bp, Homo sapiens
agggaggccgggcggt

SEQ ID NO: 5363556 - DNA, 14 bp, Homo sapiens
agggaggcctgagg

SEQ ID NO: 5363557 - DNA, 23 bp, Homo sapiens
agggaggcctttagcttaagagg

SEQ ID NO: 5363558 - DNA, 18 bp, Homo sapiens
agggaggcgggggctgcc

SEQ ID NO: 5363559 - DNA, 23 bp, Homo sapiens
agggaggctcccggggcctggac

SEQ ID NO: 5363560 - DNA, 21 bp, Homo sapiens
agggaggctctgtgtgttaaa

SEQ ID NO: 5363561 - DNA, 18 bp, Homo sapiens
agggaggctgaggcagga

SEQ ID NO: 5363562 - DNA, 15 bp, Homo sapiens
agggaggctgctgct

SEQ ID NO: 5363563 - DNA, 15 bp, Homo sapiens
agggaggctgggcgg

SEQ ID NO: 5363564 - DNA, 17 bp, Homo sapiens
agggagggaaacccggg

SEQ ID NO: 5363565 - DNA, 19 bp, Homo sapiens
agggagggaaatctttcaa

SEQ ID NO: 5363566 - DNA, 22 bp, Homo sapiens
agggagggaacagacctcggct

SEQ ID NO: 5363567 - DNA, 13 bp, Homo sapiens
agggagggaaggg

SEQ ID NO: 5363568 - DNA, 14 bp, Homo sapiens
agggagggaagggc

SEQ ID NO: 5363569 - DNA, 23 bp, Homo sapiens
agggagggaaggggatggaggcc

SEQ ID NO: 5363570 - DNA, 16 bp, Homo sapiens
agggagggaagtgtga

SEQ ID NO: 5363571 - DNA, 18 bp, Homo sapiens
agggagggacatggcccc

SEQ ID NO: 5363572 - DNA, 13 bp, Homo sapiens
agggagggagagg

SEQ ID NO: 5363573 - DNA, 16 bp, Homo sapiens
agggagggagcaagcc

SEQ ID NO: 5363574 - DNA, 17 bp, Homo sapiens
agggagggagcaagccc

SEQ ID NO: 5363575 - DNA, 13 bp, Homo sapiens
agggagggagctg

SEQ ID NO: 5363576 - DNA, 14 bp, Homo sapiens
agggagggagctga

SEQ ID NO: 5363577 - DNA, 22 bp, Homo sapiens
agggagggatgaccttcccagg

SEQ ID NO: 5363578 - DNA, 17 bp, Homo sapiens
agggagggcagagctgg

SEQ ID NO: 5363579 - DNA, 14 bp, Homo sapiens
agggagggccaggg

SEQ ID NO: 5363580 - DNA, 15 bp, Homo sapiens
agggagggccaggga

SEQ ID NO: 5363581 - DNA, 21 bp, Homo sapiens
agggagggccggcggctctga

SEQ ID NO: 5363582 - DNA, 15 bp, Homo sapiens
agggagggcctgggc

SEQ ID NO: 5363583 - DNA, 12 bp, Homo sapiens
agggagggctcc

SEQ ID NO: 5363584 - DNA, 13 bp, Homo sapiens
agggagggctcca

SEQ ID NO: 5363585 - DNA, 16 bp, Homo sapiens
agggagggctccagac

SEQ ID NO: 5363586 - DNA, 19 bp, Homo sapiens
agggagggctccagacaca

SEQ ID NO: 5363587 - DNA, 22 bp, Homo sapiens
agggagggctccagacacatgt

SEQ ID NO: 5363588 - DNA, 14 bp, Homo sapiens
agggagggctctga

SEQ ID NO: 5363589 - DNA, 15 bp, Homo sapiens
agggagggctctgag

SEQ ID NO: 5363590 - DNA, 17 bp, Homo sapiens
agggagggctctgaggc

SEQ ID NO: 5363591 - DNA, 20 bp, Homo sapiens
agggagggctgttcaagttt

SEQ ID NO: 5363592 - DNA, 13 bp, Homo sapiens
agggaggggaaat

SEQ ID NO: 5363593 - DNA, 18 bp, Homo sapiens
agggaggggaaatgtaat

SEQ ID NO: 5363594 - DNA, 23 bp, Homo sapiens
agggaggggaaatgtaatactgg

SEQ ID NO: 5363595 - DNA, 16 bp, Homo sapiens
agggaggggaaggggc

SEQ ID NO: 5363596 - DNA, 19 bp, Homo sapiens
agggaggggagaaaggaac

SEQ ID NO: 5363597 - DNA, 16 bp, Homo sapiens
agggaggggaggtggc

SEQ ID NO: 5363598 - DNA, 10 bp, Homo sapiens
agggaggggc

SEQ ID NO: 5363599 - DNA, 17 bp, Homo sapiens
agggaggggccctgtca

SEQ ID NO: 5363600 - DNA, 17 bp, Homo sapiens
agggaggggccggccct

SEQ ID NO: 5363601 - DNA, 15 bp, Homo sapiens
agggaggggcctagg

SEQ ID NO: 5363602 - DNA, 11 bp, Homo sapiens
agggaggggct

SEQ ID NO: 5363603 - DNA, 17 bp, Homo sapiens
agggaggggctggggca

SEQ ID NO: 5363604 - DNA, 22 bp, Homo sapiens
agggaggggctggggcaggctc

SEQ ID NO: 5363605 - DNA, 15 bp, Homo sapiens
agggagggggaggtg

SEQ ID NO: 5363606 - DNA, 16 bp, Homo sapiens
agggagggggaggtga

SEQ ID NO: 5363607 - DNA, 14 bp, Homo sapiens
agggaggggtcctg

SEQ ID NO: 5363608 - DNA, 12 bp, Homo sapiens
agggagggtggc

SEQ ID NO: 5363609 - DNA, 14 bp, Homo sapiens
agggagggtggcag

SEQ ID NO: 5363610 - DNA, 16 bp, Homo sapiens
agggagggtggcagag

SEQ ID NO: 5363611 - DNA, 20 bp, Homo sapiens
agggagggtggcagagacag

SEQ ID NO: 5363612 - DNA, 18 bp, Homo sapiens
agggagggtggccagcac

SEQ ID NO: 5363613 - DNA, 19 bp, Homo sapiens
agggagggttagcctgcac

SEQ ID NO: 5363614 - DNA, 19 bp, Homo sapiens
agggagggtttctctccca

SEQ ID NO: 5363615 - DNA, 15 bp, Homo sapiens
agggaggtagtttca

SEQ ID NO: 5363616 - DNA, 16 bp, Homo sapiens
agggaggtggcaggga

SEQ ID NO: 5363617 - DNA, 23 bp, Homo sapiens
agggaggtgggggcctcctcagc

SEQ ID NO: 5363618 - DNA, 23 bp, Homo sapiens
agggaggtgtttaaagagaggtt

SEQ ID NO: 5363619 - DNA, 16 bp, Homo sapiens
agggagtacctgctgc

SEQ ID NO: 5363620 - DNA, 17 bp, Homo sapiens
agggagtacctgctgcc

SEQ ID NO: 5363621 - DNA, 17 bp, Homo sapiens
agggagtcattgccttg

SEQ ID NO: 5363622 - DNA, 22 bp, Homo sapiens
agggagtcccctccccggccct

SEQ ID NO: 5363623 - DNA, 19 bp, Homo sapiens
agggagtccttgcgtccca

SEQ ID NO: 5363624 - DNA, 19 bp, Homo sapiens
agggagtctcaggaggagg

SEQ ID NO: 5363625 - DNA, 13 bp, Homo sapiens
agggagtctgcca

SEQ ID NO: 5363626 - DNA, 15 bp, Homo sapiens
agggagtctgccagg

SEQ ID NO: 5363627 - DNA, 18 bp, Homo sapiens
agggagtgacagaggcag

SEQ ID NO: 5363628 - DNA, 16 bp, Homo sapiens
agggagtgagcagcta

SEQ ID NO: 5363629 - DNA, 16 bp, Homo sapiens
agggagtgagccagca

SEQ ID NO: 5363630 - DNA, 16 bp, Homo sapiens
agggagtgaggggctg

SEQ ID NO: 5363631 - DNA, 21 bp, Homo sapiens
agggagtgcagaacacctggc

SEQ ID NO: 5363632 - DNA, 21 bp, Homo sapiens
agggagtggcacttctgcctt

SEQ ID NO: 5363633 - DNA, 19 bp, Homo sapiens
agggagtggggaggagaga

SEQ ID NO: 5363634 - DNA, 16 bp, Homo sapiens
agggagtgtactccca

SEQ ID NO: 5363635 - DNA, 18 bp, Homo sapiens
agggagtgtactcccagg

SEQ ID NO: 5363636 - DNA, 13 bp, Homo sapiens
agggagtgtgcct

SEQ ID NO: 5363637 - DNA, 20 bp, Homo sapiens
agggagttactgaagtctta

SEQ ID NO: 5363638 - DNA, 21 bp, Homo sapiens
agggagttagcactgaactgc

SEQ ID NO: 5363639 - DNA, 14 bp, Homo sapiens
agggagttcatctg

SEQ ID NO: 5363640 - DNA, 18 bp, Homo sapiens
agggagttgctcactcag

SEQ ID NO: 5363641 - DNA, 22 bp, Homo sapiens
agggagttgctcactcaggact

SEQ ID NO: 5363642 - DNA, 21 bp, Homo sapiens
agggagtttaatacaggaaat

SEQ ID NO: 5363643 - DNA, 20 bp, Homo sapiens
agggagttttgtctgtctcc

SEQ ID NO: 5363644 - DNA, 13 bp, Homo sapiens
agggagtttttga

SEQ ID NO: 5363645 - DNA, 20 bp, Homo sapiens
agggataaccccaggcactg

SEQ ID NO: 5363646 - DNA, 21 bp, Homo sapiens
agggataaccccaggcactgt

SEQ ID NO: 5363647 - DNA, 17 bp, Homo sapiens
agggataaggcagttga

SEQ ID NO: 5363648 - DNA, 10 bp, Homo sapiens
agggataatt

SEQ ID NO: 5363649 - DNA, 14 bp, Homo sapiens
agggatacactgaa

SEQ ID NO: 5363650 - DNA, 22 bp, Homo sapiens
agggatagcactgagcaaagca

SEQ ID NO: 5363651 - DNA, 20 bp, Homo sapiens
agggatagtcaccttttaaa

SEQ ID NO: 5363652 - DNA, 22 bp, Homo sapiens
agggatagtcaccttttaaatc

SEQ ID NO: 5363653 - DNA, 22 bp, Homo sapiens
agggatataaaaacagattctg

SEQ ID NO: 5363654 - DNA, 16 bp, Homo sapiens
agggatataaaatgaa

SEQ ID NO: 5363655 - DNA, 17 bp, Homo sapiens
agggatatggcaggact

SEQ ID NO: 5363656 - DNA, 21 bp, Homo sapiens
agggatcaaccagctaagaaa

SEQ ID NO: 5363657 - DNA, 22 bp, Homo sapiens
agggatcaaccagctaagaaaa

SEQ ID NO: 5363658 - DNA, 13 bp, Homo sapiens
agggatcacaggg

SEQ ID NO: 5363659 - DNA, 21 bp, Homo sapiens
agggatcagccccgcctgtca

SEQ ID NO: 5363660 - DNA, 16 bp, Homo sapiens
agggatccagagacct

SEQ ID NO: 5363661 - DNA, 19 bp, Homo sapiens
agggatccagagacctgct

SEQ ID NO: 5363662 - DNA, 20 bp, Homo sapiens
agggatccagagacctgctc

SEQ ID NO: 5363663 - DNA, 16 bp, Homo sapiens
agggatccccaggagg

SEQ ID NO: 5363664 - DNA, 21 bp, Homo sapiens
agggatccccaggaggcctgg

SEQ ID NO: 5363665 - DNA, 20 bp, Homo sapiens
agggatccctaactgttccc

SEQ ID NO: 5363666 - DNA, 22 bp, Homo sapiens
agggatcctctctccaggcccc

SEQ ID NO: 5363667 - DNA, 23 bp, Homo sapiens
agggatcctctctccaggcccca

SEQ ID NO: 5363668 - DNA, 24 bp, Homo sapiens
agggatcctctctccaggccccag

SEQ ID NO: 5363669 - DNA, 20 bp, Homo sapiens
agggatctcagaggctcaga

SEQ ID NO: 5363670 - DNA, 21 bp, Homo sapiens
agggatctgtttgaacactta

SEQ ID NO: 5363671 - DNA, 20 bp, Homo sapiens
agggatcttgcattcccagt

SEQ ID NO: 5363672 - DNA, 14 bp, Homo sapiens
agggatgaactttt

SEQ ID NO: 5363673 - DNA, 16 bp, Homo sapiens
agggatgaagaaagac

SEQ ID NO: 5363674 - DNA, 17 bp, Homo sapiens
agggatgaagggcgagt

SEQ ID NO: 5363675 - DNA, 18 bp, Homo sapiens
agggatgaagggcgagtg

SEQ ID NO: 5363676 - DNA, 17 bp, Homo sapiens
agggatgaccttcccag

SEQ ID NO: 5363677 - DNA, 18 bp, Homo sapiens
agggatgaccttcccagg

SEQ ID NO: 5363678 - DNA, 18 bp, Homo sapiens
agggatgagagtggctta

SEQ ID NO: 5363679 - DNA, 19 bp, Homo sapiens
agggatgagcatggagctg

SEQ ID NO: 5363680 - DNA, 20 bp, Homo sapiens
agggatgagcatggagctgg

SEQ ID NO: 5363681 - DNA, 23 bp, Homo sapiens
agggatgaggtgctgggagggat

SEQ ID NO: 5363682 - DNA, 17 bp, Homo sapiens
agggatgatgagggaag

SEQ ID NO: 5363683 - DNA, 16 bp, Homo sapiens
agggatgatgccacac

SEQ ID NO: 5363684 - DNA, 18 bp, Homo sapiens
agggatgcaggtgggccg

SEQ ID NO: 5363685 - DNA, 20 bp, Homo sapiens
agggatgcccccaggcagcc

SEQ ID NO: 5363686 - DNA, 13 bp, Homo sapiens
agggatgcccgct

SEQ ID NO: 5363687 - DNA, 19 bp, Homo sapiens
agggatgccctggaggtgg

SEQ ID NO: 5363688 - DNA, 20 bp, Homo sapiens
agggatgccctggaggtggc

SEQ ID NO: 5363689 - DNA, 21 bp, Homo sapiens
agggatgcggatcctgctggg

SEQ ID NO: 5363690 - DNA, 20 bp, Homo sapiens
agggatgcgtgttccagcca

SEQ ID NO: 5363691 - DNA, 20 bp, Homo sapiens
agggatgctaggtgtctggg

SEQ ID NO: 5363692 - DNA, 17 bp, Homo sapiens
agggatgctgcctgagt

SEQ ID NO: 5363693 - DNA, 18 bp, Homo sapiens
agggatgctgcctgagtc

SEQ ID NO: 5363694 - DNA, 13 bp, Homo sapiens
agggatgctgggc

SEQ ID NO: 5363695 - DNA, 15 bp, Homo sapiens
agggatggaaaagga

SEQ ID NO: 5363696 - DNA, 14 bp, Homo sapiens
agggatggaaataa

SEQ ID NO: 5363697 - DNA, 15 bp, Homo sapiens
agggatggacatctt

SEQ ID NO: 5363698 - DNA, 17 bp, Homo sapiens
agggatggacatcttgt

SEQ ID NO: 5363699 - DNA, 13 bp, Homo sapiens
agggatggactga

SEQ ID NO: 5363700 - DNA, 21 bp, Homo sapiens
agggatggacttgtgattggc

SEQ ID NO: 5363701 - DNA, 22 bp, Homo sapiens
agggatggacttgtgattggct

SEQ ID NO: 5363702 - DNA, 13 bp, Homo sapiens
agggatggagaaa

SEQ ID NO: 5363703 - DNA, 14 bp, Homo sapiens
agggatggagaaag

SEQ ID NO: 5363704 - DNA, 17 bp, Homo sapiens
agggatggagaaagaag

SEQ ID NO: 5363705 - DNA, 16 bp, Homo sapiens
agggatggaggaagaa

SEQ ID NO: 5363706 - DNA, 11 bp, Homo sapiens
agggatggcag

SEQ ID NO: 5363707 - DNA, 19 bp, Homo sapiens
agggatggcagtggctgtg

SEQ ID NO: 5363708 - DNA, 15 bp, Homo sapiens
agggatgggcctggc

SEQ ID NO: 5363709 - DNA, 17 bp, Homo sapiens
agggatggggaaaacta

SEQ ID NO: 5363710 - DNA, 15 bp, Homo sapiens
agggatgggggaaga

SEQ ID NO: 5363711 - DNA, 19 bp, Homo sapiens
agggatggtcaggcccagt

SEQ ID NO: 5363712 - DNA, 16 bp, Homo sapiens
agggatggtgttcaaa

SEQ ID NO: 5363713 - DNA, 14 bp, Homo sapiens
agggatgtatttgt

SEQ ID NO: 5363714 - DNA, 20 bp, Homo sapiens
agggatgtctgttgaaataa

SEQ ID NO: 5363715 - DNA, 22 bp, Homo sapiens
agggatgtgaattgcctgcaga

SEQ ID NO: 5363716 - DNA, 23 bp, Homo sapiens
agggatgtgaattgcctgcagag

SEQ ID NO: 5363717 - DNA, 20 bp, Homo sapiens
agggatgtgggaatctccca

SEQ ID NO: 5363718 - DNA, 22 bp, Homo sapiens
agggatgtgggttccacagacg

SEQ ID NO: 5363719 - DNA, 21 bp, Homo sapiens
agggatgttccagtggatgag

SEQ ID NO: 5363720 - DNA, 17 bp, Homo sapiens
agggattacccaagcaa

SEQ ID NO: 5363721 - DNA, 19 bp, Homo sapiens
agggattacccaagcaaaa

SEQ ID NO: 5363722 - DNA, 15 bp, Homo sapiens
agggattagggagag

SEQ ID NO: 5363723 - DNA, 18 bp, Homo sapiens
agggattcacatctgcat

SEQ ID NO: 5363724 - DNA, 15 bp, Homo sapiens
agggattcaggctgc

SEQ ID NO: 5363725 - DNA, 16 bp, Homo sapiens
agggattcaggctgct

SEQ ID NO: 5363726 - DNA, 15 bp, Homo sapiens
agggccctgggcagg

SEQ ID NO: 5363727 - DNA, 15 bp, Homo sapiens
agggccctggggtct

SEQ ID NO: 5363728 - DNA, 23 bp, Homo sapiens
agggccctgtgccaggccaaaga

SEQ ID NO: 5363729 - DNA, 12 bp, Homo sapiens
agggccctgtgg

SEQ ID NO: 5363730 - DNA, 20 bp, Homo sapiens
agggccctgtggagtccagc

SEQ ID NO: 5363731 - DNA, 23 bp, Homo sapiens
agggccctgtggagtccagctct

SEQ ID NO: 5363732 - DNA, 17 bp, Homo sapiens
agggcccttagctctcc

SEQ ID NO: 5363733 - DNA, 14 bp, Homo sapiens
agggcccttcccct

SEQ ID NO: 5363734 - DNA, 18 bp, Homo sapiens
agggcccttcccctcccc

SEQ ID NO: 5363735 - DNA, 23 bp, Homo sapiens
agggcccttcccctcccccactc

SEQ ID NO: 5363736 - DNA, 13 bp, Homo sapiens
agggcccttctct

SEQ ID NO: 5363737 - DNA, 18 bp, Homo sapiens
agggcccttggggctggg

SEQ ID NO: 5363738 - DNA, 19 bp, Homo sapiens
agggccgactaagagaagt

SEQ ID NO: 5363739 - DNA, 15 bp, Homo sapiens
agggccgagacagga

SEQ ID NO: 5363740 - DNA, 17 bp, Homo sapiens
agggccgagaggacaga

SEQ ID NO: 5363741 - DNA, 16 bp, Homo sapiens
agggccgcagggccca

SEQ ID NO: 5363742 - DNA, 14 bp, Homo sapiens
agggccgcagggcg

SEQ ID NO: 5363743 - DNA, 16 bp, Homo sapiens
agggccgcagggcgct

SEQ ID NO: 5363744 - DNA, 16 bp, Homo sapiens
agggccgcccgctccc

SEQ ID NO: 5363745 - DNA, 11 bp, Homo sapiens
agggccgccga

SEQ ID NO: 5363746 - DNA, 13 bp, Homo sapiens
agggccgcctgcc

SEQ ID NO: 5363747 - DNA, 18 bp, Homo sapiens
agggccgcggccgcccgc

SEQ ID NO: 5363748 - DNA, 20 bp, Homo sapiens
agggccgctcgatgcctttg

SEQ ID NO: 5363749 - DNA, 23 bp, Homo sapiens
agggccgctcgatgcctttgctg

SEQ ID NO: 5363750 - DNA, 15 bp, Homo sapiens
agggccggcggctct

SEQ ID NO: 5363751 - DNA, 18 bp, Homo sapiens
agggccggcggctctgag

SEQ ID NO: 5363752 - DNA, 15 bp, Homo sapiens
agggccgggcagggg

SEQ ID NO: 5363753 - DNA, 18 bp, Homo sapiens
agggccggggaactggcc

SEQ ID NO: 5363754 - DNA, 20 bp, Homo sapiens
agggccggggaactggccaa

SEQ ID NO: 5363755 - DNA, 22 bp, Homo sapiens
agggccggggaactggccaagc

SEQ ID NO: 5363756 - DNA, 19 bp, Homo sapiens
agggccggggatggatctt

SEQ ID NO: 5363757 - DNA, 23 bp, Homo sapiens
agggccggggggggtaggagagg

SEQ ID NO: 5363758 - DNA, 19 bp, Homo sapiens
agggccgtcaaggaaaggg

SEQ ID NO: 5363759 - DNA, 15 bp, Homo sapiens
agggcctagctgcta

SEQ ID NO: 5363760 - DNA, 18 bp, Homo sapiens
agggcctagctgctacaa

SEQ ID NO: 5363761 - DNA, 20 bp, Homo sapiens
agggcctagctgctacaaag

SEQ ID NO: 5363762 - DNA, 21 bp, Homo sapiens
agggcctagctgctacaaaga

SEQ ID NO: 5363763 - DNA, 14 bp, Homo sapiens
agggcctcactctg

SEQ ID NO: 5363764 - DNA, 13 bp, Homo sapiens
agggcctcagaga

SEQ ID NO: 5363765 - DNA, 16 bp, Homo sapiens
agggcctcagagacag

SEQ ID NO: 5363766 - DNA, 17 bp, Homo sapiens
agggcctcagagacagc

SEQ ID NO: 5363767 - DNA, 13 bp, Homo sapiens
agggcctcagagc

SEQ ID NO: 5363768 - DNA, 19 bp, Homo sapiens
agggcctcagagcctgacc

SEQ ID NO: 5363769 - DNA, 15 bp, Homo sapiens
agggcctcagtctgg

SEQ ID NO: 5363770 - DNA, 19 bp, Homo sapiens
agggcctcagtctggagtg

SEQ ID NO: 5363771 - DNA, 24 bp, Homo sapiens
agggcctcatctcacctctcgcaa

SEQ ID NO: 5363772 - DNA, 20 bp, Homo sapiens
agggcctccattcctggagc

SEQ ID NO: 5363773 - DNA, 19 bp, Homo sapiens
agggcctcccaccagagac

SEQ ID NO: 5363774 - DNA, 13 bp, Homo sapiens
agggcctcccagc

SEQ ID NO: 5363775 - DNA, 11 bp, Homo sapiens
agggcctcctg

SEQ ID NO: 5363776 - DNA, 21 bp, Homo sapiens
agggcctcggaggctcctccc

SEQ ID NO: 5363777 - DNA, 23 bp, Homo sapiens
agggcctcggaggctcctccctc

SEQ ID NO: 5363778 - DNA, 16 bp, Homo sapiens
agggcctctgcctggg

SEQ ID NO: 5363779 - DNA, 17 bp, Homo sapiens
agggcctctgcctggga

SEQ ID NO: 5363780 - DNA, 18 bp, Homo sapiens
agggcctctgcctgggac

SEQ ID NO: 5363781 - DNA, 11 bp, Homo sapiens
agggcctctgg

SEQ ID NO: 5363782 - DNA, 14 bp, Homo sapiens
agggcctctggaca

SEQ ID NO: 5363783 - DNA, 21 bp, Homo sapiens
agggcctctggcttccctgcc

SEQ ID NO: 5363784 - DNA, 18 bp, Homo sapiens
agggcctgaaacccgccc

SEQ ID NO: 5363785 - DNA, 21 bp, Homo sapiens
agggcctgacaggttcccagc

SEQ ID NO: 5363786 - DNA, 15 bp, Homo sapiens
agggcctgacttgag

SEQ ID NO: 5363787 - DNA, 18 bp, Homo sapiens
agggcctgacttttacag

SEQ ID NO: 5363788 - DNA, 22 bp, Homo sapiens
agggcctgaggtctggctgctt

SEQ ID NO: 5363789 - DNA, 14 bp, Homo sapiens
agggcctgatgggg

SEQ ID NO: 5363790 - DNA, 13 bp, Homo sapiens
agggcctgcagtg

SEQ ID NO: 5363791 - DNA, 15 bp, Homo sapiens
agggcctgcagtgat

SEQ ID NO: 5363792 - DNA, 16 bp, Homo sapiens
agggcctgccccctgg

SEQ ID NO: 5363793 - DNA, 17 bp, Homo sapiens
agggcctgcctggcccc

SEQ ID NO: 5363794 - DNA, 15 bp, Homo sapiens
agggcctgctggagg

SEQ ID NO: 5363795 - DNA, 19 bp, Homo sapiens
agggcctgctggaggcctc

SEQ ID NO: 5363796 - DNA, 21 bp, Homo sapiens
agggcctgctggaggcctcag

SEQ ID NO: 5363797 - DNA, 22 bp, Homo sapiens
agggcctgctggaggcctcagg

SEQ ID NO: 5363798 - DNA, 16 bp, Homo sapiens
agggcctgcttcccct

SEQ ID NO: 5363799 - DNA, 19 bp, Homo sapiens
agggcctggaagacagaga

SEQ ID NO: 5363800 - DNA, 12 bp, Homo sapiens
agggcctggagc

SEQ ID NO: 5363801 - DNA, 21 bp, Homo sapiens
agggcctggagccccatcggc

SEQ ID NO: 5363802 - DNA, 17 bp, Homo sapiens
agggcctggcaggccag

SEQ ID NO: 5363803 - DNA, 13 bp, Homo sapiens
agggcctggccag

SEQ ID NO: 5363804 - DNA, 16 bp, Homo sapiens
agggcctggccagtcc

SEQ ID NO: 5363805 - DNA, 18 bp, Homo sapiens
agggcctggccagtcctg

SEQ ID NO: 5363806 - DNA, 13 bp, Homo sapiens
agggcctggcctg

SEQ ID NO: 5363807 - DNA, 14 bp, Homo sapiens
agggcctggcctgg

SEQ ID NO: 5363808 - DNA, 15 bp, Homo sapiens
agggcctggctccag

SEQ ID NO: 5363809 - DNA, 16 bp, Homo sapiens
agggcctggctccagt

SEQ ID NO: 5363810 - DNA, 16 bp, Homo sapiens
agggcctgggcctcat

SEQ ID NO: 5363811 - DNA, 19 bp, Homo sapiens
agggcctgggcctggctcc

SEQ ID NO: 5363812 - DNA, 21 bp, Homo sapiens
agggcctggggaaaccatggc

SEQ ID NO: 5363813 - DNA, 14 bp, Homo sapiens
agggcctgggggca

SEQ ID NO: 5363814 - DNA, 17 bp, Homo sapiens
agggcctgggggcagtg

SEQ ID NO: 5363815 - DNA, 21 bp, Homo sapiens
agggcctgggggcagtgactg

SEQ ID NO: 5363816 - DNA, 17 bp, Homo sapiens
agggcctggtccctggg

SEQ ID NO: 5363817 - DNA, 15 bp, Homo sapiens
agggcctgtctccct

SEQ ID NO: 5363818 - DNA, 16 bp, Homo sapiens
agggccttcccctccc

SEQ ID NO: 5363819 - DNA, 19 bp, Homo sapiens
agggccttctgcctgctga

SEQ ID NO: 5363820 - DNA, 15 bp, Homo sapiens
agggccttgcccaga

SEQ ID NO: 5363821 - DNA, 17 bp, Homo sapiens
agggccttgcccagaga

SEQ ID NO: 5363822 - DNA, 19 bp, Homo sapiens
agggccttgcccagagatg

SEQ ID NO: 5363823 - DNA, 19 bp, Homo sapiens
agggccttgcttctcttct

SEQ ID NO: 5363824 - DNA, 17 bp, Homo sapiens
agggcctttctcctccc

SEQ ID NO: 5363825 - DNA, 20 bp, Homo sapiens
agggcctttctcctccccac

SEQ ID NO: 5363826 - DNA, 23 bp, Homo sapiens
agggcctttctcctccccacctg

SEQ ID NO: 5363827 - DNA, 20 bp, Homo sapiens
agggccttttctgtgccaga

SEQ ID NO: 5363828 - DNA, 20 bp, Homo sapiens
agggcgaacgacaatagctt

SEQ ID NO: 5363829 - DNA, 16 bp, Homo sapiens
agggcgaggcggggga

SEQ ID NO: 5363830 - DNA, 20 bp, Homo sapiens
agggcgaggcgggggagcct

SEQ ID NO: 5363831 - DNA, 22 bp, Homo sapiens
agggcgagggatgatgagggaa

SEQ ID NO: 5363832 - DNA, 23 bp, Homo sapiens
agggcgaggggagggtggcaggt

SEQ ID NO: 5363833 - DNA, 14 bp, Homo sapiens
agggcgcaaagggc

SEQ ID NO: 5363834 - DNA, 20 bp, Homo sapiens
agggcgcaggaaccgaggac

SEQ ID NO: 5363835 - DNA, 21 bp, Homo sapiens
agggcgcaggaaccgaggact

SEQ ID NO: 5363836 - DNA, 21 bp, Homo sapiens
agggcgccaagtctggcacca

SEQ ID NO: 5363837 - DNA, 14 bp, Homo sapiens
agggcgccaccacc

SEQ ID NO: 5363838 - DNA, 13 bp, Homo sapiens
agggcgcccagca

SEQ ID NO: 5363839 - DNA, 15 bp, Homo sapiens
agggcgcccagcagc

SEQ ID NO: 5363840 - DNA, 16 bp, Homo sapiens
agggcgcccagcagcc

SEQ ID NO: 5363841 - DNA, 18 bp, Homo sapiens
agggcgcccagcagcctg

SEQ ID NO: 5363842 - DNA, 18 bp, Homo sapiens
agggcgcccagcccaggc

SEQ ID NO: 5363843 - DNA, 20 bp, Homo sapiens
agggcgcccagcccaggcct

SEQ ID NO: 5363844 - DNA, 23 bp, Homo sapiens
agggcgcccagcccaggcctggt

SEQ ID NO: 5363845 - DNA, 21 bp, Homo sapiens
agggcgcccattcgtctgtcc

SEQ ID NO: 5363846 - DNA, 13 bp, Homo sapiens
agggcgcctcacc

SEQ ID NO: 5363847 - DNA, 20 bp, Homo sapiens
agggcgcctgggtcctccca

SEQ ID NO: 5363848 - DNA, 22 bp, Homo sapiens
agggcgcgcaggcagggagaag

SEQ ID NO: 5363849 - DNA, 12 bp, Homo sapiens
agggcgctcaga

SEQ ID NO: 5363850 - DNA, 16 bp, Homo sapiens
agggcgctcagacggc

SEQ ID NO: 5363851 - DNA, 22 bp, Homo sapiens
agggcgctcagacggcggccag

SEQ ID NO: 5363852 - DNA, 15 bp, Homo sapiens
agggcgctccggcag

SEQ ID NO: 5363853 - DNA, 17 bp, Homo sapiens
agggcgctccggcagag

SEQ ID NO: 5363854 - DNA, 18 bp, Homo sapiens
agggcgctccggcagagg

SEQ ID NO: 5363855 - DNA, 14 bp, Homo sapiens
agggcgctcctgtt

SEQ ID NO: 5363856 - DNA, 15 bp, Homo sapiens
agggcgctgggaagg

SEQ ID NO: 5363857 - DNA, 13 bp, Homo sapiens
agggcggcagggg

SEQ ID NO: 5363858 - DNA, 19 bp, Homo sapiens
agggcggcaggggcctgga

SEQ ID NO: 5363859 - DNA, 18 bp, Homo sapiens
agggcggcctcccaggtc

SEQ ID NO: 5363860 - DNA, 17 bp, Homo sapiens
agggcggcggggcctgg

SEQ ID NO: 5363861 - DNA, 14 bp, Homo sapiens
agggcgggcaagga

SEQ ID NO: 5363862 - DNA, 18 bp, Homo sapiens
agggcgggcagagggctg

SEQ ID NO: 5363863 - DNA, 14 bp, Homo sapiens
agggcgggcctgtt

SEQ ID NO: 5363864 - DNA, 21 bp, Homo sapiens
agggcggggctatgccttgtc

SEQ ID NO: 5363865 - DNA, 14 bp, Homo sapiens
agggcggggctggc

SEQ ID NO: 5363866 - DNA, 22 bp, Homo sapiens
agggcggggtgtctgtcttcct

SEQ ID NO: 5363867 - DNA, 17 bp, Homo sapiens
agggcgtcaggcagagg

SEQ ID NO: 5363868 - DNA, 16 bp, Homo sapiens
agggcgtgaaacacaa

SEQ ID NO: 5363869 - DNA, 13 bp, Homo sapiens
agggcgtggaggg

SEQ ID NO: 5363870 - DNA, 23 bp, Homo sapiens
agggcgtgtggtttccctgcccc

SEQ ID NO: 5363871 - DNA, 18 bp, Homo sapiens
agggctaaaaaggtcctg

SEQ ID NO: 5363872 - DNA, 17 bp, Homo sapiens
agggctaaataaagagg

SEQ ID NO: 5363873 - DNA, 14 bp, Homo sapiens
agggctaagagcta

SEQ ID NO: 5363874 - DNA, 22 bp, Homo sapiens
agggctaagagctagcgctgcc

SEQ ID NO: 5363875 - DNA, 21 bp, Homo sapiens
agggctaaggcctcttgctgg

SEQ ID NO: 5363876 - DNA, 20 bp, Homo sapiens
agggctaattctgggaaggg

SEQ ID NO: 5363877 - DNA, 19 bp, Homo sapiens
agggctacaaaggaggaca

SEQ ID NO: 5363878 - DNA, 15 bp, Homo sapiens
agggctacacagacc

SEQ ID NO: 5363879 - DNA, 19 bp, Homo sapiens
agggctacacagaccctgc

SEQ ID NO: 5363880 - DNA, 16 bp, Homo sapiens
agggctacattgtaat

SEQ ID NO: 5363881 - DNA, 18 bp, Homo sapiens
agggctaccctgagctga

SEQ ID NO: 5363882 - DNA, 20 bp, Homo sapiens
agggctaccctgagctgagg

SEQ ID NO: 5363883 - DNA, 16 bp, Homo sapiens
agggctagaacctgga

SEQ ID NO: 5363884 - DNA, 18 bp, Homo sapiens
agggctagaacctggaga

SEQ ID NO: 5363885 - DNA, 22 bp, Homo sapiens
agggctagaacctggagggctg

SEQ ID NO: 5363886 - DNA, 21 bp, Homo sapiens
agggctagaacctggaggggc

SEQ ID NO: 5363887 - DNA, 20 bp, Homo sapiens
agggctagaatctggagagc

SEQ ID NO: 5363888 - DNA, 16 bp, Homo sapiens
agggctagccctgagc

SEQ ID NO: 5363889 - DNA, 16 bp, Homo sapiens
agggctaggaatatag

SEQ ID NO: 5363890 - DNA, 23 bp, Homo sapiens
agggctagtgaagtggcctcttg

SEQ ID NO: 5363891 - DNA, 22 bp, Homo sapiens
agggctagtgacttgtgtccca

SEQ ID NO: 5363892 - DNA, 22 bp, Homo sapiens
agggctatgcctccatttcaga

SEQ ID NO: 5363893 - DNA, 21 bp, Homo sapiens
agggctatggatggggcccag

SEQ ID NO: 5363894 - DNA, 15 bp, Homo sapiens
agggctatgtggatt

SEQ ID NO: 5363895 - DNA, 18 bp, Homo sapiens
agggctcacactcctggg

SEQ ID NO: 5363896 - DNA, 19 bp, Homo sapiens
agggctcacactcctgggc

SEQ ID NO: 5363897 - DNA, 18 bp, Homo sapiens
agggctcagaagagcagc

SEQ ID NO: 5363898 - DNA, 21 bp, Homo sapiens
agggctcagagaggacaaaat

SEQ ID NO: 5363899 - DNA, 22 bp, Homo sapiens
agggctcagagaggacaaaata

SEQ ID NO: 5363900 - DNA, 18 bp, Homo sapiens
agggctcagagctgctga

SEQ ID NO: 5363901 - DNA, 21 bp, Homo sapiens
agggctcagagctgctgagca

SEQ ID NO: 5363902 - DNA, 14 bp, Homo sapiens
agggctcagagggg

SEQ ID NO: 5363903 - DNA, 16 bp, Homo sapiens
aggggcagccacacca

SEQ ID NO: 5363904 - DNA, 19 bp, Homo sapiens
aggggcagccacaccactg

SEQ ID NO: 5363905 - DNA, 12 bp, Homo sapiens
aggggcagccct

SEQ ID NO: 5363906 - DNA, 17 bp, Homo sapiens
aggggcagccctgagtg

SEQ ID NO: 5363907 - DNA, 13 bp, Homo sapiens
aggggcagccctt

SEQ ID NO: 5363908 - DNA, 14 bp, Homo sapiens
aggggcagcctgcc

SEQ ID NO: 5363909 - DNA, 12 bp, Homo sapiens
aggggcagctcc

SEQ ID NO: 5363910 - DNA, 16 bp, Homo sapiens
aggggcagctcctgac

SEQ ID NO: 5363911 - DNA, 18 bp, Homo sapiens
aggggcaggagaggctgg

SEQ ID NO: 5363912 - DNA, 18 bp, Homo sapiens
aggggcaggaggaagggg

SEQ ID NO: 5363913 - DNA, 18 bp, Homo sapiens
aggggcaggcagggctgc

SEQ ID NO: 5363914 - DNA, 18 bp, Homo sapiens
aggggcaggcctgggacc

SEQ ID NO: 5363915 - DNA, 17 bp, Homo sapiens
aggggcaggcgcagagg

SEQ ID NO: 5363916 - DNA, 18 bp, Homo sapiens
aggggcaggcgcagaggt

SEQ ID NO: 5363917 - DNA, 22 bp, Homo sapiens
aggggcaggcgcagaggtccca

SEQ ID NO: 5363918 - DNA, 12 bp, Homo sapiens
aggggcaggctg

SEQ ID NO: 5363919 - DNA, 16 bp, Homo sapiens
aggggcagggagagcg

SEQ ID NO: 5363920 - DNA, 15 bp, Homo sapiens
aggggcagggccttg

SEQ ID NO: 5363921 - DNA, 10 bp, Homo sapiens
aggggcaggt

SEQ ID NO: 5363922 - DNA, 13 bp, Homo sapiens
aggggcaggtgaa

SEQ ID NO: 5363923 - DNA, 16 bp, Homo sapiens
aggggcaggtggtgga

SEQ ID NO: 5363924 - DNA, 12 bp, Homo sapiens
aggggcaggtgt

SEQ ID NO: 5363925 - DNA, 15 bp, Homo sapiens
aggggcagtctggag

SEQ ID NO: 5363926 - DNA, 17 bp, Homo sapiens
aggggcagtctggaggg

SEQ ID NO: 5363927 - DNA, 20 bp, Homo sapiens
aggggcagtctggaggggca

SEQ ID NO: 5363928 - DNA, 21 bp, Homo sapiens
aggggcagtggagatcaggag

SEQ ID NO: 5363929 - DNA, 14 bp, Homo sapiens
aggggcagtggcct

SEQ ID NO: 5363930 - DNA, 15 bp, Homo sapiens
aggggcagtggcctg

SEQ ID NO: 5363931 - DNA, 17 bp, Homo sapiens
aggggcagtggcctgga

SEQ ID NO: 5363932 - DNA, 20 bp, Homo sapiens
aggggcagttttagcagcac

SEQ ID NO: 5363933 - DNA, 14 bp, Homo sapiens
aggggcatctgccc

SEQ ID NO: 5363934 - DNA, 17 bp, Homo sapiens
aggggcatctgcccctc

SEQ ID NO: 5363935 - DNA, 20 bp, Homo sapiens
aggggcatctgcccctcccc

SEQ ID NO: 5363936 - DNA, 22 bp, Homo sapiens
aggggcatctgcccctccccca

SEQ ID NO: 5363937 - DNA, 18 bp, Homo sapiens
aggggccaagcaggcact

SEQ ID NO: 5363938 - DNA, 19 bp, Homo sapiens
aggggccaataaaatgtat

SEQ ID NO: 5363939 - DNA, 17 bp, Homo sapiens
aggggccaattttggat

SEQ ID NO: 5363940 - DNA, 20 bp, Homo sapiens
aggggccacctcctccccct

SEQ ID NO: 5363941 - DNA, 17 bp, Homo sapiens
aggggccactccaaact

SEQ ID NO: 5363942 - DNA, 16 bp, Homo sapiens
aggggccactgaccca

SEQ ID NO: 5363943 - DNA, 24 bp, Homo sapiens
aggggccactgacccacctgcgct

SEQ ID NO: 5363944 - DNA, 14 bp, Homo sapiens
aggggccactgggc

SEQ ID NO: 5363945 - DNA, 13 bp, Homo sapiens
aggggccagaaga

SEQ ID NO: 5363946 - DNA, 16 bp, Homo sapiens
aggggccagagagcag

SEQ ID NO: 5363947 - DNA, 20 bp, Homo sapiens
aggggccagagagcagggga

SEQ ID NO: 5363948 - DNA, 21 bp, Homo sapiens
aggggccagagccttggagga

SEQ ID NO: 5363949 - DNA, 17 bp, Homo sapiens
aggggccagaggctcgt

SEQ ID NO: 5363950 - DNA, 20 bp, Homo sapiens
aggggccagatgacacccta

SEQ ID NO: 5363951 - DNA, 21 bp, Homo sapiens
aggggccagatgattttcctc

SEQ ID NO: 5363952 - DNA, 14 bp, Homo sapiens
aggggccagcggcc

SEQ ID NO: 5363953 - DNA, 17 bp, Homo sapiens
aggggccagcggccctc

SEQ ID NO: 5363954 - DNA, 15 bp, Homo sapiens
aggggccagctgccc

SEQ ID NO: 5363955 - DNA, 11 bp, Homo sapiens
aggggccagga

SEQ ID NO: 5363956 - DNA, 17 bp, Homo sapiens
aggggccaggaagggga

SEQ ID NO: 5363957 - DNA, 18 bp, Homo sapiens
aggggccaggaaggggac

SEQ ID NO: 5363958 - DNA, 21 bp, Homo sapiens
aggggccaggaaggggacagg

SEQ ID NO: 5363959 - DNA, 16 bp, Homo sapiens
aggggccaggagtggg

SEQ ID NO: 5363960 - DNA, 14 bp, Homo sapiens
aggggccaggccca

SEQ ID NO: 5363961 - DNA, 15 bp, Homo sapiens
aggggccaggcccag

SEQ ID NO: 5363962 - DNA, 19 bp, Homo sapiens
aggggccagtgagggctgg

SEQ ID NO: 5363963 - DNA, 17 bp, Homo sapiens
aggggccatcacaggat

SEQ ID NO: 5363964 - DNA, 20 bp, Homo sapiens
aggggccatcacaggatgcc

SEQ ID NO: 5363965 - DNA, 21 bp, Homo sapiens
aggggccatcacaggatgcca

SEQ ID NO: 5363966 - DNA, 15 bp, Homo sapiens
aggggccatgcccca

SEQ ID NO: 5363967 - DNA, 20 bp, Homo sapiens
aggggccatgccccaccccc

SEQ ID NO: 5363968 - DNA, 19 bp, Homo sapiens
aggggcccaagccccatct

SEQ ID NO: 5363969 - DNA, 20 bp, Homo sapiens
aggggcccaagccccatctc

SEQ ID NO: 5363970 - DNA, 13 bp, Homo sapiens
aggggcccaggga

SEQ ID NO: 5363971 - DNA, 18 bp, Homo sapiens
aggggcccattcagcctc

SEQ ID NO: 5363972 - DNA, 21 bp, Homo sapiens
aggggccccagcgtctgcagg

SEQ ID NO: 5363973 - DNA, 14 bp, Homo sapiens
aggggccccatggc

SEQ ID NO: 5363974 - DNA, 21 bp, Homo sapiens
aggggccccatggcagctcct

SEQ ID NO: 5363975 - DNA, 22 bp, Homo sapiens
aggggccccatggcagctcctg

SEQ ID NO: 5363976 - DNA, 22 bp, Homo sapiens
aggggcccccctgccctgtggg

SEQ ID NO: 5363977 - DNA, 18 bp, Homo sapiens
aggggcccccgtgttcag

SEQ ID NO: 5363978 - DNA, 19 bp, Homo sapiens
aggggcccccgtgttcagg

SEQ ID NO: 5363979 - DNA, 17 bp, Homo sapiens
aggggccccggggctgg

SEQ ID NO: 5363980 - DNA, 14 bp, Homo sapiens
aggggcccctcctc

SEQ ID NO: 5363981 - DNA, 20 bp, Homo sapiens
aggggcccctcctctgtgct

SEQ ID NO: 5363982 - DNA, 13 bp, Homo sapiens
aggggcccctctc

SEQ ID NO: 5363983 - DNA, 19 bp, Homo sapiens
aggggcccctctcagccct

SEQ ID NO: 5363984 - DNA, 15 bp, Homo sapiens
aggggcccctggccc

SEQ ID NO: 5363985 - DNA, 17 bp, Homo sapiens
aggggcccctggcccag

SEQ ID NO: 5363986 - DNA, 19 bp, Homo sapiens
aggggcccctggcccagga

SEQ ID NO: 5363987 - DNA, 21 bp, Homo sapiens
aggggcccctggcccaggagg

SEQ ID NO: 5363988 - DNA, 21 bp, Homo sapiens
aggggcccgagcagaagcagg

SEQ ID NO: 5363989 - DNA, 15 bp, Homo sapiens
aggggcccgcttgcc

SEQ ID NO: 5363990 - DNA, 16 bp, Homo sapiens
aggggcccgcttgcct

SEQ ID NO: 5363991 - DNA, 19 bp, Homo sapiens
aggggcccgcttgcctcgg

SEQ ID NO: 5363992 - DNA, 20 bp, Homo sapiens
aggggcccgcttgcctcggc

SEQ ID NO: 5363993 - DNA, 17 bp, Homo sapiens
aggggcccggatccagg

SEQ ID NO: 5363994 - DNA, 23 bp, Homo sapiens
aggggcccggatccaggattctg

SEQ ID NO: 5363995 - DNA, 13 bp, Homo sapiens
aggggcccggcca

SEQ ID NO: 5363996 - DNA, 15 bp, Homo sapiens
aggggcccgggaact

SEQ ID NO: 5363997 - DNA, 19 bp, Homo sapiens
aggggcccgggaactcctg

SEQ ID NO: 5363998 - DNA, 20 bp, Homo sapiens
aggggcccggtggcggcagg

SEQ ID NO: 5363999 - DNA, 14 bp, Homo sapiens
aggggcccgtggga

SEQ ID NO: 5364000 - DNA, 17 bp, Homo sapiens
aggggccctacctgggg

SEQ ID NO: 5364001 - DNA, 12 bp, Homo sapiens
aggggccctagg

SEQ ID NO: 5364002 - DNA, 10 bp, Homo sapiens
aggggccctc

SEQ ID NO: 5364003 - DNA, 12 bp, Homo sapiens
aggggccctcag

SEQ ID NO: 5364004 - DNA, 13 bp, Homo sapiens
aggggccctcagg

SEQ ID NO: 5364005 - DNA, 15 bp, Homo sapiens
aggggccctcaggcc

SEQ ID NO: 5364006 - DNA, 16 bp, Homo sapiens
aggggccctcaggcca

SEQ ID NO: 5364007 - DNA, 15 bp, Homo sapiens
aggggccctccgagg

SEQ ID NO: 5364008 - DNA, 16 bp, Homo sapiens
aggggccctggccagg

SEQ ID NO: 5364009 - DNA, 16 bp, Homo sapiens
aggggccctgtcactg

SEQ ID NO: 5364010 - DNA, 20 bp, Homo sapiens
aggggcccttggagcgtgga

SEQ ID NO: 5364011 - DNA, 21 bp, Homo sapiens
aggggcccttgggacagccag

SEQ ID NO: 5364012 - DNA, 17 bp, Homo sapiens
aggggccgatgcccaga

SEQ ID NO: 5364013 - DNA, 22 bp, Homo sapiens
aggggccgctgccacccacctc

SEQ ID NO: 5364014 - DNA, 14 bp, Homo sapiens
aggggccgcttcgc

SEQ ID NO: 5364015 - DNA, 20 bp, Homo sapiens
aggggccggctggcctggag

SEQ ID NO: 5364016 - DNA, 21 bp, Homo sapiens
aggggccggctggcctggagg

SEQ ID NO: 5364017 - DNA, 23 bp, Homo sapiens
aggggccggctgtttcctgacag

SEQ ID NO: 5364018 - DNA, 21 bp, Homo sapiens
aggggccggggaagctgccag

SEQ ID NO: 5364019 - DNA, 23 bp, Homo sapiens
aggggccggggaagctgccagcc

SEQ ID NO: 5364020 - DNA, 16 bp, Homo sapiens
aggggccggggagggg

SEQ ID NO: 5364021 - DNA, 22 bp, Homo sapiens
aggggccggggagggggcacgg

SEQ ID NO: 5364022 - DNA, 15 bp, Homo sapiens
aggggccgtgtcccg

SEQ ID NO: 5364023 - DNA, 20 bp, Homo sapiens
aggggcctcaggtcctactg

SEQ ID NO: 5364024 - DNA, 21 bp, Homo sapiens
aggggcctccaaccttctgcc

SEQ ID NO: 5364025 - DNA, 21 bp, Homo sapiens
aggggcctcccccagcacaga

SEQ ID NO: 5364026 - DNA, 18 bp, Homo sapiens
aggggcctctctcctgcc

SEQ ID NO: 5364027 - DNA, 19 bp, Homo sapiens
aggggcctctggctgcctg

SEQ ID NO: 5364028 - DNA, 19 bp, Homo sapiens
aggggcctcttatgggctg

SEQ ID NO: 5364029 - DNA, 13 bp, Homo sapiens
aggggcctgagca

SEQ ID NO: 5364030 - DNA, 14 bp, Homo sapiens
aggggcctgagtgg

SEQ ID NO: 5364031 - DNA, 12 bp, Homo sapiens
aggggcctgcag

SEQ ID NO: 5364032 - DNA, 16 bp, Homo sapiens
aggggcctgcagaagg

SEQ ID NO: 5364033 - DNA, 15 bp, Homo sapiens
aggggcctgccacct

SEQ ID NO: 5364034 - DNA, 22 bp, Homo sapiens
aggggcctgccacctggacccc

SEQ ID NO: 5364035 - DNA, 23 bp, Homo sapiens
aggggcctgccactctcctgagg

SEQ ID NO: 5364036 - DNA, 14 bp, Homo sapiens
aggggcctgcccag

SEQ ID NO: 5364037 - DNA, 17 bp, Homo sapiens
aggggcctggaggtctg

SEQ ID NO: 5364038 - DNA, 12 bp, Homo sapiens
aggggcctgggc

SEQ ID NO: 5364039 - DNA, 14 bp, Homo sapiens
aggggcctgggctg

SEQ ID NO: 5364040 - DNA, 19 bp, Homo sapiens
aggggcctgggctgtgagg

SEQ ID NO: 5364041 - DNA, 21 bp, Homo sapiens
aggggcctgggctgtgaggac

SEQ ID NO: 5364042 - DNA, 22 bp, Homo sapiens
aggggcctgggctgtgaggaca

SEQ ID NO: 5364043 - DNA, 18 bp, Homo sapiens
aggggccttagggagccc

SEQ ID NO: 5364044 - DNA, 11 bp, Homo sapiens
aggggccttgc

SEQ ID NO: 5364045 - DNA, 17 bp, Homo sapiens
aggggcctttgctgccc

SEQ ID NO: 5364046 - DNA, 15 bp, Homo sapiens
aggggcgacagtagt

SEQ ID NO: 5364047 - DNA, 19 bp, Homo sapiens
aggggcgcaccccacagct

SEQ ID NO: 5364048 - DNA, 14 bp, Homo sapiens
aggggcgcccaggg

SEQ ID NO: 5364049 - DNA, 23 bp, Homo sapiens
aggggcgccgcaaaccacactgg

SEQ ID NO: 5364050 - DNA, 22 bp, Homo sapiens
aggggcgcgcgcccccaggacc

SEQ ID NO: 5364051 - DNA, 14 bp, Homo sapiens
aggggcgcgggagg

SEQ ID NO: 5364052 - DNA, 18 bp, Homo sapiens
aggggcgctggcccagcc

SEQ ID NO: 5364053 - DNA, 20 bp, Homo sapiens
aggggcgctggcccagccgg

SEQ ID NO: 5364054 - DNA, 23 bp, Homo sapiens
aggggcgctggcccagccggcct

SEQ ID NO: 5364055 - DNA, 18 bp, Homo sapiens
aggggcggcaggagggag

SEQ ID NO: 5364056 - DNA, 13 bp, Homo sapiens
aggggcgggagtg

SEQ ID NO: 5364057 - DNA, 18 bp, Homo sapiens
aggggcgggcggagggag

SEQ ID NO: 5364058 - DNA, 17 bp, Homo sapiens
aggggcgggctcagagc

SEQ ID NO: 5364059 - DNA, 21 bp, Homo sapiens
aggggcgggtgatgagacctg

SEQ ID NO: 5364060 - DNA, 16 bp, Homo sapiens
aggggcgtctgttccc

SEQ ID NO: 5364061 - DNA, 14 bp, Homo sapiens
aggggcgtgtggct

SEQ ID NO: 5364062 - DNA, 20 bp, Homo sapiens
aggggcgttctcccaaagat

SEQ ID NO: 5364063 - DNA, 14 bp, Homo sapiens
aggggctaccagga

SEQ ID NO: 5364064 - DNA, 22 bp, Homo sapiens
aggggctacgttagcagcccag

SEQ ID NO: 5364065 - DNA, 15 bp, Homo sapiens
aggggctagcactgg

SEQ ID NO: 5364066 - DNA, 15 bp, Homo sapiens
aggggctatcccttc

SEQ ID NO: 5364067 - DNA, 16 bp, Homo sapiens
aggggctatcccttct

SEQ ID NO: 5364068 - DNA, 18 bp, Homo sapiens
aggggctatcctgggacc

SEQ ID NO: 5364069 - DNA, 19 bp, Homo sapiens
aggggctatcctgggacct

SEQ ID NO: 5364070 - DNA, 14 bp, Homo sapiens
aggggctcagcaag

SEQ ID NO: 5364071 - DNA, 15 bp, Homo sapiens
aggggctcaggaaaa

SEQ ID NO: 5364072 - DNA, 18 bp, Homo sapiens
aggggctccacctgttca

SEQ ID NO: 5364073 - DNA, 16 bp, Homo sapiens
aggggctccatgccag

SEQ ID NO: 5364074 - DNA, 16 bp, Homo sapiens
aggggctccccagagg

SEQ ID NO: 5364075 - DNA, 14 bp, Homo sapiens
aggggctccctccg

SEQ ID NO: 5364076 - DNA, 15 bp, Homo sapiens
aggggctccctccgc

SEQ ID NO: 5364077 - DNA, 12 bp, Homo sapiens
aggggctcctgg

SEQ ID NO: 5364078 - DNA, 13 bp, Homo sapiens
aggggctcctgga

SEQ ID NO: 5364079 - DNA, 14 bp, Homo sapiens
aggggctcctggaa

SEQ ID NO: 5364080 - DNA, 17 bp, Homo sapiens
aggggctcctgggttgg

SEQ ID NO: 5364081 - DNA, 20 bp, Homo sapiens
aggggctcctgggttggagg

SEQ ID NO: 5364082 - DNA, 15 bp, Homo sapiens
aggggtcccccctca

SEQ ID NO: 5364083 - DNA, 20 bp, Homo sapiens
aggggtcccctccaggagta

SEQ ID NO: 5364084 - DNA, 13 bp, Homo sapiens
aggggtccctgct

SEQ ID NO: 5364085 - DNA, 14 bp, Homo sapiens
aggggtccctgcta

SEQ ID NO: 5364086 - DNA, 22 bp, Homo sapiens
aggggtccgatgtttgaggagg

SEQ ID NO: 5364087 - DNA, 19 bp, Homo sapiens
aggggtcctcgggatgccg

SEQ ID NO: 5364088 - DNA, 21 bp, Homo sapiens
aggggtcctgatttcagggaa

SEQ ID NO: 5364089 - DNA, 18 bp, Homo sapiens
aggggtcctgcaggtcct

SEQ ID NO: 5364090 - DNA, 21 bp, Homo sapiens
aggggtcgacttcgggctggc

SEQ ID NO: 5364091 - DNA, 18 bp, Homo sapiens
aggggtctccaggaggag

SEQ ID NO: 5364092 - DNA, 13 bp, Homo sapiens
aggggtctccctg

SEQ ID NO: 5364093 - DNA, 15 bp, Homo sapiens
aggggtctccctgag

SEQ ID NO: 5364094 - DNA, 21 bp, Homo sapiens
aggggtctccctgagcctgcc

SEQ ID NO: 5364095 - DNA, 16 bp, Homo sapiens
aggggtctccctggct

SEQ ID NO: 5364096 - DNA, 17 bp, Homo sapiens
aggggtctgcctcccac

SEQ ID NO: 5364097 - DNA, 14 bp, Homo sapiens
aggggtctgctcct

SEQ ID NO: 5364098 - DNA, 23 bp, Homo sapiens
aggggtctgggagtcaggcccgg

SEQ ID NO: 5364099 - DNA, 19 bp, Homo sapiens
aggggtctgttctgcagtg

SEQ ID NO: 5364100 - DNA, 18 bp, Homo sapiens
aggggtgacacagactca

SEQ ID NO: 5364101 - DNA, 18 bp, Homo sapiens
aggggtgacagtggagga

SEQ ID NO: 5364102 - DNA, 14 bp, Homo sapiens
aggggtgactgaac

SEQ ID NO: 5364103 - DNA, 18 bp, Homo sapiens
aggggtgagagacctgct

SEQ ID NO: 5364104 - DNA, 21 bp, Homo sapiens
aggggtgagagacctgctcag

SEQ ID NO: 5364105 - DNA, 22 bp, Homo sapiens
aggggtgagagacctgctcagg

SEQ ID NO: 5364106 - DNA, 23 bp, Homo sapiens
aggggtgagagacctgctcaggc

SEQ ID NO: 5364107 - DNA, 15 bp, Homo sapiens
aggggtgattgaaag

SEQ ID NO: 5364108 - DNA, 19 bp, Homo sapiens
aggggtgattgaaagaaaa

SEQ ID NO: 5364109 - DNA, 16 bp, Homo sapiens
aggggtgcagaggctg

SEQ ID NO: 5364110 - DNA, 17 bp, Homo sapiens
aggggtgcagaggctgt

SEQ ID NO: 5364111 - DNA, 13 bp, Homo sapiens
aggggtgccccct

SEQ ID NO: 5364112 - DNA, 21 bp, Homo sapiens
aggggtgccccctcctctccc

SEQ ID NO: 5364113 - DNA, 21 bp, Homo sapiens
aggggtgcgctcacctgcagc

SEQ ID NO: 5364114 - DNA, 20 bp, Homo sapiens
aggggtgcggcggtcccagc

SEQ ID NO: 5364115 - DNA, 21 bp, Homo sapiens
aggggtgcggcggtcccagct

SEQ ID NO: 5364116 - DNA, 23 bp, Homo sapiens
aggggtgcggcggtcccagctcc

SEQ ID NO: 5364117 - DNA, 14 bp, Homo sapiens
aggggtgctgcctt

SEQ ID NO: 5364118 - DNA, 15 bp, Homo sapiens
aggggtgctggggca

SEQ ID NO: 5364119 - DNA, 18 bp, Homo sapiens
aggggtgctggggcagag

SEQ ID NO: 5364120 - DNA, 22 bp, Homo sapiens
aggggtgctgtggacatgtggg

SEQ ID NO: 5364121 - DNA, 15 bp, Homo sapiens
aggggtggaagggca

SEQ ID NO: 5364122 - DNA, 16 bp, Homo sapiens
aggggtggaagggcag

SEQ ID NO: 5364123 - DNA, 17 bp, Homo sapiens
aggggtggaagggcagg

SEQ ID NO: 5364124 - DNA, 23 bp, Homo sapiens
aggggtggaatgccgctgtctct

SEQ ID NO: 5364125 - DNA, 15 bp, Homo sapiens
aggggtggagactgc

SEQ ID NO: 5364126 - DNA, 17 bp, Homo sapiens
aggggtggagactgctt

SEQ ID NO: 5364127 - DNA, 21 bp, Homo sapiens
aggggtggaggagagcctggt

SEQ ID NO: 5364128 - DNA, 17 bp, Homo sapiens
aggggtggagtttctga

SEQ ID NO: 5364129 - DNA, 15 bp, Homo sapiens
aggggtggcccagag

SEQ ID NO: 5364130 - DNA, 16 bp, Homo sapiens
aggggtggcccagagc

SEQ ID NO: 5364131 - DNA, 17 bp, Homo sapiens
aggggtggcccagagcc

SEQ ID NO: 5364132 - DNA, 13 bp, Homo sapiens
aggggtgggctgg

SEQ ID NO: 5364133 - DNA, 21 bp, Homo sapiens
aggggtggggagatgcttctc

SEQ ID NO: 5364134 - DNA, 18 bp, Homo sapiens
aggggtggggggtgcagg

SEQ ID NO: 5364135 - DNA, 21 bp, Homo sapiens
aggggtggggggtgcaggtgg

SEQ ID NO: 5364136 - DNA, 20 bp, Homo sapiens
aggggtgggggtgccgctct

SEQ ID NO: 5364137 - DNA, 22 bp, Homo sapiens
aggggtgggggtgccgctgtct

SEQ ID NO: 5364138 - DNA, 11 bp, Homo sapiens
aggggtggtac

SEQ ID NO: 5364139 - DNA, 24 bp, Homo sapiens
aggggtggtggggggcagggccac

SEQ ID NO: 5364140 - DNA, 21 bp, Homo sapiens
aggggtggtgtccttctcctc

SEQ ID NO: 5364141 - DNA, 19 bp, Homo sapiens
aggggtgtccgagaggctg

SEQ ID NO: 5364142 - DNA, 18 bp, Homo sapiens
aggggtgtgattggagtg

SEQ ID NO: 5364143 - DNA, 16 bp, Homo sapiens
aggggtgtggcagtgg

SEQ ID NO: 5364144 - DNA, 15 bp, Homo sapiens
aggggtgtggctcct

SEQ ID NO: 5364145 - DNA, 16 bp, Homo sapiens
aggggtgttaaaacat

SEQ ID NO: 5364146 - DNA, 13 bp, Homo sapiens
aggggtgtttggg

SEQ ID NO: 5364147 - DNA, 23 bp, Homo sapiens
aggggtgtttgggagctgctggg

SEQ ID NO: 5364148 - DNA, 21 bp, Homo sapiens
aggggtgtttgtgtgtgtgcg

SEQ ID NO: 5364149 - DNA, 23 bp, Homo sapiens
aggggttaacttggtcagagcca

SEQ ID NO: 5364150 - DNA, 24 bp, Homo sapiens
aggggttaatttatcagtacatga

SEQ ID NO: 5364151 - DNA, 18 bp, Homo sapiens
aggggttaccatgtatca

SEQ ID NO: 5364152 - DNA, 15 bp, Homo sapiens
aggggttcattctcc

SEQ ID NO: 5364153 - DNA, 17 bp, Homo sapiens
aggggttcattctcccg

SEQ ID NO: 5364154 - DNA, 17 bp, Homo sapiens
aggggttccagcttccc

SEQ ID NO: 5364155 - DNA, 23 bp, Homo sapiens
aggggttcccttgagggctgcag

SEQ ID NO: 5364156 - DNA, 15 bp, Homo sapiens
aggggttcctcccct

SEQ ID NO: 5364157 - DNA, 21 bp, Homo sapiens
aggggttcctcccctccagct

SEQ ID NO: 5364158 - DNA, 19 bp, Homo sapiens
aggggttccttccacttct

SEQ ID NO: 5364159 - DNA, 21 bp, Homo sapiens
aggggttctatttattcctgt

SEQ ID NO: 5364160 - DNA, 23 bp, Homo sapiens
aggggttctgagaagcgctgccc

SEQ ID NO: 5364161 - DNA, 20 bp, Homo sapiens
aggggttcttgagccagcca

SEQ ID NO: 5364162 - DNA, 14 bp, Homo sapiens
aggggttgaagaaa

SEQ ID NO: 5364163 - DNA, 23 bp, Homo sapiens
aggggttgagcagggatcctggt

SEQ ID NO: 5364164 - DNA, 23 bp, Homo sapiens
aggggttgccacaggcctccctg

SEQ ID NO: 5364165 - DNA, 21 bp, Homo sapiens
aggggttggtatctcaggtct

SEQ ID NO: 5364166 - DNA, 20 bp, Homo sapiens
aggggttggtcaaggccacc

SEQ ID NO: 5364167 - DNA, 20 bp, Homo sapiens
aggggttggttgaggtggaa

SEQ ID NO: 5364168 - DNA, 14 bp, Homo sapiens
aggggttgttttgg

SEQ ID NO: 5364169 - DNA, 21 bp, Homo sapiens
aggggtttgccatttgatacc

SEQ ID NO: 5364170 - DNA, 23 bp, Homo sapiens
aggggttttcccatgactcttgg

SEQ ID NO: 5364171 - DNA, 21 bp, Homo sapiens
aggggttttcttgataatttt

SEQ ID NO: 5364172 - DNA, 21 bp, Homo sapiens
agggtaaattataaatgtttc

SEQ ID NO: 5364173 - DNA, 17 bp, Homo sapiens
agggtaaattattcagt

SEQ ID NO: 5364174 - DNA, 16 bp, Homo sapiens
agggtaactggggggc

SEQ ID NO: 5364175 - DNA, 21 bp, Homo sapiens
agggtaactggggggccacca

SEQ ID NO: 5364176 - DNA, 17 bp, Homo sapiens
agggtaagaagtttgtg

SEQ ID NO: 5364177 - DNA, 20 bp, Homo sapiens
agggtaagctgctctgaggt

SEQ ID NO: 5364178 - DNA, 21 bp, Homo sapiens
agggtaagggagagggaggga

SEQ ID NO: 5364179 - DNA, 21 bp, Homo sapiens
agggtaatttcctttgcttca

SEQ ID NO: 5364180 - DNA, 21 bp, Homo sapiens
agggtacaaaaaattcagtga

SEQ ID NO: 5364181 - DNA, 17 bp, Homo sapiens
agggtacagcccaggcg

SEQ ID NO: 5364182 - DNA, 17 bp, Homo sapiens
agggtacatggtgctgg

SEQ ID NO: 5364183 - DNA, 12 bp, Homo sapiens
agggtacatgtg

SEQ ID NO: 5364184 - DNA, 19 bp, Homo sapiens
agggtaccttgaacactgg

SEQ ID NO: 5364185 - DNA, 23 bp, Homo sapiens
agggtaccttgaacactggggga

SEQ ID NO: 5364186 - DNA, 18 bp, Homo sapiens
agggtactaaaagaaact

SEQ ID NO: 5364187 - DNA, 19 bp, Homo sapiens
agggtagaatgattaatca

SEQ ID NO: 5364188 - DNA, 16 bp, Homo sapiens
agggtagacaggggcg

SEQ ID NO: 5364189 - DNA, 23 bp, Homo sapiens
agggtagccccctcatctgcagg

SEQ ID NO: 5364190 - DNA, 14 bp, Homo sapiens
agggtagcccgcct

SEQ ID NO: 5364191 - DNA, 16 bp, Homo sapiens
agggtagcccgcctgc

SEQ ID NO: 5364192 - DNA, 14 bp, Homo sapiens
agggtagccttgat

SEQ ID NO: 5364193 - DNA, 14 bp, Homo sapiens
agggtagctgggcg

SEQ ID NO: 5364194 - DNA, 13 bp, Homo sapiens
agggtaggaaagg

SEQ ID NO: 5364195 - DNA, 16 bp, Homo sapiens
agggtaggaccctcat

SEQ ID NO: 5364196 - DNA, 17 bp, Homo sapiens
agggtaggcaaggctgc

SEQ ID NO: 5364197 - DNA, 13 bp, Homo sapiens
agggtaggcagga

SEQ ID NO: 5364198 - DNA, 16 bp, Homo sapiens
agggtaggctggagtt

SEQ ID NO: 5364199 - DNA, 14 bp, Homo sapiens
agggtaggggaagt

SEQ ID NO: 5364200 - DNA, 22 bp, Homo sapiens
agggtaggggaagtgtgctgag

SEQ ID NO: 5364201 - DNA, 17 bp, Homo sapiens
agggtaggggagggtgg

SEQ ID NO: 5364202 - DNA, 15 bp, Homo sapiens
agggtagtggctggg

SEQ ID NO: 5364203 - DNA, 18 bp, Homo sapiens
agggtagtggctggggtg

SEQ ID NO: 5364204 - DNA, 17 bp, Homo sapiens
agggtatattttcctat

SEQ ID NO: 5364205 - DNA, 21 bp, Homo sapiens
agggtatattttcctatatta

SEQ ID NO: 5364206 - DNA, 21 bp, Homo sapiens
agggtatccaagttggactgg

SEQ ID NO: 5364207 - DNA, 22 bp, Homo sapiens
agggtatccaagttggactggg

SEQ ID NO: 5364208 - DNA, 16 bp, Homo sapiens
agggtatcccagaccc

SEQ ID NO: 5364209 - DNA, 23 bp, Homo sapiens
agggtatctgctgcctctgaaaa

SEQ ID NO: 5364210 - DNA, 15 bp, Homo sapiens
agggtatctggtgac

SEQ ID NO: 5364211 - DNA, 15 bp, Homo sapiens
agggtatgaagagtg

SEQ ID NO: 5364212 - DNA, 15 bp, Homo sapiens
agggtatgagctgga

SEQ ID NO: 5364213 - DNA, 19 bp, Homo sapiens
agggtatgagctggagcta

SEQ ID NO: 5364214 - DNA, 15 bp, Homo sapiens
agggtatgatccttg

SEQ ID NO: 5364215 - DNA, 21 bp, Homo sapiens
agggtatgatccttgttttaa

SEQ ID NO: 5364216 - DNA, 21 bp, Homo sapiens
agggtatggactatctgtctg

SEQ ID NO: 5364217 - DNA, 14 bp, Homo sapiens
agggtatttgaccc

SEQ ID NO: 5364218 - DNA, 19 bp, Homo sapiens
agggtcaaagacagaatgg

SEQ ID NO: 5364219 - DNA, 14 bp, Homo sapiens
agggtcaaagtaca

SEQ ID NO: 5364220 - DNA, 15 bp, Homo sapiens
agggtcaccctggcc

SEQ ID NO: 5364221 - DNA, 15 bp, Homo sapiens
agggtcagaaacagg

SEQ ID NO: 5364222 - DNA, 21 bp, Homo sapiens
agggtcagagaggagtcagag

SEQ ID NO: 5364223 - DNA, 14 bp, Homo sapiens
agggtcagcagtgg

SEQ ID NO: 5364224 - DNA, 21 bp, Homo sapiens
agggtcaggaaggatgagcat

SEQ ID NO: 5364225 - DNA, 22 bp, Homo sapiens
agggtcaggaaggatgagcatt

SEQ ID NO: 5364226 - DNA, 18 bp, Homo sapiens
agggtcaggagaggggca

SEQ ID NO: 5364227 - DNA, 12 bp, Homo sapiens
agggtcaggccc

SEQ ID NO: 5364228 - DNA, 22 bp, Homo sapiens
agggtcatatcactcaggccct

SEQ ID NO: 5364229 - DNA, 15 bp, Homo sapiens
agggtcatgtacttc

SEQ ID NO: 5364230 - DNA, 16 bp, Homo sapiens
agggtcatgtttgcag

SEQ ID NO: 5364231 - DNA, 18 bp, Homo sapiens
agggtcattatcagaaca

SEQ ID NO: 5364232 - DNA, 17 bp, Homo sapiens
agggtccaacatagagc

SEQ ID NO: 5364233 - DNA, 18 bp, Homo sapiens
agggtccaaccagacctg

SEQ ID NO: 5364234 - DNA, 18 bp, Homo sapiens
agggtccaatcctaggac

SEQ ID NO: 5364235 - DNA, 19 bp, Homo sapiens
agggtccacagctggaaag

SEQ ID NO: 5364236 - DNA, 14 bp, Homo sapiens
agggtccacctgga

SEQ ID NO: 5364237 - DNA, 15 bp, Homo sapiens
agggtccacctggag

SEQ ID NO: 5364238 - DNA, 21 bp, Homo sapiens
agggtccagaaggagacaggc

SEQ ID NO: 5364239 - DNA, 14 bp, Homo sapiens
agggtccagccctc

SEQ ID NO: 5364240 - DNA, 15 bp, Homo sapiens
agggtccaggaatgg

SEQ ID NO: 5364241 - DNA, 17 bp, Homo sapiens
agggtccatatgaggga

SEQ ID NO: 5364242 - DNA, 13 bp, Homo sapiens
agggtcccacccc

SEQ ID NO: 5364243 - DNA, 14 bp, Homo sapiens
agggtcccagggct

SEQ ID NO: 5364244 - DNA, 15 bp, Homo sapiens
agggtcccattgtgc

SEQ ID NO: 5364245 - DNA, 18 bp, Homo sapiens
agggtcccattgtgcaga

SEQ ID NO: 5364246 - DNA, 15 bp, Homo sapiens
agggtccccacctgg

SEQ ID NO: 5364247 - DNA, 18 bp, Homo sapiens
agggtccccacctgggac

SEQ ID NO: 5364248 - DNA, 23 bp, Homo sapiens
agggtcccccactctaaagcaaa

SEQ ID NO: 5364249 - DNA, 20 bp, Homo sapiens
agggtcccccttcgtggagc

SEQ ID NO: 5364250 - DNA, 22 bp, Homo sapiens
agggtccccgggagcacacgaa

SEQ ID NO: 5364251 - DNA, 15 bp, Homo sapiens
agggtcccctcccca

SEQ ID NO: 5364252 - DNA, 13 bp, Homo sapiens
agggtcccctgca

SEQ ID NO: 5364253 - DNA, 16 bp, Homo sapiens
agggtcccctgccacc

SEQ ID NO: 5364254 - DNA, 22 bp, Homo sapiens
agggtccctaggtgggtcaact

SEQ ID NO: 5364255 - DNA, 15 bp, Homo sapiens
agggtccctgcccac

SEQ ID NO: 5364256 - DNA, 12 bp, Homo sapiens
agggtccctggt

SEQ ID NO: 5364257 - DNA, 15 bp, Homo sapiens
agggtccgcaccagc

SEQ ID NO: 5364258 - DNA, 19 bp, Homo sapiens
agggtgggagggaggaggg

SEQ ID NO: 5364259 - DNA, 15 bp, Homo sapiens
agggtgggagtgggc

SEQ ID NO: 5364260 - DNA, 17 bp, Homo sapiens
agggtgggagtggggcc

SEQ ID NO: 5364261 - DNA, 14 bp, Homo sapiens
agggtgggcagcct

SEQ ID NO: 5364262 - DNA, 18 bp, Homo sapiens
agggtgggccactctccc

SEQ ID NO: 5364263 - DNA, 22 bp, Homo sapiens
agggtgggccactctcccctcc

SEQ ID NO: 5364264 - DNA, 20 bp, Homo sapiens
agggtgggccccagccgtgg

SEQ ID NO: 5364265 - DNA, 12 bp, Homo sapiens
agggtgggccct

SEQ ID NO: 5364266 - DNA, 14 bp, Homo sapiens
agggtgggccctgg

SEQ ID NO: 5364267 - DNA, 16 bp, Homo sapiens
agggtgggccctggag

SEQ ID NO: 5364268 - DNA, 17 bp, Homo sapiens
agggtgggccctggagg

SEQ ID NO: 5364269 - DNA, 12 bp, Homo sapiens
agggtgggcgtg

SEQ ID NO: 5364270 - DNA, 22 bp, Homo sapiens
agggtgggcgtgacttcagact

SEQ ID NO: 5364271 - DNA, 19 bp, Homo sapiens
agggtgggcgtttggggcc

SEQ ID NO: 5364272 - DNA, 22 bp, Homo sapiens
agggtgggcttgtggggcctgg

SEQ ID NO: 5364273 - DNA, 19 bp, Homo sapiens
agggtgggcttttccctgg

SEQ ID NO: 5364274 - DNA, 20 bp, Homo sapiens
agggtgggcttttccctggg

SEQ ID NO: 5364275 - DNA, 24 bp, Homo sapiens
agggtggggcaatggggagaggca

SEQ ID NO: 5364276 - DNA, 12 bp, Homo sapiens
agggtggggccg

SEQ ID NO: 5364277 - DNA, 17 bp, Homo sapiens
agggtgggggccacctg

SEQ ID NO: 5364278 - DNA, 19 bp, Homo sapiens
agggtgggggccacctgcc

SEQ ID NO: 5364279 - DNA, 21 bp, Homo sapiens
agggtgggggccacctgcctg

SEQ ID NO: 5364280 - DNA, 21 bp, Homo sapiens
agggtggggggggggcgcggc

SEQ ID NO: 5364281 - DNA, 21 bp, Homo sapiens
agggtgggggtgctctctctg

SEQ ID NO: 5364282 - DNA, 17 bp, Homo sapiens
agggtggggtgccccag

SEQ ID NO: 5364283 - DNA, 19 bp, Homo sapiens
agggtggggtgccccagct

SEQ ID NO: 5364284 - DNA, 20 bp, Homo sapiens
agggtgggtgagctctcagg

SEQ ID NO: 5364285 - DNA, 17 bp, Homo sapiens
agggtgggtgctcagaa

SEQ ID NO: 5364286 - DNA, 17 bp, Homo sapiens
agggtggtctgagcacc

SEQ ID NO: 5364287 - DNA, 19 bp, Homo sapiens
agggtggtcttcaagcctg

SEQ ID NO: 5364288 - DNA, 17 bp, Homo sapiens
agggtggtggggacagg

SEQ ID NO: 5364289 - DNA, 20 bp, Homo sapiens
agggtggttcaacaaagaaa

SEQ ID NO: 5364290 - DNA, 14 bp, Homo sapiens
agggtggttcctgt

SEQ ID NO: 5364291 - DNA, 15 bp, Homo sapiens
agggtggttcctgtt

SEQ ID NO: 5364292 - DNA, 16 bp, Homo sapiens
agggtgtatagtgttc

SEQ ID NO: 5364293 - DNA, 20 bp, Homo sapiens
agggtgtatagtgttcacaa

SEQ ID NO: 5364294 - DNA, 22 bp, Homo sapiens
agggtgtccggtccctgtccca

SEQ ID NO: 5364295 - DNA, 17 bp, Homo sapiens
agggtgtcggctgtgag

SEQ ID NO: 5364296 - DNA, 18 bp, Homo sapiens
agggtgtcggctgtgagg

SEQ ID NO: 5364297 - DNA, 15 bp, Homo sapiens
agggtgtctgccccc

SEQ ID NO: 5364298 - DNA, 21 bp, Homo sapiens
agggtgtctgccccctcctga

SEQ ID NO: 5364299 - DNA, 16 bp, Homo sapiens
agggtgtgagggatgg

SEQ ID NO: 5364300 - DNA, 23 bp, Homo sapiens
agggtgtgatttaggtcagtaga

SEQ ID NO: 5364301 - DNA, 17 bp, Homo sapiens
agggtgtggcatttgga

SEQ ID NO: 5364302 - DNA, 22 bp, Homo sapiens
agggtgtggccctgccatcttc

SEQ ID NO: 5364303 - DNA, 15 bp, Homo sapiens
agggtgtggcttgga

SEQ ID NO: 5364304 - DNA, 22 bp, Homo sapiens
agggtgtggggccatgcctcct

SEQ ID NO: 5364305 - DNA, 19 bp, Homo sapiens
agggtgtgggtcagggagg

SEQ ID NO: 5364306 - DNA, 20 bp, Homo sapiens
agggtgtggtatgagggggt

SEQ ID NO: 5364307 - DNA, 23 bp, Homo sapiens
agggtgtggtatgagggggtggt

SEQ ID NO: 5364308 - DNA, 11 bp, Homo sapiens
agggtgtgtga

SEQ ID NO: 5364309 - DNA, 19 bp, Homo sapiens
agggtgtgtgttcaccttc

SEQ ID NO: 5364310 - DNA, 17 bp, Homo sapiens
agggtgttcagaggcag

SEQ ID NO: 5364311 - DNA, 14 bp, Homo sapiens
agggtgtttatgta

SEQ ID NO: 5364312 - DNA, 16 bp, Homo sapiens
agggtgtttcctctaa

SEQ ID NO: 5364313 - DNA, 16 bp, Homo sapiens
agggtgtttgcagctg

SEQ ID NO: 5364314 - DNA, 16 bp, Homo sapiens
agggttaaagaaaggc

SEQ ID NO: 5364315 - DNA, 18 bp, Homo sapiens
agggttaatcatatttga

SEQ ID NO: 5364316 - DNA, 20 bp, Homo sapiens
agggttacagagacctatgt

SEQ ID NO: 5364317 - DNA, 14 bp, Homo sapiens
agggttaccccacc

SEQ ID NO: 5364318 - DNA, 17 bp, Homo sapiens
agggttagacaagcctg

SEQ ID NO: 5364319 - DNA, 19 bp, Homo sapiens
agggttagacaagcctgga

SEQ ID NO: 5364320 - DNA, 15 bp, Homo sapiens
agggttagggagggg

SEQ ID NO: 5364321 - DNA, 16 bp, Homo sapiens
agggttagggaggggt

SEQ ID NO: 5364322 - DNA, 18 bp, Homo sapiens
agggttatacacagaaaa

SEQ ID NO: 5364323 - DNA, 14 bp, Homo sapiens
agggttatatttgg

SEQ ID NO: 5364324 - DNA, 15 bp, Homo sapiens
agggttatattttac

SEQ ID NO: 5364325 - DNA, 18 bp, Homo sapiens
agggttcaaaatgtctgt

SEQ ID NO: 5364326 - DNA, 17 bp, Homo sapiens
agggttcaagccttcca

SEQ ID NO: 5364327 - DNA, 18 bp, Homo sapiens
agggttcacacagcccag

SEQ ID NO: 5364328 - DNA, 19 bp, Homo sapiens
agggttcacacagcccagt

SEQ ID NO: 5364329 - DNA, 18 bp, Homo sapiens
agggttcatcatccctcc

SEQ ID NO: 5364330 - DNA, 23 bp, Homo sapiens
agggttcatcatccctccctgcc

SEQ ID NO: 5364331 - DNA, 17 bp, Homo sapiens
agggttccactggagaa

SEQ ID NO: 5364332 - DNA, 14 bp, Homo sapiens
agggttccagacag

SEQ ID NO: 5364333 - DNA, 12 bp, Homo sapiens
agggttcccctg

SEQ ID NO: 5364334 - DNA, 17 bp, Homo sapiens
agggttcccgcggggct

SEQ ID NO: 5364335 - DNA, 19 bp, Homo sapiens
agggttcccgcggggctgt

SEQ ID NO: 5364336 - DNA, 19 bp, Homo sapiens
agggttctaaatgcaataa

SEQ ID NO: 5364337 - DNA, 19 bp, Homo sapiens
agggttctatatttactgt

SEQ ID NO: 5364338 - DNA, 20 bp, Homo sapiens
agggttctgccctgcctgag

SEQ ID NO: 5364339 - DNA, 23 bp, Homo sapiens
agggttctgcttttaagtttttc

SEQ ID NO: 5364340 - DNA, 18 bp, Homo sapiens
agggttgaaaatgtgttt

SEQ ID NO: 5364341 - DNA, 22 bp, Homo sapiens
agggttgaagacggaaaacaat

SEQ ID NO: 5364342 - DNA, 19 bp, Homo sapiens
agggttgatatattctttc

SEQ ID NO: 5364343 - DNA, 14 bp, Homo sapiens
agggttgctggtcc

SEQ ID NO: 5364344 - DNA, 21 bp, Homo sapiens
agggttgctggtcctgcacat

SEQ ID NO: 5364345 - DNA, 16 bp, Homo sapiens
agggttgcttgcttgc

SEQ ID NO: 5364346 - DNA, 14 bp, Homo sapiens
agggttggagcagt

SEQ ID NO: 5364347 - DNA, 18 bp, Homo sapiens
agggttggcacctgcaca

SEQ ID NO: 5364348 - DNA, 14 bp, Homo sapiens
agggttggcccctg

SEQ ID NO: 5364349 - DNA, 18 bp, Homo sapiens
agggttggcccctgcccg

SEQ ID NO: 5364350 - DNA, 23 bp, Homo sapiens
agggttgggttcatctgagcaag

SEQ ID NO: 5364351 - DNA, 23 bp, Homo sapiens
agggttggtgggctggcccagcc

SEQ ID NO: 5364352 - DNA, 22 bp, Homo sapiens
agggttgtactattgtttaaaa

SEQ ID NO: 5364353 - DNA, 22 bp, Homo sapiens
agggttgtgattttgtctgctt

SEQ ID NO: 5364354 - DNA, 13 bp, Homo sapiens
agggttgtgccca

SEQ ID NO: 5364355 - DNA, 21 bp, Homo sapiens
agggttgttaatggtgcaaat

SEQ ID NO: 5364356 - DNA, 16 bp, Homo sapiens
agggtttaatagactg

SEQ ID NO: 5364357 - DNA, 19 bp, Homo sapiens
agggtttagccgggcccca

SEQ ID NO: 5364358 - DNA, 17 bp, Homo sapiens
agggtttcagagagcct

SEQ ID NO: 5364359 - DNA, 15 bp, Homo sapiens
agggtttcattgtct

SEQ ID NO: 5364360 - DNA, 21 bp, Homo sapiens
agggtttccctactgaagccc

SEQ ID NO: 5364361 - DNA, 20 bp, Homo sapiens
agggtttcgactggtccagc

SEQ ID NO: 5364362 - DNA, 14 bp, Homo sapiens
agggtttctctccc

SEQ ID NO: 5364363 - DNA, 16 bp, Homo sapiens
agggtttctctgcaga

SEQ ID NO: 5364364 - DNA, 11 bp, Homo sapiens
agggtttctga

SEQ ID NO: 5364365 - DNA, 22 bp, Homo sapiens
agggtttgagagagcagccagg

SEQ ID NO: 5364366 - DNA, 16 bp, Homo sapiens
agggtttgagagcccg

SEQ ID NO: 5364367 - DNA, 14 bp, Homo sapiens
agggtttgagcaca

SEQ ID NO: 5364368 - DNA, 23 bp, Homo sapiens
agggtttggaagaaagggagaag

SEQ ID NO: 5364369 - DNA, 15 bp, Homo sapiens
agggtttggacagac

SEQ ID NO: 5364370 - DNA, 21 bp, Homo sapiens
agggtttggctgtgtctaaac

SEQ ID NO: 5364371 - DNA, 22 bp, Homo sapiens
agggtttggctgtgtctaaact

SEQ ID NO: 5364372 - DNA, 18 bp, Homo sapiens
agggtttgtaatggtgct

SEQ ID NO: 5364373 - DNA, 14 bp, Homo sapiens
agggtttgtgccca

SEQ ID NO: 5364374 - DNA, 15 bp, Homo sapiens
agggttttccaccct

SEQ ID NO: 5364375 - DNA, 15 bp, Homo sapiens
agggttttgcaataa

SEQ ID NO: 5364376 - DNA, 23 bp, Homo sapiens
agggttttgccatgttggccagg

SEQ ID NO: 5364377 - DNA, 15 bp, Homo sapiens
agggttttggcctgc

SEQ ID NO: 5364378 - DNA, 11 bp, Homo sapiens
agggttttgta

SEQ ID NO: 5364379 - DNA, 22 bp, Homo sapiens
agggtttttacctgtcacattg

SEQ ID NO: 5364380 - DNA, 19 bp, Homo sapiens
agggttttttcttctttct

SEQ ID NO: 5364381 - DNA, 20 bp, Homo sapiens
agggttttttcttctttctt

SEQ ID NO: 5364382 - DNA, 14 bp, Homo sapiens
agggttttttttaa

SEQ ID NO: 5364383 - DNA, 16 bp, Homo sapiens
agggttttttttaatg

SEQ ID NO: 5364384 - DNA, 21 bp, Homo sapiens
agggttttttttaatgtgaat

SEQ ID NO: 5364385 - DNA, 21 bp, Homo sapiens
agggttttttttttttccttt

SEQ ID NO: 5364386 - DNA, 14 bp, Homo sapiens
aggtaaaaaaaaga

SEQ ID NO: 5364387 - DNA, 21 bp, Homo sapiens
aggtaaaaaaaagaagtgtgc

SEQ ID NO: 5364388 - DNA, 17 bp, Homo sapiens
aggtaaaacaactacat

SEQ ID NO: 5364389 - DNA, 14 bp, Homo sapiens
aggtaaaacagggc

SEQ ID NO: 5364390 - DNA, 20 bp, Homo sapiens
aggtaaaagagccaagttca

SEQ ID NO: 5364391 - DNA, 20 bp, Homo sapiens
aggtaaaagcatcacatgaa

SEQ ID NO: 5364392 - DNA, 19 bp, Homo sapiens
aggtaaaatattttccaaa

SEQ ID NO: 5364393 - DNA, 14 bp, Homo sapiens
aggtaaaatcactt

SEQ ID NO: 5364394 - DNA, 13 bp, Homo sapiens
aggtaaaatgcca

SEQ ID NO: 5364395 - DNA, 16 bp, Homo sapiens
aggtaaaatgccatga

SEQ ID NO: 5364396 - DNA, 14 bp, Homo sapiens
aggtaaaatgtagc

SEQ ID NO: 5364397 - DNA, 23 bp, Homo sapiens
aggtaaaatttgcacacaaaaca

SEQ ID NO: 5364398 - DNA, 14 bp, Homo sapiens
aggtaaacaaagac

SEQ ID NO: 5364399 - DNA, 12 bp, Homo sapiens
aggtaaagatat

SEQ ID NO: 5364400 - DNA, 22 bp, Homo sapiens
aggtaaagggtggggcattgag

SEQ ID NO: 5364401 - DNA, 13 bp, Homo sapiens
aggtaaatacaag

SEQ ID NO: 5364402 - DNA, 23 bp, Homo sapiens
aggtaaatcagactatgaagttt

SEQ ID NO: 5364403 - DNA, 14 bp, Homo sapiens
aggtaaatcccaca

SEQ ID NO: 5364404 - DNA, 23 bp, Homo sapiens
aggtaaatctagagtttatacag

SEQ ID NO: 5364405 - DNA, 14 bp, Homo sapiens
aggtaaatggttaa

SEQ ID NO: 5364406 - DNA, 18 bp, Homo sapiens
aggtaaatggttaaattt

SEQ ID NO: 5364407 - DNA, 23 bp, Homo sapiens
aggtaacaagatgagaacagata

SEQ ID NO: 5364408 - DNA, 13 bp, Homo sapiens
aggtaacagaaca

SEQ ID NO: 5364409 - DNA, 15 bp, Homo sapiens
aggtaacagaacagc

SEQ ID NO: 5364410 - DNA, 16 bp, Homo sapiens
aggtaacaggcagata

SEQ ID NO: 5364411 - DNA, 14 bp, Homo sapiens
aggtaacagttata

SEQ ID NO: 5364412 - DNA, 20 bp, Homo sapiens
aggtaacatagatgcctggg

SEQ ID NO: 5364413 - DNA, 23 bp, Homo sapiens
aggtaaccttatatttacaataa

SEQ ID NO: 5364414 - DNA, 23 bp, Homo sapiens
aggtaacgtattggacctgccca

SEQ ID NO: 5364415 - DNA, 19 bp, Homo sapiens
aggtaactaactgcataca

SEQ ID NO: 5364416 - DNA, 18 bp, Homo sapiens
aggtaactaggtaactta

SEQ ID NO: 5364417 - DNA, 20 bp, Homo sapiens
aggtaactatcaatatttaa

SEQ ID NO: 5364418 - DNA, 20 bp, Homo sapiens
aggtaactgagagcagatgg

SEQ ID NO: 5364419 - DNA, 13 bp, Homo sapiens
aggtaactggctt

SEQ ID NO: 5364420 - DNA, 19 bp, Homo sapiens
aggtaacttattagaaacc

SEQ ID NO: 5364421 - DNA, 13 bp, Homo sapiens
aggtaactttgaa

SEQ ID NO: 5364422 - DNA, 17 bp, Homo sapiens
aggtaagctgtgccttc

SEQ ID NO: 5364423 - DNA, 13 bp, Homo sapiens
aggtaagtggaat

SEQ ID NO: 5364424 - DNA, 15 bp, Homo sapiens
aggtaagtggcagga

SEQ ID NO: 5364425 - DNA, 20 bp, Homo sapiens
aggtaagttgctattttcat

SEQ ID NO: 5364426 - DNA, 20 bp, Homo sapiens
aggtaataacattttataca

SEQ ID NO: 5364427 - DNA, 21 bp, Homo sapiens
aggtaataggaagaacagtac

SEQ ID NO: 5364428 - DNA, 18 bp, Homo sapiens
aggtaatataaaaagctt

SEQ ID NO: 5364429 - DNA, 20 bp, Homo sapiens
aggtaatatacctggtttac

SEQ ID NO: 5364430 - DNA, 18 bp, Homo sapiens
aggtaatcaatgaatatt

SEQ ID NO: 5364431 - DNA, 14 bp, Homo sapiens
aggtaatcattcca

SEQ ID NO: 5364432 - DNA, 21 bp, Homo sapiens
aggtaatccaagatattttaa

SEQ ID NO: 5364433 - DNA, 19 bp, Homo sapiens
aggtaatcgacctgcctcg

SEQ ID NO: 5364434 - DNA, 21 bp, Homo sapiens
aggtcaaggctgcagtgagcc

SEQ ID NO: 5364435 - DNA, 18 bp, Homo sapiens
aggtcaagtaagaagaca

SEQ ID NO: 5364436 - DNA, 19 bp, Homo sapiens
aggtcaagtaagaagacat

SEQ ID NO: 5364437 - DNA, 21 bp, Homo sapiens
aggtcaagttcatagtttctg

SEQ ID NO: 5364438 - DNA, 23 bp, Homo sapiens
aggtcaagttcatagtttctgta

SEQ ID NO: 5364439 - DNA, 14 bp, Homo sapiens
aggtcaataaagca

SEQ ID NO: 5364440 - DNA, 15 bp, Homo sapiens
aggtcaataaagcag

SEQ ID NO: 5364441 - DNA, 16 bp, Homo sapiens
aggtcaataaagcaga

SEQ ID NO: 5364442 - DNA, 20 bp, Homo sapiens
aggtcaataaagcagagcca

SEQ ID NO: 5364443 - DNA, 23 bp, Homo sapiens
aggtcaataaagcagagccaagg

SEQ ID NO: 5364444 - DNA, 21 bp, Homo sapiens
aggtcaatgccagagacggaa

SEQ ID NO: 5364445 - DNA, 19 bp, Homo sapiens
aggtcaatgtcaagagagg

SEQ ID NO: 5364446 - DNA, 23 bp, Homo sapiens
aggtcacagctggatctgcttgt

SEQ ID NO: 5364447 - DNA, 17 bp, Homo sapiens
aggtcacatagctggga

SEQ ID NO: 5364448 - DNA, 16 bp, Homo sapiens
aggtcaccagcctgac

SEQ ID NO: 5364449 - DNA, 18 bp, Homo sapiens
aggtcaccagcctgactg

SEQ ID NO: 5364450 - DNA, 12 bp, Homo sapiens
aggtcaccagct

SEQ ID NO: 5364451 - DNA, 17 bp, Homo sapiens
aggtcaccagctgctgt

SEQ ID NO: 5364452 - DNA, 18 bp, Homo sapiens
aggtcaccaggggaggag

SEQ ID NO: 5364453 - DNA, 14 bp, Homo sapiens
aggtcaccatcctc

SEQ ID NO: 5364454 - DNA, 21 bp, Homo sapiens
aggtcaccatcctcagaggct

SEQ ID NO: 5364455 - DNA, 22 bp, Homo sapiens
aggtcaccatcctcagaggctg

SEQ ID NO: 5364456 - DNA, 15 bp, Homo sapiens
aggtcacccatcagg

SEQ ID NO: 5364457 - DNA, 19 bp, Homo sapiens
aggtcacctcactcagcac

SEQ ID NO: 5364458 - DNA, 20 bp, Homo sapiens
aggtcacctcactcagcacc

SEQ ID NO: 5364459 - DNA, 21 bp, Homo sapiens
aggtcacctcactcagcacca

SEQ ID NO: 5364460 - DNA, 23 bp, Homo sapiens
aggtcacctcactcagcaccact

SEQ ID NO: 5364461 - DNA, 23 bp, Homo sapiens
aggtcacctgccgccctgtggga

SEQ ID NO: 5364462 - DNA, 19 bp, Homo sapiens
aggtcactagatggcgagc

SEQ ID NO: 5364463 - DNA, 19 bp, Homo sapiens
aggtcactcgtggtgaggc

SEQ ID NO: 5364464 - DNA, 21 bp, Homo sapiens
aggtcactcgtggtgaggctg

SEQ ID NO: 5364465 - DNA, 13 bp, Homo sapiens
aggtcactctcca

SEQ ID NO: 5364466 - DNA, 16 bp, Homo sapiens
aggtcactctgggcct

SEQ ID NO: 5364467 - DNA, 19 bp, Homo sapiens
aggtcactcttggtccctg

SEQ ID NO: 5364468 - DNA, 14 bp, Homo sapiens
aggtcacttgaagc

SEQ ID NO: 5364469 - DNA, 19 bp, Homo sapiens
aggtcacttgaagccaaac

SEQ ID NO: 5364470 - DNA, 23 bp, Homo sapiens
aggtcacttgatcatgctgcagt

SEQ ID NO: 5364471 - DNA, 18 bp, Homo sapiens
aggtcagaagagggagag

SEQ ID NO: 5364472 - DNA, 23 bp, Homo sapiens
aggtcagactgaaacgccttgca

SEQ ID NO: 5364473 - DNA, 14 bp, Homo sapiens
aggtcagagcccag

SEQ ID NO: 5364474 - DNA, 13 bp, Homo sapiens
aggtcagagcctg

SEQ ID NO: 5364475 - DNA, 18 bp, Homo sapiens
aggtcagagcctgcagtt

SEQ ID NO: 5364476 - DNA, 17 bp, Homo sapiens
aggtcagcaaaggtctt

SEQ ID NO: 5364477 - DNA, 16 bp, Homo sapiens
aggtcagcatgtctat

SEQ ID NO: 5364478 - DNA, 12 bp, Homo sapiens
aggtcagccctg

SEQ ID NO: 5364479 - DNA, 16 bp, Homo sapiens
aggtcagccctgtgtc

SEQ ID NO: 5364480 - DNA, 17 bp, Homo sapiens
aggtcagccctgtgtct

SEQ ID NO: 5364481 - DNA, 17 bp, Homo sapiens
aggtcagcgagaaggag

SEQ ID NO: 5364482 - DNA, 13 bp, Homo sapiens
aggtcagctggga

SEQ ID NO: 5364483 - DNA, 14 bp, Homo sapiens
aggtcagctgggag

SEQ ID NO: 5364484 - DNA, 17 bp, Homo sapiens
aggtcagctgggagcca

SEQ ID NO: 5364485 - DNA, 19 bp, Homo sapiens
aggtcagctgggagccagt

SEQ ID NO: 5364486 - DNA, 18 bp, Homo sapiens
aggtcagcttgctgccct

SEQ ID NO: 5364487 - DNA, 12 bp, Homo sapiens
aggtcaggaaac

SEQ ID NO: 5364488 - DNA, 16 bp, Homo sapiens
aggtcaggaccaggac

SEQ ID NO: 5364489 - DNA, 16 bp, Homo sapiens
aggtcaggacggctcc

SEQ ID NO: 5364490 - DNA, 22 bp, Homo sapiens
aggtcaggagttcaagaccagc

SEQ ID NO: 5364491 - DNA, 12 bp, Homo sapiens
aggtcaggccct

SEQ ID NO: 5364492 - DNA, 16 bp, Homo sapiens
aggtcaggccctggaa

SEQ ID NO: 5364493 - DNA, 20 bp, Homo sapiens
aggtcagggaggatctgttc

SEQ ID NO: 5364494 - DNA, 16 bp, Homo sapiens
aggtcagggagtgctg

SEQ ID NO: 5364495 - DNA, 12 bp, Homo sapiens
aggtcagggctc

SEQ ID NO: 5364496 - DNA, 17 bp, Homo sapiens
aggtcaggggctcccta

SEQ ID NO: 5364497 - DNA, 18 bp, Homo sapiens
aggtcaggggctccctac

SEQ ID NO: 5364498 - DNA, 17 bp, Homo sapiens
aggtcaggggtgacaca

SEQ ID NO: 5364499 - DNA, 21 bp, Homo sapiens
aggtcaggggtgacacagact

SEQ ID NO: 5364500 - DNA, 19 bp, Homo sapiens
aggtcagtagactgtgatt

SEQ ID NO: 5364501 - DNA, 16 bp, Homo sapiens
aggtcagttgtaataa

SEQ ID NO: 5364502 - DNA, 16 bp, Homo sapiens
aggtcataaagcattg

SEQ ID NO: 5364503 - DNA, 18 bp, Homo sapiens
aggtcataaagcattgga

SEQ ID NO: 5364504 - DNA, 17 bp, Homo sapiens
aggtcatagattcttga

SEQ ID NO: 5364505 - DNA, 17 bp, Homo sapiens
aggtcatagctgagatt

SEQ ID NO: 5364506 - DNA, 16 bp, Homo sapiens
aggtcatattaatata

SEQ ID NO: 5364507 - DNA, 15 bp, Homo sapiens
aggtcatcaaacatt

SEQ ID NO: 5364508 - DNA, 19 bp, Homo sapiens
aggtcatcagatgcctgct

SEQ ID NO: 5364509 - DNA, 21 bp, Homo sapiens
aggtcatcagatgcctgcttg

SEQ ID NO: 5364510 - DNA, 23 bp, Homo sapiens
aggtcatctcctttcatccccac

SEQ ID NO: 5364511 - DNA, 20 bp, Homo sapiens
aggtcatctgtaaaatagtc

SEQ ID NO: 5364512 - DNA, 23 bp, Homo sapiens
aggtcatctgtaaaatagtctca

SEQ ID NO: 5364513 - DNA, 23 bp, Homo sapiens
aggtcatgcattgtaatcatcat

SEQ ID NO: 5364514 - DNA, 18 bp, Homo sapiens
aggtcatgctggtgggtt

SEQ ID NO: 5364515 - DNA, 18 bp, Homo sapiens
aggtcatggaatggaaac

SEQ ID NO: 5364516 - DNA, 13 bp, Homo sapiens
aggtcatggagca

SEQ ID NO: 5364517 - DNA, 15 bp, Homo sapiens
aggtcatggagcagc

SEQ ID NO: 5364518 - DNA, 15 bp, Homo sapiens
aggtcatggccacac

SEQ ID NO: 5364519 - DNA, 21 bp, Homo sapiens
aggtcattaaggccacatcca

SEQ ID NO: 5364520 - DNA, 23 bp, Homo sapiens
aggtcattcttaagatttctcct

SEQ ID NO: 5364521 - DNA, 21 bp, Homo sapiens
aggtcatttccatgtatgcat

SEQ ID NO: 5364522 - DNA, 14 bp, Homo sapiens
aggtcatttcttca

SEQ ID NO: 5364523 - DNA, 23 bp, Homo sapiens
aggtcatttgtagatatatattt

SEQ ID NO: 5364524 - DNA, 18 bp, Homo sapiens
aggtcattttcagtgact

SEQ ID NO: 5364525 - DNA, 20 bp, Homo sapiens
aggtccaaaaaaggctgccc

SEQ ID NO: 5364526 - DNA, 19 bp, Homo sapiens
aggtccaaattcaccttcc

SEQ ID NO: 5364527 - DNA, 17 bp, Homo sapiens
aggtccaacaagaatgc

SEQ ID NO: 5364528 - DNA, 21 bp, Homo sapiens
aggtccaagccccccacacct

SEQ ID NO: 5364529 - DNA, 13 bp, Homo sapiens
aggtccaaggctg

SEQ ID NO: 5364530 - DNA, 14 bp, Homo sapiens
aggtccaagggcca

SEQ ID NO: 5364531 - DNA, 24 bp, Homo sapiens
aggtccaattctcgagcttggggc

SEQ ID NO: 5364532 - DNA, 23 bp, Homo sapiens
aggtccacagacctactgcactg

SEQ ID NO: 5364533 - DNA, 20 bp, Homo sapiens
aggtccacaggtctagacta

SEQ ID NO: 5364534 - DNA, 21 bp, Homo sapiens
aggtccaccccgttgttgtcc

SEQ ID NO: 5364535 - DNA, 16 bp, Homo sapiens
aggtccaccggcccct

SEQ ID NO: 5364536 - DNA, 21 bp, Homo sapiens
aggtccacggtctgttcttga

SEQ ID NO: 5364537 - DNA, 16 bp, Homo sapiens
aggtccactccctgct

SEQ ID NO: 5364538 - DNA, 19 bp, Homo sapiens
aggtccagagagaccgagg

SEQ ID NO: 5364539 - DNA, 13 bp, Homo sapiens
aggtccagcatcc

SEQ ID NO: 5364540 - DNA, 15 bp, Homo sapiens
aggtccagcccatct

SEQ ID NO: 5364541 - DNA, 16 bp, Homo sapiens
aggtccagcccatctc

SEQ ID NO: 5364542 - DNA, 23 bp, Homo sapiens
aggtccagcccatctcggagcat

SEQ ID NO: 5364543 - DNA, 18 bp, Homo sapiens
aggtccagccccccaggc

SEQ ID NO: 5364544 - DNA, 16 bp, Homo sapiens
aggtccagccctggct

SEQ ID NO: 5364545 - DNA, 17 bp, Homo sapiens
aggtccagccctggctg

SEQ ID NO: 5364546 - DNA, 22 bp, Homo sapiens
aggtccagccctggctgaagga

SEQ ID NO: 5364547 - DNA, 16 bp, Homo sapiens
aggtccagctctggag

SEQ ID NO: 5364548 - DNA, 13 bp, Homo sapiens
aggtccagctggg

SEQ ID NO: 5364549 - DNA, 16 bp, Homo sapiens
aggtccagctgggcct

SEQ ID NO: 5364550 - DNA, 18 bp, Homo sapiens
aggtccagctgggcctcc

SEQ ID NO: 5364551 - DNA, 20 bp, Homo sapiens
aggtccagctgggcctcctg

SEQ ID NO: 5364552 - DNA, 17 bp, Homo sapiens
aggtccaggcaaagctg

SEQ ID NO: 5364553 - DNA, 17 bp, Homo sapiens
aggtccaggccagtggg

SEQ ID NO: 5364554 - DNA, 13 bp, Homo sapiens
aggtccaggcccc

SEQ ID NO: 5364555 - DNA, 16 bp, Homo sapiens
aggtccaggcccccaa

SEQ ID NO: 5364556 - DNA, 15 bp, Homo sapiens
aggtccaggtcccag

SEQ ID NO: 5364557 - DNA, 17 bp, Homo sapiens
aggtccaggtcccagcc

SEQ ID NO: 5364558 - DNA, 22 bp, Homo sapiens
aggtccattaatacttccttat

SEQ ID NO: 5364559 - DNA, 16 bp, Homo sapiens
aggtccattattttgt

SEQ ID NO: 5364560 - DNA, 18 bp, Homo sapiens
aggtccattcattaatta

SEQ ID NO: 5364561 - DNA, 14 bp, Homo sapiens
aggtccattttcta

SEQ ID NO: 5364562 - DNA, 12 bp, Homo sapiens
aggtcccaaggc

SEQ ID NO: 5364563 - DNA, 16 bp, Homo sapiens
aggtcccaaggcaagg

SEQ ID NO: 5364564 - DNA, 17 bp, Homo sapiens
aggtcccacagccctga

SEQ ID NO: 5364565 - DNA, 18 bp, Homo sapiens
aggtcccacctccagccc

SEQ ID NO: 5364566 - DNA, 20 bp, Homo sapiens
aggtcccagaatggaaaaaa

SEQ ID NO: 5364567 - DNA, 20 bp, Homo sapiens
aggtcccagacatgctgccc

SEQ ID NO: 5364568 - DNA, 14 bp, Homo sapiens
aggtcccagcccca

SEQ ID NO: 5364569 - DNA, 15 bp, Homo sapiens
aggtcccagcccctc

SEQ ID NO: 5364570 - DNA, 18 bp, Homo sapiens
aggtcccagcccctcctc

SEQ ID NO: 5364571 - DNA, 19 bp, Homo sapiens
aggtcccagcccctcctcc

SEQ ID NO: 5364572 - DNA, 13 bp, Homo sapiens
aggtcccagccct

SEQ ID NO: 5364573 - DNA, 17 bp, Homo sapiens
aggtcccagccctgggg

SEQ ID NO: 5364574 - DNA, 18 bp, Homo sapiens
aggtcccagccctggggg

SEQ ID NO: 5364575 - DNA, 17 bp, Homo sapiens
aggtcccagcgagccac

SEQ ID NO: 5364576 - DNA, 18 bp, Homo sapiens
aggtcccagcgagccaca

SEQ ID NO: 5364577 - DNA, 19 bp, Homo sapiens
aggtcccagcgagccacag

SEQ ID NO: 5364578 - DNA, 12 bp, Homo sapiens
aggtcccaggca

SEQ ID NO: 5364579 - DNA, 14 bp, Homo sapiens
aggtcccagtgcca

SEQ ID NO: 5364580 - DNA, 19 bp, Homo sapiens
aggtcccagttgctgtcac

SEQ ID NO: 5364581 - DNA, 21 bp, Homo sapiens
aggtcccataagggtagcccc

SEQ ID NO: 5364582 - DNA, 14 bp, Homo sapiens
aggtcccatgctcc

SEQ ID NO: 5364583 - DNA, 21 bp, Homo sapiens
aggtcccatggcctgctgggc

SEQ ID NO: 5364584 - DNA, 10 bp, Homo sapiens
aggtccccaa

SEQ ID NO: 5364585 - DNA, 20 bp, Homo sapiens
aggtccccccacagctccag

SEQ ID NO: 5364586 - DNA, 21 bp, Homo sapiens
aggtccccccacagctccagg

SEQ ID NO: 5364587 - DNA, 21 bp, Homo sapiens
aggtcccccgaccaatcccca

SEQ ID NO: 5364588 - DNA, 13 bp, Homo sapiens
aggtcccccgact

SEQ ID NO: 5364589 - DNA, 20 bp, Homo sapiens
aggtcccccgactgcctgtc

SEQ ID NO: 5364590 - DNA, 16 bp, Homo sapiens
aggtccccctgcagct

SEQ ID NO: 5364591 - DNA, 18 bp, Homo sapiens
aggtccccggttgctggt

SEQ ID NO: 5364592 - DNA, 21 bp, Homo sapiens
aggtccccggttgctggtcag

SEQ ID NO: 5364593 - DNA, 11 bp, Homo sapiens
aggtcccctca

SEQ ID NO: 5364594 - DNA, 13 bp, Homo sapiens
aggtcccctccac

SEQ ID NO: 5364595 - DNA, 14 bp, Homo sapiens
aggtcccctccaca

SEQ ID NO: 5364596 - DNA, 22 bp, Homo sapiens
aggtcccctccacatcccagca

SEQ ID NO: 5364597 - DNA, 20 bp, Homo sapiens
aggtcccctcgtcccatcca

SEQ ID NO: 5364598 - DNA, 21 bp, Homo sapiens
aggtcccctggcagtgctgag

SEQ ID NO: 5364599 - DNA, 15 bp, Homo sapiens
aggtcccctggccct

SEQ ID NO: 5364600 - DNA, 23 bp, Homo sapiens
aggtcccctggcccttccttcac

SEQ ID NO: 5364601 - DNA, 19 bp, Homo sapiens
aggtcccggccagctctgg

SEQ ID NO: 5364602 - DNA, 14 bp, Homo sapiens
aggtcccgggagga

SEQ ID NO: 5364603 - DNA, 11 bp, Homo sapiens
aggtccctaat

SEQ ID NO: 5364604 - DNA, 12 bp, Homo sapiens
aggtccctaata

SEQ ID NO: 5364605 - DNA, 22 bp, Homo sapiens
aggtccctccgcggctggagcg

SEQ ID NO: 5364606 - DNA, 19 bp, Homo sapiens
aggtccctgctgccagctt

SEQ ID NO: 5364607 - DNA, 18 bp, Homo sapiens
aggtcccttcaaggcctc

SEQ ID NO: 5364608 - DNA, 23 bp, Homo sapiens
aggtcccttcccgacccagccag

SEQ ID NO: 5364609 - DNA, 14 bp, Homo sapiens
aggtcccttgtttc

SEQ ID NO: 5364610 - DNA, 15 bp, Homo sapiens
aggtccgagctctgt

SEQ ID NO: 5364611 - DNA, 16 bp, Homo sapiens
aggtcttttgacatgt

SEQ ID NO: 5364612 - DNA, 19 bp, Homo sapiens
aggtcttttgacatgtgga

SEQ ID NO: 5364613 - DNA, 14 bp, Homo sapiens
aggtcttttgaggg

SEQ ID NO: 5364614 - DNA, 14 bp, Homo sapiens
aggtctttttttaa

SEQ ID NO: 5364615 - DNA, 20 bp, Homo sapiens
aggtgaaaaatattcagtaa

SEQ ID NO: 5364616 - DNA, 16 bp, Homo sapiens
aggtgaaaagggcaga

SEQ ID NO: 5364617 - DNA, 23 bp, Homo sapiens
aggtgaaaagggcagaggcaagg

SEQ ID NO: 5364618 - DNA, 16 bp, Homo sapiens
aggtgaaaatgaagaa

SEQ ID NO: 5364619 - DNA, 17 bp, Homo sapiens
aggtgaaaatgttttat

SEQ ID NO: 5364620 - DNA, 22 bp, Homo sapiens
aggtgaaacacacacacattct

SEQ ID NO: 5364621 - DNA, 24 bp, Homo sapiens
aggtgaaacgactcaaaatgacag

SEQ ID NO: 5364622 - DNA, 19 bp, Homo sapiens
aggtgaaactccagatgcc

SEQ ID NO: 5364623 - DNA, 23 bp, Homo sapiens
aggtgaaagaaagggacccacct

SEQ ID NO: 5364624 - DNA, 15 bp, Homo sapiens
aggtgaaatccctgc

SEQ ID NO: 5364625 - DNA, 14 bp, Homo sapiens
aggtgaaatggagg

SEQ ID NO: 5364626 - DNA, 22 bp, Homo sapiens
aggtgaaatgggagatggtcag

SEQ ID NO: 5364627 - DNA, 16 bp, Homo sapiens
aggtgaacaatcaact

SEQ ID NO: 5364628 - DNA, 23 bp, Homo sapiens
aggtgaacaccactttgtctctg

SEQ ID NO: 5364629 - DNA, 22 bp, Homo sapiens
aggtgaacactcatgcggccca

SEQ ID NO: 5364630 - DNA, 18 bp, Homo sapiens
aggtgaactccaggcatg

SEQ ID NO: 5364631 - DNA, 22 bp, Homo sapiens
aggtgaagcaaatttgtggttg

SEQ ID NO: 5364632 - DNA, 14 bp, Homo sapiens
aggtgaagcacata

SEQ ID NO: 5364633 - DNA, 14 bp, Homo sapiens
aggtgaaggaatat

SEQ ID NO: 5364634 - DNA, 19 bp, Homo sapiens
aggtgaaggaggctccagg

SEQ ID NO: 5364635 - DNA, 14 bp, Homo sapiens
aggtgaaggcagaa

SEQ ID NO: 5364636 - DNA, 18 bp, Homo sapiens
aggtgaataataaaatca

SEQ ID NO: 5364637 - DNA, 17 bp, Homo sapiens
aggtgaatactcttgaa

SEQ ID NO: 5364638 - DNA, 16 bp, Homo sapiens
aggtgaatagcacagg

SEQ ID NO: 5364639 - DNA, 22 bp, Homo sapiens
aggtgaattaatggacagtctg

SEQ ID NO: 5364640 - DNA, 14 bp, Homo sapiens
aggtgaatttcatt

SEQ ID NO: 5364641 - DNA, 22 bp, Homo sapiens
aggtgaatttcattaaatggaa

SEQ ID NO: 5364642 - DNA, 15 bp, Homo sapiens
aggtgacactatagt

SEQ ID NO: 5364643 - DNA, 19 bp, Homo sapiens
aggtgacagaaggaccagc

SEQ ID NO: 5364644 - DNA, 13 bp, Homo sapiens
aggtgacagagtg

SEQ ID NO: 5364645 - DNA, 18 bp, Homo sapiens
aggtgacagtgaggtcct

SEQ ID NO: 5364646 - DNA, 22 bp, Homo sapiens
aggtgacagtggctgctctggg

SEQ ID NO: 5364647 - DNA, 14 bp, Homo sapiens
aggtgacatgtgaa

SEQ ID NO: 5364648 - DNA, 15 bp, Homo sapiens
aggtgacatgtgaaa

SEQ ID NO: 5364649 - DNA, 16 bp, Homo sapiens
aggtgacatgtgaaac

SEQ ID NO: 5364650 - DNA, 20 bp, Homo sapiens
aggtgacatgtgaaaccttt

SEQ ID NO: 5364651 - DNA, 20 bp, Homo sapiens
aggtgaccaaaatccccttc

SEQ ID NO: 5364652 - DNA, 22 bp, Homo sapiens
aggtgaccaaaatccccttctc

SEQ ID NO: 5364653 - DNA, 14 bp, Homo sapiens
aggtgaccagaatg

SEQ ID NO: 5364654 - DNA, 17 bp, Homo sapiens
aggtgaccagaatgagg

SEQ ID NO: 5364655 - DNA, 16 bp, Homo sapiens
aggtgaccataaagat

SEQ ID NO: 5364656 - DNA, 19 bp, Homo sapiens
aggtgacccaatgattcag

SEQ ID NO: 5364657 - DNA, 15 bp, Homo sapiens
aggtgaccccagggc

SEQ ID NO: 5364658 - DNA, 17 bp, Homo sapiens
aggtgaccccagggcac

SEQ ID NO: 5364659 - DNA, 18 bp, Homo sapiens
aggtgaccccagggcaca

SEQ ID NO: 5364660 - DNA, 19 bp, Homo sapiens
aggtgaccccagggcacag

SEQ ID NO: 5364661 - DNA, 24 bp, Homo sapiens
aggtgaccccagggcacaggagct

SEQ ID NO: 5364662 - DNA, 16 bp, Homo sapiens
aggtgacccctgccat

SEQ ID NO: 5364663 - DNA, 23 bp, Homo sapiens
aggtgacccttctgtctgtaaga

SEQ ID NO: 5364664 - DNA, 17 bp, Homo sapiens
aggtgaccgcccagctc

SEQ ID NO: 5364665 - DNA, 20 bp, Homo sapiens
aggtgaccttgcaacttcat

SEQ ID NO: 5364666 - DNA, 16 bp, Homo sapiens
aggtgacggactcaga

SEQ ID NO: 5364667 - DNA, 20 bp, Homo sapiens
aggtgactaccctagttcaa

SEQ ID NO: 5364668 - DNA, 19 bp, Homo sapiens
aggtgactgggccctgcct

SEQ ID NO: 5364669 - DNA, 20 bp, Homo sapiens
aggtgactgggccctgcctc

SEQ ID NO: 5364670 - DNA, 22 bp, Homo sapiens
aggtgactgggccctgcctctg

SEQ ID NO: 5364671 - DNA, 15 bp, Homo sapiens
aggtgactgtctggg

SEQ ID NO: 5364672 - DNA, 18 bp, Homo sapiens
aggtgactgtctggggag

SEQ ID NO: 5364673 - DNA, 13 bp, Homo sapiens
aggtgactgtgct

SEQ ID NO: 5364674 - DNA, 14 bp, Homo sapiens
aggtgactgtgctg

SEQ ID NO: 5364675 - DNA, 21 bp, Homo sapiens
aggtgacttcctctggtgttt

SEQ ID NO: 5364676 - DNA, 18 bp, Homo sapiens
aggtgacttgcctggggc

SEQ ID NO: 5364677 - DNA, 16 bp, Homo sapiens
aggtgactttctgaaa

SEQ ID NO: 5364678 - DNA, 13 bp, Homo sapiens
aggtgagaaaaaa

SEQ ID NO: 5364679 - DNA, 17 bp, Homo sapiens
aggtgagaactcagaag

SEQ ID NO: 5364680 - DNA, 21 bp, Homo sapiens
aggtgagaagcagaggaagga

SEQ ID NO: 5364681 - DNA, 22 bp, Homo sapiens
aggtgagacagcggtcccaggg

SEQ ID NO: 5364682 - DNA, 22 bp, Homo sapiens
aggtgagaccaaaggatccaga

SEQ ID NO: 5364683 - DNA, 23 bp, Homo sapiens
aggtgagaggcgagtcaccctcc

SEQ ID NO: 5364684 - DNA, 15 bp, Homo sapiens
aggtgagagtgcaga

SEQ ID NO: 5364685 - DNA, 14 bp, Homo sapiens
aggtgagcagacag

SEQ ID NO: 5364686 - DNA, 11 bp, Homo sapiens
aggtgagcctg

SEQ ID NO: 5364687 - DNA, 12 bp, Homo sapiens
aggtgagctcag

SEQ ID NO: 5364688 - DNA, 19 bp, Homo sapiens
aggtgagctcagctcactg

SEQ ID NO: 5364689 - DNA, 22 bp, Homo sapiens
aggtgaggcccaagagccctgt

SEQ ID NO: 5364690 - DNA, 14 bp, Homo sapiens
aggtgaggcctgtc

SEQ ID NO: 5364691 - DNA, 13 bp, Homo sapiens
aggtgagggaagc

SEQ ID NO: 5364692 - DNA, 21 bp, Homo sapiens
aggtgagggaaggagacagga

SEQ ID NO: 5364693 - DNA, 17 bp, Homo sapiens
aggtgagggaggcctga

SEQ ID NO: 5364694 - DNA, 13 bp, Homo sapiens
aggtgaggggaag

SEQ ID NO: 5364695 - DNA, 22 bp, Homo sapiens
aggtgaggtgaactccaggcat

SEQ ID NO: 5364696 - DNA, 23 bp, Homo sapiens
aggtgaggtgacttgcctggggc

SEQ ID NO: 5364697 - DNA, 23 bp, Homo sapiens
aggtgagtctgaaccaatagaaa

SEQ ID NO: 5364698 - DNA, 12 bp, Homo sapiens
aggtgagtgggt

SEQ ID NO: 5364699 - DNA, 20 bp, Homo sapiens
aggtgagtttgagctgcctt

SEQ ID NO: 5364700 - DNA, 21 bp, Homo sapiens
aggtgagtttgagctgccttc

SEQ ID NO: 5364701 - DNA, 15 bp, Homo sapiens
aggtgataaaatcat

SEQ ID NO: 5364702 - DNA, 16 bp, Homo sapiens
aggtgataaagaggca

SEQ ID NO: 5364703 - DNA, 20 bp, Homo sapiens
aggtgataaatgtcagtagt

SEQ ID NO: 5364704 - DNA, 15 bp, Homo sapiens
aggtgataagggaaa

SEQ ID NO: 5364705 - DNA, 21 bp, Homo sapiens
aggtgataagggaaaagataa

SEQ ID NO: 5364706 - DNA, 17 bp, Homo sapiens
aggtgatagcattgctt

SEQ ID NO: 5364707 - DNA, 18 bp, Homo sapiens
aggtgatagcattgcttt

SEQ ID NO: 5364708 - DNA, 19 bp, Homo sapiens
aggtgataggtaaattttt

SEQ ID NO: 5364709 - DNA, 22 bp, Homo sapiens
aggtgatatccattctttctga

SEQ ID NO: 5364710 - DNA, 21 bp, Homo sapiens
aggtgatatttttatgtgcag

SEQ ID NO: 5364711 - DNA, 23 bp, Homo sapiens
aggtgatatttttatgtgcagcg

SEQ ID NO: 5364712 - DNA, 19 bp, Homo sapiens
aggtgatccatgtaactgc

SEQ ID NO: 5364713 - DNA, 23 bp, Homo sapiens
aggtgatccgcccacctcagcct

SEQ ID NO: 5364714 - DNA, 13 bp, Homo sapiens
aggtgatctcctg

SEQ ID NO: 5364715 - DNA, 14 bp, Homo sapiens
aggtgatctcctgt

SEQ ID NO: 5364716 - DNA, 15 bp, Homo sapiens
aggtgatgctctggc

SEQ ID NO: 5364717 - DNA, 16 bp, Homo sapiens
aggtgatgctctggct

SEQ ID NO: 5364718 - DNA, 19 bp, Homo sapiens
aggtgatggaggtatttga

SEQ ID NO: 5364719 - DNA, 23 bp, Homo sapiens
aggtgatgggcagatcttttctt

SEQ ID NO: 5364720 - DNA, 17 bp, Homo sapiens
aggtgatgggggcatgg

SEQ ID NO: 5364721 - DNA, 19 bp, Homo sapiens
aggtgatgtttccagctgc

SEQ ID NO: 5364722 - DNA, 15 bp, Homo sapiens
aggtgattctcaggg

SEQ ID NO: 5364723 - DNA, 22 bp, Homo sapiens
aggtgattctcagggctggagc

SEQ ID NO: 5364724 - DNA, 16 bp, Homo sapiens
aggtgcaacactcaag

SEQ ID NO: 5364725 - DNA, 21 bp, Homo sapiens
aggtgcaacagacttgaatgc

SEQ ID NO: 5364726 - DNA, 21 bp, Homo sapiens
aggtgcaagagacagagcccc

SEQ ID NO: 5364727 - DNA, 20 bp, Homo sapiens
aggtgcaatttcaaggttct

SEQ ID NO: 5364728 - DNA, 21 bp, Homo sapiens
aggtgcaatttcaaggttcta

SEQ ID NO: 5364729 - DNA, 22 bp, Homo sapiens
aggtgcaatttcaaggttctaa

SEQ ID NO: 5364730 - DNA, 15 bp, Homo sapiens
aggtgcacaagctcc

SEQ ID NO: 5364731 - DNA, 23 bp, Homo sapiens
aggtgcacagacgtccctccacg

SEQ ID NO: 5364732 - DNA, 21 bp, Homo sapiens
aggtgcacctgccccaggctc

SEQ ID NO: 5364733 - DNA, 20 bp, Homo sapiens
aggtgcacttggggcacagg

SEQ ID NO: 5364734 - DNA, 16 bp, Homo sapiens
aggtgcagaccttggg

SEQ ID NO: 5364735 - DNA, 15 bp, Homo sapiens
aggtgcagatgggct

SEQ ID NO: 5364736 - DNA, 16 bp, Homo sapiens
aggtgcagctcctcag

SEQ ID NO: 5364737 - DNA, 18 bp, Homo sapiens
aggtgcagctgcgttctg

SEQ ID NO: 5364738 - DNA, 20 bp, Homo sapiens
aggtgcaggggaagaccaaa

SEQ ID NO: 5364739 - DNA, 23 bp, Homo sapiens
aggtgcaggggaagaccaaagtt

SEQ ID NO: 5364740 - DNA, 23 bp, Homo sapiens
aggtgcagttcccccaacctcag

SEQ ID NO: 5364741 - DNA, 15 bp, Homo sapiens
aggtgcagtttcatt

SEQ ID NO: 5364742 - DNA, 18 bp, Homo sapiens
aggtgcatatagaaaaca

SEQ ID NO: 5364743 - DNA, 14 bp, Homo sapiens
aggtgcatctgcag

SEQ ID NO: 5364744 - DNA, 15 bp, Homo sapiens
aggtgcatctgcagg

SEQ ID NO: 5364745 - DNA, 19 bp, Homo sapiens
aggtgcatctttccctgcc

SEQ ID NO: 5364746 - DNA, 17 bp, Homo sapiens
aggtgcattgtcctttt

SEQ ID NO: 5364747 - DNA, 19 bp, Homo sapiens
aggtgccaccaataaaaat

SEQ ID NO: 5364748 - DNA, 13 bp, Homo sapiens
aggtgccaccacc

SEQ ID NO: 5364749 - DNA, 22 bp, Homo sapiens
aggtgccacccagtagcccaga

SEQ ID NO: 5364750 - DNA, 16 bp, Homo sapiens
aggtgccactccctga

SEQ ID NO: 5364751 - DNA, 15 bp, Homo sapiens
aggtgccactgaccg

SEQ ID NO: 5364752 - DNA, 13 bp, Homo sapiens
aggtgccactgga

SEQ ID NO: 5364753 - DNA, 13 bp, Homo sapiens
aggtgccagaagg

SEQ ID NO: 5364754 - DNA, 16 bp, Homo sapiens
aggtgccagaaggaag

SEQ ID NO: 5364755 - DNA, 19 bp, Homo sapiens
aggtgccagggcccacccc

SEQ ID NO: 5364756 - DNA, 20 bp, Homo sapiens
aggtgccagtcttccagaaa

SEQ ID NO: 5364757 - DNA, 17 bp, Homo sapiens
aggtgccatctcaggag

SEQ ID NO: 5364758 - DNA, 16 bp, Homo sapiens
aggtgccatgcctgct

SEQ ID NO: 5364759 - DNA, 17 bp, Homo sapiens
aggtgccatgcctgctc

SEQ ID NO: 5364760 - DNA, 20 bp, Homo sapiens
aggtgccatgcctgctccct

SEQ ID NO: 5364761 - DNA, 21 bp, Homo sapiens
aggtgccatgcctgctccctg

SEQ ID NO: 5364762 - DNA, 22 bp, Homo sapiens
aggtgccatgcctgctccctgt

SEQ ID NO: 5364763 - DNA, 20 bp, Homo sapiens
aggtgcccacatgtgtccat

SEQ ID NO: 5364764 - DNA, 13 bp, Homo sapiens
aggtgcccactcc

SEQ ID NO: 5364765 - DNA, 22 bp, Homo sapiens
aggtgcccactccgccagccac

SEQ ID NO: 5364766 - DNA, 23 bp, Homo sapiens
aggtgcccactccgccagccaca

SEQ ID NO: 5364767 - DNA, 24 bp, Homo sapiens
aggtgcccactccgccagccacag

SEQ ID NO: 5364768 - DNA, 11 bp, Homo sapiens
aggtgcccagg

SEQ ID NO: 5364769 - DNA, 12 bp, Homo sapiens
aggtgcccagga

SEQ ID NO: 5364770 - DNA, 15 bp, Homo sapiens
aggtgcccaggagaa

SEQ ID NO: 5364771 - DNA, 15 bp, Homo sapiens
aggtgcccagggcca

SEQ ID NO: 5364772 - DNA, 16 bp, Homo sapiens
aggtgcccagggccag

SEQ ID NO: 5364773 - DNA, 13 bp, Homo sapiens
aggtgcccagtct

SEQ ID NO: 5364774 - DNA, 21 bp, Homo sapiens
aggtgcccagtcttgagtggg

SEQ ID NO: 5364775 - DNA, 13 bp, Homo sapiens
aggtgcccccagg

SEQ ID NO: 5364776 - DNA, 17 bp, Homo sapiens
aggtgcccccaggtgag

SEQ ID NO: 5364777 - DNA, 19 bp, Homo sapiens
aggtgccctgtgggagagc

SEQ ID NO: 5364778 - DNA, 20 bp, Homo sapiens
aggtgcccttggaggccagc

SEQ ID NO: 5364779 - DNA, 22 bp, Homo sapiens
aggtgcccttggaggccagcca

SEQ ID NO: 5364780 - DNA, 19 bp, Homo sapiens
aggtgccgccagctgccgc

SEQ ID NO: 5364781 - DNA, 15 bp, Homo sapiens
aggtgccgtgagcag

SEQ ID NO: 5364782 - DNA, 17 bp, Homo sapiens
aggtgccgtgagcaggc

SEQ ID NO: 5364783 - DNA, 19 bp, Homo sapiens
aggtgccgtgagcaggctt

SEQ ID NO: 5364784 - DNA, 17 bp, Homo sapiens
aggtgcctaacctggga

SEQ ID NO: 5364785 - DNA, 21 bp, Homo sapiens
aggtgcctcagactccgccct

SEQ ID NO: 5364786 - DNA, 16 bp, Homo sapiens
aggtgttatgtattcc

SEQ ID NO: 5364787 - DNA, 15 bp, Homo sapiens
aggtgttcattttgt

SEQ ID NO: 5364788 - DNA, 20 bp, Homo sapiens
aggtgttcccaggctgcccc

SEQ ID NO: 5364789 - DNA, 15 bp, Homo sapiens
aggtgttctgctgat

SEQ ID NO: 5364790 - DNA, 14 bp, Homo sapiens
aggtgttgaaaatg

SEQ ID NO: 5364791 - DNA, 22 bp, Homo sapiens
aggtgttgaagaaattataaag

SEQ ID NO: 5364792 - DNA, 18 bp, Homo sapiens
aggtgttgcagcccaaag

SEQ ID NO: 5364793 - DNA, 13 bp, Homo sapiens
aggtgttgccagt

SEQ ID NO: 5364794 - DNA, 15 bp, Homo sapiens
aggtgttgggacctg

SEQ ID NO: 5364795 - DNA, 17 bp, Homo sapiens
aggtgttgggacctgct

SEQ ID NO: 5364796 - DNA, 15 bp, Homo sapiens
aggtgttgtcccttc

SEQ ID NO: 5364797 - DNA, 14 bp, Homo sapiens
aggtgttgtccgtg

SEQ ID NO: 5364798 - DNA, 17 bp, Homo sapiens
aggtgttgttgagggca

SEQ ID NO: 5364799 - DNA, 17 bp, Homo sapiens
aggtgtttattaaaatt

SEQ ID NO: 5364800 - DNA, 21 bp, Homo sapiens
aggtgtttattaaaattctga

SEQ ID NO: 5364801 - DNA, 22 bp, Homo sapiens
aggtgtttccatttctcaatca

SEQ ID NO: 5364802 - DNA, 15 bp, Homo sapiens
aggtgtttgaacaga

SEQ ID NO: 5364803 - DNA, 16 bp, Homo sapiens
aggtgtttggcaccca

SEQ ID NO: 5364804 - DNA, 17 bp, Homo sapiens
aggtgtttgtggggctg

SEQ ID NO: 5364805 - DNA, 18 bp, Homo sapiens
aggtgtttgtggggctgg

SEQ ID NO: 5364806 - DNA, 16 bp, Homo sapiens
aggtgttttctgtgta

SEQ ID NO: 5364807 - DNA, 18 bp, Homo sapiens
aggtgttttctgtgtaac

SEQ ID NO: 5364808 - DNA, 22 bp, Homo sapiens
aggtgttttttatgaagtgcgt

SEQ ID NO: 5364809 - DNA, 22 bp, Homo sapiens
aggttaaaagaccataagcaaa

SEQ ID NO: 5364810 - DNA, 19 bp, Homo sapiens
aggttaaaatataaattaa

SEQ ID NO: 5364811 - DNA, 18 bp, Homo sapiens
aggttaaacgtagcatgt

SEQ ID NO: 5364812 - DNA, 17 bp, Homo sapiens
aggttaaagaagctgca

SEQ ID NO: 5364813 - DNA, 17 bp, Homo sapiens
aggttaaagctaaactg

SEQ ID NO: 5364814 - DNA, 16 bp, Homo sapiens
aggttaaatatataaa

SEQ ID NO: 5364815 - DNA, 11 bp, Homo sapiens
aggttaaatgt

SEQ ID NO: 5364816 - DNA, 14 bp, Homo sapiens
aggttaaattattg

SEQ ID NO: 5364817 - DNA, 13 bp, Homo sapiens
aggttaacagtaa

SEQ ID NO: 5364818 - DNA, 22 bp, Homo sapiens
aggttaactatgtacaatattt

SEQ ID NO: 5364819 - DNA, 16 bp, Homo sapiens
aggttaaggtgggtcc

SEQ ID NO: 5364820 - DNA, 12 bp, Homo sapiens
aggttaagtctc

SEQ ID NO: 5364821 - DNA, 14 bp, Homo sapiens
aggttaatgttcat

SEQ ID NO: 5364822 - DNA, 16 bp, Homo sapiens
aggttaatttttcctt

SEQ ID NO: 5364823 - DNA, 15 bp, Homo sapiens
aggttacaacagatt

SEQ ID NO: 5364824 - DNA, 16 bp, Homo sapiens
aggttacaacagattt

SEQ ID NO: 5364825 - DNA, 22 bp, Homo sapiens
aggttacagattatcacattaa

SEQ ID NO: 5364826 - DNA, 15 bp, Homo sapiens
aggttaccaagaagc

SEQ ID NO: 5364827 - DNA, 20 bp, Homo sapiens
aggttacccgagaagcactt

SEQ ID NO: 5364828 - DNA, 21 bp, Homo sapiens
aggttaccctgtaacatgcaa

SEQ ID NO: 5364829 - DNA, 18 bp, Homo sapiens
aggttactcagcagcaga

SEQ ID NO: 5364830 - DNA, 22 bp, Homo sapiens
aggttactcgttcttcagcaag

SEQ ID NO: 5364831 - DNA, 17 bp, Homo sapiens
aggttactgagtgagtt

SEQ ID NO: 5364832 - DNA, 16 bp, Homo sapiens
aggttactgggagtgt

SEQ ID NO: 5364833 - DNA, 13 bp, Homo sapiens
aggttactgtttt

SEQ ID NO: 5364834 - DNA, 17 bp, Homo sapiens
aggttactttggactga

SEQ ID NO: 5364835 - DNA, 19 bp, Homo sapiens
aggttagaaaggcagccct

SEQ ID NO: 5364836 - DNA, 20 bp, Homo sapiens
aggttagaaataatgtcaaa

SEQ ID NO: 5364837 - DNA, 23 bp, Homo sapiens
aggttagaaataatgtcaaaaat

SEQ ID NO: 5364838 - DNA, 21 bp, Homo sapiens
aggttagatatttcgaccctg

SEQ ID NO: 5364839 - DNA, 21 bp, Homo sapiens
aggttaggagttcgagaccag

SEQ ID NO: 5364840 - DNA, 14 bp, Homo sapiens
aggttagtgacaaa

SEQ ID NO: 5364841 - DNA, 19 bp, Homo sapiens
aggttatacaataacccag

SEQ ID NO: 5364842 - DNA, 21 bp, Homo sapiens
aggttatacaataacccagtt

SEQ ID NO: 5364843 - DNA, 22 bp, Homo sapiens
aggttatacaataacccagtta

SEQ ID NO: 5364844 - DNA, 22 bp, Homo sapiens
aggttatatgagtagatactct

SEQ ID NO: 5364845 - DNA, 15 bp, Homo sapiens
aggttatcagtgctt

SEQ ID NO: 5364846 - DNA, 14 bp, Homo sapiens
aggttatcgaaata

SEQ ID NO: 5364847 - DNA, 17 bp, Homo sapiens
aggttatcgaaataaca

SEQ ID NO: 5364848 - DNA, 15 bp, Homo sapiens
aggttatctgcctgg

SEQ ID NO: 5364849 - DNA, 23 bp, Homo sapiens
aggttatctgcctggcctggctc

SEQ ID NO: 5364850 - DNA, 19 bp, Homo sapiens
aggttatgaaacatatcat

SEQ ID NO: 5364851 - DNA, 15 bp, Homo sapiens
aggttatgagaaaaa

SEQ ID NO: 5364852 - DNA, 14 bp, Homo sapiens
aggttatggggaga

SEQ ID NO: 5364853 - DNA, 20 bp, Homo sapiens
aggttatgttcatttttcaa

SEQ ID NO: 5364854 - DNA, 21 bp, Homo sapiens
aggttatgttcatttttcaaa

SEQ ID NO: 5364855 - DNA, 15 bp, Homo sapiens
aggttatttatttaa

SEQ ID NO: 5364856 - DNA, 17 bp, Homo sapiens
aggttattttagtttct

SEQ ID NO: 5364857 - DNA, 20 bp, Homo sapiens
aggttattttagtttctgtt

SEQ ID NO: 5364858 - DNA, 12 bp, Homo sapiens
aggttattttat

SEQ ID NO: 5364859 - DNA, 14 bp, Homo sapiens
aggttattttatat

SEQ ID NO: 5364860 - DNA, 14 bp, Homo sapiens
aggttattttgctt

SEQ ID NO: 5364861 - DNA, 15 bp, Homo sapiens
aggttattttgcttt

SEQ ID NO: 5364862 - DNA, 16 bp, Homo sapiens
aggttattttgctttg

SEQ ID NO: 5364863 - DNA, 21 bp, Homo sapiens
aggttcaaaggcagcaaggca

SEQ ID NO: 5364864 - DNA, 14 bp, Homo sapiens
aggttcaacttatt

SEQ ID NO: 5364865 - DNA, 18 bp, Homo sapiens
aggttcacactcagaaag

SEQ ID NO: 5364866 - DNA, 20 bp, Homo sapiens
aggttcacactcagaaagag

SEQ ID NO: 5364867 - DNA, 16 bp, Homo sapiens
aggttcacagcagctt

SEQ ID NO: 5364868 - DNA, 17 bp, Homo sapiens
aggttcacagcagcttt

SEQ ID NO: 5364869 - DNA, 15 bp, Homo sapiens
aggttcacccagcgc

SEQ ID NO: 5364870 - DNA, 16 bp, Homo sapiens
aggttcacgtgcagct

SEQ ID NO: 5364871 - DNA, 20 bp, Homo sapiens
aggttcactgagctccccag

SEQ ID NO: 5364872 - DNA, 15 bp, Homo sapiens
aggttcagccaaggt

SEQ ID NO: 5364873 - DNA, 21 bp, Homo sapiens
aggttcaggtcccctttcaga

SEQ ID NO: 5364874 - DNA, 20 bp, Homo sapiens
aggttcagtattatgtagtt

SEQ ID NO: 5364875 - DNA, 17 bp, Homo sapiens
aggttcatgcaaacttt

SEQ ID NO: 5364876 - DNA, 21 bp, Homo sapiens
aggttcatgccaccatggcca

SEQ ID NO: 5364877 - DNA, 12 bp, Homo sapiens
aggttcatggat

SEQ ID NO: 5364878 - DNA, 18 bp, Homo sapiens
aggttccacagaggacac

SEQ ID NO: 5364879 - DNA, 16 bp, Homo sapiens
aggttcccaagctcag

SEQ ID NO: 5364880 - DNA, 16 bp, Homo sapiens
aggttcccaaggacat

SEQ ID NO: 5364881 - DNA, 17 bp, Homo sapiens
aggttcccagcagctgg

SEQ ID NO: 5364882 - DNA, 20 bp, Homo sapiens
aggttccccaagggccctgg

SEQ ID NO: 5364883 - DNA, 19 bp, Homo sapiens
aggttccccagagagcagg

SEQ ID NO: 5364884 - DNA, 23 bp, Homo sapiens
aggttccccagagagcaggcagg

SEQ ID NO: 5364885 - DNA, 17 bp, Homo sapiens
aggttcccccagcaagc

SEQ ID NO: 5364886 - DNA, 14 bp, Homo sapiens
aggttccctcccag

SEQ ID NO: 5364887 - DNA, 16 bp, Homo sapiens
aggttccctctgagaa

SEQ ID NO: 5364888 - DNA, 15 bp, Homo sapiens
aggttccctgccaca

SEQ ID NO: 5364889 - DNA, 22 bp, Homo sapiens
aggttccctgccttgtttggat

SEQ ID NO: 5364890 - DNA, 19 bp, Homo sapiens
aggttccctgttcttcctc

SEQ ID NO: 5364891 - DNA, 20 bp, Homo sapiens
aggttccctgttcttcctcc

SEQ ID NO: 5364892 - DNA, 18 bp, Homo sapiens
aggttccgcttggagcag

SEQ ID NO: 5364893 - DNA, 23 bp, Homo sapiens
aggttccgtatctccctggagaa

SEQ ID NO: 5364894 - DNA, 21 bp, Homo sapiens
aggttcctcctaggcgctcag

SEQ ID NO: 5364895 - DNA, 12 bp, Homo sapiens
aggttcctgggg

SEQ ID NO: 5364896 - DNA, 14 bp, Homo sapiens
aggttcctggggcc

SEQ ID NO: 5364897 - DNA, 20 bp, Homo sapiens
aggttcctggggccgcctgc

SEQ ID NO: 5364898 - DNA, 18 bp, Homo sapiens
aggttcctgtactactgc

SEQ ID NO: 5364899 - DNA, 20 bp, Homo sapiens
aggttccttttgaagctcaa

SEQ ID NO: 5364900 - DNA, 17 bp, Homo sapiens
aggttcgggattccctg

SEQ ID NO: 5364901 - DNA, 16 bp, Homo sapiens
aggttcgtatagaaaa

SEQ ID NO: 5364902 - DNA, 21 bp, Homo sapiens
aggttctaatattcacatgtt

SEQ ID NO: 5364903 - DNA, 21 bp, Homo sapiens
aggttctaggtcctggcttct

SEQ ID NO: 5364904 - DNA, 17 bp, Homo sapiens
aggttctaggtttcaaa

SEQ ID NO: 5364905 - DNA, 16 bp, Homo sapiens
aggttctatgatatac

SEQ ID NO: 5364906 - DNA, 17 bp, Homo sapiens
aggttctatgatttgta

SEQ ID NO: 5364907 - DNA, 15 bp, Homo sapiens
aggttctatttggaa

SEQ ID NO: 5364908 - DNA, 13 bp, Homo sapiens
aggttctcagagc

SEQ ID NO: 5364909 - DNA, 15 bp, Homo sapiens
aggttctcagagcca

SEQ ID NO: 5364910 - DNA, 18 bp, Homo sapiens
aggttctcagagccaagt

SEQ ID NO: 5364911 - DNA, 16 bp, Homo sapiens
aggttctcagcaagtg

SEQ ID NO: 5364912 - DNA, 17 bp, Homo sapiens
aggttctcagcaagtgt

SEQ ID NO: 5364913 - DNA, 19 bp, Homo sapiens
aggttctcagcaagtgtac

SEQ ID NO: 5364914 - DNA, 16 bp, Homo sapiens
aggttctcatttctca

SEQ ID NO: 5364915 - DNA, 23 bp, Homo sapiens
aggttctcatttctcaggtgacg

SEQ ID NO: 5364916 - DNA, 21 bp, Homo sapiens
aggttctccaacatcacagcc

SEQ ID NO: 5364917 - DNA, 19 bp, Homo sapiens
aggttctcccagcccatct

SEQ ID NO: 5364918 - DNA, 19 bp, Homo sapiens
aggttctccgttagctcct

SEQ ID NO: 5364919 - DNA, 14 bp, Homo sapiens
aggttctctcctcc

SEQ ID NO: 5364920 - DNA, 17 bp, Homo sapiens
aggttctgagaccagtg

SEQ ID NO: 5364921 - DNA, 17 bp, Homo sapiens
aggttctgattttcttg

SEQ ID NO: 5364922 - DNA, 14 bp, Homo sapiens
aggttctgcactcc

SEQ ID NO: 5364923 - DNA, 17 bp, Homo sapiens
aggttctgctttctgat

SEQ ID NO: 5364924 - DNA, 23 bp, Homo sapiens
aggttctggggctgggcctgagc

SEQ ID NO: 5364925 - DNA, 16 bp, Homo sapiens
aggttctgggttttct

SEQ ID NO: 5364926 - DNA, 18 bp, Homo sapiens
aggttctgggttttctga

SEQ ID NO: 5364927 - DNA, 18 bp, Homo sapiens
aggttctggtaacctgtg

SEQ ID NO: 5364928 - DNA, 17 bp, Homo sapiens
aggttctggtgtgaact

SEQ ID NO: 5364929 - DNA, 20 bp, Homo sapiens
aggttctgtagagccaatta

SEQ ID NO: 5364930 - DNA, 17 bp, Homo sapiens
aggttcttaaaaaggaa

SEQ ID NO: 5364931 - DNA, 20 bp, Homo sapiens
aggttcttctggtgagtgca

SEQ ID NO: 5364932 - DNA, 19 bp, Homo sapiens
aggttcttcttgttctgag

SEQ ID NO: 5364933 - DNA, 14 bp, Homo sapiens
aggttcttgatgtc

SEQ ID NO: 5364934 - DNA, 16 bp, Homo sapiens
aggttcttgctttctc

SEQ ID NO: 5364935 - DNA, 12 bp, Homo sapiens
aggttctttccc

SEQ ID NO: 5364936 - DNA, 23 bp, Homo sapiens
aggttctttcccacactgaaatt

SEQ ID NO: 5364937 - DNA, 14 bp, Homo sapiens
aggttcttttccat

SEQ ID NO: 5364938 - DNA, 23 bp, Homo sapiens
aggttgaactatgaacactgtca

SEQ ID NO: 5364939 - DNA, 15 bp, Homo sapiens
aggttgaactttgcc

SEQ ID NO: 5364940 - DNA, 23 bp, Homo sapiens
aggttgaagacctaaccagggcc

SEQ ID NO: 5364941 - DNA, 15 bp, Homo sapiens
aggttgaagccaagt

SEQ ID NO: 5364942 - DNA, 17 bp, Homo sapiens
aggttgaagccatgtct

SEQ ID NO: 5364943 - DNA, 20 bp, Homo sapiens
aggttgaagctaaaaggaaa

SEQ ID NO: 5364944 - DNA, 22 bp, Homo sapiens
aggttgaagctaaaaggaaaag

SEQ ID NO: 5364945 - DNA, 15 bp, Homo sapiens
aggttgacaggaggt

SEQ ID NO: 5364946 - DNA, 17 bp, Homo sapiens
aggttgagctcttctta

SEQ ID NO: 5364947 - DNA, 15 bp, Homo sapiens
aggttgaggacagga

SEQ ID NO: 5364948 - DNA, 23 bp, Homo sapiens
aggttgaggatgcactggcctgt

SEQ ID NO: 5364949 - DNA, 17 bp, Homo sapiens
aggttgagtatgtgaag

SEQ ID NO: 5364950 - DNA, 18 bp, Homo sapiens
aggttgagtgagccggga

SEQ ID NO: 5364951 - DNA, 12 bp, Homo sapiens
aggttgataaat

SEQ ID NO: 5364952 - DNA, 12 bp, Homo sapiens
aggttgataact

SEQ ID NO: 5364953 - DNA, 16 bp, Homo sapiens
aggttgatcagatctg

SEQ ID NO: 5364954 - DNA, 14 bp, Homo sapiens
aggttgatcttgaa

SEQ ID NO: 5364955 - DNA, 13 bp, Homo sapiens
aggttgcacacag

SEQ ID NO: 5364956 - DNA, 14 bp, Homo sapiens
aggttgcacacagt

SEQ ID NO: 5364957 - DNA, 12 bp, Homo sapiens
aggttgcacagc

SEQ ID NO: 5364958 - DNA, 15 bp, Homo sapiens
aggttgcagctgctc

SEQ ID NO: 5364959 - DNA, 15 bp, Homo sapiens
aggttgcagtgagct

SEQ ID NO: 5364960 - DNA, 17 bp, Homo sapiens
aggttgcagtgagctga

SEQ ID NO: 5364961 - DNA, 18 bp, Homo sapiens
aggttgcagtgagctgag

SEQ ID NO: 5364962 - DNA, 12 bp, Homo sapiens
aggttgcagtgc

SEQ ID NO: 5364963 - DNA, 20 bp, Homo sapiens
aggttgccccttccccatct

SEQ ID NO: 5364964 - DNA, 15 bp, Homo sapiens
agtaagcatttcaaa

SEQ ID NO: 5364965 - DNA, 14 bp, Homo sapiens
agtaagcatttcca

SEQ ID NO: 5364966 - DNA, 13 bp, Homo sapiens
agtaagcccaagc

SEQ ID NO: 5364967 - DNA, 14 bp, Homo sapiens
agtaagcccaagct

SEQ ID NO: 5364968 - DNA, 17 bp, Homo sapiens
agtaagcctcatcatca

SEQ ID NO: 5364969 - DNA, 19 bp, Homo sapiens
agtaagcctccctcctcgt

SEQ ID NO: 5364970 - DNA, 21 bp, Homo sapiens
agtaagcggctcaagcccagg

SEQ ID NO: 5364971 - DNA, 15 bp, Homo sapiens
agtaagctggtttac

SEQ ID NO: 5364972 - DNA, 21 bp, Homo sapiens
agtaagctggtttacagatgt

SEQ ID NO: 5364973 - DNA, 22 bp, Homo sapiens
agtaaggaaatattaagagcta

SEQ ID NO: 5364974 - DNA, 23 bp, Homo sapiens
agtaaggaattttatttttttct

SEQ ID NO: 5364975 - DNA, 18 bp, Homo sapiens
agtaaggcagctctgtcg

SEQ ID NO: 5364976 - DNA, 21 bp, Homo sapiens
agtaaggctggtaagagaagt

SEQ ID NO: 5364977 - DNA, 23 bp, Homo sapiens
agtaaggctggtaagagaagtga

SEQ ID NO: 5364978 - DNA, 13 bp, Homo sapiens
agtaaggctgtgt

SEQ ID NO: 5364979 - DNA, 13 bp, Homo sapiens
agtaagggagtca

SEQ ID NO: 5364980 - DNA, 14 bp, Homo sapiens
agtaagggagtcat

SEQ ID NO: 5364981 - DNA, 22 bp, Homo sapiens
agtaagggcgtggctctgggtg

SEQ ID NO: 5364982 - DNA, 21 bp, Homo sapiens
agtaaggtagcattcattacc

SEQ ID NO: 5364983 - DNA, 20 bp, Homo sapiens
agtaagtaattatgcactaa

SEQ ID NO: 5364984 - DNA, 19 bp, Homo sapiens
agtaagtaccactcaggcc

SEQ ID NO: 5364985 - DNA, 19 bp, Homo sapiens
agtaagtagcaaccctgtg

SEQ ID NO: 5364986 - DNA, 15 bp, Homo sapiens
agtaagtatcttcgt

SEQ ID NO: 5364987 - DNA, 23 bp, Homo sapiens
agtaagtatcttcgttcttgtta

SEQ ID NO: 5364988 - DNA, 14 bp, Homo sapiens
agtaagtatttcca

SEQ ID NO: 5364989 - DNA, 14 bp, Homo sapiens
agtaagtcaggaca

SEQ ID NO: 5364990 - DNA, 17 bp, Homo sapiens
agtaagtgcttgtttta

SEQ ID NO: 5364991 - DNA, 23 bp, Homo sapiens
agtaagtggggttgcaaccactg

SEQ ID NO: 5364992 - DNA, 12 bp, Homo sapiens
agtaagtgtaca

SEQ ID NO: 5364993 - DNA, 11 bp, Homo sapiens
agtaagtgtgt

SEQ ID NO: 5364994 - DNA, 15 bp, Homo sapiens
agtaagttaataatg

SEQ ID NO: 5364995 - DNA, 16 bp, Homo sapiens
agtaagttaataatgt

SEQ ID NO: 5364996 - DNA, 22 bp, Homo sapiens
agtaagttaataatgtattgta

SEQ ID NO: 5364997 - DNA, 19 bp, Homo sapiens
agtaagttaatgtatataa

SEQ ID NO: 5364998 - DNA, 16 bp, Homo sapiens
agtaagttatctttga

SEQ ID NO: 5364999 - DNA, 17 bp, Homo sapiens
agtaagttcagcacttg

SEQ ID NO: 5365000 - DNA, 20 bp, Homo sapiens
agtaagttctgaaaactgtt

SEQ ID NO: 5365001 - DNA, 17 bp, Homo sapiens
agtaagttcttcaaaca

SEQ ID NO: 5365002 - DNA, 14 bp, Homo sapiens
agtaagtttcattc

SEQ ID NO: 5365003 - DNA, 17 bp, Homo sapiens
agtaagtttcattctaa

SEQ ID NO: 5365004 - DNA, 22 bp, Homo sapiens
agtaataaaaagagatgaaata

SEQ ID NO: 5365005 - DNA, 15 bp, Homo sapiens
agtaataaaaagcca

SEQ ID NO: 5365006 - DNA, 16 bp, Homo sapiens
agtaataaaaagccac

SEQ ID NO: 5365007 - DNA, 20 bp, Homo sapiens
agtaataaaaagccaccaca

SEQ ID NO: 5365008 - DNA, 12 bp, Homo sapiens
agtaataaaaca

SEQ ID NO: 5365009 - DNA, 17 bp, Homo sapiens
agtaataaaacatcttt

SEQ ID NO: 5365010 - DNA, 18 bp, Homo sapiens
agtaataaaacccagcat

SEQ ID NO: 5365011 - DNA, 20 bp, Homo sapiens
agtaataaaacccagcatgt

SEQ ID NO: 5365012 - DNA, 15 bp, Homo sapiens
agtaataaaattcaa

SEQ ID NO: 5365013 - DNA, 16 bp, Homo sapiens
agtaataaactgtgtt

SEQ ID NO: 5365014 - DNA, 15 bp, Homo sapiens
agtaataatgtaata

SEQ ID NO: 5365015 - DNA, 12 bp, Homo sapiens
agtaataatgtg

SEQ ID NO: 5365016 - DNA, 13 bp, Homo sapiens
agtaataatttgt

SEQ ID NO: 5365017 - DNA, 19 bp, Homo sapiens
agtaataatttgtaaattg

SEQ ID NO: 5365018 - DNA, 22 bp, Homo sapiens
agtaataccaaagactatttca

SEQ ID NO: 5365019 - DNA, 21 bp, Homo sapiens
agtaatacctctaatagtata

SEQ ID NO: 5365020 - DNA, 13 bp, Homo sapiens
agtaatagctgaa

SEQ ID NO: 5365021 - DNA, 15 bp, Homo sapiens
agtaatagctgaacc

SEQ ID NO: 5365022 - DNA, 17 bp, Homo sapiens
agtaataggaccagagc

SEQ ID NO: 5365023 - DNA, 19 bp, Homo sapiens
agtaataggagcttccagc

SEQ ID NO: 5365024 - DNA, 19 bp, Homo sapiens
agtaatagtccaatatttg

SEQ ID NO: 5365025 - DNA, 22 bp, Homo sapiens
agtaatagtccaatatttggcg

SEQ ID NO: 5365026 - DNA, 13 bp, Homo sapiens
agtaatatattct

SEQ ID NO: 5365027 - DNA, 16 bp, Homo sapiens
agtaatatatttaaag

SEQ ID NO: 5365028 - DNA, 13 bp, Homo sapiens
agtaatatcaaag

SEQ ID NO: 5365029 - DNA, 14 bp, Homo sapiens
agtaatatgcacac

SEQ ID NO: 5365030 - DNA, 18 bp, Homo sapiens
agtaatatgcacacattt

SEQ ID NO: 5365031 - DNA, 22 bp, Homo sapiens
agtaatatgcctgctatttgaa

SEQ ID NO: 5365032 - DNA, 22 bp, Homo sapiens
agtaatattacatttcatttat

SEQ ID NO: 5365033 - DNA, 13 bp, Homo sapiens
agtaatattatta

SEQ ID NO: 5365034 - DNA, 23 bp, Homo sapiens
agtaatattggtgctatttaaca

SEQ ID NO: 5365035 - DNA, 17 bp, Homo sapiens
agtaatatttaaagatt

SEQ ID NO: 5365036 - DNA, 14 bp, Homo sapiens
agtaatcaataaag

SEQ ID NO: 5365037 - DNA, 22 bp, Homo sapiens
agtaatcaatctactcaaagca

SEQ ID NO: 5365038 - DNA, 16 bp, Homo sapiens
agtaatcacttaaagg

SEQ ID NO: 5365039 - DNA, 20 bp, Homo sapiens
agtaatcagattactgcttt

SEQ ID NO: 5365040 - DNA, 14 bp, Homo sapiens
agtaatccacctgc

SEQ ID NO: 5365041 - DNA, 22 bp, Homo sapiens
agtaatcccgccacctatctcg

SEQ ID NO: 5365042 - DNA, 16 bp, Homo sapiens
agtaatcctgcacaga

SEQ ID NO: 5365043 - DNA, 23 bp, Homo sapiens
agtaatcgggcgcccgaagaggg

SEQ ID NO: 5365044 - DNA, 19 bp, Homo sapiens
agtaatctaatatggccac

SEQ ID NO: 5365045 - DNA, 16 bp, Homo sapiens
agtaatctaggtgtgg

SEQ ID NO: 5365046 - DNA, 14 bp, Homo sapiens
agtaatctatgtgt

SEQ ID NO: 5365047 - DNA, 14 bp, Homo sapiens
agtaatctgtacat

SEQ ID NO: 5365048 - DNA, 18 bp, Homo sapiens
agtaatctgtacattttg

SEQ ID NO: 5365049 - DNA, 13 bp, Homo sapiens
agtaatctgtata

SEQ ID NO: 5365050 - DNA, 14 bp, Homo sapiens
agtaatctgtcagt

SEQ ID NO: 5365051 - DNA, 13 bp, Homo sapiens
agtaatctgtgta

SEQ ID NO: 5365052 - DNA, 16 bp, Homo sapiens
agtaatctttcggtct

SEQ ID NO: 5365053 - DNA, 12 bp, Homo sapiens
agtaatcttttt

SEQ ID NO: 5365054 - DNA, 18 bp, Homo sapiens
agtaatctttttacagtt

SEQ ID NO: 5365055 - DNA, 15 bp, Homo sapiens
agtaatgaaatggag

SEQ ID NO: 5365056 - DNA, 13 bp, Homo sapiens
agtaatgaagaat

SEQ ID NO: 5365057 - DNA, 18 bp, Homo sapiens
agtaatgaaggcatattt

SEQ ID NO: 5365058 - DNA, 15 bp, Homo sapiens
agtaatgaattttat

SEQ ID NO: 5365059 - DNA, 22 bp, Homo sapiens
agtaatgacgtgtgtggctggg

SEQ ID NO: 5365060 - DNA, 16 bp, Homo sapiens
agtaatgacttagaaa

SEQ ID NO: 5365061 - DNA, 19 bp, Homo sapiens
agtaatgacttagaaactg

SEQ ID NO: 5365062 - DNA, 13 bp, Homo sapiens
agtaatgataact

SEQ ID NO: 5365063 - DNA, 18 bp, Homo sapiens
agtaatgataactggaaa

SEQ ID NO: 5365064 - DNA, 16 bp, Homo sapiens
agtaatgatactgtgt

SEQ ID NO: 5365065 - DNA, 17 bp, Homo sapiens
agtaatgatgaaatctt

SEQ ID NO: 5365066 - DNA, 15 bp, Homo sapiens
agtaatgatttcttg

SEQ ID NO: 5365067 - DNA, 20 bp, Homo sapiens
agtaatgcagtttttaaaaa

SEQ ID NO: 5365068 - DNA, 20 bp, Homo sapiens
agtaatgcatacagaaatat

SEQ ID NO: 5365069 - DNA, 16 bp, Homo sapiens
agtaatgctaaatgtg

SEQ ID NO: 5365070 - DNA, 19 bp, Homo sapiens
agtaatgctacgtgtgatt

SEQ ID NO: 5365071 - DNA, 20 bp, Homo sapiens
agtaatgctacgtgtgattt

SEQ ID NO: 5365072 - DNA, 21 bp, Homo sapiens
agtaatggaggtcccagccct

SEQ ID NO: 5365073 - DNA, 22 bp, Homo sapiens
agtaatggaggtcccagccctg

SEQ ID NO: 5365074 - DNA, 14 bp, Homo sapiens
agtaatggtgtaga

SEQ ID NO: 5365075 - DNA, 14 bp, Homo sapiens
agtaatgtattagt

SEQ ID NO: 5365076 - DNA, 21 bp, Homo sapiens
agtaatgtggaagaaaatggt

SEQ ID NO: 5365077 - DNA, 17 bp, Homo sapiens
agtaatgttattttctt

SEQ ID NO: 5365078 - DNA, 19 bp, Homo sapiens
agtaatgtttaagatctgt

SEQ ID NO: 5365079 - DNA, 18 bp, Homo sapiens
agtaattaaggtacatca

SEQ ID NO: 5365080 - DNA, 20 bp, Homo sapiens
agtaattaaggtacatcatt

SEQ ID NO: 5365081 - DNA, 13 bp, Homo sapiens
agtaattaataaa

SEQ ID NO: 5365082 - DNA, 22 bp, Homo sapiens
agtaattagtgttgtgcacttc

SEQ ID NO: 5365083 - DNA, 16 bp, Homo sapiens
agtaattcaactggaa

SEQ ID NO: 5365084 - DNA, 17 bp, Homo sapiens
agtaattcaactggaaa

SEQ ID NO: 5365085 - DNA, 16 bp, Homo sapiens
agtaattcccatctgc

SEQ ID NO: 5365086 - DNA, 22 bp, Homo sapiens
agtaattctaccctgaaagtga

SEQ ID NO: 5365087 - DNA, 19 bp, Homo sapiens
agtaattctgtcattccta

SEQ ID NO: 5365088 - DNA, 17 bp, Homo sapiens
agtaattgcacattttt

SEQ ID NO: 5365089 - DNA, 23 bp, Homo sapiens
agtaattgcacatttttttctat

SEQ ID NO: 5365090 - DNA, 13 bp, Homo sapiens
agtaattggaaag

SEQ ID NO: 5365091 - DNA, 12 bp, Homo sapiens
agtaattgtgaa

SEQ ID NO: 5365092 - DNA, 16 bp, Homo sapiens
agtaattgtgtttaca

SEQ ID NO: 5365093 - DNA, 21 bp, Homo sapiens
agtaattgtgtttacatttta

SEQ ID NO: 5365094 - DNA, 17 bp, Homo sapiens
agtaattgttacaattt

SEQ ID NO: 5365095 - DNA, 16 bp, Homo sapiens
agtaattgttccagag

SEQ ID NO: 5365096 - DNA, 18 bp, Homo sapiens
agtaattgttccagagac

SEQ ID NO: 5365097 - DNA, 14 bp, Homo sapiens
agtaatttaaatgc

SEQ ID NO: 5365098 - DNA, 18 bp, Homo sapiens
agtaatttaaatgctttg

SEQ ID NO: 5365099 - DNA, 14 bp, Homo sapiens
agtaatttagaaat

SEQ ID NO: 5365100 - DNA, 17 bp, Homo sapiens
agtaatttagaaatcat

SEQ ID NO: 5365101 - DNA, 23 bp, Homo sapiens
agtaatttagaaatcattttgca

SEQ ID NO: 5365102 - DNA, 17 bp, Homo sapiens
agtaatttatatagatg

SEQ ID NO: 5365103 - DNA, 13 bp, Homo sapiens
agtaatttattgt

SEQ ID NO: 5365104 - DNA, 23 bp, Homo sapiens
agtaatttattgtttttccttgt

SEQ ID NO: 5365105 - DNA, 19 bp, Homo sapiens
agtaatttcaagaatgttt

SEQ ID NO: 5365106 - DNA, 14 bp, Homo sapiens
agtaatttcagtgt

SEQ ID NO: 5365107 - DNA, 19 bp, Homo sapiens
agtaatttcagtgtaaagt

SEQ ID NO: 5365108 - DNA, 22 bp, Homo sapiens
agtaatttcagtgtaaagtgtg

SEQ ID NO: 5365109 - DNA, 12 bp, Homo sapiens
agtaatttcatg

SEQ ID NO: 5365110 - DNA, 22 bp, Homo sapiens
agtaatttcatttaaatatctg

SEQ ID NO: 5365111 - DNA, 15 bp, Homo sapiens
agtaatttgaggaca

SEQ ID NO: 5365112 - DNA, 22 bp, Homo sapiens
agtaatttggaaattaggttga

SEQ ID NO: 5365113 - DNA, 15 bp, Homo sapiens
agtaatttgtagatt

SEQ ID NO: 5365114 - DNA, 14 bp, Homo sapiens
agtaattttcatat

SEQ ID NO: 5365115 - DNA, 11 bp, Homo sapiens
agtacaaaatt

SEQ ID NO: 5365116 - DNA, 13 bp, Homo sapiens
agtacaaacatga

SEQ ID NO: 5365117 - DNA, 14 bp, Homo sapiens
agtacaaacatgaa

SEQ ID NO: 5365118 - DNA, 11 bp, Homo sapiens
agtacaaagac

SEQ ID NO: 5365119 - DNA, 18 bp, Homo sapiens
agtacaaatgaagaaagt

SEQ ID NO: 5365120 - DNA, 22 bp, Homo sapiens
agtacaaatgccttaaaatgga

SEQ ID NO: 5365121 - DNA, 17 bp, Homo sapiens
agtacaaattataaaaa

SEQ ID NO: 5365122 - DNA, 19 bp, Homo sapiens
agtacaagctcttgtttct

SEQ ID NO: 5365123 - DNA, 19 bp, Homo sapiens
agtacaagctgtaaacttg

SEQ ID NO: 5365124 - DNA, 22 bp, Homo sapiens
agtacaaggacagacagcaggc

SEQ ID NO: 5365125 - DNA, 18 bp, Homo sapiens
agtacaagtggtaatttt

SEQ ID NO: 5365126 - DNA, 14 bp, Homo sapiens
agtacaataaaagt

SEQ ID NO: 5365127 - DNA, 17 bp, Homo sapiens
agtacaataatgtactc

SEQ ID NO: 5365128 - DNA, 19 bp, Homo sapiens
agtacaataatgtactcac

SEQ ID NO: 5365129 - DNA, 12 bp, Homo sapiens
agtacaatcagc

SEQ ID NO: 5365130 - DNA, 15 bp, Homo sapiens
agtacaatcttggga

SEQ ID NO: 5365131 - DNA, 21 bp, Homo sapiens
agtacaatgaactgcttttcc

SEQ ID NO: 5365132 - DNA, 19 bp, Homo sapiens
agtacaatgtgactttgaa

SEQ ID NO: 5365133 - DNA, 22 bp, Homo sapiens
agtacaatgtgactttgaaaat

SEQ ID NO: 5365134 - DNA, 13 bp, Homo sapiens
agtacaatgtgtt

SEQ ID NO: 5365135 - DNA, 16 bp, Homo sapiens
agtacaatgtttcaga

SEQ ID NO: 5365136 - DNA, 14 bp, Homo sapiens
agtacaattcattg

SEQ ID NO: 5365137 - DNA, 15 bp, Homo sapiens
agtacaattctttgt

SEQ ID NO: 5365138 - DNA, 17 bp, Homo sapiens
agtacaattgttatgat

SEQ ID NO: 5365139 - DNA, 17 bp, Homo sapiens
agtacacaataagcaaa

SEQ ID NO: 5365140 - DNA, 21 bp, Homo sapiens
agtacacaataagcaaaaaca

SEQ ID NO: 5365141 - DNA, 11 bp, Homo sapiens
agtacacacaa

SEQ ID NO: 5365142 - DNA, 21 bp, Homo sapiens
agtacactgaatttttatgtg

SEQ ID NO: 5365143 - DNA, 23 bp, Homo sapiens
agtaggttggaagctagctcccc

SEQ ID NO: 5365144 - DNA, 17 bp, Homo sapiens
agtagtaaaattagaaa

SEQ ID NO: 5365145 - DNA, 19 bp, Homo sapiens
agtagtaaaattagaaaaa

SEQ ID NO: 5365146 - DNA, 21 bp, Homo sapiens
agtagtaaaattagaaaaaaa

SEQ ID NO: 5365147 - DNA, 17 bp, Homo sapiens
agtagtacttcttctgt

SEQ ID NO: 5365148 - DNA, 14 bp, Homo sapiens
agtagtacttgaaa

SEQ ID NO: 5365149 - DNA, 16 bp, Homo sapiens
agtagtatatttaatt

SEQ ID NO: 5365150 - DNA, 15 bp, Homo sapiens
agtagtatctgctta

SEQ ID NO: 5365151 - DNA, 21 bp, Homo sapiens
agtagtcaaaaacaaagctga

SEQ ID NO: 5365152 - DNA, 15 bp, Homo sapiens
agtagtcagaactat

SEQ ID NO: 5365153 - DNA, 16 bp, Homo sapiens
agtagtccaccttcat

SEQ ID NO: 5365154 - DNA, 12 bp, Homo sapiens
agtagtcctgtg

SEQ ID NO: 5365155 - DNA, 14 bp, Homo sapiens
agtagtcctgtgaa

SEQ ID NO: 5365156 - DNA, 17 bp, Homo sapiens
agtagtcttatgtaaag

SEQ ID NO: 5365157 - DNA, 19 bp, Homo sapiens
agtagtcttatgtaaagta

SEQ ID NO: 5365158 - DNA, 23 bp, Homo sapiens
agtagtcttatgtaaagtatgtt

SEQ ID NO: 5365159 - DNA, 18 bp, Homo sapiens
agtagtgaagactccaga

SEQ ID NO: 5365160 - DNA, 12 bp, Homo sapiens
agtagtgaccaa

SEQ ID NO: 5365161 - DNA, 20 bp, Homo sapiens
agtagtgagaagaatattgt

SEQ ID NO: 5365162 - DNA, 21 bp, Homo sapiens
agtagtgagaagaatattgtt

SEQ ID NO: 5365163 - DNA, 17 bp, Homo sapiens
agtagtgatgaaaagta

SEQ ID NO: 5365164 - DNA, 17 bp, Homo sapiens
agtagtgcatagaattc

SEQ ID NO: 5365165 - DNA, 19 bp, Homo sapiens
agtagtgcttggtgcatga

SEQ ID NO: 5365166 - DNA, 19 bp, Homo sapiens
agtagtggccactggggtg

SEQ ID NO: 5365167 - DNA, 22 bp, Homo sapiens
agtagtgggaaagatacatgct

SEQ ID NO: 5365168 - DNA, 23 bp, Homo sapiens
agtagtgtacattaccatataat

SEQ ID NO: 5365169 - DNA, 22 bp, Homo sapiens
agtagtgtcttcctagtatatt

SEQ ID NO: 5365170 - DNA, 13 bp, Homo sapiens
agtagtgtggcct

SEQ ID NO: 5365171 - DNA, 14 bp, Homo sapiens
agtagtgttctgtt

SEQ ID NO: 5365172 - DNA, 18 bp, Homo sapiens
agtagtgttctgttcact

SEQ ID NO: 5365173 - DNA, 20 bp, Homo sapiens
agtagtgttgggtggaggat

SEQ ID NO: 5365174 - DNA, 14 bp, Homo sapiens
agtagttaaaaaaa

SEQ ID NO: 5365175 - DNA, 23 bp, Homo sapiens
agtagttaaaaaaaaaaaaagga

SEQ ID NO: 5365176 - DNA, 14 bp, Homo sapiens
agtagttaaaacag

SEQ ID NO: 5365177 - DNA, 13 bp, Homo sapiens
agtagttaaataa

SEQ ID NO: 5365178 - DNA, 13 bp, Homo sapiens
agtagttagaaat

SEQ ID NO: 5365179 - DNA, 13 bp, Homo sapiens
agtagttatcatg

SEQ ID NO: 5365180 - DNA, 14 bp, Homo sapiens
agtagttatcatgt

SEQ ID NO: 5365181 - DNA, 15 bp, Homo sapiens
agtagttatcatgtt

SEQ ID NO: 5365182 - DNA, 17 bp, Homo sapiens
agtagttatcatgttag

SEQ ID NO: 5365183 - DNA, 13 bp, Homo sapiens
agtagttccagga

SEQ ID NO: 5365184 - DNA, 18 bp, Homo sapiens
agtagttctgtatttgaa

SEQ ID NO: 5365185 - DNA, 18 bp, Homo sapiens
agtagttctgtttggtgt

SEQ ID NO: 5365186 - DNA, 23 bp, Homo sapiens
agtagttgggattacaggtgact

SEQ ID NO: 5365187 - DNA, 15 bp, Homo sapiens
agtagttggtttgta

SEQ ID NO: 5365188 - DNA, 22 bp, Homo sapiens
agtagttggtttgtatgagatg

SEQ ID NO: 5365189 - DNA, 15 bp, Homo sapiens
agtagtttgcatttc

SEQ ID NO: 5365190 - DNA, 18 bp, Homo sapiens
agtagtttgcatttcaga

SEQ ID NO: 5365191 - DNA, 14 bp, Homo sapiens
agtagtttttacaa

SEQ ID NO: 5365192 - DNA, 13 bp, Homo sapiens
agtagtttttcag

SEQ ID NO: 5365193 - DNA, 15 bp, Homo sapiens
agtataaaaacttga

SEQ ID NO: 5365194 - DNA, 14 bp, Homo sapiens
agtataaaagacaa

SEQ ID NO: 5365195 - DNA, 19 bp, Homo sapiens
agtataaaataaagcaaat

SEQ ID NO: 5365196 - DNA, 17 bp, Homo sapiens
agtataaaatacaacaa

SEQ ID NO: 5365197 - DNA, 21 bp, Homo sapiens
agtataaaatacaacaaagga

SEQ ID NO: 5365198 - DNA, 13 bp, Homo sapiens
agtataaaattat

SEQ ID NO: 5365199 - DNA, 15 bp, Homo sapiens
agtataaaattatat

SEQ ID NO: 5365200 - DNA, 22 bp, Homo sapiens
agtataaacccattttggtgca

SEQ ID NO: 5365201 - DNA, 14 bp, Homo sapiens
agtataaagaatag

SEQ ID NO: 5365202 - DNA, 13 bp, Homo sapiens
agtataaatctgg

SEQ ID NO: 5365203 - DNA, 19 bp, Homo sapiens
agtataaattacatgcatg

SEQ ID NO: 5365204 - DNA, 19 bp, Homo sapiens
agtataaattcgctgtgag

SEQ ID NO: 5365205 - DNA, 19 bp, Homo sapiens
agtataaccatatgatact

SEQ ID NO: 5365206 - DNA, 17 bp, Homo sapiens
agtataactaatttgct

SEQ ID NO: 5365207 - DNA, 14 bp, Homo sapiens
agtataagaaattt

SEQ ID NO: 5365208 - DNA, 13 bp, Homo sapiens
agtataagatttt

SEQ ID NO: 5365209 - DNA, 15 bp, Homo sapiens
agtataagatttttg

SEQ ID NO: 5365210 - DNA, 16 bp, Homo sapiens
agtataagatttttga

SEQ ID NO: 5365211 - DNA, 20 bp, Homo sapiens
agtataatacattacatgta

SEQ ID NO: 5365212 - DNA, 21 bp, Homo sapiens
agtataatacattacatgtaa

SEQ ID NO: 5365213 - DNA, 15 bp, Homo sapiens
agtataatctcctct

SEQ ID NO: 5365214 - DNA, 15 bp, Homo sapiens
agtataatgaacact

SEQ ID NO: 5365215 - DNA, 22 bp, Homo sapiens
agtataatgtatgaattttgta

SEQ ID NO: 5365216 - DNA, 23 bp, Homo sapiens
agtataatgtatgaattttgtaa

SEQ ID NO: 5365217 - DNA, 14 bp, Homo sapiens
agtataattaacat

SEQ ID NO: 5365218 - DNA, 16 bp, Homo sapiens
agtataatttgacaaa

SEQ ID NO: 5365219 - DNA, 13 bp, Homo sapiens
agtataattttct

SEQ ID NO: 5365220 - DNA, 16 bp, Homo sapiens
agtataattttctaat

SEQ ID NO: 5365221 - DNA, 16 bp, Homo sapiens
agtatacaacaggaga

SEQ ID NO: 5365222 - DNA, 21 bp, Homo sapiens
agtatacaacaggagagagat

SEQ ID NO: 5365223 - DNA, 12 bp, Homo sapiens
agtatacaagat

SEQ ID NO: 5365224 - DNA, 19 bp, Homo sapiens
agtatacaatatataaaaa

SEQ ID NO: 5365225 - DNA, 22 bp, Homo sapiens
agtatacacatcataaacaaag

SEQ ID NO: 5365226 - DNA, 13 bp, Homo sapiens
agtatacattgtc

SEQ ID NO: 5365227 - DNA, 14 bp, Homo sapiens
agtatacatttagt

SEQ ID NO: 5365228 - DNA, 20 bp, Homo sapiens
agtatacatttagttaacac

SEQ ID NO: 5365229 - DNA, 13 bp, Homo sapiens
agtatacatttta

SEQ ID NO: 5365230 - DNA, 17 bp, Homo sapiens
agtatacctatcactta

SEQ ID NO: 5365231 - DNA, 12 bp, Homo sapiens
agtatacctggc

SEQ ID NO: 5365232 - DNA, 13 bp, Homo sapiens
agtatacggaaac

SEQ ID NO: 5365233 - DNA, 23 bp, Homo sapiens
agtatacggaaacaaaaatgatc

SEQ ID NO: 5365234 - DNA, 17 bp, Homo sapiens
agtatacgtataaatat

SEQ ID NO: 5365235 - DNA, 21 bp, Homo sapiens
agtatacgtataaatatcagt

SEQ ID NO: 5365236 - DNA, 22 bp, Homo sapiens
agtatacgtataaatatcagta

SEQ ID NO: 5365237 - DNA, 22 bp, Homo sapiens
agtatactaagagtaaagcaac

SEQ ID NO: 5365238 - DNA, 16 bp, Homo sapiens
agtatactgtgtggga

SEQ ID NO: 5365239 - DNA, 23 bp, Homo sapiens
agtatactttgtacccatcatgt

SEQ ID NO: 5365240 - DNA, 15 bp, Homo sapiens
agtatagaaaatgga

SEQ ID NO: 5365241 - DNA, 20 bp, Homo sapiens
agtatagaatgaactgtcta

SEQ ID NO: 5365242 - DNA, 19 bp, Homo sapiens
agtatagagaaaagtgtat

SEQ ID NO: 5365243 - DNA, 16 bp, Homo sapiens
agtatagagagaagtt

SEQ ID NO: 5365244 - DNA, 21 bp, Homo sapiens
agtatagatacaaaaccttgt

SEQ ID NO: 5365245 - DNA, 15 bp, Homo sapiens
agtatagatggccaa

SEQ ID NO: 5365246 - DNA, 15 bp, Homo sapiens
agtatagtctccctt

SEQ ID NO: 5365247 - DNA, 14 bp, Homo sapiens
agtatagtgcaaat

SEQ ID NO: 5365248 - DNA, 22 bp, Homo sapiens
agtatagtttaaaaatctgcca

SEQ ID NO: 5365249 - DNA, 15 bp, Homo sapiens
agtatataagctttt

SEQ ID NO: 5365250 - DNA, 17 bp, Homo sapiens
agtatataataacttta

SEQ ID NO: 5365251 - DNA, 19 bp, Homo sapiens
agtatatacagagcctgtt

SEQ ID NO: 5365252 - DNA, 15 bp, Homo sapiens
agtatatagtatatt

SEQ ID NO: 5365253 - DNA, 13 bp, Homo sapiens
agtatatattctt

SEQ ID NO: 5365254 - DNA, 16 bp, Homo sapiens
agtatatattctttca

SEQ ID NO: 5365255 - DNA, 20 bp, Homo sapiens
agtatatcacagagccactc

SEQ ID NO: 5365256 - DNA, 21 bp, Homo sapiens
agtatatcatgtaaagaaatg

SEQ ID NO: 5365257 - DNA, 21 bp, Homo sapiens
agtatatgaaatattttgaat

SEQ ID NO: 5365258 - DNA, 14 bp, Homo sapiens
agtatatgtaacag

SEQ ID NO: 5365259 - DNA, 15 bp, Homo sapiens
agtatatgtaacagt

SEQ ID NO: 5365260 - DNA, 13 bp, Homo sapiens
agtatatgtcatt

SEQ ID NO: 5365261 - DNA, 16 bp, Homo sapiens
agtatattaaaaatgg

SEQ ID NO: 5365262 - DNA, 22 bp, Homo sapiens
agtatattaaaaatggtaaaat

SEQ ID NO: 5365263 - DNA, 16 bp, Homo sapiens
agtatattataataga

SEQ ID NO: 5365264 - DNA, 21 bp, Homo sapiens
agtatattcttgtaaatacat

SEQ ID NO: 5365265 - DNA, 21 bp, Homo sapiens
agtatattgataaccttgaaa

SEQ ID NO: 5365266 - DNA, 14 bp, Homo sapiens
agtatattgttgaa

SEQ ID NO: 5365267 - DNA, 20 bp, Homo sapiens
agtatattgttgaagagaca

SEQ ID NO: 5365268 - DNA, 18 bp, Homo sapiens
agtatatttatataatta

SEQ ID NO: 5365269 - DNA, 13 bp, Homo sapiens
agtatatttgtaa

SEQ ID NO: 5365270 - DNA, 15 bp, Homo sapiens
agtatatttgtaaaa

SEQ ID NO: 5365271 - DNA, 20 bp, Homo sapiens
agtatattttatttcaatgt

SEQ ID NO: 5365272 - DNA, 15 bp, Homo sapiens
agtatattttctgta

SEQ ID NO: 5365273 - DNA, 16 bp, Homo sapiens
agtatattttctgtat

SEQ ID NO: 5365274 - DNA, 19 bp, Homo sapiens
agtatattttcttttcctc

SEQ ID NO: 5365275 - DNA, 12 bp, Homo sapiens
agtatatttttg

SEQ ID NO: 5365276 - DNA, 21 bp, Homo sapiens
agtatatttttgtctgcagct

SEQ ID NO: 5365277 - DNA, 16 bp, Homo sapiens
agtatcaaaggcagaa

SEQ ID NO: 5365278 - DNA, 13 bp, Homo sapiens
agtatcaaggctg

SEQ ID NO: 5365279 - DNA, 19 bp, Homo sapiens
agtatcaagtgttctaaaa

SEQ ID NO: 5365280 - DNA, 23 bp, Homo sapiens
agtatcaagtgttctaaaatgaa

SEQ ID NO: 5365281 - DNA, 20 bp, Homo sapiens
agtatcactctaatataata

SEQ ID NO: 5365282 - DNA, 21 bp, Homo sapiens
agtatcactctaatataatat

SEQ ID NO: 5365283 - DNA, 23 bp, Homo sapiens
agtatcagagatgtccattttta

SEQ ID NO: 5365284 - DNA, 15 bp, Homo sapiens
agtatcagctacaat

SEQ ID NO: 5365285 - DNA, 19 bp, Homo sapiens
agtatcagctacaattgta

SEQ ID NO: 5365286 - DNA, 15 bp, Homo sapiens
agtatcaggcctgcc

SEQ ID NO: 5365287 - DNA, 18 bp, Homo sapiens
agtatcaggtctcccacg

SEQ ID NO: 5365288 - DNA, 12 bp, Homo sapiens
agtatcataata

SEQ ID NO: 5365289 - DNA, 19 bp, Homo sapiens
agtatccaattatgtgaca

SEQ ID NO: 5365290 - DNA, 14 bp, Homo sapiens
agtatccagacctt

SEQ ID NO: 5365291 - DNA, 23 bp, Homo sapiens
agtatccaggctttgtacagagt

SEQ ID NO: 5365292 - DNA, 19 bp, Homo sapiens
agtatccagtactttataa

SEQ ID NO: 5365293 - DNA, 16 bp, Homo sapiens
agtatccatgcatgtg

SEQ ID NO: 5365294 - DNA, 12 bp, Homo sapiens
agtatcccacat

SEQ ID NO: 5365295 - DNA, 18 bp, Homo sapiens
agtatcccacatccaact

SEQ ID NO: 5365296 - DNA, 23 bp, Homo sapiens
agtatcccttatccaaaatgctt

SEQ ID NO: 5365297 - DNA, 14 bp, Homo sapiens
agtatcctccaggt

SEQ ID NO: 5365298 - DNA, 13 bp, Homo sapiens
agtatcctggatt

SEQ ID NO: 5365299 - DNA, 15 bp, Homo sapiens
agtatccttccttca

SEQ ID NO: 5365300 - DNA, 15 bp, Homo sapiens
agtatcggcactgta

SEQ ID NO: 5365301 - DNA, 16 bp, Homo sapiens
agtatcggcactgtac

SEQ ID NO: 5365302 - DNA, 17 bp, Homo sapiens
agtatctaacaaaacca

SEQ ID NO: 5365303 - DNA, 16 bp, Homo sapiens
agtatctaacatgtat

SEQ ID NO: 5365304 - DNA, 12 bp, Homo sapiens
agtatctattgt

SEQ ID NO: 5365305 - DNA, 18 bp, Homo sapiens
agtatctcaacaacatgt

SEQ ID NO: 5365306 - DNA, 21 bp, Homo sapiens
agtatctcatcaacaaagaaa

SEQ ID NO: 5365307 - DNA, 19 bp, Homo sapiens
agtatctcctcgcaagctg

SEQ ID NO: 5365308 - DNA, 21 bp, Homo sapiens
agtatctcgtaatagcttctg

SEQ ID NO: 5365309 - DNA, 18 bp, Homo sapiens
agtatctctactttcctg

SEQ ID NO: 5365310 - DNA, 21 bp, Homo sapiens
agtatctctactttcctgatg

SEQ ID NO: 5365311 - DNA, 23 bp, Homo sapiens
agtatctgctgttcttcagtcct

SEQ ID NO: 5365312 - DNA, 16 bp, Homo sapiens
agtatctggctgggtt

SEQ ID NO: 5365313 - DNA, 14 bp, Homo sapiens
agtatcttaaaatt

SEQ ID NO: 5365314 - DNA, 20 bp, Homo sapiens
agtatcttagagtttacagt

SEQ ID NO: 5365315 - DNA, 14 bp, Homo sapiens
agtatcttcaaaaa

SEQ ID NO: 5365316 - DNA, 16 bp, Homo sapiens
agtatcttcaaaaata

SEQ ID NO: 5365317 - DNA, 21 bp, Homo sapiens
agtatcttcaaaaatacagaa

SEQ ID NO: 5365318 - DNA, 15 bp, Homo sapiens
agtatcttctatttt

SEQ ID NO: 5365319 - DNA, 15 bp, Homo sapiens
agtatcttgggtgta

SEQ ID NO: 5365320 - DNA, 23 bp, Homo sapiens
agtatcttgggtgtattctctgt

SEQ ID NO: 5365321 - DNA, 16 bp, Homo sapiens
agtattgtcaccagga

SEQ ID NO: 5365322 - DNA, 15 bp, Homo sapiens
agtattgtccaggtc

SEQ ID NO: 5365323 - DNA, 13 bp, Homo sapiens
agtattgtgaaag

SEQ ID NO: 5365324 - DNA, 17 bp, Homo sapiens
agtattgtgtaaaggaa

SEQ ID NO: 5365325 - DNA, 17 bp, Homo sapiens
agtattgttaatgaata

SEQ ID NO: 5365326 - DNA, 19 bp, Homo sapiens
agtattgttcgttctgata

SEQ ID NO: 5365327 - DNA, 13 bp, Homo sapiens
agtattgttgtcc

SEQ ID NO: 5365328 - DNA, 12 bp, Homo sapiens
agtattgtttaa

SEQ ID NO: 5365329 - DNA, 13 bp, Homo sapiens
agtattgtttaaa

SEQ ID NO: 5365330 - DNA, 22 bp, Homo sapiens
agtattgtttaaaatgtaattt

SEQ ID NO: 5365331 - DNA, 16 bp, Homo sapiens
agtattgtttacatta

SEQ ID NO: 5365332 - DNA, 15 bp, Homo sapiens
agtatttaacattct

SEQ ID NO: 5365333 - DNA, 17 bp, Homo sapiens
agtatttaacattcttg

SEQ ID NO: 5365334 - DNA, 12 bp, Homo sapiens
agtatttaacta

SEQ ID NO: 5365335 - DNA, 17 bp, Homo sapiens
agtatttaacttctgag

SEQ ID NO: 5365336 - DNA, 14 bp, Homo sapiens
agtatttaagccta

SEQ ID NO: 5365337 - DNA, 15 bp, Homo sapiens
agtatttaatgaaac

SEQ ID NO: 5365338 - DNA, 16 bp, Homo sapiens
agtatttaattgtttc

SEQ ID NO: 5365339 - DNA, 19 bp, Homo sapiens
agtatttaatttggatctg

SEQ ID NO: 5365340 - DNA, 13 bp, Homo sapiens
agtatttactttt

SEQ ID NO: 5365341 - DNA, 18 bp, Homo sapiens
agtatttactttttaaaa

SEQ ID NO: 5365342 - DNA, 20 bp, Homo sapiens
agtatttactttttaaaaat

SEQ ID NO: 5365343 - DNA, 19 bp, Homo sapiens
agtatttaggatgactgct

SEQ ID NO: 5365344 - DNA, 16 bp, Homo sapiens
agtatttagtatatga

SEQ ID NO: 5365345 - DNA, 17 bp, Homo sapiens
agtatttataaaaatat

SEQ ID NO: 5365346 - DNA, 19 bp, Homo sapiens
agtatttataaaaatataa

SEQ ID NO: 5365347 - DNA, 15 bp, Homo sapiens
agtatttatatattt

SEQ ID NO: 5365348 - DNA, 21 bp, Homo sapiens
agtatttatatttaaattata

SEQ ID NO: 5365349 - DNA, 16 bp, Homo sapiens
agtatttatcaggaga

SEQ ID NO: 5365350 - DNA, 13 bp, Homo sapiens
agtatttatgggt

SEQ ID NO: 5365351 - DNA, 13 bp, Homo sapiens
agtatttatgtaa

SEQ ID NO: 5365352 - DNA, 14 bp, Homo sapiens
agtatttatgtaat

SEQ ID NO: 5365353 - DNA, 23 bp, Homo sapiens
agtatttatgtaatttgtacagg

SEQ ID NO: 5365354 - DNA, 14 bp, Homo sapiens
agtatttattccca

SEQ ID NO: 5365355 - DNA, 16 bp, Homo sapiens
agtatttattttgtaa

SEQ ID NO: 5365356 - DNA, 16 bp, Homo sapiens
agtatttcaaattgga

SEQ ID NO: 5365357 - DNA, 20 bp, Homo sapiens
agtatttcaaattggagctt

SEQ ID NO: 5365358 - DNA, 16 bp, Homo sapiens
agtatttcaactgctg

SEQ ID NO: 5365359 - DNA, 17 bp, Homo sapiens
agtatttcaactgctgt

SEQ ID NO: 5365360 - DNA, 21 bp, Homo sapiens
agtatttcacagcaacactct

SEQ ID NO: 5365361 - DNA, 17 bp, Homo sapiens
agtatttcagatgcttt

SEQ ID NO: 5365362 - DNA, 13 bp, Homo sapiens
agtatttcagtgt

SEQ ID NO: 5365363 - DNA, 17 bp, Homo sapiens
agtatttcagtgtagtt

SEQ ID NO: 5365364 - DNA, 22 bp, Homo sapiens
agtatttcagtgttttcatttt

SEQ ID NO: 5365365 - DNA, 21 bp, Homo sapiens
agtatttcattgcctgtgtat

SEQ ID NO: 5365366 - DNA, 18 bp, Homo sapiens
agtatttccacttgttct

SEQ ID NO: 5365367 - DNA, 22 bp, Homo sapiens
agtatttccacttgttctcagg

SEQ ID NO: 5365368 - DNA, 18 bp, Homo sapiens
agtatttcccttccaaag

SEQ ID NO: 5365369 - DNA, 12 bp, Homo sapiens
agtatttccttc

SEQ ID NO: 5365370 - DNA, 22 bp, Homo sapiens
agtatttccttccactgtagct

SEQ ID NO: 5365371 - DNA, 22 bp, Homo sapiens
agtatttctacattacagccat

SEQ ID NO: 5365372 - DNA, 12 bp, Homo sapiens
agtatttctcag

SEQ ID NO: 5365373 - DNA, 13 bp, Homo sapiens
agtatttctcctt

SEQ ID NO: 5365374 - DNA, 16 bp, Homo sapiens
agtatttctgattttg

SEQ ID NO: 5365375 - DNA, 15 bp, Homo sapiens
agtatttctgttcct

SEQ ID NO: 5365376 - DNA, 13 bp, Homo sapiens
agtatttgaaaac

SEQ ID NO: 5365377 - DNA, 20 bp, Homo sapiens
agtatttgaaaacagaaatt

SEQ ID NO: 5365378 - DNA, 12 bp, Homo sapiens
agtatttgaatt

SEQ ID NO: 5365379 - DNA, 20 bp, Homo sapiens
agtatttgaattaaaacttc

SEQ ID NO: 5365380 - DNA, 22 bp, Homo sapiens
agtatttgaattaaaacttctt

SEQ ID NO: 5365381 - DNA, 23 bp, Homo sapiens
agtatttgatcagtaagtcacag

SEQ ID NO: 5365382 - DNA, 22 bp, Homo sapiens
agtatttgatgtacattacaga

SEQ ID NO: 5365383 - DNA, 17 bp, Homo sapiens
agtatttgattcaaaat

SEQ ID NO: 5365384 - DNA, 12 bp, Homo sapiens
agtatttgctgt

SEQ ID NO: 5365385 - DNA, 13 bp, Homo sapiens
agtatttgctgtt

SEQ ID NO: 5365386 - DNA, 11 bp, Homo sapiens
agtatttggaa

SEQ ID NO: 5365387 - DNA, 23 bp, Homo sapiens
agtatttggcttgtcacaggaat

SEQ ID NO: 5365388 - DNA, 21 bp, Homo sapiens
agtatttgggaagtgaagact

SEQ ID NO: 5365389 - DNA, 19 bp, Homo sapiens
agtatttggtccaaaaaaa

SEQ ID NO: 5365390 - DNA, 18 bp, Homo sapiens
agtatttgtacaaatact

SEQ ID NO: 5365391 - DNA, 13 bp, Homo sapiens
agtatttgttaat

SEQ ID NO: 5365392 - DNA, 16 bp, Homo sapiens
agtattttaaaatagc

SEQ ID NO: 5365393 - DNA, 20 bp, Homo sapiens
agtattttaattttaaagag

SEQ ID NO: 5365394 - DNA, 22 bp, Homo sapiens
agtattttacctagcatttcaa

SEQ ID NO: 5365395 - DNA, 20 bp, Homo sapiens
agtattttagtgaacttgaa

SEQ ID NO: 5365396 - DNA, 13 bp, Homo sapiens
agtattttatctg

SEQ ID NO: 5365397 - DNA, 18 bp, Homo sapiens
agtattttatctggaaca

SEQ ID NO: 5365398 - DNA, 20 bp, Homo sapiens
agtattttattaaagcaaca

SEQ ID NO: 5365399 - DNA, 17 bp, Homo sapiens
agtattttccagcctta

SEQ ID NO: 5365400 - DNA, 13 bp, Homo sapiens
agtattttcctcc

SEQ ID NO: 5365401 - DNA, 16 bp, Homo sapiens
agtattttctccactt

SEQ ID NO: 5365402 - DNA, 23 bp, Homo sapiens
agtattttcttctctgtgagaag

SEQ ID NO: 5365403 - DNA, 13 bp, Homo sapiens
agtattttgaagt

SEQ ID NO: 5365404 - DNA, 22 bp, Homo sapiens
agtattttgaagtttacatttt

SEQ ID NO: 5365405 - DNA, 11 bp, Homo sapiens
agtattttgag

SEQ ID NO: 5365406 - DNA, 12 bp, Homo sapiens
agtattttgagc

SEQ ID NO: 5365407 - DNA, 21 bp, Homo sapiens
agtattttgagccttattaaa

SEQ ID NO: 5365408 - DNA, 23 bp, Homo sapiens
agtattttgagccttattaaaat

SEQ ID NO: 5365409 - DNA, 14 bp, Homo sapiens
agtattttgtttca

SEQ ID NO: 5365410 - DNA, 15 bp, Homo sapiens
agtatttttataatt

SEQ ID NO: 5365411 - DNA, 19 bp, Homo sapiens
agtatttttatatttaaat

SEQ ID NO: 5365412 - DNA, 13 bp, Homo sapiens
agtatttttcaga

SEQ ID NO: 5365413 - DNA, 18 bp, Homo sapiens
agtatttttcctttttaa

SEQ ID NO: 5365414 - DNA, 12 bp, Homo sapiens
agtatttttgaa

SEQ ID NO: 5365415 - DNA, 22 bp, Homo sapiens
agtattttttacattttacaca

SEQ ID NO: 5365416 - DNA, 24 bp, Homo sapiens
agtattttttacattttacacact

SEQ ID NO: 5365417 - DNA, 19 bp, Homo sapiens
agtatttttttaagttaga

SEQ ID NO: 5365418 - DNA, 19 bp, Homo sapiens
agtattttttttgctttta

SEQ ID NO: 5365419 - DNA, 20 bp, Homo sapiens
agtatttttttttaattttg

SEQ ID NO: 5365420 - DNA, 20 bp, Homo sapiens
agtcaaaaaattatttgcta

SEQ ID NO: 5365421 - DNA, 15 bp, Homo sapiens
agtcaaaaattaaac

SEQ ID NO: 5365422 - DNA, 17 bp, Homo sapiens
agtcaaaactacaaatc

SEQ ID NO: 5365423 - DNA, 16 bp, Homo sapiens
agtcaaaactcaaatg

SEQ ID NO: 5365424 - DNA, 13 bp, Homo sapiens
agtcaaaacttta

SEQ ID NO: 5365425 - DNA, 15 bp, Homo sapiens
agtcaaaaggtgcct

SEQ ID NO: 5365426 - DNA, 16 bp, Homo sapiens
agtcaaaaggtgcctg

SEQ ID NO: 5365427 - DNA, 21 bp, Homo sapiens
agtcaaaataatctgaaatga

SEQ ID NO: 5365428 - DNA, 21 bp, Homo sapiens
agtcaaaatatttttaaaaga

SEQ ID NO: 5365429 - DNA, 18 bp, Homo sapiens
agtcaaacaaaaaagaaa

SEQ ID NO: 5365430 - DNA, 19 bp, Homo sapiens
agtcaaacaaaaaagaaaa

SEQ ID NO: 5365431 - DNA, 16 bp, Homo sapiens
agtcaaacagtgtggc

SEQ ID NO: 5365432 - DNA, 17 bp, Homo sapiens
agtcaaacagtgtggct

SEQ ID NO: 5365433 - DNA, 21 bp, Homo sapiens
agtcaaacgactaacctatct

SEQ ID NO: 5365434 - DNA, 15 bp, Homo sapiens
agtcaaactgtgcca

SEQ ID NO: 5365435 - DNA, 13 bp, Homo sapiens
agtcaaagacatt

SEQ ID NO: 5365436 - DNA, 17 bp, Homo sapiens
agtcaaagacgctgagt

SEQ ID NO: 5365437 - DNA, 16 bp, Homo sapiens
agtcaaagagagtttt

SEQ ID NO: 5365438 - DNA, 18 bp, Homo sapiens
agtcaaaggcatctccct

SEQ ID NO: 5365439 - DNA, 19 bp, Homo sapiens
agtcaaaggcatctccctt

SEQ ID NO: 5365440 - DNA, 21 bp, Homo sapiens
agtcaaagtgttgctgtggct

SEQ ID NO: 5365441 - DNA, 17 bp, Homo sapiens
agtcaaagttgaaaatt

SEQ ID NO: 5365442 - DNA, 20 bp, Homo sapiens
agtcaaagttgaaaattcat

SEQ ID NO: 5365443 - DNA, 15 bp, Homo sapiens
agtcaaataaatgtt

SEQ ID NO: 5365444 - DNA, 19 bp, Homo sapiens
agtcaaatccagtggtggg

SEQ ID NO: 5365445 - DNA, 20 bp, Homo sapiens
agtcaaatccagtggtgggt

SEQ ID NO: 5365446 - DNA, 22 bp, Homo sapiens
agtcaaatgtaatgtggcttct

SEQ ID NO: 5365447 - DNA, 22 bp, Homo sapiens
agtcaaattaataatcttatta

SEQ ID NO: 5365448 - DNA, 14 bp, Homo sapiens
agtcaaatttacat

SEQ ID NO: 5365449 - DNA, 15 bp, Homo sapiens
agtcaaatttacatt

SEQ ID NO: 5365450 - DNA, 18 bp, Homo sapiens
agtcaaatttacatttat

SEQ ID NO: 5365451 - DNA, 21 bp, Homo sapiens
agtcaaatttacatttatcta

SEQ ID NO: 5365452 - DNA, 16 bp, Homo sapiens
agtcaaatttacttta

SEQ ID NO: 5365453 - DNA, 12 bp, Homo sapiens
agtcaacaaatt

SEQ ID NO: 5365454 - DNA, 14 bp, Homo sapiens
agtcaacaagcctg

SEQ ID NO: 5365455 - DNA, 15 bp, Homo sapiens
agtcaacactcttct

SEQ ID NO: 5365456 - DNA, 13 bp, Homo sapiens
agtcaacagattc

SEQ ID NO: 5365457 - DNA, 13 bp, Homo sapiens
agtcaacagtaaa

SEQ ID NO: 5365458 - DNA, 18 bp, Homo sapiens
agtcaacagtaaaccact

SEQ ID NO: 5365459 - DNA, 12 bp, Homo sapiens
agtcaacagtac

SEQ ID NO: 5365460 - DNA, 15 bp, Homo sapiens
agtcaacagttcaaa

SEQ ID NO: 5365461 - DNA, 22 bp, Homo sapiens
agtcaaccctcctaaaagttca

SEQ ID NO: 5365462 - DNA, 14 bp, Homo sapiens
agtcaacctgggca

SEQ ID NO: 5365463 - DNA, 19 bp, Homo sapiens
agtcaacggggggctcctg

SEQ ID NO: 5365464 - DNA, 21 bp, Homo sapiens
agtcaacggggggctcctgcc

SEQ ID NO: 5365465 - DNA, 21 bp, Homo sapiens
agtcaactacacaaagcaggc

SEQ ID NO: 5365466 - DNA, 21 bp, Homo sapiens
agtcaactgctgttttatgtc

SEQ ID NO: 5365467 - DNA, 14 bp, Homo sapiens
agtcaactggagca

SEQ ID NO: 5365468 - DNA, 19 bp, Homo sapiens
agtcaagaaaaacattatt

SEQ ID NO: 5365469 - DNA, 23 bp, Homo sapiens
agtcaagaaaaatataaaaacaa

SEQ ID NO: 5365470 - DNA, 19 bp, Homo sapiens
agtcaagacggatccacag

SEQ ID NO: 5365471 - DNA, 20 bp, Homo sapiens
agtcaagacggatccacagt

SEQ ID NO: 5365472 - DNA, 20 bp, Homo sapiens
agtcaagaggtttttctccc

SEQ ID NO: 5365473 - DNA, 16 bp, Homo sapiens
agtcaagctcctcctc

SEQ ID NO: 5365474 - DNA, 17 bp, Homo sapiens
agtcaagctcctcctcc

SEQ ID NO: 5365475 - DNA, 22 bp, Homo sapiens
agtcaagctcctcctccctgca

SEQ ID NO: 5365476 - DNA, 16 bp, Homo sapiens
agtcaaggagtggctt

SEQ ID NO: 5365477 - DNA, 15 bp, Homo sapiens
agtcaaggcctgctc

SEQ ID NO: 5365478 - DNA, 15 bp, Homo sapiens
agtcaagtctacctg

SEQ ID NO: 5365479 - DNA, 16 bp, Homo sapiens
agtcaagtgaaaaagg

SEQ ID NO: 5365480 - DNA, 20 bp, Homo sapiens
agtcaagtgaaaaaggagga

SEQ ID NO: 5365481 - DNA, 18 bp, Homo sapiens
agtcaagtgtgcctgcta

SEQ ID NO: 5365482 - DNA, 19 bp, Homo sapiens
agtcaagttccctcctgca

SEQ ID NO: 5365483 - DNA, 21 bp, Homo sapiens
agtcaataaaagagctgtctg

SEQ ID NO: 5365484 - DNA, 12 bp, Homo sapiens
agtcaataaact

SEQ ID NO: 5365485 - DNA, 18 bp, Homo sapiens
agtcaataactctgattt

SEQ ID NO: 5365486 - DNA, 21 bp, Homo sapiens
agtcaatacatagtgctgctg

SEQ ID NO: 5365487 - DNA, 23 bp, Homo sapiens
agtcaatatggggcattaatatt

SEQ ID NO: 5365488 - DNA, 14 bp, Homo sapiens
agtcaatcactgca

SEQ ID NO: 5365489 - DNA, 15 bp, Homo sapiens
agtcaatcagccttt

SEQ ID NO: 5365490 - DNA, 17 bp, Homo sapiens
agtcaatcagcctttag

SEQ ID NO: 5365491 - DNA, 18 bp, Homo sapiens
agtcaatcagcctttagg

SEQ ID NO: 5365492 - DNA, 19 bp, Homo sapiens
agtcaatcatgtgtttaaa

SEQ ID NO: 5365493 - DNA, 15 bp, Homo sapiens
agtcaatcatttctc

SEQ ID NO: 5365494 - DNA, 18 bp, Homo sapiens
agtcaatcccctcattca

SEQ ID NO: 5365495 - DNA, 15 bp, Homo sapiens
agtcaatggatccac

SEQ ID NO: 5365496 - DNA, 18 bp, Homo sapiens
agtcaatggcaaagaaaa

SEQ ID NO: 5365497 - DNA, 14 bp, Homo sapiens
agtcaatggcttgt

SEQ ID NO: 5365498 - DNA, 19 bp, Homo sapiens
agtcaatgtacttgtttga

SEQ ID NO: 5365499 - DNA, 15 bp, Homo sapiens
agtcatttgttaata

SEQ ID NO: 5365500 - DNA, 15 bp, Homo sapiens
agtcatttgtttaaa

SEQ ID NO: 5365501 - DNA, 21 bp, Homo sapiens
agtcattttaactttatcaca

SEQ ID NO: 5365502 - DNA, 13 bp, Homo sapiens
agtcattttcaag

SEQ ID NO: 5365503 - DNA, 15 bp, Homo sapiens
agtcattttcaagac

SEQ ID NO: 5365504 - DNA, 21 bp, Homo sapiens
agtcattttcatgtgtgtgag

SEQ ID NO: 5365505 - DNA, 19 bp, Homo sapiens
agtcattttgtaatatttg

SEQ ID NO: 5365506 - DNA, 13 bp, Homo sapiens
agtcatttttagc

SEQ ID NO: 5365507 - DNA, 16 bp, Homo sapiens
agtcatttttcttgat

SEQ ID NO: 5365508 - DNA, 19 bp, Homo sapiens
agtcattttttacttgaat

SEQ ID NO: 5365509 - DNA, 13 bp, Homo sapiens
agtccaaaatcat

SEQ ID NO: 5365510 - DNA, 14 bp, Homo sapiens
agtccaaaatcatt

SEQ ID NO: 5365511 - DNA, 16 bp, Homo sapiens
agtccaaatgtcctcc

SEQ ID NO: 5365512 - DNA, 19 bp, Homo sapiens
agtccaaatgtcctccaga

SEQ ID NO: 5365513 - DNA, 20 bp, Homo sapiens
agtccaaatgtgatcaactg

SEQ ID NO: 5365514 - DNA, 17 bp, Homo sapiens
agtccaaattgtttgta

SEQ ID NO: 5365515 - DNA, 17 bp, Homo sapiens
agtccaacaatgttgtt

SEQ ID NO: 5365516 - DNA, 23 bp, Homo sapiens
agtccaacattttttcccagtga

SEQ ID NO: 5365517 - DNA, 18 bp, Homo sapiens
agtccaacctgcctgtgc

SEQ ID NO: 5365518 - DNA, 18 bp, Homo sapiens
agtccaacgtggggcagc

SEQ ID NO: 5365519 - DNA, 20 bp, Homo sapiens
agtccaacgtggggcagcac

SEQ ID NO: 5365520 - DNA, 23 bp, Homo sapiens
agtccaacgtggggcagcacaga

SEQ ID NO: 5365521 - DNA, 14 bp, Homo sapiens
agtccaactcactt

SEQ ID NO: 5365522 - DNA, 17 bp, Homo sapiens
agtccaactcacttcca

SEQ ID NO: 5365523 - DNA, 21 bp, Homo sapiens
agtccaagccgtaggacccag

SEQ ID NO: 5365524 - DNA, 16 bp, Homo sapiens
agtccaaggccagtcc

SEQ ID NO: 5365525 - DNA, 22 bp, Homo sapiens
agtccaaggggtcccctccagg

SEQ ID NO: 5365526 - DNA, 23 bp, Homo sapiens
agtccaaggggtcccctccagga

SEQ ID NO: 5365527 - DNA, 14 bp, Homo sapiens
agtccaatcagtgg

SEQ ID NO: 5365528 - DNA, 17 bp, Homo sapiens
agtccaatgaagataaa

SEQ ID NO: 5365529 - DNA, 21 bp, Homo sapiens
agtccaatgtaccatgttgcc

SEQ ID NO: 5365530 - DNA, 18 bp, Homo sapiens
agtccaatgtctttttaa

SEQ ID NO: 5365531 - DNA, 17 bp, Homo sapiens
agtccaattttaattta

SEQ ID NO: 5365532 - DNA, 21 bp, Homo sapiens
agtccaattttaatttagtaa

SEQ ID NO: 5365533 - DNA, 14 bp, Homo sapiens
agtccaattttcct

SEQ ID NO: 5365534 - DNA, 13 bp, Homo sapiens
agtccacaaggtc

SEQ ID NO: 5365535 - DNA, 23 bp, Homo sapiens
agtccacaggacgcacagcccag

SEQ ID NO: 5365536 - DNA, 20 bp, Homo sapiens
agtccacatcttctcagtgt

SEQ ID NO: 5365537 - DNA, 21 bp, Homo sapiens
agtccaccccaattaactgaa

SEQ ID NO: 5365538 - DNA, 17 bp, Homo sapiens
agtccaccctgcctgcc

SEQ ID NO: 5365539 - DNA, 15 bp, Homo sapiens
agtccacctgaggaa

SEQ ID NO: 5365540 - DNA, 14 bp, Homo sapiens
agtccacggacccc

SEQ ID NO: 5365541 - DNA, 18 bp, Homo sapiens
agtccacggacccccaga

SEQ ID NO: 5365542 - DNA, 16 bp, Homo sapiens
agtccactcccagtgc

SEQ ID NO: 5365543 - DNA, 20 bp, Homo sapiens
agtccactcccagtgcttgc

SEQ ID NO: 5365544 - DNA, 20 bp, Homo sapiens
agtccactggggagtgctgg

SEQ ID NO: 5365545 - DNA, 12 bp, Homo sapiens
agtccactgtcc

SEQ ID NO: 5365546 - DNA, 14 bp, Homo sapiens
agtccactgtcctc

SEQ ID NO: 5365547 - DNA, 17 bp, Homo sapiens
agtccactgtcctcctt

SEQ ID NO: 5365548 - DNA, 18 bp, Homo sapiens
agtccactgtcctccttg

SEQ ID NO: 5365549 - DNA, 21 bp, Homo sapiens
agtccactgtcctccttggcg

SEQ ID NO: 5365550 - DNA, 13 bp, Homo sapiens
agtccactgttga

SEQ ID NO: 5365551 - DNA, 19 bp, Homo sapiens
agtccactttcctctctct

SEQ ID NO: 5365552 - DNA, 17 bp, Homo sapiens
agtccagaataagtgct

SEQ ID NO: 5365553 - DNA, 18 bp, Homo sapiens
agtccagaataagtgctg

SEQ ID NO: 5365554 - DNA, 22 bp, Homo sapiens
agtccagaccccccagcccctc

SEQ ID NO: 5365555 - DNA, 13 bp, Homo sapiens
agtccagacctgg

SEQ ID NO: 5365556 - DNA, 16 bp, Homo sapiens
agtccagacctgggcc

SEQ ID NO: 5365557 - DNA, 19 bp, Homo sapiens
agtccagacctgggccctg

SEQ ID NO: 5365558 - DNA, 20 bp, Homo sapiens
agtccagacctgggccctgg

SEQ ID NO: 5365559 - DNA, 13 bp, Homo sapiens
agtccagagccgg

SEQ ID NO: 5365560 - DNA, 21 bp, Homo sapiens
agtccagatcttgcctccaga

SEQ ID NO: 5365561 - DNA, 16 bp, Homo sapiens
agtccagatgccttcc

SEQ ID NO: 5365562 - DNA, 17 bp, Homo sapiens
agtccagatgccttcct

SEQ ID NO: 5365563 - DNA, 21 bp, Homo sapiens
agtccagatgccttcctgtct

SEQ ID NO: 5365564 - DNA, 17 bp, Homo sapiens
agtccagatggcaggct

SEQ ID NO: 5365565 - DNA, 16 bp, Homo sapiens
agtccagatttacact

SEQ ID NO: 5365566 - DNA, 22 bp, Homo sapiens
agtccagatttacactgggaga

SEQ ID NO: 5365567 - DNA, 12 bp, Homo sapiens
agtccagccagc

SEQ ID NO: 5365568 - DNA, 14 bp, Homo sapiens
agtccagccagctc

SEQ ID NO: 5365569 - DNA, 16 bp, Homo sapiens
agtccagccagctcct

SEQ ID NO: 5365570 - DNA, 13 bp, Homo sapiens
agtccagcccctc

SEQ ID NO: 5365571 - DNA, 14 bp, Homo sapiens
agtccagcccctcc

SEQ ID NO: 5365572 - DNA, 18 bp, Homo sapiens
agtccagcccctcctccc

SEQ ID NO: 5365573 - DNA, 11 bp, Homo sapiens
agtccagctcc

SEQ ID NO: 5365574 - DNA, 12 bp, Homo sapiens
agtccagctccc

SEQ ID NO: 5365575 - DNA, 12 bp, Homo sapiens
agtccagctcta

SEQ ID NO: 5365576 - DNA, 14 bp, Homo sapiens
agtccagctctccc

SEQ ID NO: 5365577 - DNA, 15 bp, Homo sapiens
agtccagctctcccc

SEQ ID NO: 5365578 - DNA, 17 bp, Homo sapiens
agtccagctctcccctg

SEQ ID NO: 5365579 - DNA, 20 bp, Homo sapiens
agtccagctctcccctgcgc

SEQ ID NO: 5365580 - DNA, 23 bp, Homo sapiens
agtccagctctcccctgcgcagg

SEQ ID NO: 5365581 - DNA, 22 bp, Homo sapiens
agtccagctttccttctgccct

SEQ ID NO: 5365582 - DNA, 23 bp, Homo sapiens
agtccaggacaggagatgctgtg

SEQ ID NO: 5365583 - DNA, 14 bp, Homo sapiens
agtccaggagcccc

SEQ ID NO: 5365584 - DNA, 21 bp, Homo sapiens
agtccaggagccccagccagc

SEQ ID NO: 5365585 - DNA, 19 bp, Homo sapiens
agtccaggaggccctggtc

SEQ ID NO: 5365586 - DNA, 22 bp, Homo sapiens
agtccaggatgctaacatctaa

SEQ ID NO: 5365587 - DNA, 12 bp, Homo sapiens
agtccaggcccc

SEQ ID NO: 5365588 - DNA, 18 bp, Homo sapiens
agtccaggccccaaaacc

SEQ ID NO: 5365589 - DNA, 17 bp, Homo sapiens
agtccaggctgccgtgg

SEQ ID NO: 5365590 - DNA, 18 bp, Homo sapiens
agtccaggctgccgtggg

SEQ ID NO: 5365591 - DNA, 12 bp, Homo sapiens
agtccaggctgt

SEQ ID NO: 5365592 - DNA, 22 bp, Homo sapiens
agtccaggcttttttatcatgt

SEQ ID NO: 5365593 - DNA, 14 bp, Homo sapiens
agtccagggcggga

SEQ ID NO: 5365594 - DNA, 23 bp, Homo sapiens
agtccagggctcccggagaggga

SEQ ID NO: 5365595 - DNA, 17 bp, Homo sapiens
agtccaggtaaatggta

SEQ ID NO: 5365596 - DNA, 18 bp, Homo sapiens
agtccaggtcctggtggg

SEQ ID NO: 5365597 - DNA, 21 bp, Homo sapiens
agtccagtcaagttccctcct

SEQ ID NO: 5365598 - DNA, 21 bp, Homo sapiens
agtccagtcctttgttgctgt

SEQ ID NO: 5365599 - DNA, 23 bp, Homo sapiens
agtccagtcctttgttgctgttg

SEQ ID NO: 5365600 - DNA, 15 bp, Homo sapiens
agtccagtctcttct

SEQ ID NO: 5365601 - DNA, 14 bp, Homo sapiens
agtccagtgaccct

SEQ ID NO: 5365602 - DNA, 20 bp, Homo sapiens
agtccagtgaccctggagct

SEQ ID NO: 5365603 - DNA, 19 bp, Homo sapiens
agtccagtgagaaattaca

SEQ ID NO: 5365604 - DNA, 18 bp, Homo sapiens
agtccagtgctctgcctc

SEQ ID NO: 5365605 - DNA, 20 bp, Homo sapiens
agtccagtgtttccacggct

SEQ ID NO: 5365606 - DNA, 14 bp, Homo sapiens
agtccagttttgtg

SEQ ID NO: 5365607 - DNA, 14 bp, Homo sapiens
agtccatgaaaata

SEQ ID NO: 5365608 - DNA, 16 bp, Homo sapiens
agtccatgagttgagt

SEQ ID NO: 5365609 - DNA, 22 bp, Homo sapiens
agtccatgcatgacagcctcta

SEQ ID NO: 5365610 - DNA, 19 bp, Homo sapiens
agtccatgtcctatgcctc

SEQ ID NO: 5365611 - DNA, 15 bp, Homo sapiens
agtccatgtgataat

SEQ ID NO: 5365612 - DNA, 19 bp, Homo sapiens
agtccatgtgataattgta

SEQ ID NO: 5365613 - DNA, 14 bp, Homo sapiens
agtccattctccca

SEQ ID NO: 5365614 - DNA, 19 bp, Homo sapiens
agtccattctcccaggtac

SEQ ID NO: 5365615 - DNA, 12 bp, Homo sapiens
agtccatttata

SEQ ID NO: 5365616 - DNA, 19 bp, Homo sapiens
agtccatttatatatgaaa

SEQ ID NO: 5365617 - DNA, 22 bp, Homo sapiens
agtccatttatatatgaaaact

SEQ ID NO: 5365618 - DNA, 14 bp, Homo sapiens
agtccatttcctaa

SEQ ID NO: 5365619 - DNA, 14 bp, Homo sapiens
agtcccaaaaccct

SEQ ID NO: 5365620 - DNA, 13 bp, Homo sapiens
agtcccaaattca

SEQ ID NO: 5365621 - DNA, 12 bp, Homo sapiens
agtcccaacccc

SEQ ID NO: 5365622 - DNA, 14 bp, Homo sapiens
agtcccaaccccag

SEQ ID NO: 5365623 - DNA, 14 bp, Homo sapiens
agtcccaagcggtg

SEQ ID NO: 5365624 - DNA, 14 bp, Homo sapiens
agtcccaaggaaag

SEQ ID NO: 5365625 - DNA, 19 bp, Homo sapiens
agtcccacaccgctggtcc

SEQ ID NO: 5365626 - DNA, 17 bp, Homo sapiens
agtcccacactgtgcag

SEQ ID NO: 5365627 - DNA, 22 bp, Homo sapiens
agtcccacactgtggccaggcc

SEQ ID NO: 5365628 - DNA, 18 bp, Homo sapiens
agtcccacccggacaggt

SEQ ID NO: 5365629 - DNA, 18 bp, Homo sapiens
agtcccaccctatggcca

SEQ ID NO: 5365630 - DNA, 19 bp, Homo sapiens
agtcccaccctcttcccat

SEQ ID NO: 5365631 - DNA, 23 bp, Homo sapiens
agtcccaccctgctgctgctcct

SEQ ID NO: 5365632 - DNA, 16 bp, Homo sapiens
agtcccaccttggctg

SEQ ID NO: 5365633 - DNA, 18 bp, Homo sapiens
agtcccaccttggctgca

SEQ ID NO: 5365634 - DNA, 21 bp, Homo sapiens
agtcccaccttggctgcaggg

SEQ ID NO: 5365635 - DNA, 23 bp, Homo sapiens
agtcccaccttggctgcagggag

SEQ ID NO: 5365636 - DNA, 15 bp, Homo sapiens
agtcccacggctctg

SEQ ID NO: 5365637 - DNA, 21 bp, Homo sapiens
agtcccacggctctgtgcccg

SEQ ID NO: 5365638 - DNA, 12 bp, Homo sapiens
agtcccactgca

SEQ ID NO: 5365639 - DNA, 15 bp, Homo sapiens
agtcccactgcaccc

SEQ ID NO: 5365640 - DNA, 18 bp, Homo sapiens
agtcccactgcacccccc

SEQ ID NO: 5365641 - DNA, 12 bp, Homo sapiens
agtcccactgcc

SEQ ID NO: 5365642 - DNA, 18 bp, Homo sapiens
agtcccactgcctcaggt

SEQ ID NO: 5365643 - DNA, 23 bp, Homo sapiens
agtcccactgcctcaggttccta

SEQ ID NO: 5365644 - DNA, 23 bp, Homo sapiens
agtcccagagcaggaggcccctg

SEQ ID NO: 5365645 - DNA, 13 bp, Homo sapiens
agtcccagagccc

SEQ ID NO: 5365646 - DNA, 21 bp, Homo sapiens
agtcccagagctgcacagggt

SEQ ID NO: 5365647 - DNA, 17 bp, Homo sapiens
agtcccagcacatttcc

SEQ ID NO: 5365648 - DNA, 16 bp, Homo sapiens
agtcccagcagccagc

SEQ ID NO: 5365649 - DNA, 22 bp, Homo sapiens
agtcccagctactcagaagcct

SEQ ID NO: 5365650 - DNA, 18 bp, Homo sapiens
agtcccagctactcagga

SEQ ID NO: 5365651 - DNA, 20 bp, Homo sapiens
agtcccaggagctgcccaga

SEQ ID NO: 5365652 - DNA, 20 bp, Homo sapiens
agtcccaggcccagtgcagt

SEQ ID NO: 5365653 - DNA, 17 bp, Homo sapiens
agtcccaggctgagcct

SEQ ID NO: 5365654 - DNA, 18 bp, Homo sapiens
agtcccaggctgagcctc

SEQ ID NO: 5365655 - DNA, 19 bp, Homo sapiens
agtcccaggctgagcctca

SEQ ID NO: 5365656 - DNA, 20 bp, Homo sapiens
agtcccaggctgagcctcag

SEQ ID NO: 5365657 - DNA, 19 bp, Homo sapiens
agtcccagggagctctgca

SEQ ID NO: 5365658 - DNA, 21 bp, Homo sapiens
agtcccagggagctctgcata

SEQ ID NO: 5365659 - DNA, 18 bp, Homo sapiens
agtcccaggggcagccac

SEQ ID NO: 5365660 - DNA, 19 bp, Homo sapiens
agtcccaggttggctctgc

SEQ ID NO: 5365661 - DNA, 19 bp, Homo sapiens
agtcccagtatacctcatt

SEQ ID NO: 5365662 - DNA, 21 bp, Homo sapiens
agtcccagtatacctcatttt

SEQ ID NO: 5365663 - DNA, 13 bp, Homo sapiens
agtcccagtggga

SEQ ID NO: 5365664 - DNA, 16 bp, Homo sapiens
agtcccatcagcctat

SEQ ID NO: 5365665 - DNA, 13 bp, Homo sapiens
agtcccatctcac

SEQ ID NO: 5365666 - DNA, 14 bp, Homo sapiens
agtcccatgctggc

SEQ ID NO: 5365667 - DNA, 14 bp, Homo sapiens
agtcccattcagtg

SEQ ID NO: 5365668 - DNA, 16 bp, Homo sapiens
agtcccattcagtggc

SEQ ID NO: 5365669 - DNA, 18 bp, Homo sapiens
agtcccattcctccactc

SEQ ID NO: 5365670 - DNA, 16 bp, Homo sapiens
agtccccaaggcctct

SEQ ID NO: 5365671 - DNA, 18 bp, Homo sapiens
agtccccaaggcctctct

SEQ ID NO: 5365672 - DNA, 19 bp, Homo sapiens
agtccccagactcagctgg

SEQ ID NO: 5365673 - DNA, 17 bp, Homo sapiens
agtccccagagctcccc

SEQ ID NO: 5365674 - DNA, 10 bp, Homo sapiens
agtccccagc

SEQ ID NO: 5365675 - DNA, 16 bp, Homo sapiens
agtccccagccctggg

SEQ ID NO: 5365676 - DNA, 15 bp, Homo sapiens
agtccccagcccttc

SEQ ID NO: 5365677 - DNA, 20 bp, Homo sapiens
agtcctgctggcctgctctt

SEQ ID NO: 5365678 - DNA, 16 bp, Homo sapiens
agtcctgctttcctat

SEQ ID NO: 5365679 - DNA, 19 bp, Homo sapiens
agtcctgctttcctatcta

SEQ ID NO: 5365680 - DNA, 12 bp, Homo sapiens
agtcctggaagc

SEQ ID NO: 5365681 - DNA, 19 bp, Homo sapiens
agtcctggatgatactaat

SEQ ID NO: 5365682 - DNA, 20 bp, Homo sapiens
agtcctggcatgggaatgaa

SEQ ID NO: 5365683 - DNA, 10 bp, Homo sapiens
agtcctggcc

SEQ ID NO: 5365684 - DNA, 13 bp, Homo sapiens
agtcctggcccaa

SEQ ID NO: 5365685 - DNA, 13 bp, Homo sapiens
agtcctggctaca

SEQ ID NO: 5365686 - DNA, 22 bp, Homo sapiens
agtcctggctacatcccagcct

SEQ ID NO: 5365687 - DNA, 15 bp, Homo sapiens
agtcctggcttcagg

SEQ ID NO: 5365688 - DNA, 23 bp, Homo sapiens
agtcctgggagaggacagggact

SEQ ID NO: 5365689 - DNA, 23 bp, Homo sapiens
agtcctgggttgtttccaggaga

SEQ ID NO: 5365690 - DNA, 18 bp, Homo sapiens
agtcctggtccctctgag

SEQ ID NO: 5365691 - DNA, 16 bp, Homo sapiens
agtcctggtcctggct

SEQ ID NO: 5365692 - DNA, 18 bp, Homo sapiens
agtcctggtcctggctgc

SEQ ID NO: 5365693 - DNA, 21 bp, Homo sapiens
agtcctggtcctggctgcact

SEQ ID NO: 5365694 - DNA, 18 bp, Homo sapiens
agtcctggttcagtggga

SEQ ID NO: 5365695 - DNA, 23 bp, Homo sapiens
agtcctgtagttttattttatgt

SEQ ID NO: 5365696 - DNA, 15 bp, Homo sapiens
agtcctgtatgtctg

SEQ ID NO: 5365697 - DNA, 21 bp, Homo sapiens
agtcctgtatgtctgtcattg

SEQ ID NO: 5365698 - DNA, 11 bp, Homo sapiens
agtcctgtcac

SEQ ID NO: 5365699 - DNA, 13 bp, Homo sapiens
agtcctgtcagct

SEQ ID NO: 5365700 - DNA, 17 bp, Homo sapiens
agtcctgtcagcttccc

SEQ ID NO: 5365701 - DNA, 16 bp, Homo sapiens
agtcctgtctcccact

SEQ ID NO: 5365702 - DNA, 17 bp, Homo sapiens
agtcctgtctcccactt

SEQ ID NO: 5365703 - DNA, 21 bp, Homo sapiens
agtcctgtctctgcctgcggc

SEQ ID NO: 5365704 - DNA, 19 bp, Homo sapiens
agtcctgtgaatgccactg

SEQ ID NO: 5365705 - DNA, 23 bp, Homo sapiens
agtcctgtgaatttcttcactgt

SEQ ID NO: 5365706 - DNA, 15 bp, Homo sapiens
agtcctgtgctgaat

SEQ ID NO: 5365707 - DNA, 15 bp, Homo sapiens
agtcctgttactatg

SEQ ID NO: 5365708 - DNA, 20 bp, Homo sapiens
agtcctgttactatggtaac

SEQ ID NO: 5365709 - DNA, 11 bp, Homo sapiens
agtcctgttct

SEQ ID NO: 5365710 - DNA, 15 bp, Homo sapiens
agtcctgttctcaga

SEQ ID NO: 5365711 - DNA, 18 bp, Homo sapiens
agtcctgttctcagagct

SEQ ID NO: 5365712 - DNA, 14 bp, Homo sapiens
agtccttaagcaga

SEQ ID NO: 5365713 - DNA, 20 bp, Homo sapiens
agtccttaccagcagagcac

SEQ ID NO: 5365714 - DNA, 17 bp, Homo sapiens
agtccttacctcgggga

SEQ ID NO: 5365715 - DNA, 17 bp, Homo sapiens
agtccttacctcttccg

SEQ ID NO: 5365716 - DNA, 21 bp, Homo sapiens
agtccttagcctgggcctcct

SEQ ID NO: 5365717 - DNA, 15 bp, Homo sapiens
agtccttaggctact

SEQ ID NO: 5365718 - DNA, 16 bp, Homo sapiens
agtccttaggctactg

SEQ ID NO: 5365719 - DNA, 18 bp, Homo sapiens
agtccttattatcccagc

SEQ ID NO: 5365720 - DNA, 16 bp, Homo sapiens
agtccttattcttctc

SEQ ID NO: 5365721 - DNA, 20 bp, Homo sapiens
agtccttattcttctcataa

SEQ ID NO: 5365722 - DNA, 17 bp, Homo sapiens
agtccttcacctcactg

SEQ ID NO: 5365723 - DNA, 14 bp, Homo sapiens
agtccttccacctg

SEQ ID NO: 5365724 - DNA, 16 bp, Homo sapiens
agtccttccacctgcc

SEQ ID NO: 5365725 - DNA, 22 bp, Homo sapiens
agtccttgaaaatattttttat

SEQ ID NO: 5365726 - DNA, 23 bp, Homo sapiens
agtccttgatttcaaagttttgt

SEQ ID NO: 5365727 - DNA, 19 bp, Homo sapiens
agtccttgcgtcccatgag

SEQ ID NO: 5365728 - DNA, 21 bp, Homo sapiens
agtccttgctgtgggatgtgc

SEQ ID NO: 5365729 - DNA, 14 bp, Homo sapiens
agtccttggctgta

SEQ ID NO: 5365730 - DNA, 21 bp, Homo sapiens
agtcctttataagttgctttc

SEQ ID NO: 5365731 - DNA, 14 bp, Homo sapiens
agtcctttatgtgg

SEQ ID NO: 5365732 - DNA, 20 bp, Homo sapiens
agtcctttcaattccaccag

SEQ ID NO: 5365733 - DNA, 20 bp, Homo sapiens
agtcctttcccaccattcct

SEQ ID NO: 5365734 - DNA, 17 bp, Homo sapiens
agtcctttctgccttgg

SEQ ID NO: 5365735 - DNA, 18 bp, Homo sapiens
agtcctttctgccttggc

SEQ ID NO: 5365736 - DNA, 18 bp, Homo sapiens
agtcctttctgtgaagct

SEQ ID NO: 5365737 - DNA, 21 bp, Homo sapiens
agtcctttctgtgaagctaat

SEQ ID NO: 5365738 - DNA, 15 bp, Homo sapiens
agtcctttgattcca

SEQ ID NO: 5365739 - DNA, 14 bp, Homo sapiens
agtcctttgtcttt

SEQ ID NO: 5365740 - DNA, 17 bp, Homo sapiens
agtcctttgtctttctt

SEQ ID NO: 5365741 - DNA, 15 bp, Homo sapiens
agtcctttgtgaata

SEQ ID NO: 5365742 - DNA, 16 bp, Homo sapiens
agtcctttgttgctgt

SEQ ID NO: 5365743 - DNA, 23 bp, Homo sapiens
agtccttttactacagctatgaa

SEQ ID NO: 5365744 - DNA, 16 bp, Homo sapiens
agtccttttgtaaagt

SEQ ID NO: 5365745 - DNA, 14 bp, Homo sapiens
agtcctttttgtaa

SEQ ID NO: 5365746 - DNA, 16 bp, Homo sapiens
agtcctttttttccat

SEQ ID NO: 5365747 - DNA, 19 bp, Homo sapiens
agtcgagacctcacacacg

SEQ ID NO: 5365748 - DNA, 20 bp, Homo sapiens
agtcgagacctcacacacgg

SEQ ID NO: 5365749 - DNA, 16 bp, Homo sapiens
agtcgaggacagggag

SEQ ID NO: 5365750 - DNA, 18 bp, Homo sapiens
agtcgaggctggtaaggg

SEQ ID NO: 5365751 - DNA, 17 bp, Homo sapiens
agtcgatattcccaggg

SEQ ID NO: 5365752 - DNA, 18 bp, Homo sapiens
agtcgatattcccagggc

SEQ ID NO: 5365753 - DNA, 22 bp, Homo sapiens
agtcgcagaccagagctgtctg

SEQ ID NO: 5365754 - DNA, 20 bp, Homo sapiens
agtcgcaggatccgctgcca

SEQ ID NO: 5365755 - DNA, 23 bp, Homo sapiens
agtcgcaggatccgctgccacca

SEQ ID NO: 5365756 - DNA, 15 bp, Homo sapiens
agtcgccagtcactg

SEQ ID NO: 5365757 - DNA, 18 bp, Homo sapiens
agtcgccagtcactgctg

SEQ ID NO: 5365758 - DNA, 23 bp, Homo sapiens
agtcgccagtcactgctgcaagg

SEQ ID NO: 5365759 - DNA, 12 bp, Homo sapiens
agtcgcccctca

SEQ ID NO: 5365760 - DNA, 14 bp, Homo sapiens
agtcgccctacaga

SEQ ID NO: 5365761 - DNA, 13 bp, Homo sapiens
agtcgccctctgt

SEQ ID NO: 5365762 - DNA, 15 bp, Homo sapiens
agtcgccctctgtgc

SEQ ID NO: 5365763 - DNA, 16 bp, Homo sapiens
agtcgccctctgtgcc

SEQ ID NO: 5365764 - DNA, 20 bp, Homo sapiens
agtcgccctctgtgcctaat

SEQ ID NO: 5365765 - DNA, 21 bp, Homo sapiens
agtcgccctctgtgcctaata

SEQ ID NO: 5365766 - DNA, 14 bp, Homo sapiens
agtcgcctgcctgc

SEQ ID NO: 5365767 - DNA, 17 bp, Homo sapiens
agtcgcctgcctgcagc

SEQ ID NO: 5365768 - DNA, 21 bp, Homo sapiens
agtcgcctgcctgcagcaggc

SEQ ID NO: 5365769 - DNA, 22 bp, Homo sapiens
agtcgcctgcctgcagcaggca

SEQ ID NO: 5365770 - DNA, 17 bp, Homo sapiens
agtcgcgagcacatgtt

SEQ ID NO: 5365771 - DNA, 17 bp, Homo sapiens
agtcgcgctgcctgtgt

SEQ ID NO: 5365772 - DNA, 13 bp, Homo sapiens
agtcgcggctgca

SEQ ID NO: 5365773 - DNA, 15 bp, Homo sapiens
agtcgctcagtctgt

SEQ ID NO: 5365774 - DNA, 22 bp, Homo sapiens
agtcgctctcatgaagccctta

SEQ ID NO: 5365775 - DNA, 13 bp, Homo sapiens
agtcgctgaggaa

SEQ ID NO: 5365776 - DNA, 12 bp, Homo sapiens
agtcgctgcagg

SEQ ID NO: 5365777 - DNA, 16 bp, Homo sapiens
agtcgctgcagggagc

SEQ ID NO: 5365778 - DNA, 18 bp, Homo sapiens
agtcgctgtgccacaggc

SEQ ID NO: 5365779 - DNA, 16 bp, Homo sapiens
agtcgcttgccaaagc

SEQ ID NO: 5365780 - DNA, 19 bp, Homo sapiens
agtcgcttgccaaagcaga

SEQ ID NO: 5365781 - DNA, 16 bp, Homo sapiens
agtcggaaaagcgtct

SEQ ID NO: 5365782 - DNA, 12 bp, Homo sapiens
agtcggattaga

SEQ ID NO: 5365783 - DNA, 16 bp, Homo sapiens
agtcggcacagcctgg

SEQ ID NO: 5365784 - DNA, 18 bp, Homo sapiens
agtcggcacagtgcagca

SEQ ID NO: 5365785 - DNA, 15 bp, Homo sapiens
agtcggccccatctc

SEQ ID NO: 5365786 - DNA, 13 bp, Homo sapiens
agtcggctgggca

SEQ ID NO: 5365787 - DNA, 19 bp, Homo sapiens
agtcggctgggcagggccg

SEQ ID NO: 5365788 - DNA, 20 bp, Homo sapiens
agtcggctgggcagggccgc

SEQ ID NO: 5365789 - DNA, 15 bp, Homo sapiens
agtcgggaaattctg

SEQ ID NO: 5365790 - DNA, 19 bp, Homo sapiens
agtcgggaaattctgctgc

SEQ ID NO: 5365791 - DNA, 21 bp, Homo sapiens
agtcgggaaattctgctgctt

SEQ ID NO: 5365792 - DNA, 20 bp, Homo sapiens
agtcgggacctcccaggaca

SEQ ID NO: 5365793 - DNA, 13 bp, Homo sapiens
agtcgggcatgag

SEQ ID NO: 5365794 - DNA, 14 bp, Homo sapiens
agtcggggcctggg

SEQ ID NO: 5365795 - DNA, 15 bp, Homo sapiens
agtcggggcctggga

SEQ ID NO: 5365796 - DNA, 22 bp, Homo sapiens
agtcgggggaaaaaattaaaat

SEQ ID NO: 5365797 - DNA, 21 bp, Homo sapiens
agtcgggggctggcctaggag

SEQ ID NO: 5365798 - DNA, 17 bp, Homo sapiens
agtcggtctgctttgga

SEQ ID NO: 5365799 - DNA, 18 bp, Homo sapiens
agtcgtacagaaagctgc

SEQ ID NO: 5365800 - DNA, 14 bp, Homo sapiens
agtcgtcagcctcc

SEQ ID NO: 5365801 - DNA, 19 bp, Homo sapiens
agtcgtccttactcctgtg

SEQ ID NO: 5365802 - DNA, 17 bp, Homo sapiens
agtcgtgatgtggagga

SEQ ID NO: 5365803 - DNA, 14 bp, Homo sapiens
agtcgtgcctgtgt

SEQ ID NO: 5365804 - DNA, 15 bp, Homo sapiens
agtcgtgggaaggag

SEQ ID NO: 5365805 - DNA, 18 bp, Homo sapiens
agtcgtggggtgtgctgg

SEQ ID NO: 5365806 - DNA, 20 bp, Homo sapiens
agtcgtggggtgtgctggga

SEQ ID NO: 5365807 - DNA, 21 bp, Homo sapiens
agtcgtggggtgtgctgggag

SEQ ID NO: 5365808 - DNA, 16 bp, Homo sapiens
agtcgttatttctgtt

SEQ ID NO: 5365809 - DNA, 20 bp, Homo sapiens
agtcgttatttctgtttgtt

SEQ ID NO: 5365810 - DNA, 22 bp, Homo sapiens
agtcgttatttctgtttgttta

SEQ ID NO: 5365811 - DNA, 16 bp, Homo sapiens
agtcgttggagactga

SEQ ID NO: 5365812 - DNA, 14 bp, Homo sapiens
agtcgttttagtgt

SEQ ID NO: 5365813 - DNA, 14 bp, Homo sapiens
agtcgttttccaaa

SEQ ID NO: 5365814 - DNA, 20 bp, Homo sapiens
agtctaaaaacttcttttta

SEQ ID NO: 5365815 - DNA, 21 bp, Homo sapiens
agtctaaaaagacctggcctt

SEQ ID NO: 5365816 - DNA, 18 bp, Homo sapiens
agtctaaacaaaattgca

SEQ ID NO: 5365817 - DNA, 22 bp, Homo sapiens
agtctaaacaaaattgcaattt

SEQ ID NO: 5365818 - DNA, 19 bp, Homo sapiens
agtctaaacaatgaattct

SEQ ID NO: 5365819 - DNA, 22 bp, Homo sapiens
agtctaaacaatgaattcttca

SEQ ID NO: 5365820 - DNA, 16 bp, Homo sapiens
agtctaaactgagctc

SEQ ID NO: 5365821 - DNA, 20 bp, Homo sapiens
agtctaaagatggagtttct

SEQ ID NO: 5365822 - DNA, 21 bp, Homo sapiens
agtctaaagatggagtttcta

SEQ ID NO: 5365823 - DNA, 17 bp, Homo sapiens
agtctaaagtttacagt

SEQ ID NO: 5365824 - DNA, 16 bp, Homo sapiens
agtctaaatatttcct

SEQ ID NO: 5365825 - DNA, 17 bp, Homo sapiens
agtctaaatatttcctt

SEQ ID NO: 5365826 - DNA, 23 bp, Homo sapiens
agtctaaatatttccttaaactg

SEQ ID NO: 5365827 - DNA, 18 bp, Homo sapiens
agtctaacgctgaactga

SEQ ID NO: 5365828 - DNA, 20 bp, Homo sapiens
agtctaactttggttttctt

SEQ ID NO: 5365829 - DNA, 16 bp, Homo sapiens
agtctaagatgattca

SEQ ID NO: 5365830 - DNA, 19 bp, Homo sapiens
agtctaatctagtgacacc

SEQ ID NO: 5365831 - DNA, 14 bp, Homo sapiens
agtctaatgaagag

SEQ ID NO: 5365832 - DNA, 12 bp, Homo sapiens
agtctacactgc

SEQ ID NO: 5365833 - DNA, 22 bp, Homo sapiens
agtctacaggcctttcaggaag

SEQ ID NO: 5365834 - DNA, 14 bp, Homo sapiens
agtctaccaaagga

SEQ ID NO: 5365835 - DNA, 18 bp, Homo sapiens
agtctacccctctccttt

SEQ ID NO: 5365836 - DNA, 17 bp, Homo sapiens
agtctacccgacataag

SEQ ID NO: 5365837 - DNA, 18 bp, Homo sapiens
agtctacccgacataagt

SEQ ID NO: 5365838 - DNA, 14 bp, Homo sapiens
agtctaccctgtcc

SEQ ID NO: 5365839 - DNA, 19 bp, Homo sapiens
agtctaccctgtcctttgc

SEQ ID NO: 5365840 - DNA, 15 bp, Homo sapiens
agtctacctcttcag

SEQ ID NO: 5365841 - DNA, 21 bp, Homo sapiens
agtctacctgccttgcctgtt

SEQ ID NO: 5365842 - DNA, 14 bp, Homo sapiens
agtctacgctctcc

SEQ ID NO: 5365843 - DNA, 15 bp, Homo sapiens
agtctacgctctcct

SEQ ID NO: 5365844 - DNA, 17 bp, Homo sapiens
agtctacgctctccttt

SEQ ID NO: 5365845 - DNA, 13 bp, Homo sapiens
agtctactcttaa

SEQ ID NO: 5365846 - DNA, 19 bp, Homo sapiens
agtctacttctgtgtctgt

SEQ ID NO: 5365847 - DNA, 22 bp, Homo sapiens
agtctagaacatccttaaatgt

SEQ ID NO: 5365848 - DNA, 14 bp, Homo sapiens
agtctagaagttgt

SEQ ID NO: 5365849 - DNA, 21 bp, Homo sapiens
agtctagaatgttattgtgta

SEQ ID NO: 5365850 - DNA, 16 bp, Homo sapiens
agtctagacacaattt

SEQ ID NO: 5365851 - DNA, 19 bp, Homo sapiens
agtctagacacaatttcat

SEQ ID NO: 5365852 - DNA, 17 bp, Homo sapiens
agtctagatggctcctc

SEQ ID NO: 5365853 - DNA, 20 bp, Homo sapiens
agtctagatggctcctctca

SEQ ID NO: 5365854 - DNA, 16 bp, Homo sapiens
agtcttatcaagcagc

SEQ ID NO: 5365855 - DNA, 22 bp, Homo sapiens
agtcttatcttctgcagtgagt

SEQ ID NO: 5365856 - DNA, 14 bp, Homo sapiens
agtcttatgaatag

SEQ ID NO: 5365857 - DNA, 15 bp, Homo sapiens
agtcttatgaataga

SEQ ID NO: 5365858 - DNA, 22 bp, Homo sapiens
agtcttatgaatagacataaat

SEQ ID NO: 5365859 - DNA, 23 bp, Homo sapiens
agtcttatgtaaagtatgttttt

SEQ ID NO: 5365860 - DNA, 14 bp, Homo sapiens
agtcttcaaatttg

SEQ ID NO: 5365861 - DNA, 14 bp, Homo sapiens
agtcttcacattta

SEQ ID NO: 5365862 - DNA, 16 bp, Homo sapiens
agtcttcactctctga

SEQ ID NO: 5365863 - DNA, 17 bp, Homo sapiens
agtcttcactctctgaa

SEQ ID NO: 5365864 - DNA, 19 bp, Homo sapiens
agtcttcactctctgaaga

SEQ ID NO: 5365865 - DNA, 17 bp, Homo sapiens
agtcttcagacccagag

SEQ ID NO: 5365866 - DNA, 18 bp, Homo sapiens
agtcttcatgaaatgcta

SEQ ID NO: 5365867 - DNA, 20 bp, Homo sapiens
agtcttcatggtctcttcca

SEQ ID NO: 5365868 - DNA, 18 bp, Homo sapiens
agtcttcatgttcccact

SEQ ID NO: 5365869 - DNA, 13 bp, Homo sapiens
agtcttccaaggc

SEQ ID NO: 5365870 - DNA, 21 bp, Homo sapiens
agtcttccaaggccagaagga

SEQ ID NO: 5365871 - DNA, 15 bp, Homo sapiens
agtcttccacctgga

SEQ ID NO: 5365872 - DNA, 23 bp, Homo sapiens
agtcttccaggtgcctggccctt

SEQ ID NO: 5365873 - DNA, 19 bp, Homo sapiens
agtcttccatcagcagtga

SEQ ID NO: 5365874 - DNA, 18 bp, Homo sapiens
agtcttccctagggctgg

SEQ ID NO: 5365875 - DNA, 20 bp, Homo sapiens
agtcttccctagggctgggt

SEQ ID NO: 5365876 - DNA, 22 bp, Homo sapiens
agtcttccctagggctgggtgt

SEQ ID NO: 5365877 - DNA, 13 bp, Homo sapiens
agtcttccctcag

SEQ ID NO: 5365878 - DNA, 11 bp, Homo sapiens
agtcttcctct

SEQ ID NO: 5365879 - DNA, 20 bp, Homo sapiens
agtcttcctcttagcctctg

SEQ ID NO: 5365880 - DNA, 15 bp, Homo sapiens
agtcttcctgacact

SEQ ID NO: 5365881 - DNA, 16 bp, Homo sapiens
agtcttcctgacactt

SEQ ID NO: 5365882 - DNA, 18 bp, Homo sapiens
agtcttcctgacacttta

SEQ ID NO: 5365883 - DNA, 23 bp, Homo sapiens
agtcttccttagctaaatgcaat

SEQ ID NO: 5365884 - DNA, 16 bp, Homo sapiens
agtcttccttgtctct

SEQ ID NO: 5365885 - DNA, 19 bp, Homo sapiens
agtcttccttgtctctgct

SEQ ID NO: 5365886 - DNA, 21 bp, Homo sapiens
agtcttcggtgtttaaagtca

SEQ ID NO: 5365887 - DNA, 19 bp, Homo sapiens
agtcttctaatgtaaattt

SEQ ID NO: 5365888 - DNA, 22 bp, Homo sapiens
agtcttctaccaaatgtgtaat

SEQ ID NO: 5365889 - DNA, 21 bp, Homo sapiens
agtcttctcatagcattaact

SEQ ID NO: 5365890 - DNA, 21 bp, Homo sapiens
agtcttctcccaactcagcct

SEQ ID NO: 5365891 - DNA, 14 bp, Homo sapiens
agtcttctcctcca

SEQ ID NO: 5365892 - DNA, 19 bp, Homo sapiens
agtcttctctctggctcag

SEQ ID NO: 5365893 - DNA, 13 bp, Homo sapiens
agtcttctgcctc

SEQ ID NO: 5365894 - DNA, 12 bp, Homo sapiens
agtcttctggat

SEQ ID NO: 5365895 - DNA, 14 bp, Homo sapiens
agtcttctgggctg

SEQ ID NO: 5365896 - DNA, 19 bp, Homo sapiens
agtcttctgggctgcggga

SEQ ID NO: 5365897 - DNA, 22 bp, Homo sapiens
agtcttctgggctgcgggaggc

SEQ ID NO: 5365898 - DNA, 20 bp, Homo sapiens
agtcttctgtaattcattga

SEQ ID NO: 5365899 - DNA, 19 bp, Homo sapiens
agtcttgaaatgaaaggga

SEQ ID NO: 5365900 - DNA, 21 bp, Homo sapiens
agtcttgaaatgaaagggaaa

SEQ ID NO: 5365901 - DNA, 22 bp, Homo sapiens
agtcttgaaatgaaagggaaac

SEQ ID NO: 5365902 - DNA, 19 bp, Homo sapiens
agtcttgacctctccagca

SEQ ID NO: 5365903 - DNA, 22 bp, Homo sapiens
agtcttgacctctccagcatcc

SEQ ID NO: 5365904 - DNA, 14 bp, Homo sapiens
agtcttgagtgggc

SEQ ID NO: 5365905 - DNA, 15 bp, Homo sapiens
agtcttgagtgggcc

SEQ ID NO: 5365906 - DNA, 19 bp, Homo sapiens
agtcttgcagtgattaagg

SEQ ID NO: 5365907 - DNA, 12 bp, Homo sapiens
agtcttgcattg

SEQ ID NO: 5365908 - DNA, 21 bp, Homo sapiens
agtcttgctacctcagtcagt

SEQ ID NO: 5365909 - DNA, 15 bp, Homo sapiens
agtcttgctctgtca

SEQ ID NO: 5365910 - DNA, 23 bp, Homo sapiens
agtcttgctctgttacccaggct

SEQ ID NO: 5365911 - DNA, 15 bp, Homo sapiens
agtcttgctgtgctt

SEQ ID NO: 5365912 - DNA, 20 bp, Homo sapiens
agtcttgctgtggtctcttt

SEQ ID NO: 5365913 - DNA, 18 bp, Homo sapiens
agtcttgctttgctgtct

SEQ ID NO: 5365914 - DNA, 15 bp, Homo sapiens
agtcttggcctgcct

SEQ ID NO: 5365915 - DNA, 15 bp, Homo sapiens
agtcttggcggcagc

SEQ ID NO: 5365916 - DNA, 22 bp, Homo sapiens
agtcttggcggcagcagccatc

SEQ ID NO: 5365917 - DNA, 18 bp, Homo sapiens
agtcttgggcctggcccg

SEQ ID NO: 5365918 - DNA, 18 bp, Homo sapiens
agtcttgggtctgaattt

SEQ ID NO: 5365919 - DNA, 14 bp, Homo sapiens
agtcttgggtggcg

SEQ ID NO: 5365920 - DNA, 16 bp, Homo sapiens
agtcttggtaaaacat

SEQ ID NO: 5365921 - DNA, 13 bp, Homo sapiens
agtcttggttcta

SEQ ID NO: 5365922 - DNA, 17 bp, Homo sapiens
agtcttggtttctctct

SEQ ID NO: 5365923 - DNA, 15 bp, Homo sapiens
agtcttggttttatc

SEQ ID NO: 5365924 - DNA, 18 bp, Homo sapiens
agtcttgtacacttaagc

SEQ ID NO: 5365925 - DNA, 13 bp, Homo sapiens
agtcttgtcagaa

SEQ ID NO: 5365926 - DNA, 21 bp, Homo sapiens
agtcttgtcagaattggcctc

SEQ ID NO: 5365927 - DNA, 21 bp, Homo sapiens
agtcttgtctcagattttatt

SEQ ID NO: 5365928 - DNA, 17 bp, Homo sapiens
agtcttgtctttgatat

SEQ ID NO: 5365929 - DNA, 12 bp, Homo sapiens
agtcttgtgaac

SEQ ID NO: 5365930 - DNA, 22 bp, Homo sapiens
agtcttgtgactagtgctgaag

SEQ ID NO: 5365931 - DNA, 15 bp, Homo sapiens
agtcttgtgcttttc

SEQ ID NO: 5365932 - DNA, 16 bp, Homo sapiens
agtctttaatatttta

SEQ ID NO: 5365933 - DNA, 16 bp, Homo sapiens
agtctttaatcccagt

SEQ ID NO: 5365934 - DNA, 20 bp, Homo sapiens
agtctttacagctgagcaca

SEQ ID NO: 5365935 - DNA, 12 bp, Homo sapiens
agtctttagaac

SEQ ID NO: 5365936 - DNA, 21 bp, Homo sapiens
agtctttaggtctttgtaaga

SEQ ID NO: 5365937 - DNA, 16 bp, Homo sapiens
agtctttcaagaatga

SEQ ID NO: 5365938 - DNA, 13 bp, Homo sapiens
agtctttcccaat

SEQ ID NO: 5365939 - DNA, 12 bp, Homo sapiens
agtctttccccc

SEQ ID NO: 5365940 - DNA, 23 bp, Homo sapiens
agtctttccgtctccctaaaata

SEQ ID NO: 5365941 - DNA, 19 bp, Homo sapiens
agtctttccttagttaaaa

SEQ ID NO: 5365942 - DNA, 16 bp, Homo sapiens
agtctttctcctcttt

SEQ ID NO: 5365943 - DNA, 17 bp, Homo sapiens
agtctttctcctctttg

SEQ ID NO: 5365944 - DNA, 18 bp, Homo sapiens
agtctttctcctctttga

SEQ ID NO: 5365945 - DNA, 14 bp, Homo sapiens
agtctttcttcact

SEQ ID NO: 5365946 - DNA, 20 bp, Homo sapiens
agtctttcttcactctggct

SEQ ID NO: 5365947 - DNA, 21 bp, Homo sapiens
agtctttcttcactctggctt

SEQ ID NO: 5365948 - DNA, 21 bp, Homo sapiens
agtctttgaagctgaaaatat

SEQ ID NO: 5365949 - DNA, 19 bp, Homo sapiens
agtctttgccctgaatggt

SEQ ID NO: 5365950 - DNA, 16 bp, Homo sapiens
agtctttgccttctct

SEQ ID NO: 5365951 - DNA, 14 bp, Homo sapiens
agtctttgctcagt

SEQ ID NO: 5365952 - DNA, 18 bp, Homo sapiens
agtctttgctcagtggat

SEQ ID NO: 5365953 - DNA, 16 bp, Homo sapiens
agtctttgctcagtgt

SEQ ID NO: 5365954 - DNA, 17 bp, Homo sapiens
agtctttggttctaagg

SEQ ID NO: 5365955 - DNA, 12 bp, Homo sapiens
agtctttgtgtg

SEQ ID NO: 5365956 - DNA, 16 bp, Homo sapiens
agtctttgtgtgttat

SEQ ID NO: 5365957 - DNA, 21 bp, Homo sapiens
agtctttgtgtgttatattcc

SEQ ID NO: 5365958 - DNA, 23 bp, Homo sapiens
agtctttgtgtgttatattccaa

SEQ ID NO: 5365959 - DNA, 20 bp, Homo sapiens
agtcttttaaaaagtattgc

SEQ ID NO: 5365960 - DNA, 13 bp, Homo sapiens
agtcttttactcc

SEQ ID NO: 5365961 - DNA, 18 bp, Homo sapiens
agtcttttccacatggca

SEQ ID NO: 5365962 - DNA, 12 bp, Homo sapiens
agtcttttctgt

SEQ ID NO: 5365963 - DNA, 13 bp, Homo sapiens
agtcttttctgtc

SEQ ID NO: 5365964 - DNA, 15 bp, Homo sapiens
agtcttttctgttat

SEQ ID NO: 5365965 - DNA, 12 bp, Homo sapiens
agtcttttgctg

SEQ ID NO: 5365966 - DNA, 13 bp, Homo sapiens
agtcttttgctgt

SEQ ID NO: 5365967 - DNA, 20 bp, Homo sapiens
agtcttttgcttttggcaaa

SEQ ID NO: 5365968 - DNA, 20 bp, Homo sapiens
agtcttttgtaatatcaagc

SEQ ID NO: 5365969 - DNA, 17 bp, Homo sapiens
agtcttttgttcgcatg

SEQ ID NO: 5365970 - DNA, 16 bp, Homo sapiens
agtctttttcattttg

SEQ ID NO: 5365971 - DNA, 17 bp, Homo sapiens
agtctttttctgttgta

SEQ ID NO: 5365972 - DNA, 20 bp, Homo sapiens
agtctttttctgttgtaact

SEQ ID NO: 5365973 - DNA, 16 bp, Homo sapiens
agtcttttttttcctg

SEQ ID NO: 5365974 - DNA, 20 bp, Homo sapiens
agtctttttttttaagtgtt

SEQ ID NO: 5365975 - DNA, 17 bp, Homo sapiens
agtcttttttttttaag

SEQ ID NO: 5365976 - DNA, 17 bp, Homo sapiens
agtcttttttttttcca

SEQ ID NO: 5365977 - DNA, 17 bp, Homo sapiens
agtgaaaaaaagaaacg

SEQ ID NO: 5365978 - DNA, 22 bp, Homo sapiens
agtgaaaaaagtcacctgccca

SEQ ID NO: 5365979 - DNA, 13 bp, Homo sapiens
agtgaaaaaatgt

SEQ ID NO: 5365980 - DNA, 14 bp, Homo sapiens
agtgaaaaagatgt

SEQ ID NO: 5365981 - DNA, 17 bp, Homo sapiens
agtgaaaaatatgttga

SEQ ID NO: 5365982 - DNA, 13 bp, Homo sapiens
agtgaaaaatctt

SEQ ID NO: 5365983 - DNA, 14 bp, Homo sapiens
agtgaaaaatgaga

SEQ ID NO: 5365984 - DNA, 20 bp, Homo sapiens
agtgaaaaatgttaggacat

SEQ ID NO: 5365985 - DNA, 15 bp, Homo sapiens
agtgaaaacaaatct

SEQ ID NO: 5365986 - DNA, 14 bp, Homo sapiens
agtgaaaagatttt

SEQ ID NO: 5365987 - DNA, 14 bp, Homo sapiens
agtgaaaagtagag

SEQ ID NO: 5365988 - DNA, 14 bp, Homo sapiens
agtgaaaatatagc

SEQ ID NO: 5365989 - DNA, 23 bp, Homo sapiens
agtgaaaattctgttggtgccac

SEQ ID NO: 5365990 - DNA, 17 bp, Homo sapiens
agtgaaacacttgcttg

SEQ ID NO: 5365991 - DNA, 22 bp, Homo sapiens
agtgaaacagagaaagaaaagg

SEQ ID NO: 5365992 - DNA, 20 bp, Homo sapiens
agtgaaacataataataatg

SEQ ID NO: 5365993 - DNA, 20 bp, Homo sapiens
agtgaaaccaacatccagat

SEQ ID NO: 5365994 - DNA, 14 bp, Homo sapiens
agtgaaactcccac

SEQ ID NO: 5365995 - DNA, 15 bp, Homo sapiens
agtgaaacttttcta

SEQ ID NO: 5365996 - DNA, 15 bp, Homo sapiens
agtgaaagaaaataa

SEQ ID NO: 5365997 - DNA, 22 bp, Homo sapiens
agtgaaagaggcagcttgaaac

SEQ ID NO: 5365998 - DNA, 18 bp, Homo sapiens
agtgaaagagtagtgcat

SEQ ID NO: 5365999 - DNA, 14 bp, Homo sapiens
agtgaaagcatcac

SEQ ID NO: 5366000 - DNA, 19 bp, Homo sapiens
agtgaaagtgaggaaataa

SEQ ID NO: 5366001 - DNA, 21 bp, Homo sapiens
agtgaaagtgaggaaataaag

SEQ ID NO: 5366002 - DNA, 12 bp, Homo sapiens
agtgaaataaca

SEQ ID NO: 5366003 - DNA, 14 bp, Homo sapiens
agtgaaataacaaa

SEQ ID NO: 5366004 - DNA, 21 bp, Homo sapiens
agtgaaataatattgatttct

SEQ ID NO: 5366005 - DNA, 15 bp, Homo sapiens
agtgaaataatgtgt

SEQ ID NO: 5366006 - DNA, 19 bp, Homo sapiens
agtgaaataatgtgtagtt

SEQ ID NO: 5366007 - DNA, 13 bp, Homo sapiens
agtgaaatagaac

SEQ ID NO: 5366008 - DNA, 17 bp, Homo sapiens
agtgaaatattgtaaat

SEQ ID NO: 5366009 - DNA, 18 bp, Homo sapiens
agtgaaatattgtaaatg

SEQ ID NO: 5366010 - DNA, 21 bp, Homo sapiens
agtgaaatattgtaaatgcta

SEQ ID NO: 5366011 - DNA, 20 bp, Homo sapiens
agtgaaatctgtgcaataaa

SEQ ID NO: 5366012 - DNA, 21 bp, Homo sapiens
agtgaaatctgtgcaataaaa

SEQ ID NO: 5366013 - DNA, 15 bp, Homo sapiens
agtgaaatggctggg

SEQ ID NO: 5366014 - DNA, 19 bp, Homo sapiens
agtgaaatggctggggccg

SEQ ID NO: 5366015 - DNA, 23 bp, Homo sapiens
agtgaaatggctggggccgctgg

SEQ ID NO: 5366016 - DNA, 20 bp, Homo sapiens
agtgaaattaagcattttga

SEQ ID NO: 5366017 - DNA, 13 bp, Homo sapiens
agtgaaattcaat

SEQ ID NO: 5366018 - DNA, 15 bp, Homo sapiens
agtgaaattcaattc

SEQ ID NO: 5366019 - DNA, 22 bp, Homo sapiens
agtgaaattcaattcatagaat

SEQ ID NO: 5366020 - DNA, 15 bp, Homo sapiens
agtgaaattttaaat

SEQ ID NO: 5366021 - DNA, 14 bp, Homo sapiens
agtgaacaaagtga

SEQ ID NO: 5366022 - DNA, 21 bp, Homo sapiens
agtgaacaaagtgagaaatga

SEQ ID NO: 5366023 - DNA, 21 bp, Homo sapiens
agtgaacaaatttacagagac

SEQ ID NO: 5366024 - DNA, 18 bp, Homo sapiens
agtgaacaactggaaata

SEQ ID NO: 5366025 - DNA, 20 bp, Homo sapiens
agtgaacaactggaaataaa

SEQ ID NO: 5366026 - DNA, 11 bp, Homo sapiens
agtgaacacac

SEQ ID NO: 5366027 - DNA, 13 bp, Homo sapiens
agtgaacacacac

SEQ ID NO: 5366028 - DNA, 15 bp, Homo sapiens
agtgaacacatttta

SEQ ID NO: 5366029 - DNA, 16 bp, Homo sapiens
agtgaacactagccag

SEQ ID NO: 5366030 - DNA, 17 bp, Homo sapiens
agtgaacactagccaga

SEQ ID NO: 5366031 - DNA, 23 bp, Homo sapiens
agtgaacagattgctacacacac

SEQ ID NO: 5366032 - DNA, 23 bp, Homo sapiens
agtgagtgcaaaaagctgagtat

SEQ ID NO: 5366033 - DNA, 17 bp, Homo sapiens
agtgagtggtgttggca

SEQ ID NO: 5366034 - DNA, 12 bp, Homo sapiens
agtgagtgtaaa

SEQ ID NO: 5366035 - DNA, 15 bp, Homo sapiens
agtgagtgtaaataa

SEQ ID NO: 5366036 - DNA, 16 bp, Homo sapiens
agtgagtgtggctccc

SEQ ID NO: 5366037 - DNA, 21 bp, Homo sapiens
agtgagtgtggctcccctcta

SEQ ID NO: 5366038 - DNA, 16 bp, Homo sapiens
agtgagtgtggcttag

SEQ ID NO: 5366039 - DNA, 15 bp, Homo sapiens
agtgagtgtgtgtgc

SEQ ID NO: 5366040 - DNA, 22 bp, Homo sapiens
agtgagttacagcgagaggcag

SEQ ID NO: 5366041 - DNA, 10 bp, Homo sapiens
agtgagttca

SEQ ID NO: 5366042 - DNA, 14 bp, Homo sapiens
agtgagttcaacta

SEQ ID NO: 5366043 - DNA, 15 bp, Homo sapiens
agtgagttggggcga

SEQ ID NO: 5366044 - DNA, 19 bp, Homo sapiens
agtgagttgggtgtattgt

SEQ ID NO: 5366045 - DNA, 21 bp, Homo sapiens
agtgagttgggtgtattgtgc

SEQ ID NO: 5366046 - DNA, 19 bp, Homo sapiens
agtgagtttccagctgctc

SEQ ID NO: 5366047 - DNA, 19 bp, Homo sapiens
agtgagtttgtaaatattc

SEQ ID NO: 5366048 - DNA, 20 bp, Homo sapiens
agtgagttttactcttaaat

SEQ ID NO: 5366049 - DNA, 22 bp, Homo sapiens
agtgagttttactcttaaatca

SEQ ID NO: 5366050 - DNA, 19 bp, Homo sapiens
agtgagttttttagtgcgt

SEQ ID NO: 5366051 - DNA, 21 bp, Homo sapiens
agtgataactcctaagaggag

SEQ ID NO: 5366052 - DNA, 22 bp, Homo sapiens
agtgataatattgtttccctcg

SEQ ID NO: 5366053 - DNA, 15 bp, Homo sapiens
agtgatacactgtat

SEQ ID NO: 5366054 - DNA, 16 bp, Homo sapiens
agtgatacactgtatc

SEQ ID NO: 5366055 - DNA, 13 bp, Homo sapiens
agtgatactggct

SEQ ID NO: 5366056 - DNA, 17 bp, Homo sapiens
agtgatagaacaaaaga

SEQ ID NO: 5366057 - DNA, 24 bp, Homo sapiens
agtgatagctactgtagaaaggaa

SEQ ID NO: 5366058 - DNA, 16 bp, Homo sapiens
agtgataggcccaagg

SEQ ID NO: 5366059 - DNA, 16 bp, Homo sapiens
agtgatatctttctca

SEQ ID NO: 5366060 - DNA, 23 bp, Homo sapiens
agtgatatggcttgtagggtgag

SEQ ID NO: 5366061 - DNA, 15 bp, Homo sapiens
agtgatattctttgt

SEQ ID NO: 5366062 - DNA, 18 bp, Homo sapiens
agtgatattctttgttaa

SEQ ID NO: 5366063 - DNA, 13 bp, Homo sapiens
agtgatatttctc

SEQ ID NO: 5366064 - DNA, 22 bp, Homo sapiens
agtgatatttctctagtagtta

SEQ ID NO: 5366065 - DNA, 16 bp, Homo sapiens
agtgatcaagaagact

SEQ ID NO: 5366066 - DNA, 16 bp, Homo sapiens
agtgatcacagcagct

SEQ ID NO: 5366067 - DNA, 20 bp, Homo sapiens
agtgatcagtatgctgtttt

SEQ ID NO: 5366068 - DNA, 15 bp, Homo sapiens
agtgatcatttaaaa

SEQ ID NO: 5366069 - DNA, 19 bp, Homo sapiens
agtgatcctcctgcctcag

SEQ ID NO: 5366070 - DNA, 14 bp, Homo sapiens
agtgatcctcctgt

SEQ ID NO: 5366071 - DNA, 15 bp, Homo sapiens
agtgatcctgcaagt

SEQ ID NO: 5366072 - DNA, 16 bp, Homo sapiens
agtgatccttacaagt

SEQ ID NO: 5366073 - DNA, 18 bp, Homo sapiens
agtgatccttccacctca

SEQ ID NO: 5366074 - DNA, 22 bp, Homo sapiens
agtgatctacatgaggaactgt

SEQ ID NO: 5366075 - DNA, 18 bp, Homo sapiens
agtgatctatgtttgtgt

SEQ ID NO: 5366076 - DNA, 21 bp, Homo sapiens
agtgatctatgtttgtgtgat

SEQ ID NO: 5366077 - DNA, 20 bp, Homo sapiens
agtgatctattttgagttaa

SEQ ID NO: 5366078 - DNA, 21 bp, Homo sapiens
agtgatctccatatgttacac

SEQ ID NO: 5366079 - DNA, 19 bp, Homo sapiens
agtgatctcgactcccccc

SEQ ID NO: 5366080 - DNA, 20 bp, Homo sapiens
agtgatctcgactcccccct

SEQ ID NO: 5366081 - DNA, 21 bp, Homo sapiens
agtgatctgtcccctctcccc

SEQ ID NO: 5366082 - DNA, 15 bp, Homo sapiens
agtgatctgttcagt

SEQ ID NO: 5366083 - DNA, 20 bp, Homo sapiens
agtgatcttttgttcccatc

SEQ ID NO: 5366084 - DNA, 14 bp, Homo sapiens
agtgatgaaattat

SEQ ID NO: 5366085 - DNA, 15 bp, Homo sapiens
agtgatgacttgctg

SEQ ID NO: 5366086 - DNA, 19 bp, Homo sapiens
agtgatgagacagtgaagt

SEQ ID NO: 5366087 - DNA, 16 bp, Homo sapiens
agtgatgatgcatgga

SEQ ID NO: 5366088 - DNA, 19 bp, Homo sapiens
agtgatgatgttttgatat

SEQ ID NO: 5366089 - DNA, 17 bp, Homo sapiens
agtgatgcaataaacaa

SEQ ID NO: 5366090 - DNA, 20 bp, Homo sapiens
agtgatgcaataaccagcat

SEQ ID NO: 5366091 - DNA, 19 bp, Homo sapiens
agtgatgccgggcgccagg

SEQ ID NO: 5366092 - DNA, 24 bp, Homo sapiens
agtgatgccgggcgccaggacagc

SEQ ID NO: 5366093 - DNA, 17 bp, Homo sapiens
agtgatgctaaaacctg

SEQ ID NO: 5366094 - DNA, 22 bp, Homo sapiens
agtgatgcttttagttttaaaa

SEQ ID NO: 5366095 - DNA, 11 bp, Homo sapiens
agtgatggcat

SEQ ID NO: 5366096 - DNA, 21 bp, Homo sapiens
agtgatggcattactctgcac

SEQ ID NO: 5366097 - DNA, 18 bp, Homo sapiens
agtgatgggaaagaccct

SEQ ID NO: 5366098 - DNA, 21 bp, Homo sapiens
agtgatgggaaggtttttaag

SEQ ID NO: 5366099 - DNA, 14 bp, Homo sapiens
agtgatgggcaagg

SEQ ID NO: 5366100 - DNA, 20 bp, Homo sapiens
agtgatgggttagtggatgg

SEQ ID NO: 5366101 - DNA, 18 bp, Homo sapiens
agtgatggtgtccttccc

SEQ ID NO: 5366102 - DNA, 18 bp, Homo sapiens
agtgatgtaattatggtt

SEQ ID NO: 5366103 - DNA, 16 bp, Homo sapiens
agtgatgtaccatgaa

SEQ ID NO: 5366104 - DNA, 17 bp, Homo sapiens
agtgatgtatacatctt

SEQ ID NO: 5366105 - DNA, 19 bp, Homo sapiens
agtgatgtattttcatagt

SEQ ID NO: 5366106 - DNA, 20 bp, Homo sapiens
agtgatgtgatttatgcatt

SEQ ID NO: 5366107 - DNA, 23 bp, Homo sapiens
agtgatgtggtgggagcacagct

SEQ ID NO: 5366108 - DNA, 13 bp, Homo sapiens
agtgatgttgaaa

SEQ ID NO: 5366109 - DNA, 19 bp, Homo sapiens
agtgatgttgtttgggaga

SEQ ID NO: 5366110 - DNA, 14 bp, Homo sapiens
agtgatgtttttat

SEQ ID NO: 5366111 - DNA, 23 bp, Homo sapiens
agtgatgtttttatgatatccct

SEQ ID NO: 5366112 - DNA, 22 bp, Homo sapiens
agtgattaaatatatctagaac

SEQ ID NO: 5366113 - DNA, 23 bp, Homo sapiens
agtgattaaggtctctctttgga

SEQ ID NO: 5366114 - DNA, 15 bp, Homo sapiens
agtgattatatttca

SEQ ID NO: 5366115 - DNA, 12 bp, Homo sapiens
agtgattcagca

SEQ ID NO: 5366116 - DNA, 19 bp, Homo sapiens
agtgattccatcaaagaga

SEQ ID NO: 5366117 - DNA, 22 bp, Homo sapiens
agtgattctcctgcctcagcct

SEQ ID NO: 5366118 - DNA, 14 bp, Homo sapiens
agtgattctgtttg

SEQ ID NO: 5366119 - DNA, 23 bp, Homo sapiens
agtgattgaagtatctgtacctg

SEQ ID NO: 5366120 - DNA, 17 bp, Homo sapiens
agtgattgacacacagc

SEQ ID NO: 5366121 - DNA, 13 bp, Homo sapiens
agtgattgcagct

SEQ ID NO: 5366122 - DNA, 20 bp, Homo sapiens
agtgattgcagctttatgtt

SEQ ID NO: 5366123 - DNA, 17 bp, Homo sapiens
agtgattgggacagagg

SEQ ID NO: 5366124 - DNA, 21 bp, Homo sapiens
agtgattgttatgccttgcta

SEQ ID NO: 5366125 - DNA, 12 bp, Homo sapiens
agtgatttcatt

SEQ ID NO: 5366126 - DNA, 15 bp, Homo sapiens
agtgatttctagaaa

SEQ ID NO: 5366127 - DNA, 23 bp, Homo sapiens
agtgatttgggggtgcaatgata

SEQ ID NO: 5366128 - DNA, 13 bp, Homo sapiens
agtgatttgtaaa

SEQ ID NO: 5366129 - DNA, 17 bp, Homo sapiens
agtgatttgtaatatga

SEQ ID NO: 5366130 - DNA, 20 bp, Homo sapiens
agtgatttgtaatatgattt

SEQ ID NO: 5366131 - DNA, 19 bp, Homo sapiens
agtgattttcaaacctcaa

SEQ ID NO: 5366132 - DNA, 16 bp, Homo sapiens
agtgatttttatccaa

SEQ ID NO: 5366133 - DNA, 23 bp, Homo sapiens
agtgatttttatccaatcttgtt

SEQ ID NO: 5366134 - DNA, 17 bp, Homo sapiens
agtgatttttggtcttc

SEQ ID NO: 5366135 - DNA, 13 bp, Homo sapiens
agtgcaaaaaaca

SEQ ID NO: 5366136 - DNA, 21 bp, Homo sapiens
agtgcaaaaactttcatgcct

SEQ ID NO: 5366137 - DNA, 14 bp, Homo sapiens
agtgcaaaactgtg

SEQ ID NO: 5366138 - DNA, 15 bp, Homo sapiens
agtgcaaaatgtctt

SEQ ID NO: 5366139 - DNA, 18 bp, Homo sapiens
agtgcaaacacagcatgg

SEQ ID NO: 5366140 - DNA, 20 bp, Homo sapiens
agtgcaaacagaagtgcatc

SEQ ID NO: 5366141 - DNA, 15 bp, Homo sapiens
agtgcaaagctgctt

SEQ ID NO: 5366142 - DNA, 17 bp, Homo sapiens
agtgcaaagctgcttga

SEQ ID NO: 5366143 - DNA, 21 bp, Homo sapiens
agtgcaaagctgcttgaatca

SEQ ID NO: 5366144 - DNA, 15 bp, Homo sapiens
agtgcaaagtgccct

SEQ ID NO: 5366145 - DNA, 18 bp, Homo sapiens
agtgcaaagtgccctcat

SEQ ID NO: 5366146 - DNA, 13 bp, Homo sapiens
agtgcaaattgta

SEQ ID NO: 5366147 - DNA, 17 bp, Homo sapiens
agtgcaacatctctgaa

SEQ ID NO: 5366148 - DNA, 13 bp, Homo sapiens
agtgcaacctctg

SEQ ID NO: 5366149 - DNA, 16 bp, Homo sapiens
agtgcaactgttttga

SEQ ID NO: 5366150 - DNA, 24 bp, Homo sapiens
agtgcaacttagatctctcctgca

SEQ ID NO: 5366151 - DNA, 15 bp, Homo sapiens
agtgcaagagacttt

SEQ ID NO: 5366152 - DNA, 19 bp, Homo sapiens
agtgcaagagactttgtca

SEQ ID NO: 5366153 - DNA, 20 bp, Homo sapiens
agtgcaagagactttgtcac

SEQ ID NO: 5366154 - DNA, 22 bp, Homo sapiens
agtgcaagagcctgagactgga

SEQ ID NO: 5366155 - DNA, 16 bp, Homo sapiens
agtgcaagcaaagcag

SEQ ID NO: 5366156 - DNA, 15 bp, Homo sapiens
agtgcaagcccctgc

SEQ ID NO: 5366157 - DNA, 14 bp, Homo sapiens
agtgcaagctgaag

SEQ ID NO: 5366158 - DNA, 15 bp, Homo sapiens
agtgcaaggaatgac

SEQ ID NO: 5366159 - DNA, 21 bp, Homo sapiens
agtgcaagttcatgtgtggaa

SEQ ID NO: 5366160 - DNA, 22 bp, Homo sapiens
agtgcaataaatctgacccagt

SEQ ID NO: 5366161 - DNA, 21 bp, Homo sapiens
agtgcaatatattttgtatgc

SEQ ID NO: 5366162 - DNA, 22 bp, Homo sapiens
agtgcaatatgggcgggcagtc

SEQ ID NO: 5366163 - DNA, 19 bp, Homo sapiens
agtgcaatctgtccagaca

SEQ ID NO: 5366164 - DNA, 20 bp, Homo sapiens
agtgcaatgccccctcccct

SEQ ID NO: 5366165 - DNA, 18 bp, Homo sapiens
agtgcaatgcttgtagaa

SEQ ID NO: 5366166 - DNA, 21 bp, Homo sapiens
agtgcaatgggtaagggaggg

SEQ ID NO: 5366167 - DNA, 22 bp, Homo sapiens
agtgcaatgggtaagggaggga

SEQ ID NO: 5366168 - DNA, 15 bp, Homo sapiens
agtgcaatggtgcaa

SEQ ID NO: 5366169 - DNA, 18 bp, Homo sapiens
agtgcaattccaagaaaa

SEQ ID NO: 5366170 - DNA, 14 bp, Homo sapiens
agtgcaatttcttc

SEQ ID NO: 5366171 - DNA, 17 bp, Homo sapiens
agtgcacaaaatgaatg

SEQ ID NO: 5366172 - DNA, 13 bp, Homo sapiens
agtgcacacacac

SEQ ID NO: 5366173 - DNA, 12 bp, Homo sapiens
agtgcacagctg

SEQ ID NO: 5366174 - DNA, 14 bp, Homo sapiens
agtgcacagctgtc

SEQ ID NO: 5366175 - DNA, 15 bp, Homo sapiens
agtgcacagctgtcc

SEQ ID NO: 5366176 - DNA, 20 bp, Homo sapiens
agtgcacatctgacccagag

SEQ ID NO: 5366177 - DNA, 16 bp, Homo sapiens
agtgcaccaaagagaa

SEQ ID NO: 5366178 - DNA, 18 bp, Homo sapiens
agtgcaccaaagagaatg

SEQ ID NO: 5366179 - DNA, 20 bp, Homo sapiens
agtgcaccaaagagaatgcc

SEQ ID NO: 5366180 - DNA, 17 bp, Homo sapiens
agtgcaccaccctttga

SEQ ID NO: 5366181 - DNA, 19 bp, Homo sapiens
agtgcaccaggtcactctg

SEQ ID NO: 5366182 - DNA, 21 bp, Homo sapiens
agtgcacctcaaatcttctaa

SEQ ID NO: 5366183 - DNA, 18 bp, Homo sapiens
agtgcacctccctcccca

SEQ ID NO: 5366184 - DNA, 19 bp, Homo sapiens
agtgcacctccctccccag

SEQ ID NO: 5366185 - DNA, 22 bp, Homo sapiens
agtgcacctgcctcagctacct

SEQ ID NO: 5366186 - DNA, 17 bp, Homo sapiens
agtgcactaaacaaata

SEQ ID NO: 5366187 - DNA, 21 bp, Homo sapiens
agtgcactaaccccagctgcc

SEQ ID NO: 5366188 - DNA, 21 bp, Homo sapiens
agtgcactgaaagtcacggct

SEQ ID NO: 5366189 - DNA, 12 bp, Homo sapiens
agtgcactgatt

SEQ ID NO: 5366190 - DNA, 13 bp, Homo sapiens
agtgcactgcatt

SEQ ID NO: 5366191 - DNA, 21 bp, Homo sapiens
agtgcactgcattcctgtgcc

SEQ ID NO: 5366192 - DNA, 22 bp, Homo sapiens
agtgcactgcattcctgtgccc

SEQ ID NO: 5366193 - DNA, 23 bp, Homo sapiens
agtgcactgcattcctgtgccct

SEQ ID NO: 5366194 - DNA, 21 bp, Homo sapiens
agtgcactttctaatgtttct

SEQ ID NO: 5366195 - DNA, 15 bp, Homo sapiens
agtgcacttttttat

SEQ ID NO: 5366196 - DNA, 14 bp, Homo sapiens
agtgcagaatgtaa

SEQ ID NO: 5366197 - DNA, 23 bp, Homo sapiens
agtgcagaatgtaagtgggccca

SEQ ID NO: 5366198 - DNA, 16 bp, Homo sapiens
agtgcagacaggccat

SEQ ID NO: 5366199 - DNA, 21 bp, Homo sapiens
agtgcagaccccttggccagc

SEQ ID NO: 5366200 - DNA, 12 bp, Homo sapiens
agtgcagagaaa

SEQ ID NO: 5366201 - DNA, 17 bp, Homo sapiens
agtgcagatctgtgctc

SEQ ID NO: 5366202 - DNA, 20 bp, Homo sapiens
agtgcagcaaccagagcact

SEQ ID NO: 5366203 - DNA, 20 bp, Homo sapiens
agtgcagcaagcctggcccc

SEQ ID NO: 5366204 - DNA, 15 bp, Homo sapiens
agtgcagcagaggac

SEQ ID NO: 5366205 - DNA, 16 bp, Homo sapiens
agtgcagcagaggaca

SEQ ID NO: 5366206 - DNA, 18 bp, Homo sapiens
agtgcagcatatacaata

SEQ ID NO: 5366207 - DNA, 18 bp, Homo sapiens
agtgcagcatgggaaagg

SEQ ID NO: 5366208 - DNA, 19 bp, Homo sapiens
agtgccgcagtggggtcaa

SEQ ID NO: 5366209 - DNA, 16 bp, Homo sapiens
agtgccgcatctcaca

SEQ ID NO: 5366210 - DNA, 16 bp, Homo sapiens
agtgccgccgcctcgc

SEQ ID NO: 5366211 - DNA, 17 bp, Homo sapiens
agtgccgccgcctcgcc

SEQ ID NO: 5366212 - DNA, 19 bp, Homo sapiens
agtgccgccgcctcgccca

SEQ ID NO: 5366213 - DNA, 20 bp, Homo sapiens
agtgccgccgcctcgcccac

SEQ ID NO: 5366214 - DNA, 23 bp, Homo sapiens
agtgccgccgcctcgcccaccgc

SEQ ID NO: 5366215 - DNA, 17 bp, Homo sapiens
agtgccgctcctgcttc

SEQ ID NO: 5366216 - DNA, 19 bp, Homo sapiens
agtgccggctgtggagcaa

SEQ ID NO: 5366217 - DNA, 22 bp, Homo sapiens
agtgccgtgtgttgcatgcagc

SEQ ID NO: 5366218 - DNA, 18 bp, Homo sapiens
agtgcctaaaattgtatg

SEQ ID NO: 5366219 - DNA, 15 bp, Homo sapiens
agtgcctagaaagca

SEQ ID NO: 5366220 - DNA, 22 bp, Homo sapiens
agtgcctagactgttactttgg

SEQ ID NO: 5366221 - DNA, 16 bp, Homo sapiens
agtgcctcagcgctgc

SEQ ID NO: 5366222 - DNA, 18 bp, Homo sapiens
agtgcctcagcgctgccc

SEQ ID NO: 5366223 - DNA, 19 bp, Homo sapiens
agtgcctcagcgctgccca

SEQ ID NO: 5366224 - DNA, 21 bp, Homo sapiens
agtgcctcagcgctgcccaca

SEQ ID NO: 5366225 - DNA, 12 bp, Homo sapiens
agtgcctccaca

SEQ ID NO: 5366226 - DNA, 12 bp, Homo sapiens
agtgcctcctgg

SEQ ID NO: 5366227 - DNA, 13 bp, Homo sapiens
agtgcctcctggc

SEQ ID NO: 5366228 - DNA, 15 bp, Homo sapiens
agtgcctcgaggcac

SEQ ID NO: 5366229 - DNA, 17 bp, Homo sapiens
agtgcctcgaggcaccg

SEQ ID NO: 5366230 - DNA, 19 bp, Homo sapiens
agtgcctctccctgctgct

SEQ ID NO: 5366231 - DNA, 23 bp, Homo sapiens
agtgcctctccctgctgctccta

SEQ ID NO: 5366232 - DNA, 21 bp, Homo sapiens
agtgcctcttgtctgagggac

SEQ ID NO: 5366233 - DNA, 19 bp, Homo sapiens
agtgcctcttgttgcagag

SEQ ID NO: 5366234 - DNA, 18 bp, Homo sapiens
agtgcctctttcatccac

SEQ ID NO: 5366235 - DNA, 14 bp, Homo sapiens
agtgcctctttgaa

SEQ ID NO: 5366236 - DNA, 22 bp, Homo sapiens
agtgcctgcacatcatgagcct

SEQ ID NO: 5366237 - DNA, 23 bp, Homo sapiens
agtgcctgcacatcatgagcctt

SEQ ID NO: 5366238 - DNA, 13 bp, Homo sapiens
agtgcctgcacca

SEQ ID NO: 5366239 - DNA, 22 bp, Homo sapiens
agtgcctgcattcccaggaaaa

SEQ ID NO: 5366240 - DNA, 11 bp, Homo sapiens
agtgcctgcca

SEQ ID NO: 5366241 - DNA, 11 bp, Homo sapiens
agtgcctgctg

SEQ ID NO: 5366242 - DNA, 12 bp, Homo sapiens
agtgcctgctgt

SEQ ID NO: 5366243 - DNA, 13 bp, Homo sapiens
agtgcctgctttt

SEQ ID NO: 5366244 - DNA, 12 bp, Homo sapiens
agtgcctggagt

SEQ ID NO: 5366245 - DNA, 19 bp, Homo sapiens
agtgcctggagtcaggtgt

SEQ ID NO: 5366246 - DNA, 13 bp, Homo sapiens
agtgcctggccca

SEQ ID NO: 5366247 - DNA, 13 bp, Homo sapiens
agtgcctgggaat

SEQ ID NO: 5366248 - DNA, 18 bp, Homo sapiens
agtgcctgggaatgtatt

SEQ ID NO: 5366249 - DNA, 13 bp, Homo sapiens
agtgcctgggctc

SEQ ID NO: 5366250 - DNA, 18 bp, Homo sapiens
agtgcctgggctcagcct

SEQ ID NO: 5366251 - DNA, 17 bp, Homo sapiens
agtgcctgtacaggaag

SEQ ID NO: 5366252 - DNA, 18 bp, Homo sapiens
agtgcctgtacaggaagg

SEQ ID NO: 5366253 - DNA, 15 bp, Homo sapiens
agtgcctgtatcttt

SEQ ID NO: 5366254 - DNA, 15 bp, Homo sapiens
agtgccttacacaat

SEQ ID NO: 5366255 - DNA, 17 bp, Homo sapiens
agtgccttacacaatgg

SEQ ID NO: 5366256 - DNA, 18 bp, Homo sapiens
agtgccttacctcctgcc

SEQ ID NO: 5366257 - DNA, 19 bp, Homo sapiens
agtgccttacctcctgccc

SEQ ID NO: 5366258 - DNA, 21 bp, Homo sapiens
agtgccttacctcctgcccag

SEQ ID NO: 5366259 - DNA, 14 bp, Homo sapiens
agtgccttagggga

SEQ ID NO: 5366260 - DNA, 13 bp, Homo sapiens
agtgccttatgga

SEQ ID NO: 5366261 - DNA, 22 bp, Homo sapiens
agtgccttatggaacactctga

SEQ ID NO: 5366262 - DNA, 16 bp, Homo sapiens
agtgccttcagccaag

SEQ ID NO: 5366263 - DNA, 13 bp, Homo sapiens
agtgccttccata

SEQ ID NO: 5366264 - DNA, 16 bp, Homo sapiens
agtgccttccataatt

SEQ ID NO: 5366265 - DNA, 16 bp, Homo sapiens
agtgccttctccttcc

SEQ ID NO: 5366266 - DNA, 15 bp, Homo sapiens
agtgccttctgggct

SEQ ID NO: 5366267 - DNA, 17 bp, Homo sapiens
agtgccttctgtgggga

SEQ ID NO: 5366268 - DNA, 19 bp, Homo sapiens
agtgccttgattttaattc

SEQ ID NO: 5366269 - DNA, 20 bp, Homo sapiens
agtgccttgattttaattca

SEQ ID NO: 5366270 - DNA, 23 bp, Homo sapiens
agtgccttgattttaattcaggt

SEQ ID NO: 5366271 - DNA, 14 bp, Homo sapiens
agtgccttgcccac

SEQ ID NO: 5366272 - DNA, 13 bp, Homo sapiens
agtgccttgctcg

SEQ ID NO: 5366273 - DNA, 16 bp, Homo sapiens
agtgcctttagagggt

SEQ ID NO: 5366274 - DNA, 17 bp, Homo sapiens
agtgcctttatctcagc

SEQ ID NO: 5366275 - DNA, 22 bp, Homo sapiens
agtgcctttctgcagtttttca

SEQ ID NO: 5366276 - DNA, 13 bp, Homo sapiens
agtgcctttgtag

SEQ ID NO: 5366277 - DNA, 20 bp, Homo sapiens
agtgccttttgctgcgcacc

SEQ ID NO: 5366278 - DNA, 14 bp, Homo sapiens
agtgcctttttcct

SEQ ID NO: 5366279 - DNA, 14 bp, Homo sapiens
agtgcgagtatgtg

SEQ ID NO: 5366280 - DNA, 17 bp, Homo sapiens
agtgcgagtatgtgttt

SEQ ID NO: 5366281 - DNA, 17 bp, Homo sapiens
agtgcgcagatctgtgc

SEQ ID NO: 5366282 - DNA, 18 bp, Homo sapiens
agtgcgcagatctgtgcc

SEQ ID NO: 5366283 - DNA, 22 bp, Homo sapiens
agtgcgctcattttaggcctcc

SEQ ID NO: 5366284 - DNA, 23 bp, Homo sapiens
agtgcgctcattttaggcctcct

SEQ ID NO: 5366285 - DNA, 19 bp, Homo sapiens
agtgcgctcttggtccctg

SEQ ID NO: 5366286 - DNA, 23 bp, Homo sapiens
agtgcggcgtggagactggcagg

SEQ ID NO: 5366287 - DNA, 16 bp, Homo sapiens
agtgcggttcctcatc

SEQ ID NO: 5366288 - DNA, 14 bp, Homo sapiens
agtgcgtctgaggg

SEQ ID NO: 5366289 - DNA, 13 bp, Homo sapiens
agtgcgtgaatgt

SEQ ID NO: 5366290 - DNA, 14 bp, Homo sapiens
agtgcgtgaatgta

SEQ ID NO: 5366291 - DNA, 15 bp, Homo sapiens
agtgcgtgatttctc

SEQ ID NO: 5366292 - DNA, 16 bp, Homo sapiens
agtgcgtgccgtgtga

SEQ ID NO: 5366293 - DNA, 13 bp, Homo sapiens
agtgcgtggccca

SEQ ID NO: 5366294 - DNA, 20 bp, Homo sapiens
agtgcgtgtgtgtatgtgtg

SEQ ID NO: 5366295 - DNA, 16 bp, Homo sapiens
agtgcgttctcccagc

SEQ ID NO: 5366296 - DNA, 22 bp, Homo sapiens
agtgctaaacaagtaagaaaaa

SEQ ID NO: 5366297 - DNA, 23 bp, Homo sapiens
agtgctaaacatggcttaatctt

SEQ ID NO: 5366298 - DNA, 20 bp, Homo sapiens
agtgctaaacctatctgtat

SEQ ID NO: 5366299 - DNA, 18 bp, Homo sapiens
agtgctaagcattagctt

SEQ ID NO: 5366300 - DNA, 20 bp, Homo sapiens
agtgctaagcattagcttta

SEQ ID NO: 5366301 - DNA, 17 bp, Homo sapiens
agtgctaagctgccctg

SEQ ID NO: 5366302 - DNA, 13 bp, Homo sapiens
agtgctaagtgtg

SEQ ID NO: 5366303 - DNA, 14 bp, Homo sapiens
agtgctaagtgtga

SEQ ID NO: 5366304 - DNA, 18 bp, Homo sapiens
agtgctaagtgtgaactg

SEQ ID NO: 5366305 - DNA, 19 bp, Homo sapiens
agtgctaagtgtgaactgg

SEQ ID NO: 5366306 - DNA, 22 bp, Homo sapiens
agtgctacacacctaacttatg

SEQ ID NO: 5366307 - DNA, 15 bp, Homo sapiens
agtgctacagatgta

SEQ ID NO: 5366308 - DNA, 18 bp, Homo sapiens
agtgctacagatgtacat

SEQ ID NO: 5366309 - DNA, 13 bp, Homo sapiens
agtgctacatttt

SEQ ID NO: 5366310 - DNA, 17 bp, Homo sapiens
agtgctacctttgagtg

SEQ ID NO: 5366311 - DNA, 14 bp, Homo sapiens
agtgctactgaaag

SEQ ID NO: 5366312 - DNA, 14 bp, Homo sapiens
agtgctactgctag

SEQ ID NO: 5366313 - DNA, 24 bp, Homo sapiens
agtgctagaaaatttagcccttta

SEQ ID NO: 5366314 - DNA, 13 bp, Homo sapiens
agtgctagccact

SEQ ID NO: 5366315 - DNA, 15 bp, Homo sapiens
agtgctatatatata

SEQ ID NO: 5366316 - DNA, 17 bp, Homo sapiens
agtgctatatatataaa

SEQ ID NO: 5366317 - DNA, 19 bp, Homo sapiens
agtgctatatatataaata

SEQ ID NO: 5366318 - DNA, 23 bp, Homo sapiens
agtgctatatatataaatatttg

SEQ ID NO: 5366319 - DNA, 22 bp, Homo sapiens
agtgctatgcggaggaaagcaa

SEQ ID NO: 5366320 - DNA, 20 bp, Homo sapiens
agtgctcaagcagcaaaatc

SEQ ID NO: 5366321 - DNA, 23 bp, Homo sapiens
agtgctcaagcagcaaaatcctt

SEQ ID NO: 5366322 - DNA, 14 bp, Homo sapiens
agtgctcaaggcca

SEQ ID NO: 5366323 - DNA, 16 bp, Homo sapiens
agtgctcaaggccagc

SEQ ID NO: 5366324 - DNA, 19 bp, Homo sapiens
agtgctcagctgtggctgg

SEQ ID NO: 5366325 - DNA, 12 bp, Homo sapiens
agtgctcaggga

SEQ ID NO: 5366326 - DNA, 17 bp, Homo sapiens
agtgctcagggaaatgg

SEQ ID NO: 5366327 - DNA, 23 bp, Homo sapiens
agtgctcagggaaatggccttcc

SEQ ID NO: 5366328 - DNA, 15 bp, Homo sapiens
agtgctcagtattga

SEQ ID NO: 5366329 - DNA, 14 bp, Homo sapiens
agtgctcagttcca

SEQ ID NO: 5366330 - DNA, 14 bp, Homo sapiens
agtgctcatctgtt

SEQ ID NO: 5366331 - DNA, 14 bp, Homo sapiens
agtgctccccacac

SEQ ID NO: 5366332 - DNA, 14 bp, Homo sapiens
agtgctccctggag

SEQ ID NO: 5366333 - DNA, 14 bp, Homo sapiens
agtgctcctgaaag

SEQ ID NO: 5366334 - DNA, 17 bp, Homo sapiens
agtgctcgaccttgata

SEQ ID NO: 5366335 - DNA, 18 bp, Homo sapiens
agtgctcgctgttgctga

SEQ ID NO: 5366336 - DNA, 22 bp, Homo sapiens
agtgctcgctgttgctgaatag

SEQ ID NO: 5366337 - DNA, 18 bp, Homo sapiens
agtgctcgctttctatgt

SEQ ID NO: 5366338 - DNA, 20 bp, Homo sapiens
agtgctcgctttctatgtag

SEQ ID NO: 5366339 - DNA, 17 bp, Homo sapiens
agtgctctaggctgccc

SEQ ID NO: 5366340 - DNA, 19 bp, Homo sapiens
agtgctctaggctgccccg

SEQ ID NO: 5366341 - DNA, 16 bp, Homo sapiens
agtgctctcagctggc

SEQ ID NO: 5366342 - DNA, 18 bp, Homo sapiens
agtgctctgaccctgggc

SEQ ID NO: 5366343 - DNA, 12 bp, Homo sapiens
agtgctctgata

SEQ ID NO: 5366344 - DNA, 17 bp, Homo sapiens
agtgctctgatccctct

SEQ ID NO: 5366345 - DNA, 12 bp, Homo sapiens
agtgctctgcct

SEQ ID NO: 5366346 - DNA, 23 bp, Homo sapiens
agtgctctgcctctaactccctc

SEQ ID NO: 5366347 - DNA, 14 bp, Homo sapiens
agtgctctgtaaaa

SEQ ID NO: 5366348 - DNA, 13 bp, Homo sapiens
agtgctcttccca

SEQ ID NO: 5366349 - DNA, 22 bp, Homo sapiens
agtgctcttcccactccagctg

SEQ ID NO: 5366350 - DNA, 23 bp, Homo sapiens
agtgctcttcccactccagctga

SEQ ID NO: 5366351 - DNA, 18 bp, Homo sapiens
agtgctcttggctgaccc

SEQ ID NO: 5366352 - DNA, 22 bp, Homo sapiens
agtgctcttggctgacccctct

SEQ ID NO: 5366353 - DNA, 20 bp, Homo sapiens
agtgctctttgtggcagtgg

SEQ ID NO: 5366354 - DNA, 13 bp, Homo sapiens
agtgctgaaaatg

SEQ ID NO: 5366355 - DNA, 19 bp, Homo sapiens
agtgctgaaagaattcctt

SEQ ID NO: 5366356 - DNA, 15 bp, Homo sapiens
agtgctgaagcttat

SEQ ID NO: 5366357 - DNA, 16 bp, Homo sapiens
agtgctgaagcttatt

SEQ ID NO: 5366358 - DNA, 16 bp, Homo sapiens
agtgctgaagggggca

SEQ ID NO: 5366359 - DNA, 16 bp, Homo sapiens
agtgctgaccccagga

SEQ ID NO: 5366360 - DNA, 17 bp, Homo sapiens
agtgctgaccccaggaa

SEQ ID NO: 5366361 - DNA, 16 bp, Homo sapiens
agtgctgatccggctg

SEQ ID NO: 5366362 - DNA, 19 bp, Homo sapiens
agtgctgatccggctgctc

SEQ ID NO: 5366363 - DNA, 21 bp, Homo sapiens
agtgctgatccggctgctcct

SEQ ID NO: 5366364 - DNA, 14 bp, Homo sapiens
agtgctgattcaaa

SEQ ID NO: 5366365 - DNA, 21 bp, Homo sapiens
agtgctgattcaaaccaaagc

SEQ ID NO: 5366366 - DNA, 22 bp, Homo sapiens
agtgctgattcaaaccaaagct

SEQ ID NO: 5366367 - DNA, 14 bp, Homo sapiens
agtgctgattcagc

SEQ ID NO: 5366368 - DNA, 19 bp, Homo sapiens
agtgctgcagccaaagaca

SEQ ID NO: 5366369 - DNA, 16 bp, Homo sapiens
agtgctgcagcctaat

SEQ ID NO: 5366370 - DNA, 14 bp, Homo sapiens
agtgctgcagcttt

SEQ ID NO: 5366371 - DNA, 19 bp, Homo sapiens
agtgctgcagctttgggaa

SEQ ID NO: 5366372 - DNA, 20 bp, Homo sapiens
agtgctgcagctttgggaaa

SEQ ID NO: 5366373 - DNA, 22 bp, Homo sapiens
agtgctgcagctttgggaaagc

SEQ ID NO: 5366374 - DNA, 21 bp, Homo sapiens
agtgctgcagggctttaaaat

SEQ ID NO: 5366375 - DNA, 16 bp, Homo sapiens
agtgctgcatcttata

SEQ ID NO: 5366376 - DNA, 12 bp, Homo sapiens
agtgctgcattt

SEQ ID NO: 5366377 - DNA, 16 bp, Homo sapiens
agtgctgcatttaaaa

SEQ ID NO: 5366378 - DNA, 17 bp, Homo sapiens
agtgctgccatgccact

SEQ ID NO: 5366379 - DNA, 19 bp, Homo sapiens
agtgctgccatgccactgc

SEQ ID NO: 5366380 - DNA, 21 bp, Homo sapiens
agtgctgccatgccactgcca

SEQ ID NO: 5366381 - DNA, 23 bp, Homo sapiens
agtgctgccatgccactgccagg

SEQ ID NO: 5366382 - DNA, 21 bp, Homo sapiens
agtgctgcccatgagcaagcc

SEQ ID NO: 5366383 - DNA, 12 bp, Homo sapiens
agtgctgcccct

SEQ ID NO: 5366384 - DNA, 17 bp, Homo sapiens
agtgctgccccttgcaa

SEQ ID NO: 5366385 - DNA, 18 bp, Homo sapiens
agtgctgccccttgcaag

SEQ ID NO: 5366386 - DNA, 16 bp, Homo sapiens
agtggagcagccagca

SEQ ID NO: 5366387 - DNA, 16 bp, Homo sapiens
agtggagcccagggtg

SEQ ID NO: 5366388 - DNA, 18 bp, Homo sapiens
agtggagcccagggtgct

SEQ ID NO: 5366389 - DNA, 12 bp, Homo sapiens
agtggagctggc

SEQ ID NO: 5366390 - DNA, 15 bp, Homo sapiens
agtggagctgggagg

SEQ ID NO: 5366391 - DNA, 16 bp, Homo sapiens
agtggagctgggaggt

SEQ ID NO: 5366392 - DNA, 13 bp, Homo sapiens
agtggagctgtct

SEQ ID NO: 5366393 - DNA, 19 bp, Homo sapiens
agtggaggaaaatccatgg

SEQ ID NO: 5366394 - DNA, 14 bp, Homo sapiens
agtggaggaagccc

SEQ ID NO: 5366395 - DNA, 15 bp, Homo sapiens
agtggaggaagccca

SEQ ID NO: 5366396 - DNA, 23 bp, Homo sapiens
agtggaggaaggtgagatggcca

SEQ ID NO: 5366397 - DNA, 13 bp, Homo sapiens
agtggaggaggag

SEQ ID NO: 5366398 - DNA, 14 bp, Homo sapiens
agtggaggcacttt

SEQ ID NO: 5366399 - DNA, 17 bp, Homo sapiens
agtggaggcactttagg

SEQ ID NO: 5366400 - DNA, 19 bp, Homo sapiens
agtggaggcgggcttggaa

SEQ ID NO: 5366401 - DNA, 14 bp, Homo sapiens
agtggagggagact

SEQ ID NO: 5366402 - DNA, 21 bp, Homo sapiens
agtggagggggcaagctttgc

SEQ ID NO: 5366403 - DNA, 12 bp, Homo sapiens
agtggagggggt

SEQ ID NO: 5366404 - DNA, 23 bp, Homo sapiens
agtggagggggtgtctggaagct

SEQ ID NO: 5366405 - DNA, 12 bp, Homo sapiens
agtggaggtgga

SEQ ID NO: 5366406 - DNA, 23 bp, Homo sapiens
agtggaggttaaggctgaggaaa

SEQ ID NO: 5366407 - DNA, 14 bp, Homo sapiens
agtggaggtttgtc

SEQ ID NO: 5366408 - DNA, 13 bp, Homo sapiens
agtggagtccaga

SEQ ID NO: 5366409 - DNA, 21 bp, Homo sapiens
agtggagtccagatggcaggc

SEQ ID NO: 5366410 - DNA, 18 bp, Homo sapiens
agtggagtctgagtctga

SEQ ID NO: 5366411 - DNA, 17 bp, Homo sapiens
agtggagtctgccaccc

SEQ ID NO: 5366412 - DNA, 19 bp, Homo sapiens
agtggagttgaaactgcta

SEQ ID NO: 5366413 - DNA, 19 bp, Homo sapiens
agtggagttttataaatta

SEQ ID NO: 5366414 - DNA, 21 bp, Homo sapiens
agtggatagatgccctgctag

SEQ ID NO: 5366415 - DNA, 21 bp, Homo sapiens
agtggatatgacccacactgc

SEQ ID NO: 5366416 - DNA, 15 bp, Homo sapiens
agtggatatgcgaat

SEQ ID NO: 5366417 - DNA, 20 bp, Homo sapiens
agtggatattttcttaaaac

SEQ ID NO: 5366418 - DNA, 21 bp, Homo sapiens
agtggatattttcttaaaacc

SEQ ID NO: 5366419 - DNA, 18 bp, Homo sapiens
agtggatcactcaccatt

SEQ ID NO: 5366420 - DNA, 15 bp, Homo sapiens
agtggatctgtagaa

SEQ ID NO: 5366421 - DNA, 18 bp, Homo sapiens
agtggatcttcagaactg

SEQ ID NO: 5366422 - DNA, 19 bp, Homo sapiens
agtggatcttcagaactgc

SEQ ID NO: 5366423 - DNA, 23 bp, Homo sapiens
agtggatcttcagaactgccctt

SEQ ID NO: 5366424 - DNA, 14 bp, Homo sapiens
agtggatgactgtt

SEQ ID NO: 5366425 - DNA, 23 bp, Homo sapiens
agtggatgatatacacagtggca

SEQ ID NO: 5366426 - DNA, 16 bp, Homo sapiens
agtggatgctgggtcc

SEQ ID NO: 5366427 - DNA, 16 bp, Homo sapiens
agtggatgctgtgcta

SEQ ID NO: 5366428 - DNA, 17 bp, Homo sapiens
agtggatggaaggggct

SEQ ID NO: 5366429 - DNA, 14 bp, Homo sapiens
agtggatggacaga

SEQ ID NO: 5366430 - DNA, 17 bp, Homo sapiens
agtggatggacagatgg

SEQ ID NO: 5366431 - DNA, 21 bp, Homo sapiens
agtggatggacagatggacca

SEQ ID NO: 5366432 - DNA, 23 bp, Homo sapiens
agtggatggacagatggaccaaa

SEQ ID NO: 5366433 - DNA, 17 bp, Homo sapiens
agtggatggatggacag

SEQ ID NO: 5366434 - DNA, 23 bp, Homo sapiens
agtggatggatggacagaatgat

SEQ ID NO: 5366435 - DNA, 17 bp, Homo sapiens
agtggatgtttttaatg

SEQ ID NO: 5366436 - DNA, 15 bp, Homo sapiens
agtggattaaaggca

SEQ ID NO: 5366437 - DNA, 14 bp, Homo sapiens
agtggattcctccc

SEQ ID NO: 5366438 - DNA, 17 bp, Homo sapiens
agtggattggctttgtg

SEQ ID NO: 5366439 - DNA, 21 bp, Homo sapiens
agtggattgtaggtgcaagat

SEQ ID NO: 5366440 - DNA, 21 bp, Homo sapiens
agtggatttttttgtcattaa

SEQ ID NO: 5366441 - DNA, 22 bp, Homo sapiens
agtggcaaaaaagaacagtgtt

SEQ ID NO: 5366442 - DNA, 16 bp, Homo sapiens
agtggcaaagagaggt

SEQ ID NO: 5366443 - DNA, 17 bp, Homo sapiens
agtggcaatatagaaac

SEQ ID NO: 5366444 - DNA, 16 bp, Homo sapiens
agtggcacctgtctgc

SEQ ID NO: 5366445 - DNA, 20 bp, Homo sapiens
agtggcacgtcatctagttt

SEQ ID NO: 5366446 - DNA, 15 bp, Homo sapiens
agtggcactctgtgt

SEQ ID NO: 5366447 - DNA, 20 bp, Homo sapiens
agtggcactgaagtggccct

SEQ ID NO: 5366448 - DNA, 22 bp, Homo sapiens
agtggcacttctgccttgagtc

SEQ ID NO: 5366449 - DNA, 15 bp, Homo sapiens
agtggcagcaaagga

SEQ ID NO: 5366450 - DNA, 17 bp, Homo sapiens
agtggcagcaaaggaag

SEQ ID NO: 5366451 - DNA, 18 bp, Homo sapiens
agtggcagcaaaggaaga

SEQ ID NO: 5366452 - DNA, 14 bp, Homo sapiens
agtggcagcagccc

SEQ ID NO: 5366453 - DNA, 17 bp, Homo sapiens
agtggcagccaagagcc

SEQ ID NO: 5366454 - DNA, 13 bp, Homo sapiens
agtggcagccatg

SEQ ID NO: 5366455 - DNA, 16 bp, Homo sapiens
agtggcagccatgcct

SEQ ID NO: 5366456 - DNA, 17 bp, Homo sapiens
agtggcagccatgcctc

SEQ ID NO: 5366457 - DNA, 13 bp, Homo sapiens
agtggcagctgct

SEQ ID NO: 5366458 - DNA, 14 bp, Homo sapiens
agtggcagctgctt

SEQ ID NO: 5366459 - DNA, 16 bp, Homo sapiens
agtggcaggacaggaa

SEQ ID NO: 5366460 - DNA, 18 bp, Homo sapiens
agtggcaggaggacaggt

SEQ ID NO: 5366461 - DNA, 19 bp, Homo sapiens
agtggcaggaggacaggtg

SEQ ID NO: 5366462 - DNA, 20 bp, Homo sapiens
agtggcaggcagaggcccag

SEQ ID NO: 5366463 - DNA, 23 bp, Homo sapiens
agtggcagggaccggcagagctc

SEQ ID NO: 5366464 - DNA, 17 bp, Homo sapiens
agtggcagggcacaggg

SEQ ID NO: 5366465 - DNA, 20 bp, Homo sapiens
agtggcagggcacagggcct

SEQ ID NO: 5366466 - DNA, 22 bp, Homo sapiens
agtggcagggcacagggcctgg

SEQ ID NO: 5366467 - DNA, 14 bp, Homo sapiens
agtggcagggctca

SEQ ID NO: 5366468 - DNA, 14 bp, Homo sapiens
agtggcaggggagc

SEQ ID NO: 5366469 - DNA, 18 bp, Homo sapiens
agtggcaggggagcaggt

SEQ ID NO: 5366470 - DNA, 13 bp, Homo sapiens
agtggcagttctt

SEQ ID NO: 5366471 - DNA, 20 bp, Homo sapiens
agtggcatactttttaaaaa

SEQ ID NO: 5366472 - DNA, 16 bp, Homo sapiens
agtggcatagagaata

SEQ ID NO: 5366473 - DNA, 15 bp, Homo sapiens
agtggcatcatctca

SEQ ID NO: 5366474 - DNA, 15 bp, Homo sapiens
agtggcatctggggc

SEQ ID NO: 5366475 - DNA, 14 bp, Homo sapiens
agtggcatggtcct

SEQ ID NO: 5366476 - DNA, 15 bp, Homo sapiens
agtggcatggtcctg

SEQ ID NO: 5366477 - DNA, 19 bp, Homo sapiens
agtggcatggtcctgtgcc

SEQ ID NO: 5366478 - DNA, 16 bp, Homo sapiens
agtggcattggcagca

SEQ ID NO: 5366479 - DNA, 18 bp, Homo sapiens
agtggcatttctttatga

SEQ ID NO: 5366480 - DNA, 19 bp, Homo sapiens
agtggccaaataggaggga

SEQ ID NO: 5366481 - DNA, 21 bp, Homo sapiens
agtggccaaataggagggaga

SEQ ID NO: 5366482 - DNA, 21 bp, Homo sapiens
agtggccaagagatgcagtgc

SEQ ID NO: 5366483 - DNA, 22 bp, Homo sapiens
agtggccaagatcacagtggcc

SEQ ID NO: 5366484 - DNA, 16 bp, Homo sapiens
agtggccaagcctgct

SEQ ID NO: 5366485 - DNA, 17 bp, Homo sapiens
agtggccaagcctgctg

SEQ ID NO: 5366486 - DNA, 23 bp, Homo sapiens
agtggccaagcctgctgtgtcct

SEQ ID NO: 5366487 - DNA, 16 bp, Homo sapiens
agtggccacagcaccc

SEQ ID NO: 5366488 - DNA, 14 bp, Homo sapiens
agtggccacggccc

SEQ ID NO: 5366489 - DNA, 22 bp, Homo sapiens
agtggccacgttcagggagggg

SEQ ID NO: 5366490 - DNA, 22 bp, Homo sapiens
agtggccactaagcagaggagg

SEQ ID NO: 5366491 - DNA, 22 bp, Homo sapiens
agtggccactaggcccagaccc

SEQ ID NO: 5366492 - DNA, 11 bp, Homo sapiens
agtggccagac

SEQ ID NO: 5366493 - DNA, 14 bp, Homo sapiens
agtggccagccagt

SEQ ID NO: 5366494 - DNA, 19 bp, Homo sapiens
agtggccagccagtgccat

SEQ ID NO: 5366495 - DNA, 15 bp, Homo sapiens
agtggcccaacaggg

SEQ ID NO: 5366496 - DNA, 15 bp, Homo sapiens
agtggcccagaattg

SEQ ID NO: 5366497 - DNA, 16 bp, Homo sapiens
agtggccccacctggc

SEQ ID NO: 5366498 - DNA, 19 bp, Homo sapiens
agtggccccacctggccct

SEQ ID NO: 5366499 - DNA, 19 bp, Homo sapiens
agtggccccatccagcatg

SEQ ID NO: 5366500 - DNA, 15 bp, Homo sapiens
agtggcccccaccct

SEQ ID NO: 5366501 - DNA, 23 bp, Homo sapiens
agtggcccccgggcctgcacaga

SEQ ID NO: 5366502 - DNA, 16 bp, Homo sapiens
agtggcccctattgag

SEQ ID NO: 5366503 - DNA, 18 bp, Homo sapiens
agtggcccctcacctggg

SEQ ID NO: 5366504 - DNA, 20 bp, Homo sapiens
agtggcccctgcccccaaag

SEQ ID NO: 5366505 - DNA, 23 bp, Homo sapiens
agtggcccgcgtgattgtggcat

SEQ ID NO: 5366506 - DNA, 15 bp, Homo sapiens
agtggccctccctca

SEQ ID NO: 5366507 - DNA, 15 bp, Homo sapiens
agtggccctgatcca

SEQ ID NO: 5366508 - DNA, 17 bp, Homo sapiens
agtggccctgatccagg

SEQ ID NO: 5366509 - DNA, 21 bp, Homo sapiens
agtggccgcaagcgcagggag

SEQ ID NO: 5366510 - DNA, 22 bp, Homo sapiens
agtggccgcaagcgcagggagg

SEQ ID NO: 5366511 - DNA, 23 bp, Homo sapiens
agtggccgcaagcgcagggagga

SEQ ID NO: 5366512 - DNA, 16 bp, Homo sapiens
agtggccgggctgggg

SEQ ID NO: 5366513 - DNA, 17 bp, Homo sapiens
agtggccggggaagctg

SEQ ID NO: 5366514 - DNA, 20 bp, Homo sapiens
agtggccggggctgaagcca

SEQ ID NO: 5366515 - DNA, 18 bp, Homo sapiens
agtggcctacaaatcagt

SEQ ID NO: 5366516 - DNA, 22 bp, Homo sapiens
agtggcctacaaatcagtaatt

SEQ ID NO: 5366517 - DNA, 12 bp, Homo sapiens
agtggcctccct

SEQ ID NO: 5366518 - DNA, 17 bp, Homo sapiens
agtggcctccctgctgt

SEQ ID NO: 5366519 - DNA, 21 bp, Homo sapiens
agtggcctcgaactcctggca

SEQ ID NO: 5366520 - DNA, 23 bp, Homo sapiens
agtggcctcttgagttcctctgc

SEQ ID NO: 5366521 - DNA, 14 bp, Homo sapiens
agtggcctcttgga

SEQ ID NO: 5366522 - DNA, 15 bp, Homo sapiens
agtggcctctttgtc

SEQ ID NO: 5366523 - DNA, 19 bp, Homo sapiens
agtggcctgatctctgctc

SEQ ID NO: 5366524 - DNA, 23 bp, Homo sapiens
agtggcctgctaaggctcctcct

SEQ ID NO: 5366525 - DNA, 15 bp, Homo sapiens
agtggcctggatgca

SEQ ID NO: 5366526 - DNA, 12 bp, Homo sapiens
agtggcctggcc

SEQ ID NO: 5366527 - DNA, 20 bp, Homo sapiens
agtggcctggccaggagctc

SEQ ID NO: 5366528 - DNA, 22 bp, Homo sapiens
agtggcctggccaggagctctt

SEQ ID NO: 5366529 - DNA, 17 bp, Homo sapiens
agtggcctgggtcccag

SEQ ID NO: 5366530 - DNA, 12 bp, Homo sapiens
agtggcctgtga

SEQ ID NO: 5366531 - DNA, 20 bp, Homo sapiens
agtggccttacccctgcctt

SEQ ID NO: 5366532 - DNA, 19 bp, Homo sapiens
agtggccttgcttcttaga

SEQ ID NO: 5366533 - DNA, 15 bp, Homo sapiens
agtggcgagaggaga

SEQ ID NO: 5366534 - DNA, 16 bp, Homo sapiens
agtggcgagaggagag

SEQ ID NO: 5366535 - DNA, 18 bp, Homo sapiens
agtggcgagtccagacac

SEQ ID NO: 5366536 - DNA, 18 bp, Homo sapiens
agtggcgccatctcggct

SEQ ID NO: 5366537 - DNA, 20 bp, Homo sapiens
agtggcgcgatctcagctca

SEQ ID NO: 5366538 - DNA, 16 bp, Homo sapiens
agtggcgcgcgccacc

SEQ ID NO: 5366539 - DNA, 19 bp, Homo sapiens
agtggcggcacgtccttgg

SEQ ID NO: 5366540 - DNA, 15 bp, Homo sapiens
agtggcgggcccact

SEQ ID NO: 5366541 - DNA, 22 bp, Homo sapiens
agtggcgggcccactcagcccc

SEQ ID NO: 5366542 - DNA, 19 bp, Homo sapiens
agtggcgggtgatggccag

SEQ ID NO: 5366543 - DNA, 16 bp, Homo sapiens
agtggctaattcaatt

SEQ ID NO: 5366544 - DNA, 14 bp, Homo sapiens
agtggctcaacatt

SEQ ID NO: 5366545 - DNA, 14 bp, Homo sapiens
agtggctcacgcct

SEQ ID NO: 5366546 - DNA, 15 bp, Homo sapiens
agtggctcactggct

SEQ ID NO: 5366547 - DNA, 18 bp, Homo sapiens
agtggctcactggctggg

SEQ ID NO: 5366548 - DNA, 20 bp, Homo sapiens
agtggctcactggctgggag

SEQ ID NO: 5366549 - DNA, 21 bp, Homo sapiens
agtggctcactggctgggagt

SEQ ID NO: 5366550 - DNA, 17 bp, Homo sapiens
agtggctccccacctgg

SEQ ID NO: 5366551 - DNA, 21 bp, Homo sapiens
agtggctccccacctggacac

SEQ ID NO: 5366552 - DNA, 15 bp, Homo sapiens
agtggctcccctgcc

SEQ ID NO: 5366553 - DNA, 24 bp, Homo sapiens
agtggctcccctgcccagcctgct

SEQ ID NO: 5366554 - DNA, 21 bp, Homo sapiens
agtggctcctcccggtgccca

SEQ ID NO: 5366555 - DNA, 16 bp, Homo sapiens
agtggctcgccaggcc

SEQ ID NO: 5366556 - DNA, 14 bp, Homo sapiens
agtggctcttggga

SEQ ID NO: 5366557 - DNA, 18 bp, Homo sapiens
agtggctgacaagggact

SEQ ID NO: 5366558 - DNA, 21 bp, Homo sapiens
agtggctgaccaggccctgct

SEQ ID NO: 5366559 - DNA, 23 bp, Homo sapiens
agtggctgcctcatatagcactt

SEQ ID NO: 5366560 - DNA, 15 bp, Homo sapiens
agtggctgccttctt

SEQ ID NO: 5366561 - DNA, 14 bp, Homo sapiens
agtggctgctctgg

SEQ ID NO: 5366562 - DNA, 16 bp, Homo sapiens
agtggctgctctggga

SEQ ID NO: 5366563 - DNA, 13 bp, Homo sapiens
agtgggtgttgca

SEQ ID NO: 5366564 - DNA, 12 bp, Homo sapiens
agtgggtttttt

SEQ ID NO: 5366565 - DNA, 21 bp, Homo sapiens
agtgggttttttagttgaatt

SEQ ID NO: 5366566 - DNA, 23 bp, Homo sapiens
agtgggttttttagttgaatttt

SEQ ID NO: 5366567 - DNA, 13 bp, Homo sapiens
agtggtaaaaaag

SEQ ID NO: 5366568 - DNA, 17 bp, Homo sapiens
agtggtaaaaaagaaat

SEQ ID NO: 5366569 - DNA, 18 bp, Homo sapiens
agtggtaaaaaagaaatg

SEQ ID NO: 5366570 - DNA, 20 bp, Homo sapiens
agtggtaacaagaggagcag

SEQ ID NO: 5366571 - DNA, 16 bp, Homo sapiens
agtggtaagctctggc

SEQ ID NO: 5366572 - DNA, 17 bp, Homo sapiens
agtggtaatttttgtac

SEQ ID NO: 5366573 - DNA, 18 bp, Homo sapiens
agtggtaatttttgtaca

SEQ ID NO: 5366574 - DNA, 13 bp, Homo sapiens
agtggtaccagct

SEQ ID NO: 5366575 - DNA, 18 bp, Homo sapiens
agtggtaccagctcactc

SEQ ID NO: 5366576 - DNA, 16 bp, Homo sapiens
agtggtactctgtgtc

SEQ ID NO: 5366577 - DNA, 19 bp, Homo sapiens
agtggtagaggtgtgtgcc

SEQ ID NO: 5366578 - DNA, 16 bp, Homo sapiens
agtggtagctctggct

SEQ ID NO: 5366579 - DNA, 15 bp, Homo sapiens
agtggtagtatctcg

SEQ ID NO: 5366580 - DNA, 22 bp, Homo sapiens
agtggtagtatctcgtaatagc

SEQ ID NO: 5366581 - DNA, 15 bp, Homo sapiens
agtggtatagaaatg

SEQ ID NO: 5366582 - DNA, 18 bp, Homo sapiens
agtggtatagaaatgctg

SEQ ID NO: 5366583 - DNA, 20 bp, Homo sapiens
agtggtatatacaagtagat

SEQ ID NO: 5366584 - DNA, 17 bp, Homo sapiens
agtggtatggggctgag

SEQ ID NO: 5366585 - DNA, 15 bp, Homo sapiens
agtggtatgtctctt

SEQ ID NO: 5366586 - DNA, 16 bp, Homo sapiens
agtggtattttaacat

SEQ ID NO: 5366587 - DNA, 20 bp, Homo sapiens
agtggtattttccagcactt

SEQ ID NO: 5366588 - DNA, 12 bp, Homo sapiens
agtggtcaagga

SEQ ID NO: 5366589 - DNA, 18 bp, Homo sapiens
agtggtcaccttcctcag

SEQ ID NO: 5366590 - DNA, 17 bp, Homo sapiens
agtggtcactggtcagg

SEQ ID NO: 5366591 - DNA, 12 bp, Homo sapiens
agtggtcagcag

SEQ ID NO: 5366592 - DNA, 23 bp, Homo sapiens
agtggtcaggagttgtttctgac

SEQ ID NO: 5366593 - DNA, 15 bp, Homo sapiens
agtggtcataaaata

SEQ ID NO: 5366594 - DNA, 18 bp, Homo sapiens
agtggtcatgctcagcct

SEQ ID NO: 5366595 - DNA, 17 bp, Homo sapiens
agtggtccacatcccgg

SEQ ID NO: 5366596 - DNA, 19 bp, Homo sapiens
agtggtctcctctcagctt

SEQ ID NO: 5366597 - DNA, 13 bp, Homo sapiens
agtggtctctgct

SEQ ID NO: 5366598 - DNA, 16 bp, Homo sapiens
agtggtctctgctggg

SEQ ID NO: 5366599 - DNA, 14 bp, Homo sapiens
agtggtctgaactg

SEQ ID NO: 5366600 - DNA, 21 bp, Homo sapiens
agtggtctggaatggactggg

SEQ ID NO: 5366601 - DNA, 20 bp, Homo sapiens
agtggtcttatttttgggtg

SEQ ID NO: 5366602 - DNA, 18 bp, Homo sapiens
agtggtctttctggagag

SEQ ID NO: 5366603 - DNA, 13 bp, Homo sapiens
agtggtctttgta

SEQ ID NO: 5366604 - DNA, 14 bp, Homo sapiens
agtggtctttgtaa

SEQ ID NO: 5366605 - DNA, 17 bp, Homo sapiens
agtggtctttgtaagag

SEQ ID NO: 5366606 - DNA, 18 bp, Homo sapiens
agtggtctttgtaagagt

SEQ ID NO: 5366607 - DNA, 19 bp, Homo sapiens
agtggtctttgtaagagtg

SEQ ID NO: 5366608 - DNA, 21 bp, Homo sapiens
agtggtctttgtaagagtgta

SEQ ID NO: 5366609 - DNA, 21 bp, Homo sapiens
agtggtgaccaaaatttttag

SEQ ID NO: 5366610 - DNA, 14 bp, Homo sapiens
agtggtgagcaagc

SEQ ID NO: 5366611 - DNA, 18 bp, Homo sapiens
agtggtgagcatgtaagt

SEQ ID NO: 5366612 - DNA, 20 bp, Homo sapiens
agtggtgaggggccactggg

SEQ ID NO: 5366613 - DNA, 13 bp, Homo sapiens
agtggtgagtgga

SEQ ID NO: 5366614 - DNA, 16 bp, Homo sapiens
agtggtgagtggaagg

SEQ ID NO: 5366615 - DNA, 13 bp, Homo sapiens
agtggtgccctgg

SEQ ID NO: 5366616 - DNA, 21 bp, Homo sapiens
agtggtgcgatctcggctcag

SEQ ID NO: 5366617 - DNA, 17 bp, Homo sapiens
agtggtgcgatctgggt

SEQ ID NO: 5366618 - DNA, 22 bp, Homo sapiens
agtggtgcgtttataattggct

SEQ ID NO: 5366619 - DNA, 15 bp, Homo sapiens
agtggtgctcagttg

SEQ ID NO: 5366620 - DNA, 17 bp, Homo sapiens
agtggtgctcagttgta

SEQ ID NO: 5366621 - DNA, 15 bp, Homo sapiens
agtggtgcttagaaa

SEQ ID NO: 5366622 - DNA, 13 bp, Homo sapiens
agtggtggcaggg

SEQ ID NO: 5366623 - DNA, 14 bp, Homo sapiens
agtggtgggggaag

SEQ ID NO: 5366624 - DNA, 13 bp, Homo sapiens
agtggtgggtaat

SEQ ID NO: 5366625 - DNA, 14 bp, Homo sapiens
agtggtgggtaatt

SEQ ID NO: 5366626 - DNA, 20 bp, Homo sapiens
agtggtgggtaattgtacaa

SEQ ID NO: 5366627 - DNA, 19 bp, Homo sapiens
agtggtggtaaccctggtg

SEQ ID NO: 5366628 - DNA, 19 bp, Homo sapiens
agtggtggtagaaatgatt

SEQ ID NO: 5366629 - DNA, 19 bp, Homo sapiens
agtggtggtatgtaatgga

SEQ ID NO: 5366630 - DNA, 21 bp, Homo sapiens
agtggtggtgaacagaacaaa

SEQ ID NO: 5366631 - DNA, 20 bp, Homo sapiens
agtggtggttttctgttctt

SEQ ID NO: 5366632 - DNA, 23 bp, Homo sapiens
agtggtggttttctgttctttct

SEQ ID NO: 5366633 - DNA, 16 bp, Homo sapiens
agtggtgttacatttt

SEQ ID NO: 5366634 - DNA, 17 bp, Homo sapiens
agtggtgttacattttc

SEQ ID NO: 5366635 - DNA, 20 bp, Homo sapiens
agtggttaagaatgtatatc

SEQ ID NO: 5366636 - DNA, 15 bp, Homo sapiens
agtggttaattacct

SEQ ID NO: 5366637 - DNA, 16 bp, Homo sapiens
agtggttactttgtgt

SEQ ID NO: 5366638 - DNA, 17 bp, Homo sapiens
agtggttaggcagcaag

SEQ ID NO: 5366639 - DNA, 17 bp, Homo sapiens
agtggttcagtctagaa

SEQ ID NO: 5366640 - DNA, 13 bp, Homo sapiens
agtggttctcatt

SEQ ID NO: 5366641 - DNA, 16 bp, Homo sapiens
agtggttctctgcctt

SEQ ID NO: 5366642 - DNA, 14 bp, Homo sapiens
agtggttgaatatg

SEQ ID NO: 5366643 - DNA, 14 bp, Homo sapiens
agtggttgcctggg

SEQ ID NO: 5366644 - DNA, 17 bp, Homo sapiens
agtggttgggctgtgcc

SEQ ID NO: 5366645 - DNA, 18 bp, Homo sapiens
agtggttgggctgtgcct

SEQ ID NO: 5366646 - DNA, 20 bp, Homo sapiens
agtggttgggctgtgcctgg

SEQ ID NO: 5366647 - DNA, 19 bp, Homo sapiens
agtggttgttagttataga

SEQ ID NO: 5366648 - DNA, 15 bp, Homo sapiens
agtggttgttttttc

SEQ ID NO: 5366649 - DNA, 16 bp, Homo sapiens
agtggtttctacttcc

SEQ ID NO: 5366650 - DNA, 19 bp, Homo sapiens
agtggtttctacttcccct

SEQ ID NO: 5366651 - DNA, 20 bp, Homo sapiens
agtggtttctatgagcatct

SEQ ID NO: 5366652 - DNA, 18 bp, Homo sapiens
agtggtttgcaggtcagc

SEQ ID NO: 5366653 - DNA, 18 bp, Homo sapiens
agtggttttaggatactt

SEQ ID NO: 5366654 - DNA, 21 bp, Homo sapiens
agtggttttaggatacttaac

SEQ ID NO: 5366655 - DNA, 17 bp, Homo sapiens
agtggttttatactgaa

SEQ ID NO: 5366656 - DNA, 20 bp, Homo sapiens
agtggttttatactgaagga

SEQ ID NO: 5366657 - DNA, 16 bp, Homo sapiens
agtggttttcttcagg

SEQ ID NO: 5366658 - DNA, 13 bp, Homo sapiens
agtgtaaaaatga

SEQ ID NO: 5366659 - DNA, 15 bp, Homo sapiens
agtgtaaaaatgaga

SEQ ID NO: 5366660 - DNA, 17 bp, Homo sapiens
agtgtaaaaatgagaac

SEQ ID NO: 5366661 - DNA, 16 bp, Homo sapiens
agtgtaaaaattcaga

SEQ ID NO: 5366662 - DNA, 13 bp, Homo sapiens
agtgtaaaataag

SEQ ID NO: 5366663 - DNA, 14 bp, Homo sapiens
agtgtaaaatattt

SEQ ID NO: 5366664 - DNA, 19 bp, Homo sapiens
agtgtaaaatgtatatttt

SEQ ID NO: 5366665 - DNA, 12 bp, Homo sapiens
agtgtaaaattg

SEQ ID NO: 5366666 - DNA, 13 bp, Homo sapiens
agtgtaaatgaag

SEQ ID NO: 5366667 - DNA, 16 bp, Homo sapiens
agtgtaacaagaaagg

SEQ ID NO: 5366668 - DNA, 15 bp, Homo sapiens
agtgtaacaattgtg

SEQ ID NO: 5366669 - DNA, 14 bp, Homo sapiens
agtgtaacactgca

SEQ ID NO: 5366670 - DNA, 19 bp, Homo sapiens
agtgtaacactgcaagaag

SEQ ID NO: 5366671 - DNA, 18 bp, Homo sapiens
agtgtaacagatatcagt

SEQ ID NO: 5366672 - DNA, 14 bp, Homo sapiens
agtgtaacctcagt

SEQ ID NO: 5366673 - DNA, 15 bp, Homo sapiens
agtgtaactggctgc

SEQ ID NO: 5366674 - DNA, 20 bp, Homo sapiens
agtgtaactggctgctccct

SEQ ID NO: 5366675 - DNA, 15 bp, Homo sapiens
agtgtaagaactgta

SEQ ID NO: 5366676 - DNA, 16 bp, Homo sapiens
agtgtaagaactgtac

SEQ ID NO: 5366677 - DNA, 17 bp, Homo sapiens
agtgtaagaactgtaca

SEQ ID NO: 5366678 - DNA, 14 bp, Homo sapiens
agtgtaaggcatag

SEQ ID NO: 5366679 - DNA, 21 bp, Homo sapiens
agtgtaaggcatagggaatat

SEQ ID NO: 5366680 - DNA, 16 bp, Homo sapiens
agtgtaataatgttat

SEQ ID NO: 5366681 - DNA, 16 bp, Homo sapiens
agtgtaatgaatacct

SEQ ID NO: 5366682 - DNA, 22 bp, Homo sapiens
agtgtaatgaataccttagtgc

SEQ ID NO: 5366683 - DNA, 20 bp, Homo sapiens
agtgtaattagcttttggag

SEQ ID NO: 5366684 - DNA, 20 bp, Homo sapiens
agtgtaatttctttgcctgt

SEQ ID NO: 5366685 - DNA, 21 bp, Homo sapiens
agtgtaatttctttgcctgtt

SEQ ID NO: 5366686 - DNA, 15 bp, Homo sapiens
agtgtacaagttgct

SEQ ID NO: 5366687 - DNA, 17 bp, Homo sapiens
agtgtacaagttgcttt

SEQ ID NO: 5366688 - DNA, 18 bp, Homo sapiens
agtgtacaagttgctttg

SEQ ID NO: 5366689 - DNA, 20 bp, Homo sapiens
agtgtacaattttcatccca

SEQ ID NO: 5366690 - DNA, 17 bp, Homo sapiens
agtgtacacgtctggac

SEQ ID NO: 5366691 - DNA, 13 bp, Homo sapiens
agtgtacagaaga

SEQ ID NO: 5366692 - DNA, 17 bp, Homo sapiens
agtgtacagaagaattt

SEQ ID NO: 5366693 - DNA, 15 bp, Homo sapiens
agtgtacagtcttgt

SEQ ID NO: 5366694 - DNA, 16 bp, Homo sapiens
agtgtacagtcttgta

SEQ ID NO: 5366695 - DNA, 17 bp, Homo sapiens
agtgtacagtcttgtat

SEQ ID NO: 5366696 - DNA, 16 bp, Homo sapiens
agtgtacatagtgtaa

SEQ ID NO: 5366697 - DNA, 18 bp, Homo sapiens
agtgtacatatgtaaaat

SEQ ID NO: 5366698 - DNA, 16 bp, Homo sapiens
agtgtacatgaagaat

SEQ ID NO: 5366699 - DNA, 21 bp, Homo sapiens
agtgtacatggaataacatgt

SEQ ID NO: 5366700 - DNA, 19 bp, Homo sapiens
agtgtacatgtacatagta

SEQ ID NO: 5366701 - DNA, 18 bp, Homo sapiens
agtgtacatttatgttcc

SEQ ID NO: 5366702 - DNA, 15 bp, Homo sapiens
agtgtacattttata

SEQ ID NO: 5366703 - DNA, 15 bp, Homo sapiens
agtgtaccaagtgct

SEQ ID NO: 5366704 - DNA, 16 bp, Homo sapiens
agtgtaccaagtgctt

SEQ ID NO: 5366705 - DNA, 18 bp, Homo sapiens
agtgtaccaagtgcttcc

SEQ ID NO: 5366706 - DNA, 19 bp, Homo sapiens
agtgtaccaagtgcttcct

SEQ ID NO: 5366707 - DNA, 13 bp, Homo sapiens
agtgtaccataat

SEQ ID NO: 5366708 - DNA, 18 bp, Homo sapiens
agtgtaccattaaaatat

SEQ ID NO: 5366709 - DNA, 23 bp, Homo sapiens
agtgtacccacgctgggtattac

SEQ ID NO: 5366710 - DNA, 20 bp, Homo sapiens
agtgtacccccgcccaggct

SEQ ID NO: 5366711 - DNA, 15 bp, Homo sapiens
agtgtacctcctctc

SEQ ID NO: 5366712 - DNA, 21 bp, Homo sapiens
agtgtacctgtaaatgtcctg

SEQ ID NO: 5366713 - DNA, 20 bp, Homo sapiens
agtgtacctgtgtacataac

SEQ ID NO: 5366714 - DNA, 16 bp, Homo sapiens
agtgtactaattaaca

SEQ ID NO: 5366715 - DNA, 15 bp, Homo sapiens
agtgtactcccaggg

SEQ ID NO: 5366716 - DNA, 14 bp, Homo sapiens
agtgtactgctttc

SEQ ID NO: 5366717 - DNA, 16 bp, Homo sapiens
agtgtactgctttcaa

SEQ ID NO: 5366718 - DNA, 22 bp, Homo sapiens
agtgtagaaaagaactggaaac

SEQ ID NO: 5366719 - DNA, 14 bp, Homo sapiens
agtgtagaagaaaa

SEQ ID NO: 5366720 - DNA, 17 bp, Homo sapiens
agtgtagaagaaaatat

SEQ ID NO: 5366721 - DNA, 20 bp, Homo sapiens
agtgtagaagcattccttct

SEQ ID NO: 5366722 - DNA, 22 bp, Homo sapiens
agtgtagaagcattccttcttt

SEQ ID NO: 5366723 - DNA, 22 bp, Homo sapiens
agtgtagactggccatgcaagt

SEQ ID NO: 5366724 - DNA, 15 bp, Homo sapiens
agtgtagatcagagc

SEQ ID NO: 5366725 - DNA, 23 bp, Homo sapiens
agtgtagatcagagcagcagtga

SEQ ID NO: 5366726 - DNA, 18 bp, Homo sapiens
agtgtagatgtagcattg

SEQ ID NO: 5366727 - DNA, 20 bp, Homo sapiens
agtgtagatgtagcattgtt

SEQ ID NO: 5366728 - DNA, 19 bp, Homo sapiens
agtgtagatttgttttgtg

SEQ ID NO: 5366729 - DNA, 21 bp, Homo sapiens
agtgtagcatcttcctctgca

SEQ ID NO: 5366730 - DNA, 15 bp, Homo sapiens
agtgtagccaggtcc

SEQ ID NO: 5366731 - DNA, 17 bp, Homo sapiens
agtgtagccaggtcccc

SEQ ID NO: 5366732 - DNA, 18 bp, Homo sapiens
agtgtagcccacacttga

SEQ ID NO: 5366733 - DNA, 23 bp, Homo sapiens
agtgtagcccacacttgagagga

SEQ ID NO: 5366734 - DNA, 21 bp, Homo sapiens
agtgtagccccaagaaggctg

SEQ ID NO: 5366735 - DNA, 22 bp, Homo sapiens
agtgtagcctaaagggcagggc

SEQ ID NO: 5366736 - DNA, 18 bp, Homo sapiens
agtgtagccttgcccgga

SEQ ID NO: 5366737 - DNA, 16 bp, Homo sapiens
agtgtagcgggaggaa

SEQ ID NO: 5366738 - DNA, 19 bp, Homo sapiens
agtgtagcgggaggaagcc

SEQ ID NO: 5366739 - DNA, 23 bp, Homo sapiens
agtgtagctgtaagggcagtgcc

SEQ ID NO: 5366740 - DNA, 15 bp, Homo sapiens
agtgtagctgtgaaa

SEQ ID NO: 5366741 - DNA, 20 bp, Homo sapiens
agtgttcttaggtttactgt

SEQ ID NO: 5366742 - DNA, 21 bp, Homo sapiens
agtgttcttcagtgtaatgtg

SEQ ID NO: 5366743 - DNA, 13 bp, Homo sapiens
agtgttgaagaag

SEQ ID NO: 5366744 - DNA, 23 bp, Homo sapiens
agtgttgaagaagagtttgcaaa

SEQ ID NO: 5366745 - DNA, 12 bp, Homo sapiens
agtgttgaaggg

SEQ ID NO: 5366746 - DNA, 19 bp, Homo sapiens
agtgttgaagggaggtggc

SEQ ID NO: 5366747 - DNA, 15 bp, Homo sapiens
agtgttgacatagcc

SEQ ID NO: 5366748 - DNA, 17 bp, Homo sapiens
agtgttgacatagcctt

SEQ ID NO: 5366749 - DNA, 18 bp, Homo sapiens
agtgttgacatagccttt

SEQ ID NO: 5366750 - DNA, 19 bp, Homo sapiens
agtgttgacatagcctttg

SEQ ID NO: 5366751 - DNA, 16 bp, Homo sapiens
agtgttgactttttaa

SEQ ID NO: 5366752 - DNA, 19 bp, Homo sapiens
agtgttgagacccaggcct

SEQ ID NO: 5366753 - DNA, 21 bp, Homo sapiens
agtgttgattgccaaattgac

SEQ ID NO: 5366754 - DNA, 19 bp, Homo sapiens
agtgttgcatatgagcctg

SEQ ID NO: 5366755 - DNA, 20 bp, Homo sapiens
agtgttgcctcttgcaatgc

SEQ ID NO: 5366756 - DNA, 15 bp, Homo sapiens
agtgttgctcagctc

SEQ ID NO: 5366757 - DNA, 12 bp, Homo sapiens
agtgttgctgat

SEQ ID NO: 5366758 - DNA, 18 bp, Homo sapiens
agtgttggagaagaactg

SEQ ID NO: 5366759 - DNA, 23 bp, Homo sapiens
agtgttggcaaacgagactttct

SEQ ID NO: 5366760 - DNA, 24 bp, Homo sapiens
agtgttggccatcatttcattcgt

SEQ ID NO: 5366761 - DNA, 19 bp, Homo sapiens
agtgttggctgtgtgacag

SEQ ID NO: 5366762 - DNA, 14 bp, Homo sapiens
agtgttgggtggag

SEQ ID NO: 5366763 - DNA, 20 bp, Homo sapiens
agtgttgggtggaggatgga

SEQ ID NO: 5366764 - DNA, 21 bp, Homo sapiens
agtgttggtatattttatatt

SEQ ID NO: 5366765 - DNA, 22 bp, Homo sapiens
agtgttggtctttctaatgtag

SEQ ID NO: 5366766 - DNA, 16 bp, Homo sapiens
agtgttgtatttctat

SEQ ID NO: 5366767 - DNA, 21 bp, Homo sapiens
agtgttgtatttctatacagt

SEQ ID NO: 5366768 - DNA, 11 bp, Homo sapiens
agtgttgtcca

SEQ ID NO: 5366769 - DNA, 18 bp, Homo sapiens
agtgttgtcttattccta

SEQ ID NO: 5366770 - DNA, 23 bp, Homo sapiens
agtgttgtcttattcctaattcc

SEQ ID NO: 5366771 - DNA, 14 bp, Homo sapiens
agtgttgtgcccct

SEQ ID NO: 5366772 - DNA, 19 bp, Homo sapiens
agtgttgtggatttaacag

SEQ ID NO: 5366773 - DNA, 16 bp, Homo sapiens
agtgttgtgttcctgg

SEQ ID NO: 5366774 - DNA, 18 bp, Homo sapiens
agtgttgtgttcctggct

SEQ ID NO: 5366775 - DNA, 23 bp, Homo sapiens
agtgttgtgttcctggctgatga

SEQ ID NO: 5366776 - DNA, 13 bp, Homo sapiens
agtgttgtttgta

SEQ ID NO: 5366777 - DNA, 14 bp, Homo sapiens
agtgttgtttgtaa

SEQ ID NO: 5366778 - DNA, 20 bp, Homo sapiens
agtgttgtttgtaaataaga

SEQ ID NO: 5366779 - DNA, 21 bp, Homo sapiens
agtgttgtttgtaaataagag

SEQ ID NO: 5366780 - DNA, 22 bp, Homo sapiens
agtgttgtttgtaaataagaga

SEQ ID NO: 5366781 - DNA, 15 bp, Homo sapiens
agtgtttaaaacttc

SEQ ID NO: 5366782 - DNA, 23 bp, Homo sapiens
agtgtttaaaagcaaatactgat

SEQ ID NO: 5366783 - DNA, 22 bp, Homo sapiens
agtgtttaaaaggctaagaata

SEQ ID NO: 5366784 - DNA, 12 bp, Homo sapiens
agtgtttaaatg

SEQ ID NO: 5366785 - DNA, 15 bp, Homo sapiens
agtgtttaaatgctg

SEQ ID NO: 5366786 - DNA, 20 bp, Homo sapiens
agtgtttaaatgctgtgtac

SEQ ID NO: 5366787 - DNA, 15 bp, Homo sapiens
agtgtttaactggca

SEQ ID NO: 5366788 - DNA, 17 bp, Homo sapiens
agtgtttaagtcatttt

SEQ ID NO: 5366789 - DNA, 21 bp, Homo sapiens
agtgtttaatgtaaagtttgt

SEQ ID NO: 5366790 - DNA, 18 bp, Homo sapiens
agtgtttaattgtataaa

SEQ ID NO: 5366791 - DNA, 19 bp, Homo sapiens
agtgtttaattgtataaaa

SEQ ID NO: 5366792 - DNA, 20 bp, Homo sapiens
agtgtttagaagagcctgac

SEQ ID NO: 5366793 - DNA, 17 bp, Homo sapiens
agtgtttagcattaaaa

SEQ ID NO: 5366794 - DNA, 18 bp, Homo sapiens
agtgtttatcctttcata

SEQ ID NO: 5366795 - DNA, 19 bp, Homo sapiens
agtgtttatgacaaattta

SEQ ID NO: 5366796 - DNA, 16 bp, Homo sapiens
agtgtttatgtgctat

SEQ ID NO: 5366797 - DNA, 12 bp, Homo sapiens
agtgtttcaatt

SEQ ID NO: 5366798 - DNA, 20 bp, Homo sapiens
agtgtttcaattctgtaatt

SEQ ID NO: 5366799 - DNA, 23 bp, Homo sapiens
agtgtttcaattctgtaattaca

SEQ ID NO: 5366800 - DNA, 20 bp, Homo sapiens
agtgtttcacagtgtctgta

SEQ ID NO: 5366801 - DNA, 16 bp, Homo sapiens
agtgtttcagattttt

SEQ ID NO: 5366802 - DNA, 13 bp, Homo sapiens
agtgtttcagcta

SEQ ID NO: 5366803 - DNA, 18 bp, Homo sapiens
agtgtttcagctaaggga

SEQ ID NO: 5366804 - DNA, 15 bp, Homo sapiens
agtgtttccacactt

SEQ ID NO: 5366805 - DNA, 18 bp, Homo sapiens
agtgtttccagtgacaca

SEQ ID NO: 5366806 - DNA, 15 bp, Homo sapiens
agtgtttcccataat

SEQ ID NO: 5366807 - DNA, 16 bp, Homo sapiens
agtgtttcgtcatgtt

SEQ ID NO: 5366808 - DNA, 17 bp, Homo sapiens
agtgtttcgttaagcag

SEQ ID NO: 5366809 - DNA, 22 bp, Homo sapiens
agtgtttcgttaagcagtacat

SEQ ID NO: 5366810 - DNA, 22 bp, Homo sapiens
agtgtttctagtaacagtattt

SEQ ID NO: 5366811 - DNA, 18 bp, Homo sapiens
agtgtttctgaatgtttg

SEQ ID NO: 5366812 - DNA, 19 bp, Homo sapiens
agtgtttctgaatgtttgt

SEQ ID NO: 5366813 - DNA, 23 bp, Homo sapiens
agtgtttctgaatgtttgtgtct

SEQ ID NO: 5366814 - DNA, 14 bp, Homo sapiens
agtgtttctgcaga

SEQ ID NO: 5366815 - DNA, 15 bp, Homo sapiens
agtgtttctgcagag

SEQ ID NO: 5366816 - DNA, 15 bp, Homo sapiens
agtgtttctgtgcat

SEQ ID NO: 5366817 - DNA, 12 bp, Homo sapiens
agtgtttctgtt

SEQ ID NO: 5366818 - DNA, 13 bp, Homo sapiens
agtgtttctgtta

SEQ ID NO: 5366819 - DNA, 14 bp, Homo sapiens
agtgtttctgttat

SEQ ID NO: 5366820 - DNA, 15 bp, Homo sapiens
agtgtttctgttatt

SEQ ID NO: 5366821 - DNA, 21 bp, Homo sapiens
agtgtttctgttattaacaaa

SEQ ID NO: 5366822 - DNA, 15 bp, Homo sapiens
agtgtttctgttctg

SEQ ID NO: 5366823 - DNA, 15 bp, Homo sapiens
agtgtttctttttat

SEQ ID NO: 5366824 - DNA, 20 bp, Homo sapiens
agtgtttgaaaacgtttcaa

SEQ ID NO: 5366825 - DNA, 13 bp, Homo sapiens
agtgtttgctgca

SEQ ID NO: 5366826 - DNA, 12 bp, Homo sapiens
agtgtttggaat

SEQ ID NO: 5366827 - DNA, 23 bp, Homo sapiens
agtgtttgggggacgtttctcat

SEQ ID NO: 5366828 - DNA, 21 bp, Homo sapiens
agtgtttgggtatattcattt

SEQ ID NO: 5366829 - DNA, 15 bp, Homo sapiens
agtgtttgtgtctga

SEQ ID NO: 5366830 - DNA, 16 bp, Homo sapiens
agtgtttgtgtctgac

SEQ ID NO: 5366831 - DNA, 19 bp, Homo sapiens
agtgtttgtgtctgactca

SEQ ID NO: 5366832 - DNA, 17 bp, Homo sapiens
agtgttttaaattctga

SEQ ID NO: 5366833 - DNA, 18 bp, Homo sapiens
agtgttttaaattctgag

SEQ ID NO: 5366834 - DNA, 22 bp, Homo sapiens
agtgttttacaatgatttgtaa

SEQ ID NO: 5366835 - DNA, 18 bp, Homo sapiens
agtgttttatgagaaagc

SEQ ID NO: 5366836 - DNA, 21 bp, Homo sapiens
agtgttttatgagaaagcctt

SEQ ID NO: 5366837 - DNA, 22 bp, Homo sapiens
agtgttttattattatcgcttt

SEQ ID NO: 5366838 - DNA, 22 bp, Homo sapiens
agtgttttattttcaaatctgg

SEQ ID NO: 5366839 - DNA, 16 bp, Homo sapiens
agtgttttcaatttta

SEQ ID NO: 5366840 - DNA, 12 bp, Homo sapiens
agtgttttcaga

SEQ ID NO: 5366841 - DNA, 18 bp, Homo sapiens
agtgttttcatattgctt

SEQ ID NO: 5366842 - DNA, 21 bp, Homo sapiens
agtgttttcatattgcttctc

SEQ ID NO: 5366843 - DNA, 13 bp, Homo sapiens
agtgttttcattc

SEQ ID NO: 5366844 - DNA, 17 bp, Homo sapiens
agtgttttcattctggt

SEQ ID NO: 5366845 - DNA, 17 bp, Homo sapiens
agtgttttcattttaga

SEQ ID NO: 5366846 - DNA, 14 bp, Homo sapiens
agtgttttctctga

SEQ ID NO: 5366847 - DNA, 15 bp, Homo sapiens
agtgttttctctgaa

SEQ ID NO: 5366848 - DNA, 17 bp, Homo sapiens
agtgttttctttgagga

SEQ ID NO: 5366849 - DNA, 18 bp, Homo sapiens
agtgttttggaataaaat

SEQ ID NO: 5366850 - DNA, 14 bp, Homo sapiens
agtgttttggactc

SEQ ID NO: 5366851 - DNA, 20 bp, Homo sapiens
agtgttttggactccatctc

SEQ ID NO: 5366852 - DNA, 22 bp, Homo sapiens
agtgttttggactccatctctc

SEQ ID NO: 5366853 - DNA, 17 bp, Homo sapiens
agtgttttggagaaaaa

SEQ ID NO: 5366854 - DNA, 16 bp, Homo sapiens
agtgttttgtaccagt

SEQ ID NO: 5366855 - DNA, 17 bp, Homo sapiens
agtgttttgtacttgtt

SEQ ID NO: 5366856 - DNA, 18 bp, Homo sapiens
agtgttttgttttttaat

SEQ ID NO: 5366857 - DNA, 21 bp, Homo sapiens
agtgtttttacctctgtcttg

SEQ ID NO: 5366858 - DNA, 12 bp, Homo sapiens
agtgtttttcct

SEQ ID NO: 5366859 - DNA, 21 bp, Homo sapiens
agtgtttttgaaacccacagt

SEQ ID NO: 5366860 - DNA, 14 bp, Homo sapiens
agtgtttttgtaaa

SEQ ID NO: 5366861 - DNA, 20 bp, Homo sapiens
agtgtttttgtaaagtgtgg

SEQ ID NO: 5366862 - DNA, 16 bp, Homo sapiens
agtgtttttgtgaatt

SEQ ID NO: 5366863 - DNA, 17 bp, Homo sapiens
agtgtttttttccctct

SEQ ID NO: 5366864 - DNA, 13 bp, Homo sapiens
agttaaaaaaaaa

SEQ ID NO: 5366865 - DNA, 22 bp, Homo sapiens
agttaaaaaaaaaaaaaggaaa

SEQ ID NO: 5366866 - DNA, 23 bp, Homo sapiens
agttaaaaaaaaaaaaaggaaaa

SEQ ID NO: 5366867 - DNA, 16 bp, Homo sapiens
agttaaaaaaaataat

SEQ ID NO: 5366868 - DNA, 19 bp, Homo sapiens
agttaaaaaaaataataaa

SEQ ID NO: 5366869 - DNA, 13 bp, Homo sapiens
agttaaaaattaa

SEQ ID NO: 5366870 - DNA, 13 bp, Homo sapiens
agttaaaagcatt

SEQ ID NO: 5366871 - DNA, 12 bp, Homo sapiens
agttaaaagtaa

SEQ ID NO: 5366872 - DNA, 18 bp, Homo sapiens
agttaaaatcacatttta

SEQ ID NO: 5366873 - DNA, 22 bp, Homo sapiens
agttaaaatcacattttaagtg

SEQ ID NO: 5366874 - DNA, 12 bp, Homo sapiens
agttaaaattga

SEQ ID NO: 5366875 - DNA, 20 bp, Homo sapiens
agttaaaattgttatcaaaa

SEQ ID NO: 5366876 - DNA, 22 bp, Homo sapiens
agttaaactaaaaaaaaaaagg

SEQ ID NO: 5366877 - DNA, 22 bp, Homo sapiens
agttaaactgagagtaattcat

SEQ ID NO: 5366878 - DNA, 20 bp, Homo sapiens
agttaaactggcttaactta

SEQ ID NO: 5366879 - DNA, 14 bp, Homo sapiens
agttaaactgtgaa

SEQ ID NO: 5366880 - DNA, 17 bp, Homo sapiens
agttaaagagacaaata

SEQ ID NO: 5366881 - DNA, 22 bp, Homo sapiens
agttaaagagaggccccggctg

SEQ ID NO: 5366882 - DNA, 23 bp, Homo sapiens
agttaaagagcagcctggctaac

SEQ ID NO: 5366883 - DNA, 16 bp, Homo sapiens
agttaaagcatatgct

SEQ ID NO: 5366884 - DNA, 18 bp, Homo sapiens
agttaaaggcagtccaga

SEQ ID NO: 5366885 - DNA, 18 bp, Homo sapiens
agttaaagggaagaaaac

SEQ ID NO: 5366886 - DNA, 18 bp, Homo sapiens
agttaaaggtacttttgt

SEQ ID NO: 5366887 - DNA, 16 bp, Homo sapiens
agttaaataactgtgt

SEQ ID NO: 5366888 - DNA, 18 bp, Homo sapiens
agttaaatagctatattt

SEQ ID NO: 5366889 - DNA, 15 bp, Homo sapiens
agttaaatatgattt

SEQ ID NO: 5366890 - DNA, 19 bp, Homo sapiens
agttaaatatgatttgcat

SEQ ID NO: 5366891 - DNA, 20 bp, Homo sapiens
agttaaatcattttcattaa

SEQ ID NO: 5366892 - DNA, 14 bp, Homo sapiens
agttaaatgtatca

SEQ ID NO: 5366893 - DNA, 22 bp, Homo sapiens
agttaaattgcacgtgcaatac

SEQ ID NO: 5366894 - DNA, 23 bp, Homo sapiens
agttaacaaggaatgcctgtgcc

SEQ ID NO: 5366895 - DNA, 20 bp, Homo sapiens
agttaacacaatgtgaattt

SEQ ID NO: 5366896 - DNA, 17 bp, Homo sapiens
agttaacatctgaagtg

SEQ ID NO: 5366897 - DNA, 18 bp, Homo sapiens
agttaacgtattagttgc

SEQ ID NO: 5366898 - DNA, 23 bp, Homo sapiens
agttaacgtcacccaaaagcaca

SEQ ID NO: 5366899 - DNA, 12 bp, Homo sapiens
agttaactgaat

SEQ ID NO: 5366900 - DNA, 16 bp, Homo sapiens
agttaacttgaagaaa

SEQ ID NO: 5366901 - DNA, 18 bp, Homo sapiens
agttaacttgaagaaacc

SEQ ID NO: 5366902 - DNA, 14 bp, Homo sapiens
agttaacttggaaa

SEQ ID NO: 5366903 - DNA, 18 bp, Homo sapiens
agttaactttaagactga

SEQ ID NO: 5366904 - DNA, 20 bp, Homo sapiens
agttaagaaaaaaataattt

SEQ ID NO: 5366905 - DNA, 13 bp, Homo sapiens
agttaagaactat

SEQ ID NO: 5366906 - DNA, 20 bp, Homo sapiens
agttaagaagctgttgtaca

SEQ ID NO: 5366907 - DNA, 22 bp, Homo sapiens
agttaagaagctgttgtacatt

SEQ ID NO: 5366908 - DNA, 15 bp, Homo sapiens
agttaagacaacagg

SEQ ID NO: 5366909 - DNA, 18 bp, Homo sapiens
agttaagacaacaggcat

SEQ ID NO: 5366910 - DNA, 19 bp, Homo sapiens
agttaagacatgatttcct

SEQ ID NO: 5366911 - DNA, 16 bp, Homo sapiens
agttaagacctggcag

SEQ ID NO: 5366912 - DNA, 17 bp, Homo sapiens
agttaagagaaacttta

SEQ ID NO: 5366913 - DNA, 22 bp, Homo sapiens
agttaagagaaactttatacat

SEQ ID NO: 5366914 - DNA, 19 bp, Homo sapiens
agttaagatgtctgagaga

SEQ ID NO: 5366915 - DNA, 22 bp, Homo sapiens
agttaagcaaatagattaatga

SEQ ID NO: 5366916 - DNA, 16 bp, Homo sapiens
agttaaggaaagaaag

SEQ ID NO: 5366917 - DNA, 22 bp, Homo sapiens
agttatataaagagaaaattga

SEQ ID NO: 5366918 - DNA, 20 bp, Homo sapiens
agttatatagataaagagat

SEQ ID NO: 5366919 - DNA, 15 bp, Homo sapiens
agttatatatatgtg

SEQ ID NO: 5366920 - DNA, 20 bp, Homo sapiens
agttatatcaagcttaatat

SEQ ID NO: 5366921 - DNA, 22 bp, Homo sapiens
agttatatgactaatataactt

SEQ ID NO: 5366922 - DNA, 23 bp, Homo sapiens
agttatatgacttcttgttcatg

SEQ ID NO: 5366923 - DNA, 14 bp, Homo sapiens
agttatatgtgtgt

SEQ ID NO: 5366924 - DNA, 13 bp, Homo sapiens
agttatattcact

SEQ ID NO: 5366925 - DNA, 15 bp, Homo sapiens
agttatattctttaa

SEQ ID NO: 5366926 - DNA, 15 bp, Homo sapiens
agttatattgaatat

SEQ ID NO: 5366927 - DNA, 19 bp, Homo sapiens
agttatattggaattataa

SEQ ID NO: 5366928 - DNA, 14 bp, Homo sapiens
agttatatttccta

SEQ ID NO: 5366929 - DNA, 14 bp, Homo sapiens
agttatatttgtct

SEQ ID NO: 5366930 - DNA, 22 bp, Homo sapiens
agttatattttctattacacaa

SEQ ID NO: 5366931 - DNA, 14 bp, Homo sapiens
agttatattttgca

SEQ ID NO: 5366932 - DNA, 15 bp, Homo sapiens
agttatattttgctg

SEQ ID NO: 5366933 - DNA, 23 bp, Homo sapiens
agttatattttgctgtttatgat

SEQ ID NO: 5366934 - DNA, 16 bp, Homo sapiens
agttatcaaaaagtat

SEQ ID NO: 5366935 - DNA, 19 bp, Homo sapiens
agttatcagctctatgtca

SEQ ID NO: 5366936 - DNA, 14 bp, Homo sapiens
agttatcaggtgca

SEQ ID NO: 5366937 - DNA, 19 bp, Homo sapiens
agttatcatctcaccacac

SEQ ID NO: 5366938 - DNA, 18 bp, Homo sapiens
agttatcatgaattttaa

SEQ ID NO: 5366939 - DNA, 22 bp, Homo sapiens
agttatcatgaattttaaagta

SEQ ID NO: 5366940 - DNA, 14 bp, Homo sapiens
agttatcatgttag

SEQ ID NO: 5366941 - DNA, 14 bp, Homo sapiens
agttatcctgcaag

SEQ ID NO: 5366942 - DNA, 17 bp, Homo sapiens
agttatctaagaataca

SEQ ID NO: 5366943 - DNA, 14 bp, Homo sapiens
agttatctattgaa

SEQ ID NO: 5366944 - DNA, 15 bp, Homo sapiens
agttatcttaaatat

SEQ ID NO: 5366945 - DNA, 18 bp, Homo sapiens
agttatcttaaatatgaa

SEQ ID NO: 5366946 - DNA, 13 bp, Homo sapiens
agttatcttcttt

SEQ ID NO: 5366947 - DNA, 12 bp, Homo sapiens
agttatgaatca

SEQ ID NO: 5366948 - DNA, 16 bp, Homo sapiens
agttatgactgtgaaa

SEQ ID NO: 5366949 - DNA, 21 bp, Homo sapiens
agttatgataaccaagaatgt

SEQ ID NO: 5366950 - DNA, 21 bp, Homo sapiens
agttatgattcagtgcatttt

SEQ ID NO: 5366951 - DNA, 23 bp, Homo sapiens
agttatgattcagtgcattttca

SEQ ID NO: 5366952 - DNA, 20 bp, Homo sapiens
agttatgatttttttttcat

SEQ ID NO: 5366953 - DNA, 18 bp, Homo sapiens
agttatgtaaataattct

SEQ ID NO: 5366954 - DNA, 20 bp, Homo sapiens
agttatgtaaataattcttt

SEQ ID NO: 5366955 - DNA, 19 bp, Homo sapiens
agttatgtacgtatatata

SEQ ID NO: 5366956 - DNA, 21 bp, Homo sapiens
agttatgtcttgtatttaaaa

SEQ ID NO: 5366957 - DNA, 13 bp, Homo sapiens
agttatgtctttt

SEQ ID NO: 5366958 - DNA, 15 bp, Homo sapiens
agttatgtgaatgat

SEQ ID NO: 5366959 - DNA, 14 bp, Homo sapiens
agttatgtgatttt

SEQ ID NO: 5366960 - DNA, 21 bp, Homo sapiens
agttatgtgttaaatttagtg

SEQ ID NO: 5366961 - DNA, 17 bp, Homo sapiens
agttatgtttgaatgaa

SEQ ID NO: 5366962 - DNA, 15 bp, Homo sapiens
agttattaaaattgt

SEQ ID NO: 5366963 - DNA, 18 bp, Homo sapiens
agttattaaaattgttgt

SEQ ID NO: 5366964 - DNA, 20 bp, Homo sapiens
agttattaaagtaatttaca

SEQ ID NO: 5366965 - DNA, 20 bp, Homo sapiens
agttattaacgggcatgtat

SEQ ID NO: 5366966 - DNA, 20 bp, Homo sapiens
agttattaactttaatgttt

SEQ ID NO: 5366967 - DNA, 16 bp, Homo sapiens
agttattaatcttatg

SEQ ID NO: 5366968 - DNA, 19 bp, Homo sapiens
agttattagcgttttaaca

SEQ ID NO: 5366969 - DNA, 15 bp, Homo sapiens
agttattattgctgt

SEQ ID NO: 5366970 - DNA, 18 bp, Homo sapiens
agttattattgctgtttg

SEQ ID NO: 5366971 - DNA, 16 bp, Homo sapiens
agttattatttaattg

SEQ ID NO: 5366972 - DNA, 15 bp, Homo sapiens
agttattcaaatgaa

SEQ ID NO: 5366973 - DNA, 13 bp, Homo sapiens
agttattcaaatt

SEQ ID NO: 5366974 - DNA, 14 bp, Homo sapiens
agttattcagaaat

SEQ ID NO: 5366975 - DNA, 14 bp, Homo sapiens
agttattcataaag

SEQ ID NO: 5366976 - DNA, 19 bp, Homo sapiens
agttattcatattctgttg

SEQ ID NO: 5366977 - DNA, 22 bp, Homo sapiens
agttattcattctgtgatcatt

SEQ ID NO: 5366978 - DNA, 19 bp, Homo sapiens
agttattccacaaacacat

SEQ ID NO: 5366979 - DNA, 18 bp, Homo sapiens
agttattccttgatcatt

SEQ ID NO: 5366980 - DNA, 15 bp, Homo sapiens
agttattctctaaga

SEQ ID NO: 5366981 - DNA, 16 bp, Homo sapiens
agttattgaagcagag

SEQ ID NO: 5366982 - DNA, 18 bp, Homo sapiens
agttattgaagcagagtg

SEQ ID NO: 5366983 - DNA, 17 bp, Homo sapiens
agttattgaatcttaat

SEQ ID NO: 5366984 - DNA, 19 bp, Homo sapiens
agttattgataagttcata

SEQ ID NO: 5366985 - DNA, 22 bp, Homo sapiens
agttattgataagttcatacat

SEQ ID NO: 5366986 - DNA, 23 bp, Homo sapiens
agttattgataagttcatacatt

SEQ ID NO: 5366987 - DNA, 22 bp, Homo sapiens
agttattgatttttgtaataaa

SEQ ID NO: 5366988 - DNA, 13 bp, Homo sapiens
agttattgcagtt

SEQ ID NO: 5366989 - DNA, 16 bp, Homo sapiens
agttattgctgcataa

SEQ ID NO: 5366990 - DNA, 23 bp, Homo sapiens
agttattgctgcataaatttgta

SEQ ID NO: 5366991 - DNA, 17 bp, Homo sapiens
agttattgggcttaaaa

SEQ ID NO: 5366992 - DNA, 13 bp, Homo sapiens
agttattgtacag

SEQ ID NO: 5366993 - DNA, 23 bp, Homo sapiens
agttattgtccctggcttcctta

SEQ ID NO: 5366994 - DNA, 22 bp, Homo sapiens
agttattgtgttgccttagcac

SEQ ID NO: 5366995 - DNA, 21 bp, Homo sapiens
agttattgttttatgttctag

SEQ ID NO: 5366996 - DNA, 16 bp, Homo sapiens
agttatttaagaagaa

SEQ ID NO: 5366997 - DNA, 15 bp, Homo sapiens
agttatttaatcaaa

SEQ ID NO: 5366998 - DNA, 17 bp, Homo sapiens
agttatttacttgaaag

SEQ ID NO: 5366999 - DNA, 17 bp, Homo sapiens
agttatttatattttgt

SEQ ID NO: 5367000 - DNA, 22 bp, Homo sapiens
agttatttatgcctctgtattt

SEQ ID NO: 5367001 - DNA, 18 bp, Homo sapiens
agttatttatttccaaaa

SEQ ID NO: 5367002 - DNA, 15 bp, Homo sapiens
agttatttcatacca

SEQ ID NO: 5367003 - DNA, 19 bp, Homo sapiens
agttatttccctttagctg

SEQ ID NO: 5367004 - DNA, 18 bp, Homo sapiens
agttatttgatctggtgc

SEQ ID NO: 5367005 - DNA, 19 bp, Homo sapiens
agttatttgtataaattaa

SEQ ID NO: 5367006 - DNA, 16 bp, Homo sapiens
agttattttaatacct

SEQ ID NO: 5367007 - DNA, 19 bp, Homo sapiens
agttattttacaaattgtt

SEQ ID NO: 5367008 - DNA, 20 bp, Homo sapiens
agttattttaggagacagtc

SEQ ID NO: 5367009 - DNA, 16 bp, Homo sapiens
agttattttcttgttt

SEQ ID NO: 5367010 - DNA, 16 bp, Homo sapiens
agttattttgtacatt

SEQ ID NO: 5367011 - DNA, 17 bp, Homo sapiens
agttattttgtgtcctt

SEQ ID NO: 5367012 - DNA, 16 bp, Homo sapiens
agttatttttattatt

SEQ ID NO: 5367013 - DNA, 12 bp, Homo sapiens
agttatttttct

SEQ ID NO: 5367014 - DNA, 17 bp, Homo sapiens
agttatttttctctttg

SEQ ID NO: 5367015 - DNA, 12 bp, Homo sapiens
agttcaaaaaca

SEQ ID NO: 5367016 - DNA, 15 bp, Homo sapiens
agttcaaactgcagc

SEQ ID NO: 5367017 - DNA, 20 bp, Homo sapiens
agttcaaagtcatgatgttt

SEQ ID NO: 5367018 - DNA, 13 bp, Homo sapiens
agttcaaagtgta

SEQ ID NO: 5367019 - DNA, 16 bp, Homo sapiens
agttcaaagtgtatat

SEQ ID NO: 5367020 - DNA, 14 bp, Homo sapiens
agttcaaatacttt

SEQ ID NO: 5367021 - DNA, 16 bp, Homo sapiens
agttcaaatcctcacc

SEQ ID NO: 5367022 - DNA, 18 bp, Homo sapiens
agttcaaattcttctgaa

SEQ ID NO: 5367023 - DNA, 20 bp, Homo sapiens
agttcaacctggtggcacca

SEQ ID NO: 5367024 - DNA, 22 bp, Homo sapiens
agttcaacctggtggcaccaga

SEQ ID NO: 5367025 - DNA, 18 bp, Homo sapiens
agttcaacttatttcata

SEQ ID NO: 5367026 - DNA, 19 bp, Homo sapiens
agttcaacttatttcataa

SEQ ID NO: 5367027 - DNA, 13 bp, Homo sapiens
agttcaagaaata

SEQ ID NO: 5367028 - DNA, 14 bp, Homo sapiens
agttcaagaaatga

SEQ ID NO: 5367029 - DNA, 15 bp, Homo sapiens
agttcaagaaatgaa

SEQ ID NO: 5367030 - DNA, 18 bp, Homo sapiens
agttcaagaaatgaagag

SEQ ID NO: 5367031 - DNA, 14 bp, Homo sapiens
agttcaagaccagc

SEQ ID NO: 5367032 - DNA, 15 bp, Homo sapiens
agttcaagaccagcc

SEQ ID NO: 5367033 - DNA, 16 bp, Homo sapiens
agttcaagaccagcct

SEQ ID NO: 5367034 - DNA, 17 bp, Homo sapiens
agttcaagaccagcctg

SEQ ID NO: 5367035 - DNA, 19 bp, Homo sapiens
agttcaagactagcctggc

SEQ ID NO: 5367036 - DNA, 15 bp, Homo sapiens
agttcaagcctgtgg

SEQ ID NO: 5367037 - DNA, 16 bp, Homo sapiens
agttcaagcctgtggg

SEQ ID NO: 5367038 - DNA, 23 bp, Homo sapiens
agttcaaggaacttgaaaaatac

SEQ ID NO: 5367039 - DNA, 13 bp, Homo sapiens
agttcaaggacca

SEQ ID NO: 5367040 - DNA, 15 bp, Homo sapiens
agttcaaggaccaac

SEQ ID NO: 5367041 - DNA, 22 bp, Homo sapiens
agttcaagtgatctttcaatat

SEQ ID NO: 5367042 - DNA, 23 bp, Homo sapiens
agttcaataaacttaactttaac

SEQ ID NO: 5367043 - DNA, 18 bp, Homo sapiens
agttcaataaatgtctgt

SEQ ID NO: 5367044 - DNA, 22 bp, Homo sapiens
agttcaatactcttgaaatgta

SEQ ID NO: 5367045 - DNA, 15 bp, Homo sapiens
agttcaatctcccgc

SEQ ID NO: 5367046 - DNA, 24 bp, Homo sapiens
agttcaatctggattcatatttaa

SEQ ID NO: 5367047 - DNA, 18 bp, Homo sapiens
agttcaatggctgcgaaa

SEQ ID NO: 5367048 - DNA, 18 bp, Homo sapiens
agttcaatggctgctgaa

SEQ ID NO: 5367049 - DNA, 16 bp, Homo sapiens
agttcacaccctgcaa

SEQ ID NO: 5367050 - DNA, 18 bp, Homo sapiens
agttcacaccctgcaagg

SEQ ID NO: 5367051 - DNA, 17 bp, Homo sapiens
agttcacaggaggccag

SEQ ID NO: 5367052 - DNA, 19 bp, Homo sapiens
agttcacaggaggccagtg

SEQ ID NO: 5367053 - DNA, 20 bp, Homo sapiens
agttcacatgtgccctgcct

SEQ ID NO: 5367054 - DNA, 17 bp, Homo sapiens
agttcacattaactcag

SEQ ID NO: 5367055 - DNA, 22 bp, Homo sapiens
agttcacattaactcaggcatt

SEQ ID NO: 5367056 - DNA, 13 bp, Homo sapiens
agttcaccagccc

SEQ ID NO: 5367057 - DNA, 17 bp, Homo sapiens
agttcaccagccctgag

SEQ ID NO: 5367058 - DNA, 18 bp, Homo sapiens
agttcaccagccctgagc

SEQ ID NO: 5367059 - DNA, 15 bp, Homo sapiens
agttcaccatctctt

SEQ ID NO: 5367060 - DNA, 14 bp, Homo sapiens
agttcaccattaaa

SEQ ID NO: 5367061 - DNA, 22 bp, Homo sapiens
agttcactctccatttaataat

SEQ ID NO: 5367062 - DNA, 24 bp, Homo sapiens
agttcactctccatttaataatta

SEQ ID NO: 5367063 - DNA, 16 bp, Homo sapiens
agttcactgctgcatg

SEQ ID NO: 5367064 - DNA, 15 bp, Homo sapiens
agttcagaaatttaa

SEQ ID NO: 5367065 - DNA, 22 bp, Homo sapiens
agttcagaaatttaaaagcaga

SEQ ID NO: 5367066 - DNA, 18 bp, Homo sapiens
agttcagaaatttggcat

SEQ ID NO: 5367067 - DNA, 20 bp, Homo sapiens
agttcagaaggaataagcat

SEQ ID NO: 5367068 - DNA, 14 bp, Homo sapiens
agttcagaatggca

SEQ ID NO: 5367069 - DNA, 21 bp, Homo sapiens
agttcagaatggcagtcctgg

SEQ ID NO: 5367070 - DNA, 22 bp, Homo sapiens
agttcagaatggcagtcctgga

SEQ ID NO: 5367071 - DNA, 15 bp, Homo sapiens
agttcagaatttagt

SEQ ID NO: 5367072 - DNA, 23 bp, Homo sapiens
agttcagagatcaggatcagctt

SEQ ID NO: 5367073 - DNA, 21 bp, Homo sapiens
agttcagagccaagccttaaa

SEQ ID NO: 5367074 - DNA, 15 bp, Homo sapiens
agttcagagctgccc

SEQ ID NO: 5367075 - DNA, 16 bp, Homo sapiens
agttcagagctgccct

SEQ ID NO: 5367076 - DNA, 17 bp, Homo sapiens
agttcagagctgccctc

SEQ ID NO: 5367077 - DNA, 20 bp, Homo sapiens
agttcagagctgccctctcc

SEQ ID NO: 5367078 - DNA, 21 bp, Homo sapiens
agttcagagctgccctctcct

SEQ ID NO: 5367079 - DNA, 15 bp, Homo sapiens
agttcagaggaagca

SEQ ID NO: 5367080 - DNA, 18 bp, Homo sapiens
agttcagaggaagcacat

SEQ ID NO: 5367081 - DNA, 11 bp, Homo sapiens
agttcagatct

SEQ ID NO: 5367082 - DNA, 16 bp, Homo sapiens
agttcagatcttaata

SEQ ID NO: 5367083 - DNA, 21 bp, Homo sapiens
agttcagcatccgcaggtgct

SEQ ID NO: 5367084 - DNA, 16 bp, Homo sapiens
agttcagccaccctga

SEQ ID NO: 5367085 - DNA, 14 bp, Homo sapiens
agttcagcttgggg

SEQ ID NO: 5367086 - DNA, 17 bp, Homo sapiens
agttcaggaacccttct

SEQ ID NO: 5367087 - DNA, 19 bp, Homo sapiens
agttcaggagtcccaagga

SEQ ID NO: 5367088 - DNA, 15 bp, Homo sapiens
agttcagggaagcag

SEQ ID NO: 5367089 - DNA, 17 bp, Homo sapiens
agttcagggaagcaggc

SEQ ID NO: 5367090 - DNA, 13 bp, Homo sapiens
agttcagggaccg

SEQ ID NO: 5367091 - DNA, 17 bp, Homo sapiens
agttcagggaggggctg

SEQ ID NO: 5367092 - DNA, 20 bp, Homo sapiens
agttcaggtaacaggcagat

SEQ ID NO: 5367093 - DNA, 20 bp, Homo sapiens
agttcaggtagctgcccctg

SEQ ID NO: 5367094 - DNA, 14 bp, Homo sapiens
agttctaggccttt

SEQ ID NO: 5367095 - DNA, 19 bp, Homo sapiens
agttctaggcctttcctct

SEQ ID NO: 5367096 - DNA, 20 bp, Homo sapiens
agttctaggcctttcctctg

SEQ ID NO: 5367097 - DNA, 23 bp, Homo sapiens
agttctaggggagaagagccctg

SEQ ID NO: 5367098 - DNA, 19 bp, Homo sapiens
agttctagtctctctgggg

SEQ ID NO: 5367099 - DNA, 15 bp, Homo sapiens
agttctagttgcttg

SEQ ID NO: 5367100 - DNA, 19 bp, Homo sapiens
agttctataaacaggcttg

SEQ ID NO: 5367101 - DNA, 13 bp, Homo sapiens
agttctataagaa

SEQ ID NO: 5367102 - DNA, 19 bp, Homo sapiens
agttctataagtgaggaag

SEQ ID NO: 5367103 - DNA, 22 bp, Homo sapiens
agttctatcagtgacttctgaa

SEQ ID NO: 5367104 - DNA, 23 bp, Homo sapiens
agttctatcagttatcctttgtg

SEQ ID NO: 5367105 - DNA, 17 bp, Homo sapiens
agttctatgaatatgga

SEQ ID NO: 5367106 - DNA, 22 bp, Homo sapiens
agttctatggagactttgctgt

SEQ ID NO: 5367107 - DNA, 18 bp, Homo sapiens
agttctattatctgggtt

SEQ ID NO: 5367108 - DNA, 15 bp, Homo sapiens
agttctatttaagtg

SEQ ID NO: 5367109 - DNA, 16 bp, Homo sapiens
agttctatttcttgaa

SEQ ID NO: 5367110 - DNA, 16 bp, Homo sapiens
agttctatttgctatc

SEQ ID NO: 5367111 - DNA, 19 bp, Homo sapiens
agttctcaaatgtgtgtgg

SEQ ID NO: 5367112 - DNA, 15 bp, Homo sapiens
agttctcaatgtgaa

SEQ ID NO: 5367113 - DNA, 23 bp, Homo sapiens
agttctcaattattggcctgcta

SEQ ID NO: 5367114 - DNA, 17 bp, Homo sapiens
agttctcaatttcattt

SEQ ID NO: 5367115 - DNA, 13 bp, Homo sapiens
agttctcacattt

SEQ ID NO: 5367116 - DNA, 23 bp, Homo sapiens
agttctcacgaaagtatttactt

SEQ ID NO: 5367117 - DNA, 20 bp, Homo sapiens
agttctcactgttccctctg

SEQ ID NO: 5367118 - DNA, 17 bp, Homo sapiens
agttctcagggctcctg

SEQ ID NO: 5367119 - DNA, 17 bp, Homo sapiens
agttctcatccacagag

SEQ ID NO: 5367120 - DNA, 22 bp, Homo sapiens
agttctcatccacagaggccag

SEQ ID NO: 5367121 - DNA, 12 bp, Homo sapiens
agttctcatctt

SEQ ID NO: 5367122 - DNA, 15 bp, Homo sapiens
agttctccagcttca

SEQ ID NO: 5367123 - DNA, 14 bp, Homo sapiens
agttctcccaacaa

SEQ ID NO: 5367124 - DNA, 22 bp, Homo sapiens
agttctcccaacaacatgaaac

SEQ ID NO: 5367125 - DNA, 12 bp, Homo sapiens
agttctcccagg

SEQ ID NO: 5367126 - DNA, 23 bp, Homo sapiens
agttctcccagggagtgagcagc

SEQ ID NO: 5367127 - DNA, 13 bp, Homo sapiens
agttctccctgta

SEQ ID NO: 5367128 - DNA, 15 bp, Homo sapiens
agttctcctggagca

SEQ ID NO: 5367129 - DNA, 16 bp, Homo sapiens
agttctctagggtctg

SEQ ID NO: 5367130 - DNA, 16 bp, Homo sapiens
agttctctcccttcct

SEQ ID NO: 5367131 - DNA, 13 bp, Homo sapiens
agttctctccttc

SEQ ID NO: 5367132 - DNA, 17 bp, Homo sapiens
agttctctcgaatactt

SEQ ID NO: 5367133 - DNA, 16 bp, Homo sapiens
agttctctcgtaactg

SEQ ID NO: 5367134 - DNA, 14 bp, Homo sapiens
agttctctgatgca

SEQ ID NO: 5367135 - DNA, 16 bp, Homo sapiens
agttctctgtaattac

SEQ ID NO: 5367136 - DNA, 12 bp, Homo sapiens
agttctctgttc

SEQ ID NO: 5367137 - DNA, 20 bp, Homo sapiens
agttctcttcactcaaggat

SEQ ID NO: 5367138 - DNA, 14 bp, Homo sapiens
agttctcttccgca

SEQ ID NO: 5367139 - DNA, 20 bp, Homo sapiens
agttctcttggtgttaaaac

SEQ ID NO: 5367140 - DNA, 22 bp, Homo sapiens
agttctctttggaaatagcatg

SEQ ID NO: 5367141 - DNA, 17 bp, Homo sapiens
agttctgaaaactgttt

SEQ ID NO: 5367142 - DNA, 11 bp, Homo sapiens
agttctgaaag

SEQ ID NO: 5367143 - DNA, 14 bp, Homo sapiens
agttctgaagaaga

SEQ ID NO: 5367144 - DNA, 17 bp, Homo sapiens
agttctgactttgaatt

SEQ ID NO: 5367145 - DNA, 22 bp, Homo sapiens
agttctgactttgaatttatat

SEQ ID NO: 5367146 - DNA, 23 bp, Homo sapiens
agttctgactttgaatttatata

SEQ ID NO: 5367147 - DNA, 17 bp, Homo sapiens
agttctgagctgccagt

SEQ ID NO: 5367148 - DNA, 18 bp, Homo sapiens
agttctgagctgccagtg

SEQ ID NO: 5367149 - DNA, 18 bp, Homo sapiens
agttctgagctgtaattt

SEQ ID NO: 5367150 - DNA, 14 bp, Homo sapiens
agttctgatgctta

SEQ ID NO: 5367151 - DNA, 16 bp, Homo sapiens
agttctgcaaatagaa

SEQ ID NO: 5367152 - DNA, 18 bp, Homo sapiens
agttctgcaaatagaaaa

SEQ ID NO: 5367153 - DNA, 13 bp, Homo sapiens
agttctgcactct

SEQ ID NO: 5367154 - DNA, 18 bp, Homo sapiens
agttctgccacctctgac

SEQ ID NO: 5367155 - DNA, 14 bp, Homo sapiens
agttctgccaggca

SEQ ID NO: 5367156 - DNA, 22 bp, Homo sapiens
agttctgcccaaattatgtgaa

SEQ ID NO: 5367157 - DNA, 21 bp, Homo sapiens
agttctgcctctgatgtattt

SEQ ID NO: 5367158 - DNA, 19 bp, Homo sapiens
agttctgccttatctaaat

SEQ ID NO: 5367159 - DNA, 12 bp, Homo sapiens
agttctgctcct

SEQ ID NO: 5367160 - DNA, 18 bp, Homo sapiens
agttctgctcctctccag

SEQ ID NO: 5367161 - DNA, 12 bp, Homo sapiens
agttctgctgcc

SEQ ID NO: 5367162 - DNA, 15 bp, Homo sapiens
agttctgctgccctc

SEQ ID NO: 5367163 - DNA, 19 bp, Homo sapiens
agttctgctgccctcttaa

SEQ ID NO: 5367164 - DNA, 16 bp, Homo sapiens
agttctgctgtctccc

SEQ ID NO: 5367165 - DNA, 23 bp, Homo sapiens
agttctgctgtctccctgaagag

SEQ ID NO: 5367166 - DNA, 22 bp, Homo sapiens
agttctgcttgctcccaagccc

SEQ ID NO: 5367167 - DNA, 18 bp, Homo sapiens
agttctgctttctgcctc

SEQ ID NO: 5367168 - DNA, 23 bp, Homo sapiens
agttctggagcttaattttctgt

SEQ ID NO: 5367169 - DNA, 13 bp, Homo sapiens
agttctggaggag

SEQ ID NO: 5367170 - DNA, 17 bp, Homo sapiens
agttctggatgtctggc

SEQ ID NO: 5367171 - DNA, 19 bp, Homo sapiens
agttctggcaagagcagat

SEQ ID NO: 5367172 - DNA, 11 bp, Homo sapiens
agttctgggca

SEQ ID NO: 5367173 - DNA, 21 bp, Homo sapiens
agttctggggcccgcctgcca

SEQ ID NO: 5367174 - DNA, 23 bp, Homo sapiens
agttctggggcccgcctgccacc

SEQ ID NO: 5367175 - DNA, 11 bp, Homo sapiens
agttctggtga

SEQ ID NO: 5367176 - DNA, 21 bp, Homo sapiens
agttctggttcatgcagacaa

SEQ ID NO: 5367177 - DNA, 13 bp, Homo sapiens
agttctgtagaaa

SEQ ID NO: 5367178 - DNA, 16 bp, Homo sapiens
agttctgtagaaatgg

SEQ ID NO: 5367179 - DNA, 15 bp, Homo sapiens
agttctgtatttgaa

SEQ ID NO: 5367180 - DNA, 17 bp, Homo sapiens
agttctgtatttgaaag

SEQ ID NO: 5367181 - DNA, 18 bp, Homo sapiens
agttctgtatttgaaagt

SEQ ID NO: 5367182 - DNA, 21 bp, Homo sapiens
agttctgtatttgaaagtgcc

SEQ ID NO: 5367183 - DNA, 23 bp, Homo sapiens
agttctgtccttggcaactttct

SEQ ID NO: 5367184 - DNA, 19 bp, Homo sapiens
agttctgtgactaggaaaa

SEQ ID NO: 5367185 - DNA, 14 bp, Homo sapiens
agttctgtgcctcc

SEQ ID NO: 5367186 - DNA, 17 bp, Homo sapiens
agttctgtgcctccccc

SEQ ID NO: 5367187 - DNA, 17 bp, Homo sapiens
agttctgtggttccagt

SEQ ID NO: 5367188 - DNA, 13 bp, Homo sapiens
agttctgtgtaca

SEQ ID NO: 5367189 - DNA, 14 bp, Homo sapiens
agttctgtgtacat

SEQ ID NO: 5367190 - DNA, 12 bp, Homo sapiens
agttctgtgtgg

SEQ ID NO: 5367191 - DNA, 13 bp, Homo sapiens
agttctgtgttta

SEQ ID NO: 5367192 - DNA, 15 bp, Homo sapiens
agttctgttaaatat

SEQ ID NO: 5367193 - DNA, 13 bp, Homo sapiens
agttcttaagact

SEQ ID NO: 5367194 - DNA, 18 bp, Homo sapiens
agttcttacgcttgacag

SEQ ID NO: 5367195 - DNA, 19 bp, Homo sapiens
agttcttactgcttaattc

SEQ ID NO: 5367196 - DNA, 15 bp, Homo sapiens
agttcttagatatct

SEQ ID NO: 5367197 - DNA, 19 bp, Homo sapiens
agttcttagctttgaaact

SEQ ID NO: 5367198 - DNA, 14 bp, Homo sapiens
agttcttagttata

SEQ ID NO: 5367199 - DNA, 16 bp, Homo sapiens
agttcttagttgctgt

SEQ ID NO: 5367200 - DNA, 17 bp, Homo sapiens
agttcttatgaggaggg

SEQ ID NO: 5367201 - DNA, 14 bp, Homo sapiens
agttcttattttag

SEQ ID NO: 5367202 - DNA, 12 bp, Homo sapiens
agttcttcacct

SEQ ID NO: 5367203 - DNA, 14 bp, Homo sapiens
agttcttcacctct

SEQ ID NO: 5367204 - DNA, 15 bp, Homo sapiens
agttcttcacctcta

SEQ ID NO: 5367205 - DNA, 18 bp, Homo sapiens
agttcttcacctctatcc

SEQ ID NO: 5367206 - DNA, 18 bp, Homo sapiens
agttcttcatttggagga

SEQ ID NO: 5367207 - DNA, 18 bp, Homo sapiens
agttcttcgactgttgtt

SEQ ID NO: 5367208 - DNA, 17 bp, Homo sapiens
agttcttcgggaagaga

SEQ ID NO: 5367209 - DNA, 20 bp, Homo sapiens
agttcttcgggaagagagga

SEQ ID NO: 5367210 - DNA, 22 bp, Homo sapiens
agttcttctcaaaaaataatta

SEQ ID NO: 5367211 - DNA, 14 bp, Homo sapiens
agttcttgaacagt

SEQ ID NO: 5367212 - DNA, 16 bp, Homo sapiens
agttcttgaattgtta

SEQ ID NO: 5367213 - DNA, 20 bp, Homo sapiens
agttcttgaattgttatgaa

SEQ ID NO: 5367214 - DNA, 22 bp, Homo sapiens
agttcttgaattgttatgaaaa

SEQ ID NO: 5367215 - DNA, 16 bp, Homo sapiens
agttcttgcaataaga

SEQ ID NO: 5367216 - DNA, 15 bp, Homo sapiens
agttcttgcccttca

SEQ ID NO: 5367217 - DNA, 17 bp, Homo sapiens
agttcttggacccctga

SEQ ID NO: 5367218 - DNA, 21 bp, Homo sapiens
agttcttgggggaggccaccc

SEQ ID NO: 5367219 - DNA, 16 bp, Homo sapiens
agttcttggtgctctg

SEQ ID NO: 5367220 - DNA, 17 bp, Homo sapiens
agttcttggtgctctgt

SEQ ID NO: 5367221 - DNA, 13 bp, Homo sapiens
agttcttgtgcat

SEQ ID NO: 5367222 - DNA, 18 bp, Homo sapiens
agttcttgtgcatgttta

SEQ ID NO: 5367223 - DNA, 21 bp, Homo sapiens
agttcttgtgcatgtttactt

SEQ ID NO: 5367224 - DNA, 14 bp, Homo sapiens
agttcttgtgccat

SEQ ID NO: 5367225 - DNA, 16 bp, Homo sapiens
agttcttgtgtcctgg

SEQ ID NO: 5367226 - DNA, 12 bp, Homo sapiens
agttctttcctc

SEQ ID NO: 5367227 - DNA, 20 bp, Homo sapiens
agttctttcctctttctgct

SEQ ID NO: 5367228 - DNA, 19 bp, Homo sapiens
agttctttctcgtgggtaa

SEQ ID NO: 5367229 - DNA, 16 bp, Homo sapiens
agttctttgggccaga

SEQ ID NO: 5367230 - DNA, 17 bp, Homo sapiens
agttctttgggccagac

SEQ ID NO: 5367231 - DNA, 18 bp, Homo sapiens
agttctttgttcctgctt

SEQ ID NO: 5367232 - DNA, 19 bp, Homo sapiens
agttctttgttcctgcttt

SEQ ID NO: 5367233 - DNA, 15 bp, Homo sapiens
agttctttttgtaca

SEQ ID NO: 5367234 - DNA, 21 bp, Homo sapiens
agttctttttgtacacttaat

SEQ ID NO: 5367235 - DNA, 20 bp, Homo sapiens
agttcttttttgtacagtat

SEQ ID NO: 5367236 - DNA, 21 bp, Homo sapiens
agttcttttttgtacagtatt

SEQ ID NO: 5367237 - DNA, 18 bp, Homo sapiens
agttgaaaaacagctgag

SEQ ID NO: 5367238 - DNA, 13 bp, Homo sapiens
agttgaaaaagga

SEQ ID NO: 5367239 - DNA, 14 bp, Homo sapiens
agttgaaaaataaa

SEQ ID NO: 5367240 - DNA, 14 bp, Homo sapiens
agttgaaaagactc

SEQ ID NO: 5367241 - DNA, 18 bp, Homo sapiens
agttgaaaagactccaaa

SEQ ID NO: 5367242 - DNA, 20 bp, Homo sapiens
agttgaaaagactccaaaga

SEQ ID NO: 5367243 - DNA, 16 bp, Homo sapiens
agttgaaaagccaaag

SEQ ID NO: 5367244 - DNA, 18 bp, Homo sapiens
agttgaaaagccaaaggt

SEQ ID NO: 5367245 - DNA, 19 bp, Homo sapiens
agttgaaaagccaaaggtc

SEQ ID NO: 5367246 - DNA, 19 bp, Homo sapiens
agttgaaaataaagtgtat

SEQ ID NO: 5367247 - DNA, 15 bp, Homo sapiens
agttgaaaatacatt

SEQ ID NO: 5367248 - DNA, 15 bp, Homo sapiens
agttgaaactgctat

SEQ ID NO: 5367249 - DNA, 18 bp, Homo sapiens
agttgaaaggcctcaaga

SEQ ID NO: 5367250 - DNA, 15 bp, Homo sapiens
agttgaaagggcaat

SEQ ID NO: 5367251 - DNA, 18 bp, Homo sapiens
agttgaacactagtctgt

SEQ ID NO: 5367252 - DNA, 13 bp, Homo sapiens
agttgaacatctc

SEQ ID NO: 5367253 - DNA, 14 bp, Homo sapiens
agttgaacatctca

SEQ ID NO: 5367254 - DNA, 14 bp, Homo sapiens
agttgaagaaaaaa

SEQ ID NO: 5367255 - DNA, 20 bp, Homo sapiens
agttgaagaaaaaatggcaa

SEQ ID NO: 5367256 - DNA, 17 bp, Homo sapiens
agttgaagacagagcta

SEQ ID NO: 5367257 - DNA, 17 bp, Homo sapiens
agttgaagactttgttt

SEQ ID NO: 5367258 - DNA, 14 bp, Homo sapiens
agttgaagagcctg

SEQ ID NO: 5367259 - DNA, 21 bp, Homo sapiens
agttgaagggaaacaaagaag

SEQ ID NO: 5367260 - DNA, 17 bp, Homo sapiens
agttgaagggaaatcaa

SEQ ID NO: 5367261 - DNA, 16 bp, Homo sapiens
agttgaagggaggtga

SEQ ID NO: 5367262 - DNA, 15 bp, Homo sapiens
agttgaataatttgt

SEQ ID NO: 5367263 - DNA, 14 bp, Homo sapiens
agttgaatacttga

SEQ ID NO: 5367264 - DNA, 16 bp, Homo sapiens
agttgaatacttgaac

SEQ ID NO: 5367265 - DNA, 16 bp, Homo sapiens
agttgaatattatata

SEQ ID NO: 5367266 - DNA, 17 bp, Homo sapiens
agttgaattccaagtgt

SEQ ID NO: 5367267 - DNA, 13 bp, Homo sapiens
agttgaatttatt

SEQ ID NO: 5367268 - DNA, 17 bp, Homo sapiens
agttgaatttattggct

SEQ ID NO: 5367269 - DNA, 20 bp, Homo sapiens
agttgaatttattggctttt

SEQ ID NO: 5367270 - DNA, 13 bp, Homo sapiens
agttgaatttttt

SEQ ID NO: 5367271 - DNA, 21 bp, Homo sapiens
agttgaattttttttaacatt

SEQ ID NO: 5367272 - DNA, 18 bp, Homo sapiens
agttgacaacctagaatg

SEQ ID NO: 5367273 - DNA, 18 bp, Homo sapiens
agtttaaaaaaataacat

SEQ ID NO: 5367274 - DNA, 23 bp, Homo sapiens
agtttaaaaaataacttcattgt

SEQ ID NO: 5367275 - DNA, 16 bp, Homo sapiens
agtttaaaaaatacac

SEQ ID NO: 5367276 - DNA, 14 bp, Homo sapiens
agtttaaaaatatt

SEQ ID NO: 5367277 - DNA, 17 bp, Homo sapiens
agtttaaaaatcaactt

SEQ ID NO: 5367278 - DNA, 21 bp, Homo sapiens
agtttaaaaatcagaaagaca

SEQ ID NO: 5367279 - DNA, 20 bp, Homo sapiens
agtttaaaaatctgccacct

SEQ ID NO: 5367280 - DNA, 19 bp, Homo sapiens
agtttaaaaattgtctctt

SEQ ID NO: 5367281 - DNA, 18 bp, Homo sapiens
agtttaaaacagtattta

SEQ ID NO: 5367282 - DNA, 20 bp, Homo sapiens
agtttaaaacagtatttatt

SEQ ID NO: 5367283 - DNA, 13 bp, Homo sapiens
agtttaaaaccca

SEQ ID NO: 5367284 - DNA, 14 bp, Homo sapiens
agtttaaaacccaa

SEQ ID NO: 5367285 - DNA, 21 bp, Homo sapiens
agtttaaaagcacgacagtgg

SEQ ID NO: 5367286 - DNA, 20 bp, Homo sapiens
agtttaaaagcatgaaacat

SEQ ID NO: 5367287 - DNA, 18 bp, Homo sapiens
agtttaaaagccatgtat

SEQ ID NO: 5367288 - DNA, 15 bp, Homo sapiens
agtttaaaatcatca

SEQ ID NO: 5367289 - DNA, 21 bp, Homo sapiens
agtttaaaatcatcagaaagg

SEQ ID NO: 5367290 - DNA, 17 bp, Homo sapiens
agtttaaaatcttgcat

SEQ ID NO: 5367291 - DNA, 14 bp, Homo sapiens
agtttaaaatgcag

SEQ ID NO: 5367292 - DNA, 13 bp, Homo sapiens
agtttaaaatgta

SEQ ID NO: 5367293 - DNA, 23 bp, Homo sapiens
agtttaaaatgtgtatttttcaa

SEQ ID NO: 5367294 - DNA, 17 bp, Homo sapiens
agtttaaaattattaaa

SEQ ID NO: 5367295 - DNA, 12 bp, Homo sapiens
agtttaaacaaa

SEQ ID NO: 5367296 - DNA, 14 bp, Homo sapiens
agtttaaacaaaaa

SEQ ID NO: 5367297 - DNA, 12 bp, Homo sapiens
agtttaaagcaa

SEQ ID NO: 5367298 - DNA, 15 bp, Homo sapiens
agtttaaagttgcac

SEQ ID NO: 5367299 - DNA, 12 bp, Homo sapiens
agtttaaatacc

SEQ ID NO: 5367300 - DNA, 16 bp, Homo sapiens
agtttaaataccagta

SEQ ID NO: 5367301 - DNA, 12 bp, Homo sapiens
agtttaaatctt

SEQ ID NO: 5367302 - DNA, 17 bp, Homo sapiens
agtttaaatctttgtta

SEQ ID NO: 5367303 - DNA, 13 bp, Homo sapiens
agtttaaattcta

SEQ ID NO: 5367304 - DNA, 14 bp, Homo sapiens
agtttaaattctag

SEQ ID NO: 5367305 - DNA, 21 bp, Homo sapiens
agtttaacagatatttaaatt

SEQ ID NO: 5367306 - DNA, 18 bp, Homo sapiens
agtttaactttaaaactg

SEQ ID NO: 5367307 - DNA, 20 bp, Homo sapiens
agtttaactttgggcccaga

SEQ ID NO: 5367308 - DNA, 13 bp, Homo sapiens
agtttaacttttt

SEQ ID NO: 5367309 - DNA, 21 bp, Homo sapiens
agtttaagaatcacatacagt

SEQ ID NO: 5367310 - DNA, 17 bp, Homo sapiens
agtttaagacttagtta

SEQ ID NO: 5367311 - DNA, 21 bp, Homo sapiens
agtttaagggtggaaaaatgc

SEQ ID NO: 5367312 - DNA, 23 bp, Homo sapiens
agtttaagggtggaaaaatgccc

SEQ ID NO: 5367313 - DNA, 17 bp, Homo sapiens
agtttaataaatttatt

SEQ ID NO: 5367314 - DNA, 20 bp, Homo sapiens
agtttaatattaaagccatg

SEQ ID NO: 5367315 - DNA, 16 bp, Homo sapiens
agtttaatcagaggaa

SEQ ID NO: 5367316 - DNA, 12 bp, Homo sapiens
agtttaatgcaa

SEQ ID NO: 5367317 - DNA, 23 bp, Homo sapiens
agtttaatgtctcctttgctctt

SEQ ID NO: 5367318 - DNA, 19 bp, Homo sapiens
agtttaattatctgcattt

SEQ ID NO: 5367319 - DNA, 13 bp, Homo sapiens
agtttaattgtct

SEQ ID NO: 5367320 - DNA, 12 bp, Homo sapiens
agtttacaagaa

SEQ ID NO: 5367321 - DNA, 13 bp, Homo sapiens
agtttacaagaaa

SEQ ID NO: 5367322 - DNA, 15 bp, Homo sapiens
agtttacaagtgtat

SEQ ID NO: 5367323 - DNA, 21 bp, Homo sapiens
agtttacaagtgtatatcaga

SEQ ID NO: 5367324 - DNA, 19 bp, Homo sapiens
agtttacaatattatgaaa

SEQ ID NO: 5367325 - DNA, 20 bp, Homo sapiens
agtttacaatattatgaaat

SEQ ID NO: 5367326 - DNA, 14 bp, Homo sapiens
agtttacacactgt

SEQ ID NO: 5367327 - DNA, 15 bp, Homo sapiens
agtttacacactgtg

SEQ ID NO: 5367328 - DNA, 13 bp, Homo sapiens
agtttacagaaaa

SEQ ID NO: 5367329 - DNA, 23 bp, Homo sapiens
agtttacagctctgactttacac

SEQ ID NO: 5367330 - DNA, 13 bp, Homo sapiens
agtttacagtaaa

SEQ ID NO: 5367331 - DNA, 16 bp, Homo sapiens
agtttacagtaaataa

SEQ ID NO: 5367332 - DNA, 14 bp, Homo sapiens
agtttacattttta

SEQ ID NO: 5367333 - DNA, 14 bp, Homo sapiens
agtttaccatttgt

SEQ ID NO: 5367334 - DNA, 18 bp, Homo sapiens
agtttaccatttgtaata

SEQ ID NO: 5367335 - DNA, 21 bp, Homo sapiens
agtttaccatttgtaataaag

SEQ ID NO: 5367336 - DNA, 22 bp, Homo sapiens
agtttaccatttgtaataaagt

SEQ ID NO: 5367337 - DNA, 16 bp, Homo sapiens
agtttacccagcatga

SEQ ID NO: 5367338 - DNA, 16 bp, Homo sapiens
agtttacccggtttct

SEQ ID NO: 5367339 - DNA, 13 bp, Homo sapiens
agtttacctcatc

SEQ ID NO: 5367340 - DNA, 16 bp, Homo sapiens
agtttacctctttaaa

SEQ ID NO: 5367341 - DNA, 18 bp, Homo sapiens
agtttacctggcttattt

SEQ ID NO: 5367342 - DNA, 14 bp, Homo sapiens
agtttaccttgtat

SEQ ID NO: 5367343 - DNA, 20 bp, Homo sapiens
agtttaccttgtatactgta

SEQ ID NO: 5367344 - DNA, 14 bp, Homo sapiens
agtttactatttta

SEQ ID NO: 5367345 - DNA, 15 bp, Homo sapiens
agtttactgagaatg

SEQ ID NO: 5367346 - DNA, 14 bp, Homo sapiens
agtttactggataa

SEQ ID NO: 5367347 - DNA, 15 bp, Homo sapiens
agtttacttcacttt

SEQ ID NO: 5367348 - DNA, 16 bp, Homo sapiens
agtttactttgccaac

SEQ ID NO: 5367349 - DNA, 17 bp, Homo sapiens
agtttagaaattacaag

SEQ ID NO: 5367350 - DNA, 15 bp, Homo sapiens
agtttagaacagagg

SEQ ID NO: 5367351 - DNA, 17 bp, Homo sapiens
agtttagaacagaggga

SEQ ID NO: 5367352 - DNA, 17 bp, Homo sapiens
agtttagaacaggtttt

SEQ ID NO: 5367353 - DNA, 23 bp, Homo sapiens
agtttagaacctacaaaagcttg

SEQ ID NO: 5367354 - DNA, 13 bp, Homo sapiens
agtttagaacttg

SEQ ID NO: 5367355 - DNA, 20 bp, Homo sapiens
agtttagaagcgctcatctg

SEQ ID NO: 5367356 - DNA, 14 bp, Homo sapiens
agtttagagaaata

SEQ ID NO: 5367357 - DNA, 19 bp, Homo sapiens
agtttagaggaaaaaaatg

SEQ ID NO: 5367358 - DNA, 21 bp, Homo sapiens
agtttagaggaaaaaaatgac

SEQ ID NO: 5367359 - DNA, 20 bp, Homo sapiens
agtttagcccttccctgcct

SEQ ID NO: 5367360 - DNA, 15 bp, Homo sapiens
agtttagctggaaaa

SEQ ID NO: 5367361 - DNA, 18 bp, Homo sapiens
agtttaggaattggaggc

SEQ ID NO: 5367362 - DNA, 13 bp, Homo sapiens
agtttaggagaaa

SEQ ID NO: 5367363 - DNA, 20 bp, Homo sapiens
agtttaggccttggcttgat

SEQ ID NO: 5367364 - DNA, 23 bp, Homo sapiens
agtttagggaacaatttggcaat

SEQ ID NO: 5367365 - DNA, 17 bp, Homo sapiens
agtttagtaaggctgtg

SEQ ID NO: 5367366 - DNA, 21 bp, Homo sapiens
agtttagtcgtctaaacataa

SEQ ID NO: 5367367 - DNA, 19 bp, Homo sapiens
agtttagtgtgtgtgcaga

SEQ ID NO: 5367368 - DNA, 14 bp, Homo sapiens
agtttagtgtttct

SEQ ID NO: 5367369 - DNA, 15 bp, Homo sapiens
agtttagtgtttctt

SEQ ID NO: 5367370 - DNA, 15 bp, Homo sapiens
agtttagttctgttg

SEQ ID NO: 5367371 - DNA, 16 bp, Homo sapiens
agtttagttctgttga

SEQ ID NO: 5367372 - DNA, 21 bp, Homo sapiens
agtttataaaagactgtctta

SEQ ID NO: 5367373 - DNA, 14 bp, Homo sapiens
agtttataaagcca

SEQ ID NO: 5367374 - DNA, 17 bp, Homo sapiens
agtttataaagccaaga

SEQ ID NO: 5367375 - DNA, 15 bp, Homo sapiens
agtttataagcccaa

SEQ ID NO: 5367376 - DNA, 14 bp, Homo sapiens
agtttatacagaac

SEQ ID NO: 5367377 - DNA, 16 bp, Homo sapiens
agtttatacagaactc

SEQ ID NO: 5367378 - DNA, 15 bp, Homo sapiens
agtttatacagtaca

SEQ ID NO: 5367379 - DNA, 15 bp, Homo sapiens
agtttatacagtgta

SEQ ID NO: 5367380 - DNA, 17 bp, Homo sapiens
agtttatacagtgtaca

SEQ ID NO: 5367381 - DNA, 22 bp, Homo sapiens
agtttatacagtgtacatgtac

SEQ ID NO: 5367382 - DNA, 22 bp, Homo sapiens
agtttatacagttttaaagaat

SEQ ID NO: 5367383 - DNA, 18 bp, Homo sapiens
agtttatagtcacccggg

SEQ ID NO: 5367384 - DNA, 22 bp, Homo sapiens
agtttatattactctcattctt

SEQ ID NO: 5367385 - DNA, 17 bp, Homo sapiens
agtttatattgtggaat

SEQ ID NO: 5367386 - DNA, 16 bp, Homo sapiens
agtttatatttaactc

SEQ ID NO: 5367387 - DNA, 18 bp, Homo sapiens
agtttatatttaactctc

SEQ ID NO: 5367388 - DNA, 19 bp, Homo sapiens
agtttatcatgaagcctgt

SEQ ID NO: 5367389 - DNA, 21 bp, Homo sapiens
agtttatctatcggaagaaca

SEQ ID NO: 5367390 - DNA, 15 bp, Homo sapiens
agtttatctgttcat

SEQ ID NO: 5367391 - DNA, 16 bp, Homo sapiens
agtttatctttgcaca

SEQ ID NO: 5367392 - DNA, 18 bp, Homo sapiens
agtttatctttgcacaat

SEQ ID NO: 5367393 - DNA, 24 bp, Homo sapiens
agtttatgatgcaaatctgccaag

SEQ ID NO: 5367394 - DNA, 18 bp, Homo sapiens
agtttatgcagtgctgct

SEQ ID NO: 5367395 - DNA, 21 bp, Homo sapiens
agtttatggatatgctgcttt

SEQ ID NO: 5367396 - DNA, 22 bp, Homo sapiens
agtttatgtggcacacaatcct

SEQ ID NO: 5367397 - DNA, 13 bp, Homo sapiens
agtttatgtttgt

SEQ ID NO: 5367398 - DNA, 14 bp, Homo sapiens
agtttatgttttgg

SEQ ID NO: 5367399 - DNA, 19 bp, Homo sapiens
agtttattacaatgtatct

SEQ ID NO: 5367400 - DNA, 22 bp, Homo sapiens
agtttattacaatgtatcttta

SEQ ID NO: 5367401 - DNA, 19 bp, Homo sapiens
agtttattattattaaagt

SEQ ID NO: 5367402 - DNA, 17 bp, Homo sapiens
agtttattattttcaaa

SEQ ID NO: 5367403 - DNA, 21 bp, Homo sapiens
agtttattattttcaaaggaa

SEQ ID NO: 5367404 - DNA, 23 bp, Homo sapiens
agtttattattttcaaaggaaaa

SEQ ID NO: 5367405 - DNA, 13 bp, Homo sapiens
agtttattctgtg

SEQ ID NO: 5367406 - DNA, 21 bp, Homo sapiens
agtttattctgtggttctata

SEQ ID NO: 5367407 - DNA, 18 bp, Homo sapiens
agtttattggaagtgttc

SEQ ID NO: 5367408 - DNA, 22 bp, Homo sapiens
agtttatttccaaataaaatga

SEQ ID NO: 5367409 - DNA, 23 bp, Homo sapiens
agtttatttccactattttcaaa

SEQ ID NO: 5367410 - DNA, 13 bp, Homo sapiens
agtttatttcctg

SEQ ID NO: 5367411 - DNA, 12 bp, Homo sapiens
agtttatttctc

SEQ ID NO: 5367412 - DNA, 19 bp, Homo sapiens
agtttatttgttgagagtg

SEQ ID NO: 5367413 - DNA, 20 bp, Homo sapiens
agtttatttgttgagagtgt

SEQ ID NO: 5367414 - DNA, 23 bp, Homo sapiens
agtttatttgttgagagtgtgac

SEQ ID NO: 5367415 - DNA, 15 bp, Homo sapiens
agtttattttaagac

SEQ ID NO: 5367416 - DNA, 15 bp, Homo sapiens
agtttattttctgtg

SEQ ID NO: 5367417 - DNA, 14 bp, Homo sapiens
agtttattttgtta

SEQ ID NO: 5367418 - DNA, 16 bp, Homo sapiens
agtttatttttaaaga

SEQ ID NO: 5367419 - DNA, 20 bp, Homo sapiens
agtttatttttaaagataga

SEQ ID NO: 5367420 - DNA, 23 bp, Homo sapiens
agtttattttttctacacagtaa

SEQ ID NO: 5367421 - DNA, 21 bp, Homo sapiens
agtttatttttttgatggcta

SEQ ID NO: 5367422 - DNA, 23 bp, Homo sapiens
agtttattttttttcttccaaca

SEQ ID NO: 5367423 - DNA, 21 bp, Homo sapiens
agtttcaaaaatctgaagatt

SEQ ID NO: 5367424 - DNA, 14 bp, Homo sapiens
agtttcaaaatgtt

SEQ ID NO: 5367425 - DNA, 16 bp, Homo sapiens
agtttcaaaatgttaa

SEQ ID NO: 5367426 - DNA, 15 bp, Homo sapiens
agtttcaaagtgtct

SEQ ID NO: 5367427 - DNA, 14 bp, Homo sapiens
agtttcaaatctgt

SEQ ID NO: 5367428 - DNA, 17 bp, Homo sapiens
agtttcaaatctgtaat

SEQ ID NO: 5367429 - DNA, 14 bp, Homo sapiens
agtttcaacatgaa

SEQ ID NO: 5367430 - DNA, 15 bp, Homo sapiens
agtttcaagttttaa

SEQ ID NO: 5367431 - DNA, 15 bp, Homo sapiens
agtttcaataaagtt

SEQ ID NO: 5367432 - DNA, 18 bp, Homo sapiens
agtttcaataaagtttga

SEQ ID NO: 5367433 - DNA, 14 bp, Homo sapiens
agtttcaatgtgat

SEQ ID NO: 5367434 - DNA, 22 bp, Homo sapiens
agtttcaatgtgattctaatgt

SEQ ID NO: 5367435 - DNA, 17 bp, Homo sapiens
agtttcacaacagattt

SEQ ID NO: 5367436 - DNA, 22 bp, Homo sapiens
agtttcacaacagatttctaag

SEQ ID NO: 5367437 - DNA, 23 bp, Homo sapiens
agtttcacaacagatttctaagt

SEQ ID NO: 5367438 - DNA, 22 bp, Homo sapiens
agtttcacagaaaataaggcac

SEQ ID NO: 5367439 - DNA, 23 bp, Homo sapiens
agtttcacaggtcaataaactta

SEQ ID NO: 5367440 - DNA, 17 bp, Homo sapiens
agtttcaccactcctct

SEQ ID NO: 5367441 - DNA, 18 bp, Homo sapiens
agtttcacgtaaatattc

SEQ ID NO: 5367442 - DNA, 18 bp, Homo sapiens
agtttcactgtactgcat

SEQ ID NO: 5367443 - DNA, 17 bp, Homo sapiens
agtttcagaaattctca

SEQ ID NO: 5367444 - DNA, 20 bp, Homo sapiens
agtttcagaagcaggcaggg

SEQ ID NO: 5367445 - DNA, 21 bp, Homo sapiens
agtttcagaagcaggcagggc

SEQ ID NO: 5367446 - DNA, 13 bp, Homo sapiens
agtttcagaataa

SEQ ID NO: 5367447 - DNA, 14 bp, Homo sapiens
agtttcagacaggg

SEQ ID NO: 5367448 - DNA, 18 bp, Homo sapiens
agtttcagagaagttctg

SEQ ID NO: 5367449 - DNA, 17 bp, Homo sapiens
agtttcagagaccttaa

SEQ ID NO: 5367450 - DNA, 13 bp, Homo sapiens
agtttcagagatg

SEQ ID NO: 5367451 - DNA, 17 bp, Homo sapiens
agtttcagagtatattg

SEQ ID NO: 5367452 - DNA, 15 bp, Homo sapiens
agtttcagctggaaa

SEQ ID NO: 5367453 - DNA, 21 bp, Homo sapiens
agtttcagcttaaaataaaca

SEQ ID NO: 5367454 - DNA, 15 bp, Homo sapiens
agtttcagctttctt

SEQ ID NO: 5367455 - DNA, 19 bp, Homo sapiens
agtttcaggagattgttaa

SEQ ID NO: 5367456 - DNA, 20 bp, Homo sapiens
agtttcaggatacatgtgcc

SEQ ID NO: 5367457 - DNA, 12 bp, Homo sapiens
agtttcaggcaa

SEQ ID NO: 5367458 - DNA, 18 bp, Homo sapiens
agtttcaggtgacatgtg

SEQ ID NO: 5367459 - DNA, 21 bp, Homo sapiens
agtttcaggtgacatgtgaaa

SEQ ID NO: 5367460 - DNA, 21 bp, Homo sapiens
agtttcagtaaataatgaaaa

SEQ ID NO: 5367461 - DNA, 19 bp, Homo sapiens
agtttcagtaatagctgaa

SEQ ID NO: 5367462 - DNA, 20 bp, Homo sapiens
agtttcagtattagatgcac

SEQ ID NO: 5367463 - DNA, 22 bp, Homo sapiens
agtttcagtattagatgcactt

SEQ ID NO: 5367464 - DNA, 19 bp, Homo sapiens
agtttcatgagatgcagta

SEQ ID NO: 5367465 - DNA, 13 bp, Homo sapiens
agtttcatttatg

SEQ ID NO: 5367466 - DNA, 22 bp, Homo sapiens
agtttcatttttcattttctct

SEQ ID NO: 5367467 - DNA, 15 bp, Homo sapiens
agtttccaaaaccag

SEQ ID NO: 5367468 - DNA, 22 bp, Homo sapiens
agtttccaaagggcagtaaagt

SEQ ID NO: 5367469 - DNA, 15 bp, Homo sapiens
agtttccaacagagg

SEQ ID NO: 5367470 - DNA, 14 bp, Homo sapiens
agtttccaagaaat

SEQ ID NO: 5367471 - DNA, 22 bp, Homo sapiens
agtttccaagcaaatgttacat

SEQ ID NO: 5367472 - DNA, 18 bp, Homo sapiens
agtttccaattatttgac

SEQ ID NO: 5367473 - DNA, 17 bp, Homo sapiens
agtttccaattccactg

SEQ ID NO: 5367474 - DNA, 20 bp, Homo sapiens
agtttccatagcaacaggaa

SEQ ID NO: 5367475 - DNA, 14 bp, Homo sapiens
agtttccatttgga

SEQ ID NO: 5367476 - DNA, 11 bp, Homo sapiens
agtttcccaga

SEQ ID NO: 5367477 - DNA, 14 bp, Homo sapiens
agtttcccctctca

SEQ ID NO: 5367478 - DNA, 14 bp, Homo sapiens
agtttcccctctgg

SEQ ID NO: 5367479 - DNA, 15 bp, Homo sapiens
agtttcccctctggc

SEQ ID NO: 5367480 - DNA, 16 bp, Homo sapiens
agtttcccttcctcca

SEQ ID NO: 5367481 - DNA, 16 bp, Homo sapiens
agtttccgcggcggct

SEQ ID NO: 5367482 - DNA, 22 bp, Homo sapiens
agtttccgtttccaggtgttta

SEQ ID NO: 5367483 - DNA, 18 bp, Homo sapiens
agtttcctatgactaatt

SEQ ID NO: 5367484 - DNA, 20 bp, Homo sapiens
agtttcctcaggctgctgga

SEQ ID NO: 5367485 - DNA, 14 bp, Homo sapiens
agtttcctcagtga

SEQ ID NO: 5367486 - DNA, 18 bp, Homo sapiens
agtttcctcatctgcaga

SEQ ID NO: 5367487 - DNA, 19 bp, Homo sapiens
agtttccttccagcccaga

SEQ ID NO: 5367488 - DNA, 18 bp, Homo sapiens
agtttccttccctaccca

SEQ ID NO: 5367489 - DNA, 17 bp, Homo sapiens
agtttccttggctggtg

SEQ ID NO: 5367490 - DNA, 19 bp, Homo sapiens
agtttccttggctggtgca

SEQ ID NO: 5367491 - DNA, 14 bp, Homo sapiens
agtttcctttaaat

SEQ ID NO: 5367492 - DNA, 19 bp, Homo sapiens
agtttcgtctaatgggggc

SEQ ID NO: 5367493 - DNA, 16 bp, Homo sapiens
agtttcgttttcaaaa

SEQ ID NO: 5367494 - DNA, 13 bp, Homo sapiens
agtttctaaaatt

SEQ ID NO: 5367495 - DNA, 21 bp, Homo sapiens
agtttctaaaccatgaaaagt

SEQ ID NO: 5367496 - DNA, 20 bp, Homo sapiens
agtttctaaactggagactg

SEQ ID NO: 5367497 - DNA, 15 bp, Homo sapiens
agtttctaagattct

SEQ ID NO: 5367498 - DNA, 17 bp, Homo sapiens
agtttctaagattctaa

SEQ ID NO: 5367499 - DNA, 19 bp, Homo sapiens
agtttctaagattctaaag

SEQ ID NO: 5367500 - DNA, 11 bp, Homo sapiens
agtttctaagg

SEQ ID NO: 5367501 - DNA, 15 bp, Homo sapiens
agtttctaagtctgt

SEQ ID NO: 5367502 - DNA, 17 bp, Homo sapiens
agtttctaagtctgtta

SEQ ID NO: 5367503 - DNA, 19 bp, Homo sapiens
agtttctaagtctgttatt

SEQ ID NO: 5367504 - DNA, 14 bp, Homo sapiens
agtttctagagggc

SEQ ID NO: 5367505 - DNA, 21 bp, Homo sapiens
agtttctagctagaaatatga

SEQ ID NO: 5367506 - DNA, 18 bp, Homo sapiens
agtttctagtgtcactga

SEQ ID NO: 5367507 - DNA, 16 bp, Homo sapiens
agtttctatggattca

SEQ ID NO: 5367508 - DNA, 12 bp, Homo sapiens
agtttctatttt

SEQ ID NO: 5367509 - DNA, 22 bp, Homo sapiens
agtttctcaaactgagcttcag

SEQ ID NO: 5367510 - DNA, 15 bp, Homo sapiens
agtttctcaagttta

SEQ ID NO: 5367511 - DNA, 17 bp, Homo sapiens
agtttctcaagtttaaa

SEQ ID NO: 5367512 - DNA, 18 bp, Homo sapiens
agtttctcaagtttaaag

SEQ ID NO: 5367513 - DNA, 15 bp, Homo sapiens
agtttctcagaagtc

SEQ ID NO: 5367514 - DNA, 15 bp, Homo sapiens
agtttctcagatcct

SEQ ID NO: 5367515 - DNA, 22 bp, Homo sapiens
agtttctcagatccttgtttca

SEQ ID NO: 5367516 - DNA, 11 bp, Homo sapiens
agtttctcagc

SEQ ID NO: 5367517 - DNA, 15 bp, Homo sapiens
agtttctcagctccc

SEQ ID NO: 5367518 - DNA, 21 bp, Homo sapiens
agtttctcagggtcactgtcc

SEQ ID NO: 5367519 - DNA, 15 bp, Homo sapiens
agtttctccaagcag

SEQ ID NO: 5367520 - DNA, 14 bp, Homo sapiens
agtttctccttgaa

SEQ ID NO: 5367521 - DNA, 17 bp, Homo sapiens
agtttctctagaagctc

SEQ ID NO: 5367522 - DNA, 15 bp, Homo sapiens
agtttctctgccttc

SEQ ID NO: 5367523 - DNA, 19 bp, Homo sapiens
agtttctcttaagctgccc

SEQ ID NO: 5367524 - DNA, 20 bp, Homo sapiens
agtttctcttaagctgccca

SEQ ID NO: 5367525 - DNA, 21 bp, Homo sapiens
agtttctcttaagctgcccaa

SEQ ID NO: 5367526 - DNA, 22 bp, Homo sapiens
agtttctgacaattaacataca

SEQ ID NO: 5367527 - DNA, 20 bp, Homo sapiens
agtttctgacgaaggtccta

SEQ ID NO: 5367528 - DNA, 11 bp, Homo sapiens
agtttctgagt

SEQ ID NO: 5367529 - DNA, 14 bp, Homo sapiens
agtttctgagtttt

SEQ ID NO: 5367530 - DNA, 17 bp, Homo sapiens
agtttctgagttttacc

SEQ ID NO: 5367531 - DNA, 18 bp, Homo sapiens
agtttctgagttttacca

SEQ ID NO: 5367532 - DNA, 20 bp, Homo sapiens
agtttctgagttttaccaaa

SEQ ID NO: 5367533 - DNA, 22 bp, Homo sapiens
agtttctgattcactattagag

SEQ ID NO: 5367534 - DNA, 23 bp, Homo sapiens
agtttctgcaaagtgtatgtgac

SEQ ID NO: 5367535 - DNA, 15 bp, Homo sapiens
agtttctgccgcagc

SEQ ID NO: 5367536 - DNA, 16 bp, Homo sapiens
agtttctggccctggc

SEQ ID NO: 5367537 - DNA, 18 bp, Homo sapiens
agtttctggctgaaaatg

SEQ ID NO: 5367538 - DNA, 21 bp, Homo sapiens
agtttctggctgaaaatggtg

SEQ ID NO: 5367539 - DNA, 22 bp, Homo sapiens
agtttctggtgccatttctgaa

SEQ ID NO: 5367540 - DNA, 21 bp, Homo sapiens
agtttctgtggttggctggga

SEQ ID NO: 5367541 - DNA, 16 bp, Homo sapiens
agtttctgttctgtgg

SEQ ID NO: 5367542 - DNA, 21 bp, Homo sapiens
agtttctgttctgtggaaagt

SEQ ID NO: 5367543 - DNA, 23 bp, Homo sapiens
agtttctgttctgtggaaagtgt

SEQ ID NO: 5367544 - DNA, 14 bp, Homo sapiens
agtttctgttgaat

SEQ ID NO: 5367545 - DNA, 21 bp, Homo sapiens
agtttctgttgtttcttttat

SEQ ID NO: 5367546 - DNA, 19 bp, Homo sapiens
agtttcttacacactgtct

SEQ ID NO: 5367547 - DNA, 15 bp, Homo sapiens
agtttcttcatgcat

SEQ ID NO: 5367548 - DNA, 12 bp, Homo sapiens
agtttcttcctg

SEQ ID NO: 5367549 - DNA, 21 bp, Homo sapiens
agtttcttctgcgcctcaggc

SEQ ID NO: 5367550 - DNA, 15 bp, Homo sapiens
agtttcttctgtaaa

SEQ ID NO: 5367551 - DNA, 20 bp, Homo sapiens
agtttcttgaagtccagtgt

SEQ ID NO: 5367552 - DNA, 11 bp, Homo sapiens
agtttcttgca

SEQ ID NO: 5367553 - DNA, 19 bp, Homo sapiens
agtttcttgcaagctccag

SEQ ID NO: 5367554 - DNA, 16 bp, Homo sapiens
agtttcttgtgtagat

SEQ ID NO: 5367555 - DNA, 17 bp, Homo sapiens
agtttcttgtgtagatt

SEQ ID NO: 5367556 - DNA, 18 bp, Homo sapiens
agtttcttgtgtagattt

SEQ ID NO: 5367557 - DNA, 23 bp, Homo sapiens
agtttcttgtgtagatttgaaaa

SEQ ID NO: 5367558 - DNA, 14 bp, Homo sapiens
agtttctttagaaa

SEQ ID NO: 5367559 - DNA, 14 bp, Homo sapiens
agtttctttcccca

SEQ ID NO: 5367560 - DNA, 23 bp, Homo sapiens
agtttctttcctgccttcttctt

SEQ ID NO: 5367561 - DNA, 13 bp, Homo sapiens
agtttctttctgt

SEQ ID NO: 5367562 - DNA, 15 bp, Homo sapiens
agtttctttctgtta

SEQ ID NO: 5367563 - DNA, 13 bp, Homo sapiens
agtttctttggga

SEQ ID NO: 5367564 - DNA, 14 bp, Homo sapiens
agtttgaaaaacta

SEQ ID NO: 5367565 - DNA, 15 bp, Homo sapiens
agtttgaaaaactaa

SEQ ID NO: 5367566 - DNA, 21 bp, Homo sapiens
agtttgaaaaactaattgagc

SEQ ID NO: 5367567 - DNA, 17 bp, Homo sapiens
agtttgaaattctgaat

SEQ ID NO: 5367568 - DNA, 19 bp, Homo sapiens
agtttgaaattctgaattt

SEQ ID NO: 5367569 - DNA, 14 bp, Homo sapiens
agtttgaatgttaa

SEQ ID NO: 5367570 - DNA, 15 bp, Homo sapiens
agtttgaatgttaaa

SEQ ID NO: 5367571 - DNA, 21 bp, Homo sapiens
agtttgaatgttaaataaatt

SEQ ID NO: 5367572 - DNA, 14 bp, Homo sapiens
agtttgaatgtttt

SEQ ID NO: 5367573 - DNA, 14 bp, Homo sapiens
agtttgaattcagt

SEQ ID NO: 5367574 - DNA, 16 bp, Homo sapiens
agtttgaattcagtaa

SEQ ID NO: 5367575 - DNA, 13 bp, Homo sapiens
agtttgacattta

SEQ ID NO: 5367576 - DNA, 15 bp, Homo sapiens
agtttgagaccagcc

SEQ ID NO: 5367577 - DNA, 18 bp, Homo sapiens
agtttgagaccagcctgg

SEQ ID NO: 5367578 - DNA, 19 bp, Homo sapiens
agtttgagatcagcctggg

SEQ ID NO: 5367579 - DNA, 14 bp, Homo sapiens
agtttgagctgcct

SEQ ID NO: 5367580 - DNA, 23 bp, Homo sapiens
agtttgagctgccttccctagct

SEQ ID NO: 5367581 - DNA, 19 bp, Homo sapiens
agtttgaggaaatttgcag

SEQ ID NO: 5367582 - DNA, 17 bp, Homo sapiens
agtttgaggggcctgtg

SEQ ID NO: 5367583 - DNA, 20 bp, Homo sapiens
agtttgatacagtattgaaa

SEQ ID NO: 5367584 - DNA, 19 bp, Homo sapiens
agtttgatatgggctttct

SEQ ID NO: 5367585 - DNA, 20 bp, Homo sapiens
agtttgatcagacagcttga

SEQ ID NO: 5367586 - DNA, 21 bp, Homo sapiens
agtttgatcttcctctgctaa

SEQ ID NO: 5367587 - DNA, 23 bp, Homo sapiens
agtttgattaaattcttgcaaag

SEQ ID NO: 5367588 - DNA, 21 bp, Homo sapiens
agtttgattattatgtttatt

SEQ ID NO: 5367589 - DNA, 17 bp, Homo sapiens
agtttgattattcagtg

SEQ ID NO: 5367590 - DNA, 18 bp, Homo sapiens
agtttgattattcagtgt

SEQ ID NO: 5367591 - DNA, 21 bp, Homo sapiens
agtttgcaaataggcagaatg

SEQ ID NO: 5367592 - DNA, 19 bp, Homo sapiens
agtttgcaaatgcaacaaa

SEQ ID NO: 5367593 - DNA, 10 bp, Homo sapiens
agtttgcact

SEQ ID NO: 5367594 - DNA, 20 bp, Homo sapiens
agtttgcactcaaatcttaa

SEQ ID NO: 5367595 - DNA, 22 bp, Homo sapiens
agtttgcactcaaatcttaaga

SEQ ID NO: 5367596 - DNA, 23 bp, Homo sapiens
agtttgcactcaaatcttaagaa

SEQ ID NO: 5367597 - DNA, 20 bp, Homo sapiens
agtttgcagaaaagcacctg

SEQ ID NO: 5367598 - DNA, 22 bp, Homo sapiens
agtttgcagaaaagcacctgcc

SEQ ID NO: 5367599 - DNA, 11 bp, Homo sapiens
agtttgcagtt

SEQ ID NO: 5367600 - DNA, 10 bp, Homo sapiens
agtttgcatg

SEQ ID NO: 5367601 - DNA, 13 bp, Homo sapiens
agtttgccagaag

SEQ ID NO: 5367602 - DNA, 15 bp, Homo sapiens
agtttgccaggagga

SEQ ID NO: 5367603 - DNA, 17 bp, Homo sapiens
agtttgccaggaggaac

SEQ ID NO: 5367604 - DNA, 22 bp, Homo sapiens
agtttgccggatacaaactggt

SEQ ID NO: 5367605 - DNA, 13 bp, Homo sapiens
agtttgcctctgc

SEQ ID NO: 5367606 - DNA, 20 bp, Homo sapiens
agtttgcctgcagtttcttg

SEQ ID NO: 5367607 - DNA, 11 bp, Homo sapiens
agtttgctaaa

SEQ ID NO: 5367608 - DNA, 20 bp, Homo sapiens
agtttgctaagtaaattagt

SEQ ID NO: 5367609 - DNA, 23 bp, Homo sapiens
agtttgctagcagaaatctagaa

SEQ ID NO: 5367610 - DNA, 16 bp, Homo sapiens
agtttgctgaaagata

SEQ ID NO: 5367611 - DNA, 22 bp, Homo sapiens
agtttgctgaaagatatgtata

SEQ ID NO: 5367612 - DNA, 11 bp, Homo sapiens
agtttgcttag

SEQ ID NO: 5367613 - DNA, 15 bp, Homo sapiens
agtttgcttgtttct

SEQ ID NO: 5367614 - DNA, 15 bp, Homo sapiens
agtttgctttgccct

SEQ ID NO: 5367615 - DNA, 23 bp, Homo sapiens
agtttgctttttgcgtacacaga

SEQ ID NO: 5367616 - DNA, 17 bp, Homo sapiens
agtttggaaataaaaat

SEQ ID NO: 5367617 - DNA, 22 bp, Homo sapiens
agtttggaaataaaaatgttct

SEQ ID NO: 5367618 - DNA, 16 bp, Homo sapiens
agtttggaaggtgtcc

SEQ ID NO: 5367619 - DNA, 15 bp, Homo sapiens
agtttggaatgaaga

SEQ ID NO: 5367620 - DNA, 22 bp, Homo sapiens
agtttggagagagcagactggc

SEQ ID NO: 5367621 - DNA, 21 bp, Homo sapiens
agtttggagagtcagatcttt

SEQ ID NO: 5367622 - DNA, 20 bp, Homo sapiens
agtttggagcactagtttga

SEQ ID NO: 5367623 - DNA, 22 bp, Homo sapiens
agtttggagcactagtttgatt

SEQ ID NO: 5367624 - DNA, 12 bp, Homo sapiens
agtttggaggaa

SEQ ID NO: 5367625 - DNA, 17 bp, Homo sapiens
agtttggatatgtaaaa

SEQ ID NO: 5367626 - DNA, 20 bp, Homo sapiens
agtttggatatgtaaaacat

SEQ ID NO: 5367627 - DNA, 16 bp, Homo sapiens
agtttggatatttttg

SEQ ID NO: 5367628 - DNA, 13 bp, Homo sapiens
ataaaaatatata

SEQ ID NO: 5367629 - DNA, 23 bp, Homo sapiens
ataaaaatatatatagtgctata

SEQ ID NO: 5367630 - DNA, 15 bp, Homo sapiens
ataaaaatatatatt

SEQ ID NO: 5367631 - DNA, 21 bp, Homo sapiens
ataaaaatatatgttgaatgt

SEQ ID NO: 5367632 - DNA, 13 bp, Homo sapiens
ataaaaatatgta

SEQ ID NO: 5367633 - DNA, 14 bp, Homo sapiens
ataaaaatattgtg

SEQ ID NO: 5367634 - DNA, 22 bp, Homo sapiens
ataaaaatattgtgttgtgaat

SEQ ID NO: 5367635 - DNA, 16 bp, Homo sapiens
ataaaaatcaaacaac

SEQ ID NO: 5367636 - DNA, 14 bp, Homo sapiens
ataaaaatcacacc

SEQ ID NO: 5367637 - DNA, 14 bp, Homo sapiens
ataaaaatcatata

SEQ ID NO: 5367638 - DNA, 19 bp, Homo sapiens
ataaaaatcatggcaacat

SEQ ID NO: 5367639 - DNA, 13 bp, Homo sapiens
ataaaaatgcatt

SEQ ID NO: 5367640 - DNA, 18 bp, Homo sapiens
ataaaaatggcaaatgca

SEQ ID NO: 5367641 - DNA, 14 bp, Homo sapiens
ataaaaatgtcttg

SEQ ID NO: 5367642 - DNA, 13 bp, Homo sapiens
ataaaaatgtgaa

SEQ ID NO: 5367643 - DNA, 18 bp, Homo sapiens
ataaaaattactgtgtta

SEQ ID NO: 5367644 - DNA, 16 bp, Homo sapiens
ataaaacaactctgat

SEQ ID NO: 5367645 - DNA, 12 bp, Homo sapiens
ataaaacaagcc

SEQ ID NO: 5367646 - DNA, 13 bp, Homo sapiens
ataaaacaagcct

SEQ ID NO: 5367647 - DNA, 15 bp, Homo sapiens
ataaaacagaatatt

SEQ ID NO: 5367648 - DNA, 14 bp, Homo sapiens
ataaaacagctttg

SEQ ID NO: 5367649 - DNA, 12 bp, Homo sapiens
ataaaacaggta

SEQ ID NO: 5367650 - DNA, 11 bp, Homo sapiens
ataaaacagta

SEQ ID NO: 5367651 - DNA, 15 bp, Homo sapiens
ataaaacagtatctc

SEQ ID NO: 5367652 - DNA, 22 bp, Homo sapiens
ataaaacagttggcatgcatcc

SEQ ID NO: 5367653 - DNA, 17 bp, Homo sapiens
ataaaacattaagaaaa

SEQ ID NO: 5367654 - DNA, 18 bp, Homo sapiens
ataaaacattaagaaaat

SEQ ID NO: 5367655 - DNA, 17 bp, Homo sapiens
ataaaacattaattgct

SEQ ID NO: 5367656 - DNA, 13 bp, Homo sapiens
ataaaacattatg

SEQ ID NO: 5367657 - DNA, 13 bp, Homo sapiens
ataaaacatttta

SEQ ID NO: 5367658 - DNA, 13 bp, Homo sapiens
ataaaaccaaaga

SEQ ID NO: 5367659 - DNA, 14 bp, Homo sapiens
ataaaaccaaagaa

SEQ ID NO: 5367660 - DNA, 20 bp, Homo sapiens
ataaaaccaagcctctggaa

SEQ ID NO: 5367661 - DNA, 12 bp, Homo sapiens
ataaaaccagaa

SEQ ID NO: 5367662 - DNA, 17 bp, Homo sapiens
ataaaacccagcatgta

SEQ ID NO: 5367663 - DNA, 20 bp, Homo sapiens
ataaaacgtatagtcaatat

SEQ ID NO: 5367664 - DNA, 12 bp, Homo sapiens
ataaaactattt

SEQ ID NO: 5367665 - DNA, 15 bp, Homo sapiens
ataaaactatttaaa

SEQ ID NO: 5367666 - DNA, 19 bp, Homo sapiens
ataaaactatttattgtgc

SEQ ID NO: 5367667 - DNA, 22 bp, Homo sapiens
ataaaactatttattgtgctgg

SEQ ID NO: 5367668 - DNA, 19 bp, Homo sapiens
ataaaactcactcactgtt

SEQ ID NO: 5367669 - DNA, 20 bp, Homo sapiens
ataaaactccttgaaaccag

SEQ ID NO: 5367670 - DNA, 15 bp, Homo sapiens
ataaaactgaaataa

SEQ ID NO: 5367671 - DNA, 16 bp, Homo sapiens
ataaaactgaaataaa

SEQ ID NO: 5367672 - DNA, 12 bp, Homo sapiens
ataaaactgaat

SEQ ID NO: 5367673 - DNA, 15 bp, Homo sapiens
ataaaactgatgtga

SEQ ID NO: 5367674 - DNA, 12 bp, Homo sapiens
ataaaactgcac

SEQ ID NO: 5367675 - DNA, 15 bp, Homo sapiens
ataaaactgtgacta

SEQ ID NO: 5367676 - DNA, 21 bp, Homo sapiens
ataaaactgtgactaggcata

SEQ ID NO: 5367677 - DNA, 15 bp, Homo sapiens
ataaaactgtgtaaa

SEQ ID NO: 5367678 - DNA, 23 bp, Homo sapiens
ataaaactgtttgacttctcaag

SEQ ID NO: 5367679 - DNA, 21 bp, Homo sapiens
ataaaactgtttttgaacctg

SEQ ID NO: 5367680 - DNA, 19 bp, Homo sapiens
ataaaacttatgctagttt

SEQ ID NO: 5367681 - DNA, 15 bp, Homo sapiens
ataaaactttaaaag

SEQ ID NO: 5367682 - DNA, 16 bp, Homo sapiens
ataaaactttaaaagg

SEQ ID NO: 5367683 - DNA, 18 bp, Homo sapiens
ataaaactttaaaaggca

SEQ ID NO: 5367684 - DNA, 19 bp, Homo sapiens
ataaaactttaaaaggcaa

SEQ ID NO: 5367685 - DNA, 20 bp, Homo sapiens
ataaaactttaaaaggcaac

SEQ ID NO: 5367686 - DNA, 15 bp, Homo sapiens
ataaaactttttaaa

SEQ ID NO: 5367687 - DNA, 14 bp, Homo sapiens
ataaaagaaaatta

SEQ ID NO: 5367688 - DNA, 12 bp, Homo sapiens
ataaaagaaaga

SEQ ID NO: 5367689 - DNA, 13 bp, Homo sapiens
ataaaagaaatat

SEQ ID NO: 5367690 - DNA, 22 bp, Homo sapiens
ataaaagaaatgcacaatgtct

SEQ ID NO: 5367691 - DNA, 13 bp, Homo sapiens
ataaaagaacatg

SEQ ID NO: 5367692 - DNA, 16 bp, Homo sapiens
ataaaagaacatgctt

SEQ ID NO: 5367693 - DNA, 17 bp, Homo sapiens
ataaaagaacatgcttg

SEQ ID NO: 5367694 - DNA, 13 bp, Homo sapiens
ataaaagaatctg

SEQ ID NO: 5367695 - DNA, 12 bp, Homo sapiens
ataaaagacaca

SEQ ID NO: 5367696 - DNA, 16 bp, Homo sapiens
ataaaagacagtgaaa

SEQ ID NO: 5367697 - DNA, 21 bp, Homo sapiens
ataaaagagctgtctgactgc

SEQ ID NO: 5367698 - DNA, 13 bp, Homo sapiens
ataaaagagcttt

SEQ ID NO: 5367699 - DNA, 13 bp, Homo sapiens
ataaaagataaaa

SEQ ID NO: 5367700 - DNA, 14 bp, Homo sapiens
ataaaagatatgtt

SEQ ID NO: 5367701 - DNA, 10 bp, Homo sapiens
ataaaagatg

SEQ ID NO: 5367702 - DNA, 17 bp, Homo sapiens
ataaaagcaaaagagaa

SEQ ID NO: 5367703 - DNA, 17 bp, Homo sapiens
ataaaagcaattccaac

SEQ ID NO: 5367704 - DNA, 19 bp, Homo sapiens
ataaaagcaattccaacct

SEQ ID NO: 5367705 - DNA, 23 bp, Homo sapiens
ataaaagcaccactgttctgttc

SEQ ID NO: 5367706 - DNA, 16 bp, Homo sapiens
ataaaagcagcatctg

SEQ ID NO: 5367707 - DNA, 13 bp, Homo sapiens
ataaaagcattgt

SEQ ID NO: 5367708 - DNA, 13 bp, Homo sapiens
ataaaagcccagg

SEQ ID NO: 5367709 - DNA, 14 bp, Homo sapiens
ataaaagccgccca

SEQ ID NO: 5367710 - DNA, 18 bp, Homo sapiens
ataaaagcctgtttaaga

SEQ ID NO: 5367711 - DNA, 12 bp, Homo sapiens
ataaaagccttg

SEQ ID NO: 5367712 - DNA, 19 bp, Homo sapiens
ataaaagcctttgaaaata

SEQ ID NO: 5367713 - DNA, 15 bp, Homo sapiens
ataaaagctatggtg

SEQ ID NO: 5367714 - DNA, 18 bp, Homo sapiens
ataaaagctcagatgaca

SEQ ID NO: 5367715 - DNA, 19 bp, Homo sapiens
ataaaagctcagatgacat

SEQ ID NO: 5367716 - DNA, 19 bp, Homo sapiens
ataaaagcttaggctgata

SEQ ID NO: 5367717 - DNA, 12 bp, Homo sapiens
ataaaaggaaaa

SEQ ID NO: 5367718 - DNA, 12 bp, Homo sapiens
ataaaaggaagg

SEQ ID NO: 5367719 - DNA, 17 bp, Homo sapiens
ataaaaggaatctggca

SEQ ID NO: 5367720 - DNA, 19 bp, Homo sapiens
ataaaaggatgttacaagt

SEQ ID NO: 5367721 - DNA, 20 bp, Homo sapiens
ataaaaggcttgaagctgtg

SEQ ID NO: 5367722 - DNA, 21 bp, Homo sapiens
ataaaagggtcaaacctgtag

SEQ ID NO: 5367723 - DNA, 20 bp, Homo sapiens
ataaaaggtcggaccagctt

SEQ ID NO: 5367724 - DNA, 20 bp, Homo sapiens
ataaaaggtggagtttctct

SEQ ID NO: 5367725 - DNA, 12 bp, Homo sapiens
ataaaaggttgc

SEQ ID NO: 5367726 - DNA, 17 bp, Homo sapiens
ataaaaggttgtgtaca

SEQ ID NO: 5367727 - DNA, 22 bp, Homo sapiens
ataaaagtagcaaccttcattt

SEQ ID NO: 5367728 - DNA, 13 bp, Homo sapiens
ataaaagtatgaa

SEQ ID NO: 5367729 - DNA, 15 bp, Homo sapiens
ataaaagtatgaatc

SEQ ID NO: 5367730 - DNA, 19 bp, Homo sapiens
ataaaagtctgagttctct

SEQ ID NO: 5367731 - DNA, 15 bp, Homo sapiens
ataaaagtgaagtga

SEQ ID NO: 5367732 - DNA, 13 bp, Homo sapiens
ataaaagtgactc

SEQ ID NO: 5367733 - DNA, 13 bp, Homo sapiens
ataaaagttaaca

SEQ ID NO: 5367734 - DNA, 16 bp, Homo sapiens
ataaaagttgcaaagg

SEQ ID NO: 5367735 - DNA, 13 bp, Homo sapiens
ataaaagttgtac

SEQ ID NO: 5367736 - DNA, 19 bp, Homo sapiens
ataaaagttttacaaaggg

SEQ ID NO: 5367737 - DNA, 12 bp, Homo sapiens
ataaaataaact

SEQ ID NO: 5367738 - DNA, 14 bp, Homo sapiens
ataaaataaataat

SEQ ID NO: 5367739 - DNA, 14 bp, Homo sapiens
ataaaataaatata

SEQ ID NO: 5367740 - DNA, 17 bp, Homo sapiens
ataaaataaatatacta

SEQ ID NO: 5367741 - DNA, 23 bp, Homo sapiens
ataaaataaatatactaataaaa

SEQ ID NO: 5367742 - DNA, 16 bp, Homo sapiens
ataaaataaatatata

SEQ ID NO: 5367743 - DNA, 21 bp, Homo sapiens
ataaaataaatatatataaac

SEQ ID NO: 5367744 - DNA, 13 bp, Homo sapiens
ataaaataactaa

SEQ ID NO: 5367745 - DNA, 18 bp, Homo sapiens
ataaaataacttgcatct

SEQ ID NO: 5367746 - DNA, 23 bp, Homo sapiens
ataaaataagaagggggagtgaa

SEQ ID NO: 5367747 - DNA, 15 bp, Homo sapiens
ataaaataatgcttt

SEQ ID NO: 5367748 - DNA, 16 bp, Homo sapiens
ataaaataattctaaa

SEQ ID NO: 5367749 - DNA, 18 bp, Homo sapiens
ataaaataattctaaagg

SEQ ID NO: 5367750 - DNA, 12 bp, Homo sapiens
ataaaataattt

SEQ ID NO: 5367751 - DNA, 16 bp, Homo sapiens
ataaaataatttttat

SEQ ID NO: 5367752 - DNA, 15 bp, Homo sapiens
ataaaatacacgtgt

SEQ ID NO: 5367753 - DNA, 18 bp, Homo sapiens
ataaaatacatagtgaaa

SEQ ID NO: 5367754 - DNA, 14 bp, Homo sapiens
ataaaatacatatt

SEQ ID NO: 5367755 - DNA, 19 bp, Homo sapiens
ataaaatactttttatcac

SEQ ID NO: 5367756 - DNA, 22 bp, Homo sapiens
ataaaatagatataaattttta

SEQ ID NO: 5367757 - DNA, 12 bp, Homo sapiens
ataaaatagtat

SEQ ID NO: 5367758 - DNA, 18 bp, Homo sapiens
ataaaatagttgtccata

SEQ ID NO: 5367759 - DNA, 21 bp, Homo sapiens
ataaaatataaaactgaaata

SEQ ID NO: 5367760 - DNA, 15 bp, Homo sapiens
ataaaatatcctcag

SEQ ID NO: 5367761 - DNA, 18 bp, Homo sapiens
ataaaatattattgaact

SEQ ID NO: 5367762 - DNA, 18 bp, Homo sapiens
ataaaatattcactctcc

SEQ ID NO: 5367763 - DNA, 14 bp, Homo sapiens
ataaaatattttct

SEQ ID NO: 5367764 - DNA, 16 bp, Homo sapiens
ataaaatattttctgt

SEQ ID NO: 5367765 - DNA, 21 bp, Homo sapiens
ataaaatattttctgtgtgtt

SEQ ID NO: 5367766 - DNA, 11 bp, Homo sapiens
ataaaatcaaa

SEQ ID NO: 5367767 - DNA, 16 bp, Homo sapiens
ataaaatcaagtttta

SEQ ID NO: 5367768 - DNA, 20 bp, Homo sapiens
ataaaatcaatttttaggaa

SEQ ID NO: 5367769 - DNA, 16 bp, Homo sapiens
ataaaatcagccaatt

SEQ ID NO: 5367770 - DNA, 23 bp, Homo sapiens
ataaaatcagccaattatgttaa

SEQ ID NO: 5367771 - DNA, 12 bp, Homo sapiens
ataaaatcataa

SEQ ID NO: 5367772 - DNA, 18 bp, Homo sapiens
ataaaatcatgtacattt

SEQ ID NO: 5367773 - DNA, 18 bp, Homo sapiens
ataaaatccatacatttg

SEQ ID NO: 5367774 - DNA, 20 bp, Homo sapiens
ataaaatcctaagacacaaa

SEQ ID NO: 5367775 - DNA, 16 bp, Homo sapiens
ataaaatcctgtgcaa

SEQ ID NO: 5367776 - DNA, 13 bp, Homo sapiens
ataaaatctgaat

SEQ ID NO: 5367777 - DNA, 23 bp, Homo sapiens
ataaaatctgaattttgcaatgt

SEQ ID NO: 5367778 - DNA, 23 bp, Homo sapiens
ataaaatcttcaactaatttttg

SEQ ID NO: 5367779 - DNA, 16 bp, Homo sapiens
ataaaatcttggcgag

SEQ ID NO: 5367780 - DNA, 19 bp, Homo sapiens
ataaaatctttccatctca

SEQ ID NO: 5367781 - DNA, 13 bp, Homo sapiens
ataaaatgaaaaa

SEQ ID NO: 5367782 - DNA, 13 bp, Homo sapiens
ataaaatgaaaga

SEQ ID NO: 5367783 - DNA, 17 bp, Homo sapiens
ataaaatgaaagatttt

SEQ ID NO: 5367784 - DNA, 16 bp, Homo sapiens
ataaaatgaaatgcta

SEQ ID NO: 5367785 - DNA, 14 bp, Homo sapiens
ataaaatgaacatc

SEQ ID NO: 5367786 - DNA, 18 bp, Homo sapiens
ataaaatgaacatctctt

SEQ ID NO: 5367787 - DNA, 12 bp, Homo sapiens
ataaaatgacta

SEQ ID NO: 5367788 - DNA, 15 bp, Homo sapiens
ataaaatgactactt

SEQ ID NO: 5367789 - DNA, 18 bp, Homo sapiens
ataaaatgagttacctca

SEQ ID NO: 5367790 - DNA, 12 bp, Homo sapiens
ataaaatgatgt

SEQ ID NO: 5367791 - DNA, 15 bp, Homo sapiens
ataaaatgatgtatg

SEQ ID NO: 5367792 - DNA, 18 bp, Homo sapiens
ataaaatgatgttataca

SEQ ID NO: 5367793 - DNA, 17 bp, Homo sapiens
ataaaatgcactgacca

SEQ ID NO: 5367794 - DNA, 15 bp, Homo sapiens
ataaaatgcatttaa

SEQ ID NO: 5367795 - DNA, 11 bp, Homo sapiens
ataaaatgcta

SEQ ID NO: 5367796 - DNA, 13 bp, Homo sapiens
ataaaatgctatt

SEQ ID NO: 5367797 - DNA, 14 bp, Homo sapiens
ataaaatggaaagg

SEQ ID NO: 5367798 - DNA, 21 bp, Homo sapiens
ataaaatggacacaaattttc

SEQ ID NO: 5367799 - DNA, 17 bp, Homo sapiens
ataaaatggatagaaaa

SEQ ID NO: 5367800 - DNA, 23 bp, Homo sapiens
ataaaatggatagaaaaaaacta

SEQ ID NO: 5367801 - DNA, 14 bp, Homo sapiens
ataaaatggcacct

SEQ ID NO: 5367802 - DNA, 17 bp, Homo sapiens
ataaaatggcaccttcc

SEQ ID NO: 5367803 - DNA, 21 bp, Homo sapiens
ataaaatgggaattctgactt

SEQ ID NO: 5367804 - DNA, 15 bp, Homo sapiens
ataaaatggtgaaag

SEQ ID NO: 5367805 - DNA, 11 bp, Homo sapiens
ataaaatgtac

SEQ ID NO: 5367806 - DNA, 15 bp, Homo sapiens
ataaaatgtcttcaa

SEQ ID NO: 5367807 - DNA, 11 bp, Homo sapiens
ataaaatgtgc

SEQ ID NO: 5367808 - DNA, 13 bp, Homo sapiens
ataaaatgtgtac

SEQ ID NO: 5367809 - DNA, 21 bp, Homo sapiens
ataaaatgtttacattttctt

SEQ ID NO: 5367810 - DNA, 15 bp, Homo sapiens
ataaaattaaagaaa

SEQ ID NO: 5367811 - DNA, 15 bp, Homo sapiens
ataaaattaaatgcc

SEQ ID NO: 5367812 - DNA, 16 bp, Homo sapiens
ataaaattacaaaaga

SEQ ID NO: 5367813 - DNA, 19 bp, Homo sapiens
ataaaattacaaaagagca

SEQ ID NO: 5367814 - DNA, 12 bp, Homo sapiens
ataaaattacag

SEQ ID NO: 5367815 - DNA, 13 bp, Homo sapiens
ataaaattagaaa

SEQ ID NO: 5367816 - DNA, 20 bp, Homo sapiens
ataaaattatagatgggaat

SEQ ID NO: 5367817 - DNA, 23 bp, Homo sapiens
ataaaattatagatgggaatgaa

SEQ ID NO: 5367818 - DNA, 21 bp, Homo sapiens
ataaaattatagctctaatgt

SEQ ID NO: 5367819 - DNA, 16 bp, Homo sapiens
ataaaattatggtgaa

SEQ ID NO: 5367820 - DNA, 16 bp, Homo sapiens
ataaaattcattccat

SEQ ID NO: 5367821 - DNA, 17 bp, Homo sapiens
ataaaattcattccatt

SEQ ID NO: 5367822 - DNA, 18 bp, Homo sapiens
ataaaattcattccattt

SEQ ID NO: 5367823 - DNA, 16 bp, Homo sapiens
ataaaattcatttcta

SEQ ID NO: 5367824 - DNA, 15 bp, Homo sapiens
ataaaattcctatct

SEQ ID NO: 5367825 - DNA, 16 bp, Homo sapiens
ataaaattcctatctc

SEQ ID NO: 5367826 - DNA, 19 bp, Homo sapiens
ataaaattcgctttctaaa

SEQ ID NO: 5367827 - DNA, 20 bp, Homo sapiens
ataaaattgcagtttcatgt

SEQ ID NO: 5367828 - DNA, 16 bp, Homo sapiens
ataaaattgcctctct

SEQ ID NO: 5367829 - DNA, 18 bp, Homo sapiens
ataaaattgctataaatc

SEQ ID NO: 5367830 - DNA, 11 bp, Homo sapiens
ataaaattgga

SEQ ID NO: 5367831 - DNA, 23 bp, Homo sapiens
ataaaattgtaaaattgtataga

SEQ ID NO: 5367832 - DNA, 16 bp, Homo sapiens
ataaaatttaaaaaac

SEQ ID NO: 5367833 - DNA, 13 bp, Homo sapiens
ataaaattttcaa

SEQ ID NO: 5367834 - DNA, 12 bp, Homo sapiens
ataaaattttct

SEQ ID NO: 5367835 - DNA, 20 bp, Homo sapiens
ataaaatttttaatctttaa

SEQ ID NO: 5367836 - DNA, 17 bp, Homo sapiens
ataaaatttttatgtaa

SEQ ID NO: 5367837 - DNA, 23 bp, Homo sapiens
ataaaatttttatgtaattatat

SEQ ID NO: 5367838 - DNA, 15 bp, Homo sapiens
ataaacaaacaaaca

SEQ ID NO: 5367839 - DNA, 13 bp, Homo sapiens
ataaacaaagaca

SEQ ID NO: 5367840 - DNA, 22 bp, Homo sapiens
ataaacaaagacattgacagca

SEQ ID NO: 5367841 - DNA, 11 bp, Homo sapiens
ataaacaaatg

SEQ ID NO: 5367842 - DNA, 19 bp, Homo sapiens
ataaacaaatgaattgtat

SEQ ID NO: 5367843 - DNA, 18 bp, Homo sapiens
ataaacaaattagcaatc

SEQ ID NO: 5367844 - DNA, 16 bp, Homo sapiens
ataaacaacttaatgt

SEQ ID NO: 5367845 - DNA, 19 bp, Homo sapiens
ataaacaacttaatgttct

SEQ ID NO: 5367846 - DNA, 13 bp, Homo sapiens
ataaacaagaaaa

SEQ ID NO: 5367847 - DNA, 16 bp, Homo sapiens
ataaacaagaaaaata

SEQ ID NO: 5367848 - DNA, 22 bp, Homo sapiens
ataaacaagaaaaataaagaaa

SEQ ID NO: 5367849 - DNA, 14 bp, Homo sapiens
ataaacaagaatga

SEQ ID NO: 5367850 - DNA, 14 bp, Homo sapiens
ataaacaatccaaa

SEQ ID NO: 5367851 - DNA, 14 bp, Homo sapiens
ataaacaatgatgc

SEQ ID NO: 5367852 - DNA, 22 bp, Homo sapiens
ataaacaattcatgcctttcat

SEQ ID NO: 5367853 - DNA, 22 bp, Homo sapiens
ataaacacaaaatccattccag

SEQ ID NO: 5367854 - DNA, 16 bp, Homo sapiens
ataaacacaactgact

SEQ ID NO: 5367855 - DNA, 18 bp, Homo sapiens
ataaacacagattatttg

SEQ ID NO: 5367856 - DNA, 17 bp, Homo sapiens
ataaacacaggcaggta

SEQ ID NO: 5367857 - DNA, 14 bp, Homo sapiens
ataaacacagtaag

SEQ ID NO: 5367858 - DNA, 20 bp, Homo sapiens
ataaacacatagattcacct

SEQ ID NO: 5367859 - DNA, 22 bp, Homo sapiens
ataaacacatcacagatgaata

SEQ ID NO: 5367860 - DNA, 19 bp, Homo sapiens
ataaacacattaaaagaca

SEQ ID NO: 5367861 - DNA, 17 bp, Homo sapiens
ataaacacccatgaatc

SEQ ID NO: 5367862 - DNA, 21 bp, Homo sapiens
ataaacactccacagtgttta

SEQ ID NO: 5367863 - DNA, 18 bp, Homo sapiens
ataaacactcttgaaaaa

SEQ ID NO: 5367864 - DNA, 22 bp, Homo sapiens
ataaacactgcctatatatgta

SEQ ID NO: 5367865 - DNA, 11 bp, Homo sapiens
ataaacactgg

SEQ ID NO: 5367866 - DNA, 16 bp, Homo sapiens
ataaacactggctctg

SEQ ID NO: 5367867 - DNA, 12 bp, Homo sapiens
ataaacactggt

SEQ ID NO: 5367868 - DNA, 18 bp, Homo sapiens
ataaacactggtgccaac

SEQ ID NO: 5367869 - DNA, 12 bp, Homo sapiens
ataaacactgtg

SEQ ID NO: 5367870 - DNA, 21 bp, Homo sapiens
ataaacactgttttatagaaa

SEQ ID NO: 5367871 - DNA, 19 bp, Homo sapiens
ataaacacttctccttaac

SEQ ID NO: 5367872 - DNA, 15 bp, Homo sapiens
ataaacactttttct

SEQ ID NO: 5367873 - DNA, 22 bp, Homo sapiens
ataaacagaactccactgcaag

SEQ ID NO: 5367874 - DNA, 14 bp, Homo sapiens
ataaacagacaaat

SEQ ID NO: 5367875 - DNA, 19 bp, Homo sapiens
ataaacagataatgctttt

SEQ ID NO: 5367876 - DNA, 14 bp, Homo sapiens
ataaacagatgtat

SEQ ID NO: 5367877 - DNA, 13 bp, Homo sapiens
ataaacagcaggg

SEQ ID NO: 5367878 - DNA, 17 bp, Homo sapiens
ataaacaggaattttat

SEQ ID NO: 5367879 - DNA, 18 bp, Homo sapiens
ataaacaggaattttatt

SEQ ID NO: 5367880 - DNA, 20 bp, Homo sapiens
ataaacaggaattttatttt

SEQ ID NO: 5367881 - DNA, 16 bp, Homo sapiens
ataaacagtcactgga

SEQ ID NO: 5367882 - DNA, 21 bp, Homo sapiens
ataaacagtgagcatatctgg

SEQ ID NO: 5367883 - DNA, 13 bp, Homo sapiens
ataaacagttgtt

SEQ ID NO: 5367884 - DNA, 14 bp, Homo sapiens
ataaacagttgtta

SEQ ID NO: 5367885 - DNA, 12 bp, Homo sapiens
ataaacagtttt

SEQ ID NO: 5367886 - DNA, 22 bp, Homo sapiens
ataaacagttttacttgtgtca

SEQ ID NO: 5367887 - DNA, 12 bp, Homo sapiens
ataaacataatt

SEQ ID NO: 5367888 - DNA, 22 bp, Homo sapiens
ataaacatacgtgtgcatgtgt

SEQ ID NO: 5367889 - DNA, 18 bp, Homo sapiens
ataaacatatacagaaaa

SEQ ID NO: 5367890 - DNA, 15 bp, Homo sapiens
ataaacatatgcaaa

SEQ ID NO: 5367891 - DNA, 20 bp, Homo sapiens
ataaacatatttttatactt

SEQ ID NO: 5367892 - DNA, 16 bp, Homo sapiens
ataaacatcacacaca

SEQ ID NO: 5367893 - DNA, 21 bp, Homo sapiens
ataaacatccttcaagaactc

SEQ ID NO: 5367894 - DNA, 15 bp, Homo sapiens
ataaacatctgtgtc

SEQ ID NO: 5367895 - DNA, 16 bp, Homo sapiens
ataaacatctgtgtct

SEQ ID NO: 5367896 - DNA, 15 bp, Homo sapiens
ataaacatgaccctg

SEQ ID NO: 5367897 - DNA, 18 bp, Homo sapiens
ataaacatgtccccttcc

SEQ ID NO: 5367898 - DNA, 17 bp, Homo sapiens
ataaacatgtgccctca

SEQ ID NO: 5367899 - DNA, 18 bp, Homo sapiens
ataaacattaaacactgt

SEQ ID NO: 5367900 - DNA, 17 bp, Homo sapiens
ataaacattaaatgtct

SEQ ID NO: 5367901 - DNA, 14 bp, Homo sapiens
ataaacattaattt

SEQ ID NO: 5367902 - DNA, 13 bp, Homo sapiens
ataaacatttgag

SEQ ID NO: 5367903 - DNA, 16 bp, Homo sapiens
ataaacatttgccaaa

SEQ ID NO: 5367904 - DNA, 15 bp, Homo sapiens
ataaacattttattt

SEQ ID NO: 5367905 - DNA, 13 bp, Homo sapiens
ataaaccaaaaac

SEQ ID NO: 5367906 - DNA, 19 bp, Homo sapiens
ataaaccaaaaacatttga

SEQ ID NO: 5367907 - DNA, 13 bp, Homo sapiens
ataaaccaaagga

SEQ ID NO: 5367908 - DNA, 21 bp, Homo sapiens
ataaaccaaaggacattatgt

SEQ ID NO: 5367909 - DNA, 13 bp, Homo sapiens
ataaaccaaatat

SEQ ID NO: 5367910 - DNA, 15 bp, Homo sapiens
ataaaccaataaatc

SEQ ID NO: 5367911 - DNA, 16 bp, Homo sapiens
ataaaccaatcatctt

SEQ ID NO: 5367912 - DNA, 12 bp, Homo sapiens
ataaaccaatct

SEQ ID NO: 5367913 - DNA, 14 bp, Homo sapiens
ataaaccaatgaaa

SEQ ID NO: 5367914 - DNA, 17 bp, Homo sapiens
ataaaccaatgaacgaa

SEQ ID NO: 5367915 - DNA, 20 bp, Homo sapiens
ataaaccagctacttgatgt

SEQ ID NO: 5367916 - DNA, 21 bp, Homo sapiens
ataaaccaggtttagacagta

SEQ ID NO: 5367917 - DNA, 10 bp, Homo sapiens
ataaaccagt

SEQ ID NO: 5367918 - DNA, 15 bp, Homo sapiens
ataaaccagtgtgaa

SEQ ID NO: 5367919 - DNA, 14 bp, Homo sapiens
ataaaccattggac

SEQ ID NO: 5367920 - DNA, 20 bp, Homo sapiens
ataaaccatttttgttactc

SEQ ID NO: 5367921 - DNA, 16 bp, Homo sapiens
ataaacccacattctt

SEQ ID NO: 5367922 - DNA, 15 bp, Homo sapiens
ataaacccatctgta

SEQ ID NO: 5367923 - DNA, 18 bp, Homo sapiens
ataaacccatctgtaata

SEQ ID NO: 5367924 - DNA, 19 bp, Homo sapiens
ataaaccggatcctgttgc

SEQ ID NO: 5367925 - DNA, 18 bp, Homo sapiens
ataaaccgtgtatttatt

SEQ ID NO: 5367926 - DNA, 18 bp, Homo sapiens
ataaacctaaaaaagata

SEQ ID NO: 5367927 - DNA, 19 bp, Homo sapiens
ataaacctaaaaaagatat

SEQ ID NO: 5367928 - DNA, 20 bp, Homo sapiens
ataaacctaaaaaagatata

SEQ ID NO: 5367929 - DNA, 15 bp, Homo sapiens
ataaacctaatattc

SEQ ID NO: 5367930 - DNA, 17 bp, Homo sapiens
ataaacctccgccaatg

SEQ ID NO: 5367931 - DNA, 19 bp, Homo sapiens
ataaacctctaatttattt

SEQ ID NO: 5367932 - DNA, 19 bp, Homo sapiens
ataaacctgcactgaaacc

SEQ ID NO: 5367933 - DNA, 20 bp, Homo sapiens
ataaaccttatgaactacag

SEQ ID NO: 5367934 - DNA, 21 bp, Homo sapiens
ataaaccttatgaactacagt

SEQ ID NO: 5367935 - DNA, 23 bp, Homo sapiens
ataaaccttcagaagctattttt

SEQ ID NO: 5367936 - DNA, 22 bp, Homo sapiens
ataaaccttgtctatgaaatga

SEQ ID NO: 5367937 - DNA, 21 bp, Homo sapiens
ataaaccttgtttctttctga

SEQ ID NO: 5367938 - DNA, 12 bp, Homo sapiens
ataaacgaccaa

SEQ ID NO: 5367939 - DNA, 17 bp, Homo sapiens
ataaacgaccaaactca

SEQ ID NO: 5367940 - DNA, 14 bp, Homo sapiens
ataaacgatatatg

SEQ ID NO: 5367941 - DNA, 23 bp, Homo sapiens
ataaacggttcctggtgactcct

SEQ ID NO: 5367942 - DNA, 16 bp, Homo sapiens
ataaacgtcttaaata

SEQ ID NO: 5367943 - DNA, 17 bp, Homo sapiens
ataaacgtgcgcggact

SEQ ID NO: 5367944 - DNA, 22 bp, Homo sapiens
ataaacgtggagaatcacaggc

SEQ ID NO: 5367945 - DNA, 17 bp, Homo sapiens
ataaactaaagaaaaat

SEQ ID NO: 5367946 - DNA, 14 bp, Homo sapiens
ataaactaataatt

SEQ ID NO: 5367947 - DNA, 20 bp, Homo sapiens
ataaactaattttgtacgta

SEQ ID NO: 5367948 - DNA, 21 bp, Homo sapiens
ataaactaccaaattagtgaa

SEQ ID NO: 5367949 - DNA, 17 bp, Homo sapiens
ataaactactctttgat

SEQ ID NO: 5367950 - DNA, 19 bp, Homo sapiens
ataaactactctttgattt

SEQ ID NO: 5367951 - DNA, 14 bp, Homo sapiens
ataaactactgtaa

SEQ ID NO: 5367952 - DNA, 21 bp, Homo sapiens
ataaactactgtaattaagtg

SEQ ID NO: 5367953 - DNA, 13 bp, Homo sapiens
ataaactactttg

SEQ ID NO: 5367954 - DNA, 17 bp, Homo sapiens
ataaactagattacatt

SEQ ID NO: 5367955 - DNA, 15 bp, Homo sapiens
ataaactagtttcca

SEQ ID NO: 5367956 - DNA, 17 bp, Homo sapiens
ataaactagtttccagt

SEQ ID NO: 5367957 - DNA, 22 bp, Homo sapiens
ataaactagtttccagtggatc

SEQ ID NO: 5367958 - DNA, 18 bp, Homo sapiens
ataaactattggaaagta

SEQ ID NO: 5367959 - DNA, 17 bp, Homo sapiens
ataaactatttatatca

SEQ ID NO: 5367960 - DNA, 16 bp, Homo sapiens
ataaactcataaaact

SEQ ID NO: 5367961 - DNA, 18 bp, Homo sapiens
ataaactccttaacttca

SEQ ID NO: 5367962 - DNA, 19 bp, Homo sapiens
ataaactctaagtgtaaaa

SEQ ID NO: 5367963 - DNA, 20 bp, Homo sapiens
ataaactctaagtgtaaaaa

SEQ ID NO: 5367964 - DNA, 12 bp, Homo sapiens
ataaactgaaaa

SEQ ID NO: 5367965 - DNA, 16 bp, Homo sapiens
ataaactgaaaaatgt

SEQ ID NO: 5367966 - DNA, 19 bp, Homo sapiens
ataaactgaaaaatgtcag

SEQ ID NO: 5367967 - DNA, 17 bp, Homo sapiens
ataaactgaatattttg

SEQ ID NO: 5367968 - DNA, 22 bp, Homo sapiens
ataaactgaatattttggaaac

SEQ ID NO: 5367969 - DNA, 22 bp, Homo sapiens
ataaactgactatcataaaatc

SEQ ID NO: 5367970 - DNA, 15 bp, Homo sapiens
ataaactgactttat

SEQ ID NO: 5367971 - DNA, 18 bp, Homo sapiens
ataaactgactttatcct

SEQ ID NO: 5367972 - DNA, 12 bp, Homo sapiens
ataaactgagcc

SEQ ID NO: 5367973 - DNA, 14 bp, Homo sapiens
ataaactgagcctc

SEQ ID NO: 5367974 - DNA, 16 bp, Homo sapiens
ataaactgagcgaccc

SEQ ID NO: 5367975 - DNA, 23 bp, Homo sapiens
ataaactggtatgaataattgca

SEQ ID NO: 5367976 - DNA, 18 bp, Homo sapiens
ataaactgtcaaattttc

SEQ ID NO: 5367977 - DNA, 12 bp, Homo sapiens
ataaactgtgag

SEQ ID NO: 5367978 - DNA, 17 bp, Homo sapiens
ataaactgtgagataaa

SEQ ID NO: 5367979 - DNA, 16 bp, Homo sapiens
ataaactgtgtttact

SEQ ID NO: 5367980 - DNA, 19 bp, Homo sapiens
ataaactgttatgagtagt

SEQ ID NO: 5367981 - DNA, 14 bp, Homo sapiens
ataaactgtttata

SEQ ID NO: 5367982 - DNA, 15 bp, Homo sapiens
ataaacttaattttg

SEQ ID NO: 5367983 - DNA, 17 bp, Homo sapiens
ataaacttacagatctg

SEQ ID NO: 5367984 - DNA, 14 bp, Homo sapiens
ataaacttagaata

SEQ ID NO: 5367985 - DNA, 18 bp, Homo sapiens
ataaacttagaggaaaat

SEQ ID NO: 5367986 - DNA, 23 bp, Homo sapiens
ataaacttagtgcggacaagttt

SEQ ID NO: 5367987 - DNA, 12 bp, Homo sapiens
ataaacttcagc

SEQ ID NO: 5367988 - DNA, 13 bp, Homo sapiens
ataaacttcttaa

SEQ ID NO: 5367989 - DNA, 21 bp, Homo sapiens
ataaacttgattatattgttt

SEQ ID NO: 5367990 - DNA, 17 bp, Homo sapiens
ataaatcttcttattaa

SEQ ID NO: 5367991 - DNA, 18 bp, Homo sapiens
ataaatctttttactttg

SEQ ID NO: 5367992 - DNA, 21 bp, Homo sapiens
ataaatgaaacttggccagtt

SEQ ID NO: 5367993 - DNA, 14 bp, Homo sapiens
ataaatgaaagaaa

SEQ ID NO: 5367994 - DNA, 18 bp, Homo sapiens
ataaatgaagtttataca

SEQ ID NO: 5367995 - DNA, 17 bp, Homo sapiens
ataaatgaatgaataac

SEQ ID NO: 5367996 - DNA, 12 bp, Homo sapiens
ataaatgaatgt

SEQ ID NO: 5367997 - DNA, 15 bp, Homo sapiens
ataaatgaatgtgct

SEQ ID NO: 5367998 - DNA, 16 bp, Homo sapiens
ataaatgaattttagt

SEQ ID NO: 5367999 - DNA, 17 bp, Homo sapiens
ataaatgaattttagtt

SEQ ID NO: 5368000 - DNA, 11 bp, Homo sapiens
ataaatgacca

SEQ ID NO: 5368001 - DNA, 12 bp, Homo sapiens
ataaatgaccag

SEQ ID NO: 5368002 - DNA, 19 bp, Homo sapiens
ataaatgactattgtaatg

SEQ ID NO: 5368003 - DNA, 22 bp, Homo sapiens
ataaatgagacccctttaaact

SEQ ID NO: 5368004 - DNA, 12 bp, Homo sapiens
ataaatgagcaa

SEQ ID NO: 5368005 - DNA, 18 bp, Homo sapiens
ataaatgagctatgtatt

SEQ ID NO: 5368006 - DNA, 15 bp, Homo sapiens
ataaatgatatctat

SEQ ID NO: 5368007 - DNA, 15 bp, Homo sapiens
ataaatgattcaaaa

SEQ ID NO: 5368008 - DNA, 14 bp, Homo sapiens
ataaatgcaaataa

SEQ ID NO: 5368009 - DNA, 18 bp, Homo sapiens
ataaatgcaatatgtatt

SEQ ID NO: 5368010 - DNA, 23 bp, Homo sapiens
ataaatgcaatattaatgccttt

SEQ ID NO: 5368011 - DNA, 15 bp, Homo sapiens
ataaatgcactgtaa

SEQ ID NO: 5368012 - DNA, 15 bp, Homo sapiens
ataaatgcagcccat

SEQ ID NO: 5368013 - DNA, 18 bp, Homo sapiens
ataaatgcagcccatttc

SEQ ID NO: 5368014 - DNA, 15 bp, Homo sapiens
ataaatgcataattt

SEQ ID NO: 5368015 - DNA, 20 bp, Homo sapiens
ataaatgcatagagcaatta

SEQ ID NO: 5368016 - DNA, 14 bp, Homo sapiens
ataaatgcatgatt

SEQ ID NO: 5368017 - DNA, 20 bp, Homo sapiens
ataaatgccaactggtcact

SEQ ID NO: 5368018 - DNA, 13 bp, Homo sapiens
ataaatgcccagc

SEQ ID NO: 5368019 - DNA, 21 bp, Homo sapiens
ataaatgcccagcacaattca

SEQ ID NO: 5368020 - DNA, 13 bp, Homo sapiens
ataaatgctgctt

SEQ ID NO: 5368021 - DNA, 13 bp, Homo sapiens
ataaatgctttta

SEQ ID NO: 5368022 - DNA, 16 bp, Homo sapiens
ataaatgcttttctaa

SEQ ID NO: 5368023 - DNA, 17 bp, Homo sapiens
ataaatggactacagta

SEQ ID NO: 5368024 - DNA, 12 bp, Homo sapiens
ataaatggactt

SEQ ID NO: 5368025 - DNA, 15 bp, Homo sapiens
ataaatggaggtaca

SEQ ID NO: 5368026 - DNA, 22 bp, Homo sapiens
ataaatggccagtgctgcttct

SEQ ID NO: 5368027 - DNA, 13 bp, Homo sapiens
ataaatgggaaca

SEQ ID NO: 5368028 - DNA, 19 bp, Homo sapiens
ataaatgggaacatttatt

SEQ ID NO: 5368029 - DNA, 21 bp, Homo sapiens
ataaatgggtgtatataattt

SEQ ID NO: 5368030 - DNA, 22 bp, Homo sapiens
ataaatggtatagcaaatgttt

SEQ ID NO: 5368031 - DNA, 22 bp, Homo sapiens
ataaatggtgagaattaaaata

SEQ ID NO: 5368032 - DNA, 15 bp, Homo sapiens
ataaatggtgtcata

SEQ ID NO: 5368033 - DNA, 22 bp, Homo sapiens
ataaatggttaaaagaggtttt

SEQ ID NO: 5368034 - DNA, 19 bp, Homo sapiens
ataaatgtaaaaataataa

SEQ ID NO: 5368035 - DNA, 22 bp, Homo sapiens
ataaatgtaatagccaaaccca

SEQ ID NO: 5368036 - DNA, 18 bp, Homo sapiens
ataaatgtaccagagaga

SEQ ID NO: 5368037 - DNA, 15 bp, Homo sapiens
ataaatgtactacat

SEQ ID NO: 5368038 - DNA, 14 bp, Homo sapiens
ataaatgtatatac

SEQ ID NO: 5368039 - DNA, 18 bp, Homo sapiens
ataaatgtatatacacat

SEQ ID NO: 5368040 - DNA, 19 bp, Homo sapiens
ataaatgtatatacacata

SEQ ID NO: 5368041 - DNA, 17 bp, Homo sapiens
ataaatgtatcatagaa

SEQ ID NO: 5368042 - DNA, 15 bp, Homo sapiens
ataaatgtatctgaa

SEQ ID NO: 5368043 - DNA, 15 bp, Homo sapiens
ataaatgtatcttat

SEQ ID NO: 5368044 - DNA, 15 bp, Homo sapiens
ataaatgtattgatt

SEQ ID NO: 5368045 - DNA, 16 bp, Homo sapiens
ataaatgtcacttcat

SEQ ID NO: 5368046 - DNA, 21 bp, Homo sapiens
ataaatgtcattaaaataaat

SEQ ID NO: 5368047 - DNA, 17 bp, Homo sapiens
ataaatgtcccaaataa

SEQ ID NO: 5368048 - DNA, 17 bp, Homo sapiens
ataaatgtctattatta

SEQ ID NO: 5368049 - DNA, 20 bp, Homo sapiens
ataaatgtctattattatga

SEQ ID NO: 5368050 - DNA, 21 bp, Homo sapiens
ataaatgtctattattatgaa

SEQ ID NO: 5368051 - DNA, 12 bp, Homo sapiens
ataaatgtctgt

SEQ ID NO: 5368052 - DNA, 23 bp, Homo sapiens
ataaatgtcttttttttaatgtg

SEQ ID NO: 5368053 - DNA, 14 bp, Homo sapiens
ataaatgtgtaaat

SEQ ID NO: 5368054 - DNA, 15 bp, Homo sapiens
ataaatgtgtaaatg

SEQ ID NO: 5368055 - DNA, 16 bp, Homo sapiens
ataaatgtgtaaatgt

SEQ ID NO: 5368056 - DNA, 21 bp, Homo sapiens
ataaatgtgtaaatgtggaca

SEQ ID NO: 5368057 - DNA, 13 bp, Homo sapiens
ataaatgtgttcc

SEQ ID NO: 5368058 - DNA, 15 bp, Homo sapiens
ataaatgtgtttata

SEQ ID NO: 5368059 - DNA, 15 bp, Homo sapiens
ataaatgttaagaaa

SEQ ID NO: 5368060 - DNA, 14 bp, Homo sapiens
ataaatgttaatat

SEQ ID NO: 5368061 - DNA, 19 bp, Homo sapiens
ataaatgttacctaattat

SEQ ID NO: 5368062 - DNA, 16 bp, Homo sapiens
ataaatgttattgtcc

SEQ ID NO: 5368063 - DNA, 12 bp, Homo sapiens
ataaatgttcaa

SEQ ID NO: 5368064 - DNA, 22 bp, Homo sapiens
ataaatgttcatgatttcaaga

SEQ ID NO: 5368065 - DNA, 20 bp, Homo sapiens
ataaatgttctggtatgcat

SEQ ID NO: 5368066 - DNA, 12 bp, Homo sapiens
ataaatgtttaa

SEQ ID NO: 5368067 - DNA, 20 bp, Homo sapiens
ataaatgtttaaatataaat

SEQ ID NO: 5368068 - DNA, 21 bp, Homo sapiens
ataaatgtttggaaaggttct

SEQ ID NO: 5368069 - DNA, 19 bp, Homo sapiens
ataaatgtttgttatttac

SEQ ID NO: 5368070 - DNA, 12 bp, Homo sapiens
ataaatgtttta

SEQ ID NO: 5368071 - DNA, 15 bp, Homo sapiens
ataaatgttttaaag

SEQ ID NO: 5368072 - DNA, 14 bp, Homo sapiens
ataaatgttttgga

SEQ ID NO: 5368073 - DNA, 16 bp, Homo sapiens
ataaatgttttggaat

SEQ ID NO: 5368074 - DNA, 15 bp, Homo sapiens
ataaatgtttttatt

SEQ ID NO: 5368075 - DNA, 13 bp, Homo sapiens
ataaattaaaatg

SEQ ID NO: 5368076 - DNA, 13 bp, Homo sapiens
ataaattaagact

SEQ ID NO: 5368077 - DNA, 14 bp, Homo sapiens
ataaattaagactt

SEQ ID NO: 5368078 - DNA, 21 bp, Homo sapiens
ataaattaagatcctaaactc

SEQ ID NO: 5368079 - DNA, 14 bp, Homo sapiens
ataaattaatacat

SEQ ID NO: 5368080 - DNA, 15 bp, Homo sapiens
ataaattaatatatt

SEQ ID NO: 5368081 - DNA, 17 bp, Homo sapiens
ataaattaatattgtat

SEQ ID NO: 5368082 - DNA, 15 bp, Homo sapiens
ataaattaatttgac

SEQ ID NO: 5368083 - DNA, 16 bp, Homo sapiens
ataaattaatttttca

SEQ ID NO: 5368084 - DNA, 18 bp, Homo sapiens
ataaattaatttttcaat

SEQ ID NO: 5368085 - DNA, 14 bp, Homo sapiens
ataaattacacaat

SEQ ID NO: 5368086 - DNA, 20 bp, Homo sapiens
ataaattacacaataaagca

SEQ ID NO: 5368087 - DNA, 11 bp, Homo sapiens
ataaattacag

SEQ ID NO: 5368088 - DNA, 13 bp, Homo sapiens
ataaattacagtc

SEQ ID NO: 5368089 - DNA, 13 bp, Homo sapiens
ataaattacatgc

SEQ ID NO: 5368090 - DNA, 15 bp, Homo sapiens
ataaattacattaaa

SEQ ID NO: 5368091 - DNA, 20 bp, Homo sapiens
ataaattaccccctcctcca

SEQ ID NO: 5368092 - DNA, 22 bp, Homo sapiens
ataaattactttgattccattt

SEQ ID NO: 5368093 - DNA, 14 bp, Homo sapiens
ataaattagttgtt

SEQ ID NO: 5368094 - DNA, 13 bp, Homo sapiens
ataaattataatg

SEQ ID NO: 5368095 - DNA, 13 bp, Homo sapiens
ataaattatctga

SEQ ID NO: 5368096 - DNA, 18 bp, Homo sapiens
ataaattatctgaatatt

SEQ ID NO: 5368097 - DNA, 22 bp, Homo sapiens
ataaattatctgaatattagat

SEQ ID NO: 5368098 - DNA, 23 bp, Homo sapiens
ataaattatctgaatattagatg

SEQ ID NO: 5368099 - DNA, 16 bp, Homo sapiens
ataaattatgaaggac

SEQ ID NO: 5368100 - DNA, 15 bp, Homo sapiens
ataaattatggcatt

SEQ ID NO: 5368101 - DNA, 17 bp, Homo sapiens
ataaattatggcatttc

SEQ ID NO: 5368102 - DNA, 13 bp, Homo sapiens
ataaattatggta

SEQ ID NO: 5368103 - DNA, 14 bp, Homo sapiens
ataaattatgttta

SEQ ID NO: 5368104 - DNA, 13 bp, Homo sapiens
ataaattattact

SEQ ID NO: 5368105 - DNA, 15 bp, Homo sapiens
ataaattattacttt

SEQ ID NO: 5368106 - DNA, 20 bp, Homo sapiens
ataaattattactttaaatt

SEQ ID NO: 5368107 - DNA, 15 bp, Homo sapiens
ataaattattcagaa

SEQ ID NO: 5368108 - DNA, 11 bp, Homo sapiens
ataaattattt

SEQ ID NO: 5368109 - DNA, 14 bp, Homo sapiens
ataaattatttatt

SEQ ID NO: 5368110 - DNA, 17 bp, Homo sapiens
ataaattatttgattat

SEQ ID NO: 5368111 - DNA, 14 bp, Homo sapiens
ataaattcaaacca

SEQ ID NO: 5368112 - DNA, 15 bp, Homo sapiens
ataaattcaaaccat

SEQ ID NO: 5368113 - DNA, 15 bp, Homo sapiens
ataaattcaactttg

SEQ ID NO: 5368114 - DNA, 15 bp, Homo sapiens
ataaattcacctagt

SEQ ID NO: 5368115 - DNA, 16 bp, Homo sapiens
ataaattcagatatat

SEQ ID NO: 5368116 - DNA, 15 bp, Homo sapiens
ataaattcagtattt

SEQ ID NO: 5368117 - DNA, 14 bp, Homo sapiens
ataaattcatcaga

SEQ ID NO: 5368118 - DNA, 12 bp, Homo sapiens
ataaattccaga

SEQ ID NO: 5368119 - DNA, 21 bp, Homo sapiens
ataaattccagaggactctgc

SEQ ID NO: 5368120 - DNA, 21 bp, Homo sapiens
ataaattccccatatttgtgt

SEQ ID NO: 5368121 - DNA, 21 bp, Homo sapiens
ataaattccctggcctttcat

SEQ ID NO: 5368122 - DNA, 22 bp, Homo sapiens
ataaattccctggcctttcata

SEQ ID NO: 5368123 - DNA, 22 bp, Homo sapiens
ataaattctacctccttgtgtt

SEQ ID NO: 5368124 - DNA, 23 bp, Homo sapiens
ataaattctacctccttgtgttg

SEQ ID NO: 5368125 - DNA, 20 bp, Homo sapiens
ataaattctactaagttatt

SEQ ID NO: 5368126 - DNA, 14 bp, Homo sapiens
ataaattctgattc

SEQ ID NO: 5368127 - DNA, 22 bp, Homo sapiens
ataaattctgttagctgctcac

SEQ ID NO: 5368128 - DNA, 22 bp, Homo sapiens
ataaattgaaatataatgcaaa

SEQ ID NO: 5368129 - DNA, 13 bp, Homo sapiens
ataaattgaaatt

SEQ ID NO: 5368130 - DNA, 20 bp, Homo sapiens
ataaattgcatgctgcttta

SEQ ID NO: 5368131 - DNA, 13 bp, Homo sapiens
ataaattgccata

SEQ ID NO: 5368132 - DNA, 17 bp, Homo sapiens
ataaattgccataatat

SEQ ID NO: 5368133 - DNA, 16 bp, Homo sapiens
ataaattgcctccctt

SEQ ID NO: 5368134 - DNA, 12 bp, Homo sapiens
ataaattggatt

SEQ ID NO: 5368135 - DNA, 15 bp, Homo sapiens
ataaattggattatt

SEQ ID NO: 5368136 - DNA, 19 bp, Homo sapiens
ataaattggattattttct

SEQ ID NO: 5368137 - DNA, 21 bp, Homo sapiens
ataaattggcctctgtatgca

SEQ ID NO: 5368138 - DNA, 18 bp, Homo sapiens
ataaattggctcctttcc

SEQ ID NO: 5368139 - DNA, 13 bp, Homo sapiens
ataaattggggtg

SEQ ID NO: 5368140 - DNA, 21 bp, Homo sapiens
ataaattggtgataagtggaa

SEQ ID NO: 5368141 - DNA, 19 bp, Homo sapiens
ataaattgtaattgtaaag

SEQ ID NO: 5368142 - DNA, 21 bp, Homo sapiens
ataaattgtaatttgggaaca

SEQ ID NO: 5368143 - DNA, 23 bp, Homo sapiens
ataaattgtaccatcattttatt

SEQ ID NO: 5368144 - DNA, 13 bp, Homo sapiens
ataaattgtatat

SEQ ID NO: 5368145 - DNA, 18 bp, Homo sapiens
ataaattgtatattcact

SEQ ID NO: 5368146 - DNA, 18 bp, Homo sapiens
ataaattgtcttaatgga

SEQ ID NO: 5368147 - DNA, 15 bp, Homo sapiens
ataaattgtgaaaaa

SEQ ID NO: 5368148 - DNA, 13 bp, Homo sapiens
ataaattgtttga

SEQ ID NO: 5368149 - DNA, 19 bp, Homo sapiens
ataaatttaaaaatcatct

SEQ ID NO: 5368150 - DNA, 16 bp, Homo sapiens
ataaatttaaaacaca

SEQ ID NO: 5368151 - DNA, 20 bp, Homo sapiens
ataaatttaaaacacagtat

SEQ ID NO: 5368152 - DNA, 19 bp, Homo sapiens
ataaatttaagaaaacaag

SEQ ID NO: 5368153 - DNA, 12 bp, Homo sapiens
ataaatttaatc

SEQ ID NO: 5368154 - DNA, 15 bp, Homo sapiens
ataaatttatatgaa

SEQ ID NO: 5368155 - DNA, 16 bp, Homo sapiens
ataaatttatcaactg

SEQ ID NO: 5368156 - DNA, 19 bp, Homo sapiens
ataaatttatcaactgtca

SEQ ID NO: 5368157 - DNA, 21 bp, Homo sapiens
ataaatttatcctataagatg

SEQ ID NO: 5368158 - DNA, 19 bp, Homo sapiens
ataaatttatttactgcta

SEQ ID NO: 5368159 - DNA, 20 bp, Homo sapiens
ataaatttcaattagattta

SEQ ID NO: 5368160 - DNA, 21 bp, Homo sapiens
ataaatttcagcctacattga

SEQ ID NO: 5368161 - DNA, 17 bp, Homo sapiens
ataaatttcgcttctta

SEQ ID NO: 5368162 - DNA, 18 bp, Homo sapiens
ataaatttctatttttat

SEQ ID NO: 5368163 - DNA, 20 bp, Homo sapiens
ataaatttgaactccatggg

SEQ ID NO: 5368164 - DNA, 12 bp, Homo sapiens
ataaatttgact

SEQ ID NO: 5368165 - DNA, 18 bp, Homo sapiens
ataaatttgacttttctg

SEQ ID NO: 5368166 - DNA, 20 bp, Homo sapiens
ataaatttgacttttctgta

SEQ ID NO: 5368167 - DNA, 13 bp, Homo sapiens
ataaatttgtaat

SEQ ID NO: 5368168 - DNA, 16 bp, Homo sapiens
ataaatttgttgtcat

SEQ ID NO: 5368169 - DNA, 17 bp, Homo sapiens
ataaattttaaaaagga

SEQ ID NO: 5368170 - DNA, 23 bp, Homo sapiens
ataactatcaggcagaagaatct

SEQ ID NO: 5368171 - DNA, 13 bp, Homo sapiens
ataactatctttt

SEQ ID NO: 5368172 - DNA, 20 bp, Homo sapiens
ataactatctttttgaaagc

SEQ ID NO: 5368173 - DNA, 22 bp, Homo sapiens
ataactatctttttgaaagcaa

SEQ ID NO: 5368174 - DNA, 19 bp, Homo sapiens
ataactatggtaaataact

SEQ ID NO: 5368175 - DNA, 23 bp, Homo sapiens
ataactatggtaaataactgtga

SEQ ID NO: 5368176 - DNA, 15 bp, Homo sapiens
ataactatgttgata

SEQ ID NO: 5368177 - DNA, 17 bp, Homo sapiens
ataactattacagtgtt

SEQ ID NO: 5368178 - DNA, 14 bp, Homo sapiens
ataactattcagtt

SEQ ID NO: 5368179 - DNA, 15 bp, Homo sapiens
ataactattcagttg

SEQ ID NO: 5368180 - DNA, 16 bp, Homo sapiens
ataactcatcataaaa

SEQ ID NO: 5368181 - DNA, 17 bp, Homo sapiens
ataactcatcataaaat

SEQ ID NO: 5368182 - DNA, 10 bp, Homo sapiens
ataactcatg

SEQ ID NO: 5368183 - DNA, 14 bp, Homo sapiens
ataactccaagcag

SEQ ID NO: 5368184 - DNA, 12 bp, Homo sapiens
ataactcctccc

SEQ ID NO: 5368185 - DNA, 14 bp, Homo sapiens
ataactcctcccag

SEQ ID NO: 5368186 - DNA, 18 bp, Homo sapiens
ataactcctcccagggtt

SEQ ID NO: 5368187 - DNA, 17 bp, Homo sapiens
ataactcctgtcccttt

SEQ ID NO: 5368188 - DNA, 18 bp, Homo sapiens
ataactcctgtccctttt

SEQ ID NO: 5368189 - DNA, 22 bp, Homo sapiens
ataactctaaccaaggctgtgt

SEQ ID NO: 5368190 - DNA, 18 bp, Homo sapiens
ataactctgattttgata

SEQ ID NO: 5368191 - DNA, 19 bp, Homo sapiens
ataactctgcactactcct

SEQ ID NO: 5368192 - DNA, 21 bp, Homo sapiens
ataactctgcactactcctct

SEQ ID NO: 5368193 - DNA, 12 bp, Homo sapiens
ataactctgtaa

SEQ ID NO: 5368194 - DNA, 22 bp, Homo sapiens
ataactctgtggcattattgca

SEQ ID NO: 5368195 - DNA, 22 bp, Homo sapiens
ataactctttggatagcatgtc

SEQ ID NO: 5368196 - DNA, 15 bp, Homo sapiens
ataactgaaaatgtg

SEQ ID NO: 5368197 - DNA, 20 bp, Homo sapiens
ataactgaaaattatttaaa

SEQ ID NO: 5368198 - DNA, 18 bp, Homo sapiens
ataactgaaccaaattgc

SEQ ID NO: 5368199 - DNA, 13 bp, Homo sapiens
ataactgaactgt

SEQ ID NO: 5368200 - DNA, 14 bp, Homo sapiens
ataactgaaggaga

SEQ ID NO: 5368201 - DNA, 12 bp, Homo sapiens
ataactgaataa

SEQ ID NO: 5368202 - DNA, 19 bp, Homo sapiens
ataactgaataaaaaataa

SEQ ID NO: 5368203 - DNA, 12 bp, Homo sapiens
ataactgacaaa

SEQ ID NO: 5368204 - DNA, 16 bp, Homo sapiens
ataactgacaaatcaa

SEQ ID NO: 5368205 - DNA, 15 bp, Homo sapiens
ataactgacttagtt

SEQ ID NO: 5368206 - DNA, 12 bp, Homo sapiens
ataactgagaat

SEQ ID NO: 5368207 - DNA, 22 bp, Homo sapiens
ataactgagatattattttaaa

SEQ ID NO: 5368208 - DNA, 23 bp, Homo sapiens
ataactgagatattattttaaat

SEQ ID NO: 5368209 - DNA, 16 bp, Homo sapiens
ataactgatctattta

SEQ ID NO: 5368210 - DNA, 21 bp, Homo sapiens
ataactgatgagatacatttg

SEQ ID NO: 5368211 - DNA, 13 bp, Homo sapiens
ataactgatttct

SEQ ID NO: 5368212 - DNA, 14 bp, Homo sapiens
ataactgatttcta

SEQ ID NO: 5368213 - DNA, 15 bp, Homo sapiens
ataactgatttctat

SEQ ID NO: 5368214 - DNA, 15 bp, Homo sapiens
ataactgcagaaaaa

SEQ ID NO: 5368215 - DNA, 14 bp, Homo sapiens
ataactgcagtgtt

SEQ ID NO: 5368216 - DNA, 15 bp, Homo sapiens
ataactgcagtgttc

SEQ ID NO: 5368217 - DNA, 23 bp, Homo sapiens
ataactgcccagcggacagtggc

SEQ ID NO: 5368218 - DNA, 12 bp, Homo sapiens
ataactgctgta

SEQ ID NO: 5368219 - DNA, 16 bp, Homo sapiens
ataactgctgtattca

SEQ ID NO: 5368220 - DNA, 14 bp, Homo sapiens
ataactgctttgca

SEQ ID NO: 5368221 - DNA, 21 bp, Homo sapiens
ataactggaaaacagaacact

SEQ ID NO: 5368222 - DNA, 23 bp, Homo sapiens
ataactggaaaacagaacactta

SEQ ID NO: 5368223 - DNA, 12 bp, Homo sapiens
ataactggaaac

SEQ ID NO: 5368224 - DNA, 15 bp, Homo sapiens
ataactggattttga

SEQ ID NO: 5368225 - DNA, 16 bp, Homo sapiens
ataactggattttgaa

SEQ ID NO: 5368226 - DNA, 17 bp, Homo sapiens
ataactggattttgaac

SEQ ID NO: 5368227 - DNA, 18 bp, Homo sapiens
ataactggattttgaacg

SEQ ID NO: 5368228 - DNA, 18 bp, Homo sapiens
ataactggttactcagct

SEQ ID NO: 5368229 - DNA, 20 bp, Homo sapiens
ataactgtaaatgtgacatt

SEQ ID NO: 5368230 - DNA, 14 bp, Homo sapiens
ataactgtagctca

SEQ ID NO: 5368231 - DNA, 20 bp, Homo sapiens
ataactgtagctcaagttta

SEQ ID NO: 5368232 - DNA, 15 bp, Homo sapiens
ataactgtatttgaa

SEQ ID NO: 5368233 - DNA, 18 bp, Homo sapiens
ataactgtatttgaaata

SEQ ID NO: 5368234 - DNA, 22 bp, Homo sapiens
ataactgtcatctagccccttc

SEQ ID NO: 5368235 - DNA, 19 bp, Homo sapiens
ataactgtcttgtttcagt

SEQ ID NO: 5368236 - DNA, 16 bp, Homo sapiens
ataactgtgactgtgg

SEQ ID NO: 5368237 - DNA, 16 bp, Homo sapiens
ataactgtgtactgtt

SEQ ID NO: 5368238 - DNA, 18 bp, Homo sapiens
ataactgttatttataat

SEQ ID NO: 5368239 - DNA, 16 bp, Homo sapiens
ataactgttgttgata

SEQ ID NO: 5368240 - DNA, 15 bp, Homo sapiens
ataacttaaaataat

SEQ ID NO: 5368241 - DNA, 16 bp, Homo sapiens
ataacttaaataattt

SEQ ID NO: 5368242 - DNA, 17 bp, Homo sapiens
ataacttaaatattgct

SEQ ID NO: 5368243 - DNA, 20 bp, Homo sapiens
ataacttaataaatattgta

SEQ ID NO: 5368244 - DNA, 16 bp, Homo sapiens
ataacttaatgaaaac

SEQ ID NO: 5368245 - DNA, 23 bp, Homo sapiens
ataacttaatgaaaacaatgcag

SEQ ID NO: 5368246 - DNA, 21 bp, Homo sapiens
ataacttacctctgcttctga

SEQ ID NO: 5368247 - DNA, 20 bp, Homo sapiens
ataacttactgtatatgtat

SEQ ID NO: 5368248 - DNA, 15 bp, Homo sapiens
ataacttatattgta

SEQ ID NO: 5368249 - DNA, 15 bp, Homo sapiens
ataacttattagcag

SEQ ID NO: 5368250 - DNA, 14 bp, Homo sapiens
ataacttattgctg

SEQ ID NO: 5368251 - DNA, 13 bp, Homo sapiens
ataacttcaaatt

SEQ ID NO: 5368252 - DNA, 16 bp, Homo sapiens
ataacttcaaattttt

SEQ ID NO: 5368253 - DNA, 16 bp, Homo sapiens
ataacttcaagcaaac

SEQ ID NO: 5368254 - DNA, 14 bp, Homo sapiens
ataacttcagagaa

SEQ ID NO: 5368255 - DNA, 20 bp, Homo sapiens
ataacttcagtcctgctcca

SEQ ID NO: 5368256 - DNA, 21 bp, Homo sapiens
ataacttcagtgcaagagact

SEQ ID NO: 5368257 - DNA, 13 bp, Homo sapiens
ataacttcattgt

SEQ ID NO: 5368258 - DNA, 23 bp, Homo sapiens
ataacttccttcacatctcccat

SEQ ID NO: 5368259 - DNA, 23 bp, Homo sapiens
ataacttccttgcccctgctctg

SEQ ID NO: 5368260 - DNA, 21 bp, Homo sapiens
ataacttctatgttggtttca

SEQ ID NO: 5368261 - DNA, 17 bp, Homo sapiens
ataacttctcatgtata

SEQ ID NO: 5368262 - DNA, 18 bp, Homo sapiens
ataacttctcatgtatat

SEQ ID NO: 5368263 - DNA, 20 bp, Homo sapiens
ataacttctcatgtatatta

SEQ ID NO: 5368264 - DNA, 16 bp, Homo sapiens
ataacttcttaaaagt

SEQ ID NO: 5368265 - DNA, 18 bp, Homo sapiens
ataacttcttcctgctgg

SEQ ID NO: 5368266 - DNA, 19 bp, Homo sapiens
ataacttgagacctaatct

SEQ ID NO: 5368267 - DNA, 21 bp, Homo sapiens
ataacttgagacctaatctct

SEQ ID NO: 5368268 - DNA, 11 bp, Homo sapiens
ataacttgatg

SEQ ID NO: 5368269 - DNA, 17 bp, Homo sapiens
ataacttgatgcatgtg

SEQ ID NO: 5368270 - DNA, 14 bp, Homo sapiens
ataacttgccattt

SEQ ID NO: 5368271 - DNA, 17 bp, Homo sapiens
ataacttgccatttctt

SEQ ID NO: 5368272 - DNA, 22 bp, Homo sapiens
ataacttgccatttctttatat

SEQ ID NO: 5368273 - DNA, 16 bp, Homo sapiens
ataacttgctgaattt

SEQ ID NO: 5368274 - DNA, 18 bp, Homo sapiens
ataacttggggaggcaag

SEQ ID NO: 5368275 - DNA, 19 bp, Homo sapiens
ataacttgttttgacttga

SEQ ID NO: 5368276 - DNA, 22 bp, Homo sapiens
ataactttaacttctgttttac

SEQ ID NO: 5368277 - DNA, 19 bp, Homo sapiens
ataactttatgaagtgcta

SEQ ID NO: 5368278 - DNA, 16 bp, Homo sapiens
ataactttattgcata

SEQ ID NO: 5368279 - DNA, 19 bp, Homo sapiens
ataactttctctgtgaaag

SEQ ID NO: 5368280 - DNA, 23 bp, Homo sapiens
ataactttctctgtgaaagcttt

SEQ ID NO: 5368281 - DNA, 21 bp, Homo sapiens
ataactttgcttgcagtagat

SEQ ID NO: 5368282 - DNA, 20 bp, Homo sapiens
ataactttgtctcgttcctg

SEQ ID NO: 5368283 - DNA, 12 bp, Homo sapiens
ataactttttat

SEQ ID NO: 5368284 - DNA, 18 bp, Homo sapiens
ataactttttatattctc

SEQ ID NO: 5368285 - DNA, 18 bp, Homo sapiens
ataacttttttatatttg

SEQ ID NO: 5368286 - DNA, 21 bp, Homo sapiens
ataactttttttcaatttttt

SEQ ID NO: 5368287 - DNA, 23 bp, Homo sapiens
ataactttttttgagaaggaaat

SEQ ID NO: 5368288 - DNA, 19 bp, Homo sapiens
ataagaaaaaattctttca

SEQ ID NO: 5368289 - DNA, 11 bp, Homo sapiens
ataagaaaaag

SEQ ID NO: 5368290 - DNA, 11 bp, Homo sapiens
ataagaaaaat

SEQ ID NO: 5368291 - DNA, 15 bp, Homo sapiens
ataagaaaacatgta

SEQ ID NO: 5368292 - DNA, 16 bp, Homo sapiens
ataagaaaacatgtaa

SEQ ID NO: 5368293 - DNA, 12 bp, Homo sapiens
ataagaaaagat

SEQ ID NO: 5368294 - DNA, 13 bp, Homo sapiens
ataagaaaagcct

SEQ ID NO: 5368295 - DNA, 18 bp, Homo sapiens
ataagaaaagcctgaact

SEQ ID NO: 5368296 - DNA, 16 bp, Homo sapiens
ataagaaaatatattc

SEQ ID NO: 5368297 - DNA, 21 bp, Homo sapiens
ataagaaaatatattctttca

SEQ ID NO: 5368298 - DNA, 14 bp, Homo sapiens
ataagaaacagttt

SEQ ID NO: 5368299 - DNA, 18 bp, Homo sapiens
ataagaaacatgatgtga

SEQ ID NO: 5368300 - DNA, 14 bp, Homo sapiens
ataagaaacttttt

SEQ ID NO: 5368301 - DNA, 22 bp, Homo sapiens
ataagaaacttttttatttaaa

SEQ ID NO: 5368302 - DNA, 12 bp, Homo sapiens
ataagaaagaat

SEQ ID NO: 5368303 - DNA, 13 bp, Homo sapiens
ataagaaagacat

SEQ ID NO: 5368304 - DNA, 15 bp, Homo sapiens
ataagaaagcctgag

SEQ ID NO: 5368305 - DNA, 22 bp, Homo sapiens
ataagaaagtgcgagtcctcca

SEQ ID NO: 5368306 - DNA, 15 bp, Homo sapiens
ataagaaatgaacaa

SEQ ID NO: 5368307 - DNA, 17 bp, Homo sapiens
ataagaaatgcatatgt

SEQ ID NO: 5368308 - DNA, 23 bp, Homo sapiens
ataagaaatgtattcctgaaaag

SEQ ID NO: 5368309 - DNA, 12 bp, Homo sapiens
ataagaaatttt

SEQ ID NO: 5368310 - DNA, 22 bp, Homo sapiens
ataagaacaataggtaaagcta

SEQ ID NO: 5368311 - DNA, 15 bp, Homo sapiens
ataagaagaatgctt

SEQ ID NO: 5368312 - DNA, 19 bp, Homo sapiens
ataagaagaatgcttaatc

SEQ ID NO: 5368313 - DNA, 20 bp, Homo sapiens
ataagaagaatgcttaatca

SEQ ID NO: 5368314 - DNA, 19 bp, Homo sapiens
ataagaagaggaaattaaa

SEQ ID NO: 5368315 - DNA, 20 bp, Homo sapiens
ataagaagcaatctttgaaa

SEQ ID NO: 5368316 - DNA, 23 bp, Homo sapiens
ataagaagcaatctttgaaataa

SEQ ID NO: 5368317 - DNA, 20 bp, Homo sapiens
ataagaagggatggattcca

SEQ ID NO: 5368318 - DNA, 24 bp, Homo sapiens
ataagaagggggagtgaaacagag

SEQ ID NO: 5368319 - DNA, 15 bp, Homo sapiens
ataagaataaaatgt

SEQ ID NO: 5368320 - DNA, 18 bp, Homo sapiens
ataagaataaaatgttga

SEQ ID NO: 5368321 - DNA, 21 bp, Homo sapiens
ataagaataaaatgttgaaaa

SEQ ID NO: 5368322 - DNA, 16 bp, Homo sapiens
ataagaatgagcctgt

SEQ ID NO: 5368323 - DNA, 21 bp, Homo sapiens
ataagaatgctggttttccta

SEQ ID NO: 5368324 - DNA, 18 bp, Homo sapiens
ataagaatggagcagtac

SEQ ID NO: 5368325 - DNA, 18 bp, Homo sapiens
ataagaatggttgcctta

SEQ ID NO: 5368326 - DNA, 15 bp, Homo sapiens
ataagaattaatctt

SEQ ID NO: 5368327 - DNA, 15 bp, Homo sapiens
ataagaattactttg

SEQ ID NO: 5368328 - DNA, 13 bp, Homo sapiens
ataagaattagac

SEQ ID NO: 5368329 - DNA, 14 bp, Homo sapiens
ataagacaaaattt

SEQ ID NO: 5368330 - DNA, 14 bp, Homo sapiens
ataagacaaacact

SEQ ID NO: 5368331 - DNA, 16 bp, Homo sapiens
ataagacaaacactgc

SEQ ID NO: 5368332 - DNA, 19 bp, Homo sapiens
ataagacaaacactgccat

SEQ ID NO: 5368333 - DNA, 15 bp, Homo sapiens
ataagacaagtctga

SEQ ID NO: 5368334 - DNA, 21 bp, Homo sapiens
ataagacaatagtatttctcc

SEQ ID NO: 5368335 - DNA, 22 bp, Homo sapiens
ataagacagagaaggttcttct

SEQ ID NO: 5368336 - DNA, 11 bp, Homo sapiens
ataagacatta

SEQ ID NO: 5368337 - DNA, 21 bp, Homo sapiens
ataagactggaaaatagtcct

SEQ ID NO: 5368338 - DNA, 23 bp, Homo sapiens
ataagactgtttttaagtaactt

SEQ ID NO: 5368339 - DNA, 14 bp, Homo sapiens
ataagacttcctct

SEQ ID NO: 5368340 - DNA, 16 bp, Homo sapiens
ataagacttgtttctt

SEQ ID NO: 5368341 - DNA, 12 bp, Homo sapiens
ataagagaaacc

SEQ ID NO: 5368342 - DNA, 21 bp, Homo sapiens
ataagagaaagaggccagaca

SEQ ID NO: 5368343 - DNA, 19 bp, Homo sapiens
ataagagaagtctcattcg

SEQ ID NO: 5368344 - DNA, 15 bp, Homo sapiens
ataagagaatcaaca

SEQ ID NO: 5368345 - DNA, 20 bp, Homo sapiens
ataagagaattatatatttc

SEQ ID NO: 5368346 - DNA, 20 bp, Homo sapiens
ataagagacctgttttaaaa

SEQ ID NO: 5368347 - DNA, 15 bp, Homo sapiens
ataagagagatgaga

SEQ ID NO: 5368348 - DNA, 13 bp, Homo sapiens
ataatagtactat

SEQ ID NO: 5368349 - DNA, 18 bp, Homo sapiens
ataatagttattatttaa

SEQ ID NO: 5368350 - DNA, 21 bp, Homo sapiens
ataatagttcaggatttggtt

SEQ ID NO: 5368351 - DNA, 20 bp, Homo sapiens
ataatagtttacatgtagta

SEQ ID NO: 5368352 - DNA, 14 bp, Homo sapiens
ataatagttttttc

SEQ ID NO: 5368353 - DNA, 11 bp, Homo sapiens
ataatataaaa

SEQ ID NO: 5368354 - DNA, 12 bp, Homo sapiens
ataatataaaaa

SEQ ID NO: 5368355 - DNA, 14 bp, Homo sapiens
ataatataaatata

SEQ ID NO: 5368356 - DNA, 16 bp, Homo sapiens
ataatataagaatcat

SEQ ID NO: 5368357 - DNA, 13 bp, Homo sapiens
ataatatataaaa

SEQ ID NO: 5368358 - DNA, 18 bp, Homo sapiens
ataatatataaaagaaat

SEQ ID NO: 5368359 - DNA, 20 bp, Homo sapiens
ataatatataaaagaaatat

SEQ ID NO: 5368360 - DNA, 15 bp, Homo sapiens
ataatatatatatat

SEQ ID NO: 5368361 - DNA, 21 bp, Homo sapiens
ataatatatatctacaatata

SEQ ID NO: 5368362 - DNA, 15 bp, Homo sapiens
ataatatatgacttc

SEQ ID NO: 5368363 - DNA, 12 bp, Homo sapiens
ataatatatttg

SEQ ID NO: 5368364 - DNA, 15 bp, Homo sapiens
ataatatattttcaa

SEQ ID NO: 5368365 - DNA, 15 bp, Homo sapiens
ataatatcaaaacaa

SEQ ID NO: 5368366 - DNA, 13 bp, Homo sapiens
ataatatcaaata

SEQ ID NO: 5368367 - DNA, 14 bp, Homo sapiens
ataatatcaaataa

SEQ ID NO: 5368368 - DNA, 19 bp, Homo sapiens
ataatatcaaataaaatat

SEQ ID NO: 5368369 - DNA, 21 bp, Homo sapiens
ataatatcagatttcattaat

SEQ ID NO: 5368370 - DNA, 16 bp, Homo sapiens
ataatatcctgaataa

SEQ ID NO: 5368371 - DNA, 14 bp, Homo sapiens
ataatatctgtgag

SEQ ID NO: 5368372 - DNA, 21 bp, Homo sapiens
ataatatctgtgaggtgctga

SEQ ID NO: 5368373 - DNA, 19 bp, Homo sapiens
ataatatcttgaagaatat

SEQ ID NO: 5368374 - DNA, 24 bp, Homo sapiens
ataatatgaagcctttggtgaatt

SEQ ID NO: 5368375 - DNA, 12 bp, Homo sapiens
ataatatgagaa

SEQ ID NO: 5368376 - DNA, 15 bp, Homo sapiens
ataatatgatgcaaa

SEQ ID NO: 5368377 - DNA, 20 bp, Homo sapiens
ataatatggatcagagcatt

SEQ ID NO: 5368378 - DNA, 23 bp, Homo sapiens
ataatatggatcagagcatttat

SEQ ID NO: 5368379 - DNA, 17 bp, Homo sapiens
ataatatggctatgctt

SEQ ID NO: 5368380 - DNA, 14 bp, Homo sapiens
ataatatgtactaa

SEQ ID NO: 5368381 - DNA, 20 bp, Homo sapiens
ataatatgtactaagaatgt

SEQ ID NO: 5368382 - DNA, 16 bp, Homo sapiens
ataatatgtgagagga

SEQ ID NO: 5368383 - DNA, 21 bp, Homo sapiens
ataatatgtttagttttacat

SEQ ID NO: 5368384 - DNA, 19 bp, Homo sapiens
ataatatgtttccttccct

SEQ ID NO: 5368385 - DNA, 20 bp, Homo sapiens
ataatatgtttccttccctc

SEQ ID NO: 5368386 - DNA, 13 bp, Homo sapiens
ataatattactgt

SEQ ID NO: 5368387 - DNA, 20 bp, Homo sapiens
ataatattagtgattctgat

SEQ ID NO: 5368388 - DNA, 16 bp, Homo sapiens
ataatattatattgta

SEQ ID NO: 5368389 - DNA, 18 bp, Homo sapiens
ataatattcatacaacaa

SEQ ID NO: 5368390 - DNA, 14 bp, Homo sapiens
ataatattgaaaat

SEQ ID NO: 5368391 - DNA, 16 bp, Homo sapiens
ataatattgaaaattg

SEQ ID NO: 5368392 - DNA, 19 bp, Homo sapiens
ataatattgaaaattgaaa

SEQ ID NO: 5368393 - DNA, 23 bp, Homo sapiens
ataatattgcagttcatactgaa

SEQ ID NO: 5368394 - DNA, 13 bp, Homo sapiens
ataatattgcctt

SEQ ID NO: 5368395 - DNA, 15 bp, Homo sapiens
ataatattgtctgtc

SEQ ID NO: 5368396 - DNA, 19 bp, Homo sapiens
ataatattgttgtataatt

SEQ ID NO: 5368397 - DNA, 14 bp, Homo sapiens
ataatattgtttgg

SEQ ID NO: 5368398 - DNA, 16 bp, Homo sapiens
ataatattgtttttct

SEQ ID NO: 5368399 - DNA, 20 bp, Homo sapiens
ataatatttcaagtgcctag

SEQ ID NO: 5368400 - DNA, 18 bp, Homo sapiens
ataatatttcttaatttg

SEQ ID NO: 5368401 - DNA, 16 bp, Homo sapiens
ataatatttgaacaaa

SEQ ID NO: 5368402 - DNA, 18 bp, Homo sapiens
ataatatttgaagcagct

SEQ ID NO: 5368403 - DNA, 20 bp, Homo sapiens
ataatatttttgtatttctc

SEQ ID NO: 5368404 - DNA, 15 bp, Homo sapiens
ataatcaaagctcat

SEQ ID NO: 5368405 - DNA, 12 bp, Homo sapiens
ataatcaaatga

SEQ ID NO: 5368406 - DNA, 20 bp, Homo sapiens
ataatcaagagccttaaaac

SEQ ID NO: 5368407 - DNA, 21 bp, Homo sapiens
ataatcaagagccttaaaaca

SEQ ID NO: 5368408 - DNA, 16 bp, Homo sapiens
ataatcaagattttag

SEQ ID NO: 5368409 - DNA, 19 bp, Homo sapiens
ataatcaagggcactgtga

SEQ ID NO: 5368410 - DNA, 18 bp, Homo sapiens
ataatcaagtgcatttct

SEQ ID NO: 5368411 - DNA, 21 bp, Homo sapiens
ataatcaatgaatttgttctt

SEQ ID NO: 5368412 - DNA, 18 bp, Homo sapiens
ataatcacaacccttcag

SEQ ID NO: 5368413 - DNA, 16 bp, Homo sapiens
ataatcactactagtt

SEQ ID NO: 5368414 - DNA, 15 bp, Homo sapiens
ataatcagaatatgt

SEQ ID NO: 5368415 - DNA, 19 bp, Homo sapiens
ataatcagaatggaagaga

SEQ ID NO: 5368416 - DNA, 14 bp, Homo sapiens
ataatcagcctctt

SEQ ID NO: 5368417 - DNA, 17 bp, Homo sapiens
ataatcagcctcttaaa

SEQ ID NO: 5368418 - DNA, 20 bp, Homo sapiens
ataatcagcgccctggagtc

SEQ ID NO: 5368419 - DNA, 16 bp, Homo sapiens
ataatcaggaaaaatg

SEQ ID NO: 5368420 - DNA, 13 bp, Homo sapiens
ataatcagtaaat

SEQ ID NO: 5368421 - DNA, 19 bp, Homo sapiens
ataatcagtatatttggtt

SEQ ID NO: 5368422 - DNA, 19 bp, Homo sapiens
ataatcatcaagtaataca

SEQ ID NO: 5368423 - DNA, 23 bp, Homo sapiens
ataatcatggctcttagaaactc

SEQ ID NO: 5368424 - DNA, 19 bp, Homo sapiens
ataatcatgtaaatgctca

SEQ ID NO: 5368425 - DNA, 21 bp, Homo sapiens
ataatcattattacttttgct

SEQ ID NO: 5368426 - DNA, 16 bp, Homo sapiens
ataatcattgcttatg

SEQ ID NO: 5368427 - DNA, 22 bp, Homo sapiens
ataatcattttagaattaaaat

SEQ ID NO: 5368428 - DNA, 20 bp, Homo sapiens
ataatccaggtaactttgaa

SEQ ID NO: 5368429 - DNA, 16 bp, Homo sapiens
ataatccattccaaaa

SEQ ID NO: 5368430 - DNA, 14 bp, Homo sapiens
ataatcccagcatt

SEQ ID NO: 5368431 - DNA, 14 bp, Homo sapiens
ataatcccagctac

SEQ ID NO: 5368432 - DNA, 20 bp, Homo sapiens
ataatccctggatgatattt

SEQ ID NO: 5368433 - DNA, 15 bp, Homo sapiens
ataatcctgcaaagt

SEQ ID NO: 5368434 - DNA, 20 bp, Homo sapiens
ataatcctgtgaaaatatga

SEQ ID NO: 5368435 - DNA, 18 bp, Homo sapiens
ataatcgaagcaaaagta

SEQ ID NO: 5368436 - DNA, 17 bp, Homo sapiens
ataatcgctcttttcca

SEQ ID NO: 5368437 - DNA, 15 bp, Homo sapiens
ataatctagaacaca

SEQ ID NO: 5368438 - DNA, 23 bp, Homo sapiens
ataatctagtttacagaaaaatc

SEQ ID NO: 5368439 - DNA, 17 bp, Homo sapiens
ataatctatattaaatg

SEQ ID NO: 5368440 - DNA, 19 bp, Homo sapiens
ataatctatattaaatgag

SEQ ID NO: 5368441 - DNA, 14 bp, Homo sapiens
ataatctatttcta

SEQ ID NO: 5368442 - DNA, 18 bp, Homo sapiens
ataatctcaaaggagaaa

SEQ ID NO: 5368443 - DNA, 19 bp, Homo sapiens
ataatctcacaaaacatat

SEQ ID NO: 5368444 - DNA, 13 bp, Homo sapiens
ataatctcatttc

SEQ ID NO: 5368445 - DNA, 20 bp, Homo sapiens
ataatctcctctaaaacaac

SEQ ID NO: 5368446 - DNA, 14 bp, Homo sapiens
ataatctgaaatga

SEQ ID NO: 5368447 - DNA, 17 bp, Homo sapiens
ataatctgaagatatat

SEQ ID NO: 5368448 - DNA, 12 bp, Homo sapiens
ataatctgagca

SEQ ID NO: 5368449 - DNA, 24 bp, Homo sapiens
ataatctgagcaggtacatttctg

SEQ ID NO: 5368450 - DNA, 21 bp, Homo sapiens
ataatctgatgggcctggctg

SEQ ID NO: 5368451 - DNA, 18 bp, Homo sapiens
ataatctggactcctctg

SEQ ID NO: 5368452 - DNA, 19 bp, Homo sapiens
ataatctgtcaaaacactg

SEQ ID NO: 5368453 - DNA, 13 bp, Homo sapiens
ataatcttataca

SEQ ID NO: 5368454 - DNA, 14 bp, Homo sapiens
ataatcttatacaa

SEQ ID NO: 5368455 - DNA, 20 bp, Homo sapiens
ataatcttcaggtgaacact

SEQ ID NO: 5368456 - DNA, 17 bp, Homo sapiens
ataatcttctgccttct

SEQ ID NO: 5368457 - DNA, 20 bp, Homo sapiens
ataatcttctgccttctcat

SEQ ID NO: 5368458 - DNA, 19 bp, Homo sapiens
ataatcttggcttcttaaa

SEQ ID NO: 5368459 - DNA, 20 bp, Homo sapiens
ataatcttggcttcttaaaa

SEQ ID NO: 5368460 - DNA, 15 bp, Homo sapiens
ataatcttttacatt

SEQ ID NO: 5368461 - DNA, 17 bp, Homo sapiens
ataatcttttacattga

SEQ ID NO: 5368462 - DNA, 18 bp, Homo sapiens
ataatgaaataatcagtg

SEQ ID NO: 5368463 - DNA, 16 bp, Homo sapiens
ataatgaacagaattt

SEQ ID NO: 5368464 - DNA, 12 bp, Homo sapiens
ataatgaacttt

SEQ ID NO: 5368465 - DNA, 17 bp, Homo sapiens
ataatgaagaacactgt

SEQ ID NO: 5368466 - DNA, 13 bp, Homo sapiens
ataatgaagaatg

SEQ ID NO: 5368467 - DNA, 14 bp, Homo sapiens
ataatgaagcttta

SEQ ID NO: 5368468 - DNA, 14 bp, Homo sapiens
ataatgaataaatc

SEQ ID NO: 5368469 - DNA, 14 bp, Homo sapiens
ataatgaatacttt

SEQ ID NO: 5368470 - DNA, 15 bp, Homo sapiens
ataatgaatactttc

SEQ ID NO: 5368471 - DNA, 14 bp, Homo sapiens
ataatgaatgtcat

SEQ ID NO: 5368472 - DNA, 20 bp, Homo sapiens
ataatgacactgtttcctga

SEQ ID NO: 5368473 - DNA, 12 bp, Homo sapiens
ataatgacagat

SEQ ID NO: 5368474 - DNA, 14 bp, Homo sapiens
ataatgactctaaa

SEQ ID NO: 5368475 - DNA, 15 bp, Homo sapiens
ataatgacttttaaa

SEQ ID NO: 5368476 - DNA, 19 bp, Homo sapiens
ataatgagaccttggggat

SEQ ID NO: 5368477 - DNA, 14 bp, Homo sapiens
ataatgagatgtaa

SEQ ID NO: 5368478 - DNA, 14 bp, Homo sapiens
ataatgagatgtga

SEQ ID NO: 5368479 - DNA, 10 bp, Homo sapiens
ataatgagga

SEQ ID NO: 5368480 - DNA, 23 bp, Homo sapiens
ataatgagtaatgcagacattta

SEQ ID NO: 5368481 - DNA, 21 bp, Homo sapiens
ataatgagtctgcataaactt

SEQ ID NO: 5368482 - DNA, 15 bp, Homo sapiens
ataatgataaaacac

SEQ ID NO: 5368483 - DNA, 16 bp, Homo sapiens
ataatgataaaacacc

SEQ ID NO: 5368484 - DNA, 17 bp, Homo sapiens
ataatgataaaacacct

SEQ ID NO: 5368485 - DNA, 22 bp, Homo sapiens
ataatgataaaataaataattt

SEQ ID NO: 5368486 - DNA, 17 bp, Homo sapiens
ataatgatctgaatctg

SEQ ID NO: 5368487 - DNA, 22 bp, Homo sapiens
ataatgatgatgggaattgtgt

SEQ ID NO: 5368488 - DNA, 23 bp, Homo sapiens
ataatgatggatttaacagcatg

SEQ ID NO: 5368489 - DNA, 20 bp, Homo sapiens
ataatgattaagggacattt

SEQ ID NO: 5368490 - DNA, 22 bp, Homo sapiens
ataatgattaagggacatttct

SEQ ID NO: 5368491 - DNA, 15 bp, Homo sapiens
ataatgattaggaga

SEQ ID NO: 5368492 - DNA, 18 bp, Homo sapiens
ataatgattcaatgtgaa

SEQ ID NO: 5368493 - DNA, 19 bp, Homo sapiens
ataatgattcaatgtgaat

SEQ ID NO: 5368494 - DNA, 19 bp, Homo sapiens
ataatgatttaagcatttt

SEQ ID NO: 5368495 - DNA, 15 bp, Homo sapiens
ataatgatttcctct

SEQ ID NO: 5368496 - DNA, 16 bp, Homo sapiens
ataatgatttgctctt

SEQ ID NO: 5368497 - DNA, 21 bp, Homo sapiens
ataatgatttgctctttgaca

SEQ ID NO: 5368498 - DNA, 10 bp, Homo sapiens
ataatgcaat

SEQ ID NO: 5368499 - DNA, 18 bp, Homo sapiens
ataatgcagaagtattct

SEQ ID NO: 5368500 - DNA, 19 bp, Homo sapiens
ataatgcagataaatacat

SEQ ID NO: 5368501 - DNA, 13 bp, Homo sapiens
ataatgcagtatg

SEQ ID NO: 5368502 - DNA, 19 bp, Homo sapiens
ataatgcagtatggtacat

SEQ ID NO: 5368503 - DNA, 14 bp, Homo sapiens
ataatgcatgaagc

SEQ ID NO: 5368504 - DNA, 14 bp, Homo sapiens
ataatgcatttctg

SEQ ID NO: 5368505 - DNA, 19 bp, Homo sapiens
ataatgccaccaaaggaga

SEQ ID NO: 5368506 - DNA, 16 bp, Homo sapiens
ataatgccccaaggac

SEQ ID NO: 5368507 - DNA, 16 bp, Homo sapiens
ataatgcctttgtaac

SEQ ID NO: 5368508 - DNA, 19 bp, Homo sapiens
ataatgcggacacttttga

SEQ ID NO: 5368509 - DNA, 22 bp, Homo sapiens
ataatgcggacacttttgagga

SEQ ID NO: 5368510 - DNA, 21 bp, Homo sapiens
ataatgcgtgcataccacttt

SEQ ID NO: 5368511 - DNA, 17 bp, Homo sapiens
ataatgctaatttaaag

SEQ ID NO: 5368512 - DNA, 15 bp, Homo sapiens
ataatgctaatttta

SEQ ID NO: 5368513 - DNA, 14 bp, Homo sapiens
ataatgctacaatt

SEQ ID NO: 5368514 - DNA, 15 bp, Homo sapiens
ataatgctacaattt

SEQ ID NO: 5368515 - DNA, 17 bp, Homo sapiens
ataatgctacaatttta

SEQ ID NO: 5368516 - DNA, 16 bp, Homo sapiens
ataatgctattttaaa

SEQ ID NO: 5368517 - DNA, 23 bp, Homo sapiens
ataatgctattttaaaaaatata

SEQ ID NO: 5368518 - DNA, 17 bp, Homo sapiens
ataatgctcacttggtc

SEQ ID NO: 5368519 - DNA, 20 bp, Homo sapiens
ataatgctcccatctcctga

SEQ ID NO: 5368520 - DNA, 20 bp, Homo sapiens
ataatgcttaacataaactt

SEQ ID NO: 5368521 - DNA, 17 bp, Homo sapiens
ataatgcttaatttcta

SEQ ID NO: 5368522 - DNA, 18 bp, Homo sapiens
ataatgcttaatttctaa

SEQ ID NO: 5368523 - DNA, 13 bp, Homo sapiens
ataatgctttctg

SEQ ID NO: 5368524 - DNA, 14 bp, Homo sapiens
ataatgctttgtta

SEQ ID NO: 5368525 - DNA, 14 bp, Homo sapiens
ataatggaaaaaaa

SEQ ID NO: 5368526 - DNA, 16 bp, Homo sapiens
ataatggaaaaatagt

SEQ ID NO: 5368527 - DNA, 15 bp, Homo sapiens
atacaagataagctt

SEQ ID NO: 5368528 - DNA, 19 bp, Homo sapiens
atacaagatattatgtata

SEQ ID NO: 5368529 - DNA, 15 bp, Homo sapiens
atacaagattgaaaa

SEQ ID NO: 5368530 - DNA, 18 bp, Homo sapiens
atacaagccaagctagaa

SEQ ID NO: 5368531 - DNA, 17 bp, Homo sapiens
atacaagctacagttgt

SEQ ID NO: 5368532 - DNA, 23 bp, Homo sapiens
atacaagctacagttgtccagat

SEQ ID NO: 5368533 - DNA, 17 bp, Homo sapiens
atacaaggacattcact

SEQ ID NO: 5368534 - DNA, 19 bp, Homo sapiens
atacaaggcaagcattttt

SEQ ID NO: 5368535 - DNA, 22 bp, Homo sapiens
atacaaggcccagaagcctgat

SEQ ID NO: 5368536 - DNA, 20 bp, Homo sapiens
atacaaggtgagtgtgactt

SEQ ID NO: 5368537 - DNA, 16 bp, Homo sapiens
atacaagtaaattctg

SEQ ID NO: 5368538 - DNA, 17 bp, Homo sapiens
atacaagtaaattctgt

SEQ ID NO: 5368539 - DNA, 22 bp, Homo sapiens
atacaagtgataatacagattt

SEQ ID NO: 5368540 - DNA, 21 bp, Homo sapiens
atacaagttacatacatttaa

SEQ ID NO: 5368541 - DNA, 13 bp, Homo sapiens
atacaagttcttt

SEQ ID NO: 5368542 - DNA, 18 bp, Homo sapiens
atacaagtttgaacaggc

SEQ ID NO: 5368543 - DNA, 17 bp, Homo sapiens
atacaataaaacaaata

SEQ ID NO: 5368544 - DNA, 14 bp, Homo sapiens
atacaataaaagag

SEQ ID NO: 5368545 - DNA, 20 bp, Homo sapiens
atacaataacccagttactt

SEQ ID NO: 5368546 - DNA, 20 bp, Homo sapiens
atacaataatgtaatttagt

SEQ ID NO: 5368547 - DNA, 15 bp, Homo sapiens
atacaatatataaaa

SEQ ID NO: 5368548 - DNA, 20 bp, Homo sapiens
atacaatatataaaaatata

SEQ ID NO: 5368549 - DNA, 15 bp, Homo sapiens
atacaatatcatcca

SEQ ID NO: 5368550 - DNA, 12 bp, Homo sapiens
atacaatattgc

SEQ ID NO: 5368551 - DNA, 16 bp, Homo sapiens
atacaatcctgtttat

SEQ ID NO: 5368552 - DNA, 17 bp, Homo sapiens
atacaatgaacacttat

SEQ ID NO: 5368553 - DNA, 18 bp, Homo sapiens
atacaatgaacacttata

SEQ ID NO: 5368554 - DNA, 16 bp, Homo sapiens
atacaatgacaagtat

SEQ ID NO: 5368555 - DNA, 23 bp, Homo sapiens
atacaatgctgtgccctaaagtg

SEQ ID NO: 5368556 - DNA, 20 bp, Homo sapiens
atacaatggtcatttccaga

SEQ ID NO: 5368557 - DNA, 21 bp, Homo sapiens
atacaatggtcatttccagac

SEQ ID NO: 5368558 - DNA, 12 bp, Homo sapiens
atacaatgtaca

SEQ ID NO: 5368559 - DNA, 15 bp, Homo sapiens
atacaatgtacaatt

SEQ ID NO: 5368560 - DNA, 17 bp, Homo sapiens
atacaatgtacaattat

SEQ ID NO: 5368561 - DNA, 17 bp, Homo sapiens
atacaatgtatgtaatt

SEQ ID NO: 5368562 - DNA, 21 bp, Homo sapiens
atacaatgtatgtacaataca

SEQ ID NO: 5368563 - DNA, 18 bp, Homo sapiens
atacaatgtatttattta

SEQ ID NO: 5368564 - DNA, 19 bp, Homo sapiens
atacaatgttctgttgtaa

SEQ ID NO: 5368565 - DNA, 13 bp, Homo sapiens
atacaattaaagg

SEQ ID NO: 5368566 - DNA, 16 bp, Homo sapiens
atacaattattgtata

SEQ ID NO: 5368567 - DNA, 17 bp, Homo sapiens
atacaattattgtatat

SEQ ID NO: 5368568 - DNA, 20 bp, Homo sapiens
atacaattattgtatattga

SEQ ID NO: 5368569 - DNA, 14 bp, Homo sapiens
atacaattcaaatg

SEQ ID NO: 5368570 - DNA, 12 bp, Homo sapiens
atacaattcagt

SEQ ID NO: 5368571 - DNA, 13 bp, Homo sapiens
atacaattcagta

SEQ ID NO: 5368572 - DNA, 22 bp, Homo sapiens
atacaattcagtactgattatt

SEQ ID NO: 5368573 - DNA, 23 bp, Homo sapiens
atacaattcagttttagtttcaa

SEQ ID NO: 5368574 - DNA, 15 bp, Homo sapiens
atacaatttactttt

SEQ ID NO: 5368575 - DNA, 16 bp, Homo sapiens
atacaatttactttta

SEQ ID NO: 5368576 - DNA, 22 bp, Homo sapiens
atacaatttctattatttttca

SEQ ID NO: 5368577 - DNA, 12 bp, Homo sapiens
atacaatttgta

SEQ ID NO: 5368578 - DNA, 16 bp, Homo sapiens
atacaattttgtttct

SEQ ID NO: 5368579 - DNA, 20 bp, Homo sapiens
atacaattttttttattagt

SEQ ID NO: 5368580 - DNA, 18 bp, Homo sapiens
atacacaaagatattatt

SEQ ID NO: 5368581 - DNA, 14 bp, Homo sapiens
atacacaacattta

SEQ ID NO: 5368582 - DNA, 17 bp, Homo sapiens
atacacaactttgcaaa

SEQ ID NO: 5368583 - DNA, 22 bp, Homo sapiens
atacacaagagggactgtattt

SEQ ID NO: 5368584 - DNA, 18 bp, Homo sapiens
atacacaagcaatgcaag

SEQ ID NO: 5368585 - DNA, 22 bp, Homo sapiens
atacacaaggccagaaaaagaa

SEQ ID NO: 5368586 - DNA, 9 bp, Homo sapiens
atacacaca

SEQ ID NO: 5368587 - DNA, 10 bp, Homo sapiens
atacacacac

SEQ ID NO: 5368588 - DNA, 19 bp, Homo sapiens
atacacacacaaaccattt

SEQ ID NO: 5368589 - DNA, 14 bp, Homo sapiens
atacacacacaaag

SEQ ID NO: 5368590 - DNA, 16 bp, Homo sapiens
atacacacacacacac

SEQ ID NO: 5368591 - DNA, 22 bp, Homo sapiens
atacacacacacacacagccac

SEQ ID NO: 5368592 - DNA, 13 bp, Homo sapiens
atacacacaggag

SEQ ID NO: 5368593 - DNA, 21 bp, Homo sapiens
atacacacatagtttcttttt

SEQ ID NO: 5368594 - DNA, 22 bp, Homo sapiens
atacacacatagtttctttttt

SEQ ID NO: 5368595 - DNA, 14 bp, Homo sapiens
atacacacatatac

SEQ ID NO: 5368596 - DNA, 22 bp, Homo sapiens
atacacacatatacatatatat

SEQ ID NO: 5368597 - DNA, 19 bp, Homo sapiens
atacacacatatgtcatat

SEQ ID NO: 5368598 - DNA, 20 bp, Homo sapiens
atacacacatgccctcctgg

SEQ ID NO: 5368599 - DNA, 14 bp, Homo sapiens
atacacaccctgcc

SEQ ID NO: 5368600 - DNA, 15 bp, Homo sapiens
atacacaccctgccc

SEQ ID NO: 5368601 - DNA, 19 bp, Homo sapiens
atacacactcgaatcattg

SEQ ID NO: 5368602 - DNA, 19 bp, Homo sapiens
atacacagaaatcctaaca

SEQ ID NO: 5368603 - DNA, 18 bp, Homo sapiens
atacacagggaggggatg

SEQ ID NO: 5368604 - DNA, 16 bp, Homo sapiens
atacacagtactttat

SEQ ID NO: 5368605 - DNA, 19 bp, Homo sapiens
atacacagtactttattgt

SEQ ID NO: 5368606 - DNA, 10 bp, Homo sapiens
atacacataa

SEQ ID NO: 5368607 - DNA, 15 bp, Homo sapiens
atacacatacataca

SEQ ID NO: 5368608 - DNA, 18 bp, Homo sapiens
atacacatacatacacat

SEQ ID NO: 5368609 - DNA, 16 bp, Homo sapiens
atacacatacatacat

SEQ ID NO: 5368610 - DNA, 19 bp, Homo sapiens
atacacatacatatataca

SEQ ID NO: 5368611 - DNA, 18 bp, Homo sapiens
atacacatagttctgtaa

SEQ ID NO: 5368612 - DNA, 15 bp, Homo sapiens
atacacatataaaaa

SEQ ID NO: 5368613 - DNA, 23 bp, Homo sapiens
atacacatatacctataatgtgt

SEQ ID NO: 5368614 - DNA, 15 bp, Homo sapiens
atacacatatagtgt

SEQ ID NO: 5368615 - DNA, 20 bp, Homo sapiens
atacacatccccagccagaa

SEQ ID NO: 5368616 - DNA, 22 bp, Homo sapiens
atacacatctctgtcagtgtga

SEQ ID NO: 5368617 - DNA, 22 bp, Homo sapiens
atacacatgaaaacaagaaaga

SEQ ID NO: 5368618 - DNA, 22 bp, Homo sapiens
atacacatttgctactgttgta

SEQ ID NO: 5368619 - DNA, 17 bp, Homo sapiens
atacacattttgtaaat

SEQ ID NO: 5368620 - DNA, 17 bp, Homo sapiens
atacaccaaacatttct

SEQ ID NO: 5368621 - DNA, 17 bp, Homo sapiens
atacaccactacattct

SEQ ID NO: 5368622 - DNA, 20 bp, Homo sapiens
atacaccactgcaaaatgtc

SEQ ID NO: 5368623 - DNA, 21 bp, Homo sapiens
atacacctcaactaaatccaa

SEQ ID NO: 5368624 - DNA, 18 bp, Homo sapiens
atacaccttccccaccct

SEQ ID NO: 5368625 - DNA, 15 bp, Homo sapiens
atacacgaaagagag

SEQ ID NO: 5368626 - DNA, 20 bp, Homo sapiens
atacacgaatagacatcaaa

SEQ ID NO: 5368627 - DNA, 14 bp, Homo sapiens
atacacgtgtatat

SEQ ID NO: 5368628 - DNA, 19 bp, Homo sapiens
atacacgttaactgcagag

SEQ ID NO: 5368629 - DNA, 22 bp, Homo sapiens
atacactcaagtgccattcatc

SEQ ID NO: 5368630 - DNA, 14 bp, Homo sapiens
atacactcatgggg

SEQ ID NO: 5368631 - DNA, 12 bp, Homo sapiens
atacactcctgc

SEQ ID NO: 5368632 - DNA, 15 bp, Homo sapiens
atacactgaaaggaa

SEQ ID NO: 5368633 - DNA, 21 bp, Homo sapiens
atacactgaagttaacagaga

SEQ ID NO: 5368634 - DNA, 20 bp, Homo sapiens
atacactgaatggaaataaa

SEQ ID NO: 5368635 - DNA, 15 bp, Homo sapiens
atacactgaattgaa

SEQ ID NO: 5368636 - DNA, 14 bp, Homo sapiens
atacactgcacttt

SEQ ID NO: 5368637 - DNA, 22 bp, Homo sapiens
atacactgcactttgtttagaa

SEQ ID NO: 5368638 - DNA, 13 bp, Homo sapiens
atacactggaatt

SEQ ID NO: 5368639 - DNA, 19 bp, Homo sapiens
atacactgtaagctttgtt

SEQ ID NO: 5368640 - DNA, 22 bp, Homo sapiens
atacactgtaagctttgttctg

SEQ ID NO: 5368641 - DNA, 14 bp, Homo sapiens
atacactgtatcta

SEQ ID NO: 5368642 - DNA, 18 bp, Homo sapiens
atacacttcttaaataca

SEQ ID NO: 5368643 - DNA, 19 bp, Homo sapiens
atacacttggagtttgcat

SEQ ID NO: 5368644 - DNA, 21 bp, Homo sapiens
atacacttggagtttgcattc

SEQ ID NO: 5368645 - DNA, 17 bp, Homo sapiens
atacacttgtataaatg

SEQ ID NO: 5368646 - DNA, 18 bp, Homo sapiens
atacacttgtataaatgt

SEQ ID NO: 5368647 - DNA, 22 bp, Homo sapiens
atacacttgtataaatgtatat

SEQ ID NO: 5368648 - DNA, 13 bp, Homo sapiens
atacactttatta

SEQ ID NO: 5368649 - DNA, 17 bp, Homo sapiens
atacactttgttgcaag

SEQ ID NO: 5368650 - DNA, 13 bp, Homo sapiens
atacagaaatgca

SEQ ID NO: 5368651 - DNA, 15 bp, Homo sapiens
atacagaaatgcaaa

SEQ ID NO: 5368652 - DNA, 16 bp, Homo sapiens
atacagaactcacagt

SEQ ID NO: 5368653 - DNA, 20 bp, Homo sapiens
atacagaactcacagtacct

SEQ ID NO: 5368654 - DNA, 14 bp, Homo sapiens
atacagaactcttt

SEQ ID NO: 5368655 - DNA, 15 bp, Homo sapiens
atacagaactctttc

SEQ ID NO: 5368656 - DNA, 16 bp, Homo sapiens
atacagaactctttca

SEQ ID NO: 5368657 - DNA, 18 bp, Homo sapiens
atacagaactctttcaaa

SEQ ID NO: 5368658 - DNA, 18 bp, Homo sapiens
atacagaatcttgttttg

SEQ ID NO: 5368659 - DNA, 22 bp, Homo sapiens
atacagaattgactgcagttga

SEQ ID NO: 5368660 - DNA, 20 bp, Homo sapiens
atacagacaaacttgatttc

SEQ ID NO: 5368661 - DNA, 12 bp, Homo sapiens
atacagacacat

SEQ ID NO: 5368662 - DNA, 19 bp, Homo sapiens
atacagacactaagttata

SEQ ID NO: 5368663 - DNA, 13 bp, Homo sapiens
atacagacattca

SEQ ID NO: 5368664 - DNA, 21 bp, Homo sapiens
atacagacattcaatgaatta

SEQ ID NO: 5368665 - DNA, 16 bp, Homo sapiens
atacagacctaatatc

SEQ ID NO: 5368666 - DNA, 15 bp, Homo sapiens
atacagacctccaga

SEQ ID NO: 5368667 - DNA, 14 bp, Homo sapiens
atacagagaagtca

SEQ ID NO: 5368668 - DNA, 23 bp, Homo sapiens
atacagagaagtcacagggcagt

SEQ ID NO: 5368669 - DNA, 20 bp, Homo sapiens
atacagagattgtagtattt

SEQ ID NO: 5368670 - DNA, 16 bp, Homo sapiens
atacagagcctgtttt

SEQ ID NO: 5368671 - DNA, 21 bp, Homo sapiens
atacagaggatgccttttctg

SEQ ID NO: 5368672 - DNA, 22 bp, Homo sapiens
atacagaggatgccttttctgt

SEQ ID NO: 5368673 - DNA, 23 bp, Homo sapiens
atacagaggatgccttttctgtg

SEQ ID NO: 5368674 - DNA, 15 bp, Homo sapiens
atacagaggtaacta

SEQ ID NO: 5368675 - DNA, 16 bp, Homo sapiens
atacagaggtaactat

SEQ ID NO: 5368676 - DNA, 14 bp, Homo sapiens
atacagagtaatta

SEQ ID NO: 5368677 - DNA, 13 bp, Homo sapiens
atacagataaatg

SEQ ID NO: 5368678 - DNA, 21 bp, Homo sapiens
atacagataattcatttgtat

SEQ ID NO: 5368679 - DNA, 17 bp, Homo sapiens
atacagatcatcttgga

SEQ ID NO: 5368680 - DNA, 22 bp, Homo sapiens
atacagatccgcatgtgtctgt

SEQ ID NO: 5368681 - DNA, 15 bp, Homo sapiens
atacagatgaaaatt

SEQ ID NO: 5368682 - DNA, 19 bp, Homo sapiens
atacagatttgtaacatta

SEQ ID NO: 5368683 - DNA, 14 bp, Homo sapiens
atacagattttgat

SEQ ID NO: 5368684 - DNA, 18 bp, Homo sapiens
atacagattttgatagca

SEQ ID NO: 5368685 - DNA, 23 bp, Homo sapiens
atacagcaaacctaattgcacaa

SEQ ID NO: 5368686 - DNA, 13 bp, Homo sapiens
atacagcactact

SEQ ID NO: 5368687 - DNA, 14 bp, Homo sapiens
atacagcagcaaga

SEQ ID NO: 5368688 - DNA, 20 bp, Homo sapiens
atacagcatttctttggaaa

SEQ ID NO: 5368689 - DNA, 18 bp, Homo sapiens
atacagccaaagataatc

SEQ ID NO: 5368690 - DNA, 23 bp, Homo sapiens
atacagcctgaataaaccaagac

SEQ ID NO: 5368691 - DNA, 18 bp, Homo sapiens
atacagccttacaataca

SEQ ID NO: 5368692 - DNA, 11 bp, Homo sapiens
atacagctcta

SEQ ID NO: 5368693 - DNA, 12 bp, Homo sapiens
atacagctgtat

SEQ ID NO: 5368694 - DNA, 16 bp, Homo sapiens
atacagcttttggatt

SEQ ID NO: 5368695 - DNA, 17 bp, Homo sapiens
atacaggaaaaacaaaa

SEQ ID NO: 5368696 - DNA, 14 bp, Homo sapiens
atacaggaaaagct

SEQ ID NO: 5368697 - DNA, 15 bp, Homo sapiens
atacaggaaacagtt

SEQ ID NO: 5368698 - DNA, 11 bp, Homo sapiens
atacaggaaat

SEQ ID NO: 5368699 - DNA, 15 bp, Homo sapiens
atacaggaacaacat

SEQ ID NO: 5368700 - DNA, 12 bp, Homo sapiens
atacaggaagaa

SEQ ID NO: 5368701 - DNA, 19 bp, Homo sapiens
atacaggacttttaaatgg

SEQ ID NO: 5368702 - DNA, 19 bp, Homo sapiens
atacaggattattttgatt

SEQ ID NO: 5368703 - DNA, 18 bp, Homo sapiens
atacaggcccctgggttt

SEQ ID NO: 5368704 - DNA, 20 bp, Homo sapiens
atacaggctggaaagtaagg

SEQ ID NO: 5368705 - DNA, 22 bp, Homo sapiens
atacattttacatatggaaata

SEQ ID NO: 5368706 - DNA, 14 bp, Homo sapiens
atacattttattct

SEQ ID NO: 5368707 - DNA, 14 bp, Homo sapiens
atacattttctggt

SEQ ID NO: 5368708 - DNA, 16 bp, Homo sapiens
atacattttgaaaata

SEQ ID NO: 5368709 - DNA, 13 bp, Homo sapiens
atacattttgcag

SEQ ID NO: 5368710 - DNA, 20 bp, Homo sapiens
atacattttgtatattaact

SEQ ID NO: 5368711 - DNA, 16 bp, Homo sapiens
ataccaaaatgttgct

SEQ ID NO: 5368712 - DNA, 20 bp, Homo sapiens
ataccaaaatgttgctgaaa

SEQ ID NO: 5368713 - DNA, 18 bp, Homo sapiens
ataccaaaattatttcag

SEQ ID NO: 5368714 - DNA, 19 bp, Homo sapiens
ataccaaaattatttcaga

SEQ ID NO: 5368715 - DNA, 13 bp, Homo sapiens
ataccaaacatgc

SEQ ID NO: 5368716 - DNA, 16 bp, Homo sapiens
ataccaaagcagttgg

SEQ ID NO: 5368717 - DNA, 17 bp, Homo sapiens
ataccaaagctgctgca

SEQ ID NO: 5368718 - DNA, 24 bp, Homo sapiens
ataccaaatagcttctgttttgtt

SEQ ID NO: 5368719 - DNA, 14 bp, Homo sapiens
ataccaaatatttt

SEQ ID NO: 5368720 - DNA, 13 bp, Homo sapiens
ataccaacctgaa

SEQ ID NO: 5368721 - DNA, 18 bp, Homo sapiens
ataccaactgggcctctg

SEQ ID NO: 5368722 - DNA, 17 bp, Homo sapiens
ataccaagcatgtggat

SEQ ID NO: 5368723 - DNA, 20 bp, Homo sapiens
ataccaagggggtaaaaaaa

SEQ ID NO: 5368724 - DNA, 22 bp, Homo sapiens
ataccaaggtacaactgtattt

SEQ ID NO: 5368725 - DNA, 17 bp, Homo sapiens
ataccaagtatttatta

SEQ ID NO: 5368726 - DNA, 11 bp, Homo sapiens
ataccaagtgt

SEQ ID NO: 5368727 - DNA, 18 bp, Homo sapiens
ataccaatcacaaggata

SEQ ID NO: 5368728 - DNA, 17 bp, Homo sapiens
ataccaatgtgttttct

SEQ ID NO: 5368729 - DNA, 20 bp, Homo sapiens
ataccaatgtgttttctgta

SEQ ID NO: 5368730 - DNA, 18 bp, Homo sapiens
ataccacaagacatttct

SEQ ID NO: 5368731 - DNA, 20 bp, Homo sapiens
ataccacaagcctgagaact

SEQ ID NO: 5368732 - DNA, 21 bp, Homo sapiens
ataccacacttaaaagatggt

SEQ ID NO: 5368733 - DNA, 16 bp, Homo sapiens
ataccacagctattta

SEQ ID NO: 5368734 - DNA, 15 bp, Homo sapiens
ataccacatcaaata

SEQ ID NO: 5368735 - DNA, 14 bp, Homo sapiens
ataccacattttct

SEQ ID NO: 5368736 - DNA, 18 bp, Homo sapiens
ataccaccatttaaaaat

SEQ ID NO: 5368737 - DNA, 16 bp, Homo sapiens
ataccacccatagtgc

SEQ ID NO: 5368738 - DNA, 16 bp, Homo sapiens
ataccacctgtacata

SEQ ID NO: 5368739 - DNA, 14 bp, Homo sapiens
ataccacgaggaaa

SEQ ID NO: 5368740 - DNA, 16 bp, Homo sapiens
ataccactagtggaaa

SEQ ID NO: 5368741 - DNA, 14 bp, Homo sapiens
ataccactctgtaa

SEQ ID NO: 5368742 - DNA, 17 bp, Homo sapiens
ataccactctgtaattg

SEQ ID NO: 5368743 - DNA, 21 bp, Homo sapiens
ataccactctttacctttatt

SEQ ID NO: 5368744 - DNA, 16 bp, Homo sapiens
ataccactgtaattga

SEQ ID NO: 5368745 - DNA, 15 bp, Homo sapiens
ataccagaaagctct

SEQ ID NO: 5368746 - DNA, 16 bp, Homo sapiens
ataccagactgcaggt

SEQ ID NO: 5368747 - DNA, 12 bp, Homo sapiens
ataccagagacc

SEQ ID NO: 5368748 - DNA, 19 bp, Homo sapiens
ataccagagacctgaggca

SEQ ID NO: 5368749 - DNA, 12 bp, Homo sapiens
ataccagagcct

SEQ ID NO: 5368750 - DNA, 17 bp, Homo sapiens
ataccagagtctggagc

SEQ ID NO: 5368751 - DNA, 16 bp, Homo sapiens
ataccagatgaacatt

SEQ ID NO: 5368752 - DNA, 18 bp, Homo sapiens
ataccagatgaacatttc

SEQ ID NO: 5368753 - DNA, 15 bp, Homo sapiens
ataccagcaaaagtg

SEQ ID NO: 5368754 - DNA, 19 bp, Homo sapiens
ataccagcttgtatgcaat

SEQ ID NO: 5368755 - DNA, 16 bp, Homo sapiens
ataccaggattttttt

SEQ ID NO: 5368756 - DNA, 12 bp, Homo sapiens
ataccagtgtgg

SEQ ID NO: 5368757 - DNA, 17 bp, Homo sapiens
ataccatacattatcat

SEQ ID NO: 5368758 - DNA, 19 bp, Homo sapiens
ataccatactcatttctaa

SEQ ID NO: 5368759 - DNA, 23 bp, Homo sapiens
ataccatatgaatgaaacatggg

SEQ ID NO: 5368760 - DNA, 12 bp, Homo sapiens
ataccatcactg

SEQ ID NO: 5368761 - DNA, 14 bp, Homo sapiens
ataccatcttctgt

SEQ ID NO: 5368762 - DNA, 19 bp, Homo sapiens
ataccatggtgaattaatc

SEQ ID NO: 5368763 - DNA, 16 bp, Homo sapiens
ataccatgtataattt

SEQ ID NO: 5368764 - DNA, 23 bp, Homo sapiens
ataccattatatgttccccctgt

SEQ ID NO: 5368765 - DNA, 17 bp, Homo sapiens
ataccattattatgtaa

SEQ ID NO: 5368766 - DNA, 22 bp, Homo sapiens
ataccattcagatcactgaatt

SEQ ID NO: 5368767 - DNA, 18 bp, Homo sapiens
ataccatttagtaagaat

SEQ ID NO: 5368768 - DNA, 21 bp, Homo sapiens
ataccatttatctactatttg

SEQ ID NO: 5368769 - DNA, 13 bp, Homo sapiens
ataccatttccgt

SEQ ID NO: 5368770 - DNA, 15 bp, Homo sapiens
ataccattttgaaat

SEQ ID NO: 5368771 - DNA, 22 bp, Homo sapiens
ataccattttttaaggaaacaa

SEQ ID NO: 5368772 - DNA, 22 bp, Homo sapiens
atacccaaaaccctgaagccat

SEQ ID NO: 5368773 - DNA, 17 bp, Homo sapiens
atacccaaatgtccctg

SEQ ID NO: 5368774 - DNA, 17 bp, Homo sapiens
atacccaacagtttatt

SEQ ID NO: 5368775 - DNA, 19 bp, Homo sapiens
atacccacaatctgagcac

SEQ ID NO: 5368776 - DNA, 12 bp, Homo sapiens
atacccaccccc

SEQ ID NO: 5368777 - DNA, 17 bp, Homo sapiens
atacccacccccaccca

SEQ ID NO: 5368778 - DNA, 20 bp, Homo sapiens
atacccagagagaaaaagag

SEQ ID NO: 5368779 - DNA, 18 bp, Homo sapiens
atacccagcagagggata

SEQ ID NO: 5368780 - DNA, 18 bp, Homo sapiens
atacccatagcttccatg

SEQ ID NO: 5368781 - DNA, 19 bp, Homo sapiens
atacccatgttacttctct

SEQ ID NO: 5368782 - DNA, 19 bp, Homo sapiens
atacccattcttcagtgcc

SEQ ID NO: 5368783 - DNA, 16 bp, Homo sapiens
ataccccaaagtccag

SEQ ID NO: 5368784 - DNA, 20 bp, Homo sapiens
ataccccaaagtccaggcta

SEQ ID NO: 5368785 - DNA, 19 bp, Homo sapiens
ataccccaagactcccatg

SEQ ID NO: 5368786 - DNA, 17 bp, Homo sapiens
ataccccaccagcagaa

SEQ ID NO: 5368787 - DNA, 14 bp, Homo sapiens
ataccccatatatt

SEQ ID NO: 5368788 - DNA, 16 bp, Homo sapiens
ataccccatatattac

SEQ ID NO: 5368789 - DNA, 15 bp, Homo sapiens
ataccccatttgatt

SEQ ID NO: 5368790 - DNA, 15 bp, Homo sapiens
atacccccagagacc

SEQ ID NO: 5368791 - DNA, 17 bp, Homo sapiens
atacccccagagacctt

SEQ ID NO: 5368792 - DNA, 19 bp, Homo sapiens
ataccccctgcaaagccca

SEQ ID NO: 5368793 - DNA, 20 bp, Homo sapiens
ataccccctgccccagagaa

SEQ ID NO: 5368794 - DNA, 16 bp, Homo sapiens
ataccccgtgaagcat

SEQ ID NO: 5368795 - DNA, 15 bp, Homo sapiens
atacccctgcctggg

SEQ ID NO: 5368796 - DNA, 19 bp, Homo sapiens
ataccccttattgctgcca

SEQ ID NO: 5368797 - DNA, 20 bp, Homo sapiens
ataccccttattgctgccaa

SEQ ID NO: 5368798 - DNA, 21 bp, Homo sapiens
atacccggtggcttctggcac

SEQ ID NO: 5368799 - DNA, 16 bp, Homo sapiens
ataccctactgtgggg

SEQ ID NO: 5368800 - DNA, 19 bp, Homo sapiens
ataccctagaagaaaaccc

SEQ ID NO: 5368801 - DNA, 18 bp, Homo sapiens
ataccctaggtctccacc

SEQ ID NO: 5368802 - DNA, 21 bp, Homo sapiens
ataccctaggtctccacccct

SEQ ID NO: 5368803 - DNA, 14 bp, Homo sapiens
ataccctccctccc

SEQ ID NO: 5368804 - DNA, 15 bp, Homo sapiens
ataccctgacctggc

SEQ ID NO: 5368805 - DNA, 18 bp, Homo sapiens
atacccttctttaaatca

SEQ ID NO: 5368806 - DNA, 19 bp, Homo sapiens
atacccttctttaaatcaa

SEQ ID NO: 5368807 - DNA, 24 bp, Homo sapiens
atacccttctttaaatcaaaagct

SEQ ID NO: 5368808 - DNA, 19 bp, Homo sapiens
atacccttcttttatgagc

SEQ ID NO: 5368809 - DNA, 14 bp, Homo sapiens
ataccgagaatgat

SEQ ID NO: 5368810 - DNA, 16 bp, Homo sapiens
ataccgagacccacca

SEQ ID NO: 5368811 - DNA, 16 bp, Homo sapiens
ataccgcctcgtgcca

SEQ ID NO: 5368812 - DNA, 16 bp, Homo sapiens
ataccgctcagtattt

SEQ ID NO: 5368813 - DNA, 20 bp, Homo sapiens
ataccgtttggtgtctgatg

SEQ ID NO: 5368814 - DNA, 13 bp, Homo sapiens
atacctaaaagag

SEQ ID NO: 5368815 - DNA, 16 bp, Homo sapiens
atacctaaataaagaa

SEQ ID NO: 5368816 - DNA, 13 bp, Homo sapiens
atacctaagcaaa

SEQ ID NO: 5368817 - DNA, 17 bp, Homo sapiens
atacctacaataaactg

SEQ ID NO: 5368818 - DNA, 15 bp, Homo sapiens
atacctactgactga

SEQ ID NO: 5368819 - DNA, 19 bp, Homo sapiens
atacctactgactgatgac

SEQ ID NO: 5368820 - DNA, 21 bp, Homo sapiens
atacctagtgatacggattta

SEQ ID NO: 5368821 - DNA, 18 bp, Homo sapiens
atacctcaggaaagaata

SEQ ID NO: 5368822 - DNA, 21 bp, Homo sapiens
atacctcaggaaagaatagaa

SEQ ID NO: 5368823 - DNA, 13 bp, Homo sapiens
atacctcatgttt

SEQ ID NO: 5368824 - DNA, 21 bp, Homo sapiens
atacctcatgtttatgaaaat

SEQ ID NO: 5368825 - DNA, 17 bp, Homo sapiens
atacctcattcacagct

SEQ ID NO: 5368826 - DNA, 19 bp, Homo sapiens
atacctcatttttcatact

SEQ ID NO: 5368827 - DNA, 17 bp, Homo sapiens
atacctccattaaatgg

SEQ ID NO: 5368828 - DNA, 22 bp, Homo sapiens
atacctccctcatttaagaaaa

SEQ ID NO: 5368829 - DNA, 17 bp, Homo sapiens
atacctcgttagagaat

SEQ ID NO: 5368830 - DNA, 15 bp, Homo sapiens
atacctctaactgtg

SEQ ID NO: 5368831 - DNA, 16 bp, Homo sapiens
atacctctaataacct

SEQ ID NO: 5368832 - DNA, 18 bp, Homo sapiens
atacctctaatagtataa

SEQ ID NO: 5368833 - DNA, 21 bp, Homo sapiens
atacctctctctatatataca

SEQ ID NO: 5368834 - DNA, 15 bp, Homo sapiens
atacctctgaccaac

SEQ ID NO: 5368835 - DNA, 15 bp, Homo sapiens
atacctctgctggga

SEQ ID NO: 5368836 - DNA, 18 bp, Homo sapiens
atacctctggcttagaaa

SEQ ID NO: 5368837 - DNA, 18 bp, Homo sapiens
atacctcttactttgctt

SEQ ID NO: 5368838 - DNA, 23 bp, Homo sapiens
atacctgagcctcaaccttctgg

SEQ ID NO: 5368839 - DNA, 20 bp, Homo sapiens
atacctgattttttttcctt

SEQ ID NO: 5368840 - DNA, 14 bp, Homo sapiens
atacctgcacgttc

SEQ ID NO: 5368841 - DNA, 12 bp, Homo sapiens
atacctgcccct

SEQ ID NO: 5368842 - DNA, 17 bp, Homo sapiens
atacctggcctcattta

SEQ ID NO: 5368843 - DNA, 19 bp, Homo sapiens
atacctggcctcatttaaa

SEQ ID NO: 5368844 - DNA, 22 bp, Homo sapiens
atacctggcctcatttaaaaca

SEQ ID NO: 5368845 - DNA, 20 bp, Homo sapiens
atacctggcttttactttat

SEQ ID NO: 5368846 - DNA, 20 bp, Homo sapiens
atacctgggatactgtgccc

SEQ ID NO: 5368847 - DNA, 13 bp, Homo sapiens
atacctggtttac

SEQ ID NO: 5368848 - DNA, 17 bp, Homo sapiens
atacctgtacacacaca

SEQ ID NO: 5368849 - DNA, 13 bp, Homo sapiens
atacctgtccccc

SEQ ID NO: 5368850 - DNA, 21 bp, Homo sapiens
atacctgtcctagcaggatct

SEQ ID NO: 5368851 - DNA, 22 bp, Homo sapiens
atacctgtctaggaaggtgtga

SEQ ID NO: 5368852 - DNA, 19 bp, Homo sapiens
atacctgtgtttcttgcct

SEQ ID NO: 5368853 - DNA, 21 bp, Homo sapiens
atacctgtgtttcttgcctca

SEQ ID NO: 5368854 - DNA, 13 bp, Homo sapiens
ataccttaaaatt

SEQ ID NO: 5368855 - DNA, 15 bp, Homo sapiens
ataccttaaaatttg

SEQ ID NO: 5368856 - DNA, 18 bp, Homo sapiens
ataccttaaaatttgaaa

SEQ ID NO: 5368857 - DNA, 19 bp, Homo sapiens
ataccttaaaatttgaaac

SEQ ID NO: 5368858 - DNA, 21 bp, Homo sapiens
ataccttaaaatttgaaacat

SEQ ID NO: 5368859 - DNA, 22 bp, Homo sapiens
ataccttaaaatttgaaacatt

SEQ ID NO: 5368860 - DNA, 23 bp, Homo sapiens
ataccttaaaatttgaaacattg

SEQ ID NO: 5368861 - DNA, 16 bp, Homo sapiens
ataccttaattctttg

SEQ ID NO: 5368862 - DNA, 18 bp, Homo sapiens
ataccttagtgcagttat

SEQ ID NO: 5368863 - DNA, 18 bp, Homo sapiens
ataccttatatatgcact

SEQ ID NO: 5368864 - DNA, 15 bp, Homo sapiens
ataccttatttattt

SEQ ID NO: 5368865 - DNA, 14 bp, Homo sapiens
ataccttccatctc

SEQ ID NO: 5368866 - DNA, 20 bp, Homo sapiens
ataccttccttccctgggct

SEQ ID NO: 5368867 - DNA, 22 bp, Homo sapiens
ataccttctatgtattagtgtc

SEQ ID NO: 5368868 - DNA, 12 bp, Homo sapiens
ataccttctccc

SEQ ID NO: 5368869 - DNA, 13 bp, Homo sapiens
ataccttctccca

SEQ ID NO: 5368870 - DNA, 17 bp, Homo sapiens
ataccttctcccaggcc

SEQ ID NO: 5368871 - DNA, 14 bp, Homo sapiens
ataccttctgatga

SEQ ID NO: 5368872 - DNA, 14 bp, Homo sapiens
ataccttcttcgct

SEQ ID NO: 5368873 - DNA, 23 bp, Homo sapiens
ataccttgaaaaagtagagaaca

SEQ ID NO: 5368874 - DNA, 14 bp, Homo sapiens
ataccttgcttatt

SEQ ID NO: 5368875 - DNA, 12 bp, Homo sapiens
atacctttaaat

SEQ ID NO: 5368876 - DNA, 22 bp, Homo sapiens
atacctttcacagcttttatca

SEQ ID NO: 5368877 - DNA, 12 bp, Homo sapiens
atacctttccag

SEQ ID NO: 5368878 - DNA, 21 bp, Homo sapiens
atacctttcctttttggggag

SEQ ID NO: 5368879 - DNA, 15 bp, Homo sapiens
atacctttgccttgg

SEQ ID NO: 5368880 - DNA, 22 bp, Homo sapiens
atacctttgcgtggatcaagct

SEQ ID NO: 5368881 - DNA, 20 bp, Homo sapiens
atacctttgctactactatg

SEQ ID NO: 5368882 - DNA, 16 bp, Homo sapiens
atacctttggaaaaat

SEQ ID NO: 5368883 - DNA, 22 bp, Homo sapiens
atacttccttataaaaattcta

SEQ ID NO: 5368884 - DNA, 19 bp, Homo sapiens
atacttcgacactgttctt

SEQ ID NO: 5368885 - DNA, 20 bp, Homo sapiens
atacttctctttttttgctg

SEQ ID NO: 5368886 - DNA, 18 bp, Homo sapiens
atacttctgctgtgggaa

SEQ ID NO: 5368887 - DNA, 19 bp, Homo sapiens
atacttctgctgtgggaaa

SEQ ID NO: 5368888 - DNA, 22 bp, Homo sapiens
atacttctgctgtgggaaaaat

SEQ ID NO: 5368889 - DNA, 20 bp, Homo sapiens
atacttcttacttgtctgta

SEQ ID NO: 5368890 - DNA, 16 bp, Homo sapiens
atacttcttgtgtgta

SEQ ID NO: 5368891 - DNA, 20 bp, Homo sapiens
atacttgaaaacttctcatt

SEQ ID NO: 5368892 - DNA, 19 bp, Homo sapiens
atacttgaaaattaacatg

SEQ ID NO: 5368893 - DNA, 20 bp, Homo sapiens
atacttgaaaccagtattta

SEQ ID NO: 5368894 - DNA, 22 bp, Homo sapiens
atacttgaaaccagtatttaag

SEQ ID NO: 5368895 - DNA, 15 bp, Homo sapiens
atacttgaacaaaag

SEQ ID NO: 5368896 - DNA, 18 bp, Homo sapiens
atacttgaacaaaagggt

SEQ ID NO: 5368897 - DNA, 17 bp, Homo sapiens
atacttgaaccataaaa

SEQ ID NO: 5368898 - DNA, 18 bp, Homo sapiens
atacttgaactgttgccc

SEQ ID NO: 5368899 - DNA, 13 bp, Homo sapiens
atacttgaacttg

SEQ ID NO: 5368900 - DNA, 17 bp, Homo sapiens
atacttgaagggccaga

SEQ ID NO: 5368901 - DNA, 16 bp, Homo sapiens
atacttgaatatggaa

SEQ ID NO: 5368902 - DNA, 16 bp, Homo sapiens
atacttgaatattata

SEQ ID NO: 5368903 - DNA, 13 bp, Homo sapiens
atacttgaatttt

SEQ ID NO: 5368904 - DNA, 17 bp, Homo sapiens
atacttgaattttttga

SEQ ID NO: 5368905 - DNA, 17 bp, Homo sapiens
atacttgactctaatat

SEQ ID NO: 5368906 - DNA, 10 bp, Homo sapiens
atacttgagc

SEQ ID NO: 5368907 - DNA, 17 bp, Homo sapiens
atacttgatgcacttat

SEQ ID NO: 5368908 - DNA, 18 bp, Homo sapiens
atacttgatgcacttatt

SEQ ID NO: 5368909 - DNA, 20 bp, Homo sapiens
atacttgcaactaaggacaa

SEQ ID NO: 5368910 - DNA, 22 bp, Homo sapiens
atacttgcaactaaggacaaat

SEQ ID NO: 5368911 - DNA, 21 bp, Homo sapiens
atacttgcaagataattttca

SEQ ID NO: 5368912 - DNA, 17 bp, Homo sapiens
atacttgcatccaaggt

SEQ ID NO: 5368913 - DNA, 13 bp, Homo sapiens
atacttggattta

SEQ ID NO: 5368914 - DNA, 17 bp, Homo sapiens
atacttggatttagttt

SEQ ID NO: 5368915 - DNA, 22 bp, Homo sapiens
atacttggatttagtttcagta

SEQ ID NO: 5368916 - DNA, 14 bp, Homo sapiens
atacttggtcctta

SEQ ID NO: 5368917 - DNA, 17 bp, Homo sapiens
atacttggtccttaaaa

SEQ ID NO: 5368918 - DNA, 14 bp, Homo sapiens
atacttgtaacttt

SEQ ID NO: 5368919 - DNA, 17 bp, Homo sapiens
atacttgtattccctta

SEQ ID NO: 5368920 - DNA, 16 bp, Homo sapiens
atacttgtctgtttta

SEQ ID NO: 5368921 - DNA, 13 bp, Homo sapiens
atacttgtgaaca

SEQ ID NO: 5368922 - DNA, 14 bp, Homo sapiens
atacttgtgatttt

SEQ ID NO: 5368923 - DNA, 14 bp, Homo sapiens
atacttgtggacta

SEQ ID NO: 5368924 - DNA, 20 bp, Homo sapiens
atacttgtggactaaaagat

SEQ ID NO: 5368925 - DNA, 18 bp, Homo sapiens
atacttgtggttttcaaa

SEQ ID NO: 5368926 - DNA, 19 bp, Homo sapiens
atacttgtggttttcaaat

SEQ ID NO: 5368927 - DNA, 12 bp, Homo sapiens
atacttgtttca

SEQ ID NO: 5368928 - DNA, 15 bp, Homo sapiens
atacttgttttcaaa

SEQ ID NO: 5368929 - DNA, 15 bp, Homo sapiens
atacttgtttttgta

SEQ ID NO: 5368930 - DNA, 16 bp, Homo sapiens
atacttgtttttgtaa

SEQ ID NO: 5368931 - DNA, 15 bp, Homo sapiens
atactttaaaggaaa

SEQ ID NO: 5368932 - DNA, 20 bp, Homo sapiens
atactttaaataatttaact

SEQ ID NO: 5368933 - DNA, 19 bp, Homo sapiens
atactttaatgttttaact

SEQ ID NO: 5368934 - DNA, 22 bp, Homo sapiens
atactttaatttttataaatat

SEQ ID NO: 5368935 - DNA, 23 bp, Homo sapiens
atactttaatttttataaatatg

SEQ ID NO: 5368936 - DNA, 23 bp, Homo sapiens
atactttagaagtagaattgaca

SEQ ID NO: 5368937 - DNA, 18 bp, Homo sapiens
atactttagtagacattt

SEQ ID NO: 5368938 - DNA, 20 bp, Homo sapiens
atactttagtagacatttat

SEQ ID NO: 5368939 - DNA, 14 bp, Homo sapiens
atactttagtatga

SEQ ID NO: 5368940 - DNA, 16 bp, Homo sapiens
atactttatatatgta

SEQ ID NO: 5368941 - DNA, 13 bp, Homo sapiens
atactttatatct

SEQ ID NO: 5368942 - DNA, 17 bp, Homo sapiens
atactttatatctgtaa

SEQ ID NO: 5368943 - DNA, 16 bp, Homo sapiens
atactttatcaaagat

SEQ ID NO: 5368944 - DNA, 16 bp, Homo sapiens
atactttattgaaagg

SEQ ID NO: 5368945 - DNA, 15 bp, Homo sapiens
atactttatttctga

SEQ ID NO: 5368946 - DNA, 21 bp, Homo sapiens
atactttcatcctgactctgc

SEQ ID NO: 5368947 - DNA, 18 bp, Homo sapiens
atactttccaacattatc

SEQ ID NO: 5368948 - DNA, 15 bp, Homo sapiens
atactttccctaccc

SEQ ID NO: 5368949 - DNA, 21 bp, Homo sapiens
atactttccctaccctctaga

SEQ ID NO: 5368950 - DNA, 19 bp, Homo sapiens
atactttcgaaatttcatt

SEQ ID NO: 5368951 - DNA, 20 bp, Homo sapiens
atactttcggagaaattctc

SEQ ID NO: 5368952 - DNA, 22 bp, Homo sapiens
atactttgaaaggagatgtctt

SEQ ID NO: 5368953 - DNA, 21 bp, Homo sapiens
atactttgaacacaaagcctg

SEQ ID NO: 5368954 - DNA, 20 bp, Homo sapiens
atactttgaagtgcagctca

SEQ ID NO: 5368955 - DNA, 15 bp, Homo sapiens
atactttgaatgtgt

SEQ ID NO: 5368956 - DNA, 23 bp, Homo sapiens
atactttgaatgtgtttcacagt

SEQ ID NO: 5368957 - DNA, 16 bp, Homo sapiens
atactttgaatgttgt

SEQ ID NO: 5368958 - DNA, 17 bp, Homo sapiens
atactttgacaaggaaa

SEQ ID NO: 5368959 - DNA, 18 bp, Homo sapiens
atactttgcataaattaa

SEQ ID NO: 5368960 - DNA, 19 bp, Homo sapiens
atactttgctgttgaagaa

SEQ ID NO: 5368961 - DNA, 23 bp, Homo sapiens
atactttgcttcatagtattgga

SEQ ID NO: 5368962 - DNA, 13 bp, Homo sapiens
atactttgtattt

SEQ ID NO: 5368963 - DNA, 16 bp, Homo sapiens
atactttgtgtctttt

SEQ ID NO: 5368964 - DNA, 21 bp, Homo sapiens
atactttgttctgttgtctgc

SEQ ID NO: 5368965 - DNA, 17 bp, Homo sapiens
atactttgttgttttta

SEQ ID NO: 5368966 - DNA, 23 bp, Homo sapiens
atacttttaaagttttgtcagaa

SEQ ID NO: 5368967 - DNA, 16 bp, Homo sapiens
atacttttaaattatg

SEQ ID NO: 5368968 - DNA, 16 bp, Homo sapiens
atacttttacaagtaa

SEQ ID NO: 5368969 - DNA, 15 bp, Homo sapiens
atacttttactctgc

SEQ ID NO: 5368970 - DNA, 12 bp, Homo sapiens
atacttttatgc

SEQ ID NO: 5368971 - DNA, 18 bp, Homo sapiens
atacttttcccctgttaa

SEQ ID NO: 5368972 - DNA, 19 bp, Homo sapiens
atacttttcccctgttaaa

SEQ ID NO: 5368973 - DNA, 13 bp, Homo sapiens
atacttttgtgta

SEQ ID NO: 5368974 - DNA, 22 bp, Homo sapiens
atacttttgtgtattctgtgga

SEQ ID NO: 5368975 - DNA, 13 bp, Homo sapiens
atactttttcagt

SEQ ID NO: 5368976 - DNA, 17 bp, Homo sapiens
atactttttcttttgta

SEQ ID NO: 5368977 - DNA, 15 bp, Homo sapiens
atacttttttctatt

SEQ ID NO: 5368978 - DNA, 19 bp, Homo sapiens
atacttttttcttatttaa

SEQ ID NO: 5368979 - DNA, 15 bp, Homo sapiens
atactttttttcaca

SEQ ID NO: 5368980 - DNA, 21 bp, Homo sapiens
atacttttttttctttaaaaa

SEQ ID NO: 5368981 - DNA, 14 bp, Homo sapiens
atagaaaaaaagaa

SEQ ID NO: 5368982 - DNA, 16 bp, Homo sapiens
atagaaaaaccctgcc

SEQ ID NO: 5368983 - DNA, 14 bp, Homo sapiens
atagaaaaagcaca

SEQ ID NO: 5368984 - DNA, 18 bp, Homo sapiens
atagaaaaagcacagctc

SEQ ID NO: 5368985 - DNA, 22 bp, Homo sapiens
atagaaaaaggatggaagaaag

SEQ ID NO: 5368986 - DNA, 23 bp, Homo sapiens
atagaaaaaggatggaagaaaga

SEQ ID NO: 5368987 - DNA, 15 bp, Homo sapiens
atagaaaaatgtata

SEQ ID NO: 5368988 - DNA, 16 bp, Homo sapiens
atagaaaacaaaggag

SEQ ID NO: 5368989 - DNA, 22 bp, Homo sapiens
atagaaaacaggaaaaaaactt

SEQ ID NO: 5368990 - DNA, 22 bp, Homo sapiens
atagaaaactaatctaaactgt

SEQ ID NO: 5368991 - DNA, 17 bp, Homo sapiens
atagaaaactgaaaatc

SEQ ID NO: 5368992 - DNA, 20 bp, Homo sapiens
atagaaaactgtggttaaag

SEQ ID NO: 5368993 - DNA, 20 bp, Homo sapiens
atagaaaagatgagaggcag

SEQ ID NO: 5368994 - DNA, 12 bp, Homo sapiens
atagaaaaggaa

SEQ ID NO: 5368995 - DNA, 13 bp, Homo sapiens
atagaaaaggaag

SEQ ID NO: 5368996 - DNA, 22 bp, Homo sapiens
atagaaaaggaagacagcattt

SEQ ID NO: 5368997 - DNA, 22 bp, Homo sapiens
atagaaaagtatgttctaacct

SEQ ID NO: 5368998 - DNA, 14 bp, Homo sapiens
atagaaaagttatt

SEQ ID NO: 5368999 - DNA, 22 bp, Homo sapiens
atagaaaataaaataaattatg

SEQ ID NO: 5369000 - DNA, 13 bp, Homo sapiens
atagaaaattatt

SEQ ID NO: 5369001 - DNA, 16 bp, Homo sapiens
atagaaaattcttgag

SEQ ID NO: 5369002 - DNA, 11 bp, Homo sapiens
atagaaacatg

SEQ ID NO: 5369003 - DNA, 15 bp, Homo sapiens
atagaaacatgacac

SEQ ID NO: 5369004 - DNA, 16 bp, Homo sapiens
atagaaacatgacact

SEQ ID NO: 5369005 - DNA, 17 bp, Homo sapiens
atagaaacgtaaactat

SEQ ID NO: 5369006 - DNA, 21 bp, Homo sapiens
atagaaacgtaaactatgacc

SEQ ID NO: 5369007 - DNA, 20 bp, Homo sapiens
atagaaactaaactaaaata

SEQ ID NO: 5369008 - DNA, 21 bp, Homo sapiens
atagaaactaaactaaaatag

SEQ ID NO: 5369009 - DNA, 21 bp, Homo sapiens
atagaaactgaggagtagctg

SEQ ID NO: 5369010 - DNA, 14 bp, Homo sapiens
atagaaagaaacta

SEQ ID NO: 5369011 - DNA, 13 bp, Homo sapiens
atagaaagcaaac

SEQ ID NO: 5369012 - DNA, 22 bp, Homo sapiens
atagaaagccaaatcaaaatat

SEQ ID NO: 5369013 - DNA, 13 bp, Homo sapiens
atagaaagctgga

SEQ ID NO: 5369014 - DNA, 16 bp, Homo sapiens
atagaaagctggactg

SEQ ID NO: 5369015 - DNA, 17 bp, Homo sapiens
atagaaagctggactga

SEQ ID NO: 5369016 - DNA, 12 bp, Homo sapiens
atagaaaggaac

SEQ ID NO: 5369017 - DNA, 18 bp, Homo sapiens
atagaaagtgttctgtta

SEQ ID NO: 5369018 - DNA, 19 bp, Homo sapiens
atagaaagtgttctgttac

SEQ ID NO: 5369019 - DNA, 19 bp, Homo sapiens
atagaaagttgatattcaa

SEQ ID NO: 5369020 - DNA, 17 bp, Homo sapiens
atagaaagttgcaaggc

SEQ ID NO: 5369021 - DNA, 23 bp, Homo sapiens
atagaaagttgcaaggcaaatgt

SEQ ID NO: 5369022 - DNA, 20 bp, Homo sapiens
atagaaataaatagctatat

SEQ ID NO: 5369023 - DNA, 13 bp, Homo sapiens
atagaaatacatc

SEQ ID NO: 5369024 - DNA, 14 bp, Homo sapiens
atagaaatatatac

SEQ ID NO: 5369025 - DNA, 13 bp, Homo sapiens
atagaaatgctgg

SEQ ID NO: 5369026 - DNA, 22 bp, Homo sapiens
atagaaatgctggtttttcagt

SEQ ID NO: 5369027 - DNA, 12 bp, Homo sapiens
atagaaatggaa

SEQ ID NO: 5369028 - DNA, 22 bp, Homo sapiens
atagaaatggtttcctctggat

SEQ ID NO: 5369029 - DNA, 17 bp, Homo sapiens
atagaaatgtattttga

SEQ ID NO: 5369030 - DNA, 17 bp, Homo sapiens
atagaaatgtttgctga

SEQ ID NO: 5369031 - DNA, 14 bp, Homo sapiens
atagaaattctgaa

SEQ ID NO: 5369032 - DNA, 16 bp, Homo sapiens
atagaaattctgaatt

SEQ ID NO: 5369033 - DNA, 19 bp, Homo sapiens
atagaaattctgaattttg

SEQ ID NO: 5369034 - DNA, 20 bp, Homo sapiens
atagaaattgtgtttgctaa

SEQ ID NO: 5369035 - DNA, 21 bp, Homo sapiens
atagaaatttgcccctggcaa

SEQ ID NO: 5369036 - DNA, 22 bp, Homo sapiens
atagaaatttgcccctggcaaa

SEQ ID NO: 5369037 - DNA, 16 bp, Homo sapiens
atagaaattttgtaag

SEQ ID NO: 5369038 - DNA, 23 bp, Homo sapiens
atagaaattttgtaagaaggcaa

SEQ ID NO: 5369039 - DNA, 13 bp, Homo sapiens
atagaacaaaaga

SEQ ID NO: 5369040 - DNA, 14 bp, Homo sapiens
atagaacaacatat

SEQ ID NO: 5369041 - DNA, 17 bp, Homo sapiens
atagaacaagaccctgt

SEQ ID NO: 5369042 - DNA, 23 bp, Homo sapiens
atagaacacaaaacttgaaagaa

SEQ ID NO: 5369043 - DNA, 23 bp, Homo sapiens
atagaacacaagggatataaaat

SEQ ID NO: 5369044 - DNA, 23 bp, Homo sapiens
atagaacacagagtgtgtttttg

SEQ ID NO: 5369045 - DNA, 17 bp, Homo sapiens
atagaacagagaaagag

SEQ ID NO: 5369046 - DNA, 21 bp, Homo sapiens
atagaacagtttacttggaaa

SEQ ID NO: 5369047 - DNA, 20 bp, Homo sapiens
atagaacctctttgtctaca

SEQ ID NO: 5369048 - DNA, 18 bp, Homo sapiens
atagaactggattttcag

SEQ ID NO: 5369049 - DNA, 22 bp, Homo sapiens
atagaactgtcccacaaaatat

SEQ ID NO: 5369050 - DNA, 23 bp, Homo sapiens
atagaactgtcccacaaaatatt

SEQ ID NO: 5369051 - DNA, 20 bp, Homo sapiens
atagaacttgccttttaagt

SEQ ID NO: 5369052 - DNA, 13 bp, Homo sapiens
atagaagaaaaaa

SEQ ID NO: 5369053 - DNA, 14 bp, Homo sapiens
atagaagaaaaaag

SEQ ID NO: 5369054 - DNA, 19 bp, Homo sapiens
atagaagaaaaaagaatgt

SEQ ID NO: 5369055 - DNA, 23 bp, Homo sapiens
atagaagaaaaaagaatgtcaga

SEQ ID NO: 5369056 - DNA, 13 bp, Homo sapiens
atagaagaaagaa

SEQ ID NO: 5369057 - DNA, 14 bp, Homo sapiens
atagaagaaagaaa

SEQ ID NO: 5369058 - DNA, 17 bp, Homo sapiens
atagaagaaagaaaatg

SEQ ID NO: 5369059 - DNA, 23 bp, Homo sapiens
atagaagaaagaaaatggaaaga

SEQ ID NO: 5369060 - DNA, 19 bp, Homo sapiens
atagcccctctccccgcag

SEQ ID NO: 5369061 - DNA, 14 bp, Homo sapiens
atagcccctggtgt

SEQ ID NO: 5369062 - DNA, 15 bp, Homo sapiens
atagcccggtgcagc

SEQ ID NO: 5369063 - DNA, 15 bp, Homo sapiens
atagccctatttatc

SEQ ID NO: 5369064 - DNA, 17 bp, Homo sapiens
atagccctcagacattt

SEQ ID NO: 5369065 - DNA, 21 bp, Homo sapiens
atagccctggtgctcctgccc

SEQ ID NO: 5369066 - DNA, 16 bp, Homo sapiens
atagccctgtcctggt

SEQ ID NO: 5369067 - DNA, 15 bp, Homo sapiens
atagccctgtgaagt

SEQ ID NO: 5369068 - DNA, 19 bp, Homo sapiens
atagccgaactccaggctg

SEQ ID NO: 5369069 - DNA, 18 bp, Homo sapiens
atagccgattctctgccc

SEQ ID NO: 5369070 - DNA, 18 bp, Homo sapiens
atagccgggcatggtggc

SEQ ID NO: 5369071 - DNA, 13 bp, Homo sapiens
atagcctacattt

SEQ ID NO: 5369072 - DNA, 14 bp, Homo sapiens
atagcctagctttc

SEQ ID NO: 5369073 - DNA, 12 bp, Homo sapiens
atagcctatatt

SEQ ID NO: 5369074 - DNA, 13 bp, Homo sapiens
atagcctcatgtt

SEQ ID NO: 5369075 - DNA, 16 bp, Homo sapiens
atagcctctgtctggc

SEQ ID NO: 5369076 - DNA, 18 bp, Homo sapiens
atagcctggccaccagcc

SEQ ID NO: 5369077 - DNA, 22 bp, Homo sapiens
atagcctggccaccagccatcc

SEQ ID NO: 5369078 - DNA, 17 bp, Homo sapiens
atagcctgttacaggaa

SEQ ID NO: 5369079 - DNA, 17 bp, Homo sapiens
atagccttgaaaacaaa

SEQ ID NO: 5369080 - DNA, 11 bp, Homo sapiens
atagcctttcc

SEQ ID NO: 5369081 - DNA, 12 bp, Homo sapiens
atagcctttccc

SEQ ID NO: 5369082 - DNA, 23 bp, Homo sapiens
atagcgacaggaatagatgtggt

SEQ ID NO: 5369083 - DNA, 16 bp, Homo sapiens
atagcgatgtgcagga

SEQ ID NO: 5369084 - DNA, 17 bp, Homo sapiens
atagcgatgtgcaggaa

SEQ ID NO: 5369085 - DNA, 17 bp, Homo sapiens
atagcgcataataaggg

SEQ ID NO: 5369086 - DNA, 17 bp, Homo sapiens
atagcgctggctcagga

SEQ ID NO: 5369087 - DNA, 13 bp, Homo sapiens
atagcggccctgg

SEQ ID NO: 5369088 - DNA, 23 bp, Homo sapiens
atagcggggccttgtctcttcct

SEQ ID NO: 5369089 - DNA, 18 bp, Homo sapiens
atagcgtcataactagaa

SEQ ID NO: 5369090 - DNA, 20 bp, Homo sapiens
atagcgtcataactagaact

SEQ ID NO: 5369091 - DNA, 16 bp, Homo sapiens
atagcgtcctgccctg

SEQ ID NO: 5369092 - DNA, 20 bp, Homo sapiens
atagcgtgggttatcagtta

SEQ ID NO: 5369093 - DNA, 22 bp, Homo sapiens
atagcgttggaattaaaacaat

SEQ ID NO: 5369094 - DNA, 16 bp, Homo sapiens
atagctaagatataat

SEQ ID NO: 5369095 - DNA, 16 bp, Homo sapiens
atagctaataatacct

SEQ ID NO: 5369096 - DNA, 13 bp, Homo sapiens
atagctacagctg

SEQ ID NO: 5369097 - DNA, 14 bp, Homo sapiens
atagctacagctgt

SEQ ID NO: 5369098 - DNA, 15 bp, Homo sapiens
atagctacaggaagc

SEQ ID NO: 5369099 - DNA, 19 bp, Homo sapiens
atagctacccaaaagagaa

SEQ ID NO: 5369100 - DNA, 21 bp, Homo sapiens
atagctacccacagagcaagt

SEQ ID NO: 5369101 - DNA, 18 bp, Homo sapiens
atagctactaattttaaa

SEQ ID NO: 5369102 - DNA, 20 bp, Homo sapiens
atagctactatatgcataaa

SEQ ID NO: 5369103 - DNA, 19 bp, Homo sapiens
atagctactgtagaaagga

SEQ ID NO: 5369104 - DNA, 18 bp, Homo sapiens
atagctagactggtgact

SEQ ID NO: 5369105 - DNA, 23 bp, Homo sapiens
atagctagactggtgactgattc

SEQ ID NO: 5369106 - DNA, 18 bp, Homo sapiens
atagctataaatagtgaa

SEQ ID NO: 5369107 - DNA, 22 bp, Homo sapiens
atagctatatccatgtactgta

SEQ ID NO: 5369108 - DNA, 13 bp, Homo sapiens
atagctatattta

SEQ ID NO: 5369109 - DNA, 16 bp, Homo sapiens
atagctatcatttctt

SEQ ID NO: 5369110 - DNA, 18 bp, Homo sapiens
atagctattgcatgtaaa

SEQ ID NO: 5369111 - DNA, 22 bp, Homo sapiens
atagctattgcatgtaaaatgc

SEQ ID NO: 5369112 - DNA, 20 bp, Homo sapiens
atagctattttccttgcttt

SEQ ID NO: 5369113 - DNA, 22 bp, Homo sapiens
atagctattttcttacagtgga

SEQ ID NO: 5369114 - DNA, 12 bp, Homo sapiens
atagctattttt

SEQ ID NO: 5369115 - DNA, 20 bp, Homo sapiens
atagctatttttatggaatt

SEQ ID NO: 5369116 - DNA, 17 bp, Homo sapiens
atagctcaataaaagaa

SEQ ID NO: 5369117 - DNA, 19 bp, Homo sapiens
atagctcaatactctctga

SEQ ID NO: 5369118 - DNA, 22 bp, Homo sapiens
atagctcaatactctctgagta

SEQ ID NO: 5369119 - DNA, 18 bp, Homo sapiens
atagctcacagcacattt

SEQ ID NO: 5369120 - DNA, 14 bp, Homo sapiens
atagctccaagctg

SEQ ID NO: 5369121 - DNA, 18 bp, Homo sapiens
atagctccaagctgttaa

SEQ ID NO: 5369122 - DNA, 16 bp, Homo sapiens
atagctcccaaaagaa

SEQ ID NO: 5369123 - DNA, 23 bp, Homo sapiens
atagctccccgcttctgcctgca

SEQ ID NO: 5369124 - DNA, 14 bp, Homo sapiens
atagctcctctccc

SEQ ID NO: 5369125 - DNA, 20 bp, Homo sapiens
atagctcctgctccacagcc

SEQ ID NO: 5369126 - DNA, 23 bp, Homo sapiens
atagctccttcatgcttttctca

SEQ ID NO: 5369127 - DNA, 16 bp, Homo sapiens
atagctcgagcaaaat

SEQ ID NO: 5369128 - DNA, 15 bp, Homo sapiens
atagctctaatgttt

SEQ ID NO: 5369129 - DNA, 16 bp, Homo sapiens
atagctctaatgtttg

SEQ ID NO: 5369130 - DNA, 19 bp, Homo sapiens
atagctctaatgtttgcat

SEQ ID NO: 5369131 - DNA, 22 bp, Homo sapiens
atagctctacacaacatgtatg

SEQ ID NO: 5369132 - DNA, 12 bp, Homo sapiens
atagctctctga

SEQ ID NO: 5369133 - DNA, 13 bp, Homo sapiens
atagctctctgac

SEQ ID NO: 5369134 - DNA, 16 bp, Homo sapiens
atagctctctgactgc

SEQ ID NO: 5369135 - DNA, 19 bp, Homo sapiens
atagctctggggtgggcag

SEQ ID NO: 5369136 - DNA, 22 bp, Homo sapiens
atagctctggggtgggcagttt

SEQ ID NO: 5369137 - DNA, 23 bp, Homo sapiens
atagctcttcacttcctccagaa

SEQ ID NO: 5369138 - DNA, 21 bp, Homo sapiens
atagctcttcctccccaggac

SEQ ID NO: 5369139 - DNA, 22 bp, Homo sapiens
atagctcttctatttaaaaaat

SEQ ID NO: 5369140 - DNA, 23 bp, Homo sapiens
atagctcttctatttaaaaaata

SEQ ID NO: 5369141 - DNA, 15 bp, Homo sapiens
atagctctttcaggg

SEQ ID NO: 5369142 - DNA, 16 bp, Homo sapiens
atagctgaaaactaat

SEQ ID NO: 5369143 - DNA, 20 bp, Homo sapiens
atagctgaaaactaatgtac

SEQ ID NO: 5369144 - DNA, 23 bp, Homo sapiens
atagctgaaaactaatgtactgt

SEQ ID NO: 5369145 - DNA, 18 bp, Homo sapiens
atagctgaaaagggcact

SEQ ID NO: 5369146 - DNA, 19 bp, Homo sapiens
atagctgacatctcctcta

SEQ ID NO: 5369147 - DNA, 21 bp, Homo sapiens
atagctgagattcctggttcg

SEQ ID NO: 5369148 - DNA, 17 bp, Homo sapiens
atagctgagctggaaag

SEQ ID NO: 5369149 - DNA, 20 bp, Homo sapiens
atagctgccttcaaggactg

SEQ ID NO: 5369150 - DNA, 15 bp, Homo sapiens
atagctgcttccagt

SEQ ID NO: 5369151 - DNA, 21 bp, Homo sapiens
atagctggaaaaaacaaaata

SEQ ID NO: 5369152 - DNA, 16 bp, Homo sapiens
atagctggcaagaatg

SEQ ID NO: 5369153 - DNA, 15 bp, Homo sapiens
atagctgtacaaata

SEQ ID NO: 5369154 - DNA, 22 bp, Homo sapiens
atagctgtacttcttgaatata

SEQ ID NO: 5369155 - DNA, 21 bp, Homo sapiens
atagctgtatatttgaaactg

SEQ ID NO: 5369156 - DNA, 15 bp, Homo sapiens
atagctgtattgaat

SEQ ID NO: 5369157 - DNA, 22 bp, Homo sapiens
atagctgtattgaatcatgtag

SEQ ID NO: 5369158 - DNA, 12 bp, Homo sapiens
atagctgtgact

SEQ ID NO: 5369159 - DNA, 22 bp, Homo sapiens
atagctgtgatttttggtattt

SEQ ID NO: 5369160 - DNA, 20 bp, Homo sapiens
atagctgtgtgaacgtgtat

SEQ ID NO: 5369161 - DNA, 19 bp, Homo sapiens
atagctgtttcaaatgtgc

SEQ ID NO: 5369162 - DNA, 21 bp, Homo sapiens
atagctgttttagctgaggga

SEQ ID NO: 5369163 - DNA, 17 bp, Homo sapiens
atagctgttttgtgtat

SEQ ID NO: 5369164 - DNA, 18 bp, Homo sapiens
atagctgttttgtgtata

SEQ ID NO: 5369165 - DNA, 19 bp, Homo sapiens
atagctgttttgtgtatat

SEQ ID NO: 5369166 - DNA, 16 bp, Homo sapiens
atagcttaagaagtat

SEQ ID NO: 5369167 - DNA, 15 bp, Homo sapiens
atagcttacactgag

SEQ ID NO: 5369168 - DNA, 14 bp, Homo sapiens
atagcttacctgaa

SEQ ID NO: 5369169 - DNA, 16 bp, Homo sapiens
atagcttactgaagaa

SEQ ID NO: 5369170 - DNA, 16 bp, Homo sapiens
atagcttattattgaa

SEQ ID NO: 5369171 - DNA, 19 bp, Homo sapiens
atagcttcaggatactgta

SEQ ID NO: 5369172 - DNA, 18 bp, Homo sapiens
atagcttcatcttgagcc

SEQ ID NO: 5369173 - DNA, 15 bp, Homo sapiens
atagcttctgtgtgt

SEQ ID NO: 5369174 - DNA, 20 bp, Homo sapiens
atagcttctgtgtgtgagct

SEQ ID NO: 5369175 - DNA, 17 bp, Homo sapiens
atagcttgtatagtgta

SEQ ID NO: 5369176 - DNA, 17 bp, Homo sapiens
atagctttaaaagggaa

SEQ ID NO: 5369177 - DNA, 23 bp, Homo sapiens
atagctttacagatgtagatata

SEQ ID NO: 5369178 - DNA, 21 bp, Homo sapiens
atagctttagagaagccataa

SEQ ID NO: 5369179 - DNA, 15 bp, Homo sapiens
atagctttatactct

SEQ ID NO: 5369180 - DNA, 15 bp, Homo sapiens
atagctttatttctt

SEQ ID NO: 5369181 - DNA, 22 bp, Homo sapiens
atagctttattttttaagtatt

SEQ ID NO: 5369182 - DNA, 14 bp, Homo sapiens
atagctttcacaag

SEQ ID NO: 5369183 - DNA, 20 bp, Homo sapiens
atagctttctttcccttact

SEQ ID NO: 5369184 - DNA, 14 bp, Homo sapiens
atagctttgagatt

SEQ ID NO: 5369185 - DNA, 16 bp, Homo sapiens
atagctttgagatttc

SEQ ID NO: 5369186 - DNA, 12 bp, Homo sapiens
atagctttgcaa

SEQ ID NO: 5369187 - DNA, 14 bp, Homo sapiens
atagcttttattga

SEQ ID NO: 5369188 - DNA, 23 bp, Homo sapiens
atagcttttattgagtaatatta

SEQ ID NO: 5369189 - DNA, 14 bp, Homo sapiens
atagcttttattgt

SEQ ID NO: 5369190 - DNA, 17 bp, Homo sapiens
atagcttttcacttctt

SEQ ID NO: 5369191 - DNA, 19 bp, Homo sapiens
atagcttttcacttcttaa

SEQ ID NO: 5369192 - DNA, 22 bp, Homo sapiens
atagcttttccctttttttaag

SEQ ID NO: 5369193 - DNA, 14 bp, Homo sapiens
atagcttttcctgt

SEQ ID NO: 5369194 - DNA, 15 bp, Homo sapiens
atagcttttttctct

SEQ ID NO: 5369195 - DNA, 17 bp, Homo sapiens
ataggaaaaactgattt

SEQ ID NO: 5369196 - DNA, 18 bp, Homo sapiens
ataggaaaacaataattt

SEQ ID NO: 5369197 - DNA, 22 bp, Homo sapiens
ataggaaaacattgcaataaat

SEQ ID NO: 5369198 - DNA, 16 bp, Homo sapiens
ataggaaaatacattg

SEQ ID NO: 5369199 - DNA, 17 bp, Homo sapiens
ataggaaaatgtacata

SEQ ID NO: 5369200 - DNA, 20 bp, Homo sapiens
ataggaaaatgtacatacta

SEQ ID NO: 5369201 - DNA, 19 bp, Homo sapiens
ataggaaactaagcattgt

SEQ ID NO: 5369202 - DNA, 16 bp, Homo sapiens
ataggaaactgaagca

SEQ ID NO: 5369203 - DNA, 20 bp, Homo sapiens
ataggaaagatttaatgtta

SEQ ID NO: 5369204 - DNA, 15 bp, Homo sapiens
ataggaacatatgaa

SEQ ID NO: 5369205 - DNA, 14 bp, Homo sapiens
ataggaactgaggt

SEQ ID NO: 5369206 - DNA, 14 bp, Homo sapiens
ataggaagaaaatg

SEQ ID NO: 5369207 - DNA, 17 bp, Homo sapiens
ataggaagaaaatgtca

SEQ ID NO: 5369208 - DNA, 13 bp, Homo sapiens
ataggaagacaca

SEQ ID NO: 5369209 - DNA, 18 bp, Homo sapiens
ataggaagacataaaact

SEQ ID NO: 5369210 - DNA, 20 bp, Homo sapiens
ataggaagacataaaacttt

SEQ ID NO: 5369211 - DNA, 23 bp, Homo sapiens
ataggaagacataaaactttaaa

SEQ ID NO: 5369212 - DNA, 11 bp, Homo sapiens
ataggaagcat

SEQ ID NO: 5369213 - DNA, 16 bp, Homo sapiens
ataggaagcgtctggc

SEQ ID NO: 5369214 - DNA, 19 bp, Homo sapiens
ataggaagcgtctggcaga

SEQ ID NO: 5369215 - DNA, 13 bp, Homo sapiens
ataggaaggaaac

SEQ ID NO: 5369216 - DNA, 18 bp, Homo sapiens
ataggaagggatctgaga

SEQ ID NO: 5369217 - DNA, 15 bp, Homo sapiens
ataggaaggtcattt

SEQ ID NO: 5369218 - DNA, 14 bp, Homo sapiens
ataggaagtggctg

SEQ ID NO: 5369219 - DNA, 23 bp, Homo sapiens
ataggaagttagcctttatctac

SEQ ID NO: 5369220 - DNA, 16 bp, Homo sapiens
ataggaatagaggaag

SEQ ID NO: 5369221 - DNA, 17 bp, Homo sapiens
ataggaatagaggaaga

SEQ ID NO: 5369222 - DNA, 19 bp, Homo sapiens
ataggaatagaggaagaaa

SEQ ID NO: 5369223 - DNA, 22 bp, Homo sapiens
ataggaatatgactcaggagcc

SEQ ID NO: 5369224 - DNA, 20 bp, Homo sapiens
ataggaatgtccaccatgaa

SEQ ID NO: 5369225 - DNA, 21 bp, Homo sapiens
ataggaatgtccaccatgaac

SEQ ID NO: 5369226 - DNA, 13 bp, Homo sapiens
ataggaattcatc

SEQ ID NO: 5369227 - DNA, 21 bp, Homo sapiens
ataggaattgacccacaagaa

SEQ ID NO: 5369228 - DNA, 16 bp, Homo sapiens
ataggaattgcattag

SEQ ID NO: 5369229 - DNA, 21 bp, Homo sapiens
ataggaatttgcgtaactaac

SEQ ID NO: 5369230 - DNA, 19 bp, Homo sapiens
ataggacatactgcatgta

SEQ ID NO: 5369231 - DNA, 13 bp, Homo sapiens
ataggaccagagc

SEQ ID NO: 5369232 - DNA, 22 bp, Homo sapiens
ataggacctgcatccttcctgg

SEQ ID NO: 5369233 - DNA, 20 bp, Homo sapiens
ataggacctttccaccacag

SEQ ID NO: 5369234 - DNA, 14 bp, Homo sapiens
ataggacgtattta

SEQ ID NO: 5369235 - DNA, 17 bp, Homo sapiens
ataggacgtatttataa

SEQ ID NO: 5369236 - DNA, 19 bp, Homo sapiens
ataggactaccgcaggccc

SEQ ID NO: 5369237 - DNA, 17 bp, Homo sapiens
atagtatattaaaaatg

SEQ ID NO: 5369238 - DNA, 20 bp, Homo sapiens
atagtatattaaaaatggta

SEQ ID NO: 5369239 - DNA, 16 bp, Homo sapiens
atagtatatttatact

SEQ ID NO: 5369240 - DNA, 17 bp, Homo sapiens
atagtatatttatactc

SEQ ID NO: 5369241 - DNA, 23 bp, Homo sapiens
atagtatccatattttattactg

SEQ ID NO: 5369242 - DNA, 16 bp, Homo sapiens
atagtatcctccaggt

SEQ ID NO: 5369243 - DNA, 22 bp, Homo sapiens
atagtatctgtatataagttgc

SEQ ID NO: 5369244 - DNA, 18 bp, Homo sapiens
atagtatgcagctaaaaa

SEQ ID NO: 5369245 - DNA, 22 bp, Homo sapiens
atagtatgctctgagtagcttt

SEQ ID NO: 5369246 - DNA, 21 bp, Homo sapiens
atagtatggaagtatttgaga

SEQ ID NO: 5369247 - DNA, 19 bp, Homo sapiens
atagtatgggaaaaaaact

SEQ ID NO: 5369248 - DNA, 17 bp, Homo sapiens
atagtatggtggctggg

SEQ ID NO: 5369249 - DNA, 18 bp, Homo sapiens
atagtatggtggctgggt

SEQ ID NO: 5369250 - DNA, 14 bp, Homo sapiens
atagtatgtgcata

SEQ ID NO: 5369251 - DNA, 15 bp, Homo sapiens
atagtattaagtgaa

SEQ ID NO: 5369252 - DNA, 12 bp, Homo sapiens
atagtattccat

SEQ ID NO: 5369253 - DNA, 21 bp, Homo sapiens
atagtattccattgtgtgagt

SEQ ID NO: 5369254 - DNA, 22 bp, Homo sapiens
atagtattccattgtgtgagtg

SEQ ID NO: 5369255 - DNA, 22 bp, Homo sapiens
atagtattggagcacatgttac

SEQ ID NO: 5369256 - DNA, 21 bp, Homo sapiens
atagtatttctcctttgcaat

SEQ ID NO: 5369257 - DNA, 21 bp, Homo sapiens
atagtatttgagagttctaaa

SEQ ID NO: 5369258 - DNA, 23 bp, Homo sapiens
atagtatttgagagttctaaatt

SEQ ID NO: 5369259 - DNA, 22 bp, Homo sapiens
atagtatttgattcaaaatatt

SEQ ID NO: 5369260 - DNA, 18 bp, Homo sapiens
atagtcaaaaattaaata

SEQ ID NO: 5369261 - DNA, 22 bp, Homo sapiens
atagtcaaaccataaacttcat

SEQ ID NO: 5369262 - DNA, 18 bp, Homo sapiens
atagtcaaattgtgtgaa

SEQ ID NO: 5369263 - DNA, 17 bp, Homo sapiens
atagtcaatatgcctgc

SEQ ID NO: 5369264 - DNA, 18 bp, Homo sapiens
atagtcaatcaaacaggg

SEQ ID NO: 5369265 - DNA, 13 bp, Homo sapiens
atagtcaatgtaa

SEQ ID NO: 5369266 - DNA, 19 bp, Homo sapiens
atagtcaatgtttctttta

SEQ ID NO: 5369267 - DNA, 17 bp, Homo sapiens
atagtcaatttctactt

SEQ ID NO: 5369268 - DNA, 16 bp, Homo sapiens
atagtcacctgctggt

SEQ ID NO: 5369269 - DNA, 14 bp, Homo sapiens
atagtcagagtgtc

SEQ ID NO: 5369270 - DNA, 19 bp, Homo sapiens
atagtcagcagcagctctg

SEQ ID NO: 5369271 - DNA, 14 bp, Homo sapiens
atagtcagctctga

SEQ ID NO: 5369272 - DNA, 14 bp, Homo sapiens
atagtcagctgcct

SEQ ID NO: 5369273 - DNA, 14 bp, Homo sapiens
atagtcatatgtga

SEQ ID NO: 5369274 - DNA, 22 bp, Homo sapiens
atagtcatgctgctagatcttt

SEQ ID NO: 5369275 - DNA, 22 bp, Homo sapiens
atagtcatggggtccctgctgc

SEQ ID NO: 5369276 - DNA, 23 bp, Homo sapiens
atagtcatgtttctgcagtattc

SEQ ID NO: 5369277 - DNA, 18 bp, Homo sapiens
atagtcattaaaaacata

SEQ ID NO: 5369278 - DNA, 16 bp, Homo sapiens
atagtcattccaaata

SEQ ID NO: 5369279 - DNA, 18 bp, Homo sapiens
atagtcatttattttaaa

SEQ ID NO: 5369280 - DNA, 13 bp, Homo sapiens
atagtccagagaa

SEQ ID NO: 5369281 - DNA, 21 bp, Homo sapiens
atagtcccaccttggagcatt

SEQ ID NO: 5369282 - DNA, 22 bp, Homo sapiens
atagtcccaccttggagcattt

SEQ ID NO: 5369283 - DNA, 23 bp, Homo sapiens
atagtcccaccttggagcattta

SEQ ID NO: 5369284 - DNA, 18 bp, Homo sapiens
atagtccccagagctccc

SEQ ID NO: 5369285 - DNA, 19 bp, Homo sapiens
atagtccccagagctcccc

SEQ ID NO: 5369286 - DNA, 12 bp, Homo sapiens
atagtccctgcc

SEQ ID NO: 5369287 - DNA, 14 bp, Homo sapiens
atagtcctaaaaag

SEQ ID NO: 5369288 - DNA, 16 bp, Homo sapiens
atagtccttcctggca

SEQ ID NO: 5369289 - DNA, 17 bp, Homo sapiens
atagtccttcctggcat

SEQ ID NO: 5369290 - DNA, 22 bp, Homo sapiens
atagtcgggatgtcagcagaca

SEQ ID NO: 5369291 - DNA, 18 bp, Homo sapiens
atagtctaagactatata

SEQ ID NO: 5369292 - DNA, 23 bp, Homo sapiens
atagtctaagactatatatataa

SEQ ID NO: 5369293 - DNA, 19 bp, Homo sapiens
atagtctagactaaaagat

SEQ ID NO: 5369294 - DNA, 14 bp, Homo sapiens
atagtctagtgtag

SEQ ID NO: 5369295 - DNA, 16 bp, Homo sapiens
atagtctatgtgattc

SEQ ID NO: 5369296 - DNA, 19 bp, Homo sapiens
atagtctattcattaagta

SEQ ID NO: 5369297 - DNA, 20 bp, Homo sapiens
atagtctcaaatcaaataca

SEQ ID NO: 5369298 - DNA, 13 bp, Homo sapiens
atagtctggctgt

SEQ ID NO: 5369299 - DNA, 12 bp, Homo sapiens
atagtctgggtc

SEQ ID NO: 5369300 - DNA, 23 bp, Homo sapiens
atagtctgggtcagacccatctc

SEQ ID NO: 5369301 - DNA, 14 bp, Homo sapiens
atagtctgtacttc

SEQ ID NO: 5369302 - DNA, 14 bp, Homo sapiens
atagtcttccacaa

SEQ ID NO: 5369303 - DNA, 16 bp, Homo sapiens
atagtctttggagaaa

SEQ ID NO: 5369304 - DNA, 18 bp, Homo sapiens
atagtctttttttttaag

SEQ ID NO: 5369305 - DNA, 16 bp, Homo sapiens
atagtgaaaagtagag

SEQ ID NO: 5369306 - DNA, 16 bp, Homo sapiens
atagtgaaataaattc

SEQ ID NO: 5369307 - DNA, 17 bp, Homo sapiens
atagtgaaataaattct

SEQ ID NO: 5369308 - DNA, 23 bp, Homo sapiens
atagtgaaataaattctgattct

SEQ ID NO: 5369309 - DNA, 14 bp, Homo sapiens
atagtgaagaatag

SEQ ID NO: 5369310 - DNA, 14 bp, Homo sapiens
atagtgaagtgtta

SEQ ID NO: 5369311 - DNA, 16 bp, Homo sapiens
atagtgaagtgttaat

SEQ ID NO: 5369312 - DNA, 18 bp, Homo sapiens
atagtgaagtgttaatac

SEQ ID NO: 5369313 - DNA, 19 bp, Homo sapiens
atagtgaagtgttaataca

SEQ ID NO: 5369314 - DNA, 23 bp, Homo sapiens
atagtgaagtgttaatacatcac

SEQ ID NO: 5369315 - DNA, 16 bp, Homo sapiens
atagtgaatacttact

SEQ ID NO: 5369316 - DNA, 19 bp, Homo sapiens
atagtgacctgtgtttcac

SEQ ID NO: 5369317 - DNA, 12 bp, Homo sapiens
atagtgactttt

SEQ ID NO: 5369318 - DNA, 21 bp, Homo sapiens
atagtgacttttcaagtattt

SEQ ID NO: 5369319 - DNA, 15 bp, Homo sapiens
atagtgagagaggag

SEQ ID NO: 5369320 - DNA, 19 bp, Homo sapiens
atagtgatggggctcagat

SEQ ID NO: 5369321 - DNA, 23 bp, Homo sapiens
atagtgcaacatctctgaatcct

SEQ ID NO: 5369322 - DNA, 15 bp, Homo sapiens
atagtgcaatatatt

SEQ ID NO: 5369323 - DNA, 18 bp, Homo sapiens
atagtgccaggtggctca

SEQ ID NO: 5369324 - DNA, 18 bp, Homo sapiens
atagtgcctaaaattgta

SEQ ID NO: 5369325 - DNA, 16 bp, Homo sapiens
atagtgcctaaagtgc

SEQ ID NO: 5369326 - DNA, 20 bp, Homo sapiens
atagtgcctaaagtgctgca

SEQ ID NO: 5369327 - DNA, 19 bp, Homo sapiens
atagtgcctcagcgctgcc

SEQ ID NO: 5369328 - DNA, 22 bp, Homo sapiens
atagtgcctcagcgctgcccac

SEQ ID NO: 5369329 - DNA, 23 bp, Homo sapiens
atagtgcctcagcgctgcccaca

SEQ ID NO: 5369330 - DNA, 14 bp, Homo sapiens
atagtgcctctgca

SEQ ID NO: 5369331 - DNA, 19 bp, Homo sapiens
atagtgctaacatgaagac

SEQ ID NO: 5369332 - DNA, 19 bp, Homo sapiens
atagtgctatatatataaa

SEQ ID NO: 5369333 - DNA, 10 bp, Homo sapiens
atagtgctgg

SEQ ID NO: 5369334 - DNA, 15 bp, Homo sapiens
atagtgcttcttgta

SEQ ID NO: 5369335 - DNA, 20 bp, Homo sapiens
atagtgctttattttgttaa

SEQ ID NO: 5369336 - DNA, 12 bp, Homo sapiens
atagtgcttttt

SEQ ID NO: 5369337 - DNA, 18 bp, Homo sapiens
atagtggaaaaacacatg

SEQ ID NO: 5369338 - DNA, 18 bp, Homo sapiens
atagtggaccacttggaa

SEQ ID NO: 5369339 - DNA, 18 bp, Homo sapiens
atagtggatctcagtttt

SEQ ID NO: 5369340 - DNA, 21 bp, Homo sapiens
atagtggatgatatacacagt

SEQ ID NO: 5369341 - DNA, 17 bp, Homo sapiens
atagtggatggacagat

SEQ ID NO: 5369342 - DNA, 19 bp, Homo sapiens
atagtggatggacagatgg

SEQ ID NO: 5369343 - DNA, 22 bp, Homo sapiens
atagtggatggacagatggacc

SEQ ID NO: 5369344 - DNA, 21 bp, Homo sapiens
atagtggcacttgcctgtagt

SEQ ID NO: 5369345 - DNA, 17 bp, Homo sapiens
atagtggcttaaaacaa

SEQ ID NO: 5369346 - DNA, 22 bp, Homo sapiens
atagtggctttcatttcttatt

SEQ ID NO: 5369347 - DNA, 20 bp, Homo sapiens
atagtgggcaccccactgca

SEQ ID NO: 5369348 - DNA, 12 bp, Homo sapiens
atagtggggcct

SEQ ID NO: 5369349 - DNA, 21 bp, Homo sapiens
atagtggggttccatgagtta

SEQ ID NO: 5369350 - DNA, 17 bp, Homo sapiens
atagtggtattttaaca

SEQ ID NO: 5369351 - DNA, 16 bp, Homo sapiens
atagtggtgagatgga

SEQ ID NO: 5369352 - DNA, 15 bp, Homo sapiens
atagtggttaacaga

SEQ ID NO: 5369353 - DNA, 18 bp, Homo sapiens
atagtggttcttggaaaa

SEQ ID NO: 5369354 - DNA, 21 bp, Homo sapiens
atagtggttcttggaaaaatg

SEQ ID NO: 5369355 - DNA, 14 bp, Homo sapiens
atagtgtaacttgc

SEQ ID NO: 5369356 - DNA, 15 bp, Homo sapiens
atagtgtaagaactg

SEQ ID NO: 5369357 - DNA, 16 bp, Homo sapiens
atagtgtaagaactgt

SEQ ID NO: 5369358 - DNA, 18 bp, Homo sapiens
atagtgtaagaactgtac

SEQ ID NO: 5369359 - DNA, 18 bp, Homo sapiens
atagtgtataccacctgt

SEQ ID NO: 5369360 - DNA, 21 bp, Homo sapiens
atagtgtataccacctgtaca

SEQ ID NO: 5369361 - DNA, 14 bp, Homo sapiens
atagtgtcacttcc

SEQ ID NO: 5369362 - DNA, 18 bp, Homo sapiens
atagtgtcatataaactc

SEQ ID NO: 5369363 - DNA, 18 bp, Homo sapiens
atagtgtcctatgcaata

SEQ ID NO: 5369364 - DNA, 13 bp, Homo sapiens
atagtgtcctgcc

SEQ ID NO: 5369365 - DNA, 20 bp, Homo sapiens
atagtgtctattatcacatt

SEQ ID NO: 5369366 - DNA, 15 bp, Homo sapiens
atagtgtgaaatata

SEQ ID NO: 5369367 - DNA, 14 bp, Homo sapiens
atagtgtgttctga

SEQ ID NO: 5369368 - DNA, 19 bp, Homo sapiens
atagtgtgttctgattaga

SEQ ID NO: 5369369 - DNA, 21 bp, Homo sapiens
atagtgtgttgtgctttcaag

SEQ ID NO: 5369370 - DNA, 22 bp, Homo sapiens
atagtgtgttgtgctttcaaga

SEQ ID NO: 5369371 - DNA, 20 bp, Homo sapiens
atagtgttaatcaatttaaa

SEQ ID NO: 5369372 - DNA, 16 bp, Homo sapiens
atagtgttcacaaact

SEQ ID NO: 5369373 - DNA, 17 bp, Homo sapiens
atagtgttctgctcctg

SEQ ID NO: 5369374 - DNA, 20 bp, Homo sapiens
atagtgttgtgttacaataa

SEQ ID NO: 5369375 - DNA, 23 bp, Homo sapiens
atagtgttgtgttacaataagtg

SEQ ID NO: 5369376 - DNA, 19 bp, Homo sapiens
atagtgtttaactggcatg

SEQ ID NO: 5369377 - DNA, 22 bp, Homo sapiens
atagtgtttaactggcatggat

SEQ ID NO: 5369378 - DNA, 19 bp, Homo sapiens
atagtgtttcgttaagcag

SEQ ID NO: 5369379 - DNA, 22 bp, Homo sapiens
atagttaagcgtgcataagtta

SEQ ID NO: 5369380 - DNA, 14 bp, Homo sapiens
atagttaatatagt

SEQ ID NO: 5369381 - DNA, 20 bp, Homo sapiens
atagttaattgtggctttat

SEQ ID NO: 5369382 - DNA, 21 bp, Homo sapiens
atagttaattgtggctttatg

SEQ ID NO: 5369383 - DNA, 13 bp, Homo sapiens
atagttactgtaa

SEQ ID NO: 5369384 - DNA, 21 bp, Homo sapiens
atagttactgtaaaatgcaaa

SEQ ID NO: 5369385 - DNA, 14 bp, Homo sapiens
atagttactgtgta

SEQ ID NO: 5369386 - DNA, 16 bp, Homo sapiens
atagttactgttgtga

SEQ ID NO: 5369387 - DNA, 17 bp, Homo sapiens
atagttatacatcaatt

SEQ ID NO: 5369388 - DNA, 18 bp, Homo sapiens
atagttatacatcttcat

SEQ ID NO: 5369389 - DNA, 19 bp, Homo sapiens
atagttatacatcttcatt

SEQ ID NO: 5369390 - DNA, 21 bp, Homo sapiens
atagttatacatcttcattaa

SEQ ID NO: 5369391 - DNA, 19 bp, Homo sapiens
atagttatgtaaataattc

SEQ ID NO: 5369392 - DNA, 17 bp, Homo sapiens
atagttattaaatgttt

SEQ ID NO: 5369393 - DNA, 21 bp, Homo sapiens
atagttattaaatgtttcaaa

SEQ ID NO: 5369394 - DNA, 14 bp, Homo sapiens
atagttattcaaat

SEQ ID NO: 5369395 - DNA, 19 bp, Homo sapiens
atagttattcaaatccata

SEQ ID NO: 5369396 - DNA, 17 bp, Homo sapiens
atagttatttacttgaa

SEQ ID NO: 5369397 - DNA, 19 bp, Homo sapiens
atagttatttacttgaaag

SEQ ID NO: 5369398 - DNA, 18 bp, Homo sapiens
atagttattttaatacct

SEQ ID NO: 5369399 - DNA, 17 bp, Homo sapiens
atagttattttacaaat

SEQ ID NO: 5369400 - DNA, 22 bp, Homo sapiens
atagttcactgacacagtaaaa

SEQ ID NO: 5369401 - DNA, 21 bp, Homo sapiens
atagttcaggagactttacaa

SEQ ID NO: 5369402 - DNA, 15 bp, Homo sapiens
atagttcaggatttg

SEQ ID NO: 5369403 - DNA, 18 bp, Homo sapiens
atagttcagtagaattac

SEQ ID NO: 5369404 - DNA, 18 bp, Homo sapiens
atagttccagataaaaac

SEQ ID NO: 5369405 - DNA, 22 bp, Homo sapiens
atagttccagataaaaacaata

SEQ ID NO: 5369406 - DNA, 23 bp, Homo sapiens
atagttccagataaaaacaatat

SEQ ID NO: 5369407 - DNA, 19 bp, Homo sapiens
atagttccattctatgact

SEQ ID NO: 5369408 - DNA, 17 bp, Homo sapiens
atagttcccatgttaaa

SEQ ID NO: 5369409 - DNA, 22 bp, Homo sapiens
atagttccctagtctattcatt

SEQ ID NO: 5369410 - DNA, 18 bp, Homo sapiens
atagttcctaagaagctt

SEQ ID NO: 5369411 - DNA, 21 bp, Homo sapiens
atagttcctaagaagcttcta

SEQ ID NO: 5369412 - DNA, 16 bp, Homo sapiens
atatacgaaaagccag

SEQ ID NO: 5369413 - DNA, 14 bp, Homo sapiens
atatactaaccatt

SEQ ID NO: 5369414 - DNA, 13 bp, Homo sapiens
atatactaataaa

SEQ ID NO: 5369415 - DNA, 14 bp, Homo sapiens
atatactaataaaa

SEQ ID NO: 5369416 - DNA, 17 bp, Homo sapiens
atatactaataaaaagg

SEQ ID NO: 5369417 - DNA, 20 bp, Homo sapiens
atatactaataaaaaggttt

SEQ ID NO: 5369418 - DNA, 13 bp, Homo sapiens
atatactatattt

SEQ ID NO: 5369419 - DNA, 13 bp, Homo sapiens
atatactatttag

SEQ ID NO: 5369420 - DNA, 19 bp, Homo sapiens
atatactcagggattcctt

SEQ ID NO: 5369421 - DNA, 19 bp, Homo sapiens
atatactcattagaattac

SEQ ID NO: 5369422 - DNA, 14 bp, Homo sapiens
atatactccttaaa

SEQ ID NO: 5369423 - DNA, 20 bp, Homo sapiens
atatactgaagtcttttctg

SEQ ID NO: 5369424 - DNA, 20 bp, Homo sapiens
atatactgagctgctaaaat

SEQ ID NO: 5369425 - DNA, 19 bp, Homo sapiens
atatactgctatttacact

SEQ ID NO: 5369426 - DNA, 22 bp, Homo sapiens
atatactgggttcttgttttat

SEQ ID NO: 5369427 - DNA, 10 bp, Homo sapiens
atatactgta

SEQ ID NO: 5369428 - DNA, 22 bp, Homo sapiens
atatactgtaaagaaagagaga

SEQ ID NO: 5369429 - DNA, 24 bp, Homo sapiens
atatactgtaaagaaagagagaaa

SEQ ID NO: 5369430 - DNA, 18 bp, Homo sapiens
atatactgttcttcattt

SEQ ID NO: 5369431 - DNA, 13 bp, Homo sapiens
atatacttaaaaa

SEQ ID NO: 5369432 - DNA, 13 bp, Homo sapiens
atatacttatttt

SEQ ID NO: 5369433 - DNA, 15 bp, Homo sapiens
atatacttgactcta

SEQ ID NO: 5369434 - DNA, 17 bp, Homo sapiens
atatacttgactctaat

SEQ ID NO: 5369435 - DNA, 21 bp, Homo sapiens
atatacttgcaagataatttt

SEQ ID NO: 5369436 - DNA, 14 bp, Homo sapiens
atatacttgtggac

SEQ ID NO: 5369437 - DNA, 15 bp, Homo sapiens
atatacttgtggact

SEQ ID NO: 5369438 - DNA, 21 bp, Homo sapiens
atatacttgtggactaaaaga

SEQ ID NO: 5369439 - DNA, 14 bp, Homo sapiens
atatacttgttttt

SEQ ID NO: 5369440 - DNA, 18 bp, Homo sapiens
atatacttgtttttgtaa

SEQ ID NO: 5369441 - DNA, 20 bp, Homo sapiens
atatacttgtttttgtaaag

SEQ ID NO: 5369442 - DNA, 20 bp, Homo sapiens
atatactttactttttccat

SEQ ID NO: 5369443 - DNA, 20 bp, Homo sapiens
atatactttgaaaggagatg

SEQ ID NO: 5369444 - DNA, 14 bp, Homo sapiens
atatactttgtctt

SEQ ID NO: 5369445 - DNA, 20 bp, Homo sapiens
atatacttttacattaaaga

SEQ ID NO: 5369446 - DNA, 11 bp, Homo sapiens
atatacttttt

SEQ ID NO: 5369447 - DNA, 16 bp, Homo sapiens
atatactttttcatga

SEQ ID NO: 5369448 - DNA, 22 bp, Homo sapiens
atatacttttttcttatttaac

SEQ ID NO: 5369449 - DNA, 20 bp, Homo sapiens
atatacttttttttctttaa

SEQ ID NO: 5369450 - DNA, 13 bp, Homo sapiens
atatagaaaacaa

SEQ ID NO: 5369451 - DNA, 14 bp, Homo sapiens
atatagaaaacaaa

SEQ ID NO: 5369452 - DNA, 15 bp, Homo sapiens
atatagaaagaaaat

SEQ ID NO: 5369453 - DNA, 13 bp, Homo sapiens
atatagaacacaa

SEQ ID NO: 5369454 - DNA, 19 bp, Homo sapiens
atatagaaggactgcagcc

SEQ ID NO: 5369455 - DNA, 17 bp, Homo sapiens
atatagaagtataaaga

SEQ ID NO: 5369456 - DNA, 15 bp, Homo sapiens
atatagaatgctgca

SEQ ID NO: 5369457 - DNA, 17 bp, Homo sapiens
atatagaattagctttt

SEQ ID NO: 5369458 - DNA, 21 bp, Homo sapiens
atatagaattgcaattttaac

SEQ ID NO: 5369459 - DNA, 16 bp, Homo sapiens
atatagaatttcctgt

SEQ ID NO: 5369460 - DNA, 18 bp, Homo sapiens
atatagaatttcctgtaa

SEQ ID NO: 5369461 - DNA, 19 bp, Homo sapiens
atatagacagtgcccttgg

SEQ ID NO: 5369462 - DNA, 17 bp, Homo sapiens
atatagaccaattgaag

SEQ ID NO: 5369463 - DNA, 12 bp, Homo sapiens
atatagactgta

SEQ ID NO: 5369464 - DNA, 22 bp, Homo sapiens
atatagacttggagaatactgc

SEQ ID NO: 5369465 - DNA, 22 bp, Homo sapiens
atatagagacaggacagaatgt

SEQ ID NO: 5369466 - DNA, 17 bp, Homo sapiens
atatagagtcattgtaa

SEQ ID NO: 5369467 - DNA, 19 bp, Homo sapiens
atatagagtgacttggaga

SEQ ID NO: 5369468 - DNA, 16 bp, Homo sapiens
atatagataacagatt

SEQ ID NO: 5369469 - DNA, 23 bp, Homo sapiens
atatagatgtctgtgtatacata

SEQ ID NO: 5369470 - DNA, 12 bp, Homo sapiens
atatagatgtgc

SEQ ID NO: 5369471 - DNA, 15 bp, Homo sapiens
atatagattaaatca

SEQ ID NO: 5369472 - DNA, 18 bp, Homo sapiens
atatagattataacttgt

SEQ ID NO: 5369473 - DNA, 16 bp, Homo sapiens
atatagcaaaatgatt

SEQ ID NO: 5369474 - DNA, 18 bp, Homo sapiens
atatagcaaagatatata

SEQ ID NO: 5369475 - DNA, 20 bp, Homo sapiens
atatagcaaagatatatatt

SEQ ID NO: 5369476 - DNA, 22 bp, Homo sapiens
atatagcaaagatatatattca

SEQ ID NO: 5369477 - DNA, 17 bp, Homo sapiens
atatagcaagacattat

SEQ ID NO: 5369478 - DNA, 20 bp, Homo sapiens
atatagcattgataatcttc

SEQ ID NO: 5369479 - DNA, 23 bp, Homo sapiens
atatagcattgataatcttcagg

SEQ ID NO: 5369480 - DNA, 23 bp, Homo sapiens
atatagccattgatcataaactg

SEQ ID NO: 5369481 - DNA, 19 bp, Homo sapiens
atatagccctttccccact

SEQ ID NO: 5369482 - DNA, 13 bp, Homo sapiens
atatagcctgcct

SEQ ID NO: 5369483 - DNA, 14 bp, Homo sapiens
atatagcctgcctc

SEQ ID NO: 5369484 - DNA, 22 bp, Homo sapiens
atatagcctgcctcagtggcag

SEQ ID NO: 5369485 - DNA, 23 bp, Homo sapiens
atatagcgtgggttatcagttaa

SEQ ID NO: 5369486 - DNA, 23 bp, Homo sapiens
atatagctaggtgacatatacat

SEQ ID NO: 5369487 - DNA, 18 bp, Homo sapiens
atatagctatcatttctt

SEQ ID NO: 5369488 - DNA, 21 bp, Homo sapiens
atatagctctacacaacatgt

SEQ ID NO: 5369489 - DNA, 22 bp, Homo sapiens
atatagctctacacaacatgta

SEQ ID NO: 5369490 - DNA, 23 bp, Homo sapiens
atatagctctacacaacatgtat

SEQ ID NO: 5369491 - DNA, 14 bp, Homo sapiens
atatagctgctcct

SEQ ID NO: 5369492 - DNA, 14 bp, Homo sapiens
atatagctgtacaa

SEQ ID NO: 5369493 - DNA, 17 bp, Homo sapiens
atatagctgtacaaata

SEQ ID NO: 5369494 - DNA, 20 bp, Homo sapiens
atatagctttgcaaccttgt

SEQ ID NO: 5369495 - DNA, 20 bp, Homo sapiens
atataggaaaacaataattt

SEQ ID NO: 5369496 - DNA, 16 bp, Homo sapiens
atataggaaaatacat

SEQ ID NO: 5369497 - DNA, 15 bp, Homo sapiens
atataggaagcatat

SEQ ID NO: 5369498 - DNA, 14 bp, Homo sapiens
atataggacattga

SEQ ID NO: 5369499 - DNA, 15 bp, Homo sapiens
atataggataaaata

SEQ ID NO: 5369500 - DNA, 21 bp, Homo sapiens
atataggatagacactggaca

SEQ ID NO: 5369501 - DNA, 22 bp, Homo sapiens
atataggatagacactggacat

SEQ ID NO: 5369502 - DNA, 13 bp, Homo sapiens
atataggctattt

SEQ ID NO: 5369503 - DNA, 17 bp, Homo sapiens
atataggggcaaaaatt

SEQ ID NO: 5369504 - DNA, 14 bp, Homo sapiens
atatagggtttgtt

SEQ ID NO: 5369505 - DNA, 20 bp, Homo sapiens
atatagggttttttttaatg

SEQ ID NO: 5369506 - DNA, 16 bp, Homo sapiens
atataggttgtgcaaa

SEQ ID NO: 5369507 - DNA, 20 bp, Homo sapiens
atataggttttgtttgctat

SEQ ID NO: 5369508 - DNA, 17 bp, Homo sapiens
atatagtaatgcactct

SEQ ID NO: 5369509 - DNA, 20 bp, Homo sapiens
atatagtaggggttgaagaa

SEQ ID NO: 5369510 - DNA, 13 bp, Homo sapiens
atatagtatattt

SEQ ID NO: 5369511 - DNA, 16 bp, Homo sapiens
atatagtatatttata

SEQ ID NO: 5369512 - DNA, 19 bp, Homo sapiens
atatagtatatttatactc

SEQ ID NO: 5369513 - DNA, 19 bp, Homo sapiens
atatagtatttaattgttt

SEQ ID NO: 5369514 - DNA, 15 bp, Homo sapiens
atatagtccagacac

SEQ ID NO: 5369515 - DNA, 14 bp, Homo sapiens
atatagtctacagt

SEQ ID NO: 5369516 - DNA, 22 bp, Homo sapiens
atatagtgaagcaatttgaaat

SEQ ID NO: 5369517 - DNA, 22 bp, Homo sapiens
atatagtgggtacatcaagtcc

SEQ ID NO: 5369518 - DNA, 13 bp, Homo sapiens
atatagtgtacag

SEQ ID NO: 5369519 - DNA, 21 bp, Homo sapiens
atatagttaaactgagagtaa

SEQ ID NO: 5369520 - DNA, 21 bp, Homo sapiens
atatagttaattgtggcttta

SEQ ID NO: 5369521 - DNA, 22 bp, Homo sapiens
atatagttccttgccttaataa

SEQ ID NO: 5369522 - DNA, 13 bp, Homo sapiens
atatagttctgtg

SEQ ID NO: 5369523 - DNA, 19 bp, Homo sapiens
atatagttctgtgtagaga

SEQ ID NO: 5369524 - DNA, 12 bp, Homo sapiens
atatagttgaaa

SEQ ID NO: 5369525 - DNA, 21 bp, Homo sapiens
atatagttgtctttctttgct

SEQ ID NO: 5369526 - DNA, 16 bp, Homo sapiens
atatagtttactattt

SEQ ID NO: 5369527 - DNA, 15 bp, Homo sapiens
atatagtttgttttc

SEQ ID NO: 5369528 - DNA, 16 bp, Homo sapiens
atatagtttgttttct

SEQ ID NO: 5369529 - DNA, 17 bp, Homo sapiens
atatagtttgttttctt

SEQ ID NO: 5369530 - DNA, 20 bp, Homo sapiens
atatagtttgttttcttttt

SEQ ID NO: 5369531 - DNA, 23 bp, Homo sapiens
atatagtttgttttctttttctg

SEQ ID NO: 5369532 - DNA, 12 bp, Homo sapiens
atatagttttac

SEQ ID NO: 5369533 - DNA, 18 bp, Homo sapiens
atatagttttacttttaa

SEQ ID NO: 5369534 - DNA, 17 bp, Homo sapiens
atatagtttttaccttt

SEQ ID NO: 5369535 - DNA, 22 bp, Homo sapiens
atatagtttttttttttttcct

SEQ ID NO: 5369536 - DNA, 10 bp, Homo sapiens
atatataaaa

SEQ ID NO: 5369537 - DNA, 19 bp, Homo sapiens
atatataaaaagaaaagat

SEQ ID NO: 5369538 - DNA, 17 bp, Homo sapiens
atatataaaacggtgct

SEQ ID NO: 5369539 - DNA, 23 bp, Homo sapiens
atatataaaataaatatactaat

SEQ ID NO: 5369540 - DNA, 20 bp, Homo sapiens
atatataaaataaatatata

SEQ ID NO: 5369541 - DNA, 17 bp, Homo sapiens
atatataaaatacacgt

SEQ ID NO: 5369542 - DNA, 16 bp, Homo sapiens
atatataaaatatcta

SEQ ID NO: 5369543 - DNA, 14 bp, Homo sapiens
atatataaacaaac

SEQ ID NO: 5369544 - DNA, 15 bp, Homo sapiens
atatataaacaaaca

SEQ ID NO: 5369545 - DNA, 17 bp, Homo sapiens
atatataaacaaacaaa

SEQ ID NO: 5369546 - DNA, 19 bp, Homo sapiens
atatataaacaataaaaac

SEQ ID NO: 5369547 - DNA, 14 bp, Homo sapiens
atatataaacactc

SEQ ID NO: 5369548 - DNA, 22 bp, Homo sapiens
atatataaacagaactcccttc

SEQ ID NO: 5369549 - DNA, 19 bp, Homo sapiens
atatataaacgatatatgt

SEQ ID NO: 5369550 - DNA, 22 bp, Homo sapiens
atatataaacgatatatgtaaa

SEQ ID NO: 5369551 - DNA, 19 bp, Homo sapiens
atatataaagaatatatat

SEQ ID NO: 5369552 - DNA, 14 bp, Homo sapiens
atatataaagacaa

SEQ ID NO: 5369553 - DNA, 22 bp, Homo sapiens
atatataaagacaacaaaagaa

SEQ ID NO: 5369554 - DNA, 18 bp, Homo sapiens
atatataaagtatagaga

SEQ ID NO: 5369555 - DNA, 17 bp, Homo sapiens
atatataaagtcagtga

SEQ ID NO: 5369556 - DNA, 13 bp, Homo sapiens
atatataaataaa

SEQ ID NO: 5369557 - DNA, 12 bp, Homo sapiens
atatataaatat

SEQ ID NO: 5369558 - DNA, 13 bp, Homo sapiens
atatataaatata

SEQ ID NO: 5369559 - DNA, 15 bp, Homo sapiens
atatataaatatata

SEQ ID NO: 5369560 - DNA, 14 bp, Homo sapiens
atatataaatgtat

SEQ ID NO: 5369561 - DNA, 15 bp, Homo sapiens
atatataaatgtata

SEQ ID NO: 5369562 - DNA, 16 bp, Homo sapiens
atatataaatgtataa

SEQ ID NO: 5369563 - DNA, 14 bp, Homo sapiens
atatataacaatgc

SEQ ID NO: 5369564 - DNA, 18 bp, Homo sapiens
atatataacaatgctgta

SEQ ID NO: 5369565 - DNA, 18 bp, Homo sapiens
atatataacatatatgga

SEQ ID NO: 5369566 - DNA, 13 bp, Homo sapiens
atatataaccagt

SEQ ID NO: 5369567 - DNA, 13 bp, Homo sapiens
atatataagaaag

SEQ ID NO: 5369568 - DNA, 22 bp, Homo sapiens
atatataagaaagacatctttc

SEQ ID NO: 5369569 - DNA, 18 bp, Homo sapiens
atatataagactgctgca

SEQ ID NO: 5369570 - DNA, 23 bp, Homo sapiens
atatataagctcagattatttaa

SEQ ID NO: 5369571 - DNA, 20 bp, Homo sapiens
atatataagtgtacatatgt

SEQ ID NO: 5369572 - DNA, 14 bp, Homo sapiens
atatataataaata

SEQ ID NO: 5369573 - DNA, 17 bp, Homo sapiens
atatataataaatggga

SEQ ID NO: 5369574 - DNA, 20 bp, Homo sapiens
atatataataaatgggaaat

SEQ ID NO: 5369575 - DNA, 12 bp, Homo sapiens
atatataataat

SEQ ID NO: 5369576 - DNA, 14 bp, Homo sapiens
atatataatatact

SEQ ID NO: 5369577 - DNA, 17 bp, Homo sapiens
atatataatggtttact

SEQ ID NO: 5369578 - DNA, 18 bp, Homo sapiens
atatataatggtttactg

SEQ ID NO: 5369579 - DNA, 19 bp, Homo sapiens
atatataattctgtacata

SEQ ID NO: 5369580 - DNA, 13 bp, Homo sapiens
atatataatttaa

SEQ ID NO: 5369581 - DNA, 21 bp, Homo sapiens
atatataatttgagtgtatat

SEQ ID NO: 5369582 - DNA, 23 bp, Homo sapiens
atatataatttgagtgtatatat

SEQ ID NO: 5369583 - DNA, 13 bp, Homo sapiens
atatatacaatat

SEQ ID NO: 5369584 - DNA, 21 bp, Homo sapiens
atatatacacacacaaagaga

SEQ ID NO: 5369585 - DNA, 16 bp, Homo sapiens
atatatacacatacat

SEQ ID NO: 5369586 - DNA, 18 bp, Homo sapiens
atatatacagtaacttta

SEQ ID NO: 5369587 - DNA, 14 bp, Homo sapiens
atatatacataaca

SEQ ID NO: 5369588 - DNA, 18 bp, Homo sapiens
atatatacatattcaaag

SEQ ID NO: 5369589 - DNA, 13 bp, Homo sapiens
atatatacatgga

SEQ ID NO: 5369590 - DNA, 16 bp, Homo sapiens
atatatttatatcata

SEQ ID NO: 5369591 - DNA, 15 bp, Homo sapiens
atatatttattattt

SEQ ID NO: 5369592 - DNA, 19 bp, Homo sapiens
atatatttattattttcat

SEQ ID NO: 5369593 - DNA, 13 bp, Homo sapiens
atatatttattga

SEQ ID NO: 5369594 - DNA, 15 bp, Homo sapiens
atatatttatttaaa

SEQ ID NO: 5369595 - DNA, 15 bp, Homo sapiens
atatatttcactttt

SEQ ID NO: 5369596 - DNA, 13 bp, Homo sapiens
atatatttccaaa

SEQ ID NO: 5369597 - DNA, 12 bp, Homo sapiens
atatatttcccc

SEQ ID NO: 5369598 - DNA, 14 bp, Homo sapiens
atatatttcccctt

SEQ ID NO: 5369599 - DNA, 13 bp, Homo sapiens
atatatttcttaa

SEQ ID NO: 5369600 - DNA, 19 bp, Homo sapiens
atatatttgaaagaagtca

SEQ ID NO: 5369601 - DNA, 22 bp, Homo sapiens
atatatttgaaagaagtcaaat

SEQ ID NO: 5369602 - DNA, 21 bp, Homo sapiens
atatatttgaaatagtataca

SEQ ID NO: 5369603 - DNA, 23 bp, Homo sapiens
atatatttgattgtaaaaacaaa

SEQ ID NO: 5369604 - DNA, 15 bp, Homo sapiens
atatatttgcagtat

SEQ ID NO: 5369605 - DNA, 22 bp, Homo sapiens
atatatttgcataatatgcata

SEQ ID NO: 5369606 - DNA, 15 bp, Homo sapiens
atatatttgtaaaag

SEQ ID NO: 5369607 - DNA, 17 bp, Homo sapiens
atatatttgtgtattta

SEQ ID NO: 5369608 - DNA, 19 bp, Homo sapiens
atatatttgtttcatttct

SEQ ID NO: 5369609 - DNA, 11 bp, Homo sapiens
atatattttaa

SEQ ID NO: 5369610 - DNA, 15 bp, Homo sapiens
atatattttaaatgt

SEQ ID NO: 5369611 - DNA, 16 bp, Homo sapiens
atatattttaaatgtg

SEQ ID NO: 5369612 - DNA, 23 bp, Homo sapiens
atatattttaaggttgcacacag

SEQ ID NO: 5369613 - DNA, 18 bp, Homo sapiens
atatattttacaattttt

SEQ ID NO: 5369614 - DNA, 14 bp, Homo sapiens
atatattttatatg

SEQ ID NO: 5369615 - DNA, 16 bp, Homo sapiens
atatattttattttca

SEQ ID NO: 5369616 - DNA, 17 bp, Homo sapiens
atatattttattttcat

SEQ ID NO: 5369617 - DNA, 15 bp, Homo sapiens
atatattttcagtac

SEQ ID NO: 5369618 - DNA, 16 bp, Homo sapiens
atatattttgtatgca

SEQ ID NO: 5369619 - DNA, 23 bp, Homo sapiens
atatattttgtatgcaagcagtt

SEQ ID NO: 5369620 - DNA, 15 bp, Homo sapiens
atatattttgttgtt

SEQ ID NO: 5369621 - DNA, 16 bp, Homo sapiens
atatattttgtttaca

SEQ ID NO: 5369622 - DNA, 22 bp, Homo sapiens
atatatttttaaaaaatgaaat

SEQ ID NO: 5369623 - DNA, 20 bp, Homo sapiens
atatatttttaaagcaaaaa

SEQ ID NO: 5369624 - DNA, 23 bp, Homo sapiens
atatatttttaagataataatat

SEQ ID NO: 5369625 - DNA, 22 bp, Homo sapiens
atatatttttaatggaaagttt

SEQ ID NO: 5369626 - DNA, 22 bp, Homo sapiens
atatatttttactgctttctga

SEQ ID NO: 5369627 - DNA, 19 bp, Homo sapiens
atatatttttatatttact

SEQ ID NO: 5369628 - DNA, 21 bp, Homo sapiens
atatatttttatatttagtta

SEQ ID NO: 5369629 - DNA, 14 bp, Homo sapiens
atatatttttcaaa

SEQ ID NO: 5369630 - DNA, 15 bp, Homo sapiens
atatatttttcaaat

SEQ ID NO: 5369631 - DNA, 22 bp, Homo sapiens
atatatttttcaaccagcattt

SEQ ID NO: 5369632 - DNA, 15 bp, Homo sapiens
atatatttttcacag

SEQ ID NO: 5369633 - DNA, 17 bp, Homo sapiens
atatattttttgctttt

SEQ ID NO: 5369634 - DNA, 19 bp, Homo sapiens
atatatttttttcaactgc

SEQ ID NO: 5369635 - DNA, 23 bp, Homo sapiens
atatatttttttttaagctctga

SEQ ID NO: 5369636 - DNA, 13 bp, Homo sapiens
atatcaaaacaag

SEQ ID NO: 5369637 - DNA, 16 bp, Homo sapiens
atatcaaaagacacag

SEQ ID NO: 5369638 - DNA, 14 bp, Homo sapiens
atatcaaaaggaag

SEQ ID NO: 5369639 - DNA, 15 bp, Homo sapiens
atatcaaaaggaaga

SEQ ID NO: 5369640 - DNA, 18 bp, Homo sapiens
atatcaaaataggatttc

SEQ ID NO: 5369641 - DNA, 15 bp, Homo sapiens
atatcaaaattctag

SEQ ID NO: 5369642 - DNA, 17 bp, Homo sapiens
atatcaaacatgcacac

SEQ ID NO: 5369643 - DNA, 24 bp, Homo sapiens
atatcaaagagaagatgcctgtta

SEQ ID NO: 5369644 - DNA, 19 bp, Homo sapiens
atatcaaatagatatttta

SEQ ID NO: 5369645 - DNA, 21 bp, Homo sapiens
atatcaaattaattgtgtgaa

SEQ ID NO: 5369646 - DNA, 15 bp, Homo sapiens
atatcaactctgaag

SEQ ID NO: 5369647 - DNA, 18 bp, Homo sapiens
atatcaactctgaagcta

SEQ ID NO: 5369648 - DNA, 14 bp, Homo sapiens
atatcaagaatagt

SEQ ID NO: 5369649 - DNA, 15 bp, Homo sapiens
atatcaagatgattc

SEQ ID NO: 5369650 - DNA, 19 bp, Homo sapiens
atatcaaggaaaactgtga

SEQ ID NO: 5369651 - DNA, 20 bp, Homo sapiens
atatcaaggaaaactgtgac

SEQ ID NO: 5369652 - DNA, 15 bp, Homo sapiens
atatcaaggatgttc

SEQ ID NO: 5369653 - DNA, 17 bp, Homo sapiens
atatcaaggtggaaatg

SEQ ID NO: 5369654 - DNA, 18 bp, Homo sapiens
atatcaagtactacattt

SEQ ID NO: 5369655 - DNA, 18 bp, Homo sapiens
atatcaagtcccgaggca

SEQ ID NO: 5369656 - DNA, 20 bp, Homo sapiens
atatcaataaatagatgagt

SEQ ID NO: 5369657 - DNA, 14 bp, Homo sapiens
atatcaatatggtg

SEQ ID NO: 5369658 - DNA, 19 bp, Homo sapiens
atatcaatattttctgcaa

SEQ ID NO: 5369659 - DNA, 20 bp, Homo sapiens
atatcaatattttctgcaat

SEQ ID NO: 5369660 - DNA, 21 bp, Homo sapiens
atatcaatcaagccatgtata

SEQ ID NO: 5369661 - DNA, 15 bp, Homo sapiens
atatcaatcagtaat

SEQ ID NO: 5369662 - DNA, 17 bp, Homo sapiens
atatcaatcattttcct

SEQ ID NO: 5369663 - DNA, 12 bp, Homo sapiens
atatcaattcaa

SEQ ID NO: 5369664 - DNA, 14 bp, Homo sapiens
atatcaattcaaca

SEQ ID NO: 5369665 - DNA, 14 bp, Homo sapiens
atatcacacaatat

SEQ ID NO: 5369666 - DNA, 16 bp, Homo sapiens
atatcacagtattatc

SEQ ID NO: 5369667 - DNA, 18 bp, Homo sapiens
atatcacatgttttctct

SEQ ID NO: 5369668 - DNA, 19 bp, Homo sapiens
atatcacccagacataaag

SEQ ID NO: 5369669 - DNA, 12 bp, Homo sapiens
atatcactaaaa

SEQ ID NO: 5369670 - DNA, 16 bp, Homo sapiens
atatcactaaaagcat

SEQ ID NO: 5369671 - DNA, 18 bp, Homo sapiens
atatcactaaaagcatga

SEQ ID NO: 5369672 - DNA, 19 bp, Homo sapiens
atatcactaaaagcatgaa

SEQ ID NO: 5369673 - DNA, 22 bp, Homo sapiens
atatcactaaaagcatgaattg

SEQ ID NO: 5369674 - DNA, 19 bp, Homo sapiens
atatcactaatttcttctt

SEQ ID NO: 5369675 - DNA, 14 bp, Homo sapiens
atatcactcattaa

SEQ ID NO: 5369676 - DNA, 16 bp, Homo sapiens
atatcactcattaatt

SEQ ID NO: 5369677 - DNA, 17 bp, Homo sapiens
atatcactcattaatta

SEQ ID NO: 5369678 - DNA, 12 bp, Homo sapiens
atatcactgtct

SEQ ID NO: 5369679 - DNA, 11 bp, Homo sapiens
atatcactttg

SEQ ID NO: 5369680 - DNA, 19 bp, Homo sapiens
atatcactttgtattctct

SEQ ID NO: 5369681 - DNA, 17 bp, Homo sapiens
atatcagaaaagggaag

SEQ ID NO: 5369682 - DNA, 19 bp, Homo sapiens
atatcagaaaagtagaatt

SEQ ID NO: 5369683 - DNA, 20 bp, Homo sapiens
atatcagaaaagtagaatta

SEQ ID NO: 5369684 - DNA, 18 bp, Homo sapiens
atatcagaatcgctaata

SEQ ID NO: 5369685 - DNA, 15 bp, Homo sapiens
atatcagacctctga

SEQ ID NO: 5369686 - DNA, 16 bp, Homo sapiens
atatcagacctctgat

SEQ ID NO: 5369687 - DNA, 18 bp, Homo sapiens
atatcagacttcaccaaa

SEQ ID NO: 5369688 - DNA, 15 bp, Homo sapiens
atatcagcagacact

SEQ ID NO: 5369689 - DNA, 14 bp, Homo sapiens
atatcagcctgagt

SEQ ID NO: 5369690 - DNA, 23 bp, Homo sapiens
atatcagctctaaagcagagatg

SEQ ID NO: 5369691 - DNA, 14 bp, Homo sapiens
atatcagctctgca

SEQ ID NO: 5369692 - DNA, 20 bp, Homo sapiens
atatcagctctgcataagat

SEQ ID NO: 5369693 - DNA, 16 bp, Homo sapiens
atatcagctttgataa

SEQ ID NO: 5369694 - DNA, 18 bp, Homo sapiens
atatcaggaaatatctgt

SEQ ID NO: 5369695 - DNA, 21 bp, Homo sapiens
atatcaggaaatatctgtgaa

SEQ ID NO: 5369696 - DNA, 12 bp, Homo sapiens
atatcaggaggg

SEQ ID NO: 5369697 - DNA, 17 bp, Homo sapiens
atatcagggcacagtct

SEQ ID NO: 5369698 - DNA, 18 bp, Homo sapiens
atatcagggcctgagtga

SEQ ID NO: 5369699 - DNA, 18 bp, Homo sapiens
atatcagggtataaatta

SEQ ID NO: 5369700 - DNA, 14 bp, Homo sapiens
atatcaggtgtata

SEQ ID NO: 5369701 - DNA, 18 bp, Homo sapiens
atatcaggtgtataaatg

SEQ ID NO: 5369702 - DNA, 20 bp, Homo sapiens
atatcaggtgtataaatgta

SEQ ID NO: 5369703 - DNA, 14 bp, Homo sapiens
atatcagtagtgta

SEQ ID NO: 5369704 - DNA, 16 bp, Homo sapiens
atatcagtagtgtaca

SEQ ID NO: 5369705 - DNA, 18 bp, Homo sapiens
atatcagtagtgtacatt

SEQ ID NO: 5369706 - DNA, 14 bp, Homo sapiens
atatcagtattctg

SEQ ID NO: 5369707 - DNA, 18 bp, Homo sapiens
atatcagtattctgacat

SEQ ID NO: 5369708 - DNA, 21 bp, Homo sapiens
atatcagtcgttttagtgtct

SEQ ID NO: 5369709 - DNA, 22 bp, Homo sapiens
atatcagttacagtggcagtat

SEQ ID NO: 5369710 - DNA, 19 bp, Homo sapiens
atatcagttactcagccct

SEQ ID NO: 5369711 - DNA, 21 bp, Homo sapiens
atatcagttataattattcca

SEQ ID NO: 5369712 - DNA, 15 bp, Homo sapiens
atatcataaaggata

SEQ ID NO: 5369713 - DNA, 16 bp, Homo sapiens
atatcatacagttttc

SEQ ID NO: 5369714 - DNA, 14 bp, Homo sapiens
atatcatatgtata

SEQ ID NO: 5369715 - DNA, 14 bp, Homo sapiens
atatcatattggta

SEQ ID NO: 5369716 - DNA, 16 bp, Homo sapiens
atatcatatttctgtg

SEQ ID NO: 5369717 - DNA, 17 bp, Homo sapiens
atatcatcaatactttt

SEQ ID NO: 5369718 - DNA, 20 bp, Homo sapiens
atatcatcacgtatgttata

SEQ ID NO: 5369719 - DNA, 21 bp, Homo sapiens
atatcatcagcatacctttat

SEQ ID NO: 5369720 - DNA, 17 bp, Homo sapiens
atatcatcagtattgaa

SEQ ID NO: 5369721 - DNA, 24 bp, Homo sapiens
atatcatccacacatgaatctgca

SEQ ID NO: 5369722 - DNA, 21 bp, Homo sapiens
atatcatctacctagatttaa

SEQ ID NO: 5369723 - DNA, 14 bp, Homo sapiens
atatcatctgtcat

SEQ ID NO: 5369724 - DNA, 24 bp, Homo sapiens
atatcatctgtcattatattctaa

SEQ ID NO: 5369725 - DNA, 13 bp, Homo sapiens
atatcatgcaaaa

SEQ ID NO: 5369726 - DNA, 20 bp, Homo sapiens
atatcatgcaaaatatgttt

SEQ ID NO: 5369727 - DNA, 14 bp, Homo sapiens
atatcatgctaaaa

SEQ ID NO: 5369728 - DNA, 20 bp, Homo sapiens
atatcatgctttaaagtgta

SEQ ID NO: 5369729 - DNA, 22 bp, Homo sapiens
atatcatgctttaaagtgtaat

SEQ ID NO: 5369730 - DNA, 17 bp, Homo sapiens
atatcatggaatttcca

SEQ ID NO: 5369731 - DNA, 14 bp, Homo sapiens
atatcatggggagt

SEQ ID NO: 5369732 - DNA, 13 bp, Homo sapiens
atatcatgtacct

SEQ ID NO: 5369733 - DNA, 23 bp, Homo sapiens
atatcattataactgaaggagaa

SEQ ID NO: 5369734 - DNA, 19 bp, Homo sapiens
atatcattatctttgctgt

SEQ ID NO: 5369735 - DNA, 16 bp, Homo sapiens
atatcattatttagca

SEQ ID NO: 5369736 - DNA, 13 bp, Homo sapiens
atatcattcagaa

SEQ ID NO: 5369737 - DNA, 13 bp, Homo sapiens
atatcattcagca

SEQ ID NO: 5369738 - DNA, 14 bp, Homo sapiens
atatcattcagcaa

SEQ ID NO: 5369739 - DNA, 15 bp, Homo sapiens
atatcattcagcaac

SEQ ID NO: 5369740 - DNA, 15 bp, Homo sapiens
atatcattctacaga

SEQ ID NO: 5369741 - DNA, 20 bp, Homo sapiens
atatcattctacagaataat

SEQ ID NO: 5369742 - DNA, 13 bp, Homo sapiens
atatcattctttg

SEQ ID NO: 5369743 - DNA, 20 bp, Homo sapiens
atatcattctttgtatctta

SEQ ID NO: 5369744 - DNA, 18 bp, Homo sapiens
atatcattggatgatatg

SEQ ID NO: 5369745 - DNA, 17 bp, Homo sapiens
atatcattgttggtgtt

SEQ ID NO: 5369746 - DNA, 17 bp, Homo sapiens
atatcatttcataaaaa

SEQ ID NO: 5369747 - DNA, 12 bp, Homo sapiens
atatcatttctt

SEQ ID NO: 5369748 - DNA, 15 bp, Homo sapiens
atatcatttgtgaag

SEQ ID NO: 5369749 - DNA, 19 bp, Homo sapiens
atatcattttaaaaacttt

SEQ ID NO: 5369750 - DNA, 22 bp, Homo sapiens
atatcattttaaaaactttatt

SEQ ID NO: 5369751 - DNA, 16 bp, Homo sapiens
atatcattttaaaatg

SEQ ID NO: 5369752 - DNA, 18 bp, Homo sapiens
atatcattttatagaaaa

SEQ ID NO: 5369753 - DNA, 20 bp, Homo sapiens
atatcattttatagaaaatg

SEQ ID NO: 5369754 - DNA, 13 bp, Homo sapiens
atatcattttatt

SEQ ID NO: 5369755 - DNA, 19 bp, Homo sapiens
atatcattttgtggatata

SEQ ID NO: 5369756 - DNA, 13 bp, Homo sapiens
atatcatttttat

SEQ ID NO: 5369757 - DNA, 12 bp, Homo sapiens
atatccaaaagc

SEQ ID NO: 5369758 - DNA, 19 bp, Homo sapiens
atatccaaaagctttttat

SEQ ID NO: 5369759 - DNA, 15 bp, Homo sapiens
atatccaaacaagac

SEQ ID NO: 5369760 - DNA, 17 bp, Homo sapiens
atatccaattttaaaat

SEQ ID NO: 5369761 - DNA, 22 bp, Homo sapiens
atatccaattttaaaatgaaat

SEQ ID NO: 5369762 - DNA, 18 bp, Homo sapiens
atatccacccagcaggca

SEQ ID NO: 5369763 - DNA, 20 bp, Homo sapiens
atatccacctacctattcat

SEQ ID NO: 5369764 - DNA, 18 bp, Homo sapiens
atatccagaaggggagct

SEQ ID NO: 5369765 - DNA, 16 bp, Homo sapiens
atatccagctgagtga

SEQ ID NO: 5369766 - DNA, 18 bp, Homo sapiens
atatccaggtcaacagaa

SEQ ID NO: 5369767 - DNA, 21 bp, Homo sapiens
atatccaggtcaacagaatga

SEQ ID NO: 5369768 - DNA, 13 bp, Homo sapiens
atatctttgcact

SEQ ID NO: 5369769 - DNA, 14 bp, Homo sapiens
atatctttgcactg

SEQ ID NO: 5369770 - DNA, 20 bp, Homo sapiens
atatctttgtaaattatttt

SEQ ID NO: 5369771 - DNA, 18 bp, Homo sapiens
atatcttttatgtttgaa

SEQ ID NO: 5369772 - DNA, 21 bp, Homo sapiens
atatcttttatgtttgaatat

SEQ ID NO: 5369773 - DNA, 13 bp, Homo sapiens
atatcttttggtt

SEQ ID NO: 5369774 - DNA, 12 bp, Homo sapiens
atatgaaaacac

SEQ ID NO: 5369775 - DNA, 16 bp, Homo sapiens
atatgaaaatacaact

SEQ ID NO: 5369776 - DNA, 23 bp, Homo sapiens
atatgaaaatacaacttaaataa

SEQ ID NO: 5369777 - DNA, 20 bp, Homo sapiens
atatgaaactcatctgtaaa

SEQ ID NO: 5369778 - DNA, 18 bp, Homo sapiens
atatgaaactctacattt

SEQ ID NO: 5369779 - DNA, 16 bp, Homo sapiens
atatgaaagagaaaat

SEQ ID NO: 5369780 - DNA, 21 bp, Homo sapiens
atatgaaagccacactttgaa

SEQ ID NO: 5369781 - DNA, 13 bp, Homo sapiens
atatgaaagccta

SEQ ID NO: 5369782 - DNA, 19 bp, Homo sapiens
atatgaaataagtaaatgt

SEQ ID NO: 5369783 - DNA, 15 bp, Homo sapiens
atatgaaatataaat

SEQ ID NO: 5369784 - DNA, 16 bp, Homo sapiens
atatgaaatataaatt

SEQ ID NO: 5369785 - DNA, 17 bp, Homo sapiens
atatgaaatattttgaa

SEQ ID NO: 5369786 - DNA, 18 bp, Homo sapiens
atatgaaatgataaagat

SEQ ID NO: 5369787 - DNA, 17 bp, Homo sapiens
atatgaaatgtttcact

SEQ ID NO: 5369788 - DNA, 23 bp, Homo sapiens
atatgaacacagacaaagtgcta

SEQ ID NO: 5369789 - DNA, 16 bp, Homo sapiens
atatgaacatacaaat

SEQ ID NO: 5369790 - DNA, 17 bp, Homo sapiens
atatgaacatacaaatg

SEQ ID NO: 5369791 - DNA, 15 bp, Homo sapiens
atatgaacatattgt

SEQ ID NO: 5369792 - DNA, 17 bp, Homo sapiens
atatgaacctattttca

SEQ ID NO: 5369793 - DNA, 21 bp, Homo sapiens
atatgaacctattttcatttg

SEQ ID NO: 5369794 - DNA, 22 bp, Homo sapiens
atatgaacgcacaacatgcaca

SEQ ID NO: 5369795 - DNA, 14 bp, Homo sapiens
atatgaacttaaca

SEQ ID NO: 5369796 - DNA, 15 bp, Homo sapiens
atatgaagacataaa

SEQ ID NO: 5369797 - DNA, 11 bp, Homo sapiens
atatgaagcaa

SEQ ID NO: 5369798 - DNA, 23 bp, Homo sapiens
atatgaagcaagctgtgttactt

SEQ ID NO: 5369799 - DNA, 15 bp, Homo sapiens
atatgaagcagaatg

SEQ ID NO: 5369800 - DNA, 17 bp, Homo sapiens
atatgaagcagaatgag

SEQ ID NO: 5369801 - DNA, 21 bp, Homo sapiens
atatgaagctcacctgttgct

SEQ ID NO: 5369802 - DNA, 18 bp, Homo sapiens
atatgaaggaaatgaacc

SEQ ID NO: 5369803 - DNA, 16 bp, Homo sapiens
atatgaaggtttgaga

SEQ ID NO: 5369804 - DNA, 18 bp, Homo sapiens
atatgaagtaagttctga

SEQ ID NO: 5369805 - DNA, 15 bp, Homo sapiens
atatgaagtattaaa

SEQ ID NO: 5369806 - DNA, 21 bp, Homo sapiens
atatgaagtattaaaatgcat

SEQ ID NO: 5369807 - DNA, 19 bp, Homo sapiens
atatgaagttactttctta

SEQ ID NO: 5369808 - DNA, 16 bp, Homo sapiens
atatgaataattatgt

SEQ ID NO: 5369809 - DNA, 22 bp, Homo sapiens
atatgaatacagggcatgcatt

SEQ ID NO: 5369810 - DNA, 14 bp, Homo sapiens
atatgaatctataa

SEQ ID NO: 5369811 - DNA, 16 bp, Homo sapiens
atatgaatgtcacatt

SEQ ID NO: 5369812 - DNA, 17 bp, Homo sapiens
atatgaatgtcacattt

SEQ ID NO: 5369813 - DNA, 14 bp, Homo sapiens
atatgaatgttctt

SEQ ID NO: 5369814 - DNA, 18 bp, Homo sapiens
atatgaattctgttgtaa

SEQ ID NO: 5369815 - DNA, 23 bp, Homo sapiens
atatgaattgctgtctagcctta

SEQ ID NO: 5369816 - DNA, 14 bp, Homo sapiens
atatgaattgtaca

SEQ ID NO: 5369817 - DNA, 15 bp, Homo sapiens
atatgaattgtacag

SEQ ID NO: 5369818 - DNA, 18 bp, Homo sapiens
atatgacaatcctgaaga

SEQ ID NO: 5369819 - DNA, 19 bp, Homo sapiens
atatgacaatcctgaagaa

SEQ ID NO: 5369820 - DNA, 22 bp, Homo sapiens
atatgacaatctaccaactgtc

SEQ ID NO: 5369821 - DNA, 22 bp, Homo sapiens
atatgacaatttcaaaatgcat

SEQ ID NO: 5369822 - DNA, 18 bp, Homo sapiens
atatgacagataacctaa

SEQ ID NO: 5369823 - DNA, 21 bp, Homo sapiens
atatgacagataacctaataa

SEQ ID NO: 5369824 - DNA, 22 bp, Homo sapiens
atatgacccacactgccagaag

SEQ ID NO: 5369825 - DNA, 23 bp, Homo sapiens
atatgacctaaatccattttcta

SEQ ID NO: 5369826 - DNA, 13 bp, Homo sapiens
atatgacctcatg

SEQ ID NO: 5369827 - DNA, 16 bp, Homo sapiens
atatgaccttaaggaa

SEQ ID NO: 5369828 - DNA, 22 bp, Homo sapiens
atatgaccttaaggaaaagtaa

SEQ ID NO: 5369829 - DNA, 14 bp, Homo sapiens
atatgactaattca

SEQ ID NO: 5369830 - DNA, 16 bp, Homo sapiens
atatgactcaggagcc

SEQ ID NO: 5369831 - DNA, 15 bp, Homo sapiens
atatgagaaatacag

SEQ ID NO: 5369832 - DNA, 15 bp, Homo sapiens
atatgagaagaatag

SEQ ID NO: 5369833 - DNA, 13 bp, Homo sapiens
atatgagaatgta

SEQ ID NO: 5369834 - DNA, 15 bp, Homo sapiens
atatgagaatgtatt

SEQ ID NO: 5369835 - DNA, 19 bp, Homo sapiens
atatgagacacaggtggac

SEQ ID NO: 5369836 - DNA, 20 bp, Homo sapiens
atatgagagaatcacacaag

SEQ ID NO: 5369837 - DNA, 16 bp, Homo sapiens
atatgagagctctagt

SEQ ID NO: 5369838 - DNA, 22 bp, Homo sapiens
atatgagattggaaaaaattag

SEQ ID NO: 5369839 - DNA, 17 bp, Homo sapiens
atatgagcttcaatata

SEQ ID NO: 5369840 - DNA, 18 bp, Homo sapiens
atatgagcttcaatataa

SEQ ID NO: 5369841 - DNA, 23 bp, Homo sapiens
atatgagcttcaatataagaagc

SEQ ID NO: 5369842 - DNA, 18 bp, Homo sapiens
atatgaggggactgcatg

SEQ ID NO: 5369843 - DNA, 21 bp, Homo sapiens
atatgaggggactgcatgcaa

SEQ ID NO: 5369844 - DNA, 17 bp, Homo sapiens
atatgagtatacaatat

SEQ ID NO: 5369845 - DNA, 18 bp, Homo sapiens
atatgagtatacaatata

SEQ ID NO: 5369846 - DNA, 16 bp, Homo sapiens
atatgagtatctttaa

SEQ ID NO: 5369847 - DNA, 23 bp, Homo sapiens
atatgagtatctttaaatataat

SEQ ID NO: 5369848 - DNA, 23 bp, Homo sapiens
atatgagtgtggaagccggaggg

SEQ ID NO: 5369849 - DNA, 17 bp, Homo sapiens
atatgagtgttttgaaa

SEQ ID NO: 5369850 - DNA, 17 bp, Homo sapiens
atatgagttactgaagg

SEQ ID NO: 5369851 - DNA, 13 bp, Homo sapiens
atatgagttcttc

SEQ ID NO: 5369852 - DNA, 19 bp, Homo sapiens
atatgagtttcatagctaa

SEQ ID NO: 5369853 - DNA, 23 bp, Homo sapiens
atatgataataatcatgatcaca

SEQ ID NO: 5369854 - DNA, 20 bp, Homo sapiens
atatgatacaccattatgtt

SEQ ID NO: 5369855 - DNA, 21 bp, Homo sapiens
atatgatacaccattatgttt

SEQ ID NO: 5369856 - DNA, 20 bp, Homo sapiens
atatgatagcgggaaaagga

SEQ ID NO: 5369857 - DNA, 12 bp, Homo sapiens
atatgatatata

SEQ ID NO: 5369858 - DNA, 15 bp, Homo sapiens
atatgatatataaac

SEQ ID NO: 5369859 - DNA, 18 bp, Homo sapiens
atatgatatataaacctt

SEQ ID NO: 5369860 - DNA, 15 bp, Homo sapiens
atatgatatgcatgt

SEQ ID NO: 5369861 - DNA, 16 bp, Homo sapiens
atatgatatgcatgta

SEQ ID NO: 5369862 - DNA, 15 bp, Homo sapiens
atatgatattgcata

SEQ ID NO: 5369863 - DNA, 13 bp, Homo sapiens
atatgatcaaata

SEQ ID NO: 5369864 - DNA, 15 bp, Homo sapiens
atatgatcagagctt

SEQ ID NO: 5369865 - DNA, 19 bp, Homo sapiens
atatgatcaggtaactttc

SEQ ID NO: 5369866 - DNA, 16 bp, Homo sapiens
atatgatcatgtaaat

SEQ ID NO: 5369867 - DNA, 18 bp, Homo sapiens
atatgatcattgaaatac

SEQ ID NO: 5369868 - DNA, 16 bp, Homo sapiens
atatgatccagagcag

SEQ ID NO: 5369869 - DNA, 21 bp, Homo sapiens
atatgatccagttaacatcat

SEQ ID NO: 5369870 - DNA, 19 bp, Homo sapiens
atatgatccctaatgtgtt

SEQ ID NO: 5369871 - DNA, 18 bp, Homo sapiens
atatgatctaatacaaag

SEQ ID NO: 5369872 - DNA, 17 bp, Homo sapiens
atatgatctgtctgtgg

SEQ ID NO: 5369873 - DNA, 14 bp, Homo sapiens
atatgatctgtgga

SEQ ID NO: 5369874 - DNA, 20 bp, Homo sapiens
atatgatctgtggagaatgt

SEQ ID NO: 5369875 - DNA, 11 bp, Homo sapiens
atatgatgcca

SEQ ID NO: 5369876 - DNA, 13 bp, Homo sapiens
atatgatgccact

SEQ ID NO: 5369877 - DNA, 14 bp, Homo sapiens
atatgatgccactt

SEQ ID NO: 5369878 - DNA, 17 bp, Homo sapiens
atatgatgggggaaaaa

SEQ ID NO: 5369879 - DNA, 15 bp, Homo sapiens
atatgatgtggacat

SEQ ID NO: 5369880 - DNA, 21 bp, Homo sapiens
atatgatgtggacatatgtat

SEQ ID NO: 5369881 - DNA, 22 bp, Homo sapiens
atatgatgtggacatatgtata

SEQ ID NO: 5369882 - DNA, 15 bp, Homo sapiens
atatgatgttaaaaa

SEQ ID NO: 5369883 - DNA, 21 bp, Homo sapiens
atatgatgttaaaaaaataag

SEQ ID NO: 5369884 - DNA, 21 bp, Homo sapiens
atatgattaaaaatatcaaat

SEQ ID NO: 5369885 - DNA, 22 bp, Homo sapiens
atatgattaaaaatatcaaatt

SEQ ID NO: 5369886 - DNA, 13 bp, Homo sapiens
atatgattataca

SEQ ID NO: 5369887 - DNA, 17 bp, Homo sapiens
atatgattattaatcag

SEQ ID NO: 5369888 - DNA, 22 bp, Homo sapiens
atatgattcaaatgtctataaa

SEQ ID NO: 5369889 - DNA, 17 bp, Homo sapiens
atatgattgcactaaat

SEQ ID NO: 5369890 - DNA, 14 bp, Homo sapiens
atatgattgtaaca

SEQ ID NO: 5369891 - DNA, 18 bp, Homo sapiens
atatgattgtaacatatt

SEQ ID NO: 5369892 - DNA, 20 bp, Homo sapiens
atatgattgtaacatatttc

SEQ ID NO: 5369893 - DNA, 20 bp, Homo sapiens
atatgattgtataatgtgat

SEQ ID NO: 5369894 - DNA, 18 bp, Homo sapiens
atatgattgtatttaaag

SEQ ID NO: 5369895 - DNA, 22 bp, Homo sapiens
atatgattgtttctcaaatctt

SEQ ID NO: 5369896 - DNA, 15 bp, Homo sapiens
atatgattgtttgca

SEQ ID NO: 5369897 - DNA, 20 bp, Homo sapiens
atatgatttaaaacatgtaa

SEQ ID NO: 5369898 - DNA, 12 bp, Homo sapiens
atatgatttata

SEQ ID NO: 5369899 - DNA, 15 bp, Homo sapiens
atatgatttatatta

SEQ ID NO: 5369900 - DNA, 15 bp, Homo sapiens
atatgatttgcatgt

SEQ ID NO: 5369901 - DNA, 16 bp, Homo sapiens
atatgatttgcatttt

SEQ ID NO: 5369902 - DNA, 16 bp, Homo sapiens
atatgattttatttga

SEQ ID NO: 5369903 - DNA, 22 bp, Homo sapiens
atatgattttttaaaagaaatt

SEQ ID NO: 5369904 - DNA, 20 bp, Homo sapiens
atatgcaaacagggtaacta

SEQ ID NO: 5369905 - DNA, 18 bp, Homo sapiens
atatgcaaacataacaaa

SEQ ID NO: 5369906 - DNA, 22 bp, Homo sapiens
atatgcaaacataacaaaatca

SEQ ID NO: 5369907 - DNA, 14 bp, Homo sapiens
atatgcaagcagct

SEQ ID NO: 5369908 - DNA, 16 bp, Homo sapiens
atatgcaagcagcttt

SEQ ID NO: 5369909 - DNA, 19 bp, Homo sapiens
atatgcaaggcggtacact

SEQ ID NO: 5369910 - DNA, 16 bp, Homo sapiens
atatgcaataaatatt

SEQ ID NO: 5369911 - DNA, 17 bp, Homo sapiens
atatgcaatatatgttc

SEQ ID NO: 5369912 - DNA, 15 bp, Homo sapiens
atatgcaatcctact

SEQ ID NO: 5369913 - DNA, 16 bp, Homo sapiens
atatgcacacatatat

SEQ ID NO: 5369914 - DNA, 19 bp, Homo sapiens
atatgcaccttgtgtctgt

SEQ ID NO: 5369915 - DNA, 21 bp, Homo sapiens
atatgcaccttgtgtctgtac

SEQ ID NO: 5369916 - DNA, 14 bp, Homo sapiens
atatgcacgttaaa

SEQ ID NO: 5369917 - DNA, 16 bp, Homo sapiens
atatgcactatgtata

SEQ ID NO: 5369918 - DNA, 14 bp, Homo sapiens
atatgcacttataa

SEQ ID NO: 5369919 - DNA, 13 bp, Homo sapiens
atatgcactttcc

SEQ ID NO: 5369920 - DNA, 18 bp, Homo sapiens
atatgcactttccctaga

SEQ ID NO: 5369921 - DNA, 14 bp, Homo sapiens
atatgcagacatgt

SEQ ID NO: 5369922 - DNA, 18 bp, Homo sapiens
atatgcagatacttatta

SEQ ID NO: 5369923 - DNA, 13 bp, Homo sapiens
atatgcagccaac

SEQ ID NO: 5369924 - DNA, 14 bp, Homo sapiens
atatgcaggctgtc

SEQ ID NO: 5369925 - DNA, 22 bp, Homo sapiens
atatgcagtctctttattttac

SEQ ID NO: 5369926 - DNA, 20 bp, Homo sapiens
atatgcagtgatatggcaga

SEQ ID NO: 5369927 - DNA, 17 bp, Homo sapiens
atatgcagttttcctta

SEQ ID NO: 5369928 - DNA, 14 bp, Homo sapiens
atatgcataaacaa

SEQ ID NO: 5369929 - DNA, 21 bp, Homo sapiens
atatgcataatcagcgccctg

SEQ ID NO: 5369930 - DNA, 11 bp, Homo sapiens
atatgcatact

SEQ ID NO: 5369931 - DNA, 22 bp, Homo sapiens
atatgcatactaatttttgctt

SEQ ID NO: 5369932 - DNA, 22 bp, Homo sapiens
atatgcatatatatatgtgtgt

SEQ ID NO: 5369933 - DNA, 16 bp, Homo sapiens
atatgcatatatatgt

SEQ ID NO: 5369934 - DNA, 15 bp, Homo sapiens
atatgcatatatttt

SEQ ID NO: 5369935 - DNA, 17 bp, Homo sapiens
atatgcatcccacagcc

SEQ ID NO: 5369936 - DNA, 14 bp, Homo sapiens
atatgcatctttga

SEQ ID NO: 5369937 - DNA, 18 bp, Homo sapiens
atatgcatctttgagaat

SEQ ID NO: 5369938 - DNA, 15 bp, Homo sapiens
atatgcatgccaggc

SEQ ID NO: 5369939 - DNA, 20 bp, Homo sapiens
atatgcatgctgatttacca

SEQ ID NO: 5369940 - DNA, 11 bp, Homo sapiens
atatgcatgta

SEQ ID NO: 5369941 - DNA, 12 bp, Homo sapiens
atatgcatgtac

SEQ ID NO: 5369942 - DNA, 14 bp, Homo sapiens
atatgcatgtagca

SEQ ID NO: 5369943 - DNA, 17 bp, Homo sapiens
atatgcatgtagcatat

SEQ ID NO: 5369944 - DNA, 13 bp, Homo sapiens
atatgcattcaag

SEQ ID NO: 5369945 - DNA, 17 bp, Homo sapiens
atatgccaagctaattt

SEQ ID NO: 5369946 - DNA, 16 bp, Homo sapiens
atatgtatatttttga

SEQ ID NO: 5369947 - DNA, 18 bp, Homo sapiens
atatgtatatttttttaa

SEQ ID NO: 5369948 - DNA, 18 bp, Homo sapiens
atatgtatccagtacatt

SEQ ID NO: 5369949 - DNA, 22 bp, Homo sapiens
atatgtatccagtacatttaat

SEQ ID NO: 5369950 - DNA, 18 bp, Homo sapiens
atatgtatctttataatt

SEQ ID NO: 5369951 - DNA, 20 bp, Homo sapiens
atatgtatctttataattga

SEQ ID NO: 5369952 - DNA, 23 bp, Homo sapiens
atatgtatctttataattgatga

SEQ ID NO: 5369953 - DNA, 20 bp, Homo sapiens
atatgtatgctgatttacta

SEQ ID NO: 5369954 - DNA, 23 bp, Homo sapiens
atatgtatggatctatattttca

SEQ ID NO: 5369955 - DNA, 14 bp, Homo sapiens
atatgtatggtttt

SEQ ID NO: 5369956 - DNA, 13 bp, Homo sapiens
atatgtatgtcta

SEQ ID NO: 5369957 - DNA, 11 bp, Homo sapiens
atatgtatgtg

SEQ ID NO: 5369958 - DNA, 14 bp, Homo sapiens
atatgtatgtgtga

SEQ ID NO: 5369959 - DNA, 22 bp, Homo sapiens
atatgtatgtgtgagtgtatgt

SEQ ID NO: 5369960 - DNA, 23 bp, Homo sapiens
atatgtatgtgtgagtgtatgta

SEQ ID NO: 5369961 - DNA, 15 bp, Homo sapiens
atatgtatgtgtgta

SEQ ID NO: 5369962 - DNA, 13 bp, Homo sapiens
atatgtatgtgtt

SEQ ID NO: 5369963 - DNA, 18 bp, Homo sapiens
atatgtatgtgtttagaa

SEQ ID NO: 5369964 - DNA, 20 bp, Homo sapiens
atatgtatgtgtttagaatt

SEQ ID NO: 5369965 - DNA, 22 bp, Homo sapiens
atatgtatgtgtttagaattga

SEQ ID NO: 5369966 - DNA, 14 bp, Homo sapiens
atatgtattaataa

SEQ ID NO: 5369967 - DNA, 23 bp, Homo sapiens
atatgtattaataaatagagcaa

SEQ ID NO: 5369968 - DNA, 13 bp, Homo sapiens
atatgtattactt

SEQ ID NO: 5369969 - DNA, 16 bp, Homo sapiens
atatgtattataggag

SEQ ID NO: 5369970 - DNA, 17 bp, Homo sapiens
atatgtattatttataa

SEQ ID NO: 5369971 - DNA, 23 bp, Homo sapiens
atatgtattatttataattccta

SEQ ID NO: 5369972 - DNA, 15 bp, Homo sapiens
atatgtattcccttg

SEQ ID NO: 5369973 - DNA, 16 bp, Homo sapiens
atatgtattcccttgt

SEQ ID NO: 5369974 - DNA, 19 bp, Homo sapiens
atatgtattcccttgtatt

SEQ ID NO: 5369975 - DNA, 14 bp, Homo sapiens
atatgtattctaat

SEQ ID NO: 5369976 - DNA, 15 bp, Homo sapiens
atatgtattctaatt

SEQ ID NO: 5369977 - DNA, 13 bp, Homo sapiens
atatgtattcttt

SEQ ID NO: 5369978 - DNA, 14 bp, Homo sapiens
atatgtattgtaaa

SEQ ID NO: 5369979 - DNA, 21 bp, Homo sapiens
atatgtattgtaaacatgtgt

SEQ ID NO: 5369980 - DNA, 22 bp, Homo sapiens
atatgtatttaagatgtacatt

SEQ ID NO: 5369981 - DNA, 18 bp, Homo sapiens
atatgtatttaccaaaaa

SEQ ID NO: 5369982 - DNA, 15 bp, Homo sapiens
atatgtatttattgt

SEQ ID NO: 5369983 - DNA, 14 bp, Homo sapiens
atatgtattttcct

SEQ ID NO: 5369984 - DNA, 15 bp, Homo sapiens
atatgtattttccta

SEQ ID NO: 5369985 - DNA, 23 bp, Homo sapiens
atatgtattttttgaatctatga

SEQ ID NO: 5369986 - DNA, 14 bp, Homo sapiens
atatgtcaaaaata

SEQ ID NO: 5369987 - DNA, 16 bp, Homo sapiens
atatgtcaaaaatatt

SEQ ID NO: 5369988 - DNA, 22 bp, Homo sapiens
atatgtcaagtgctgtgcaagg

SEQ ID NO: 5369989 - DNA, 15 bp, Homo sapiens
atatgtcactagaat

SEQ ID NO: 5369990 - DNA, 14 bp, Homo sapiens
atatgtcagtgctg

SEQ ID NO: 5369991 - DNA, 20 bp, Homo sapiens
atatgtcatgcctcactttc

SEQ ID NO: 5369992 - DNA, 13 bp, Homo sapiens
atatgtcattatt

SEQ ID NO: 5369993 - DNA, 21 bp, Homo sapiens
atatgtcattatttattgtta

SEQ ID NO: 5369994 - DNA, 14 bp, Homo sapiens
atatgtcatttact

SEQ ID NO: 5369995 - DNA, 21 bp, Homo sapiens
atatgtcgtagaattccttcg

SEQ ID NO: 5369996 - DNA, 21 bp, Homo sapiens
atatgtctcgctagtgatgtt

SEQ ID NO: 5369997 - DNA, 17 bp, Homo sapiens
atatgtctgcaggtttc

SEQ ID NO: 5369998 - DNA, 12 bp, Homo sapiens
atatgtctgcca

SEQ ID NO: 5369999 - DNA, 13 bp, Homo sapiens
atatgtctgcttc

SEQ ID NO: 5370000 - DNA, 14 bp, Homo sapiens
atatgtctgtgtgt

SEQ ID NO: 5370001 - DNA, 23 bp, Homo sapiens
atatgtcttactactttaaatcc

SEQ ID NO: 5370002 - DNA, 11 bp, Homo sapiens
atatgtcttgc

SEQ ID NO: 5370003 - DNA, 16 bp, Homo sapiens
atatgtcttgcaaagc

SEQ ID NO: 5370004 - DNA, 13 bp, Homo sapiens
atatgtctttaaa

SEQ ID NO: 5370005 - DNA, 14 bp, Homo sapiens
atatgtctttaaaa

SEQ ID NO: 5370006 - DNA, 16 bp, Homo sapiens
atatgtgaacatttat

SEQ ID NO: 5370007 - DNA, 19 bp, Homo sapiens
atatgtgaacatttatcaa

SEQ ID NO: 5370008 - DNA, 19 bp, Homo sapiens
atatgtgaactttctcagc

SEQ ID NO: 5370009 - DNA, 23 bp, Homo sapiens
atatgtgaactttctcagcatat

SEQ ID NO: 5370010 - DNA, 13 bp, Homo sapiens
atatgtgaagaaa

SEQ ID NO: 5370011 - DNA, 18 bp, Homo sapiens
atatgtgaagaaaaagac

SEQ ID NO: 5370012 - DNA, 22 bp, Homo sapiens
atatgtgaaggaccttcactct

SEQ ID NO: 5370013 - DNA, 11 bp, Homo sapiens
atatgtgaatc

SEQ ID NO: 5370014 - DNA, 15 bp, Homo sapiens
atatgtgaatctgga

SEQ ID NO: 5370015 - DNA, 17 bp, Homo sapiens
atatgtgaatctggata

SEQ ID NO: 5370016 - DNA, 21 bp, Homo sapiens
atatgtgacactgcagcagaa

SEQ ID NO: 5370017 - DNA, 15 bp, Homo sapiens
atatgtgagaacttt

SEQ ID NO: 5370018 - DNA, 19 bp, Homo sapiens
atatgtgagcatgaaacta

SEQ ID NO: 5370019 - DNA, 19 bp, Homo sapiens
atatgtgagtgaaagtact

SEQ ID NO: 5370020 - DNA, 13 bp, Homo sapiens
atatgtgatctgt

SEQ ID NO: 5370021 - DNA, 16 bp, Homo sapiens
atatgtgatctgtctt

SEQ ID NO: 5370022 - DNA, 15 bp, Homo sapiens
atatgtgattatcat

SEQ ID NO: 5370023 - DNA, 15 bp, Homo sapiens
atatgtgattttcaa

SEQ ID NO: 5370024 - DNA, 23 bp, Homo sapiens
atatgtgattttcaaatatgtaa

SEQ ID NO: 5370025 - DNA, 18 bp, Homo sapiens
atatgtgccacattttct

SEQ ID NO: 5370026 - DNA, 13 bp, Homo sapiens
atatgtgccttaa

SEQ ID NO: 5370027 - DNA, 18 bp, Homo sapiens
atatgtgctggaattcta

SEQ ID NO: 5370028 - DNA, 23 bp, Homo sapiens
atatgtgcttgtgtgtatgtcta

SEQ ID NO: 5370029 - DNA, 20 bp, Homo sapiens
atatgtggagttcatcttga

SEQ ID NO: 5370030 - DNA, 21 bp, Homo sapiens
atatgtggagttcatcttgaa

SEQ ID NO: 5370031 - DNA, 19 bp, Homo sapiens
atatgtggcattcctttct

SEQ ID NO: 5370032 - DNA, 21 bp, Homo sapiens
atatgtggtccatctctgaaa

SEQ ID NO: 5370033 - DNA, 22 bp, Homo sapiens
atatgtggtccatctctgaaaa

SEQ ID NO: 5370034 - DNA, 14 bp, Homo sapiens
atatgtgtaaatgt

SEQ ID NO: 5370035 - DNA, 13 bp, Homo sapiens
atatgtgtaattt

SEQ ID NO: 5370036 - DNA, 22 bp, Homo sapiens
atatgtgtaattttttaaatga

SEQ ID NO: 5370037 - DNA, 13 bp, Homo sapiens
atatgtgtatata

SEQ ID NO: 5370038 - DNA, 16 bp, Homo sapiens
atatgtgtatatatac

SEQ ID NO: 5370039 - DNA, 14 bp, Homo sapiens
atatgtgtgccctg

SEQ ID NO: 5370040 - DNA, 16 bp, Homo sapiens
atatgtgtgccctgga

SEQ ID NO: 5370041 - DNA, 18 bp, Homo sapiens
atatgtgtgccctggact

SEQ ID NO: 5370042 - DNA, 16 bp, Homo sapiens
atatgtgtgtgtatgt

SEQ ID NO: 5370043 - DNA, 18 bp, Homo sapiens
atatgtgttgaaaaccaa

SEQ ID NO: 5370044 - DNA, 19 bp, Homo sapiens
atatgtgtttttcacattt

SEQ ID NO: 5370045 - DNA, 15 bp, Homo sapiens
atatgttattaaaca

SEQ ID NO: 5370046 - DNA, 12 bp, Homo sapiens
atatgttcaact

SEQ ID NO: 5370047 - DNA, 18 bp, Homo sapiens
atatgttcaggaaatgaa

SEQ ID NO: 5370048 - DNA, 13 bp, Homo sapiens
atatgttctgcaa

SEQ ID NO: 5370049 - DNA, 19 bp, Homo sapiens
atatgttctgcaagaatta

SEQ ID NO: 5370050 - DNA, 13 bp, Homo sapiens
atatgttgaatgt

SEQ ID NO: 5370051 - DNA, 16 bp, Homo sapiens
atatgttgaatgttaa

SEQ ID NO: 5370052 - DNA, 21 bp, Homo sapiens
atatgttgactttatttctga

SEQ ID NO: 5370053 - DNA, 13 bp, Homo sapiens
atatgttgatcag

SEQ ID NO: 5370054 - DNA, 14 bp, Homo sapiens
atatgttgatgaaa

SEQ ID NO: 5370055 - DNA, 15 bp, Homo sapiens
atatgttgatgaaat

SEQ ID NO: 5370056 - DNA, 18 bp, Homo sapiens
atatgttgctataataaa

SEQ ID NO: 5370057 - DNA, 16 bp, Homo sapiens
atatgttgctgaaaca

SEQ ID NO: 5370058 - DNA, 15 bp, Homo sapiens
atatgttgctttgaa

SEQ ID NO: 5370059 - DNA, 22 bp, Homo sapiens
atatgttggggtttttttaaga

SEQ ID NO: 5370060 - DNA, 14 bp, Homo sapiens
atatgttgtaataa

SEQ ID NO: 5370061 - DNA, 18 bp, Homo sapiens
atatgttgtattaactgg

SEQ ID NO: 5370062 - DNA, 13 bp, Homo sapiens
atatgttgttctt

SEQ ID NO: 5370063 - DNA, 16 bp, Homo sapiens
atatgtttacacaatt

SEQ ID NO: 5370064 - DNA, 22 bp, Homo sapiens
atatgtttaccttttaattaat

SEQ ID NO: 5370065 - DNA, 18 bp, Homo sapiens
atatgtttatacacacag

SEQ ID NO: 5370066 - DNA, 21 bp, Homo sapiens
atatgtttatattctttctta

SEQ ID NO: 5370067 - DNA, 14 bp, Homo sapiens
atatgtttcaaact

SEQ ID NO: 5370068 - DNA, 19 bp, Homo sapiens
atatgtttcaccctgtccc

SEQ ID NO: 5370069 - DNA, 20 bp, Homo sapiens
atatgtttccccatctctgt

SEQ ID NO: 5370070 - DNA, 13 bp, Homo sapiens
atatgtttccttg

SEQ ID NO: 5370071 - DNA, 18 bp, Homo sapiens
atatgtttccttgtttat

SEQ ID NO: 5370072 - DNA, 15 bp, Homo sapiens
atatgtttggctgaa

SEQ ID NO: 5370073 - DNA, 13 bp, Homo sapiens
atatgtttgtgcc

SEQ ID NO: 5370074 - DNA, 22 bp, Homo sapiens
atatgtttgtggaatggatttt

SEQ ID NO: 5370075 - DNA, 11 bp, Homo sapiens
atatgttttaa

SEQ ID NO: 5370076 - DNA, 14 bp, Homo sapiens
atatgttttccaca

SEQ ID NO: 5370077 - DNA, 16 bp, Homo sapiens
atatgttttgagaaaa

SEQ ID NO: 5370078 - DNA, 17 bp, Homo sapiens
atatgttttgagaaaaa

SEQ ID NO: 5370079 - DNA, 21 bp, Homo sapiens
atatgttttgtgggaacagat

SEQ ID NO: 5370080 - DNA, 21 bp, Homo sapiens
atatgttttttagatcaaata

SEQ ID NO: 5370081 - DNA, 17 bp, Homo sapiens
atattaaaaaacttcat

SEQ ID NO: 5370082 - DNA, 13 bp, Homo sapiens
atattaaaaagtc

SEQ ID NO: 5370083 - DNA, 16 bp, Homo sapiens
atattaaaaagtcttt

SEQ ID NO: 5370084 - DNA, 14 bp, Homo sapiens
atattaaaaatata

SEQ ID NO: 5370085 - DNA, 21 bp, Homo sapiens
atattaaaaatggtaaaattg

SEQ ID NO: 5370086 - DNA, 22 bp, Homo sapiens
atattaaaaattaattctttat

SEQ ID NO: 5370087 - DNA, 15 bp, Homo sapiens
atattaaaaattgaa

SEQ ID NO: 5370088 - DNA, 17 bp, Homo sapiens
atattaaaaattgaaaa

SEQ ID NO: 5370089 - DNA, 15 bp, Homo sapiens
atattaaaagagacc

SEQ ID NO: 5370090 - DNA, 21 bp, Homo sapiens
atattaaaataagcactgtgc

SEQ ID NO: 5370091 - DNA, 17 bp, Homo sapiens
atattaaaatagcatac

SEQ ID NO: 5370092 - DNA, 14 bp, Homo sapiens
atattaaaatcaca

SEQ ID NO: 5370093 - DNA, 15 bp, Homo sapiens
atattaaaatcacaa

SEQ ID NO: 5370094 - DNA, 18 bp, Homo sapiens
atattaaaatcacaaact

SEQ ID NO: 5370095 - DNA, 18 bp, Homo sapiens
atattaaaatgtcggatt

SEQ ID NO: 5370096 - DNA, 11 bp, Homo sapiens
atattaaaatt

SEQ ID NO: 5370097 - DNA, 18 bp, Homo sapiens
atattaaaattacagatg

SEQ ID NO: 5370098 - DNA, 21 bp, Homo sapiens
atattaaaattccaaattcat

SEQ ID NO: 5370099 - DNA, 22 bp, Homo sapiens
atattaaaattccaaattcatg

SEQ ID NO: 5370100 - DNA, 12 bp, Homo sapiens
atattaaaattg

SEQ ID NO: 5370101 - DNA, 18 bp, Homo sapiens
atattaaaattgttaata

SEQ ID NO: 5370102 - DNA, 22 bp, Homo sapiens
atattaaaattgttaatatgca

SEQ ID NO: 5370103 - DNA, 19 bp, Homo sapiens
atattaaacactaaatgca

SEQ ID NO: 5370104 - DNA, 18 bp, Homo sapiens
atattaaacgtgtaaatt

SEQ ID NO: 5370105 - DNA, 19 bp, Homo sapiens
atattaaacgtgtaaattg

SEQ ID NO: 5370106 - DNA, 12 bp, Homo sapiens
atattaaagata

SEQ ID NO: 5370107 - DNA, 15 bp, Homo sapiens
atattaaagatatca

SEQ ID NO: 5370108 - DNA, 18 bp, Homo sapiens
atattaaagattctcttt

SEQ ID NO: 5370109 - DNA, 16 bp, Homo sapiens
atattaaagatttctt

SEQ ID NO: 5370110 - DNA, 19 bp, Homo sapiens
atattaaagatttcttttc

SEQ ID NO: 5370111 - DNA, 12 bp, Homo sapiens
atattaaagcca

SEQ ID NO: 5370112 - DNA, 18 bp, Homo sapiens
atattaaagccatgttta

SEQ ID NO: 5370113 - DNA, 23 bp, Homo sapiens
atattaaagccatgtttattaca

SEQ ID NO: 5370114 - DNA, 12 bp, Homo sapiens
atattaaaggct

SEQ ID NO: 5370115 - DNA, 19 bp, Homo sapiens
atattaaaggtatacaaat

SEQ ID NO: 5370116 - DNA, 22 bp, Homo sapiens
atattaaaggtatacaaataaa

SEQ ID NO: 5370117 - DNA, 19 bp, Homo sapiens
atattaaaggtgaaaattg

SEQ ID NO: 5370118 - DNA, 19 bp, Homo sapiens
atattaaagtctgagaaat

SEQ ID NO: 5370119 - DNA, 20 bp, Homo sapiens
atattaaagtctgagaaatt

SEQ ID NO: 5370120 - DNA, 15 bp, Homo sapiens
atattaaataaatgt

SEQ ID NO: 5370121 - DNA, 14 bp, Homo sapiens
atattaaataacat

SEQ ID NO: 5370122 - DNA, 17 bp, Homo sapiens
atattaaatacagacac

SEQ ID NO: 5370123 - DNA, 19 bp, Homo sapiens
atattaaatacagacacta

SEQ ID NO: 5370124 - DNA, 12 bp, Homo sapiens
atattaaatatt

SEQ ID NO: 5370125 - DNA, 15 bp, Homo sapiens
atattgctactataa

SEQ ID NO: 5370126 - DNA, 16 bp, Homo sapiens
atattgctatgtaatt

SEQ ID NO: 5370127 - DNA, 24 bp, Homo sapiens
atattgctattgtttataggaaat

SEQ ID NO: 5370128 - DNA, 21 bp, Homo sapiens
atattgctctaattcttttca

SEQ ID NO: 5370129 - DNA, 23 bp, Homo sapiens
atattgctctaattcttttcaaa

SEQ ID NO: 5370130 - DNA, 16 bp, Homo sapiens
atattgctcttaaaaa

SEQ ID NO: 5370131 - DNA, 18 bp, Homo sapiens
atattgctcttaaaaatc

SEQ ID NO: 5370132 - DNA, 22 bp, Homo sapiens
atattgctgagagaaatatgga

SEQ ID NO: 5370133 - DNA, 21 bp, Homo sapiens
atattgctgatggtgcaatga

SEQ ID NO: 5370134 - DNA, 22 bp, Homo sapiens
atattgctgatggtgcaatgac

SEQ ID NO: 5370135 - DNA, 21 bp, Homo sapiens
atattgctgctggtaatttgt

SEQ ID NO: 5370136 - DNA, 17 bp, Homo sapiens
atattgctgtctgaaaa

SEQ ID NO: 5370137 - DNA, 14 bp, Homo sapiens
atattgcttatgtc

SEQ ID NO: 5370138 - DNA, 14 bp, Homo sapiens
atattgcttcaatt

SEQ ID NO: 5370139 - DNA, 11 bp, Homo sapiens
atattgcttct

SEQ ID NO: 5370140 - DNA, 21 bp, Homo sapiens
atattgctttttctaatgtgg

SEQ ID NO: 5370141 - DNA, 22 bp, Homo sapiens
atattgctttttctaatgtggt

SEQ ID NO: 5370142 - DNA, 12 bp, Homo sapiens
atattggaactt

SEQ ID NO: 5370143 - DNA, 13 bp, Homo sapiens
atattggaagaga

SEQ ID NO: 5370144 - DNA, 22 bp, Homo sapiens
atattggaagctgctgaggccc

SEQ ID NO: 5370145 - DNA, 18 bp, Homo sapiens
atattggaattataaata

SEQ ID NO: 5370146 - DNA, 19 bp, Homo sapiens
atattggacaaagaacctt

SEQ ID NO: 5370147 - DNA, 23 bp, Homo sapiens
atattggaggaatacttctgata

SEQ ID NO: 5370148 - DNA, 19 bp, Homo sapiens
atattggagggaaatcttg

SEQ ID NO: 5370149 - DNA, 17 bp, Homo sapiens
atattggatgaaaagag

SEQ ID NO: 5370150 - DNA, 19 bp, Homo sapiens
atattggattgcgcctttg

SEQ ID NO: 5370151 - DNA, 13 bp, Homo sapiens
atattgggaagct

SEQ ID NO: 5370152 - DNA, 16 bp, Homo sapiens
atattgggacacacat

SEQ ID NO: 5370153 - DNA, 19 bp, Homo sapiens
atattgggctcagagagta

SEQ ID NO: 5370154 - DNA, 21 bp, Homo sapiens
atattggggaccaaatcaaat

SEQ ID NO: 5370155 - DNA, 21 bp, Homo sapiens
atattgggtctcagccctagg

SEQ ID NO: 5370156 - DNA, 23 bp, Homo sapiens
atattgggtgtagatttctgaca

SEQ ID NO: 5370157 - DNA, 15 bp, Homo sapiens
atattggtgcgtttt

SEQ ID NO: 5370158 - DNA, 17 bp, Homo sapiens
atattggtgtactgtaa

SEQ ID NO: 5370159 - DNA, 16 bp, Homo sapiens
atattggttcttcccc

SEQ ID NO: 5370160 - DNA, 16 bp, Homo sapiens
atattggtttgcacaa

SEQ ID NO: 5370161 - DNA, 20 bp, Homo sapiens
atattggtttgttattcttt

SEQ ID NO: 5370162 - DNA, 12 bp, Homo sapiens
atattggtttta

SEQ ID NO: 5370163 - DNA, 17 bp, Homo sapiens
atattggttttatgatg

SEQ ID NO: 5370164 - DNA, 20 bp, Homo sapiens
atattgtaaatgctattata

SEQ ID NO: 5370165 - DNA, 16 bp, Homo sapiens
atattgtaagaaatac

SEQ ID NO: 5370166 - DNA, 20 bp, Homo sapiens
atattgtaatatgacagata

SEQ ID NO: 5370167 - DNA, 12 bp, Homo sapiens
atattgtaatct

SEQ ID NO: 5370168 - DNA, 18 bp, Homo sapiens
atattgtaatctatgttt

SEQ ID NO: 5370169 - DNA, 23 bp, Homo sapiens
atattgtaatctatgtttataat

SEQ ID NO: 5370170 - DNA, 13 bp, Homo sapiens
atattgtacataa

SEQ ID NO: 5370171 - DNA, 16 bp, Homo sapiens
atattgtacataaaag

SEQ ID NO: 5370172 - DNA, 17 bp, Homo sapiens
atattgtacataaaaga

SEQ ID NO: 5370173 - DNA, 21 bp, Homo sapiens
atattgtacataaaagaattt

SEQ ID NO: 5370174 - DNA, 13 bp, Homo sapiens
atattgtatgtaa

SEQ ID NO: 5370175 - DNA, 18 bp, Homo sapiens
atattgtatgtaagtaat

SEQ ID NO: 5370176 - DNA, 16 bp, Homo sapiens
atattgtattactaga

SEQ ID NO: 5370177 - DNA, 13 bp, Homo sapiens
atattgtattatc

SEQ ID NO: 5370178 - DNA, 21 bp, Homo sapiens
atattgtattatcatatatgc

SEQ ID NO: 5370179 - DNA, 22 bp, Homo sapiens
atattgtattatcatatatgct

SEQ ID NO: 5370180 - DNA, 22 bp, Homo sapiens
atattgtattgttagatgtttg

SEQ ID NO: 5370181 - DNA, 22 bp, Homo sapiens
atattgtatttaacccattatt

SEQ ID NO: 5370182 - DNA, 14 bp, Homo sapiens
atattgtatttata

SEQ ID NO: 5370183 - DNA, 21 bp, Homo sapiens
atattgtatttgagaaaataa

SEQ ID NO: 5370184 - DNA, 19 bp, Homo sapiens
atattgtcacaacactgaa

SEQ ID NO: 5370185 - DNA, 22 bp, Homo sapiens
atattgtcagagttctgctcta

SEQ ID NO: 5370186 - DNA, 16 bp, Homo sapiens
atattgtcagatattt

SEQ ID NO: 5370187 - DNA, 18 bp, Homo sapiens
atattgtcattcctgtat

SEQ ID NO: 5370188 - DNA, 19 bp, Homo sapiens
atattgtcctaagtgtcaa

SEQ ID NO: 5370189 - DNA, 13 bp, Homo sapiens
atattgtgaagta

SEQ ID NO: 5370190 - DNA, 19 bp, Homo sapiens
atattgtgcacatttaata

SEQ ID NO: 5370191 - DNA, 19 bp, Homo sapiens
atattgtgcttaaattatt

SEQ ID NO: 5370192 - DNA, 21 bp, Homo sapiens
atattgtggaataaatccttc

SEQ ID NO: 5370193 - DNA, 14 bp, Homo sapiens
atattgtgtaaata

SEQ ID NO: 5370194 - DNA, 14 bp, Homo sapiens
atattgtgtaagaa

SEQ ID NO: 5370195 - DNA, 15 bp, Homo sapiens
atattgtgtaagaat

SEQ ID NO: 5370196 - DNA, 12 bp, Homo sapiens
atattgtgtagg

SEQ ID NO: 5370197 - DNA, 21 bp, Homo sapiens
atattgtgtaggaaatctgaa

SEQ ID NO: 5370198 - DNA, 15 bp, Homo sapiens
atattgttaaatcct

SEQ ID NO: 5370199 - DNA, 14 bp, Homo sapiens
atattgttaatctc

SEQ ID NO: 5370200 - DNA, 20 bp, Homo sapiens
atattgttcaaacaatatca

SEQ ID NO: 5370201 - DNA, 13 bp, Homo sapiens
atattgttcctaa

SEQ ID NO: 5370202 - DNA, 20 bp, Homo sapiens
atattgttgcattgcttttt

SEQ ID NO: 5370203 - DNA, 16 bp, Homo sapiens
atattgttgtataatt

SEQ ID NO: 5370204 - DNA, 16 bp, Homo sapiens
atattgttgttttcca

SEQ ID NO: 5370205 - DNA, 13 bp, Homo sapiens
atattgtttaaaa

SEQ ID NO: 5370206 - DNA, 15 bp, Homo sapiens
atattgtttaaaatt

SEQ ID NO: 5370207 - DNA, 17 bp, Homo sapiens
atattgtttaaaattca

SEQ ID NO: 5370208 - DNA, 18 bp, Homo sapiens
atattgtttaaaattcag

SEQ ID NO: 5370209 - DNA, 19 bp, Homo sapiens
atattgtttaaaattcagt

SEQ ID NO: 5370210 - DNA, 14 bp, Homo sapiens
atattgtttccctc

SEQ ID NO: 5370211 - DNA, 12 bp, Homo sapiens
atattgtttcta

SEQ ID NO: 5370212 - DNA, 12 bp, Homo sapiens
atattgtttgct

SEQ ID NO: 5370213 - DNA, 18 bp, Homo sapiens
atattgtttgctgttggg

SEQ ID NO: 5370214 - DNA, 19 bp, Homo sapiens
atattgttttataaatgga

SEQ ID NO: 5370215 - DNA, 17 bp, Homo sapiens
atattgttttcagtgta

SEQ ID NO: 5370216 - DNA, 20 bp, Homo sapiens
atattgttttcagtgtacat

SEQ ID NO: 5370217 - DNA, 12 bp, Homo sapiens
atattgttttcc

SEQ ID NO: 5370218 - DNA, 16 bp, Homo sapiens
atattgttttcctaca

SEQ ID NO: 5370219 - DNA, 16 bp, Homo sapiens
atattgtttttatata

SEQ ID NO: 5370220 - DNA, 19 bp, Homo sapiens
atattgtttttatatatta

SEQ ID NO: 5370221 - DNA, 13 bp, Homo sapiens
atattgtttttct

SEQ ID NO: 5370222 - DNA, 16 bp, Homo sapiens
atattgtttttgtatt

SEQ ID NO: 5370223 - DNA, 20 bp, Homo sapiens
atatttaaaaaaaaaatcag

SEQ ID NO: 5370224 - DNA, 19 bp, Homo sapiens
atatttaaaaaattatgga

SEQ ID NO: 5370225 - DNA, 19 bp, Homo sapiens
atatttaaaaacaaaaggc

SEQ ID NO: 5370226 - DNA, 22 bp, Homo sapiens
atatttaaaaacaaaaggcaat

SEQ ID NO: 5370227 - DNA, 17 bp, Homo sapiens
atatttaaaaatgtctt

SEQ ID NO: 5370228 - DNA, 15 bp, Homo sapiens
atatttaaaagaaag

SEQ ID NO: 5370229 - DNA, 15 bp, Homo sapiens
atatttaaaagacaa

SEQ ID NO: 5370230 - DNA, 16 bp, Homo sapiens
atatttaaaagtgtca

SEQ ID NO: 5370231 - DNA, 12 bp, Homo sapiens
atatttaaacag

SEQ ID NO: 5370232 - DNA, 22 bp, Homo sapiens
atatttaaacctttttcttgat

SEQ ID NO: 5370233 - DNA, 12 bp, Homo sapiens
atatttaaactc

SEQ ID NO: 5370234 - DNA, 20 bp, Homo sapiens
atatttaaagccaaatgtaa

SEQ ID NO: 5370235 - DNA, 22 bp, Homo sapiens
atatttaaaggccctatctgtt

SEQ ID NO: 5370236 - DNA, 14 bp, Homo sapiens
atatttaaatcatt

SEQ ID NO: 5370237 - DNA, 11 bp, Homo sapiens
atatttaaatt

SEQ ID NO: 5370238 - DNA, 22 bp, Homo sapiens
atatttaaatttagtgctcaga

SEQ ID NO: 5370239 - DNA, 19 bp, Homo sapiens
atatttaagaaaagcactt

SEQ ID NO: 5370240 - DNA, 20 bp, Homo sapiens
atatttaagaaaagcacttt

SEQ ID NO: 5370241 - DNA, 19 bp, Homo sapiens
atatttaagaaaatacaat

SEQ ID NO: 5370242 - DNA, 20 bp, Homo sapiens
atatttaagaaaatacaata

SEQ ID NO: 5370243 - DNA, 23 bp, Homo sapiens
atatttaagaaaatacaataaac

SEQ ID NO: 5370244 - DNA, 14 bp, Homo sapiens
atatttaagcaata

SEQ ID NO: 5370245 - DNA, 14 bp, Homo sapiens
atatttaagcctta

SEQ ID NO: 5370246 - DNA, 18 bp, Homo sapiens
atatttaagccttttgtg

SEQ ID NO: 5370247 - DNA, 23 bp, Homo sapiens
atatttaaggagatgtaagagct

SEQ ID NO: 5370248 - DNA, 13 bp, Homo sapiens
atatttaagtata

SEQ ID NO: 5370249 - DNA, 17 bp, Homo sapiens
atatttaagtgaaggag

SEQ ID NO: 5370250 - DNA, 15 bp, Homo sapiens
atatttaagtgtatt

SEQ ID NO: 5370251 - DNA, 15 bp, Homo sapiens
atatttaagtttgtt

SEQ ID NO: 5370252 - DNA, 23 bp, Homo sapiens
atatttaataccaccaacaaata

SEQ ID NO: 5370253 - DNA, 22 bp, Homo sapiens
atatttaataggataaattaat

SEQ ID NO: 5370254 - DNA, 15 bp, Homo sapiens
atatttaatatattg

SEQ ID NO: 5370255 - DNA, 14 bp, Homo sapiens
atatttaatatcaa

SEQ ID NO: 5370256 - DNA, 23 bp, Homo sapiens
atatttaatgataagtaaatgct

SEQ ID NO: 5370257 - DNA, 21 bp, Homo sapiens
atatttaatgcattaaacctg

SEQ ID NO: 5370258 - DNA, 21 bp, Homo sapiens
atatttaatgttgaacaaaat

SEQ ID NO: 5370259 - DNA, 14 bp, Homo sapiens
atatttaatgtttt

SEQ ID NO: 5370260 - DNA, 21 bp, Homo sapiens
atatttaatgttttaaatgta

SEQ ID NO: 5370261 - DNA, 22 bp, Homo sapiens
atatttaatgttttaaatgtac

SEQ ID NO: 5370262 - DNA, 16 bp, Homo sapiens
atatttaattatgaaa

SEQ ID NO: 5370263 - DNA, 18 bp, Homo sapiens
atatttaattatgaaaac

SEQ ID NO: 5370264 - DNA, 15 bp, Homo sapiens
atatttaattattaa

SEQ ID NO: 5370265 - DNA, 12 bp, Homo sapiens
atatttaattgt

SEQ ID NO: 5370266 - DNA, 20 bp, Homo sapiens
atatttaatttttacatgac

SEQ ID NO: 5370267 - DNA, 13 bp, Homo sapiens
atatttacaaatg

SEQ ID NO: 5370268 - DNA, 13 bp, Homo sapiens
atatttacaataa

SEQ ID NO: 5370269 - DNA, 15 bp, Homo sapiens
atatttacaataaat

SEQ ID NO: 5370270 - DNA, 18 bp, Homo sapiens
atatttacaataaatgaa

SEQ ID NO: 5370271 - DNA, 17 bp, Homo sapiens
atatttacaatgtatta

SEQ ID NO: 5370272 - DNA, 21 bp, Homo sapiens
atatttacaatgtattaagcc

SEQ ID NO: 5370273 - DNA, 17 bp, Homo sapiens
atatttacataaagact

SEQ ID NO: 5370274 - DNA, 23 bp, Homo sapiens
atatttacatccagcttctcatg

SEQ ID NO: 5370275 - DNA, 18 bp, Homo sapiens
atatttacattctagttc

SEQ ID NO: 5370276 - DNA, 15 bp, Homo sapiens
atatttacctcagcc

SEQ ID NO: 5370277 - DNA, 18 bp, Homo sapiens
atatttacctcagcctgg

SEQ ID NO: 5370278 - DNA, 14 bp, Homo sapiens
atatttacctgtat

SEQ ID NO: 5370279 - DNA, 14 bp, Homo sapiens
atatttactgttta

SEQ ID NO: 5370280 - DNA, 19 bp, Homo sapiens
atatttacttcttatacat

SEQ ID NO: 5370281 - DNA, 14 bp, Homo sapiens
atatttactttaaa

SEQ ID NO: 5370282 - DNA, 12 bp, Homo sapiens
atatttagaaaa

SEQ ID NO: 5370283 - DNA, 17 bp, Homo sapiens
atatttagaaaattttg

SEQ ID NO: 5370284 - DNA, 20 bp, Homo sapiens
atatttagcataaatttaat

SEQ ID NO: 5370285 - DNA, 22 bp, Homo sapiens
atatttagcataaatttaatgt

SEQ ID NO: 5370286 - DNA, 19 bp, Homo sapiens
atatttaggaaaatgctta

SEQ ID NO: 5370287 - DNA, 21 bp, Homo sapiens
atatttaggcctcttgaattt

SEQ ID NO: 5370288 - DNA, 19 bp, Homo sapiens
atatttagggtactattca

SEQ ID NO: 5370289 - DNA, 20 bp, Homo sapiens
atatttagtataccagagaa

SEQ ID NO: 5370290 - DNA, 16 bp, Homo sapiens
atatttagtatctagt

SEQ ID NO: 5370291 - DNA, 22 bp, Homo sapiens
atatttagttatagtttcagat

SEQ ID NO: 5370292 - DNA, 22 bp, Homo sapiens
atatttataactcatcataaaa

SEQ ID NO: 5370293 - DNA, 16 bp, Homo sapiens
atatttataagagaag

SEQ ID NO: 5370294 - DNA, 17 bp, Homo sapiens
atatttataattaaaga

SEQ ID NO: 5370295 - DNA, 21 bp, Homo sapiens
atatttataattaaagaaaat

SEQ ID NO: 5370296 - DNA, 23 bp, Homo sapiens
atatttataattaaagaaaattg

SEQ ID NO: 5370297 - DNA, 17 bp, Homo sapiens
atatttatagaacagtt

SEQ ID NO: 5370298 - DNA, 22 bp, Homo sapiens
atatttatagagttcatagaaa

SEQ ID NO: 5370299 - DNA, 15 bp, Homo sapiens
atatttatagcaaag

SEQ ID NO: 5370300 - DNA, 18 bp, Homo sapiens
atatttatagggctttta

SEQ ID NO: 5370301 - DNA, 19 bp, Homo sapiens
atatttataggtacccaat

SEQ ID NO: 5370302 - DNA, 14 bp, Homo sapiens
atattttatctttt

SEQ ID NO: 5370303 - DNA, 13 bp, Homo sapiens
atattttatgaac

SEQ ID NO: 5370304 - DNA, 19 bp, Homo sapiens
atattttatgaacattgta

SEQ ID NO: 5370305 - DNA, 17 bp, Homo sapiens
atattttatgatccagc

SEQ ID NO: 5370306 - DNA, 15 bp, Homo sapiens
atattttatgattta

SEQ ID NO: 5370307 - DNA, 17 bp, Homo sapiens
atattttatgatttaaa

SEQ ID NO: 5370308 - DNA, 14 bp, Homo sapiens
atattttatggtta

SEQ ID NO: 5370309 - DNA, 13 bp, Homo sapiens
atattttatgtgt

SEQ ID NO: 5370310 - DNA, 14 bp, Homo sapiens
atattttatgtgta

SEQ ID NO: 5370311 - DNA, 15 bp, Homo sapiens
atattttattactgt

SEQ ID NO: 5370312 - DNA, 19 bp, Homo sapiens
atattttattcaaggtaaa

SEQ ID NO: 5370313 - DNA, 15 bp, Homo sapiens
atattttatttctga

SEQ ID NO: 5370314 - DNA, 14 bp, Homo sapiens
atattttattttca

SEQ ID NO: 5370315 - DNA, 14 bp, Homo sapiens
atattttattttta

SEQ ID NO: 5370316 - DNA, 15 bp, Homo sapiens
atattttatttttat

SEQ ID NO: 5370317 - DNA, 16 bp, Homo sapiens
atattttcaacaatta

SEQ ID NO: 5370318 - DNA, 21 bp, Homo sapiens
atattttcaattcaaaaatgt

SEQ ID NO: 5370319 - DNA, 23 bp, Homo sapiens
atattttcaattcaaaaatgtac

SEQ ID NO: 5370320 - DNA, 22 bp, Homo sapiens
atattttcacactggtaaatgt

SEQ ID NO: 5370321 - DNA, 13 bp, Homo sapiens
atattttcagagc

SEQ ID NO: 5370322 - DNA, 14 bp, Homo sapiens
atattttcagtaat

SEQ ID NO: 5370323 - DNA, 13 bp, Homo sapiens
atattttcagtac

SEQ ID NO: 5370324 - DNA, 20 bp, Homo sapiens
atattttcatcctataagct

SEQ ID NO: 5370325 - DNA, 18 bp, Homo sapiens
atattttcatgctgttca

SEQ ID NO: 5370326 - DNA, 21 bp, Homo sapiens
atattttcatgctgttcatga

SEQ ID NO: 5370327 - DNA, 12 bp, Homo sapiens
atattttcatgt

SEQ ID NO: 5370328 - DNA, 13 bp, Homo sapiens
atattttcattct

SEQ ID NO: 5370329 - DNA, 17 bp, Homo sapiens
atattttcattctccta

SEQ ID NO: 5370330 - DNA, 15 bp, Homo sapiens
atattttccatatat

SEQ ID NO: 5370331 - DNA, 17 bp, Homo sapiens
atattttccatatattg

SEQ ID NO: 5370332 - DNA, 16 bp, Homo sapiens
atattttccctaccta

SEQ ID NO: 5370333 - DNA, 20 bp, Homo sapiens
atattttccctctcttgcct

SEQ ID NO: 5370334 - DNA, 24 bp, Homo sapiens
atattttcctagtagatctatatt

SEQ ID NO: 5370335 - DNA, 13 bp, Homo sapiens
atattttcctgcc

SEQ ID NO: 5370336 - DNA, 16 bp, Homo sapiens
atattttcgtatgaaa

SEQ ID NO: 5370337 - DNA, 17 bp, Homo sapiens
atattttcgtatgaaaa

SEQ ID NO: 5370338 - DNA, 19 bp, Homo sapiens
atattttcgtatgaaaatg

SEQ ID NO: 5370339 - DNA, 14 bp, Homo sapiens
atattttctatttt

SEQ ID NO: 5370340 - DNA, 13 bp, Homo sapiens
atattttctctgt

SEQ ID NO: 5370341 - DNA, 16 bp, Homo sapiens
atattttctgtgtgtt

SEQ ID NO: 5370342 - DNA, 17 bp, Homo sapiens
atattttctgtgtgttc

SEQ ID NO: 5370343 - DNA, 14 bp, Homo sapiens
atattttcttaaaa

SEQ ID NO: 5370344 - DNA, 14 bp, Homo sapiens
atattttcttcctt

SEQ ID NO: 5370345 - DNA, 21 bp, Homo sapiens
atattttctttaaaagacaaa

SEQ ID NO: 5370346 - DNA, 12 bp, Homo sapiens
atattttctttc

SEQ ID NO: 5370347 - DNA, 20 bp, Homo sapiens
atattttcttttatggcaaa

SEQ ID NO: 5370348 - DNA, 13 bp, Homo sapiens
atattttgaaata

SEQ ID NO: 5370349 - DNA, 19 bp, Homo sapiens
atattttgaaatgaacttt

SEQ ID NO: 5370350 - DNA, 12 bp, Homo sapiens
atattttgaatc

SEQ ID NO: 5370351 - DNA, 15 bp, Homo sapiens
atattttgagaaact

SEQ ID NO: 5370352 - DNA, 16 bp, Homo sapiens
atattttgagaaactg

SEQ ID NO: 5370353 - DNA, 17 bp, Homo sapiens
atattttgataataata

SEQ ID NO: 5370354 - DNA, 15 bp, Homo sapiens
atattttgatacaaa

SEQ ID NO: 5370355 - DNA, 16 bp, Homo sapiens
atattttgatcttcaa

SEQ ID NO: 5370356 - DNA, 17 bp, Homo sapiens
atattttgatcttcaac

SEQ ID NO: 5370357 - DNA, 22 bp, Homo sapiens
atattttgatcttcaacaaatt

SEQ ID NO: 5370358 - DNA, 13 bp, Homo sapiens
atattttgctaac

SEQ ID NO: 5370359 - DNA, 23 bp, Homo sapiens
atattttgctaactggttaaaca

SEQ ID NO: 5370360 - DNA, 12 bp, Homo sapiens
atattttgctgg

SEQ ID NO: 5370361 - DNA, 14 bp, Homo sapiens
atattttgctgttt

SEQ ID NO: 5370362 - DNA, 13 bp, Homo sapiens
atattttggaaac

SEQ ID NO: 5370363 - DNA, 19 bp, Homo sapiens
atattttgggaatcttttc

SEQ ID NO: 5370364 - DNA, 20 bp, Homo sapiens
atattttgtaaaatgtatta

SEQ ID NO: 5370365 - DNA, 21 bp, Homo sapiens
atattttgtaatattctgttt

SEQ ID NO: 5370366 - DNA, 14 bp, Homo sapiens
atattttgtatata

SEQ ID NO: 5370367 - DNA, 14 bp, Homo sapiens
atattttgtatgca

SEQ ID NO: 5370368 - DNA, 17 bp, Homo sapiens
atattttgtatgcaagc

SEQ ID NO: 5370369 - DNA, 16 bp, Homo sapiens
atattttgtattattg

SEQ ID NO: 5370370 - DNA, 18 bp, Homo sapiens
atattttgtattattgct

SEQ ID NO: 5370371 - DNA, 13 bp, Homo sapiens
atattttgtattt

SEQ ID NO: 5370372 - DNA, 14 bp, Homo sapiens
atattttgtctaaa

SEQ ID NO: 5370373 - DNA, 22 bp, Homo sapiens
atattttgtgggcttaattgaa

SEQ ID NO: 5370374 - DNA, 22 bp, Homo sapiens
atattttgtgtataatgtgctt

SEQ ID NO: 5370375 - DNA, 13 bp, Homo sapiens
atattttgtgtga

SEQ ID NO: 5370376 - DNA, 22 bp, Homo sapiens
atattttgtgtgaaattgcata

SEQ ID NO: 5370377 - DNA, 16 bp, Homo sapiens
atattttgttaacttt

SEQ ID NO: 5370378 - DNA, 22 bp, Homo sapiens
atattttgttaccttttacaga

SEQ ID NO: 5370379 - DNA, 14 bp, Homo sapiens
atattttgttctta

SEQ ID NO: 5370380 - DNA, 21 bp, Homo sapiens
atattttgttgccttcatctt

SEQ ID NO: 5370381 - DNA, 20 bp, Homo sapiens
atattttgttgttcctctat

SEQ ID NO: 5370382 - DNA, 11 bp, Homo sapiens
atatttttaaa

SEQ ID NO: 5370383 - DNA, 17 bp, Homo sapiens
atatttttaaaaaactg

SEQ ID NO: 5370384 - DNA, 14 bp, Homo sapiens
atatttttaaaaga

SEQ ID NO: 5370385 - DNA, 22 bp, Homo sapiens
atatttttaaaatatttaactt

SEQ ID NO: 5370386 - DNA, 13 bp, Homo sapiens
atatttttaaaga

SEQ ID NO: 5370387 - DNA, 15 bp, Homo sapiens
atatttttaaagaaa

SEQ ID NO: 5370388 - DNA, 14 bp, Homo sapiens
atatttttaaagat

SEQ ID NO: 5370389 - DNA, 19 bp, Homo sapiens
atatttttaataaaagttg

SEQ ID NO: 5370390 - DNA, 15 bp, Homo sapiens
atatttttaattaaa

SEQ ID NO: 5370391 - DNA, 22 bp, Homo sapiens
atatttttacaaataattatca

SEQ ID NO: 5370392 - DNA, 22 bp, Homo sapiens
atatttttactgctttctgaat

SEQ ID NO: 5370393 - DNA, 13 bp, Homo sapiens
atatttttagata

SEQ ID NO: 5370394 - DNA, 17 bp, Homo sapiens
atatttttataataaac

SEQ ID NO: 5370395 - DNA, 20 bp, Homo sapiens
atatttttataataaacata

SEQ ID NO: 5370396 - DNA, 13 bp, Homo sapiens
atatttttatact

SEQ ID NO: 5370397 - DNA, 18 bp, Homo sapiens
atatttttatactttatt

SEQ ID NO: 5370398 - DNA, 13 bp, Homo sapiens
atatttttataga

SEQ ID NO: 5370399 - DNA, 16 bp, Homo sapiens
atatttttatatttac

SEQ ID NO: 5370400 - DNA, 18 bp, Homo sapiens
atatttttatatttagtt

SEQ ID NO: 5370401 - DNA, 19 bp, Homo sapiens
atatttttatatttccttt

SEQ ID NO: 5370402 - DNA, 22 bp, Homo sapiens
atatttttatctttatatgaag

SEQ ID NO: 5370403 - DNA, 22 bp, Homo sapiens
atatttttatgtgaaggtgttt

SEQ ID NO: 5370404 - DNA, 15 bp, Homo sapiens
atatttttatgtgca

SEQ ID NO: 5370405 - DNA, 16 bp, Homo sapiens
atatttttatgtgcag

SEQ ID NO: 5370406 - DNA, 17 bp, Homo sapiens
atatttttattcaaact

SEQ ID NO: 5370407 - DNA, 23 bp, Homo sapiens
atatttttatttcattcacatta

SEQ ID NO: 5370408 - DNA, 16 bp, Homo sapiens
atatttttattttatt

SEQ ID NO: 5370409 - DNA, 14 bp, Homo sapiens
atatttttcaaaat

SEQ ID NO: 5370410 - DNA, 16 bp, Homo sapiens
atatttttcaaataga

SEQ ID NO: 5370411 - DNA, 18 bp, Homo sapiens
atatttttcaaccagcat

SEQ ID NO: 5370412 - DNA, 13 bp, Homo sapiens
atatttttcacat

SEQ ID NO: 5370413 - DNA, 14 bp, Homo sapiens
atatttttccattt

SEQ ID NO: 5370414 - DNA, 22 bp, Homo sapiens
atatttttccctccgggcaggg

SEQ ID NO: 5370415 - DNA, 12 bp, Homo sapiens
atatttttcctt

SEQ ID NO: 5370416 - DNA, 19 bp, Homo sapiens
atatttttctcaatgttta

SEQ ID NO: 5370417 - DNA, 12 bp, Homo sapiens
atatttttctga

SEQ ID NO: 5370418 - DNA, 21 bp, Homo sapiens
atatttttctgtgtggagtat

SEQ ID NO: 5370419 - DNA, 20 bp, Homo sapiens
atatttttcttatttatgta

SEQ ID NO: 5370420 - DNA, 12 bp, Homo sapiens
atatttttgaat

SEQ ID NO: 5370421 - DNA, 15 bp, Homo sapiens
atatttttgatcttt

SEQ ID NO: 5370422 - DNA, 16 bp, Homo sapiens
atatttttgatggtaa

SEQ ID NO: 5370423 - DNA, 18 bp, Homo sapiens
atatttttggttgtcaat

SEQ ID NO: 5370424 - DNA, 22 bp, Homo sapiens
atatttttgtaaatatgacaga

SEQ ID NO: 5370425 - DNA, 12 bp, Homo sapiens
atatttttgtac

SEQ ID NO: 5370426 - DNA, 13 bp, Homo sapiens
atatttttgtaca

SEQ ID NO: 5370427 - DNA, 15 bp, Homo sapiens
atatttttgtacttg

SEQ ID NO: 5370428 - DNA, 13 bp, Homo sapiens
atatttttgtatt

SEQ ID NO: 5370429 - DNA, 15 bp, Homo sapiens
atatttttgtatttt

SEQ ID NO: 5370430 - DNA, 23 bp, Homo sapiens
atatttttgttactgttctgagc

SEQ ID NO: 5370431 - DNA, 21 bp, Homo sapiens
atattttttaaatttacagaa

SEQ ID NO: 5370432 - DNA, 17 bp, Homo sapiens
atattttttaatttaaa

SEQ ID NO: 5370433 - DNA, 20 bp, Homo sapiens
atattttttaatttgatgaa

SEQ ID NO: 5370434 - DNA, 12 bp, Homo sapiens
atattttttaca

SEQ ID NO: 5370435 - DNA, 12 bp, Homo sapiens
atattttttagt

SEQ ID NO: 5370436 - DNA, 22 bp, Homo sapiens
atattttttatatctggaatga

SEQ ID NO: 5370437 - DNA, 22 bp, Homo sapiens
atattttttattaatatttgca

SEQ ID NO: 5370438 - DNA, 15 bp, Homo sapiens
atattttttctcaaa

SEQ ID NO: 5370439 - DNA, 15 bp, Homo sapiens
atattttttctgaat

SEQ ID NO: 5370440 - DNA, 21 bp, Homo sapiens
atattttttcttttgacataa

SEQ ID NO: 5370441 - DNA, 20 bp, Homo sapiens
atattttttgagtgtatgct

SEQ ID NO: 5370442 - DNA, 16 bp, Homo sapiens
atattttttgatggaa

SEQ ID NO: 5370443 - DNA, 13 bp, Homo sapiens
atattttttgcaa

SEQ ID NO: 5370444 - DNA, 19 bp, Homo sapiens
atattttttgcaagttata

SEQ ID NO: 5370445 - DNA, 16 bp, Homo sapiens
atattttttgcttttg

SEQ ID NO: 5370446 - DNA, 14 bp, Homo sapiens
atattttttgtctg

SEQ ID NO: 5370447 - DNA, 21 bp, Homo sapiens
atatttttttaaaatgttaaa

SEQ ID NO: 5370448 - DNA, 17 bp, Homo sapiens
atatttttttaatttaa

SEQ ID NO: 5370449 - DNA, 21 bp, Homo sapiens
atatttttttccttacataaa

SEQ ID NO: 5370450 - DNA, 22 bp, Homo sapiens
atatttttttccttacataaac

SEQ ID NO: 5370451 - DNA, 17 bp, Homo sapiens
atatttttttcctttgc

SEQ ID NO: 5370452 - DNA, 23 bp, Homo sapiens
atatttttttcctttgcattcat

SEQ ID NO: 5370453 - DNA, 18 bp, Homo sapiens
atatttttttctagctat

SEQ ID NO: 5370454 - DNA, 22 bp, Homo sapiens
atattttttttctttttaccca

SEQ ID NO: 5370455 - DNA, 16 bp, Homo sapiens
atcaaaaaaacaagtt

SEQ ID NO: 5370456 - DNA, 17 bp, Homo sapiens
atcaaaaaaagactcag

SEQ ID NO: 5370457 - DNA, 13 bp, Homo sapiens
atcaaaaaacaga

SEQ ID NO: 5370458 - DNA, 21 bp, Homo sapiens
atcaaaaaacagaaaaacaaa

SEQ ID NO: 5370459 - DNA, 13 bp, Homo sapiens
atcaaaaactgac

SEQ ID NO: 5370460 - DNA, 16 bp, Homo sapiens
atcaaaaactgacttt

SEQ ID NO: 5370461 - DNA, 13 bp, Homo sapiens
atcaaaaactttt

SEQ ID NO: 5370462 - DNA, 14 bp, Homo sapiens
atcaaaaacttttc

SEQ ID NO: 5370463 - DNA, 11 bp, Homo sapiens
atcaaaaagag

SEQ ID NO: 5370464 - DNA, 23 bp, Homo sapiens
atcaaaaagagtcttaattttct

SEQ ID NO: 5370465 - DNA, 13 bp, Homo sapiens
atcaaaaaggctt

SEQ ID NO: 5370466 - DNA, 17 bp, Homo sapiens
atcaaaaaggcttataa

SEQ ID NO: 5370467 - DNA, 11 bp, Homo sapiens
atcaaaaataa

SEQ ID NO: 5370468 - DNA, 14 bp, Homo sapiens
atcaaaaataaact

SEQ ID NO: 5370469 - DNA, 15 bp, Homo sapiens
atcaaaaataaacta

SEQ ID NO: 5370470 - DNA, 22 bp, Homo sapiens
atcaaaaataaactagtttcca

SEQ ID NO: 5370471 - DNA, 22 bp, Homo sapiens
atcaaaaatatgtgtttttaag

SEQ ID NO: 5370472 - DNA, 16 bp, Homo sapiens
atcaaaaatattccat

SEQ ID NO: 5370473 - DNA, 18 bp, Homo sapiens
atcaaaacatatcaattc

SEQ ID NO: 5370474 - DNA, 19 bp, Homo sapiens
atcaaaacatatcaattca

SEQ ID NO: 5370475 - DNA, 12 bp, Homo sapiens
atcaaaacatgc

SEQ ID NO: 5370476 - DNA, 21 bp, Homo sapiens
atcaaaacctttcaaatatca

SEQ ID NO: 5370477 - DNA, 13 bp, Homo sapiens
atcaaaagaaaat

SEQ ID NO: 5370478 - DNA, 22 bp, Homo sapiens
atcaaaagaaaattgatatttt

SEQ ID NO: 5370479 - DNA, 18 bp, Homo sapiens
atcaaaagaaatagaaaa

SEQ ID NO: 5370480 - DNA, 16 bp, Homo sapiens
atcaaaagctgcttga

SEQ ID NO: 5370481 - DNA, 20 bp, Homo sapiens
atcaaaaggaggaatttcag

SEQ ID NO: 5370482 - DNA, 16 bp, Homo sapiens
atcacacactttctga

SEQ ID NO: 5370483 - DNA, 21 bp, Homo sapiens
atcacacactttctgactgca

SEQ ID NO: 5370484 - DNA, 23 bp, Homo sapiens
atcacacatgaataaagcctttg

SEQ ID NO: 5370485 - DNA, 16 bp, Homo sapiens
atcacacatgttcaga

SEQ ID NO: 5370486 - DNA, 17 bp, Homo sapiens
atcacaccaatttagaa

SEQ ID NO: 5370487 - DNA, 13 bp, Homo sapiens
atcacaccactgc

SEQ ID NO: 5370488 - DNA, 17 bp, Homo sapiens
atcacaccactgtactc

SEQ ID NO: 5370489 - DNA, 20 bp, Homo sapiens
atcacaccatcgctggcccc

SEQ ID NO: 5370490 - DNA, 15 bp, Homo sapiens
atcacacccatttaa

SEQ ID NO: 5370491 - DNA, 15 bp, Homo sapiens
atcacacctcagtgg

SEQ ID NO: 5370492 - DNA, 13 bp, Homo sapiens
atcacacctctgg

SEQ ID NO: 5370493 - DNA, 15 bp, Homo sapiens
atcacacctctgggc

SEQ ID NO: 5370494 - DNA, 18 bp, Homo sapiens
atcacacctctgggcttc

SEQ ID NO: 5370495 - DNA, 17 bp, Homo sapiens
atcacactcaaactttg

SEQ ID NO: 5370496 - DNA, 23 bp, Homo sapiens
atcacacttcattgtaaatcact

SEQ ID NO: 5370497 - DNA, 19 bp, Homo sapiens
atcacagaaacggtcttta

SEQ ID NO: 5370498 - DNA, 15 bp, Homo sapiens
atcacagaccacagg

SEQ ID NO: 5370499 - DNA, 15 bp, Homo sapiens
atcacagaccccagc

SEQ ID NO: 5370500 - DNA, 16 bp, Homo sapiens
atcacagaccccagct

SEQ ID NO: 5370501 - DNA, 17 bp, Homo sapiens
atcacagaccccagctg

SEQ ID NO: 5370502 - DNA, 18 bp, Homo sapiens
atcacagagacattcctc

SEQ ID NO: 5370503 - DNA, 23 bp, Homo sapiens
atcacagagccactcttcaagta

SEQ ID NO: 5370504 - DNA, 19 bp, Homo sapiens
atcacagatcgcatttcct

SEQ ID NO: 5370505 - DNA, 20 bp, Homo sapiens
atcacagatcgcatttccta

SEQ ID NO: 5370506 - DNA, 16 bp, Homo sapiens
atcacagatgtgccca

SEQ ID NO: 5370507 - DNA, 21 bp, Homo sapiens
atcacagatgtgcccagagta

SEQ ID NO: 5370508 - DNA, 19 bp, Homo sapiens
atcacagattttttcttta

SEQ ID NO: 5370509 - DNA, 15 bp, Homo sapiens
atcacagcacccact

SEQ ID NO: 5370510 - DNA, 14 bp, Homo sapiens
atcacagcagcttc

SEQ ID NO: 5370511 - DNA, 17 bp, Homo sapiens
atcacagccagcccagc

SEQ ID NO: 5370512 - DNA, 20 bp, Homo sapiens
atcacagcccaaaatttgat

SEQ ID NO: 5370513 - DNA, 16 bp, Homo sapiens
atcacagcccagcccg

SEQ ID NO: 5370514 - DNA, 14 bp, Homo sapiens
atcacagcctccag

SEQ ID NO: 5370515 - DNA, 13 bp, Homo sapiens
atcacagcctctg

SEQ ID NO: 5370516 - DNA, 21 bp, Homo sapiens
atcacagcctctgaaaaccaa

SEQ ID NO: 5370517 - DNA, 21 bp, Homo sapiens
atcacagctcactgcagcctc

SEQ ID NO: 5370518 - DNA, 21 bp, Homo sapiens
atcacagcttcagccaggagc

SEQ ID NO: 5370519 - DNA, 14 bp, Homo sapiens
atcacagcttgttt

SEQ ID NO: 5370520 - DNA, 21 bp, Homo sapiens
atcacagcttgttttggactt

SEQ ID NO: 5370521 - DNA, 22 bp, Homo sapiens
atcacaggagcaatcacaggaa

SEQ ID NO: 5370522 - DNA, 19 bp, Homo sapiens
atcacaggatgccagcccc

SEQ ID NO: 5370523 - DNA, 22 bp, Homo sapiens
atcacaggctctgcatacacat

SEQ ID NO: 5370524 - DNA, 15 bp, Homo sapiens
atcacaggctgggct

SEQ ID NO: 5370525 - DNA, 20 bp, Homo sapiens
atcacaggctgggctgggca

SEQ ID NO: 5370526 - DNA, 21 bp, Homo sapiens
atcacaggctgggctgggcac

SEQ ID NO: 5370527 - DNA, 21 bp, Homo sapiens
atcacagggccccagaaggca

SEQ ID NO: 5370528 - DNA, 14 bp, Homo sapiens
atcacagggcctca

SEQ ID NO: 5370529 - DNA, 18 bp, Homo sapiens
atcacagggcctcagttt

SEQ ID NO: 5370530 - DNA, 21 bp, Homo sapiens
atcacagggtgggcctcggcc

SEQ ID NO: 5370531 - DNA, 14 bp, Homo sapiens
atcacagtcaatgg

SEQ ID NO: 5370532 - DNA, 19 bp, Homo sapiens
atcacataaagaaattcaa

SEQ ID NO: 5370533 - DNA, 15 bp, Homo sapiens
atcacataacagaat

SEQ ID NO: 5370534 - DNA, 21 bp, Homo sapiens
atcacatacaatttgcactgt

SEQ ID NO: 5370535 - DNA, 17 bp, Homo sapiens
atcacatctcacctccg

SEQ ID NO: 5370536 - DNA, 15 bp, Homo sapiens
atcacatcttattta

SEQ ID NO: 5370537 - DNA, 17 bp, Homo sapiens
atcacatcttatttatt

SEQ ID NO: 5370538 - DNA, 23 bp, Homo sapiens
atcacatgaaggagacagcagca

SEQ ID NO: 5370539 - DNA, 20 bp, Homo sapiens
atcacatgaattattacagt

SEQ ID NO: 5370540 - DNA, 17 bp, Homo sapiens
atcacatgtatgttttg

SEQ ID NO: 5370541 - DNA, 15 bp, Homo sapiens
atcacatgtgctgca

SEQ ID NO: 5370542 - DNA, 15 bp, Homo sapiens
atcacatgtggactt

SEQ ID NO: 5370543 - DNA, 16 bp, Homo sapiens
atcacattaaagttaa

SEQ ID NO: 5370544 - DNA, 15 bp, Homo sapiens
atcacattaacattt

SEQ ID NO: 5370545 - DNA, 15 bp, Homo sapiens
atcacattatttgca

SEQ ID NO: 5370546 - DNA, 16 bp, Homo sapiens
atcacattatttgcat

SEQ ID NO: 5370547 - DNA, 14 bp, Homo sapiens
atcacatttaaatt

SEQ ID NO: 5370548 - DNA, 12 bp, Homo sapiens
atcacatttctg

SEQ ID NO: 5370549 - DNA, 22 bp, Homo sapiens
atcacattttattaaacacagg

SEQ ID NO: 5370550 - DNA, 19 bp, Homo sapiens
atcaccaacgtctgtgcca

SEQ ID NO: 5370551 - DNA, 20 bp, Homo sapiens
atcaccaacgtctgtgccat

SEQ ID NO: 5370552 - DNA, 23 bp, Homo sapiens
atcaccacaaactgtaatacaat

SEQ ID NO: 5370553 - DNA, 19 bp, Homo sapiens
atcaccacagctgcagcca

SEQ ID NO: 5370554 - DNA, 15 bp, Homo sapiens
atcaccacatctttt

SEQ ID NO: 5370555 - DNA, 15 bp, Homo sapiens
atcaccaccgcctct

SEQ ID NO: 5370556 - DNA, 20 bp, Homo sapiens
atcaccaccgcctctggccg

SEQ ID NO: 5370557 - DNA, 15 bp, Homo sapiens
atcaccacgcagaga

SEQ ID NO: 5370558 - DNA, 12 bp, Homo sapiens
atcaccagagag

SEQ ID NO: 5370559 - DNA, 13 bp, Homo sapiens
atcaccagggcca

SEQ ID NO: 5370560 - DNA, 17 bp, Homo sapiens
atcaccagtctgtaaaa

SEQ ID NO: 5370561 - DNA, 20 bp, Homo sapiens
atcaccagtgcatcacatct

SEQ ID NO: 5370562 - DNA, 21 bp, Homo sapiens
atcaccagtgcatcacatctg

SEQ ID NO: 5370563 - DNA, 22 bp, Homo sapiens
atcaccagtgcatccttcatca

SEQ ID NO: 5370564 - DNA, 22 bp, Homo sapiens
atcaccagtggccttggtcctt

SEQ ID NO: 5370565 - DNA, 19 bp, Homo sapiens
atcaccatagggctgggga

SEQ ID NO: 5370566 - DNA, 19 bp, Homo sapiens
atcaccatgatttaatcca

SEQ ID NO: 5370567 - DNA, 14 bp, Homo sapiens
atcaccatgtaaca

SEQ ID NO: 5370568 - DNA, 18 bp, Homo sapiens
atcaccatgttagcctta

SEQ ID NO: 5370569 - DNA, 14 bp, Homo sapiens
atcaccattatatt

SEQ ID NO: 5370570 - DNA, 22 bp, Homo sapiens
atcacccacaaccctctggaag

SEQ ID NO: 5370571 - DNA, 23 bp, Homo sapiens
atcacccacaaccctctggaagt

SEQ ID NO: 5370572 - DNA, 17 bp, Homo sapiens
atcacccactcctatgt

SEQ ID NO: 5370573 - DNA, 14 bp, Homo sapiens
atcacccaggcctg

SEQ ID NO: 5370574 - DNA, 12 bp, Homo sapiens
atcacccagtcc

SEQ ID NO: 5370575 - DNA, 20 bp, Homo sapiens
atcaccccagcccccacagc

SEQ ID NO: 5370576 - DNA, 14 bp, Homo sapiens
atcaccccagcctc

SEQ ID NO: 5370577 - DNA, 17 bp, Homo sapiens
atcacccccaggacctc

SEQ ID NO: 5370578 - DNA, 21 bp, Homo sapiens
atcaccccctccctacacaca

SEQ ID NO: 5370579 - DNA, 18 bp, Homo sapiens
atcacccctctgcccctg

SEQ ID NO: 5370580 - DNA, 13 bp, Homo sapiens
atcacccctggtg

SEQ ID NO: 5370581 - DNA, 18 bp, Homo sapiens
atcacccctggtggctgc

SEQ ID NO: 5370582 - DNA, 14 bp, Homo sapiens
atcaccccttcccc

SEQ ID NO: 5370583 - DNA, 15 bp, Homo sapiens
atcaccccttcccca

SEQ ID NO: 5370584 - DNA, 21 bp, Homo sapiens
atcaccccttgaagccttttt

SEQ ID NO: 5370585 - DNA, 23 bp, Homo sapiens
atcacccgctaagagggagggag

SEQ ID NO: 5370586 - DNA, 15 bp, Homo sapiens
atcaccctcttcctg

SEQ ID NO: 5370587 - DNA, 15 bp, Homo sapiens
atcaccctgaattca

SEQ ID NO: 5370588 - DNA, 21 bp, Homo sapiens
atcaccctgaattcattgtct

SEQ ID NO: 5370589 - DNA, 21 bp, Homo sapiens
atcaccctgggagtttcctga

SEQ ID NO: 5370590 - DNA, 12 bp, Homo sapiens
atcacccttccc

SEQ ID NO: 5370591 - DNA, 22 bp, Homo sapiens
atcaccgacgcgtctcctgttt

SEQ ID NO: 5370592 - DNA, 16 bp, Homo sapiens
atcaccgactgaaaat

SEQ ID NO: 5370593 - DNA, 18 bp, Homo sapiens
atcaccgggaacgccccc

SEQ ID NO: 5370594 - DNA, 20 bp, Homo sapiens
atcacctaattaatttcagt

SEQ ID NO: 5370595 - DNA, 19 bp, Homo sapiens
atcacctactcacacaggc

SEQ ID NO: 5370596 - DNA, 17 bp, Homo sapiens
atcacctattacatttt

SEQ ID NO: 5370597 - DNA, 14 bp, Homo sapiens
atcacctatttcca

SEQ ID NO: 5370598 - DNA, 14 bp, Homo sapiens
atcacctcagggca

SEQ ID NO: 5370599 - DNA, 13 bp, Homo sapiens
atcacctcccctc

SEQ ID NO: 5370600 - DNA, 16 bp, Homo sapiens
atcacctctactgtct

SEQ ID NO: 5370601 - DNA, 13 bp, Homo sapiens
atcacctctctgt

SEQ ID NO: 5370602 - DNA, 14 bp, Homo sapiens
atcacctctcttca

SEQ ID NO: 5370603 - DNA, 20 bp, Homo sapiens
atcacctctgtaatttttca

SEQ ID NO: 5370604 - DNA, 18 bp, Homo sapiens
atcacctgaaacactgga

SEQ ID NO: 5370605 - DNA, 21 bp, Homo sapiens
atcacctgaaacactggacct

SEQ ID NO: 5370606 - DNA, 18 bp, Homo sapiens
atcacctgaaccccagag

SEQ ID NO: 5370607 - DNA, 21 bp, Homo sapiens
atcacctgaaccccagaggca

SEQ ID NO: 5370608 - DNA, 18 bp, Homo sapiens
atcacctgaattattaat

SEQ ID NO: 5370609 - DNA, 16 bp, Homo sapiens
atcacctgaggtcagg

SEQ ID NO: 5370610 - DNA, 12 bp, Homo sapiens
atcacctgcctg

SEQ ID NO: 5370611 - DNA, 22 bp, Homo sapiens
atcacctgctggggtcctttgt

SEQ ID NO: 5370612 - DNA, 14 bp, Homo sapiens
atcacctggctgag

SEQ ID NO: 5370613 - DNA, 16 bp, Homo sapiens
atcacctggctgagca

SEQ ID NO: 5370614 - DNA, 12 bp, Homo sapiens
atcacctgtctt

SEQ ID NO: 5370615 - DNA, 22 bp, Homo sapiens
atcacctgtcttgcctttttca

SEQ ID NO: 5370616 - DNA, 23 bp, Homo sapiens
atcacctgtcttgcctttttcat

SEQ ID NO: 5370617 - DNA, 20 bp, Homo sapiens
atcaccttagaccaccaagc

SEQ ID NO: 5370618 - DNA, 20 bp, Homo sapiens
atcaccttaggcagggaagt

SEQ ID NO: 5370619 - DNA, 13 bp, Homo sapiens
atcaccttccaaa

SEQ ID NO: 5370620 - DNA, 19 bp, Homo sapiens
atcaccttccaaacaaaag

SEQ ID NO: 5370621 - DNA, 21 bp, Homo sapiens
atcacgacacatttgccttca

SEQ ID NO: 5370622 - DNA, 20 bp, Homo sapiens
atcacgaggtcaggagttca

SEQ ID NO: 5370623 - DNA, 17 bp, Homo sapiens
atcacgccactgcactc

SEQ ID NO: 5370624 - DNA, 23 bp, Homo sapiens
atcacgccattgtactccagcct

SEQ ID NO: 5370625 - DNA, 14 bp, Homo sapiens
atcacgcctggcta

SEQ ID NO: 5370626 - DNA, 17 bp, Homo sapiens
atcacggatcaatagac

SEQ ID NO: 5370627 - DNA, 22 bp, Homo sapiens
atcacggatggtgcatgggctc

SEQ ID NO: 5370628 - DNA, 15 bp, Homo sapiens
atcacggctcactgc

SEQ ID NO: 5370629 - DNA, 22 bp, Homo sapiens
atcacggctcactgcagcctca

SEQ ID NO: 5370630 - DNA, 22 bp, Homo sapiens
atcacggtcgccacctggcatt

SEQ ID NO: 5370631 - DNA, 16 bp, Homo sapiens
atcacggtggtaaaga

SEQ ID NO: 5370632 - DNA, 19 bp, Homo sapiens
atcacggtggtaaagaaag

SEQ ID NO: 5370633 - DNA, 22 bp, Homo sapiens
atcacgtaccccactgggccag

SEQ ID NO: 5370634 - DNA, 15 bp, Homo sapiens
atcacgtctgacaaa

SEQ ID NO: 5370635 - DNA, 20 bp, Homo sapiens
atcacgtctgacaaatgtgt

SEQ ID NO: 5370636 - DNA, 21 bp, Homo sapiens
atcacgttagaggaaaaatat

SEQ ID NO: 5370637 - DNA, 22 bp, Homo sapiens
atcacgttagaggaaaaatatt

SEQ ID NO: 5370638 - DNA, 15 bp, Homo sapiens
atcactaaaagcatg

SEQ ID NO: 5370639 - DNA, 17 bp, Homo sapiens
atcactaaaagcatgaa

SEQ ID NO: 5370640 - DNA, 22 bp, Homo sapiens
atcactaaaccgataatgcatg

SEQ ID NO: 5370641 - DNA, 20 bp, Homo sapiens
atcactaaactttatttgta

SEQ ID NO: 5370642 - DNA, 22 bp, Homo sapiens
atcactaaactttatttgtaaa

SEQ ID NO: 5370643 - DNA, 18 bp, Homo sapiens
atcactaaatatctagtg

SEQ ID NO: 5370644 - DNA, 13 bp, Homo sapiens
atcactaagaaag

SEQ ID NO: 5370645 - DNA, 14 bp, Homo sapiens
atcactaagaaaga

SEQ ID NO: 5370646 - DNA, 18 bp, Homo sapiens
atcactaagaaagaaagg

SEQ ID NO: 5370647 - DNA, 22 bp, Homo sapiens
atcactaagaaagaaaggaaag

SEQ ID NO: 5370648 - DNA, 22 bp, Homo sapiens
atcactaataaagtctgtctgc

SEQ ID NO: 5370649 - DNA, 24 bp, Homo sapiens
atcactaatttggctttcacattt

SEQ ID NO: 5370650 - DNA, 16 bp, Homo sapiens
atcactacaaaaagaa

SEQ ID NO: 5370651 - DNA, 22 bp, Homo sapiens
atcactacctttatagctctca

SEQ ID NO: 5370652 - DNA, 23 bp, Homo sapiens
atcactacctttatagctctcat

SEQ ID NO: 5370653 - DNA, 15 bp, Homo sapiens
atcactagagtgctc

SEQ ID NO: 5370654 - DNA, 14 bp, Homo sapiens
atcactagcctgtc

SEQ ID NO: 5370655 - DNA, 22 bp, Homo sapiens
atcactaggtaacttattagaa

SEQ ID NO: 5370656 - DNA, 19 bp, Homo sapiens
atcactagtcaagaaaaat

SEQ ID NO: 5370657 - DNA, 14 bp, Homo sapiens
atcactagtggcaa

SEQ ID NO: 5370658 - DNA, 23 bp, Homo sapiens
atcagagattattcaacagagag

SEQ ID NO: 5370659 - DNA, 23 bp, Homo sapiens
atcagagcatttattttggggag

SEQ ID NO: 5370660 - DNA, 17 bp, Homo sapiens
atcagagctccagtttg

SEQ ID NO: 5370661 - DNA, 21 bp, Homo sapiens
atcagagctcctctgtcctgc

SEQ ID NO: 5370662 - DNA, 21 bp, Homo sapiens
atcagagctcttaatgttgct

SEQ ID NO: 5370663 - DNA, 18 bp, Homo sapiens
atcagagctgcagccagt

SEQ ID NO: 5370664 - DNA, 20 bp, Homo sapiens
atcagagctggcagcctcca

SEQ ID NO: 5370665 - DNA, 17 bp, Homo sapiens
atcagaggcctataatg

SEQ ID NO: 5370666 - DNA, 22 bp, Homo sapiens
atcagaggtcatcccttcctcc

SEQ ID NO: 5370667 - DNA, 21 bp, Homo sapiens
atcagaggtgtacactaacat

SEQ ID NO: 5370668 - DNA, 20 bp, Homo sapiens
atcagaggtttgcttcctca

SEQ ID NO: 5370669 - DNA, 15 bp, Homo sapiens
atcagagtagaaata

SEQ ID NO: 5370670 - DNA, 23 bp, Homo sapiens
atcagagtagaaataaaagtgaa

SEQ ID NO: 5370671 - DNA, 21 bp, Homo sapiens
atcagagtatctgaagggaat

SEQ ID NO: 5370672 - DNA, 20 bp, Homo sapiens
atcagagtctggcctgccag

SEQ ID NO: 5370673 - DNA, 21 bp, Homo sapiens
atcagagtgcattagaaagat

SEQ ID NO: 5370674 - DNA, 20 bp, Homo sapiens
atcagagtgtatttttgtaa

SEQ ID NO: 5370675 - DNA, 14 bp, Homo sapiens
atcagagttaccat

SEQ ID NO: 5370676 - DNA, 15 bp, Homo sapiens
atcagataagacata

SEQ ID NO: 5370677 - DNA, 12 bp, Homo sapiens
atcagatacatc

SEQ ID NO: 5370678 - DNA, 14 bp, Homo sapiens
atcagatacatcac

SEQ ID NO: 5370679 - DNA, 13 bp, Homo sapiens
atcagatattttc

SEQ ID NO: 5370680 - DNA, 16 bp, Homo sapiens
atcagatattttcata

SEQ ID NO: 5370681 - DNA, 22 bp, Homo sapiens
atcagatattttcatatttaaa

SEQ ID NO: 5370682 - DNA, 12 bp, Homo sapiens
atcagatcaaga

SEQ ID NO: 5370683 - DNA, 18 bp, Homo sapiens
atcagatcatttcaaaac

SEQ ID NO: 5370684 - DNA, 14 bp, Homo sapiens
atcagatctgtctt

SEQ ID NO: 5370685 - DNA, 15 bp, Homo sapiens
atcagatcttctttt

SEQ ID NO: 5370686 - DNA, 16 bp, Homo sapiens
atcagatcttcttttg

SEQ ID NO: 5370687 - DNA, 22 bp, Homo sapiens
atcagatgaactcttagaaatg

SEQ ID NO: 5370688 - DNA, 16 bp, Homo sapiens
atcagatgcctgcttg

SEQ ID NO: 5370689 - DNA, 22 bp, Homo sapiens
atcagatgctccaagattctag

SEQ ID NO: 5370690 - DNA, 15 bp, Homo sapiens
atcagatgtgttcct

SEQ ID NO: 5370691 - DNA, 21 bp, Homo sapiens
atcagatgtgttcctccattt

SEQ ID NO: 5370692 - DNA, 22 bp, Homo sapiens
atcagatgtgttcctccatttt

SEQ ID NO: 5370693 - DNA, 17 bp, Homo sapiens
atcagatgttcccgtgt

SEQ ID NO: 5370694 - DNA, 16 bp, Homo sapiens
atcagatgttgaattc

SEQ ID NO: 5370695 - DNA, 16 bp, Homo sapiens
atcagattcttgctgt

SEQ ID NO: 5370696 - DNA, 21 bp, Homo sapiens
atcagattgacagcatataga

SEQ ID NO: 5370697 - DNA, 14 bp, Homo sapiens
atcagattgcatgt

SEQ ID NO: 5370698 - DNA, 18 bp, Homo sapiens
atcagattgcttttgtgc

SEQ ID NO: 5370699 - DNA, 16 bp, Homo sapiens
atcagatttcttaatg

SEQ ID NO: 5370700 - DNA, 21 bp, Homo sapiens
atcagatttcttaatgtctgt

SEQ ID NO: 5370701 - DNA, 21 bp, Homo sapiens
atcagatttggtgatggaaaa

SEQ ID NO: 5370702 - DNA, 14 bp, Homo sapiens
atcagatttgtaat

SEQ ID NO: 5370703 - DNA, 15 bp, Homo sapiens
atcagattttctcct

SEQ ID NO: 5370704 - DNA, 13 bp, Homo sapiens
atcagcaaaaaag

SEQ ID NO: 5370705 - DNA, 20 bp, Homo sapiens
atcagcaaaaagactggatt

SEQ ID NO: 5370706 - DNA, 18 bp, Homo sapiens
atcagcaaacacaataag

SEQ ID NO: 5370707 - DNA, 13 bp, Homo sapiens
atcagcaaagaat

SEQ ID NO: 5370708 - DNA, 19 bp, Homo sapiens
atcagcaacccttcctgct

SEQ ID NO: 5370709 - DNA, 21 bp, Homo sapiens
atcagcaacttctagcatata

SEQ ID NO: 5370710 - DNA, 23 bp, Homo sapiens
atcagcaacttctagcatataga

SEQ ID NO: 5370711 - DNA, 13 bp, Homo sapiens
atcagcaagactt

SEQ ID NO: 5370712 - DNA, 21 bp, Homo sapiens
atcagcaagtctctttatatg

SEQ ID NO: 5370713 - DNA, 18 bp, Homo sapiens
atcagcaatactcatcag

SEQ ID NO: 5370714 - DNA, 18 bp, Homo sapiens
atcagcaatattgcctgt

SEQ ID NO: 5370715 - DNA, 17 bp, Homo sapiens
atcagcaatttcagaac

SEQ ID NO: 5370716 - DNA, 22 bp, Homo sapiens
atcagcacagctctcctcctcc

SEQ ID NO: 5370717 - DNA, 12 bp, Homo sapiens
atcagcaccatg

SEQ ID NO: 5370718 - DNA, 18 bp, Homo sapiens
atcagcacgatttctgtt

SEQ ID NO: 5370719 - DNA, 20 bp, Homo sapiens
atcagcacgatttctgttta

SEQ ID NO: 5370720 - DNA, 14 bp, Homo sapiens
atcagcactctgta

SEQ ID NO: 5370721 - DNA, 15 bp, Homo sapiens
atcagcactgaaaat

SEQ ID NO: 5370722 - DNA, 14 bp, Homo sapiens
atcagcactgccaa

SEQ ID NO: 5370723 - DNA, 13 bp, Homo sapiens
atcagcactggat

SEQ ID NO: 5370724 - DNA, 16 bp, Homo sapiens
atcagcactggattgt

SEQ ID NO: 5370725 - DNA, 16 bp, Homo sapiens
atcagcactttaacca

SEQ ID NO: 5370726 - DNA, 13 bp, Homo sapiens
atcagcagagaga

SEQ ID NO: 5370727 - DNA, 22 bp, Homo sapiens
atcagcagcaacaactgtcagt

SEQ ID NO: 5370728 - DNA, 19 bp, Homo sapiens
atcagcaggagtaataaat

SEQ ID NO: 5370729 - DNA, 14 bp, Homo sapiens
atcagcagtggcag

SEQ ID NO: 5370730 - DNA, 19 bp, Homo sapiens
atcagcatccaaaagcagg

SEQ ID NO: 5370731 - DNA, 15 bp, Homo sapiens
atcagcatctgacag

SEQ ID NO: 5370732 - DNA, 15 bp, Homo sapiens
atcagcatgaaaatg

SEQ ID NO: 5370733 - DNA, 23 bp, Homo sapiens
atcagcatgacaaaaataacact

SEQ ID NO: 5370734 - DNA, 16 bp, Homo sapiens
atcagcatgttttctg

SEQ ID NO: 5370735 - DNA, 18 bp, Homo sapiens
atcagcattcaaaatagt

SEQ ID NO: 5370736 - DNA, 16 bp, Homo sapiens
atcagcattgtgactt

SEQ ID NO: 5370737 - DNA, 16 bp, Homo sapiens
atcagcattttagaaa

SEQ ID NO: 5370738 - DNA, 16 bp, Homo sapiens
atcagccaagttttat

SEQ ID NO: 5370739 - DNA, 12 bp, Homo sapiens
atcagccaatta

SEQ ID NO: 5370740 - DNA, 15 bp, Homo sapiens
atcagccaattatgt

SEQ ID NO: 5370741 - DNA, 18 bp, Homo sapiens
atcagccaattatgttaa

SEQ ID NO: 5370742 - DNA, 19 bp, Homo sapiens
atcagccaattatgttaaa

SEQ ID NO: 5370743 - DNA, 13 bp, Homo sapiens
atcagccagacat

SEQ ID NO: 5370744 - DNA, 20 bp, Homo sapiens
atcagccagcccatggcccc

SEQ ID NO: 5370745 - DNA, 21 bp, Homo sapiens
atcagccagcccatggccccc

SEQ ID NO: 5370746 - DNA, 23 bp, Homo sapiens
atcagccagcccatggcccccaa

SEQ ID NO: 5370747 - DNA, 15 bp, Homo sapiens
atcagccagccttcc

SEQ ID NO: 5370748 - DNA, 15 bp, Homo sapiens
atcagccattaaaat

SEQ ID NO: 5370749 - DNA, 22 bp, Homo sapiens
atcagccattaaaataaaacaa

SEQ ID NO: 5370750 - DNA, 16 bp, Homo sapiens
atcagccatttttaga

SEQ ID NO: 5370751 - DNA, 17 bp, Homo sapiens
atcagcccagtgcaaac

SEQ ID NO: 5370752 - DNA, 15 bp, Homo sapiens
atcagccccaccctg

SEQ ID NO: 5370753 - DNA, 17 bp, Homo sapiens
atcagccccaccctggc

SEQ ID NO: 5370754 - DNA, 13 bp, Homo sapiens
atcagcccccagc

SEQ ID NO: 5370755 - DNA, 14 bp, Homo sapiens
atcagcccccagcc

SEQ ID NO: 5370756 - DNA, 16 bp, Homo sapiens
atcagcccccagcctt

SEQ ID NO: 5370757 - DNA, 14 bp, Homo sapiens
atcagccccgcctg

SEQ ID NO: 5370758 - DNA, 23 bp, Homo sapiens
atcagccccgcctgtcacaataa

SEQ ID NO: 5370759 - DNA, 13 bp, Homo sapiens
atcagcccctggg

SEQ ID NO: 5370760 - DNA, 19 bp, Homo sapiens
atcagcccggtgtgaggag

SEQ ID NO: 5370761 - DNA, 20 bp, Homo sapiens
atcagcccggtgtgaggagg

SEQ ID NO: 5370762 - DNA, 23 bp, Homo sapiens
atcagccctgcccttcagcatcc

SEQ ID NO: 5370763 - DNA, 20 bp, Homo sapiens
atcagcctcatgactttata

SEQ ID NO: 5370764 - DNA, 22 bp, Homo sapiens
atcagcctgagtctcctgtgcc

SEQ ID NO: 5370765 - DNA, 19 bp, Homo sapiens
atcagcctgctccagctgt

SEQ ID NO: 5370766 - DNA, 14 bp, Homo sapiens
atcagcctgtctct

SEQ ID NO: 5370767 - DNA, 18 bp, Homo sapiens
atcagcctgtctcttcca

SEQ ID NO: 5370768 - DNA, 19 bp, Homo sapiens
atcagccttttatgtattt

SEQ ID NO: 5370769 - DNA, 13 bp, Homo sapiens
atcagccttttca

SEQ ID NO: 5370770 - DNA, 17 bp, Homo sapiens
atcagcgctctgtagct

SEQ ID NO: 5370771 - DNA, 22 bp, Homo sapiens
atcagcgggtctcctcccagcg

SEQ ID NO: 5370772 - DNA, 16 bp, Homo sapiens
atcagcgtagtgtttt

SEQ ID NO: 5370773 - DNA, 13 bp, Homo sapiens
atcagcgtggcct

SEQ ID NO: 5370774 - DNA, 21 bp, Homo sapiens
atcagcgtggccttgttctgt

SEQ ID NO: 5370775 - DNA, 22 bp, Homo sapiens
atcagctatgcaaatcagtctc

SEQ ID NO: 5370776 - DNA, 17 bp, Homo sapiens
atcagctcaaaatttgc

SEQ ID NO: 5370777 - DNA, 19 bp, Homo sapiens
atcagctcccttcccctgc

SEQ ID NO: 5370778 - DNA, 23 bp, Homo sapiens
atcagctcccttcccctgcctgg

SEQ ID NO: 5370779 - DNA, 15 bp, Homo sapiens
atcagctccttttcc

SEQ ID NO: 5370780 - DNA, 15 bp, Homo sapiens
atcagctctcctggc

SEQ ID NO: 5370781 - DNA, 16 bp, Homo sapiens
atcagctctcctggct

SEQ ID NO: 5370782 - DNA, 14 bp, Homo sapiens
atcagctctctgct

SEQ ID NO: 5370783 - DNA, 18 bp, Homo sapiens
atcagctctctgctgggt

SEQ ID NO: 5370784 - DNA, 14 bp, Homo sapiens
atcagctctgcctt

SEQ ID NO: 5370785 - DNA, 14 bp, Homo sapiens
atcagctgaattca

SEQ ID NO: 5370786 - DNA, 17 bp, Homo sapiens
atcagctgctgaaacaa

SEQ ID NO: 5370787 - DNA, 22 bp, Homo sapiens
atcagctgctgaaacaacaaat

SEQ ID NO: 5370788 - DNA, 19 bp, Homo sapiens
atcagctgctttgttacct

SEQ ID NO: 5370789 - DNA, 22 bp, Homo sapiens
atcagctggacatactgctgga

SEQ ID NO: 5370790 - DNA, 22 bp, Homo sapiens
atcagctggtcaaacaaactct

SEQ ID NO: 5370791 - DNA, 19 bp, Homo sapiens
atcagctgttaaccatttg

SEQ ID NO: 5370792 - DNA, 16 bp, Homo sapiens
atcagctgttgcaggc

SEQ ID NO: 5370793 - DNA, 17 bp, Homo sapiens
atcagctgttgcaggca

SEQ ID NO: 5370794 - DNA, 16 bp, Homo sapiens
atcagcttaatttaag

SEQ ID NO: 5370795 - DNA, 22 bp, Homo sapiens
atcagcttgccctgttaaaaga

SEQ ID NO: 5370796 - DNA, 18 bp, Homo sapiens
atcagctttataataaac

SEQ ID NO: 5370797 - DNA, 23 bp, Homo sapiens
atcagctttataataaactgttt

SEQ ID NO: 5370798 - DNA, 23 bp, Homo sapiens
atcagctttccctggctcaggga

SEQ ID NO: 5370799 - DNA, 21 bp, Homo sapiens
atcagctttctaatgttctaa

SEQ ID NO: 5370800 - DNA, 21 bp, Homo sapiens
atcagctttgataattgtgta

SEQ ID NO: 5370801 - DNA, 22 bp, Homo sapiens
atcaggaaaggaagatgtaaga

SEQ ID NO: 5370802 - DNA, 20 bp, Homo sapiens
atcaggaaatatatatgtgt

SEQ ID NO: 5370803 - DNA, 23 bp, Homo sapiens
atcaggaaatatctgtgaaggac

SEQ ID NO: 5370804 - DNA, 23 bp, Homo sapiens
atcaggaacgtttagctgacaaa

SEQ ID NO: 5370805 - DNA, 14 bp, Homo sapiens
atcaggaagactgg

SEQ ID NO: 5370806 - DNA, 23 bp, Homo sapiens
atcaggaaggtaaaaacccagcg

SEQ ID NO: 5370807 - DNA, 21 bp, Homo sapiens
atcaggaattgtcaaatgatg

SEQ ID NO: 5370808 - DNA, 22 bp, Homo sapiens
atcaggagaaaaagcctccagt

SEQ ID NO: 5370809 - DNA, 15 bp, Homo sapiens
atcaggagagcaagg

SEQ ID NO: 5370810 - DNA, 22 bp, Homo sapiens
atcaggagcccccaacacaggc

SEQ ID NO: 5370811 - DNA, 19 bp, Homo sapiens
atcaggagcctgctaagga

SEQ ID NO: 5370812 - DNA, 15 bp, Homo sapiens
atcaggagctgctca

SEQ ID NO: 5370813 - DNA, 20 bp, Homo sapiens
atcaggaggagattaacaca

SEQ ID NO: 5370814 - DNA, 22 bp, Homo sapiens
atcaggaggagattaacacact

SEQ ID NO: 5370815 - DNA, 21 bp, Homo sapiens
atcaggaggggtgttaaaaca

SEQ ID NO: 5370816 - DNA, 22 bp, Homo sapiens
atcaggaggggtgttaaaacat

SEQ ID NO: 5370817 - DNA, 18 bp, Homo sapiens
atcaggagttccagtgct

SEQ ID NO: 5370818 - DNA, 21 bp, Homo sapiens
atcaggatccagtctggaaaa

SEQ ID NO: 5370819 - DNA, 19 bp, Homo sapiens
atcaggatttcctcttgaa

SEQ ID NO: 5370820 - DNA, 13 bp, Homo sapiens
atcaggcaaggag

SEQ ID NO: 5370821 - DNA, 15 bp, Homo sapiens
atcaggcaaggagga

SEQ ID NO: 5370822 - DNA, 16 bp, Homo sapiens
atcaggcaaggaggag

SEQ ID NO: 5370823 - DNA, 14 bp, Homo sapiens
atcaggcacaggtc

SEQ ID NO: 5370824 - DNA, 23 bp, Homo sapiens
atcaggcacccggggccagagac

SEQ ID NO: 5370825 - DNA, 22 bp, Homo sapiens
atcaggcactgcgccacctgct

SEQ ID NO: 5370826 - DNA, 21 bp, Homo sapiens
atcaggcagataactgctgta

SEQ ID NO: 5370827 - DNA, 19 bp, Homo sapiens
atcaggcagttccctgttg

SEQ ID NO: 5370828 - DNA, 14 bp, Homo sapiens
atcaggccaggccc

SEQ ID NO: 5370829 - DNA, 16 bp, Homo sapiens
atcaggccaggccctc

SEQ ID NO: 5370830 - DNA, 13 bp, Homo sapiens
atcaggccattgt

SEQ ID NO: 5370831 - DNA, 13 bp, Homo sapiens
atcaggccccacc

SEQ ID NO: 5370832 - DNA, 16 bp, Homo sapiens
atcaggcctgccagac

SEQ ID NO: 5370833 - DNA, 13 bp, Homo sapiens
atcaggctgaggt

SEQ ID NO: 5370834 - DNA, 19 bp, Homo sapiens
atcatgcaaatgctgtatt

SEQ ID NO: 5370835 - DNA, 13 bp, Homo sapiens
atcatgcaggaac

SEQ ID NO: 5370836 - DNA, 13 bp, Homo sapiens
atcatgcattgtt

SEQ ID NO: 5370837 - DNA, 21 bp, Homo sapiens
atcatgcattgttgaggtggt

SEQ ID NO: 5370838 - DNA, 14 bp, Homo sapiens
atcatgccctgcct

SEQ ID NO: 5370839 - DNA, 12 bp, Homo sapiens
atcatgccctgt

SEQ ID NO: 5370840 - DNA, 17 bp, Homo sapiens
atcatgccgccgcagct

SEQ ID NO: 5370841 - DNA, 19 bp, Homo sapiens
atcatgccgccgcagctgg

SEQ ID NO: 5370842 - DNA, 22 bp, Homo sapiens
atcatgcctacattagtgagat

SEQ ID NO: 5370843 - DNA, 19 bp, Homo sapiens
atcatgcctctgaggccag

SEQ ID NO: 5370844 - DNA, 20 bp, Homo sapiens
atcatgcctctgaggccagc

SEQ ID NO: 5370845 - DNA, 19 bp, Homo sapiens
atcatgccttgataaatat

SEQ ID NO: 5370846 - DNA, 20 bp, Homo sapiens
atcatgccttgataaatata

SEQ ID NO: 5370847 - DNA, 21 bp, Homo sapiens
atcatgccttgataaatatat

SEQ ID NO: 5370848 - DNA, 24 bp, Homo sapiens
atcatgccttgataaatatatatg

SEQ ID NO: 5370849 - DNA, 16 bp, Homo sapiens
atcatgctaaaattct

SEQ ID NO: 5370850 - DNA, 21 bp, Homo sapiens
atcatgctaaaattctataga

SEQ ID NO: 5370851 - DNA, 14 bp, Homo sapiens
atcatgctttaaag

SEQ ID NO: 5370852 - DNA, 14 bp, Homo sapiens
atcatggaagaaaa

SEQ ID NO: 5370853 - DNA, 22 bp, Homo sapiens
atcatggaccaaatgtgccata

SEQ ID NO: 5370854 - DNA, 15 bp, Homo sapiens
atcatggagcaagag

SEQ ID NO: 5370855 - DNA, 14 bp, Homo sapiens
atcatggatcttgg

SEQ ID NO: 5370856 - DNA, 20 bp, Homo sapiens
atcatggattcattacagct

SEQ ID NO: 5370857 - DNA, 15 bp, Homo sapiens
atcatggcctcttga

SEQ ID NO: 5370858 - DNA, 18 bp, Homo sapiens
atcatggctcttagaaac

SEQ ID NO: 5370859 - DNA, 20 bp, Homo sapiens
atcatggctcttagaaactc

SEQ ID NO: 5370860 - DNA, 23 bp, Homo sapiens
atcatggctcttagaaactcagg

SEQ ID NO: 5370861 - DNA, 19 bp, Homo sapiens
atcatgggaaaagaccagg

SEQ ID NO: 5370862 - DNA, 17 bp, Homo sapiens
atcatgggaattttaac

SEQ ID NO: 5370863 - DNA, 20 bp, Homo sapiens
atcatgggaattttaacttt

SEQ ID NO: 5370864 - DNA, 14 bp, Homo sapiens
atcatgggtcaaga

SEQ ID NO: 5370865 - DNA, 22 bp, Homo sapiens
atcatggtagagaatctctccc

SEQ ID NO: 5370866 - DNA, 18 bp, Homo sapiens
atcatggtcaagttccca

SEQ ID NO: 5370867 - DNA, 17 bp, Homo sapiens
atcatggtcagctcaca

SEQ ID NO: 5370868 - DNA, 15 bp, Homo sapiens
atcatggtgaaaagc

SEQ ID NO: 5370869 - DNA, 16 bp, Homo sapiens
atcatggtgtaataag

SEQ ID NO: 5370870 - DNA, 19 bp, Homo sapiens
atcatggtttttgctctac

SEQ ID NO: 5370871 - DNA, 22 bp, Homo sapiens
atcatggtttttgctctacttt

SEQ ID NO: 5370872 - DNA, 17 bp, Homo sapiens
atcatgtaaagaaatgt

SEQ ID NO: 5370873 - DNA, 18 bp, Homo sapiens
atcatgtaaagaaatgtc

SEQ ID NO: 5370874 - DNA, 18 bp, Homo sapiens
atcatgtaaatgattatc

SEQ ID NO: 5370875 - DNA, 15 bp, Homo sapiens
atcatgtaaatgctc

SEQ ID NO: 5370876 - DNA, 16 bp, Homo sapiens
atcatgtaaatgctca

SEQ ID NO: 5370877 - DNA, 16 bp, Homo sapiens
atcatgtaaatgtatt

SEQ ID NO: 5370878 - DNA, 22 bp, Homo sapiens
atcatgtaaatgtattggcaca

SEQ ID NO: 5370879 - DNA, 23 bp, Homo sapiens
atcatgtaatagtggctttcatt

SEQ ID NO: 5370880 - DNA, 15 bp, Homo sapiens
atcatgtacatttga

SEQ ID NO: 5370881 - DNA, 18 bp, Homo sapiens
atcatgtactttttagta

SEQ ID NO: 5370882 - DNA, 11 bp, Homo sapiens
atcatgtatgt

SEQ ID NO: 5370883 - DNA, 16 bp, Homo sapiens
atcatgtatgttatga

SEQ ID NO: 5370884 - DNA, 14 bp, Homo sapiens
atcatgtcagagca

SEQ ID NO: 5370885 - DNA, 22 bp, Homo sapiens
atcatgtccatcccttttcctg

SEQ ID NO: 5370886 - DNA, 16 bp, Homo sapiens
atcatgtcgatcctgg

SEQ ID NO: 5370887 - DNA, 14 bp, Homo sapiens
atcatgtctattgt

SEQ ID NO: 5370888 - DNA, 17 bp, Homo sapiens
atcatgtctattgtcca

SEQ ID NO: 5370889 - DNA, 21 bp, Homo sapiens
atcatgtctattgtccaaagt

SEQ ID NO: 5370890 - DNA, 23 bp, Homo sapiens
atcatgtctgtatccccagtgcc

SEQ ID NO: 5370891 - DNA, 20 bp, Homo sapiens
atcatgtcttgtgcataatt

SEQ ID NO: 5370892 - DNA, 17 bp, Homo sapiens
atcatgtgcatatatct

SEQ ID NO: 5370893 - DNA, 18 bp, Homo sapiens
atcatgtgctcagaagag

SEQ ID NO: 5370894 - DNA, 17 bp, Homo sapiens
atcatgtggccccaccc

SEQ ID NO: 5370895 - DNA, 20 bp, Homo sapiens
atcatgtgtaatcaataaac

SEQ ID NO: 5370896 - DNA, 21 bp, Homo sapiens
atcatgtgtaatcaataaacg

SEQ ID NO: 5370897 - DNA, 16 bp, Homo sapiens
atcatgtgtagagccc

SEQ ID NO: 5370898 - DNA, 19 bp, Homo sapiens
atcatgtgtagatattatg

SEQ ID NO: 5370899 - DNA, 15 bp, Homo sapiens
atcatgttaaattag

SEQ ID NO: 5370900 - DNA, 17 bp, Homo sapiens
atcatgttaaattagaa

SEQ ID NO: 5370901 - DNA, 19 bp, Homo sapiens
atcatgttaatagacagta

SEQ ID NO: 5370902 - DNA, 18 bp, Homo sapiens
atcatgttaatcctagct

SEQ ID NO: 5370903 - DNA, 17 bp, Homo sapiens
atcatgttacttgagaa

SEQ ID NO: 5370904 - DNA, 22 bp, Homo sapiens
atcatgttagtaatacctctaa

SEQ ID NO: 5370905 - DNA, 20 bp, Homo sapiens
atcatgttatgataaaaaat

SEQ ID NO: 5370906 - DNA, 22 bp, Homo sapiens
atcatgttatgataaaaaattt

SEQ ID NO: 5370907 - DNA, 17 bp, Homo sapiens
atcatgttatgatttgt

SEQ ID NO: 5370908 - DNA, 21 bp, Homo sapiens
atcatgttccccctaaacatg

SEQ ID NO: 5370909 - DNA, 23 bp, Homo sapiens
atcatgttctggtggtttgattg

SEQ ID NO: 5370910 - DNA, 15 bp, Homo sapiens
atcatgttgaaacaa

SEQ ID NO: 5370911 - DNA, 16 bp, Homo sapiens
atcatgttgaaacaaa

SEQ ID NO: 5370912 - DNA, 15 bp, Homo sapiens
atcatgtttattttg

SEQ ID NO: 5370913 - DNA, 12 bp, Homo sapiens
atcatgtttctt

SEQ ID NO: 5370914 - DNA, 12 bp, Homo sapiens
atcatgtttgct

SEQ ID NO: 5370915 - DNA, 13 bp, Homo sapiens
atcatgtttgctc

SEQ ID NO: 5370916 - DNA, 14 bp, Homo sapiens
atcatgtttgctct

SEQ ID NO: 5370917 - DNA, 16 bp, Homo sapiens
atcatgtttgctctcc

SEQ ID NO: 5370918 - DNA, 17 bp, Homo sapiens
atcatgttttggtgaaa

SEQ ID NO: 5370919 - DNA, 19 bp, Homo sapiens
atcatgttttggtgaaaat

SEQ ID NO: 5370920 - DNA, 12 bp, Homo sapiens
atcattaaaaat

SEQ ID NO: 5370921 - DNA, 21 bp, Homo sapiens
atcattaaaagaacataagtt

SEQ ID NO: 5370922 - DNA, 13 bp, Homo sapiens
atcattaaaatat

SEQ ID NO: 5370923 - DNA, 16 bp, Homo sapiens
atcattaaaatatatg

SEQ ID NO: 5370924 - DNA, 23 bp, Homo sapiens
atcattaaaatatatgttctgca

SEQ ID NO: 5370925 - DNA, 22 bp, Homo sapiens
atcattaaacatgaatttaatg

SEQ ID NO: 5370926 - DNA, 23 bp, Homo sapiens
atcattaaacatgaatttaatgt

SEQ ID NO: 5370927 - DNA, 13 bp, Homo sapiens
atcattaaaggaa

SEQ ID NO: 5370928 - DNA, 18 bp, Homo sapiens
atcattaaagtgctttca

SEQ ID NO: 5370929 - DNA, 12 bp, Homo sapiens
atcattaaagtt

SEQ ID NO: 5370930 - DNA, 17 bp, Homo sapiens
atcattaaatttttcct

SEQ ID NO: 5370931 - DNA, 16 bp, Homo sapiens
atcattaagtgacttt

SEQ ID NO: 5370932 - DNA, 16 bp, Homo sapiens
atcattaataagtgaa

SEQ ID NO: 5370933 - DNA, 17 bp, Homo sapiens
atcattaatttttaatt

SEQ ID NO: 5370934 - DNA, 19 bp, Homo sapiens
atcattacaattttctgta

SEQ ID NO: 5370935 - DNA, 20 bp, Homo sapiens
atcattacccttccctgcac

SEQ ID NO: 5370936 - DNA, 22 bp, Homo sapiens
atcattacccttccctgcacta

SEQ ID NO: 5370937 - DNA, 23 bp, Homo sapiens
atcattaccttttaccagctttt

SEQ ID NO: 5370938 - DNA, 13 bp, Homo sapiens
atcattactataa

SEQ ID NO: 5370939 - DNA, 16 bp, Homo sapiens
atcattataaacgtga

SEQ ID NO: 5370940 - DNA, 23 bp, Homo sapiens
atcattataaacgtgatgatcag

SEQ ID NO: 5370941 - DNA, 22 bp, Homo sapiens
atcattataactgaaggagaag

SEQ ID NO: 5370942 - DNA, 20 bp, Homo sapiens
atcattatcagcctgtgcca

SEQ ID NO: 5370943 - DNA, 20 bp, Homo sapiens
atcattatctcactttgtaa

SEQ ID NO: 5370944 - DNA, 14 bp, Homo sapiens
atcattatttatgt

SEQ ID NO: 5370945 - DNA, 17 bp, Homo sapiens
atcattatttatgtatt

SEQ ID NO: 5370946 - DNA, 15 bp, Homo sapiens
atcattatttgagac

SEQ ID NO: 5370947 - DNA, 15 bp, Homo sapiens
atcattcaaaacaac

SEQ ID NO: 5370948 - DNA, 18 bp, Homo sapiens
atcattcaatatctgaca

SEQ ID NO: 5370949 - DNA, 21 bp, Homo sapiens
atcattcacttcactgtgctg

SEQ ID NO: 5370950 - DNA, 21 bp, Homo sapiens
atcattcagcaaatgcctttt

SEQ ID NO: 5370951 - DNA, 22 bp, Homo sapiens
atcattcattcttagctcttaa

SEQ ID NO: 5370952 - DNA, 15 bp, Homo sapiens
atcattcatttttgt

SEQ ID NO: 5370953 - DNA, 18 bp, Homo sapiens
atcattccaattctaaat

SEQ ID NO: 5370954 - DNA, 15 bp, Homo sapiens
atcattccagtgcta

SEQ ID NO: 5370955 - DNA, 15 bp, Homo sapiens
atcattccctctcat

SEQ ID NO: 5370956 - DNA, 22 bp, Homo sapiens
atcattccctctcatctcaggt

SEQ ID NO: 5370957 - DNA, 15 bp, Homo sapiens
atcattcctttttat

SEQ ID NO: 5370958 - DNA, 23 bp, Homo sapiens
atcattcctttttatttatatgt

SEQ ID NO: 5370959 - DNA, 13 bp, Homo sapiens
atcattctaaaga

SEQ ID NO: 5370960 - DNA, 17 bp, Homo sapiens
atcattctacagaataa

SEQ ID NO: 5370961 - DNA, 18 bp, Homo sapiens
atcattctacagaataat

SEQ ID NO: 5370962 - DNA, 15 bp, Homo sapiens
atcattctcagtatc

SEQ ID NO: 5370963 - DNA, 21 bp, Homo sapiens
atcattctgggtgtgttctta

SEQ ID NO: 5370964 - DNA, 14 bp, Homo sapiens
atcattcttactaa

SEQ ID NO: 5370965 - DNA, 15 bp, Homo sapiens
atcattcttataaca

SEQ ID NO: 5370966 - DNA, 22 bp, Homo sapiens
atcattcttataacattgtatg

SEQ ID NO: 5370967 - DNA, 14 bp, Homo sapiens
atcattctttcccc

SEQ ID NO: 5370968 - DNA, 22 bp, Homo sapiens
atcattctttcccctcagagct

SEQ ID NO: 5370969 - DNA, 15 bp, Homo sapiens
atcattctttctgct

SEQ ID NO: 5370970 - DNA, 19 bp, Homo sapiens
atcattctttgtatcttaa

SEQ ID NO: 5370971 - DNA, 12 bp, Homo sapiens
atcattctttta

SEQ ID NO: 5370972 - DNA, 13 bp, Homo sapiens
atcattcttttat

SEQ ID NO: 5370973 - DNA, 14 bp, Homo sapiens
atcattgaaatact

SEQ ID NO: 5370974 - DNA, 15 bp, Homo sapiens
atcattgaaatactt

SEQ ID NO: 5370975 - DNA, 16 bp, Homo sapiens
atcattgaaatacttt

SEQ ID NO: 5370976 - DNA, 21 bp, Homo sapiens
atcattgaaatctttttgctt

SEQ ID NO: 5370977 - DNA, 15 bp, Homo sapiens
atcattgaagtatat

SEQ ID NO: 5370978 - DNA, 14 bp, Homo sapiens
atcattgatgatca

SEQ ID NO: 5370979 - DNA, 21 bp, Homo sapiens
atcattgcaaacaactgaaat

SEQ ID NO: 5370980 - DNA, 22 bp, Homo sapiens
atcattgcactctagcctgggc

SEQ ID NO: 5370981 - DNA, 12 bp, Homo sapiens
atcattgcattt

SEQ ID NO: 5370982 - DNA, 18 bp, Homo sapiens
atcattgccatcaccatt

SEQ ID NO: 5370983 - DNA, 13 bp, Homo sapiens
atcattgcctggt

SEQ ID NO: 5370984 - DNA, 17 bp, Homo sapiens
atcattgctcccctgat

SEQ ID NO: 5370985 - DNA, 19 bp, Homo sapiens
atcattggaacaactgata

SEQ ID NO: 5370986 - DNA, 20 bp, Homo sapiens
atcattggtatctgatatct

SEQ ID NO: 5370987 - DNA, 22 bp, Homo sapiens
atcattggtatctgatatctgt

SEQ ID NO: 5370988 - DNA, 15 bp, Homo sapiens
atcattgtacagttt

SEQ ID NO: 5370989 - DNA, 18 bp, Homo sapiens
atcattgtacagtttgtt

SEQ ID NO: 5370990 - DNA, 22 bp, Homo sapiens
atcattgtacatagcatgttta

SEQ ID NO: 5370991 - DNA, 13 bp, Homo sapiens
atcattgtatgtg

SEQ ID NO: 5370992 - DNA, 16 bp, Homo sapiens
atcattgtccagagct

SEQ ID NO: 5370993 - DNA, 23 bp, Homo sapiens
atcattgtccagagctgcttccc

SEQ ID NO: 5370994 - DNA, 15 bp, Homo sapiens
atcattgtgaaatta

SEQ ID NO: 5370995 - DNA, 19 bp, Homo sapiens
atcattgtgaaattattca

SEQ ID NO: 5370996 - DNA, 14 bp, Homo sapiens
atcattgttgcctc

SEQ ID NO: 5370997 - DNA, 19 bp, Homo sapiens
atcattgttggacatttgg

SEQ ID NO: 5370998 - DNA, 23 bp, Homo sapiens
atcattgttggtgttaattgaaa

SEQ ID NO: 5370999 - DNA, 18 bp, Homo sapiens
atcattgttgtgtataat

SEQ ID NO: 5371000 - DNA, 23 bp, Homo sapiens
atcattgtttagatgaggctcag

SEQ ID NO: 5371001 - DNA, 19 bp, Homo sapiens
atcattgtttgtcctttat

SEQ ID NO: 5371002 - DNA, 18 bp, Homo sapiens
atcattgttttgaatatt

SEQ ID NO: 5371003 - DNA, 17 bp, Homo sapiens
atcatttaaaaaaaaag

SEQ ID NO: 5371004 - DNA, 11 bp, Homo sapiens
atcatttaact

SEQ ID NO: 5371005 - DNA, 12 bp, Homo sapiens
atcatttaactg

SEQ ID NO: 5371006 - DNA, 15 bp, Homo sapiens
atcatttaactgaac

SEQ ID NO: 5371007 - DNA, 14 bp, Homo sapiens
atcatttaagaagg

SEQ ID NO: 5371008 - DNA, 13 bp, Homo sapiens
atcatttaataat

SEQ ID NO: 5371009 - DNA, 14 bp, Homo sapiens
atcatttaataata

SEQ ID NO: 5371010 - DNA, 17 bp, Homo sapiens
atcatttaataatatac

SEQ ID NO: 5371011 - DNA, 13 bp, Homo sapiens
atccataaagaag

SEQ ID NO: 5371012 - DNA, 14 bp, Homo sapiens
atccataaagaagc

SEQ ID NO: 5371013 - DNA, 16 bp, Homo sapiens
atccataaagaagcaa

SEQ ID NO: 5371014 - DNA, 23 bp, Homo sapiens
atccataaagacaatcactgcca

SEQ ID NO: 5371015 - DNA, 15 bp, Homo sapiens
atccataactgaaca

SEQ ID NO: 5371016 - DNA, 14 bp, Homo sapiens
atccataatgatgg

SEQ ID NO: 5371017 - DNA, 11 bp, Homo sapiens
atccatacaaa

SEQ ID NO: 5371018 - DNA, 17 bp, Homo sapiens
atccatacagtcaagat

SEQ ID NO: 5371019 - DNA, 16 bp, Homo sapiens
atccataccagctcgc

SEQ ID NO: 5371020 - DNA, 15 bp, Homo sapiens
atccataccccctgc

SEQ ID NO: 5371021 - DNA, 19 bp, Homo sapiens
atccataccccctgcccca

SEQ ID NO: 5371022 - DNA, 21 bp, Homo sapiens
atccataccccctgccccaga

SEQ ID NO: 5371023 - DNA, 21 bp, Homo sapiens
atccatactaacccttttcca

SEQ ID NO: 5371024 - DNA, 22 bp, Homo sapiens
atccatactgtagacactctga

SEQ ID NO: 5371025 - DNA, 14 bp, Homo sapiens
atccatagacacag

SEQ ID NO: 5371026 - DNA, 18 bp, Homo sapiens
atccatagcacaagataa

SEQ ID NO: 5371027 - DNA, 23 bp, Homo sapiens
atccataggactaccgcaggccc

SEQ ID NO: 5371028 - DNA, 16 bp, Homo sapiens
atccatagtagtatga

SEQ ID NO: 5371029 - DNA, 15 bp, Homo sapiens
atccatagtgacttt

SEQ ID NO: 5371030 - DNA, 19 bp, Homo sapiens
atccatagtggacattgtt

SEQ ID NO: 5371031 - DNA, 15 bp, Homo sapiens
atccatattacgttg

SEQ ID NO: 5371032 - DNA, 20 bp, Homo sapiens
atccatattgagtcaaatgg

SEQ ID NO: 5371033 - DNA, 15 bp, Homo sapiens
atccatatttgctaa

SEQ ID NO: 5371034 - DNA, 22 bp, Homo sapiens
atccatcaactaaaacattata

SEQ ID NO: 5371035 - DNA, 13 bp, Homo sapiens
atccatccctaga

SEQ ID NO: 5371036 - DNA, 14 bp, Homo sapiens
atccatccctagaa

SEQ ID NO: 5371037 - DNA, 14 bp, Homo sapiens
atccatccctccat

SEQ ID NO: 5371038 - DNA, 15 bp, Homo sapiens
atccatcctgagcca

SEQ ID NO: 5371039 - DNA, 13 bp, Homo sapiens
atccatcctgcaa

SEQ ID NO: 5371040 - DNA, 14 bp, Homo sapiens
atccatcctgctag

SEQ ID NO: 5371041 - DNA, 13 bp, Homo sapiens
atccatcctgctc

SEQ ID NO: 5371042 - DNA, 23 bp, Homo sapiens
atccatcctgctcttccatttct

SEQ ID NO: 5371043 - DNA, 16 bp, Homo sapiens
atccatcgatttgtat

SEQ ID NO: 5371044 - DNA, 12 bp, Homo sapiens
atccatctcagt

SEQ ID NO: 5371045 - DNA, 22 bp, Homo sapiens
atccatctcagtcactttttcc

SEQ ID NO: 5371046 - DNA, 14 bp, Homo sapiens
atccatctctctct

SEQ ID NO: 5371047 - DNA, 18 bp, Homo sapiens
atccatctctctcttgcc

SEQ ID NO: 5371048 - DNA, 19 bp, Homo sapiens
atccatctgaggcttcatg

SEQ ID NO: 5371049 - DNA, 18 bp, Homo sapiens
atccatcttgagccacag

SEQ ID NO: 5371050 - DNA, 20 bp, Homo sapiens
atccatcttgctttttcccc

SEQ ID NO: 5371051 - DNA, 17 bp, Homo sapiens
atccatgaaaataaacg

SEQ ID NO: 5371052 - DNA, 24 bp, Homo sapiens
atccatgacaggcctgaagatatt

SEQ ID NO: 5371053 - DNA, 20 bp, Homo sapiens
atccatgacctagttttcca

SEQ ID NO: 5371054 - DNA, 22 bp, Homo sapiens
atccatgacctagttttccatg

SEQ ID NO: 5371055 - DNA, 19 bp, Homo sapiens
atccatgagtttgccctgg

SEQ ID NO: 5371056 - DNA, 14 bp, Homo sapiens
atccatgccctccc

SEQ ID NO: 5371057 - DNA, 21 bp, Homo sapiens
atccatgcggccggcctgggg

SEQ ID NO: 5371058 - DNA, 15 bp, Homo sapiens
atccatgcttcactc

SEQ ID NO: 5371059 - DNA, 12 bp, Homo sapiens
atccatggccag

SEQ ID NO: 5371060 - DNA, 21 bp, Homo sapiens
atccatggccagcagcacctg

SEQ ID NO: 5371061 - DNA, 20 bp, Homo sapiens
atccatggggctgattgtat

SEQ ID NO: 5371062 - DNA, 16 bp, Homo sapiens
atccatgggggcaggg

SEQ ID NO: 5371063 - DNA, 13 bp, Homo sapiens
atccatgggggga

SEQ ID NO: 5371064 - DNA, 15 bp, Homo sapiens
atccatggggggaga

SEQ ID NO: 5371065 - DNA, 16 bp, Homo sapiens
atccatgggtctggct

SEQ ID NO: 5371066 - DNA, 17 bp, Homo sapiens
atccatgggtctggcta

SEQ ID NO: 5371067 - DNA, 13 bp, Homo sapiens
atccatgtaactg

SEQ ID NO: 5371068 - DNA, 16 bp, Homo sapiens
atccatgtaataagca

SEQ ID NO: 5371069 - DNA, 12 bp, Homo sapiens
atccatgtaatg

SEQ ID NO: 5371070 - DNA, 12 bp, Homo sapiens
atccatgtactg

SEQ ID NO: 5371071 - DNA, 18 bp, Homo sapiens
atccatgtactgtagttt

SEQ ID NO: 5371072 - DNA, 20 bp, Homo sapiens
atccatgtactgtagttttt

SEQ ID NO: 5371073 - DNA, 21 bp, Homo sapiens
atccatgtactttccctgtgt

SEQ ID NO: 5371074 - DNA, 18 bp, Homo sapiens
atccatgtcctatgtgtg

SEQ ID NO: 5371075 - DNA, 19 bp, Homo sapiens
atccatgtgaccattctgc

SEQ ID NO: 5371076 - DNA, 23 bp, Homo sapiens
atccatgtgaccattctgcctct

SEQ ID NO: 5371077 - DNA, 20 bp, Homo sapiens
atccatgtgattaatgtttt

SEQ ID NO: 5371078 - DNA, 13 bp, Homo sapiens
atccatgtgtccc

SEQ ID NO: 5371079 - DNA, 20 bp, Homo sapiens
atccatgtgtcccccctgtg

SEQ ID NO: 5371080 - DNA, 15 bp, Homo sapiens
atccatgttgctgac

SEQ ID NO: 5371081 - DNA, 22 bp, Homo sapiens
atccattaaaaagttgttcttt

SEQ ID NO: 5371082 - DNA, 13 bp, Homo sapiens
atccattaattaa

SEQ ID NO: 5371083 - DNA, 18 bp, Homo sapiens
atccattacgtgcattta

SEQ ID NO: 5371084 - DNA, 19 bp, Homo sapiens
atccattacgtgcatttaa

SEQ ID NO: 5371085 - DNA, 17 bp, Homo sapiens
atccattaggccagcaa

SEQ ID NO: 5371086 - DNA, 18 bp, Homo sapiens
atccattatcatgtgtaa

SEQ ID NO: 5371087 - DNA, 21 bp, Homo sapiens
atccattcacaagcctcctgt

SEQ ID NO: 5371088 - DNA, 15 bp, Homo sapiens
atccattccagagct

SEQ ID NO: 5371089 - DNA, 15 bp, Homo sapiens
atccattcccaagat

SEQ ID NO: 5371090 - DNA, 16 bp, Homo sapiens
atccattcccaagatg

SEQ ID NO: 5371091 - DNA, 21 bp, Homo sapiens
atccattcccaagatgcctga

SEQ ID NO: 5371092 - DNA, 23 bp, Homo sapiens
atccattcccaagatgcctgatc

SEQ ID NO: 5371093 - DNA, 14 bp, Homo sapiens
atccattcctcagg

SEQ ID NO: 5371094 - DNA, 18 bp, Homo sapiens
atccattcctcagggaca

SEQ ID NO: 5371095 - DNA, 13 bp, Homo sapiens
atccattctttct

SEQ ID NO: 5371096 - DNA, 19 bp, Homo sapiens
atccattgccatcagtgat

SEQ ID NO: 5371097 - DNA, 19 bp, Homo sapiens
atccattgctggcaatgag

SEQ ID NO: 5371098 - DNA, 19 bp, Homo sapiens
atccatttaaaacaagctg

SEQ ID NO: 5371099 - DNA, 21 bp, Homo sapiens
atccatttactgacacttcct

SEQ ID NO: 5371100 - DNA, 22 bp, Homo sapiens
atccatttagcactatttaaaa

SEQ ID NO: 5371101 - DNA, 15 bp, Homo sapiens
atccatttatctttt

SEQ ID NO: 5371102 - DNA, 13 bp, Homo sapiens
atccatttcagga

SEQ ID NO: 5371103 - DNA, 16 bp, Homo sapiens
atccatttcaggactc

SEQ ID NO: 5371104 - DNA, 21 bp, Homo sapiens
atccatttcatctatttctga

SEQ ID NO: 5371105 - DNA, 13 bp, Homo sapiens
atccatttctaat

SEQ ID NO: 5371106 - DNA, 15 bp, Homo sapiens
atccatttctaatta

SEQ ID NO: 5371107 - DNA, 14 bp, Homo sapiens
atccatttcttcat

SEQ ID NO: 5371108 - DNA, 22 bp, Homo sapiens
atccatttcttttactctgtgt

SEQ ID NO: 5371109 - DNA, 15 bp, Homo sapiens
atccatttcttttat

SEQ ID NO: 5371110 - DNA, 21 bp, Homo sapiens
atccatttgaataaaatgaca

SEQ ID NO: 5371111 - DNA, 14 bp, Homo sapiens
atccatttgccttt

SEQ ID NO: 5371112 - DNA, 23 bp, Homo sapiens
atccatttgcgttccatgatgct

SEQ ID NO: 5371113 - DNA, 13 bp, Homo sapiens
atccatttggaaa

SEQ ID NO: 5371114 - DNA, 19 bp, Homo sapiens
atccatttggaaatcttta

SEQ ID NO: 5371115 - DNA, 21 bp, Homo sapiens
atccatttggaaatctttaaa

SEQ ID NO: 5371116 - DNA, 17 bp, Homo sapiens
atccatttggacaaaat

SEQ ID NO: 5371117 - DNA, 20 bp, Homo sapiens
atccatttggacaaaatgga

SEQ ID NO: 5371118 - DNA, 23 bp, Homo sapiens
atccatttggacaaaatggaagg

SEQ ID NO: 5371119 - DNA, 22 bp, Homo sapiens
atccatttgttttcacactgat

SEQ ID NO: 5371120 - DNA, 20 bp, Homo sapiens
atccattttctaaactgttt

SEQ ID NO: 5371121 - DNA, 16 bp, Homo sapiens
atcccaaaccattact

SEQ ID NO: 5371122 - DNA, 18 bp, Homo sapiens
atcccaaaccattactga

SEQ ID NO: 5371123 - DNA, 21 bp, Homo sapiens
atcccaaaccattactgaggg

SEQ ID NO: 5371124 - DNA, 20 bp, Homo sapiens
atcccaaacccttcagtgcc

SEQ ID NO: 5371125 - DNA, 14 bp, Homo sapiens
atcccaaactgtga

SEQ ID NO: 5371126 - DNA, 15 bp, Homo sapiens
atcccaaacttcgga

SEQ ID NO: 5371127 - DNA, 20 bp, Homo sapiens
atcccaaagcaaggagatca

SEQ ID NO: 5371128 - DNA, 17 bp, Homo sapiens
atcccaaaggatgagaa

SEQ ID NO: 5371129 - DNA, 21 bp, Homo sapiens
atcccaaagtgccttctgagc

SEQ ID NO: 5371130 - DNA, 20 bp, Homo sapiens
atcccaacacttttgggagg

SEQ ID NO: 5371131 - DNA, 15 bp, Homo sapiens
atcccaacagccatg

SEQ ID NO: 5371132 - DNA, 15 bp, Homo sapiens
atcccaacattctgc

SEQ ID NO: 5371133 - DNA, 19 bp, Homo sapiens
atcccaacctctttttcct

SEQ ID NO: 5371134 - DNA, 23 bp, Homo sapiens
atcccaactgtctttttttccct

SEQ ID NO: 5371135 - DNA, 19 bp, Homo sapiens
atcccaagacctcatctgc

SEQ ID NO: 5371136 - DNA, 22 bp, Homo sapiens
atcccaagacctcatctgcctg

SEQ ID NO: 5371137 - DNA, 21 bp, Homo sapiens
atcccaagatggagaggaaga

SEQ ID NO: 5371138 - DNA, 22 bp, Homo sapiens
atcccaagatggagaggaagaa

SEQ ID NO: 5371139 - DNA, 23 bp, Homo sapiens
atcccaagatggagaggaagaaa

SEQ ID NO: 5371140 - DNA, 14 bp, Homo sapiens
atcccaagcctcct

SEQ ID NO: 5371141 - DNA, 18 bp, Homo sapiens
atcccaagtcaaacagtg

SEQ ID NO: 5371142 - DNA, 19 bp, Homo sapiens
atcccaagtcaaacagtgt

SEQ ID NO: 5371143 - DNA, 21 bp, Homo sapiens
atcccaagtgtctcttgactg

SEQ ID NO: 5371144 - DNA, 21 bp, Homo sapiens
atcccaagttggaagggaccc

SEQ ID NO: 5371145 - DNA, 16 bp, Homo sapiens
atcccaataaagtcct

SEQ ID NO: 5371146 - DNA, 17 bp, Homo sapiens
atcccaatcattgttgc

SEQ ID NO: 5371147 - DNA, 14 bp, Homo sapiens
atcccaatctttct

SEQ ID NO: 5371148 - DNA, 16 bp, Homo sapiens
atcccaattcatttca

SEQ ID NO: 5371149 - DNA, 12 bp, Homo sapiens
atcccacagccc

SEQ ID NO: 5371150 - DNA, 23 bp, Homo sapiens
atcccacagtggcacggagagaa

SEQ ID NO: 5371151 - DNA, 15 bp, Homo sapiens
atcccaccagccccg

SEQ ID NO: 5371152 - DNA, 24 bp, Homo sapiens
atcccacccccgaccctgccctgg

SEQ ID NO: 5371153 - DNA, 19 bp, Homo sapiens
atcccaccccctcctcccc

SEQ ID NO: 5371154 - DNA, 15 bp, Homo sapiens
atcccacccctccat

SEQ ID NO: 5371155 - DNA, 13 bp, Homo sapiens
atcccaccctggg

SEQ ID NO: 5371156 - DNA, 22 bp, Homo sapiens
atcccaccgacccttcctggcc

SEQ ID NO: 5371157 - DNA, 14 bp, Homo sapiens
atcccacctagccc

SEQ ID NO: 5371158 - DNA, 17 bp, Homo sapiens
atcccacctagcccagg

SEQ ID NO: 5371159 - DNA, 18 bp, Homo sapiens
atcccacctagcccagga

SEQ ID NO: 5371160 - DNA, 13 bp, Homo sapiens
atcccacctccag

SEQ ID NO: 5371161 - DNA, 21 bp, Homo sapiens
atcccacctccagcccacagt

SEQ ID NO: 5371162 - DNA, 22 bp, Homo sapiens
atcccacctccagcccacagtg

SEQ ID NO: 5371163 - DNA, 18 bp, Homo sapiens
atcccacctccatcccag

SEQ ID NO: 5371164 - DNA, 20 bp, Homo sapiens
atcccacctctggataattt

SEQ ID NO: 5371165 - DNA, 17 bp, Homo sapiens
atcccacgcactccatg

SEQ ID NO: 5371166 - DNA, 16 bp, Homo sapiens
atcccacgcttctctt

SEQ ID NO: 5371167 - DNA, 16 bp, Homo sapiens
atcccacgttctgtta

SEQ ID NO: 5371168 - DNA, 19 bp, Homo sapiens
atcccactaatgcaaactg

SEQ ID NO: 5371169 - DNA, 12 bp, Homo sapiens
atcccactccta

SEQ ID NO: 5371170 - DNA, 14 bp, Homo sapiens
atcccactgactgt

SEQ ID NO: 5371171 - DNA, 14 bp, Homo sapiens
atcccactggatct

SEQ ID NO: 5371172 - DNA, 16 bp, Homo sapiens
atcccactggatctgg

SEQ ID NO: 5371173 - DNA, 21 bp, Homo sapiens
atcccactggatctggcttac

SEQ ID NO: 5371174 - DNA, 12 bp, Homo sapiens
atcccactggcg

SEQ ID NO: 5371175 - DNA, 12 bp, Homo sapiens
atcccacttcac

SEQ ID NO: 5371176 - DNA, 17 bp, Homo sapiens
atcccacttcactgtga

SEQ ID NO: 5371177 - DNA, 16 bp, Homo sapiens
atcccacttcctttcc

SEQ ID NO: 5371178 - DNA, 20 bp, Homo sapiens
atcccagacattgatgggga

SEQ ID NO: 5371179 - DNA, 17 bp, Homo sapiens
atcccagacccattcct

SEQ ID NO: 5371180 - DNA, 22 bp, Homo sapiens
atcccagacctgtcgtctctcc

SEQ ID NO: 5371181 - DNA, 14 bp, Homo sapiens
atcccagagaacaa

SEQ ID NO: 5371182 - DNA, 19 bp, Homo sapiens
atcccagagaacaatcact

SEQ ID NO: 5371183 - DNA, 23 bp, Homo sapiens
atcccagagcccagggcatccca

SEQ ID NO: 5371184 - DNA, 19 bp, Homo sapiens
atcccagagcttcccagga

SEQ ID NO: 5371185 - DNA, 23 bp, Homo sapiens
atcccagaggtgggatcctccct

SEQ ID NO: 5371186 - DNA, 15 bp, Homo sapiens
atcccagcacctgcc

SEQ ID NO: 5371187 - DNA, 18 bp, Homo sapiens
atcccagcacctgccagg

SEQ ID NO: 5371188 - DNA, 15 bp, Homo sapiens
atcccgagtctggga

SEQ ID NO: 5371189 - DNA, 16 bp, Homo sapiens
atcccgagtctgggac

SEQ ID NO: 5371190 - DNA, 17 bp, Homo sapiens
atcccgagtctgggaca

SEQ ID NO: 5371191 - DNA, 18 bp, Homo sapiens
atcccgatacctcagccc

SEQ ID NO: 5371192 - DNA, 22 bp, Homo sapiens
atcccgatacctcagccctggc

SEQ ID NO: 5371193 - DNA, 22 bp, Homo sapiens
atcccgcctcttcttcttcaga

SEQ ID NO: 5371194 - DNA, 14 bp, Homo sapiens
atcccgctcctgct

SEQ ID NO: 5371195 - DNA, 17 bp, Homo sapiens
atcccgctcttttccta

SEQ ID NO: 5371196 - DNA, 15 bp, Homo sapiens
atcccgcttagcctg

SEQ ID NO: 5371197 - DNA, 16 bp, Homo sapiens
atcccgcttagcctgc

SEQ ID NO: 5371198 - DNA, 19 bp, Homo sapiens
atcccgcttctgaagctgc

SEQ ID NO: 5371199 - DNA, 16 bp, Homo sapiens
atcccggaggaaatct

SEQ ID NO: 5371200 - DNA, 22 bp, Homo sapiens
atcccggcagcgaggctgggct

SEQ ID NO: 5371201 - DNA, 15 bp, Homo sapiens
atcccggcctcttcc

SEQ ID NO: 5371202 - DNA, 18 bp, Homo sapiens
atcccggcctcttccacc

SEQ ID NO: 5371203 - DNA, 23 bp, Homo sapiens
atcccggcggaaagcctctgtcc

SEQ ID NO: 5371204 - DNA, 17 bp, Homo sapiens
atcccggctccagagca

SEQ ID NO: 5371205 - DNA, 21 bp, Homo sapiens
atcccggctccagagcaggaa

SEQ ID NO: 5371206 - DNA, 15 bp, Homo sapiens
atcccggctgaccct

SEQ ID NO: 5371207 - DNA, 22 bp, Homo sapiens
atcccggctgaccctgtgcccc

SEQ ID NO: 5371208 - DNA, 15 bp, Homo sapiens
atcccggggccatgg

SEQ ID NO: 5371209 - DNA, 22 bp, Homo sapiens
atcccggggccatggaagctgg

SEQ ID NO: 5371210 - DNA, 14 bp, Homo sapiens
atcccgggggtggg

SEQ ID NO: 5371211 - DNA, 18 bp, Homo sapiens
atcccggtttcagaagct

SEQ ID NO: 5371212 - DNA, 23 bp, Homo sapiens
atcccgtaagaccaccttccctt

SEQ ID NO: 5371213 - DNA, 22 bp, Homo sapiens
atcccgtacctcttcccatgac

SEQ ID NO: 5371214 - DNA, 15 bp, Homo sapiens
atcccgtatcacagt

SEQ ID NO: 5371215 - DNA, 20 bp, Homo sapiens
atcccgtgaaagtttttaat

SEQ ID NO: 5371216 - DNA, 19 bp, Homo sapiens
atcccgtgcaaaacatgct

SEQ ID NO: 5371217 - DNA, 18 bp, Homo sapiens
atcccgtgcccctttcct

SEQ ID NO: 5371218 - DNA, 15 bp, Homo sapiens
atccctaagaattcc

SEQ ID NO: 5371219 - DNA, 18 bp, Homo sapiens
atccctaagaattcccag

SEQ ID NO: 5371220 - DNA, 14 bp, Homo sapiens
atccctaatgtttt

SEQ ID NO: 5371221 - DNA, 17 bp, Homo sapiens
atccctaatgttttgct

SEQ ID NO: 5371222 - DNA, 19 bp, Homo sapiens
atccctacagggtgtctgt

SEQ ID NO: 5371223 - DNA, 13 bp, Homo sapiens
atccctacatgta

SEQ ID NO: 5371224 - DNA, 22 bp, Homo sapiens
atccctagaagagcacagagcc

SEQ ID NO: 5371225 - DNA, 14 bp, Homo sapiens
atccctagctgtga

SEQ ID NO: 5371226 - DNA, 21 bp, Homo sapiens
atccctatgaagttgaaaaat

SEQ ID NO: 5371227 - DNA, 14 bp, Homo sapiens
atccctatgctgcc

SEQ ID NO: 5371228 - DNA, 17 bp, Homo sapiens
atccctatgggattcag

SEQ ID NO: 5371229 - DNA, 22 bp, Homo sapiens
atccctatgtttgtctcacttt

SEQ ID NO: 5371230 - DNA, 12 bp, Homo sapiens
atccctcaccca

SEQ ID NO: 5371231 - DNA, 17 bp, Homo sapiens
atccctcagatcccact

SEQ ID NO: 5371232 - DNA, 13 bp, Homo sapiens
atccctcatcctc

SEQ ID NO: 5371233 - DNA, 11 bp, Homo sapiens
atccctcatct

SEQ ID NO: 5371234 - DNA, 16 bp, Homo sapiens
atccctcattcatcca

SEQ ID NO: 5371235 - DNA, 22 bp, Homo sapiens
atccctccaccccagtccccgg

SEQ ID NO: 5371236 - DNA, 20 bp, Homo sapiens
atccctccaccttccgttcc

SEQ ID NO: 5371237 - DNA, 12 bp, Homo sapiens
atccctccatcc

SEQ ID NO: 5371238 - DNA, 17 bp, Homo sapiens
atccctccatccggctc

SEQ ID NO: 5371239 - DNA, 16 bp, Homo sapiens
atccctccccagttca

SEQ ID NO: 5371240 - DNA, 15 bp, Homo sapiens
atccctcccccagca

SEQ ID NO: 5371241 - DNA, 22 bp, Homo sapiens
atccctcccccccatgcactgt

SEQ ID NO: 5371242 - DNA, 17 bp, Homo sapiens
atccctcccctcagcct

SEQ ID NO: 5371243 - DNA, 20 bp, Homo sapiens
atccctcccctcagcctcct

SEQ ID NO: 5371244 - DNA, 14 bp, Homo sapiens
atccctccctccac

SEQ ID NO: 5371245 - DNA, 17 bp, Homo sapiens
atccctccctccacctc

SEQ ID NO: 5371246 - DNA, 20 bp, Homo sapiens
atccctccctccacctccct

SEQ ID NO: 5371247 - DNA, 14 bp, Homo sapiens
atccctcctgagct

SEQ ID NO: 5371248 - DNA, 15 bp, Homo sapiens
atccctcctgagctc

SEQ ID NO: 5371249 - DNA, 17 bp, Homo sapiens
atccctcgatattttta

SEQ ID NO: 5371250 - DNA, 20 bp, Homo sapiens
atccctcgatatttttaaag

SEQ ID NO: 5371251 - DNA, 20 bp, Homo sapiens
atccctcgggaagcagccag

SEQ ID NO: 5371252 - DNA, 17 bp, Homo sapiens
atccctcggtcagcacc

SEQ ID NO: 5371253 - DNA, 21 bp, Homo sapiens
atccctcggtcagcaccgtgg

SEQ ID NO: 5371254 - DNA, 21 bp, Homo sapiens
atccctctacagagcttccct

SEQ ID NO: 5371255 - DNA, 23 bp, Homo sapiens
atccctctacagagcttccctga

SEQ ID NO: 5371256 - DNA, 15 bp, Homo sapiens
atccctctcacccag

SEQ ID NO: 5371257 - DNA, 22 bp, Homo sapiens
atccctctccataaccccaccc

SEQ ID NO: 5371258 - DNA, 15 bp, Homo sapiens
atccctctcctaact

SEQ ID NO: 5371259 - DNA, 14 bp, Homo sapiens
atccctctcttccc

SEQ ID NO: 5371260 - DNA, 15 bp, Homo sapiens
atccctctcttcccc

SEQ ID NO: 5371261 - DNA, 18 bp, Homo sapiens
atccctctcttccccttc

SEQ ID NO: 5371262 - DNA, 22 bp, Homo sapiens
atccctctcttccccttccctt

SEQ ID NO: 5371263 - DNA, 15 bp, Homo sapiens
atccctctgggggct

SEQ ID NO: 5371264 - DNA, 17 bp, Homo sapiens
atccctgaacatagttt

SEQ ID NO: 5371265 - DNA, 17 bp, Homo sapiens
atccctgaaggccccgc

SEQ ID NO: 5371266 - DNA, 18 bp, Homo sapiens
atccctgaggactgattt

SEQ ID NO: 5371267 - DNA, 18 bp, Homo sapiens
atccctgaggctggactc

SEQ ID NO: 5371268 - DNA, 22 bp, Homo sapiens
atccctgataaatattcacact

SEQ ID NO: 5371269 - DNA, 15 bp, Homo sapiens
atccctgatcccttc

SEQ ID NO: 5371270 - DNA, 15 bp, Homo sapiens
atccctgcacacggc

SEQ ID NO: 5371271 - DNA, 17 bp, Homo sapiens
atccctgcacataaact

SEQ ID NO: 5371272 - DNA, 11 bp, Homo sapiens
atccctgccaa

SEQ ID NO: 5371273 - DNA, 17 bp, Homo sapiens
atccctgccaagaactc

SEQ ID NO: 5371274 - DNA, 22 bp, Homo sapiens
atccctgccaagaactctgggc

SEQ ID NO: 5371275 - DNA, 22 bp, Homo sapiens
atccctgccacatacaggtgct

SEQ ID NO: 5371276 - DNA, 20 bp, Homo sapiens
atccctgccactgggctctg

SEQ ID NO: 5371277 - DNA, 15 bp, Homo sapiens
atccctgccagctct

SEQ ID NO: 5371278 - DNA, 12 bp, Homo sapiens
atccctgcccat

SEQ ID NO: 5371279 - DNA, 14 bp, Homo sapiens
atccctgcctggtc

SEQ ID NO: 5371280 - DNA, 13 bp, Homo sapiens
atccctgctcact

SEQ ID NO: 5371281 - DNA, 15 bp, Homo sapiens
atccctgctcactgc

SEQ ID NO: 5371282 - DNA, 20 bp, Homo sapiens
atccctgctcactgcagcct

SEQ ID NO: 5371283 - DNA, 18 bp, Homo sapiens
atccctggagcaggagcc

SEQ ID NO: 5371284 - DNA, 12 bp, Homo sapiens
atccctggccac

SEQ ID NO: 5371285 - DNA, 18 bp, Homo sapiens
atccctggccacctgcca

SEQ ID NO: 5371286 - DNA, 14 bp, Homo sapiens
atccctggccactg

SEQ ID NO: 5371287 - DNA, 12 bp, Homo sapiens
atccctggcccc

SEQ ID NO: 5371288 - DNA, 22 bp, Homo sapiens
atccctggccccctccctggat

SEQ ID NO: 5371289 - DNA, 20 bp, Homo sapiens
atccctggctgacctgctgt

SEQ ID NO: 5371290 - DNA, 21 bp, Homo sapiens
atccctggctgacctgctgtg

SEQ ID NO: 5371291 - DNA, 22 bp, Homo sapiens
atccctggctgacctgctgtgg

SEQ ID NO: 5371292 - DNA, 19 bp, Homo sapiens
atccctggctgggatccac

SEQ ID NO: 5371293 - DNA, 22 bp, Homo sapiens
atccctggcttccccttcagac

SEQ ID NO: 5371294 - DNA, 23 bp, Homo sapiens
atccctggcttccccttcagacc

SEQ ID NO: 5371295 - DNA, 16 bp, Homo sapiens
atccctgggcattgct

SEQ ID NO: 5371296 - DNA, 18 bp, Homo sapiens
atccctgggcattgcttt

SEQ ID NO: 5371297 - DNA, 11 bp, Homo sapiens
atccctgggcc

SEQ ID NO: 5371298 - DNA, 22 bp, Homo sapiens
atccctgggcctgctgctgaga

SEQ ID NO: 5371299 - DNA, 15 bp, Homo sapiens
atccctgggccttgg

SEQ ID NO: 5371300 - DNA, 16 bp, Homo sapiens
atccctggggctgtgc

SEQ ID NO: 5371301 - DNA, 19 bp, Homo sapiens
atccctgggggccttgggt

SEQ ID NO: 5371302 - DNA, 18 bp, Homo sapiens
atccctggtgaaagagta

SEQ ID NO: 5371303 - DNA, 17 bp, Homo sapiens
atccctggttgcctcat

SEQ ID NO: 5371304 - DNA, 13 bp, Homo sapiens
atccctgtcttct

SEQ ID NO: 5371305 - DNA, 12 bp, Homo sapiens
atccctgtgagc

SEQ ID NO: 5371306 - DNA, 13 bp, Homo sapiens
atccctgtgtcca

SEQ ID NO: 5371307 - DNA, 20 bp, Homo sapiens
atccctgtgtgtcgttccct

SEQ ID NO: 5371308 - DNA, 19 bp, Homo sapiens
atccctgttacccagagaa

SEQ ID NO: 5371309 - DNA, 17 bp, Homo sapiens
atccctgttcattgtaa

SEQ ID NO: 5371310 - DNA, 22 bp, Homo sapiens
atccctgtttaatatttaaaca

SEQ ID NO: 5371311 - DNA, 13 bp, Homo sapiens
atcccttaaaatt

SEQ ID NO: 5371312 - DNA, 12 bp, Homo sapiens
atcccttaagaa

SEQ ID NO: 5371313 - DNA, 20 bp, Homo sapiens
atcccttactttaacccttt

SEQ ID NO: 5371314 - DNA, 22 bp, Homo sapiens
atcccttcaaccccacttccta

SEQ ID NO: 5371315 - DNA, 23 bp, Homo sapiens
atcccttcaagagtcctgaagat

SEQ ID NO: 5371316 - DNA, 22 bp, Homo sapiens
atcccttccacctgctctgctg

SEQ ID NO: 5371317 - DNA, 19 bp, Homo sapiens
atcccttcccacatgcctg

SEQ ID NO: 5371318 - DNA, 16 bp, Homo sapiens
atcccttcctccccag

SEQ ID NO: 5371319 - DNA, 13 bp, Homo sapiens
atcccttcctcct

SEQ ID NO: 5371320 - DNA, 15 bp, Homo sapiens
atcccttcctggaaa

SEQ ID NO: 5371321 - DNA, 16 bp, Homo sapiens
atcccttcctggaaac

SEQ ID NO: 5371322 - DNA, 19 bp, Homo sapiens
atcccttcctggaaacagc

SEQ ID NO: 5371323 - DNA, 16 bp, Homo sapiens
atcccttcctgtctga

SEQ ID NO: 5371324 - DNA, 17 bp, Homo sapiens
atcccttcggagccaac

SEQ ID NO: 5371325 - DNA, 18 bp, Homo sapiens
atcccttcggagccaaca

SEQ ID NO: 5371326 - DNA, 13 bp, Homo sapiens
atcccttctcaca

SEQ ID NO: 5371327 - DNA, 16 bp, Homo sapiens
atcccttctcacagca

SEQ ID NO: 5371328 - DNA, 15 bp, Homo sapiens
atcccttctcttcca

SEQ ID NO: 5371329 - DNA, 16 bp, Homo sapiens
atcccttggcccctct

SEQ ID NO: 5371330 - DNA, 15 bp, Homo sapiens
atcccttgtttataa

SEQ ID NO: 5371331 - DNA, 19 bp, Homo sapiens
atcccttgtttataaatag

SEQ ID NO: 5371332 - DNA, 20 bp, Homo sapiens
atccctttacaatgtgaata

SEQ ID NO: 5371333 - DNA, 14 bp, Homo sapiens
atccctttattacc

SEQ ID NO: 5371334 - DNA, 15 bp, Homo sapiens
atccctttctcttct

SEQ ID NO: 5371335 - DNA, 17 bp, Homo sapiens
atccctttctgctagtg

SEQ ID NO: 5371336 - DNA, 15 bp, Homo sapiens
atccctttgcaacgc

SEQ ID NO: 5371337 - DNA, 12 bp, Homo sapiens
atcccttttcct

SEQ ID NO: 5371338 - DNA, 15 bp, Homo sapiens
atcccttttcctgtc

SEQ ID NO: 5371339 - DNA, 20 bp, Homo sapiens
atcccttttcctgtcagtgt

SEQ ID NO: 5371340 - DNA, 18 bp, Homo sapiens
atcccttttcctttctgg

SEQ ID NO: 5371341 - DNA, 20 bp, Homo sapiens
atcccttttcctttctggcc

SEQ ID NO: 5371342 - DNA, 22 bp, Homo sapiens
atcccttttcctttctggcccc

SEQ ID NO: 5371343 - DNA, 15 bp, Homo sapiens
atcccttttcttgac

SEQ ID NO: 5371344 - DNA, 16 bp, Homo sapiens
atccctttttttacat

SEQ ID NO: 5371345 - DNA, 19 bp, Homo sapiens
atccctttttttacatttc

SEQ ID NO: 5371346 - DNA, 20 bp, Homo sapiens
atccctttttttacatttca

SEQ ID NO: 5371347 - DNA, 23 bp, Homo sapiens
atccgaacagttggggctgttca

SEQ ID NO: 5371348 - DNA, 16 bp, Homo sapiens
atccgaacctcctctg

SEQ ID NO: 5371349 - DNA, 19 bp, Homo sapiens
atccgaacctcctctgtga

SEQ ID NO: 5371350 - DNA, 14 bp, Homo sapiens
atccgaatctcttt

SEQ ID NO: 5371351 - DNA, 17 bp, Homo sapiens
atccgactgctttggac

SEQ ID NO: 5371352 - DNA, 12 bp, Homo sapiens
atccgagcccct

SEQ ID NO: 5371353 - DNA, 13 bp, Homo sapiens
atccgaggcaggg

SEQ ID NO: 5371354 - DNA, 16 bp, Homo sapiens
atccgagggcccctct

SEQ ID NO: 5371355 - DNA, 16 bp, Homo sapiens
atccgcaacccatgcc

SEQ ID NO: 5371356 - DNA, 14 bp, Homo sapiens
atccgcagcccagg

SEQ ID NO: 5371357 - DNA, 18 bp, Homo sapiens
atccgcatgtgtctgtat

SEQ ID NO: 5371358 - DNA, 15 bp, Homo sapiens
atccgcccacctcag

SEQ ID NO: 5371359 - DNA, 17 bp, Homo sapiens
atccgcccacctcagcc

SEQ ID NO: 5371360 - DNA, 18 bp, Homo sapiens
atccgcccacctcagcct

SEQ ID NO: 5371361 - DNA, 21 bp, Homo sapiens
atccgcccacctcagcctccc

SEQ ID NO: 5371362 - DNA, 17 bp, Homo sapiens
atccgccctgggctctg

SEQ ID NO: 5371363 - DNA, 18 bp, Homo sapiens
atccgccctgggctctgg

SEQ ID NO: 5371364 - DNA, 18 bp, Homo sapiens
atccgcctacctcagcct

SEQ ID NO: 5371365 - DNA, 18 bp, Homo sapiens
atccgcctctgagccagg

SEQ ID NO: 5371366 - DNA, 23 bp, Homo sapiens
atcctcccttgccccaggccagg

SEQ ID NO: 5371367 - DNA, 23 bp, Homo sapiens
atcctccgccctttttgtcctag

SEQ ID NO: 5371368 - DNA, 18 bp, Homo sapiens
atcctccgcggaggcccc

SEQ ID NO: 5371369 - DNA, 15 bp, Homo sapiens
atcctccgtccagcc

SEQ ID NO: 5371370 - DNA, 16 bp, Homo sapiens
atcctccgtccagccg

SEQ ID NO: 5371371 - DNA, 16 bp, Homo sapiens
atcctcctcagatctt

SEQ ID NO: 5371372 - DNA, 16 bp, Homo sapiens
atcctcctcagccccc

SEQ ID NO: 5371373 - DNA, 17 bp, Homo sapiens
atcctcctcagccccca

SEQ ID NO: 5371374 - DNA, 18 bp, Homo sapiens
atcctcctcagcccccag

SEQ ID NO: 5371375 - DNA, 22 bp, Homo sapiens
atcctcctcagcccccaggcca

SEQ ID NO: 5371376 - DNA, 11 bp, Homo sapiens
atcctcctccc

SEQ ID NO: 5371377 - DNA, 13 bp, Homo sapiens
atcctcctcccca

SEQ ID NO: 5371378 - DNA, 16 bp, Homo sapiens
atcctcctccccagct

SEQ ID NO: 5371379 - DNA, 19 bp, Homo sapiens
atcctcctccccagctctt

SEQ ID NO: 5371380 - DNA, 18 bp, Homo sapiens
atcctcctccttcctagt

SEQ ID NO: 5371381 - DNA, 14 bp, Homo sapiens
atcctcctctccat

SEQ ID NO: 5371382 - DNA, 10 bp, Homo sapiens
atcctcctgc

SEQ ID NO: 5371383 - DNA, 12 bp, Homo sapiens
atcctcctgcct

SEQ ID NO: 5371384 - DNA, 19 bp, Homo sapiens
atcctcctgcctcagcctt

SEQ ID NO: 5371385 - DNA, 20 bp, Homo sapiens
atcctcctgcctcagccttc

SEQ ID NO: 5371386 - DNA, 21 bp, Homo sapiens
atcctcctggaaccttgctgt

SEQ ID NO: 5371387 - DNA, 23 bp, Homo sapiens
atcctcctggaaccttgctgtcc

SEQ ID NO: 5371388 - DNA, 16 bp, Homo sapiens
atcctcctggacccag

SEQ ID NO: 5371389 - DNA, 19 bp, Homo sapiens
atcctcctggacccagcag

SEQ ID NO: 5371390 - DNA, 20 bp, Homo sapiens
atcctcctggtgcccacagc

SEQ ID NO: 5371391 - DNA, 20 bp, Homo sapiens
atcctccttataagcccagc

SEQ ID NO: 5371392 - DNA, 15 bp, Homo sapiens
atcctccttccaggc

SEQ ID NO: 5371393 - DNA, 21 bp, Homo sapiens
atcctccttccaggccccagg

SEQ ID NO: 5371394 - DNA, 16 bp, Homo sapiens
atcctctaaagcagag

SEQ ID NO: 5371395 - DNA, 19 bp, Homo sapiens
atcctctaaagcagaggca

SEQ ID NO: 5371396 - DNA, 12 bp, Homo sapiens
atcctctatttt

SEQ ID NO: 5371397 - DNA, 19 bp, Homo sapiens
atcctctattttgtgatga

SEQ ID NO: 5371398 - DNA, 20 bp, Homo sapiens
atcctctcaaccacctttca

SEQ ID NO: 5371399 - DNA, 16 bp, Homo sapiens
atcctctccaccctcc

SEQ ID NO: 5371400 - DNA, 14 bp, Homo sapiens
atcctctcccccac

SEQ ID NO: 5371401 - DNA, 21 bp, Homo sapiens
atcctctcccccacaagagcc

SEQ ID NO: 5371402 - DNA, 17 bp, Homo sapiens
atcctctccccctcctc

SEQ ID NO: 5371403 - DNA, 21 bp, Homo sapiens
atcctctccccctcctccagg

SEQ ID NO: 5371404 - DNA, 15 bp, Homo sapiens
atcctctcccttctt

SEQ ID NO: 5371405 - DNA, 14 bp, Homo sapiens
atcctctcctttga

SEQ ID NO: 5371406 - DNA, 22 bp, Homo sapiens
atcctctctccaggccccaggt

SEQ ID NO: 5371407 - DNA, 13 bp, Homo sapiens
atcctctctcccc

SEQ ID NO: 5371408 - DNA, 12 bp, Homo sapiens
atcctctctctc

SEQ ID NO: 5371409 - DNA, 14 bp, Homo sapiens
atcctctctctctt

SEQ ID NO: 5371410 - DNA, 17 bp, Homo sapiens
atcctctctctcttcta

SEQ ID NO: 5371411 - DNA, 12 bp, Homo sapiens
atcctctctggg

SEQ ID NO: 5371412 - DNA, 19 bp, Homo sapiens
atcctctctggggctgtgt

SEQ ID NO: 5371413 - DNA, 16 bp, Homo sapiens
atcctctcttcctctt

SEQ ID NO: 5371414 - DNA, 21 bp, Homo sapiens
atcctctgactccactcaaag

SEQ ID NO: 5371415 - DNA, 18 bp, Homo sapiens
atcctctgagtgtgacca

SEQ ID NO: 5371416 - DNA, 23 bp, Homo sapiens
atcctctgatatacaattagaga

SEQ ID NO: 5371417 - DNA, 14 bp, Homo sapiens
atcctctgctggtt

SEQ ID NO: 5371418 - DNA, 10 bp, Homo sapiens
atcctctggc

SEQ ID NO: 5371419 - DNA, 14 bp, Homo sapiens
atcctctggctggc

SEQ ID NO: 5371420 - DNA, 16 bp, Homo sapiens
atcctctgtacagagc

SEQ ID NO: 5371421 - DNA, 18 bp, Homo sapiens
atcctctgtacagagccc

SEQ ID NO: 5371422 - DNA, 15 bp, Homo sapiens
atcctctgttttctc

SEQ ID NO: 5371423 - DNA, 16 bp, Homo sapiens
atcctctgttttctct

SEQ ID NO: 5371424 - DNA, 12 bp, Homo sapiens
atcctcttccat

SEQ ID NO: 5371425 - DNA, 16 bp, Homo sapiens
atcctcttcctctgag

SEQ ID NO: 5371426 - DNA, 17 bp, Homo sapiens
atcctcttcctctgagg

SEQ ID NO: 5371427 - DNA, 13 bp, Homo sapiens
atcctcttctttt

SEQ ID NO: 5371428 - DNA, 18 bp, Homo sapiens
atcctcttcttttagcag

SEQ ID NO: 5371429 - DNA, 21 bp, Homo sapiens
atcctcttgccacatcttgaa

SEQ ID NO: 5371430 - DNA, 23 bp, Homo sapiens
atcctcttgccacatcttgaaaa

SEQ ID NO: 5371431 - DNA, 13 bp, Homo sapiens
atcctctttagag

SEQ ID NO: 5371432 - DNA, 16 bp, Homo sapiens
atcctctttagagtta

SEQ ID NO: 5371433 - DNA, 20 bp, Homo sapiens
atcctctttagagttagact

SEQ ID NO: 5371434 - DNA, 21 bp, Homo sapiens
atcctctttagagttagactg

SEQ ID NO: 5371435 - DNA, 22 bp, Homo sapiens
atcctctttagagttagactgt

SEQ ID NO: 5371436 - DNA, 23 bp, Homo sapiens
atcctctttagagttagactgtt

SEQ ID NO: 5371437 - DNA, 17 bp, Homo sapiens
atcctctttccccactg

SEQ ID NO: 5371438 - DNA, 22 bp, Homo sapiens
atcctctttccccactgaagaa

SEQ ID NO: 5371439 - DNA, 13 bp, Homo sapiens
atcctctttgtaa

SEQ ID NO: 5371440 - DNA, 22 bp, Homo sapiens
atcctcttttaatggcatttct

SEQ ID NO: 5371441 - DNA, 9 bp, Homo sapiens
atcctgaaa

SEQ ID NO: 5371442 - DNA, 13 bp, Homo sapiens
atcctgaaaaaat

SEQ ID NO: 5371443 - DNA, 16 bp, Homo sapiens
atcctgaaaaaatgat

SEQ ID NO: 5371444 - DNA, 16 bp, Homo sapiens
atcctgaaagccagca

SEQ ID NO: 5371445 - DNA, 17 bp, Homo sapiens
atcctgaaagccagcaa

SEQ ID NO: 5371446 - DNA, 16 bp, Homo sapiens
atcctgaaagggcact

SEQ ID NO: 5371447 - DNA, 18 bp, Homo sapiens
atcctgaaatagaggcta

SEQ ID NO: 5371448 - DNA, 17 bp, Homo sapiens
atcctgaaatttcagat

SEQ ID NO: 5371449 - DNA, 14 bp, Homo sapiens
atcctgaacagcat

SEQ ID NO: 5371450 - DNA, 17 bp, Homo sapiens
atcctgaactttctccc

SEQ ID NO: 5371451 - DNA, 17 bp, Homo sapiens
atcctgaagcagttcag

SEQ ID NO: 5371452 - DNA, 20 bp, Homo sapiens
atcctgaagcagttcagaag

SEQ ID NO: 5371453 - DNA, 16 bp, Homo sapiens
atcctgaatctgtgca

SEQ ID NO: 5371454 - DNA, 17 bp, Homo sapiens
atcctgaatctgtgcaa

SEQ ID NO: 5371455 - DNA, 12 bp, Homo sapiens
atcctgacagcg

SEQ ID NO: 5371456 - DNA, 20 bp, Homo sapiens
atcctgacagcgccatgtgt

SEQ ID NO: 5371457 - DNA, 14 bp, Homo sapiens
atcctgactctgcc

SEQ ID NO: 5371458 - DNA, 12 bp, Homo sapiens
atcctgagccaa

SEQ ID NO: 5371459 - DNA, 15 bp, Homo sapiens
atcctgagccagatt

SEQ ID NO: 5371460 - DNA, 16 bp, Homo sapiens
atcctgagccagggaa

SEQ ID NO: 5371461 - DNA, 19 bp, Homo sapiens
atcctgagccagggaacag

SEQ ID NO: 5371462 - DNA, 12 bp, Homo sapiens
atcctgagccat

SEQ ID NO: 5371463 - DNA, 24 bp, Homo sapiens
atcctgagccatcggtgaaactaa

SEQ ID NO: 5371464 - DNA, 12 bp, Homo sapiens
atcctgagccca

SEQ ID NO: 5371465 - DNA, 11 bp, Homo sapiens
atcctgagctc

SEQ ID NO: 5371466 - DNA, 14 bp, Homo sapiens
atcctgagctcaaa

SEQ ID NO: 5371467 - DNA, 13 bp, Homo sapiens
atcctgaggctcc

SEQ ID NO: 5371468 - DNA, 18 bp, Homo sapiens
atcctgaggtgcctccca

SEQ ID NO: 5371469 - DNA, 20 bp, Homo sapiens
atcctgaggtgcctcccagt

SEQ ID NO: 5371470 - DNA, 12 bp, Homo sapiens
atcctgataaac

SEQ ID NO: 5371471 - DNA, 19 bp, Homo sapiens
atcctgataaacattaaac

SEQ ID NO: 5371472 - DNA, 15 bp, Homo sapiens
atcctgatcccagac

SEQ ID NO: 5371473 - DNA, 19 bp, Homo sapiens
atcctgattattgaatgtt

SEQ ID NO: 5371474 - DNA, 18 bp, Homo sapiens
atcctgattcatatttaa

SEQ ID NO: 5371475 - DNA, 14 bp, Homo sapiens
atcctgattccaaa

SEQ ID NO: 5371476 - DNA, 20 bp, Homo sapiens
atcctgattcctctctaagt

SEQ ID NO: 5371477 - DNA, 19 bp, Homo sapiens
atcctgcaaaggcccttgt

SEQ ID NO: 5371478 - DNA, 11 bp, Homo sapiens
atcctgcaagg

SEQ ID NO: 5371479 - DNA, 16 bp, Homo sapiens
atcctgcaagggacag

SEQ ID NO: 5371480 - DNA, 21 bp, Homo sapiens
atcctgcaagggacaggaagg

SEQ ID NO: 5371481 - DNA, 17 bp, Homo sapiens
atcctgcaatgaaaggt

SEQ ID NO: 5371482 - DNA, 16 bp, Homo sapiens
atcctgcaattccact

SEQ ID NO: 5371483 - DNA, 16 bp, Homo sapiens
atcctgcaatttctcc

SEQ ID NO: 5371484 - DNA, 14 bp, Homo sapiens
atcctgcaccctct

SEQ ID NO: 5371485 - DNA, 17 bp, Homo sapiens
atcctgcactgactctg

SEQ ID NO: 5371486 - DNA, 18 bp, Homo sapiens
atcctgcactgactctgg

SEQ ID NO: 5371487 - DNA, 19 bp, Homo sapiens
atcctgcactgactctgga

SEQ ID NO: 5371488 - DNA, 18 bp, Homo sapiens
atcctgcaggaaatataa

SEQ ID NO: 5371489 - DNA, 20 bp, Homo sapiens
atcctgcaggaacgagcact

SEQ ID NO: 5371490 - DNA, 21 bp, Homo sapiens
atcctgcatgggaaaaatgtt

SEQ ID NO: 5371491 - DNA, 17 bp, Homo sapiens
atcctgccagccccaca

SEQ ID NO: 5371492 - DNA, 17 bp, Homo sapiens
atcctgcccaaaatgtg

SEQ ID NO: 5371493 - DNA, 18 bp, Homo sapiens
atcctgcccaaaatgtga

SEQ ID NO: 5371494 - DNA, 19 bp, Homo sapiens
atcctgcccaaaatgtgaa

SEQ ID NO: 5371495 - DNA, 14 bp, Homo sapiens
atcctgcccagtgt

SEQ ID NO: 5371496 - DNA, 15 bp, Homo sapiens
atcctgcccagtgtt

SEQ ID NO: 5371497 - DNA, 22 bp, Homo sapiens
atcctgcccccagccatggtga

SEQ ID NO: 5371498 - DNA, 15 bp, Homo sapiens
atcctgcccccgccc

SEQ ID NO: 5371499 - DNA, 21 bp, Homo sapiens
atcctgcccgagggcagcccc

SEQ ID NO: 5371500 - DNA, 12 bp, Homo sapiens
atcctgccctgc

SEQ ID NO: 5371501 - DNA, 18 bp, Homo sapiens
atcctgccctggaggaag

SEQ ID NO: 5371502 - DNA, 11 bp, Homo sapiens
atcctgccctt

SEQ ID NO: 5371503 - DNA, 12 bp, Homo sapiens
atcctgcctctc

SEQ ID NO: 5371504 - DNA, 14 bp, Homo sapiens
atcctgcctctccc

SEQ ID NO: 5371505 - DNA, 12 bp, Homo sapiens
atcctgcctgcc

SEQ ID NO: 5371506 - DNA, 11 bp, Homo sapiens
atcctgcctgg

SEQ ID NO: 5371507 - DNA, 12 bp, Homo sapiens
atcctgcctggg

SEQ ID NO: 5371508 - DNA, 22 bp, Homo sapiens
atcctgcctgggtgggacagcc

SEQ ID NO: 5371509 - DNA, 18 bp, Homo sapiens
atcctgctagcacctccc

SEQ ID NO: 5371510 - DNA, 18 bp, Homo sapiens
atcctgctagcaggcccc

SEQ ID NO: 5371511 - DNA, 15 bp, Homo sapiens
atcctgctagctgta

SEQ ID NO: 5371512 - DNA, 18 bp, Homo sapiens
atcctgctagctgtagaa

SEQ ID NO: 5371513 - DNA, 17 bp, Homo sapiens
atcctgctccagcagca

SEQ ID NO: 5371514 - DNA, 15 bp, Homo sapiens
atcctgctcttttgt

SEQ ID NO: 5371515 - DNA, 17 bp, Homo sapiens
atcctgctcttttgtga

SEQ ID NO: 5371516 - DNA, 22 bp, Homo sapiens
atcctgctgaaagtcctgcttt

SEQ ID NO: 5371517 - DNA, 15 bp, Homo sapiens
atcctgctgacctca

SEQ ID NO: 5371518 - DNA, 23 bp, Homo sapiens
atcctgctgacctcactgtcctg

SEQ ID NO: 5371519 - DNA, 12 bp, Homo sapiens
atcctgctgccg

SEQ ID NO: 5371520 - DNA, 14 bp, Homo sapiens
atcctgctgctttg

SEQ ID NO: 5371521 - DNA, 13 bp, Homo sapiens
atcctgctgtggc

SEQ ID NO: 5371522 - DNA, 17 bp, Homo sapiens
atcctgctgtggcctca

SEQ ID NO: 5371523 - DNA, 15 bp, Homo sapiens
atcctgctgttctag

SEQ ID NO: 5371524 - DNA, 14 bp, Homo sapiens
atcctgcttcctag

SEQ ID NO: 5371525 - DNA, 21 bp, Homo sapiens
atcctgcttcctaggccccag

SEQ ID NO: 5371526 - DNA, 23 bp, Homo sapiens
atcctgcttcctaggccccagag

SEQ ID NO: 5371527 - DNA, 16 bp, Homo sapiens
atcctgcttcctgaaa

SEQ ID NO: 5371528 - DNA, 15 bp, Homo sapiens
atcctgcttctcttt

SEQ ID NO: 5371529 - DNA, 19 bp, Homo sapiens
atcctgcttctgatatgca

SEQ ID NO: 5371530 - DNA, 13 bp, Homo sapiens
atcctgcttgacc

SEQ ID NO: 5371531 - DNA, 17 bp, Homo sapiens
atcctgctttccctccc

SEQ ID NO: 5371532 - DNA, 13 bp, Homo sapiens
atcctgctttgat

SEQ ID NO: 5371533 - DNA, 15 bp, Homo sapiens
atcctggaaccactg

SEQ ID NO: 5371534 - DNA, 18 bp, Homo sapiens
atcctggaaggacacagt

SEQ ID NO: 5371535 - DNA, 20 bp, Homo sapiens
atcctggaaggacacagtga

SEQ ID NO: 5371536 - DNA, 21 bp, Homo sapiens
atcctggaaggacacagtgat

SEQ ID NO: 5371537 - DNA, 15 bp, Homo sapiens
atcctggaggcccag

SEQ ID NO: 5371538 - DNA, 19 bp, Homo sapiens
atcctggaggcccagttca

SEQ ID NO: 5371539 - DNA, 21 bp, Homo sapiens
atcctggattcctctaagatc

SEQ ID NO: 5371540 - DNA, 16 bp, Homo sapiens
atcctggcaaataata

SEQ ID NO: 5371541 - DNA, 17 bp, Homo sapiens
atcctggcaaataatac

SEQ ID NO: 5371542 - DNA, 17 bp, Homo sapiens
atcctggcaagtgaccc

SEQ ID NO: 5371543 - DNA, 17 bp, Homo sapiens
atcctggcacccggccc

SEQ ID NO: 5371544 - DNA, 22 bp, Homo sapiens
atcctggcacccggcccctgct

SEQ ID NO: 5371545 - DNA, 12 bp, Homo sapiens
atcctggcagcc

SEQ ID NO: 5371546 - DNA, 18 bp, Homo sapiens
atcgtgccgtggagcttg

SEQ ID NO: 5371547 - DNA, 18 bp, Homo sapiens
atcgtgccgttactctcc

SEQ ID NO: 5371548 - DNA, 19 bp, Homo sapiens
atcgtgccgttactctcca

SEQ ID NO: 5371549 - DNA, 12 bp, Homo sapiens
atcgtgctaaat

SEQ ID NO: 5371550 - DNA, 15 bp, Homo sapiens
atcgtgctaaatttt

SEQ ID NO: 5371551 - DNA, 20 bp, Homo sapiens
atcgtgctgggataactggc

SEQ ID NO: 5371552 - DNA, 15 bp, Homo sapiens
atcgtggagaaacaa

SEQ ID NO: 5371553 - DNA, 15 bp, Homo sapiens
atcgtggcacgtatt

SEQ ID NO: 5371554 - DNA, 17 bp, Homo sapiens
atcgtgggcactgctga

SEQ ID NO: 5371555 - DNA, 16 bp, Homo sapiens
atcgtggtatgtgaat

SEQ ID NO: 5371556 - DNA, 20 bp, Homo sapiens
atcgttatctactgactata

SEQ ID NO: 5371557 - DNA, 21 bp, Homo sapiens
atcgttatgtgtgtatatgta

SEQ ID NO: 5371558 - DNA, 16 bp, Homo sapiens
atcgttattataaatg

SEQ ID NO: 5371559 - DNA, 15 bp, Homo sapiens
atcgttccagttccc

SEQ ID NO: 5371560 - DNA, 23 bp, Homo sapiens
atcgttcctatacatttctgttc

SEQ ID NO: 5371561 - DNA, 20 bp, Homo sapiens
atcgttcgcttgttttaaaa

SEQ ID NO: 5371562 - DNA, 14 bp, Homo sapiens
atcgttctctgcct

SEQ ID NO: 5371563 - DNA, 13 bp, Homo sapiens
atcgttctgctgg

SEQ ID NO: 5371564 - DNA, 14 bp, Homo sapiens
atcgttgagacatc

SEQ ID NO: 5371565 - DNA, 21 bp, Homo sapiens
atcgtttaaaaacaaaggaat

SEQ ID NO: 5371566 - DNA, 14 bp, Homo sapiens
atcgtttatttcac

SEQ ID NO: 5371567 - DNA, 20 bp, Homo sapiens
atcgtttctcagaagtactt

SEQ ID NO: 5371568 - DNA, 14 bp, Homo sapiens
atcgttttcttaaa

SEQ ID NO: 5371569 - DNA, 20 bp, Homo sapiens
atcgttttctttgctgtgcc

SEQ ID NO: 5371570 - DNA, 21 bp, Homo sapiens
atcgttttctttgctgtgcca

SEQ ID NO: 5371571 - DNA, 22 bp, Homo sapiens
atcgttttctttgctgtgccaa

SEQ ID NO: 5371572 - DNA, 14 bp, Homo sapiens
atctaaaaaaatgt

SEQ ID NO: 5371573 - DNA, 15 bp, Homo sapiens
atctaaaaaataact

SEQ ID NO: 5371574 - DNA, 23 bp, Homo sapiens
atctaaaaatagacttaaatctc

SEQ ID NO: 5371575 - DNA, 13 bp, Homo sapiens
atctaaaaatata

SEQ ID NO: 5371576 - DNA, 20 bp, Homo sapiens
atctaaaaattttgcatttc

SEQ ID NO: 5371577 - DNA, 20 bp, Homo sapiens
atctaaaacaaaatctgaac

SEQ ID NO: 5371578 - DNA, 16 bp, Homo sapiens
atctaaaaccaaatat

SEQ ID NO: 5371579 - DNA, 19 bp, Homo sapiens
atctaaaagaaatgtctat

SEQ ID NO: 5371580 - DNA, 21 bp, Homo sapiens
atctaaaagaatttaaattct

SEQ ID NO: 5371581 - DNA, 13 bp, Homo sapiens
atctaaaagctgt

SEQ ID NO: 5371582 - DNA, 13 bp, Homo sapiens
atctaaaatgatt

SEQ ID NO: 5371583 - DNA, 13 bp, Homo sapiens
atctaaaatgtgt

SEQ ID NO: 5371584 - DNA, 13 bp, Homo sapiens
atctaaaatgttt

SEQ ID NO: 5371585 - DNA, 21 bp, Homo sapiens
atctaaaatgttttatgacat

SEQ ID NO: 5371586 - DNA, 17 bp, Homo sapiens
atctaaaatttaaaatt

SEQ ID NO: 5371587 - DNA, 22 bp, Homo sapiens
atctaaaatttcataattctga

SEQ ID NO: 5371588 - DNA, 13 bp, Homo sapiens
atctaaaatttgt

SEQ ID NO: 5371589 - DNA, 20 bp, Homo sapiens
atctaaaatttgtaatattt

SEQ ID NO: 5371590 - DNA, 18 bp, Homo sapiens
atctaaaccagaaggaag

SEQ ID NO: 5371591 - DNA, 22 bp, Homo sapiens
atctaaactggattcacagctc

SEQ ID NO: 5371592 - DNA, 16 bp, Homo sapiens
atctaaactttaatat

SEQ ID NO: 5371593 - DNA, 22 bp, Homo sapiens
atctaaactttaatatgtattt

SEQ ID NO: 5371594 - DNA, 18 bp, Homo sapiens
atctaaagccagtggcag

SEQ ID NO: 5371595 - DNA, 19 bp, Homo sapiens
atctaaagccagtggcagt

SEQ ID NO: 5371596 - DNA, 17 bp, Homo sapiens
atctaaagctttatctt

SEQ ID NO: 5371597 - DNA, 19 bp, Homo sapiens
atctaaagctttatctttg

SEQ ID NO: 5371598 - DNA, 21 bp, Homo sapiens
atctaaagctttatctttgtg

SEQ ID NO: 5371599 - DNA, 19 bp, Homo sapiens
atctaaaggatggaaaaat

SEQ ID NO: 5371600 - DNA, 20 bp, Homo sapiens
atctaaagtgtgttgttgct

SEQ ID NO: 5371601 - DNA, 13 bp, Homo sapiens
atctaaagttata

SEQ ID NO: 5371602 - DNA, 17 bp, Homo sapiens
atctaaagttatatttc

SEQ ID NO: 5371603 - DNA, 14 bp, Homo sapiens
atctaaagttttgt

SEQ ID NO: 5371604 - DNA, 16 bp, Homo sapiens
atctaaataaaatgct

SEQ ID NO: 5371605 - DNA, 18 bp, Homo sapiens
atctaaatacctgccctg

SEQ ID NO: 5371606 - DNA, 18 bp, Homo sapiens
atctaaatagtattttgt

SEQ ID NO: 5371607 - DNA, 22 bp, Homo sapiens
atctaaatatggactgctcagg

SEQ ID NO: 5371608 - DNA, 13 bp, Homo sapiens
atctaaatattat

SEQ ID NO: 5371609 - DNA, 14 bp, Homo sapiens
atctaaatattatg

SEQ ID NO: 5371610 - DNA, 13 bp, Homo sapiens
atctaaatctatt

SEQ ID NO: 5371611 - DNA, 16 bp, Homo sapiens
atctaaatctatttat

SEQ ID NO: 5371612 - DNA, 16 bp, Homo sapiens
atctaaatctgtccaa

SEQ ID NO: 5371613 - DNA, 18 bp, Homo sapiens
atctaaatgattatcttg

SEQ ID NO: 5371614 - DNA, 19 bp, Homo sapiens
atctaaatggaaccactct

SEQ ID NO: 5371615 - DNA, 16 bp, Homo sapiens
atctaaattaacttct

SEQ ID NO: 5371616 - DNA, 15 bp, Homo sapiens
atctaaattgaataa

SEQ ID NO: 5371617 - DNA, 16 bp, Homo sapiens
atctaaatttggaact

SEQ ID NO: 5371618 - DNA, 15 bp, Homo sapiens
atctaacaataatat

SEQ ID NO: 5371619 - DNA, 22 bp, Homo sapiens
atctaacaataatatttcaagt

SEQ ID NO: 5371620 - DNA, 16 bp, Homo sapiens
atctaacattattact

SEQ ID NO: 5371621 - DNA, 19 bp, Homo sapiens
atctaacattattactttt

SEQ ID NO: 5371622 - DNA, 14 bp, Homo sapiens
atctaaccacatca

SEQ ID NO: 5371623 - DNA, 18 bp, Homo sapiens
atctaacctcatcttctt

SEQ ID NO: 5371624 - DNA, 20 bp, Homo sapiens
atctaacgtgttccagtgtc

SEQ ID NO: 5371625 - DNA, 22 bp, Homo sapiens
atctaactgatgagtaaactga

SEQ ID NO: 5371626 - DNA, 19 bp, Homo sapiens
atctaactgttgttactgg

SEQ ID NO: 5371627 - DNA, 21 bp, Homo sapiens
atctaactgttgttactggaa

SEQ ID NO: 5371628 - DNA, 21 bp, Homo sapiens
atctaacttcgaatatatctg

SEQ ID NO: 5371629 - DNA, 12 bp, Homo sapiens
atctaagaataa

SEQ ID NO: 5371630 - DNA, 19 bp, Homo sapiens
atctaagaatacagctttc

SEQ ID NO: 5371631 - DNA, 18 bp, Homo sapiens
atctaagcagcatttctg

SEQ ID NO: 5371632 - DNA, 13 bp, Homo sapiens
atctaagcctgaa

SEQ ID NO: 5371633 - DNA, 14 bp, Homo sapiens
atctaagctgcagc

SEQ ID NO: 5371634 - DNA, 15 bp, Homo sapiens
atctaagctgcagct

SEQ ID NO: 5371635 - DNA, 18 bp, Homo sapiens
atctaagctgcagcttcc

SEQ ID NO: 5371636 - DNA, 15 bp, Homo sapiens
atctaaggaaacatt

SEQ ID NO: 5371637 - DNA, 11 bp, Homo sapiens
atctaaggata

SEQ ID NO: 5371638 - DNA, 18 bp, Homo sapiens
atctaaggatgtcacagg

SEQ ID NO: 5371639 - DNA, 13 bp, Homo sapiens
atctaaggcatgc

SEQ ID NO: 5371640 - DNA, 19 bp, Homo sapiens
atctaaggcatgctcccag

SEQ ID NO: 5371641 - DNA, 17 bp, Homo sapiens
atctaaggctgtttgct

SEQ ID NO: 5371642 - DNA, 19 bp, Homo sapiens
atctaaggtccccagcaga

SEQ ID NO: 5371643 - DNA, 23 bp, Homo sapiens
atctaagtcagtttcacatattt

SEQ ID NO: 5371644 - DNA, 14 bp, Homo sapiens
atctaagtgatata

SEQ ID NO: 5371645 - DNA, 17 bp, Homo sapiens
atctaagtgatataaat

SEQ ID NO: 5371646 - DNA, 19 bp, Homo sapiens
atctaagttataagactct

SEQ ID NO: 5371647 - DNA, 15 bp, Homo sapiens
atctaataaacttta

SEQ ID NO: 5371648 - DNA, 15 bp, Homo sapiens
atctaataaatcagt

SEQ ID NO: 5371649 - DNA, 13 bp, Homo sapiens
atctaataatgaa

SEQ ID NO: 5371650 - DNA, 15 bp, Homo sapiens
atctaataattattc

SEQ ID NO: 5371651 - DNA, 15 bp, Homo sapiens
atctaatacctctgt

SEQ ID NO: 5371652 - DNA, 19 bp, Homo sapiens
atctaatacctctgtgtgc

SEQ ID NO: 5371653 - DNA, 17 bp, Homo sapiens
atctaatatatatgaat

SEQ ID NO: 5371654 - DNA, 20 bp, Homo sapiens
atctaatatgtaacaagcca

SEQ ID NO: 5371655 - DNA, 14 bp, Homo sapiens
atctaatattaaaa

SEQ ID NO: 5371656 - DNA, 16 bp, Homo sapiens
atctaatatttctagt

SEQ ID NO: 5371657 - DNA, 19 bp, Homo sapiens
atctaatcaggttgttaat

SEQ ID NO: 5371658 - DNA, 20 bp, Homo sapiens
atctaatcaggttgttaatg

SEQ ID NO: 5371659 - DNA, 22 bp, Homo sapiens
atctaatcccttcaaggaagtg

SEQ ID NO: 5371660 - DNA, 18 bp, Homo sapiens
atctaatcctttaatgat

SEQ ID NO: 5371661 - DNA, 19 bp, Homo sapiens
atctaatgaaaaacaaaaa

SEQ ID NO: 5371662 - DNA, 23 bp, Homo sapiens
atctaatgaaaaacaaaaagcta

SEQ ID NO: 5371663 - DNA, 15 bp, Homo sapiens
atctaattaaatgta

SEQ ID NO: 5371664 - DNA, 14 bp, Homo sapiens
atctaattctttaa

SEQ ID NO: 5371665 - DNA, 15 bp, Homo sapiens
atctaattctttaat

SEQ ID NO: 5371666 - DNA, 13 bp, Homo sapiens
atctaatttataa

SEQ ID NO: 5371667 - DNA, 19 bp, Homo sapiens
atctaatttataaaaaggt

SEQ ID NO: 5371668 - DNA, 23 bp, Homo sapiens
atctaatttataaaaaggtgttt

SEQ ID NO: 5371669 - DNA, 15 bp, Homo sapiens
atctaatttatacaa

SEQ ID NO: 5371670 - DNA, 17 bp, Homo sapiens
atctaatttatacaaaa

SEQ ID NO: 5371671 - DNA, 21 bp, Homo sapiens
atctaatttatacaaaataat

SEQ ID NO: 5371672 - DNA, 12 bp, Homo sapiens
atctacaaactt

SEQ ID NO: 5371673 - DNA, 15 bp, Homo sapiens
atctacaaagaaaaa

SEQ ID NO: 5371674 - DNA, 18 bp, Homo sapiens
atctacaaagaaaaatta

SEQ ID NO: 5371675 - DNA, 12 bp, Homo sapiens
atctacaagcca

SEQ ID NO: 5371676 - DNA, 13 bp, Homo sapiens
atctacaatcagt

SEQ ID NO: 5371677 - DNA, 14 bp, Homo sapiens
atctacaatctctt

SEQ ID NO: 5371678 - DNA, 23 bp, Homo sapiens
atctacaatctctttttgtttgc

SEQ ID NO: 5371679 - DNA, 19 bp, Homo sapiens
atctacacatacagaaaga

SEQ ID NO: 5371680 - DNA, 22 bp, Homo sapiens
atctacacatataaacacagta

SEQ ID NO: 5371681 - DNA, 14 bp, Homo sapiens
atctacacatgttg

SEQ ID NO: 5371682 - DNA, 11 bp, Homo sapiens
atctacaccaa

SEQ ID NO: 5371683 - DNA, 22 bp, Homo sapiens
atctacaccaatgaaaacatgt

SEQ ID NO: 5371684 - DNA, 14 bp, Homo sapiens
atctacactctcga

SEQ ID NO: 5371685 - DNA, 19 bp, Homo sapiens
atctacagaactacatatt

SEQ ID NO: 5371686 - DNA, 20 bp, Homo sapiens
atctacaggcctcagggtgg

SEQ ID NO: 5371687 - DNA, 18 bp, Homo sapiens
atctacagtaatgaaatg

SEQ ID NO: 5371688 - DNA, 23 bp, Homo sapiens
atctacagtaatgaaatgtttac

SEQ ID NO: 5371689 - DNA, 14 bp, Homo sapiens
atctacatcttttt

SEQ ID NO: 5371690 - DNA, 21 bp, Homo sapiens
atctacatcttttttcacaaa

SEQ ID NO: 5371691 - DNA, 12 bp, Homo sapiens
atctacattaaa

SEQ ID NO: 5371692 - DNA, 17 bp, Homo sapiens
atctacattaaaatgac

SEQ ID NO: 5371693 - DNA, 23 bp, Homo sapiens
atctacattaaaatgacaaacat

SEQ ID NO: 5371694 - DNA, 14 bp, Homo sapiens
atctacattataat

SEQ ID NO: 5371695 - DNA, 18 bp, Homo sapiens
atctacatttgtttgtat

SEQ ID NO: 5371696 - DNA, 13 bp, Homo sapiens
atctaccaactgt

SEQ ID NO: 5371697 - DNA, 14 bp, Homo sapiens
atctacccaaagga

SEQ ID NO: 5371698 - DNA, 21 bp, Homo sapiens
atctaccccagactagatgta

SEQ ID NO: 5371699 - DNA, 22 bp, Homo sapiens
atctaccccagactagatgtag

SEQ ID NO: 5371700 - DNA, 22 bp, Homo sapiens
atctaccccagggagaatctga

SEQ ID NO: 5371701 - DNA, 17 bp, Homo sapiens
atctaccccttacttat

SEQ ID NO: 5371702 - DNA, 16 bp, Homo sapiens
atctacctaaaggact

SEQ ID NO: 5371703 - DNA, 20 bp, Homo sapiens
atctacctgcaacacaacat

SEQ ID NO: 5371704 - DNA, 20 bp, Homo sapiens
atctacctgccctctctcag

SEQ ID NO: 5371705 - DNA, 13 bp, Homo sapiens
atctacctggagg

SEQ ID NO: 5371706 - DNA, 18 bp, Homo sapiens
atctacctggagggaaga

SEQ ID NO: 5371707 - DNA, 19 bp, Homo sapiens
atctacctggagggaagag

SEQ ID NO: 5371708 - DNA, 16 bp, Homo sapiens
atctacctgttctgta

SEQ ID NO: 5371709 - DNA, 22 bp, Homo sapiens
atctaccttccagtcaggatga

SEQ ID NO: 5371710 - DNA, 13 bp, Homo sapiens
atctaccttcctt

SEQ ID NO: 5371711 - DNA, 21 bp, Homo sapiens
atctaccttctgtagttttat

SEQ ID NO: 5371712 - DNA, 16 bp, Homo sapiens
atctaccttttctctt

SEQ ID NO: 5371713 - DNA, 20 bp, Homo sapiens
atctacgaagccacaggcct

SEQ ID NO: 5371714 - DNA, 21 bp, Homo sapiens
atctacgaagccacaggcctg

SEQ ID NO: 5371715 - DNA, 16 bp, Homo sapiens
atctacgtctttatta

SEQ ID NO: 5371716 - DNA, 15 bp, Homo sapiens
atctactaattccac

SEQ ID NO: 5371717 - DNA, 19 bp, Homo sapiens
atctactaattccacacct

SEQ ID NO: 5371718 - DNA, 16 bp, Homo sapiens
atctactacagcactg

SEQ ID NO: 5371719 - DNA, 21 bp, Homo sapiens
atctactaccagaagggcttc

SEQ ID NO: 5371720 - DNA, 19 bp, Homo sapiens
atctactagaaccttctaa

SEQ ID NO: 5371721 - DNA, 22 bp, Homo sapiens
atctactagtaataatgtaata

SEQ ID NO: 5371722 - DNA, 16 bp, Homo sapiens
atctactctaaagaaa

SEQ ID NO: 5371723 - DNA, 21 bp, Homo sapiens
atctactctggaccaaggagc

SEQ ID NO: 5371724 - DNA, 16 bp, Homo sapiens
atctccagtgtgccag

SEQ ID NO: 5371725 - DNA, 13 bp, Homo sapiens
atctccatacttt

SEQ ID NO: 5371726 - DNA, 15 bp, Homo sapiens
atctccatactttgg

SEQ ID NO: 5371727 - DNA, 17 bp, Homo sapiens
atctccatactttggat

SEQ ID NO: 5371728 - DNA, 19 bp, Homo sapiens
atctccatccctgaaattt

SEQ ID NO: 5371729 - DNA, 19 bp, Homo sapiens
atctccatccttaactgtc

SEQ ID NO: 5371730 - DNA, 19 bp, Homo sapiens
atctccatgctttgctctc

SEQ ID NO: 5371731 - DNA, 15 bp, Homo sapiens
atctccatggccctg

SEQ ID NO: 5371732 - DNA, 16 bp, Homo sapiens
atctccatggggaggc

SEQ ID NO: 5371733 - DNA, 13 bp, Homo sapiens
atctccattgcat

SEQ ID NO: 5371734 - DNA, 22 bp, Homo sapiens
atctccattgtgcctaagtcca

SEQ ID NO: 5371735 - DNA, 14 bp, Homo sapiens
atctccatttcaaa

SEQ ID NO: 5371736 - DNA, 14 bp, Homo sapiens
atctccatttcaca

SEQ ID NO: 5371737 - DNA, 22 bp, Homo sapiens
atctccatttcacacaggtcct

SEQ ID NO: 5371738 - DNA, 12 bp, Homo sapiens
atctccatttct

SEQ ID NO: 5371739 - DNA, 20 bp, Homo sapiens
atctcccaagctatctaaag

SEQ ID NO: 5371740 - DNA, 13 bp, Homo sapiens
atctcccaaggag

SEQ ID NO: 5371741 - DNA, 21 bp, Homo sapiens
atctcccaaggctgccagaca

SEQ ID NO: 5371742 - DNA, 15 bp, Homo sapiens
atctcccacaagtat

SEQ ID NO: 5371743 - DNA, 17 bp, Homo sapiens
atctcccactgcgggga

SEQ ID NO: 5371744 - DNA, 20 bp, Homo sapiens
atctcccagataatgtgaaa

SEQ ID NO: 5371745 - DNA, 22 bp, Homo sapiens
atctcccagggctctctggacc

SEQ ID NO: 5371746 - DNA, 17 bp, Homo sapiens
atctcccattttggaat

SEQ ID NO: 5371747 - DNA, 13 bp, Homo sapiens
atctccccaggcc

SEQ ID NO: 5371748 - DNA, 18 bp, Homo sapiens
atctccccaggcctccag

SEQ ID NO: 5371749 - DNA, 20 bp, Homo sapiens
atctcccccaacccacctct

SEQ ID NO: 5371750 - DNA, 17 bp, Homo sapiens
atctcccccaccctgtg

SEQ ID NO: 5371751 - DNA, 21 bp, Homo sapiens
atctcccccaccctgtgcccc

SEQ ID NO: 5371752 - DNA, 12 bp, Homo sapiens
atctcccccagc

SEQ ID NO: 5371753 - DNA, 17 bp, Homo sapiens
atctcccccagccccat

SEQ ID NO: 5371754 - DNA, 20 bp, Homo sapiens
atctcccccatcccccactg

SEQ ID NO: 5371755 - DNA, 23 bp, Homo sapiens
atctcccccatcccccactgcca

SEQ ID NO: 5371756 - DNA, 16 bp, Homo sapiens
atctcccctagctcac

SEQ ID NO: 5371757 - DNA, 14 bp, Homo sapiens
atctcccctcagct

SEQ ID NO: 5371758 - DNA, 15 bp, Homo sapiens
atctcccctcagctc

SEQ ID NO: 5371759 - DNA, 15 bp, Homo sapiens
atctcccctttgcta

SEQ ID NO: 5371760 - DNA, 18 bp, Homo sapiens
atctcccgaagtcctctg

SEQ ID NO: 5371761 - DNA, 20 bp, Homo sapiens
atctccctgagatgggcttc

SEQ ID NO: 5371762 - DNA, 15 bp, Homo sapiens
atctccctgccatcc

SEQ ID NO: 5371763 - DNA, 19 bp, Homo sapiens
atctccctgccgcctcaat

SEQ ID NO: 5371764 - DNA, 14 bp, Homo sapiens
atctccctgcctcc

SEQ ID NO: 5371765 - DNA, 16 bp, Homo sapiens
atctccctgcctcctg

SEQ ID NO: 5371766 - DNA, 15 bp, Homo sapiens
atctccctgcctggc

SEQ ID NO: 5371767 - DNA, 19 bp, Homo sapiens
atctccctgcttcatatct

SEQ ID NO: 5371768 - DNA, 15 bp, Homo sapiens
atctccctggctcac

SEQ ID NO: 5371769 - DNA, 21 bp, Homo sapiens
atctccctggctcactggcag

SEQ ID NO: 5371770 - DNA, 14 bp, Homo sapiens
atctccctggtgct

SEQ ID NO: 5371771 - DNA, 18 bp, Homo sapiens
atctcccttagaagagag

SEQ ID NO: 5371772 - DNA, 22 bp, Homo sapiens
atctcccttccacctcacaact

SEQ ID NO: 5371773 - DNA, 21 bp, Homo sapiens
atctcccttttccatgactgt

SEQ ID NO: 5371774 - DNA, 20 bp, Homo sapiens
atctccgtcaactcatattt

SEQ ID NO: 5371775 - DNA, 19 bp, Homo sapiens
atctccgtctcccaaagtg

SEQ ID NO: 5371776 - DNA, 17 bp, Homo sapiens
atctccgttccatctgg

SEQ ID NO: 5371777 - DNA, 16 bp, Homo sapiens
atctcctaacaaaaga

SEQ ID NO: 5371778 - DNA, 20 bp, Homo sapiens
atctcctatcttttatttca

SEQ ID NO: 5371779 - DNA, 18 bp, Homo sapiens
atctcctatttttcagaa

SEQ ID NO: 5371780 - DNA, 21 bp, Homo sapiens
atctcctatttttcagaatgc

SEQ ID NO: 5371781 - DNA, 11 bp, Homo sapiens
atctcctcccg

SEQ ID NO: 5371782 - DNA, 23 bp, Homo sapiens
atctcctctccccaacccttcca

SEQ ID NO: 5371783 - DNA, 15 bp, Homo sapiens
atctcctctgctcat

SEQ ID NO: 5371784 - DNA, 21 bp, Homo sapiens
atctcctctgctcattaaact

SEQ ID NO: 5371785 - DNA, 16 bp, Homo sapiens
atctcctctttgtgaa

SEQ ID NO: 5371786 - DNA, 17 bp, Homo sapiens
atctcctgacagaaggt

SEQ ID NO: 5371787 - DNA, 13 bp, Homo sapiens
atctcctgaccct

SEQ ID NO: 5371788 - DNA, 14 bp, Homo sapiens
atctcctgacctca

SEQ ID NO: 5371789 - DNA, 21 bp, Homo sapiens
atctcctgaggatcagaaagt

SEQ ID NO: 5371790 - DNA, 13 bp, Homo sapiens
atctcctgagtat

SEQ ID NO: 5371791 - DNA, 17 bp, Homo sapiens
atctcctgagttgtata

SEQ ID NO: 5371792 - DNA, 15 bp, Homo sapiens
atctcctgccagccc

SEQ ID NO: 5371793 - DNA, 17 bp, Homo sapiens
atctcctgccttcctcc

SEQ ID NO: 5371794 - DNA, 15 bp, Homo sapiens
atctcctgctcacca

SEQ ID NO: 5371795 - DNA, 22 bp, Homo sapiens
atctcctgctcaccacctgcct

SEQ ID NO: 5371796 - DNA, 12 bp, Homo sapiens
atctcctgctga

SEQ ID NO: 5371797 - DNA, 17 bp, Homo sapiens
atctcctggaacactat

SEQ ID NO: 5371798 - DNA, 13 bp, Homo sapiens
atctcctggtgtt

SEQ ID NO: 5371799 - DNA, 19 bp, Homo sapiens
atctcctggtgttctgcag

SEQ ID NO: 5371800 - DNA, 13 bp, Homo sapiens
atctcctgtattc

SEQ ID NO: 5371801 - DNA, 21 bp, Homo sapiens
atctcctgtccatcagccagg

SEQ ID NO: 5371802 - DNA, 12 bp, Homo sapiens
atctcctgtcta

SEQ ID NO: 5371803 - DNA, 14 bp, Homo sapiens
atctcctgtgcatg

SEQ ID NO: 5371804 - DNA, 15 bp, Homo sapiens
atctcctgtgcatgg

SEQ ID NO: 5371805 - DNA, 15 bp, Homo sapiens
atctcctgtggctca

SEQ ID NO: 5371806 - DNA, 14 bp, Homo sapiens
atctcctgtttgtt

SEQ ID NO: 5371807 - DNA, 16 bp, Homo sapiens
atctccttcccacccc

SEQ ID NO: 5371808 - DNA, 17 bp, Homo sapiens
atctccttcccacccct

SEQ ID NO: 5371809 - DNA, 18 bp, Homo sapiens
atctccttcccccagccc

SEQ ID NO: 5371810 - DNA, 23 bp, Homo sapiens
atctccttcccccagcccaataa

SEQ ID NO: 5371811 - DNA, 13 bp, Homo sapiens
atctccttccctt

SEQ ID NO: 5371812 - DNA, 15 bp, Homo sapiens
atctccttgggctgg

SEQ ID NO: 5371813 - DNA, 15 bp, Homo sapiens
atctccttgtggcct

SEQ ID NO: 5371814 - DNA, 16 bp, Homo sapiens
atctccttgtggccta

SEQ ID NO: 5371815 - DNA, 20 bp, Homo sapiens
atctcctttgaagaaggcaa

SEQ ID NO: 5371816 - DNA, 12 bp, Homo sapiens
atctcctttgct

SEQ ID NO: 5371817 - DNA, 13 bp, Homo sapiens
atctcctttgcta

SEQ ID NO: 5371818 - DNA, 17 bp, Homo sapiens
atctccttttatctggt

SEQ ID NO: 5371819 - DNA, 18 bp, Homo sapiens
atctccttttatgctcac

SEQ ID NO: 5371820 - DNA, 22 bp, Homo sapiens
atctccttttgcgcttatttgg

SEQ ID NO: 5371821 - DNA, 14 bp, Homo sapiens
atctcgactccccc

SEQ ID NO: 5371822 - DNA, 15 bp, Homo sapiens
atctcgagccccctg

SEQ ID NO: 5371823 - DNA, 22 bp, Homo sapiens
atctcgcagtgtttctgtgaat

SEQ ID NO: 5371824 - DNA, 17 bp, Homo sapiens
atctcgctccctcccag

SEQ ID NO: 5371825 - DNA, 19 bp, Homo sapiens
atctcggagcatcccggag

SEQ ID NO: 5371826 - DNA, 12 bp, Homo sapiens
atctcggctcac

SEQ ID NO: 5371827 - DNA, 19 bp, Homo sapiens
atctcggctcactgcaacc

SEQ ID NO: 5371828 - DNA, 19 bp, Homo sapiens
atctcggctcactgcaatc

SEQ ID NO: 5371829 - DNA, 17 bp, Homo sapiens
atctcgtaatagcttct

SEQ ID NO: 5371830 - DNA, 23 bp, Homo sapiens
atctcgtaatagcttctgtgtgt

SEQ ID NO: 5371831 - DNA, 18 bp, Homo sapiens
atctcgtatggatttcta

SEQ ID NO: 5371832 - DNA, 13 bp, Homo sapiens
atctcgtttcaaa

SEQ ID NO: 5371833 - DNA, 17 bp, Homo sapiens
atctcgtttcaaaaaca

SEQ ID NO: 5371834 - DNA, 21 bp, Homo sapiens
atctctaaaatgctgttctca

SEQ ID NO: 5371835 - DNA, 23 bp, Homo sapiens
atctctaaaatgctgttctcaat

SEQ ID NO: 5371836 - DNA, 21 bp, Homo sapiens
atctctaaaattctagtctct

SEQ ID NO: 5371837 - DNA, 15 bp, Homo sapiens
atctctaaactgctg

SEQ ID NO: 5371838 - DNA, 16 bp, Homo sapiens
atctctaaactgctgt

SEQ ID NO: 5371839 - DNA, 15 bp, Homo sapiens
atctctaatgagcta

SEQ ID NO: 5371840 - DNA, 21 bp, Homo sapiens
atctctaattagtctatcaaa

SEQ ID NO: 5371841 - DNA, 14 bp, Homo sapiens
atctctaccccttt

SEQ ID NO: 5371842 - DNA, 16 bp, Homo sapiens
atctctacccctttct

SEQ ID NO: 5371843 - DNA, 15 bp, Homo sapiens
atctctagaatttta

SEQ ID NO: 5371844 - DNA, 18 bp, Homo sapiens
atctctagaattttaagt

SEQ ID NO: 5371845 - DNA, 14 bp, Homo sapiens
atctctaggaagtc

SEQ ID NO: 5371846 - DNA, 21 bp, Homo sapiens
atctctaggatgtcgtctttg

SEQ ID NO: 5371847 - DNA, 15 bp, Homo sapiens
atctctagtccctgt

SEQ ID NO: 5371848 - DNA, 21 bp, Homo sapiens
atctctagtgtagctgccaca

SEQ ID NO: 5371849 - DNA, 17 bp, Homo sapiens
atctctataacagatcc

SEQ ID NO: 5371850 - DNA, 19 bp, Homo sapiens
atctctatcgattgtgtag

SEQ ID NO: 5371851 - DNA, 17 bp, Homo sapiens
atctctattatatcttg

SEQ ID NO: 5371852 - DNA, 17 bp, Homo sapiens
atctctatttaatattt

SEQ ID NO: 5371853 - DNA, 18 bp, Homo sapiens
atctctatttaatattta

SEQ ID NO: 5371854 - DNA, 16 bp, Homo sapiens
atctctatttgagaag

SEQ ID NO: 5371855 - DNA, 18 bp, Homo sapiens
atctctatttgagaagtt

SEQ ID NO: 5371856 - DNA, 19 bp, Homo sapiens
atctctcaaaatgtgccgt

SEQ ID NO: 5371857 - DNA, 16 bp, Homo sapiens
atctctcaaatctgtt

SEQ ID NO: 5371858 - DNA, 19 bp, Homo sapiens
atctctcaaatctgttatc

SEQ ID NO: 5371859 - DNA, 17 bp, Homo sapiens
atctctcacccagttca

SEQ ID NO: 5371860 - DNA, 16 bp, Homo sapiens
atctctcagagccctc

SEQ ID NO: 5371861 - DNA, 17 bp, Homo sapiens
atctctcagagccctca

SEQ ID NO: 5371862 - DNA, 19 bp, Homo sapiens
atctctcaggaatcatctc

SEQ ID NO: 5371863 - DNA, 14 bp, Homo sapiens
atctctcaggagca

SEQ ID NO: 5371864 - DNA, 16 bp, Homo sapiens
atctctcaggagcaca

SEQ ID NO: 5371865 - DNA, 23 bp, Homo sapiens
atctctcatattcgctagtgttt

SEQ ID NO: 5371866 - DNA, 12 bp, Homo sapiens
atctctcatcct

SEQ ID NO: 5371867 - DNA, 18 bp, Homo sapiens
atctctccaccttccaaa

SEQ ID NO: 5371868 - DNA, 19 bp, Homo sapiens
atctctccaccttccaaag

SEQ ID NO: 5371869 - DNA, 17 bp, Homo sapiens
atctctccactttcagc

SEQ ID NO: 5371870 - DNA, 18 bp, Homo sapiens
atctctccactttcagct

SEQ ID NO: 5371871 - DNA, 19 bp, Homo sapiens
atctctccactttcagctg

SEQ ID NO: 5371872 - DNA, 16 bp, Homo sapiens
atctctcccacttcct

SEQ ID NO: 5371873 - DNA, 17 bp, Homo sapiens
atctctcccacttcctc

SEQ ID NO: 5371874 - DNA, 15 bp, Homo sapiens
atctctccctcccct

SEQ ID NO: 5371875 - DNA, 23 bp, Homo sapiens
atctctccctcccctgccatttt

SEQ ID NO: 5371876 - DNA, 22 bp, Homo sapiens
atctctcctggcctatccgctg

SEQ ID NO: 5371877 - DNA, 20 bp, Homo sapiens
atctctctacctccaccctg

SEQ ID NO: 5371878 - DNA, 22 bp, Homo sapiens
atctctctactcctacctcagc

SEQ ID NO: 5371879 - DNA, 15 bp, Homo sapiens
atctctctctgtgtc

SEQ ID NO: 5371880 - DNA, 15 bp, Homo sapiens
atctctctctgttgt

SEQ ID NO: 5371881 - DNA, 16 bp, Homo sapiens
atctctctgcagctgc

SEQ ID NO: 5371882 - DNA, 18 bp, Homo sapiens
atctctctgcagctgccg

SEQ ID NO: 5371883 - DNA, 22 bp, Homo sapiens
atctctctgcctatttattggg

SEQ ID NO: 5371884 - DNA, 12 bp, Homo sapiens
atctctctggcc

SEQ ID NO: 5371885 - DNA, 16 bp, Homo sapiens
atctctctggggccct

SEQ ID NO: 5371886 - DNA, 18 bp, Homo sapiens
atctctctgtgctgtgga

SEQ ID NO: 5371887 - DNA, 12 bp, Homo sapiens
atctctcttcca

SEQ ID NO: 5371888 - DNA, 18 bp, Homo sapiens
atctctcttgggccaagc

SEQ ID NO: 5371889 - DNA, 18 bp, Homo sapiens
atctctcttgtcctcttc

SEQ ID NO: 5371890 - DNA, 20 bp, Homo sapiens
atctctcttgtcctcttctg

SEQ ID NO: 5371891 - DNA, 17 bp, Homo sapiens
atctctctttaatataa

SEQ ID NO: 5371892 - DNA, 11 bp, Homo sapiens
atctctgaaaa

SEQ ID NO: 5371893 - DNA, 18 bp, Homo sapiens
atctctgaaacatattta

SEQ ID NO: 5371894 - DNA, 13 bp, Homo sapiens
atctctgaaagca

SEQ ID NO: 5371895 - DNA, 17 bp, Homo sapiens
atctctgaagcatgttt

SEQ ID NO: 5371896 - DNA, 18 bp, Homo sapiens
atctctgaagccacaaat

SEQ ID NO: 5371897 - DNA, 22 bp, Homo sapiens
atctctgaaggagttacaggga

SEQ ID NO: 5371898 - DNA, 21 bp, Homo sapiens
atctctgagtggaggaagccc

SEQ ID NO: 5371899 - DNA, 17 bp, Homo sapiens
atctctgagtgtctctg

SEQ ID NO: 5371900 - DNA, 18 bp, Homo sapiens
atctctgagtgtctctgc

SEQ ID NO: 5371901 - DNA, 21 bp, Homo sapiens
atctctgagtgtctctgcctg

SEQ ID NO: 5371902 - DNA, 15 bp, Homo sapiens
atctctgattaaatt

SEQ ID NO: 5371903 - DNA, 21 bp, Homo sapiens
atctctgattaaatttaatat

SEQ ID NO: 5371904 - DNA, 21 bp, Homo sapiens
atctctgcaatcttctcagaa

SEQ ID NO: 5371905 - DNA, 21 bp, Homo sapiens
atctctgccaacatgaggaca

SEQ ID NO: 5371906 - DNA, 23 bp, Homo sapiens
atctctgcctccaacccagcagt

SEQ ID NO: 5371907 - DNA, 12 bp, Homo sapiens
atctctgcctgt

SEQ ID NO: 5371908 - DNA, 13 bp, Homo sapiens
atctctgcctgtc

SEQ ID NO: 5371909 - DNA, 24 bp, Homo sapiens
atctctgctctctatgtatgtagc

SEQ ID NO: 5371910 - DNA, 15 bp, Homo sapiens
atctctgctgaacat

SEQ ID NO: 5371911 - DNA, 16 bp, Homo sapiens
atctctgctgaacatt

SEQ ID NO: 5371912 - DNA, 18 bp, Homo sapiens
atctctgctgcttctggg

SEQ ID NO: 5371913 - DNA, 15 bp, Homo sapiens
atctctggaaaaata

SEQ ID NO: 5371914 - DNA, 16 bp, Homo sapiens
atctctggaaaaataa

SEQ ID NO: 5371915 - DNA, 15 bp, Homo sapiens
atctctggagccaga

SEQ ID NO: 5371916 - DNA, 18 bp, Homo sapiens
atctctggagccagagag

SEQ ID NO: 5371917 - DNA, 20 bp, Homo sapiens
atctctggttgacgggctgt

SEQ ID NO: 5371918 - DNA, 16 bp, Homo sapiens
atctctgtcaaggtaa

SEQ ID NO: 5371919 - DNA, 17 bp, Homo sapiens
atctctgtcccattccc

SEQ ID NO: 5371920 - DNA, 19 bp, Homo sapiens
atctctgtcccattccctg

SEQ ID NO: 5371921 - DNA, 20 bp, Homo sapiens
atctctgtcccattccctgg

SEQ ID NO: 5371922 - DNA, 22 bp, Homo sapiens
atctctgtcccattccctggga

SEQ ID NO: 5371923 - DNA, 17 bp, Homo sapiens
atctctgtctaccatct

SEQ ID NO: 5371924 - DNA, 16 bp, Homo sapiens
atctctgtctggggct

SEQ ID NO: 5371925 - DNA, 21 bp, Homo sapiens
atctctgtgactcgcttagct

SEQ ID NO: 5371926 - DNA, 17 bp, Homo sapiens
atctctgtgtacccact

SEQ ID NO: 5371927 - DNA, 19 bp, Homo sapiens
atctctgtgtacccactcc

SEQ ID NO: 5371928 - DNA, 24 bp, Homo sapiens
atctctgtgtacccactcctcact

SEQ ID NO: 5371929 - DNA, 17 bp, Homo sapiens
atctctgtgtgcacaaa

SEQ ID NO: 5371930 - DNA, 19 bp, Homo sapiens
atctctgtgtgcacaaata

SEQ ID NO: 5371931 - DNA, 18 bp, Homo sapiens
atctctgttacaaaagaa

SEQ ID NO: 5371932 - DNA, 13 bp, Homo sapiens
atctctgttatgt

SEQ ID NO: 5371933 - DNA, 16 bp, Homo sapiens
atctctgttatgtact

SEQ ID NO: 5371934 - DNA, 18 bp, Homo sapiens
atctctgttatgtactgt

SEQ ID NO: 5371935 - DNA, 20 bp, Homo sapiens
atctctgttatgtactgtac

SEQ ID NO: 5371936 - DNA, 21 bp, Homo sapiens
atctctgttctgtttggcact

SEQ ID NO: 5371937 - DNA, 16 bp, Homo sapiens
atctctgttgcacctg

SEQ ID NO: 5371938 - DNA, 23 bp, Homo sapiens
atctcttaagacagcatgtgtta

SEQ ID NO: 5371939 - DNA, 19 bp, Homo sapiens
atctcttaatattgagaat

SEQ ID NO: 5371940 - DNA, 16 bp, Homo sapiens
atctcttacatcagta

SEQ ID NO: 5371941 - DNA, 12 bp, Homo sapiens
atctcttagaag

SEQ ID NO: 5371942 - DNA, 15 bp, Homo sapiens
atctcttagaagcca

SEQ ID NO: 5371943 - DNA, 17 bp, Homo sapiens
atctcttagaagccatg

SEQ ID NO: 5371944 - DNA, 23 bp, Homo sapiens
atctcttagaagccatgggacct

SEQ ID NO: 5371945 - DNA, 18 bp, Homo sapiens
atctcttagctcccctcc

SEQ ID NO: 5371946 - DNA, 18 bp, Homo sapiens
atctcttatcttacgaaa

SEQ ID NO: 5371947 - DNA, 14 bp, Homo sapiens
atctcttattctaa

SEQ ID NO: 5371948 - DNA, 19 bp, Homo sapiens
atctcttattttacaataa

SEQ ID NO: 5371949 - DNA, 21 bp, Homo sapiens
atctcttcaatcactagtcaa

SEQ ID NO: 5371950 - DNA, 13 bp, Homo sapiens
atctcttcagtct

SEQ ID NO: 5371951 - DNA, 20 bp, Homo sapiens
atctcttcattattctctgc

SEQ ID NO: 5371952 - DNA, 11 bp, Homo sapiens
atctcttccat

SEQ ID NO: 5371953 - DNA, 18 bp, Homo sapiens
atctcttccccagagagg

SEQ ID NO: 5371954 - DNA, 19 bp, Homo sapiens
atctcttcctgattcccca

SEQ ID NO: 5371955 - DNA, 11 bp, Homo sapiens
atctcttcctt

SEQ ID NO: 5371956 - DNA, 18 bp, Homo sapiens
atctcttccttacaggtg

SEQ ID NO: 5371957 - DNA, 12 bp, Homo sapiens
atctcttccttg

SEQ ID NO: 5371958 - DNA, 16 bp, Homo sapiens
atctcttcctttcctt

SEQ ID NO: 5371959 - DNA, 21 bp, Homo sapiens
atctcttctgggttccttcct

SEQ ID NO: 5371960 - DNA, 13 bp, Homo sapiens
atctcttctggtg

SEQ ID NO: 5371961 - DNA, 18 bp, Homo sapiens
atctcttctggtgttgac

SEQ ID NO: 5371962 - DNA, 14 bp, Homo sapiens
atctcttcttcctt

SEQ ID NO: 5371963 - DNA, 17 bp, Homo sapiens
atctcttgctgttaaat

SEQ ID NO: 5371964 - DNA, 16 bp, Homo sapiens
atctcttgcttgtcat

SEQ ID NO: 5371965 - DNA, 13 bp, Homo sapiens
atctcttggaaaa

SEQ ID NO: 5371966 - DNA, 20 bp, Homo sapiens
atctcttggaaaataagaca

SEQ ID NO: 5371967 - DNA, 19 bp, Homo sapiens
atctcttgggagtcttggg

SEQ ID NO: 5371968 - DNA, 21 bp, Homo sapiens
atctcttgggagtcttgggtg

SEQ ID NO: 5371969 - DNA, 22 bp, Homo sapiens
atctcttgtaaatacatgtccc

SEQ ID NO: 5371970 - DNA, 19 bp, Homo sapiens
atctcttgtaccagcccag

SEQ ID NO: 5371971 - DNA, 20 bp, Homo sapiens
atctcttgtaccagcccagg

SEQ ID NO: 5371972 - DNA, 15 bp, Homo sapiens
atctcttgtcatata

SEQ ID NO: 5371973 - DNA, 16 bp, Homo sapiens
atctcttgtcatataa

SEQ ID NO: 5371974 - DNA, 19 bp, Homo sapiens
atctcttgtgcttttttga

SEQ ID NO: 5371975 - DNA, 19 bp, Homo sapiens
atctctttaaaaacaaaca

SEQ ID NO: 5371976 - DNA, 14 bp, Homo sapiens
atctctttagagaa

SEQ ID NO: 5371977 - DNA, 11 bp, Homo sapiens
atctctttcat

SEQ ID NO: 5371978 - DNA, 22 bp, Homo sapiens
atctctttctaaagacaggaga

SEQ ID NO: 5371979 - DNA, 23 bp, Homo sapiens
atctctttctctctttccatctc

SEQ ID NO: 5371980 - DNA, 14 bp, Homo sapiens
atctctttctttct

SEQ ID NO: 5371981 - DNA, 21 bp, Homo sapiens
atctctttctttctctttctg

SEQ ID NO: 5371982 - DNA, 21 bp, Homo sapiens
atctctttgaattttctgtgt

SEQ ID NO: 5371983 - DNA, 15 bp, Homo sapiens
atctctttgatctac

SEQ ID NO: 5371984 - DNA, 16 bp, Homo sapiens
atctctttgatctact

SEQ ID NO: 5371985 - DNA, 17 bp, Homo sapiens
atctctttgatctactt

SEQ ID NO: 5371986 - DNA, 20 bp, Homo sapiens
atctctttggttcctgtata

SEQ ID NO: 5371987 - DNA, 22 bp, Homo sapiens
atctctttgtcctgaatggctt

SEQ ID NO: 5371988 - DNA, 22 bp, Homo sapiens
atctctttgttctaaagatgga

SEQ ID NO: 5371989 - DNA, 13 bp, Homo sapiens
atctcttttctgg

SEQ ID NO: 5371990 - DNA, 21 bp, Homo sapiens
atctctttttatttaaatgtg

SEQ ID NO: 5371991 - DNA, 22 bp, Homo sapiens
atctctttttatttaaatgtga

SEQ ID NO: 5371992 - DNA, 19 bp, Homo sapiens
atctctttttgctttcgaa

SEQ ID NO: 5371993 - DNA, 16 bp, Homo sapiens
atctctttttttctgg

SEQ ID NO: 5371994 - DNA, 21 bp, Homo sapiens
atctgaaaaatggccatgttg

SEQ ID NO: 5371995 - DNA, 19 bp, Homo sapiens
atctgaaaactcattagag

SEQ ID NO: 5371996 - DNA, 15 bp, Homo sapiens
atctgaaaagaaatg

SEQ ID NO: 5371997 - DNA, 23 bp, Homo sapiens
atctgaaaatgtatgtgtaagta

SEQ ID NO: 5371998 - DNA, 14 bp, Homo sapiens
atctgaaaggcaca

SEQ ID NO: 5371999 - DNA, 13 bp, Homo sapiens
atctgaaaggcca

SEQ ID NO: 5372000 - DNA, 16 bp, Homo sapiens
atctgaaaggccagca

SEQ ID NO: 5372001 - DNA, 19 bp, Homo sapiens
atctgaaaggccagcagct

SEQ ID NO: 5372002 - DNA, 23 bp, Homo sapiens
atctgaaagttttgatacttgta

SEQ ID NO: 5372003 - DNA, 22 bp, Homo sapiens
atctgaaatccataaactaaga

SEQ ID NO: 5372004 - DNA, 12 bp, Homo sapiens
atctgaaatcta

SEQ ID NO: 5372005 - DNA, 15 bp, Homo sapiens
atctgaaatctacaa

SEQ ID NO: 5372006 - DNA, 18 bp, Homo sapiens
atctgaaattcaaaatgc

SEQ ID NO: 5372007 - DNA, 19 bp, Homo sapiens
atctgaacacaaccagagg

SEQ ID NO: 5372008 - DNA, 18 bp, Homo sapiens
atctgaacacagtttagt

SEQ ID NO: 5372009 - DNA, 14 bp, Homo sapiens
atctgaacatctgg

SEQ ID NO: 5372010 - DNA, 13 bp, Homo sapiens
atctgaacccagc

SEQ ID NO: 5372011 - DNA, 20 bp, Homo sapiens
atctgaactaattcatttat

SEQ ID NO: 5372012 - DNA, 20 bp, Homo sapiens
atctgaactcacagactgct

SEQ ID NO: 5372013 - DNA, 13 bp, Homo sapiens
atctgaactctca

SEQ ID NO: 5372014 - DNA, 23 bp, Homo sapiens
atctgaactgaccttgaatcttt

SEQ ID NO: 5372015 - DNA, 20 bp, Homo sapiens
atctgaactttgtttccaga

SEQ ID NO: 5372016 - DNA, 22 bp, Homo sapiens
atctgaactttgtttccagaaa

SEQ ID NO: 5372017 - DNA, 20 bp, Homo sapiens
atctgaagaggcttctcctg

SEQ ID NO: 5372018 - DNA, 21 bp, Homo sapiens
atctgaagaggcttctcctgt

SEQ ID NO: 5372019 - DNA, 23 bp, Homo sapiens
atctgaagagtatccttccttca

SEQ ID NO: 5372020 - DNA, 17 bp, Homo sapiens
atctgaagatatatttc

SEQ ID NO: 5372021 - DNA, 14 bp, Homo sapiens
atctgaagattgtt

SEQ ID NO: 5372022 - DNA, 21 bp, Homo sapiens
atctgaagattgtttatctag

SEQ ID NO: 5372023 - DNA, 20 bp, Homo sapiens
atctgaagccacctctctgc

SEQ ID NO: 5372024 - DNA, 13 bp, Homo sapiens
atctgaagctatt

SEQ ID NO: 5372025 - DNA, 23 bp, Homo sapiens
atctgaagcttcactcactgtca

SEQ ID NO: 5372026 - DNA, 13 bp, Homo sapiens
atctgaaggagat

SEQ ID NO: 5372027 - DNA, 16 bp, Homo sapiens
atctgaagggaattgt

SEQ ID NO: 5372028 - DNA, 19 bp, Homo sapiens
atctgaagtagtgtgagtg

SEQ ID NO: 5372029 - DNA, 21 bp, Homo sapiens
atctgaagtagtgtgagtgtt

SEQ ID NO: 5372030 - DNA, 18 bp, Homo sapiens
atctgaagtcagatctgc

SEQ ID NO: 5372031 - DNA, 23 bp, Homo sapiens
atctgaagtcagatctgcctaag

SEQ ID NO: 5372032 - DNA, 17 bp, Homo sapiens
atctgaatacctctttg

SEQ ID NO: 5372033 - DNA, 23 bp, Homo sapiens
atctgaatatatgatttgcatgt

SEQ ID NO: 5372034 - DNA, 15 bp, Homo sapiens
atctgaatcctgtta

SEQ ID NO: 5372035 - DNA, 16 bp, Homo sapiens
atctgaatcctgttaa

SEQ ID NO: 5372036 - DNA, 22 bp, Homo sapiens
atctgaatgaaaataactgaac

SEQ ID NO: 5372037 - DNA, 18 bp, Homo sapiens
atctgaatgatcctgtct

SEQ ID NO: 5372038 - DNA, 20 bp, Homo sapiens
atctgaatgtattatcctgt

SEQ ID NO: 5372039 - DNA, 15 bp, Homo sapiens
atctgaattcctgta

SEQ ID NO: 5372040 - DNA, 16 bp, Homo sapiens
atctgaattggaatgc

SEQ ID NO: 5372041 - DNA, 16 bp, Homo sapiens
atctgaattttgcaat

SEQ ID NO: 5372042 - DNA, 19 bp, Homo sapiens
atctgaattttgcaatgta

SEQ ID NO: 5372043 - DNA, 22 bp, Homo sapiens
atctgacacaagtgtattattt

SEQ ID NO: 5372044 - DNA, 14 bp, Homo sapiens
atctgacaggtgaa

SEQ ID NO: 5372045 - DNA, 16 bp, Homo sapiens
atctgacagtctcaaa

SEQ ID NO: 5372046 - DNA, 14 bp, Homo sapiens
atctgacatcccca

SEQ ID NO: 5372047 - DNA, 15 bp, Homo sapiens
atctgacatctctgc

SEQ ID NO: 5372048 - DNA, 19 bp, Homo sapiens
atctgacatgattccttcc

SEQ ID NO: 5372049 - DNA, 15 bp, Homo sapiens
atctgaccagcagcg

SEQ ID NO: 5372050 - DNA, 20 bp, Homo sapiens
atctgaccagcagcgccttt

SEQ ID NO: 5372051 - DNA, 16 bp, Homo sapiens
atctgaccatctgtga

SEQ ID NO: 5372052 - DNA, 20 bp, Homo sapiens
atctgaccatctgtgactat

SEQ ID NO: 5372053 - DNA, 15 bp, Homo sapiens
atctgacccactttg

SEQ ID NO: 5372054 - DNA, 21 bp, Homo sapiens
atctgacccactttgtaattt

SEQ ID NO: 5372055 - DNA, 20 bp, Homo sapiens
atctgacccagtgcccccac

SEQ ID NO: 5372056 - DNA, 21 bp, Homo sapiens
atctgaccctatgggtctagg

SEQ ID NO: 5372057 - DNA, 20 bp, Homo sapiens
atctgaccttcaccttggat

SEQ ID NO: 5372058 - DNA, 13 bp, Homo sapiens
atctgactgcacg

SEQ ID NO: 5372059 - DNA, 16 bp, Homo sapiens
atctgactgccaaata

SEQ ID NO: 5372060 - DNA, 18 bp, Homo sapiens
atctgacttctcacttcc

SEQ ID NO: 5372061 - DNA, 18 bp, Homo sapiens
atctgactttaattgtgt

SEQ ID NO: 5372062 - DNA, 21 bp, Homo sapiens
atctgagaaacaatgactaat

SEQ ID NO: 5372063 - DNA, 20 bp, Homo sapiens
atctgagaacacgttgccag

SEQ ID NO: 5372064 - DNA, 17 bp, Homo sapiens
atctgagaagtgtatat

SEQ ID NO: 5372065 - DNA, 13 bp, Homo sapiens
atctgagaatgaa

SEQ ID NO: 5372066 - DNA, 21 bp, Homo sapiens
atctgagacactaggatgaat

SEQ ID NO: 5372067 - DNA, 17 bp, Homo sapiens
atctgagagacctgtgt

SEQ ID NO: 5372068 - DNA, 22 bp, Homo sapiens
atctgagagacctgtgtgaact

SEQ ID NO: 5372069 - DNA, 22 bp, Homo sapiens
atctgagagaggctaaaatgtt

SEQ ID NO: 5372070 - DNA, 23 bp, Homo sapiens
atctgagagaggctaaaatgttt

SEQ ID NO: 5372071 - DNA, 19 bp, Homo sapiens
atctgagatctccctccag

SEQ ID NO: 5372072 - DNA, 22 bp, Homo sapiens
atctgagattgtgtttgttcat

SEQ ID NO: 5372073 - DNA, 13 bp, Homo sapiens
atctgagcaaaca

SEQ ID NO: 5372074 - DNA, 13 bp, Homo sapiens
atctgagcaagga

SEQ ID NO: 5372075 - DNA, 17 bp, Homo sapiens
atctgagcaataacttc

SEQ ID NO: 5372076 - DNA, 15 bp, Homo sapiens
atctgagccagtgct

SEQ ID NO: 5372077 - DNA, 20 bp, Homo sapiens
atctgagccctccctcttcc

SEQ ID NO: 5372078 - DNA, 21 bp, Homo sapiens
atctgagccctccctcttccc

SEQ ID NO: 5372079 - DNA, 16 bp, Homo sapiens
atctgtaaaatagtct

SEQ ID NO: 5372080 - DNA, 13 bp, Homo sapiens
atctgtaaagaaa

SEQ ID NO: 5372081 - DNA, 13 bp, Homo sapiens
atctgtaaagcca

SEQ ID NO: 5372082 - DNA, 23 bp, Homo sapiens
atctgtaaatagtgagatggact

SEQ ID NO: 5372083 - DNA, 15 bp, Homo sapiens
atctgtaaatctaca

SEQ ID NO: 5372084 - DNA, 23 bp, Homo sapiens
atctgtaaatttaactgcatata

SEQ ID NO: 5372085 - DNA, 18 bp, Homo sapiens
atctgtaacactattaca

SEQ ID NO: 5372086 - DNA, 17 bp, Homo sapiens
atctgtaacccccaagg

SEQ ID NO: 5372087 - DNA, 22 bp, Homo sapiens
atctgtaacccccaaggaggaa

SEQ ID NO: 5372088 - DNA, 15 bp, Homo sapiens
atctgtaagaagtag

SEQ ID NO: 5372089 - DNA, 17 bp, Homo sapiens
atctgtaagagcttgct

SEQ ID NO: 5372090 - DNA, 17 bp, Homo sapiens
atctgtaagagtgttta

SEQ ID NO: 5372091 - DNA, 12 bp, Homo sapiens
atctgtaagctg

SEQ ID NO: 5372092 - DNA, 14 bp, Homo sapiens
atctgtaagctgtt

SEQ ID NO: 5372093 - DNA, 15 bp, Homo sapiens
atctgtaagctgttt

SEQ ID NO: 5372094 - DNA, 17 bp, Homo sapiens
atctgtaatcacatttc

SEQ ID NO: 5372095 - DNA, 14 bp, Homo sapiens
atctgtaatttcac

SEQ ID NO: 5372096 - DNA, 13 bp, Homo sapiens
atctgtacaatga

SEQ ID NO: 5372097 - DNA, 11 bp, Homo sapiens
atctgtacatt

SEQ ID NO: 5372098 - DNA, 20 bp, Homo sapiens
atctgtactgtaattttgtt

SEQ ID NO: 5372099 - DNA, 11 bp, Homo sapiens
atctgtacttt

SEQ ID NO: 5372100 - DNA, 19 bp, Homo sapiens
atctgtacttttttcaaat

SEQ ID NO: 5372101 - DNA, 12 bp, Homo sapiens
atctgtagatac

SEQ ID NO: 5372102 - DNA, 18 bp, Homo sapiens
atctgtagctacactgta

SEQ ID NO: 5372103 - DNA, 17 bp, Homo sapiens
atctgtaggtcactctc

SEQ ID NO: 5372104 - DNA, 22 bp, Homo sapiens
atctgtaggtcactctccagca

SEQ ID NO: 5372105 - DNA, 23 bp, Homo sapiens
atctgtagtaatttattgtctgt

SEQ ID NO: 5372106 - DNA, 13 bp, Homo sapiens
atctgtataaatg

SEQ ID NO: 5372107 - DNA, 22 bp, Homo sapiens
atctgtataaatgtctattatt

SEQ ID NO: 5372108 - DNA, 15 bp, Homo sapiens
atctgtataaatgtg

SEQ ID NO: 5372109 - DNA, 17 bp, Homo sapiens
atctgtataagtaagaa

SEQ ID NO: 5372110 - DNA, 20 bp, Homo sapiens
atctgtataagtaagaaaat

SEQ ID NO: 5372111 - DNA, 15 bp, Homo sapiens
atctgtataatactt

SEQ ID NO: 5372112 - DNA, 16 bp, Homo sapiens
atctgtataatacttt

SEQ ID NO: 5372113 - DNA, 20 bp, Homo sapiens
atctgtataatactttgtat

SEQ ID NO: 5372114 - DNA, 22 bp, Homo sapiens
atctgtatataagttgctgtgt

SEQ ID NO: 5372115 - DNA, 14 bp, Homo sapiens
atctgtatatacaa

SEQ ID NO: 5372116 - DNA, 21 bp, Homo sapiens
atctgtatatacaataacata

SEQ ID NO: 5372117 - DNA, 18 bp, Homo sapiens
atctgtatatcagctcta

SEQ ID NO: 5372118 - DNA, 13 bp, Homo sapiens
atctgtatctctc

SEQ ID NO: 5372119 - DNA, 14 bp, Homo sapiens
atctgtatctctct

SEQ ID NO: 5372120 - DNA, 15 bp, Homo sapiens
atctgtatctctctc

SEQ ID NO: 5372121 - DNA, 17 bp, Homo sapiens
atctgtatgttaggtga

SEQ ID NO: 5372122 - DNA, 17 bp, Homo sapiens
atctgtattaagctcca

SEQ ID NO: 5372123 - DNA, 18 bp, Homo sapiens
atctgtattggcagcaca

SEQ ID NO: 5372124 - DNA, 22 bp, Homo sapiens
atctgtattggcagcacagcta

SEQ ID NO: 5372125 - DNA, 22 bp, Homo sapiens
atctgtatttaatggtttttat

SEQ ID NO: 5372126 - DNA, 17 bp, Homo sapiens
atctgtatttaattttg

SEQ ID NO: 5372127 - DNA, 18 bp, Homo sapiens
atctgtatttaattttga

SEQ ID NO: 5372128 - DNA, 15 bp, Homo sapiens
atctgtcaaaacact

SEQ ID NO: 5372129 - DNA, 16 bp, Homo sapiens
atctgtcaaaacactg

SEQ ID NO: 5372130 - DNA, 18 bp, Homo sapiens
atctgtcaaaacactgtg

SEQ ID NO: 5372131 - DNA, 22 bp, Homo sapiens
atctgtcaaagaaaacttccaa

SEQ ID NO: 5372132 - DNA, 22 bp, Homo sapiens
atctgtcaagagtagttatata

SEQ ID NO: 5372133 - DNA, 16 bp, Homo sapiens
atctgtcacaataaat

SEQ ID NO: 5372134 - DNA, 21 bp, Homo sapiens
atctgtcacaataaatggcca

SEQ ID NO: 5372135 - DNA, 21 bp, Homo sapiens
atctgtcagcatctggctgtc

SEQ ID NO: 5372136 - DNA, 18 bp, Homo sapiens
atctgtcagcttcccaac

SEQ ID NO: 5372137 - DNA, 12 bp, Homo sapiens
atctgtcagttc

SEQ ID NO: 5372138 - DNA, 17 bp, Homo sapiens
atctgtcataagcatta

SEQ ID NO: 5372139 - DNA, 18 bp, Homo sapiens
atctgtcataagcattac

SEQ ID NO: 5372140 - DNA, 19 bp, Homo sapiens
atctgtccaaaggaggctg

SEQ ID NO: 5372141 - DNA, 21 bp, Homo sapiens
atctgtccacatccccagagc

SEQ ID NO: 5372142 - DNA, 13 bp, Homo sapiens
atctgtccagaca

SEQ ID NO: 5372143 - DNA, 20 bp, Homo sapiens
atctgtccatcctcctctcc

SEQ ID NO: 5372144 - DNA, 21 bp, Homo sapiens
atctgtccatcctcctctcca

SEQ ID NO: 5372145 - DNA, 22 bp, Homo sapiens
atctgtccatggcctttctaat

SEQ ID NO: 5372146 - DNA, 13 bp, Homo sapiens
atctgtcccactg

SEQ ID NO: 5372147 - DNA, 14 bp, Homo sapiens
atctgtcccactgg

SEQ ID NO: 5372148 - DNA, 15 bp, Homo sapiens
atctgtcccccttta

SEQ ID NO: 5372149 - DNA, 13 bp, Homo sapiens
atctgtcccctgc

SEQ ID NO: 5372150 - DNA, 14 bp, Homo sapiens
atctgtcccctgct

SEQ ID NO: 5372151 - DNA, 22 bp, Homo sapiens
atctgtccgtccagagccggca

SEQ ID NO: 5372152 - DNA, 17 bp, Homo sapiens
atctgtccgtggaaaat

SEQ ID NO: 5372153 - DNA, 16 bp, Homo sapiens
atctgtcctctgtagt

SEQ ID NO: 5372154 - DNA, 18 bp, Homo sapiens
atctgtcctctgtagtat

SEQ ID NO: 5372155 - DNA, 12 bp, Homo sapiens
atctgtcctggg

SEQ ID NO: 5372156 - DNA, 16 bp, Homo sapiens
atctgtcgcatttcat

SEQ ID NO: 5372157 - DNA, 19 bp, Homo sapiens
atctgtcgcatttcatcaa

SEQ ID NO: 5372158 - DNA, 21 bp, Homo sapiens
atctgtctagaatcctgcttt

SEQ ID NO: 5372159 - DNA, 22 bp, Homo sapiens
atctgtctagaatcctgcttta

SEQ ID NO: 5372160 - DNA, 15 bp, Homo sapiens
atctgtctgagccct

SEQ ID NO: 5372161 - DNA, 16 bp, Homo sapiens
atctgtctgagccctg

SEQ ID NO: 5372162 - DNA, 17 bp, Homo sapiens
atctgtctgagccctgc

SEQ ID NO: 5372163 - DNA, 21 bp, Homo sapiens
atctgtctgagccctgccctc

SEQ ID NO: 5372164 - DNA, 13 bp, Homo sapiens
atctgtctgattc

SEQ ID NO: 5372165 - DNA, 16 bp, Homo sapiens
atctgtctgattctat

SEQ ID NO: 5372166 - DNA, 22 bp, Homo sapiens
atctgtctgccaacctaaaact

SEQ ID NO: 5372167 - DNA, 23 bp, Homo sapiens
atctgtctgccaacctaaaactc

SEQ ID NO: 5372168 - DNA, 14 bp, Homo sapiens
atctgtctggtggc

SEQ ID NO: 5372169 - DNA, 16 bp, Homo sapiens
atctgtctggtggccc

SEQ ID NO: 5372170 - DNA, 17 bp, Homo sapiens
atctgtctgtctgtggg

SEQ ID NO: 5372171 - DNA, 17 bp, Homo sapiens
atctgtctgtgcacatg

SEQ ID NO: 5372172 - DNA, 20 bp, Homo sapiens
atctgtctgtgcacatgcct

SEQ ID NO: 5372173 - DNA, 15 bp, Homo sapiens
atctgtctgtggcaa

SEQ ID NO: 5372174 - DNA, 14 bp, Homo sapiens
atctgtcttggcat

SEQ ID NO: 5372175 - DNA, 15 bp, Homo sapiens
atctgtcttgtaata

SEQ ID NO: 5372176 - DNA, 21 bp, Homo sapiens
atctgtcttgtaatattttgt

SEQ ID NO: 5372177 - DNA, 21 bp, Homo sapiens
atctgtctttagaatcgcttt

SEQ ID NO: 5372178 - DNA, 13 bp, Homo sapiens
atctgtctttatg

SEQ ID NO: 5372179 - DNA, 15 bp, Homo sapiens
atctgtctttatgat

SEQ ID NO: 5372180 - DNA, 21 bp, Homo sapiens
atctgtctttatgatttcatg

SEQ ID NO: 5372181 - DNA, 20 bp, Homo sapiens
atctgtctttcactggaatg

SEQ ID NO: 5372182 - DNA, 13 bp, Homo sapiens
atctgtctttcca

SEQ ID NO: 5372183 - DNA, 17 bp, Homo sapiens
atctgtctttccactct

SEQ ID NO: 5372184 - DNA, 21 bp, Homo sapiens
atctgtctttgcggggcctgt

SEQ ID NO: 5372185 - DNA, 23 bp, Homo sapiens
atctgtctttgcggggcctgtct

SEQ ID NO: 5372186 - DNA, 13 bp, Homo sapiens
atctgtcttttat

SEQ ID NO: 5372187 - DNA, 20 bp, Homo sapiens
atctgtgaaaggtaggaaac

SEQ ID NO: 5372188 - DNA, 21 bp, Homo sapiens
atctgtgaaaggtaggaaact

SEQ ID NO: 5372189 - DNA, 17 bp, Homo sapiens
atctgtgaacttgaaat

SEQ ID NO: 5372190 - DNA, 11 bp, Homo sapiens
atctgtgaata

SEQ ID NO: 5372191 - DNA, 13 bp, Homo sapiens
atctgtgaatctg

SEQ ID NO: 5372192 - DNA, 13 bp, Homo sapiens
atctgtgaattaa

SEQ ID NO: 5372193 - DNA, 17 bp, Homo sapiens
atctgtgaattcagatt

SEQ ID NO: 5372194 - DNA, 16 bp, Homo sapiens
atctgtgacctctgac

SEQ ID NO: 5372195 - DNA, 21 bp, Homo sapiens
atctgtgactataaagctgtt

SEQ ID NO: 5372196 - DNA, 13 bp, Homo sapiens
atctgtgagaagt

SEQ ID NO: 5372197 - DNA, 21 bp, Homo sapiens
atctgtgaggggctctctcat

SEQ ID NO: 5372198 - DNA, 22 bp, Homo sapiens
atctgtgaggggctctctcatg

SEQ ID NO: 5372199 - DNA, 19 bp, Homo sapiens
atctgtgaggtgctgatga

SEQ ID NO: 5372200 - DNA, 22 bp, Homo sapiens
atctgtgagtgaaagttgccat

SEQ ID NO: 5372201 - DNA, 17 bp, Homo sapiens
atctgtgataattttct

SEQ ID NO: 5372202 - DNA, 12 bp, Homo sapiens
atctgtgatgat

SEQ ID NO: 5372203 - DNA, 13 bp, Homo sapiens
atctgtgatttct

SEQ ID NO: 5372204 - DNA, 20 bp, Homo sapiens
atctgtgcaataaaataaca

SEQ ID NO: 5372205 - DNA, 18 bp, Homo sapiens
atctgtgcacactaagaa

SEQ ID NO: 5372206 - DNA, 16 bp, Homo sapiens
atctgtgcactgccca

SEQ ID NO: 5372207 - DNA, 12 bp, Homo sapiens
atctgtgcaggg

SEQ ID NO: 5372208 - DNA, 20 bp, Homo sapiens
atctgtgcagggctggtttg

SEQ ID NO: 5372209 - DNA, 21 bp, Homo sapiens
atctgtgcccagagatgggac

SEQ ID NO: 5372210 - DNA, 12 bp, Homo sapiens
atctgtgcccca

SEQ ID NO: 5372211 - DNA, 15 bp, Homo sapiens
atctgtgccccatgc

SEQ ID NO: 5372212 - DNA, 18 bp, Homo sapiens
atctgtgcctgtctgtcc

SEQ ID NO: 5372213 - DNA, 15 bp, Homo sapiens
atctgtgctctttca

SEQ ID NO: 5372214 - DNA, 19 bp, Homo sapiens
atctgtgcttctaatatta

SEQ ID NO: 5372215 - DNA, 21 bp, Homo sapiens
atctgtgcttctaatattagt

SEQ ID NO: 5372216 - DNA, 15 bp, Homo sapiens
atctgtgctttccag

SEQ ID NO: 5372217 - DNA, 13 bp, Homo sapiens
atctgtggaaagc

SEQ ID NO: 5372218 - DNA, 21 bp, Homo sapiens
atctgtggagctgccacagag

SEQ ID NO: 5372219 - DNA, 14 bp, Homo sapiens
atctgtggagttcc

SEQ ID NO: 5372220 - DNA, 13 bp, Homo sapiens
atctgtggcaagc

SEQ ID NO: 5372221 - DNA, 15 bp, Homo sapiens
atctgtgggatgctg

SEQ ID NO: 5372222 - DNA, 16 bp, Homo sapiens
atctgtgggatgctga

SEQ ID NO: 5372223 - DNA, 23 bp, Homo sapiens
atctgtgggtctgggagtcacac

SEQ ID NO: 5372224 - DNA, 16 bp, Homo sapiens
atctgtgtacaaagaa

SEQ ID NO: 5372225 - DNA, 13 bp, Homo sapiens
atctgtgtctctg

SEQ ID NO: 5372226 - DNA, 17 bp, Homo sapiens
atctgtgtctgtgtctg

SEQ ID NO: 5372227 - DNA, 17 bp, Homo sapiens
atctgtgtgaaaatggg

SEQ ID NO: 5372228 - DNA, 20 bp, Homo sapiens
atctgtgtgaaactttcatt

SEQ ID NO: 5372229 - DNA, 14 bp, Homo sapiens
atctgtgtgcatat

SEQ ID NO: 5372230 - DNA, 18 bp, Homo sapiens
atctgtgtgccctagggc

SEQ ID NO: 5372231 - DNA, 19 bp, Homo sapiens
atctgtgtggctcctgggc

SEQ ID NO: 5372232 - DNA, 21 bp, Homo sapiens
atctgtgtggctcctgggccg

SEQ ID NO: 5372233 - DNA, 20 bp, Homo sapiens
atctgtgtgtgaattccttt

SEQ ID NO: 5372234 - DNA, 9 bp, Homo sapiens
atctgtgtt

SEQ ID NO: 5372235 - DNA, 16 bp, Homo sapiens
atctgtgttatttgga

SEQ ID NO: 5372236 - DNA, 10 bp, Homo sapiens
atctgtgttc

SEQ ID NO: 5372237 - DNA, 12 bp, Homo sapiens
atctgtgttcta

SEQ ID NO: 5372238 - DNA, 19 bp, Homo sapiens
atctgtgttctatgcaaag

SEQ ID NO: 5372239 - DNA, 16 bp, Homo sapiens
atctgtgtttttgaaa

SEQ ID NO: 5372240 - DNA, 12 bp, Homo sapiens
atctgttacaca

SEQ ID NO: 5372241 - DNA, 18 bp, Homo sapiens
atctgttacggttaatga

SEQ ID NO: 5372242 - DNA, 18 bp, Homo sapiens
atctgttagcagagtctg

SEQ ID NO: 5372243 - DNA, 14 bp, Homo sapiens
atctgttagcatta

SEQ ID NO: 5372244 - DNA, 16 bp, Homo sapiens
atctgttagggccttg

SEQ ID NO: 5372245 - DNA, 21 bp, Homo sapiens
atctgttattcaaatttgatg

SEQ ID NO: 5372246 - DNA, 23 bp, Homo sapiens
atctgttattcaaatttgatgat

SEQ ID NO: 5372247 - DNA, 13 bp, Homo sapiens
atctgttcatttc

SEQ ID NO: 5372248 - DNA, 22 bp, Homo sapiens
atctgttcccagcccctcctcc

SEQ ID NO: 5372249 - DNA, 16 bp, Homo sapiens
atctgttcccttcctc

SEQ ID NO: 5372250 - DNA, 16 bp, Homo sapiens
atctgttccttggcag

SEQ ID NO: 5372251 - DNA, 14 bp, Homo sapiens
atctgttctaacat

SEQ ID NO: 5372252 - DNA, 16 bp, Homo sapiens
atctgttctaacatgt

SEQ ID NO: 5372253 - DNA, 15 bp, Homo sapiens
atctgttctatgctt

SEQ ID NO: 5372254 - DNA, 16 bp, Homo sapiens
atctgttctatgcttc

SEQ ID NO: 5372255 - DNA, 13 bp, Homo sapiens
atctgttctatgg

SEQ ID NO: 5372256 - DNA, 19 bp, Homo sapiens
atctgttctttaatttatt

SEQ ID NO: 5372257 - DNA, 15 bp, Homo sapiens
atctgttgaaatgcc

SEQ ID NO: 5372258 - DNA, 14 bp, Homo sapiens
atctgttgacaaat

SEQ ID NO: 5372259 - DNA, 13 bp, Homo sapiens
atctgttgcaaac

SEQ ID NO: 5372260 - DNA, 11 bp, Homo sapiens
atctgttgtaa

SEQ ID NO: 5372261 - DNA, 13 bp, Homo sapiens
atctgttgtaata

SEQ ID NO: 5372262 - DNA, 15 bp, Homo sapiens
atctgttgtaatatc

SEQ ID NO: 5372263 - DNA, 18 bp, Homo sapiens
atctgttgtaatatcagt

SEQ ID NO: 5372264 - DNA, 16 bp, Homo sapiens
atctgttgttccaaat

SEQ ID NO: 5372265 - DNA, 13 bp, Homo sapiens
atctgttgtttga

SEQ ID NO: 5372266 - DNA, 21 bp, Homo sapiens
atctgtttaaagcatatagag

SEQ ID NO: 5372267 - DNA, 13 bp, Homo sapiens
atctgtttcccag

SEQ ID NO: 5372268 - DNA, 15 bp, Homo sapiens
atctgtttctctgct

SEQ ID NO: 5372269 - DNA, 13 bp, Homo sapiens
atctgtttgagaa

SEQ ID NO: 5372270 - DNA, 19 bp, Homo sapiens
atctgtttgagaaagtcag

SEQ ID NO: 5372271 - DNA, 12 bp, Homo sapiens
atctgtttgtat

SEQ ID NO: 5372272 - DNA, 18 bp, Homo sapiens
atctgtttgtatatttgc

SEQ ID NO: 5372273 - DNA, 20 bp, Homo sapiens
atctgtttgtatatttgcaa

SEQ ID NO: 5372274 - DNA, 13 bp, Homo sapiens
atctgtttgttga

SEQ ID NO: 5372275 - DNA, 14 bp, Homo sapiens
atctgttttacagg

SEQ ID NO: 5372276 - DNA, 17 bp, Homo sapiens
atctgttttactgcttt

SEQ ID NO: 5372277 - DNA, 21 bp, Homo sapiens
atctgttttctacctcctcct

SEQ ID NO: 5372278 - DNA, 14 bp, Homo sapiens
atctgttttctgga

SEQ ID NO: 5372279 - DNA, 19 bp, Homo sapiens
atctgttttgaaggcaaaa

SEQ ID NO: 5372280 - DNA, 19 bp, Homo sapiens
atctgttttggatgttgct

SEQ ID NO: 5372281 - DNA, 22 bp, Homo sapiens
atctgttttggatgttgctata

SEQ ID NO: 5372282 - DNA, 21 bp, Homo sapiens
atctgttttgtggtttggaat

SEQ ID NO: 5372283 - DNA, 14 bp, Homo sapiens
atctgttttgtttc

SEQ ID NO: 5372284 - DNA, 13 bp, Homo sapiens
atctgtttttaaa

SEQ ID NO: 5372285 - DNA, 20 bp, Homo sapiens
atctgtttttaaaaatcata

SEQ ID NO: 5372286 - DNA, 17 bp, Homo sapiens
atctgtttttaaagcac

SEQ ID NO: 5372287 - DNA, 14 bp, Homo sapiens
atctgtttttctaa

SEQ ID NO: 5372288 - DNA, 13 bp, Homo sapiens
atcttaaaaacaa

SEQ ID NO: 5372289 - DNA, 12 bp, Homo sapiens
atcttaaaaagt

SEQ ID NO: 5372290 - DNA, 19 bp, Homo sapiens
atcttaaaagggtggtagt

SEQ ID NO: 5372291 - DNA, 15 bp, Homo sapiens
atcttaaaagtgtaa

SEQ ID NO: 5372292 - DNA, 15 bp, Homo sapiens
atcttaaaataattc

SEQ ID NO: 5372293 - DNA, 15 bp, Homo sapiens
atcttaaaattcttg

SEQ ID NO: 5372294 - DNA, 13 bp, Homo sapiens
atcttaaaattgg

SEQ ID NO: 5372295 - DNA, 20 bp, Homo sapiens
atcttaaacaatgtataaag

SEQ ID NO: 5372296 - DNA, 20 bp, Homo sapiens
atcttaaacccacataaaca

SEQ ID NO: 5372297 - DNA, 19 bp, Homo sapiens
atcttaaaccttaagatac

SEQ ID NO: 5372298 - DNA, 10 bp, Homo sapiens
atcttaaact

SEQ ID NO: 5372299 - DNA, 11 bp, Homo sapiens
atcttaaacta

SEQ ID NO: 5372300 - DNA, 19 bp, Homo sapiens
atcttaaagaaacagcttt

SEQ ID NO: 5372301 - DNA, 13 bp, Homo sapiens
atcttaaatatga

SEQ ID NO: 5372302 - DNA, 16 bp, Homo sapiens
atcttaaatatgaatt

SEQ ID NO: 5372303 - DNA, 20 bp, Homo sapiens
atcttaaatatgaattctgt

SEQ ID NO: 5372304 - DNA, 19 bp, Homo sapiens
atcttaaatcagaataaat

SEQ ID NO: 5372305 - DNA, 18 bp, Homo sapiens
atcttaaatctaaacaaa

SEQ ID NO: 5372306 - DNA, 13 bp, Homo sapiens
atcttaaattcat

SEQ ID NO: 5372307 - DNA, 17 bp, Homo sapiens
atcttaaattcatttct

SEQ ID NO: 5372308 - DNA, 20 bp, Homo sapiens
atcttaaattcatttctaga

SEQ ID NO: 5372309 - DNA, 21 bp, Homo sapiens
atcttaaattcatttctagac

SEQ ID NO: 5372310 - DNA, 16 bp, Homo sapiens
atcttaacactgaaat

SEQ ID NO: 5372311 - DNA, 17 bp, Homo sapiens
atcttaacactgaaatt

SEQ ID NO: 5372312 - DNA, 20 bp, Homo sapiens
atcttaaccttcaaatacat

SEQ ID NO: 5372313 - DNA, 13 bp, Homo sapiens
atcttaactcttt

SEQ ID NO: 5372314 - DNA, 15 bp, Homo sapiens
atcttaactctttgc

SEQ ID NO: 5372315 - DNA, 13 bp, Homo sapiens
atcttaagaaata

SEQ ID NO: 5372316 - DNA, 16 bp, Homo sapiens
atcttaagaaataaat

SEQ ID NO: 5372317 - DNA, 14 bp, Homo sapiens
atcttaagaatgtg

SEQ ID NO: 5372318 - DNA, 15 bp, Homo sapiens
atcttaagagcttga

SEQ ID NO: 5372319 - DNA, 20 bp, Homo sapiens
atcttaagagcttgatctgt

SEQ ID NO: 5372320 - DNA, 22 bp, Homo sapiens
atcttaagagcttgatctgtga

SEQ ID NO: 5372321 - DNA, 15 bp, Homo sapiens
atcttaagataatat

SEQ ID NO: 5372322 - DNA, 18 bp, Homo sapiens
atcttaagataatattta

SEQ ID NO: 5372323 - DNA, 18 bp, Homo sapiens
atcttaagcaggtttgtt

SEQ ID NO: 5372324 - DNA, 19 bp, Homo sapiens
atcttaagcaggtttgttt

SEQ ID NO: 5372325 - DNA, 17 bp, Homo sapiens
atcttaaggtctaactg

SEQ ID NO: 5372326 - DNA, 17 bp, Homo sapiens
atcttaagtaccaatgg

SEQ ID NO: 5372327 - DNA, 18 bp, Homo sapiens
atcttaagtcataatgaa

SEQ ID NO: 5372328 - DNA, 14 bp, Homo sapiens
atcttaagttctat

SEQ ID NO: 5372329 - DNA, 17 bp, Homo sapiens
atcttaatactgttatt

SEQ ID NO: 5372330 - DNA, 22 bp, Homo sapiens
atcttaatactgttattctttg

SEQ ID NO: 5372331 - DNA, 12 bp, Homo sapiens
atcttaatataa

SEQ ID NO: 5372332 - DNA, 23 bp, Homo sapiens
atcttaatatatttctaaatgtt

SEQ ID NO: 5372333 - DNA, 18 bp, Homo sapiens
atcttaatccattaaaaa

SEQ ID NO: 5372334 - DNA, 19 bp, Homo sapiens
atcttaatctgtttattta

SEQ ID NO: 5372335 - DNA, 22 bp, Homo sapiens
atcttaatctgtttatttacaa

SEQ ID NO: 5372336 - DNA, 15 bp, Homo sapiens
atcttaatctttatt

SEQ ID NO: 5372337 - DNA, 20 bp, Homo sapiens
atcttaatctttattttatt

SEQ ID NO: 5372338 - DNA, 15 bp, Homo sapiens
atcttaatgtatcaa

SEQ ID NO: 5372339 - DNA, 18 bp, Homo sapiens
atcttaatgtatcaaact

SEQ ID NO: 5372340 - DNA, 14 bp, Homo sapiens
atcttaatgtctgg

SEQ ID NO: 5372341 - DNA, 18 bp, Homo sapiens
atcttaatgtctggtgtt

SEQ ID NO: 5372342 - DNA, 21 bp, Homo sapiens
atcttaattaagctccttcag

SEQ ID NO: 5372343 - DNA, 22 bp, Homo sapiens
atcttaattactttcagaatat

SEQ ID NO: 5372344 - DNA, 18 bp, Homo sapiens
atcttaattttggttgta

SEQ ID NO: 5372345 - DNA, 19 bp, Homo sapiens
atcttaattttttttaatg

SEQ ID NO: 5372346 - DNA, 16 bp, Homo sapiens
atcttacaaaatcctg

SEQ ID NO: 5372347 - DNA, 18 bp, Homo sapiens
atcttacaaagtgtattt

SEQ ID NO: 5372348 - DNA, 22 bp, Homo sapiens
atcttacaaagtgtattttata

SEQ ID NO: 5372349 - DNA, 21 bp, Homo sapiens
atcttacaacaggcttatgaa

SEQ ID NO: 5372350 - DNA, 21 bp, Homo sapiens
atcttacaagatattgatgat

SEQ ID NO: 5372351 - DNA, 22 bp, Homo sapiens
atcttacagagtgattgtagtt

SEQ ID NO: 5372352 - DNA, 23 bp, Homo sapiens
atcttaccagatgctactggact

SEQ ID NO: 5372353 - DNA, 18 bp, Homo sapiens
atcttacccttcaatgtt

SEQ ID NO: 5372354 - DNA, 15 bp, Homo sapiens
atcttacctttatga

SEQ ID NO: 5372355 - DNA, 16 bp, Homo sapiens
atcttacgctatttct

SEQ ID NO: 5372356 - DNA, 16 bp, Homo sapiens
atcttactatttcaca

SEQ ID NO: 5372357 - DNA, 18 bp, Homo sapiens
atcttactctactgctgc

SEQ ID NO: 5372358 - DNA, 14 bp, Homo sapiens
atcttactgaaggt

SEQ ID NO: 5372359 - DNA, 14 bp, Homo sapiens
atcttacttggctt

SEQ ID NO: 5372360 - DNA, 12 bp, Homo sapiens
atcttactttgt

SEQ ID NO: 5372361 - DNA, 16 bp, Homo sapiens
atcttagactttgcaa

SEQ ID NO: 5372362 - DNA, 18 bp, Homo sapiens
atcttagagtttacagtt

SEQ ID NO: 5372363 - DNA, 19 bp, Homo sapiens
atcttagataacttcttga

SEQ ID NO: 5372364 - DNA, 20 bp, Homo sapiens
atcttagataacttcttgaa

SEQ ID NO: 5372365 - DNA, 13 bp, Homo sapiens
atcttagattctc

SEQ ID NO: 5372366 - DNA, 19 bp, Homo sapiens
atcttaggcaaaataccag

SEQ ID NO: 5372367 - DNA, 21 bp, Homo sapiens
atcttaggcactttttaacat

SEQ ID NO: 5372368 - DNA, 22 bp, Homo sapiens
atcttaggcactttttaacatt

SEQ ID NO: 5372369 - DNA, 17 bp, Homo sapiens
atcttagggaactttga

SEQ ID NO: 5372370 - DNA, 18 bp, Homo sapiens
atcttagggaactttgat

SEQ ID NO: 5372371 - DNA, 22 bp, Homo sapiens
atcttagggatgattaaaggca

SEQ ID NO: 5372372 - DNA, 20 bp, Homo sapiens
atcttaggggagagctttct

SEQ ID NO: 5372373 - DNA, 15 bp, Homo sapiens
atcttagggtgaacc

SEQ ID NO: 5372374 - DNA, 18 bp, Homo sapiens
atcttagggtgaaccact

SEQ ID NO: 5372375 - DNA, 18 bp, Homo sapiens
atcttagtgcctgagagt

SEQ ID NO: 5372376 - DNA, 12 bp, Homo sapiens
atcttagtggtt

SEQ ID NO: 5372377 - DNA, 15 bp, Homo sapiens
atcttagtgtatgat

SEQ ID NO: 5372378 - DNA, 15 bp, Homo sapiens
atcttagttctgtat

SEQ ID NO: 5372379 - DNA, 21 bp, Homo sapiens
atcttagttctgtatataaat

SEQ ID NO: 5372380 - DNA, 13 bp, Homo sapiens
atcttagtttact

SEQ ID NO: 5372381 - DNA, 22 bp, Homo sapiens
atcttagtttggattcttatgt

SEQ ID NO: 5372382 - DNA, 15 bp, Homo sapiens
atcttataaactgac

SEQ ID NO: 5372383 - DNA, 18 bp, Homo sapiens
atcttataactgttttag

SEQ ID NO: 5372384 - DNA, 15 bp, Homo sapiens
atcttataatttaaa

SEQ ID NO: 5372385 - DNA, 12 bp, Homo sapiens
atcttatacaac

SEQ ID NO: 5372386 - DNA, 13 bp, Homo sapiens
atcttatactgta

SEQ ID NO: 5372387 - DNA, 17 bp, Homo sapiens
atcttatactgtacaat

SEQ ID NO: 5372388 - DNA, 12 bp, Homo sapiens
atcttatattgg

SEQ ID NO: 5372389 - DNA, 15 bp, Homo sapiens
atcttatattggttt

SEQ ID NO: 5372390 - DNA, 22 bp, Homo sapiens
atcttatcaagagttgtgacaa

SEQ ID NO: 5372391 - DNA, 16 bp, Homo sapiens
atcttatcatttatca

SEQ ID NO: 5372392 - DNA, 19 bp, Homo sapiens
atcttatctcagatatttg

SEQ ID NO: 5372393 - DNA, 20 bp, Homo sapiens
atcttatctcagatatttgc

SEQ ID NO: 5372394 - DNA, 21 bp, Homo sapiens
atcttatctcagatatttgca

SEQ ID NO: 5372395 - DNA, 18 bp, Homo sapiens
atcttatgaataagcact

SEQ ID NO: 5372396 - DNA, 18 bp, Homo sapiens
atcttatgcaaaactttt

SEQ ID NO: 5372397 - DNA, 20 bp, Homo sapiens
atcttattaaagtttcaaaa

SEQ ID NO: 5372398 - DNA, 14 bp, Homo sapiens
atcttattataaaa

SEQ ID NO: 5372399 - DNA, 19 bp, Homo sapiens
atcttattcccaattaaaa

SEQ ID NO: 5372400 - DNA, 18 bp, Homo sapiens
atcttattccgagcattc

SEQ ID NO: 5372401 - DNA, 13 bp, Homo sapiens
atcttattgcttg

SEQ ID NO: 5372402 - DNA, 12 bp, Homo sapiens
atcttatttata

SEQ ID NO: 5372403 - DNA, 13 bp, Homo sapiens
atcttatttatat

SEQ ID NO: 5372404 - DNA, 17 bp, Homo sapiens
atcttatttatatatga

SEQ ID NO: 5372405 - DNA, 12 bp, Homo sapiens
atcttatttatt

SEQ ID NO: 5372406 - DNA, 20 bp, Homo sapiens
atcttatttattttagcaaa

SEQ ID NO: 5372407 - DNA, 15 bp, Homo sapiens
atcttattttatctt

SEQ ID NO: 5372408 - DNA, 18 bp, Homo sapiens
atcttatttttcctgtcc

SEQ ID NO: 5372409 - DNA, 17 bp, Homo sapiens
atcttatttttctaaac

SEQ ID NO: 5372410 - DNA, 21 bp, Homo sapiens
atcttatttttctaaacgtaa

SEQ ID NO: 5372411 - DNA, 12 bp, Homo sapiens
atcttcaaaaat

SEQ ID NO: 5372412 - DNA, 15 bp, Homo sapiens
atcttcaaaaataca

SEQ ID NO: 5372413 - DNA, 24 bp, Homo sapiens
atcttcaaaagtaatgcctctgtc

SEQ ID NO: 5372414 - DNA, 19 bp, Homo sapiens
atcttcaaagcttgaagat

SEQ ID NO: 5372415 - DNA, 14 bp, Homo sapiens
atcttcaaggtttg

SEQ ID NO: 5372416 - DNA, 20 bp, Homo sapiens
atcttcaatatgaatctata

SEQ ID NO: 5372417 - DNA, 16 bp, Homo sapiens
atcttcacaagtgtgt

SEQ ID NO: 5372418 - DNA, 19 bp, Homo sapiens
atcttcacatagttctcca

SEQ ID NO: 5372419 - DNA, 15 bp, Homo sapiens
atcttcacattgtgt

SEQ ID NO: 5372420 - DNA, 21 bp, Homo sapiens
atcttcaccagaggaatcact

SEQ ID NO: 5372421 - DNA, 19 bp, Homo sapiens
atcttcacccaggcctatg

SEQ ID NO: 5372422 - DNA, 22 bp, Homo sapiens
atcttcaccctgtaatggttgg

SEQ ID NO: 5372423 - DNA, 18 bp, Homo sapiens
atcttcacctctattctt

SEQ ID NO: 5372424 - DNA, 15 bp, Homo sapiens
atcttcacgacaatg

SEQ ID NO: 5372425 - DNA, 23 bp, Homo sapiens
atcttcacgacaatgttgagaag

SEQ ID NO: 5372426 - DNA, 14 bp, Homo sapiens
atcttcactagaag

SEQ ID NO: 5372427 - DNA, 16 bp, Homo sapiens
atcttcactgaatatc

SEQ ID NO: 5372428 - DNA, 18 bp, Homo sapiens
atcttcactgaatatcat

SEQ ID NO: 5372429 - DNA, 19 bp, Homo sapiens
atcttcactgaatatcata

SEQ ID NO: 5372430 - DNA, 14 bp, Homo sapiens
atcttcactggctt

SEQ ID NO: 5372431 - DNA, 14 bp, Homo sapiens
atcttcactgtata

SEQ ID NO: 5372432 - DNA, 15 bp, Homo sapiens
atcttcactgtatat

SEQ ID NO: 5372433 - DNA, 16 bp, Homo sapiens
atcttcagaactgccc

SEQ ID NO: 5372434 - DNA, 14 bp, Homo sapiens
atcttcagagcagg

SEQ ID NO: 5372435 - DNA, 16 bp, Homo sapiens
atcttcagctcccata

SEQ ID NO: 5372436 - DNA, 13 bp, Homo sapiens
atcttcagctggt

SEQ ID NO: 5372437 - DNA, 14 bp, Homo sapiens
atcttcagcttctt

SEQ ID NO: 5372438 - DNA, 14 bp, Homo sapiens
atctttgcactcca

SEQ ID NO: 5372439 - DNA, 14 bp, Homo sapiens
atctttgccaagta

SEQ ID NO: 5372440 - DNA, 16 bp, Homo sapiens
atctttgccaccctca

SEQ ID NO: 5372441 - DNA, 22 bp, Homo sapiens
atctttgccttgggctgctcct

SEQ ID NO: 5372442 - DNA, 14 bp, Homo sapiens
atctttgcgaaaag

SEQ ID NO: 5372443 - DNA, 20 bp, Homo sapiens
atctttgcgaaaagataaac

SEQ ID NO: 5372444 - DNA, 15 bp, Homo sapiens
atctttgctgaagaa

SEQ ID NO: 5372445 - DNA, 14 bp, Homo sapiens
atctttgctgcaga

SEQ ID NO: 5372446 - DNA, 17 bp, Homo sapiens
atctttggcatgattta

SEQ ID NO: 5372447 - DNA, 21 bp, Homo sapiens
atctttgggacacctcagaaa

SEQ ID NO: 5372448 - DNA, 22 bp, Homo sapiens
atctttggttatcctgtttgaa

SEQ ID NO: 5372449 - DNA, 16 bp, Homo sapiens
atctttgtaaattatt

SEQ ID NO: 5372450 - DNA, 12 bp, Homo sapiens
atctttgtattc

SEQ ID NO: 5372451 - DNA, 21 bp, Homo sapiens
atctttgtattcttcatgaaa

SEQ ID NO: 5372452 - DNA, 16 bp, Homo sapiens
atctttgtctaaacaa

SEQ ID NO: 5372453 - DNA, 15 bp, Homo sapiens
atctttgtgaacatt

SEQ ID NO: 5372454 - DNA, 16 bp, Homo sapiens
atctttgtgaacattc

SEQ ID NO: 5372455 - DNA, 17 bp, Homo sapiens
atctttgtgaaggcctc

SEQ ID NO: 5372456 - DNA, 14 bp, Homo sapiens
atctttgtgacagg

SEQ ID NO: 5372457 - DNA, 14 bp, Homo sapiens
atctttgtgataat

SEQ ID NO: 5372458 - DNA, 12 bp, Homo sapiens
atctttgtgtaa

SEQ ID NO: 5372459 - DNA, 19 bp, Homo sapiens
atctttgttacttccttat

SEQ ID NO: 5372460 - DNA, 18 bp, Homo sapiens
atctttgttgaagtttga

SEQ ID NO: 5372461 - DNA, 19 bp, Homo sapiens
atctttgttggctcagaaa

SEQ ID NO: 5372462 - DNA, 20 bp, Homo sapiens
atctttgttggctcagaaaa

SEQ ID NO: 5372463 - DNA, 16 bp, Homo sapiens
atctttgttttaacca

SEQ ID NO: 5372464 - DNA, 16 bp, Homo sapiens
atcttttaaaaatgat

SEQ ID NO: 5372465 - DNA, 22 bp, Homo sapiens
atcttttaaaatgaaatgtttt

SEQ ID NO: 5372466 - DNA, 16 bp, Homo sapiens
atcttttaatcatgag

SEQ ID NO: 5372467 - DNA, 19 bp, Homo sapiens
atcttttaatcatgagcct

SEQ ID NO: 5372468 - DNA, 19 bp, Homo sapiens
atcttttaattacagaaga

SEQ ID NO: 5372469 - DNA, 20 bp, Homo sapiens
atcttttaattcacctcttc

SEQ ID NO: 5372470 - DNA, 13 bp, Homo sapiens
atcttttactgtg

SEQ ID NO: 5372471 - DNA, 14 bp, Homo sapiens
atcttttacttttt

SEQ ID NO: 5372472 - DNA, 22 bp, Homo sapiens
atcttttactttttttctgtga

SEQ ID NO: 5372473 - DNA, 23 bp, Homo sapiens
atcttttagagtaaactattcta

SEQ ID NO: 5372474 - DNA, 18 bp, Homo sapiens
atcttttatcctgggagc

SEQ ID NO: 5372475 - DNA, 17 bp, Homo sapiens
atcttttatgtttgaat

SEQ ID NO: 5372476 - DNA, 20 bp, Homo sapiens
atcttttatgtttgaatatg

SEQ ID NO: 5372477 - DNA, 21 bp, Homo sapiens
atcttttatgtttgaatatgg

SEQ ID NO: 5372478 - DNA, 13 bp, Homo sapiens
atcttttattctt

SEQ ID NO: 5372479 - DNA, 14 bp, Homo sapiens
atcttttattcttt

SEQ ID NO: 5372480 - DNA, 13 bp, Homo sapiens
atcttttatttca

SEQ ID NO: 5372481 - DNA, 15 bp, Homo sapiens
atcttttattttgga

SEQ ID NO: 5372482 - DNA, 17 bp, Homo sapiens
atcttttattttggaac

SEQ ID NO: 5372483 - DNA, 15 bp, Homo sapiens
atcttttcacaaata

SEQ ID NO: 5372484 - DNA, 15 bp, Homo sapiens
atcttttcatctcat

SEQ ID NO: 5372485 - DNA, 13 bp, Homo sapiens
atcttttcattct

SEQ ID NO: 5372486 - DNA, 17 bp, Homo sapiens
atcttttccatcctgag

SEQ ID NO: 5372487 - DNA, 20 bp, Homo sapiens
atcttttcctcccattttag

SEQ ID NO: 5372488 - DNA, 12 bp, Homo sapiens
atcttttcctgc

SEQ ID NO: 5372489 - DNA, 19 bp, Homo sapiens
atcttttctaatcacagtg

SEQ ID NO: 5372490 - DNA, 21 bp, Homo sapiens
atcttttctaatcacagtgtt

SEQ ID NO: 5372491 - DNA, 12 bp, Homo sapiens
atcttttctaca

SEQ ID NO: 5372492 - DNA, 15 bp, Homo sapiens
atcttttctacagca

SEQ ID NO: 5372493 - DNA, 22 bp, Homo sapiens
atcttttctacagcaaatttat

SEQ ID NO: 5372494 - DNA, 15 bp, Homo sapiens
atcttttctggatga

SEQ ID NO: 5372495 - DNA, 23 bp, Homo sapiens
atcttttcttgcctctgtcccct

SEQ ID NO: 5372496 - DNA, 13 bp, Homo sapiens
atcttttctttaa

SEQ ID NO: 5372497 - DNA, 18 bp, Homo sapiens
atcttttctttagagaac

SEQ ID NO: 5372498 - DNA, 19 bp, Homo sapiens
atcttttctttagagaact

SEQ ID NO: 5372499 - DNA, 23 bp, Homo sapiens
atcttttctttagagaactgaaa

SEQ ID NO: 5372500 - DNA, 17 bp, Homo sapiens
atcttttgaaacagatt

SEQ ID NO: 5372501 - DNA, 11 bp, Homo sapiens
atcttttgaac

SEQ ID NO: 5372502 - DNA, 13 bp, Homo sapiens
atcttttgaagag

SEQ ID NO: 5372503 - DNA, 16 bp, Homo sapiens
atcttttgaagcatag

SEQ ID NO: 5372504 - DNA, 17 bp, Homo sapiens
atcttttgaagcataga

SEQ ID NO: 5372505 - DNA, 21 bp, Homo sapiens
atcttttgaagggagaagaca

SEQ ID NO: 5372506 - DNA, 13 bp, Homo sapiens
atcttttgagaac

SEQ ID NO: 5372507 - DNA, 17 bp, Homo sapiens
atcttttggacctggct

SEQ ID NO: 5372508 - DNA, 14 bp, Homo sapiens
atcttttggctctg

SEQ ID NO: 5372509 - DNA, 17 bp, Homo sapiens
atcttttggctctgaag

SEQ ID NO: 5372510 - DNA, 14 bp, Homo sapiens
atcttttggcttct

SEQ ID NO: 5372511 - DNA, 20 bp, Homo sapiens
atcttttggggtcatctttg

SEQ ID NO: 5372512 - DNA, 21 bp, Homo sapiens
atcttttgtaagacatttcct

SEQ ID NO: 5372513 - DNA, 14 bp, Homo sapiens
atcttttgtatatc

SEQ ID NO: 5372514 - DNA, 14 bp, Homo sapiens
atcttttgtgagat

SEQ ID NO: 5372515 - DNA, 16 bp, Homo sapiens
atcttttgttcccatc

SEQ ID NO: 5372516 - DNA, 19 bp, Homo sapiens
atctttttaaaaactcttc

SEQ ID NO: 5372517 - DNA, 21 bp, Homo sapiens
atctttttaaaaactcttcag

SEQ ID NO: 5372518 - DNA, 22 bp, Homo sapiens
atctttttaaaaactcttcagt

SEQ ID NO: 5372519 - DNA, 19 bp, Homo sapiens
atctttttaacctctgttc

SEQ ID NO: 5372520 - DNA, 18 bp, Homo sapiens
atctttttacagttgcat

SEQ ID NO: 5372521 - DNA, 15 bp, Homo sapiens
atctttttatacaca

SEQ ID NO: 5372522 - DNA, 14 bp, Homo sapiens
atctttttatattc

SEQ ID NO: 5372523 - DNA, 19 bp, Homo sapiens
atctttttatcatgatcct

SEQ ID NO: 5372524 - DNA, 22 bp, Homo sapiens
atctttttatcccatttagtgt

SEQ ID NO: 5372525 - DNA, 23 bp, Homo sapiens
atctttttatcccatttagtgtg

SEQ ID NO: 5372526 - DNA, 19 bp, Homo sapiens
atctttttattgatgtgca

SEQ ID NO: 5372527 - DNA, 13 bp, Homo sapiens
atctttttcatta

SEQ ID NO: 5372528 - DNA, 14 bp, Homo sapiens
atctttttctccac

SEQ ID NO: 5372529 - DNA, 14 bp, Homo sapiens
atctttttctctaa

SEQ ID NO: 5372530 - DNA, 18 bp, Homo sapiens
atctttttgaaagcaata

SEQ ID NO: 5372531 - DNA, 17 bp, Homo sapiens
atctttttgaccctcat

SEQ ID NO: 5372532 - DNA, 15 bp, Homo sapiens
atctttttgcttcta

SEQ ID NO: 5372533 - DNA, 17 bp, Homo sapiens
atctttttgcttctact

SEQ ID NO: 5372534 - DNA, 18 bp, Homo sapiens
atcttttttaaactgtaa

SEQ ID NO: 5372535 - DNA, 21 bp, Homo sapiens
atcttttttaaactgtaaagt

SEQ ID NO: 5372536 - DNA, 15 bp, Homo sapiens
atcttttttaaatga

SEQ ID NO: 5372537 - DNA, 16 bp, Homo sapiens
atcttttttagcataa

SEQ ID NO: 5372538 - DNA, 18 bp, Homo sapiens
atcttttttagtgttaaa

SEQ ID NO: 5372539 - DNA, 14 bp, Homo sapiens
atcttttttcacaa

SEQ ID NO: 5372540 - DNA, 20 bp, Homo sapiens
atcttttttcctagtttttc

SEQ ID NO: 5372541 - DNA, 21 bp, Homo sapiens
atcttttttggaactaaagca

SEQ ID NO: 5372542 - DNA, 15 bp, Homo sapiens
atctttttttaagtg

SEQ ID NO: 5372543 - DNA, 21 bp, Homo sapiens
atcttttttttaggcaaaacc

SEQ ID NO: 5372544 - DNA, 22 bp, Homo sapiens
atcttttttttatataaatata

SEQ ID NO: 5372545 - DNA, 14 bp, Homo sapiens
atgaaaaaatatat

SEQ ID NO: 5372546 - DNA, 19 bp, Homo sapiens
atgaaaaaatgttcaaatt

SEQ ID NO: 5372547 - DNA, 18 bp, Homo sapiens
atgaaaaacaaaaagcta

SEQ ID NO: 5372548 - DNA, 20 bp, Homo sapiens
atgaaaaacacggcagctgt

SEQ ID NO: 5372549 - DNA, 11 bp, Homo sapiens
atgaaaaacat

SEQ ID NO: 5372550 - DNA, 17 bp, Homo sapiens
atgaaaaacatcccaaa

SEQ ID NO: 5372551 - DNA, 20 bp, Homo sapiens
atgaaaaacatcccaaactt

SEQ ID NO: 5372552 - DNA, 21 bp, Homo sapiens
atgaaaaacatcccaaacttt

SEQ ID NO: 5372553 - DNA, 13 bp, Homo sapiens
atgaaaaaccatt

SEQ ID NO: 5372554 - DNA, 16 bp, Homo sapiens
atgaaaaagcatgtac

SEQ ID NO: 5372555 - DNA, 19 bp, Homo sapiens
atgaaaaagcatgtacagt

SEQ ID NO: 5372556 - DNA, 16 bp, Homo sapiens
atgaaaaagctgcttc

SEQ ID NO: 5372557 - DNA, 13 bp, Homo sapiens
atgaaaaatacat

SEQ ID NO: 5372558 - DNA, 19 bp, Homo sapiens
atgaaaaatagtgtctttg

SEQ ID NO: 5372559 - DNA, 20 bp, Homo sapiens
atgaaaaatagtgtctttgt

SEQ ID NO: 5372560 - DNA, 21 bp, Homo sapiens
atgaaaaatagtgtgtccatg

SEQ ID NO: 5372561 - DNA, 13 bp, Homo sapiens
atgaaaaatatga

SEQ ID NO: 5372562 - DNA, 17 bp, Homo sapiens
atgaaaaatctgaattt

SEQ ID NO: 5372563 - DNA, 16 bp, Homo sapiens
atgaaaaatgaaagat

SEQ ID NO: 5372564 - DNA, 13 bp, Homo sapiens
atgaaaaattctc

SEQ ID NO: 5372565 - DNA, 18 bp, Homo sapiens
atgaaaaattggggagga

SEQ ID NO: 5372566 - DNA, 16 bp, Homo sapiens
atgaaaaatttaagca

SEQ ID NO: 5372567 - DNA, 21 bp, Homo sapiens
atgaaaaatttaagcattgtt

SEQ ID NO: 5372568 - DNA, 11 bp, Homo sapiens
atgaaaacaag

SEQ ID NO: 5372569 - DNA, 12 bp, Homo sapiens
atgaaaacactc

SEQ ID NO: 5372570 - DNA, 19 bp, Homo sapiens
atgaaaacagaatgtctct

SEQ ID NO: 5372571 - DNA, 17 bp, Homo sapiens
atgaaaacagtgtgtaa

SEQ ID NO: 5372572 - DNA, 17 bp, Homo sapiens
atgaaaacatggaacag

SEQ ID NO: 5372573 - DNA, 19 bp, Homo sapiens
atgaaaacatgtactacag

SEQ ID NO: 5372574 - DNA, 15 bp, Homo sapiens
atgaaaacattgatg

SEQ ID NO: 5372575 - DNA, 22 bp, Homo sapiens
atgaaaacattttatttttaaa

SEQ ID NO: 5372576 - DNA, 19 bp, Homo sapiens
atgaaaaccaccctatcat

SEQ ID NO: 5372577 - DNA, 23 bp, Homo sapiens
atgaaaactagcattacattatt

SEQ ID NO: 5372578 - DNA, 15 bp, Homo sapiens
atgaaaactatacaa

SEQ ID NO: 5372579 - DNA, 12 bp, Homo sapiens
atgaaaacttat

SEQ ID NO: 5372580 - DNA, 17 bp, Homo sapiens
atgaaaacttttgtaaa

SEQ ID NO: 5372581 - DNA, 18 bp, Homo sapiens
atgaaaacttttgtaaat

SEQ ID NO: 5372582 - DNA, 16 bp, Homo sapiens
atgaaaactttttaat

SEQ ID NO: 5372583 - DNA, 14 bp, Homo sapiens
atgaaaagaataaa

SEQ ID NO: 5372584 - DNA, 18 bp, Homo sapiens
atgaaaagacaagaaaat

SEQ ID NO: 5372585 - DNA, 12 bp, Homo sapiens
atgaaaagagaa

SEQ ID NO: 5372586 - DNA, 17 bp, Homo sapiens
atgaaaagcctctgttt

SEQ ID NO: 5372587 - DNA, 13 bp, Homo sapiens
atgaaaagctaga

SEQ ID NO: 5372588 - DNA, 18 bp, Homo sapiens
atgaaaagctatcttaaa

SEQ ID NO: 5372589 - DNA, 22 bp, Homo sapiens
atgaaaagctatcttaaaatat

SEQ ID NO: 5372590 - DNA, 19 bp, Homo sapiens
atgaaaaggagagattaaa

SEQ ID NO: 5372591 - DNA, 21 bp, Homo sapiens
atgaaaaggcagcatttgaat

SEQ ID NO: 5372592 - DNA, 18 bp, Homo sapiens
atgaaaaggtgattgtca

SEQ ID NO: 5372593 - DNA, 22 bp, Homo sapiens
atgaaaagtacatgttgatact

SEQ ID NO: 5372594 - DNA, 14 bp, Homo sapiens
atgaaaagttttca

SEQ ID NO: 5372595 - DNA, 16 bp, Homo sapiens
atgaaaataaaataaa

SEQ ID NO: 5372596 - DNA, 17 bp, Homo sapiens
atgaaaataaagaatgg

SEQ ID NO: 5372597 - DNA, 16 bp, Homo sapiens
atgaaaataaatagct

SEQ ID NO: 5372598 - DNA, 13 bp, Homo sapiens
atgaaaataactg

SEQ ID NO: 5372599 - DNA, 14 bp, Homo sapiens
atgaaaataactga

SEQ ID NO: 5372600 - DNA, 19 bp, Homo sapiens
atgaaaataactgaatttg

SEQ ID NO: 5372601 - DNA, 19 bp, Homo sapiens
atgaaaataatctctgatt

SEQ ID NO: 5372602 - DNA, 15 bp, Homo sapiens
atgaaaataattttc

SEQ ID NO: 5372603 - DNA, 18 bp, Homo sapiens
atgaaaataattttccaa

SEQ ID NO: 5372604 - DNA, 22 bp, Homo sapiens
atgaaaatacaacttaaataat

SEQ ID NO: 5372605 - DNA, 23 bp, Homo sapiens
atgaaaataccataggaagacat

SEQ ID NO: 5372606 - DNA, 14 bp, Homo sapiens
atgaaaataccatt

SEQ ID NO: 5372607 - DNA, 17 bp, Homo sapiens
atgaaaatcagcaactt

SEQ ID NO: 5372608 - DNA, 12 bp, Homo sapiens
atgaaaatcctt

SEQ ID NO: 5372609 - DNA, 16 bp, Homo sapiens
atgaaaatccttttaa

SEQ ID NO: 5372610 - DNA, 12 bp, Homo sapiens
atgaaaatctta

SEQ ID NO: 5372611 - DNA, 13 bp, Homo sapiens
atgaaaatgaata

SEQ ID NO: 5372612 - DNA, 14 bp, Homo sapiens
atgaaaatgagccc

SEQ ID NO: 5372613 - DNA, 16 bp, Homo sapiens
atgaaaatgagccctg

SEQ ID NO: 5372614 - DNA, 21 bp, Homo sapiens
atgaaaatgagttgtgaaagt

SEQ ID NO: 5372615 - DNA, 22 bp, Homo sapiens
atgaaaatggctgaagaaacac

SEQ ID NO: 5372616 - DNA, 14 bp, Homo sapiens
atgaaaatgtattc

SEQ ID NO: 5372617 - DNA, 19 bp, Homo sapiens
atgaactagagactctgtg

SEQ ID NO: 5372618 - DNA, 20 bp, Homo sapiens
atgaactagagactctgtga

SEQ ID NO: 5372619 - DNA, 17 bp, Homo sapiens
atgaactatatgactgg

SEQ ID NO: 5372620 - DNA, 14 bp, Homo sapiens
atgaactcaacttt

SEQ ID NO: 5372621 - DNA, 22 bp, Homo sapiens
atgaactcaatctaaattaaaa

SEQ ID NO: 5372622 - DNA, 14 bp, Homo sapiens
atgaactcaatgca

SEQ ID NO: 5372623 - DNA, 17 bp, Homo sapiens
atgaactcaatgcatga

SEQ ID NO: 5372624 - DNA, 22 bp, Homo sapiens
atgaactcaatgcatgatgact

SEQ ID NO: 5372625 - DNA, 22 bp, Homo sapiens
atgaactcagctattaagaaaa

SEQ ID NO: 5372626 - DNA, 16 bp, Homo sapiens
atgaactcttaatcaa

SEQ ID NO: 5372627 - DNA, 12 bp, Homo sapiens
atgaactgaaag

SEQ ID NO: 5372628 - DNA, 14 bp, Homo sapiens
atgaactgaagttt

SEQ ID NO: 5372629 - DNA, 16 bp, Homo sapiens
atgaactgaagtttca

SEQ ID NO: 5372630 - DNA, 21 bp, Homo sapiens
atgaactgcatcaagacttca

SEQ ID NO: 5372631 - DNA, 22 bp, Homo sapiens
atgaactgcatcaagacttcaa

SEQ ID NO: 5372632 - DNA, 18 bp, Homo sapiens
atgaactgcatgtataaa

SEQ ID NO: 5372633 - DNA, 23 bp, Homo sapiens
atgaactgcttttcctcaagcaa

SEQ ID NO: 5372634 - DNA, 12 bp, Homo sapiens
atgaactggctt

SEQ ID NO: 5372635 - DNA, 17 bp, Homo sapiens
atgaactggcttgtaca

SEQ ID NO: 5372636 - DNA, 15 bp, Homo sapiens
atgaactgtaaatgc

SEQ ID NO: 5372637 - DNA, 19 bp, Homo sapiens
atgaactgtatattattgc

SEQ ID NO: 5372638 - DNA, 14 bp, Homo sapiens
atgaactgtgacag

SEQ ID NO: 5372639 - DNA, 17 bp, Homo sapiens
atgaactgtggaattta

SEQ ID NO: 5372640 - DNA, 11 bp, Homo sapiens
atgaactgtgt

SEQ ID NO: 5372641 - DNA, 12 bp, Homo sapiens
atgaacttagat

SEQ ID NO: 5372642 - DNA, 16 bp, Homo sapiens
atgaacttccatttgt

SEQ ID NO: 5372643 - DNA, 20 bp, Homo sapiens
atgaacttcgcatcaaaaga

SEQ ID NO: 5372644 - DNA, 23 bp, Homo sapiens
atgaacttcgcatcaaaagacaa

SEQ ID NO: 5372645 - DNA, 23 bp, Homo sapiens
atgaacttgagctctgtaactta

SEQ ID NO: 5372646 - DNA, 13 bp, Homo sapiens
atgaacttgagga

SEQ ID NO: 5372647 - DNA, 15 bp, Homo sapiens
atgaacttgaggaca

SEQ ID NO: 5372648 - DNA, 17 bp, Homo sapiens
atgaacttgaggacaca

SEQ ID NO: 5372649 - DNA, 18 bp, Homo sapiens
atgaacttgtaaaggaat

SEQ ID NO: 5372650 - DNA, 14 bp, Homo sapiens
atgaacttgttact

SEQ ID NO: 5372651 - DNA, 21 bp, Homo sapiens
atgaacttgttacttgcagca

SEQ ID NO: 5372652 - DNA, 13 bp, Homo sapiens
atgaactttgtca

SEQ ID NO: 5372653 - DNA, 14 bp, Homo sapiens
atgaactttgtcat

SEQ ID NO: 5372654 - DNA, 21 bp, Homo sapiens
atgaactttgtcattatgatt

SEQ ID NO: 5372655 - DNA, 20 bp, Homo sapiens
atgaacttttacagaatgca

SEQ ID NO: 5372656 - DNA, 16 bp, Homo sapiens
atgaactttttcctgg

SEQ ID NO: 5372657 - DNA, 14 bp, Homo sapiens
atgaagaaaaagta

SEQ ID NO: 5372658 - DNA, 21 bp, Homo sapiens
atgaagaaaatacttaaatgt

SEQ ID NO: 5372659 - DNA, 19 bp, Homo sapiens
atgaagaaagagactgtgg

SEQ ID NO: 5372660 - DNA, 18 bp, Homo sapiens
atgaagaacacagcatgt

SEQ ID NO: 5372661 - DNA, 15 bp, Homo sapiens
atgaagaacataaaa

SEQ ID NO: 5372662 - DNA, 15 bp, Homo sapiens
atgaagaacatctgg

SEQ ID NO: 5372663 - DNA, 14 bp, Homo sapiens
atgaagaactgagg

SEQ ID NO: 5372664 - DNA, 21 bp, Homo sapiens
atgaagaagaaaacatgtctg

SEQ ID NO: 5372665 - DNA, 19 bp, Homo sapiens
atgaagaagacaaagtcta

SEQ ID NO: 5372666 - DNA, 14 bp, Homo sapiens
atgaagaaggaagc

SEQ ID NO: 5372667 - DNA, 17 bp, Homo sapiens
atgaagaaggaagctgt

SEQ ID NO: 5372668 - DNA, 23 bp, Homo sapiens
atgaagaaggaagctgtgttgaa

SEQ ID NO: 5372669 - DNA, 15 bp, Homo sapiens
atgaagaagtttcta

SEQ ID NO: 5372670 - DNA, 20 bp, Homo sapiens
atgaagaatacccaggaaga

SEQ ID NO: 5372671 - DNA, 19 bp, Homo sapiens
atgaagaatcacgatttca

SEQ ID NO: 5372672 - DNA, 12 bp, Homo sapiens
atgaagaatgca

SEQ ID NO: 5372673 - DNA, 22 bp, Homo sapiens
atgaagaatgcattcaaaatat

SEQ ID NO: 5372674 - DNA, 15 bp, Homo sapiens
atgaagaattatgta

SEQ ID NO: 5372675 - DNA, 17 bp, Homo sapiens
atgaagaattatgtaat

SEQ ID NO: 5372676 - DNA, 13 bp, Homo sapiens
atgaagaatttaa

SEQ ID NO: 5372677 - DNA, 15 bp, Homo sapiens
atgaagacagaggca

SEQ ID NO: 5372678 - DNA, 20 bp, Homo sapiens
atgaagacagaggcagagat

SEQ ID NO: 5372679 - DNA, 21 bp, Homo sapiens
atgaagacctaaatgacctca

SEQ ID NO: 5372680 - DNA, 24 bp, Homo sapiens
atgaagacctttttctgcactata

SEQ ID NO: 5372681 - DNA, 14 bp, Homo sapiens
atgaagacttaaaa

SEQ ID NO: 5372682 - DNA, 16 bp, Homo sapiens
atgaagacttaaaaga

SEQ ID NO: 5372683 - DNA, 22 bp, Homo sapiens
atgaagacttaaaagagctcag

SEQ ID NO: 5372684 - DNA, 23 bp, Homo sapiens
atgaagacttaactggcccagaa

SEQ ID NO: 5372685 - DNA, 14 bp, Homo sapiens
atgaagagaagctg

SEQ ID NO: 5372686 - DNA, 21 bp, Homo sapiens
atgaagagaagctgagaagaa

SEQ ID NO: 5372687 - DNA, 18 bp, Homo sapiens
atgaagagactctcttag

SEQ ID NO: 5372688 - DNA, 18 bp, Homo sapiens
atgaagagacttaagaaa

SEQ ID NO: 5372689 - DNA, 17 bp, Homo sapiens
atgaagagctagagaaa

SEQ ID NO: 5372690 - DNA, 22 bp, Homo sapiens
atgaagagctgtcttcccctga

SEQ ID NO: 5372691 - DNA, 24 bp, Homo sapiens
atgaagaggagattggccagtgag

SEQ ID NO: 5372692 - DNA, 15 bp, Homo sapiens
atgaagagtattaat

SEQ ID NO: 5372693 - DNA, 13 bp, Homo sapiens
atgaagagttgtt

SEQ ID NO: 5372694 - DNA, 14 bp, Homo sapiens
atgaagagttgttt

SEQ ID NO: 5372695 - DNA, 14 bp, Homo sapiens
atgaagataaatgc

SEQ ID NO: 5372696 - DNA, 15 bp, Homo sapiens
atgaagatacacatt

SEQ ID NO: 5372697 - DNA, 16 bp, Homo sapiens
atgaagatacacatta

SEQ ID NO: 5372698 - DNA, 16 bp, Homo sapiens
atgaagatactgaaat

SEQ ID NO: 5372699 - DNA, 22 bp, Homo sapiens
atgaagatatttgctttaataa

SEQ ID NO: 5372700 - DNA, 20 bp, Homo sapiens
atgaagatcatatacgtgaa

SEQ ID NO: 5372701 - DNA, 22 bp, Homo sapiens
atgaagatcggctttcatgtaa

SEQ ID NO: 5372702 - DNA, 22 bp, Homo sapiens
atgaagatctaaataaaatgct

SEQ ID NO: 5372703 - DNA, 19 bp, Homo sapiens
atgaagatctttatatttc

SEQ ID NO: 5372704 - DNA, 22 bp, Homo sapiens
atgaagatgcattttaaatgtc

SEQ ID NO: 5372705 - DNA, 23 bp, Homo sapiens
atgaagatgcattttaaatgtct

SEQ ID NO: 5372706 - DNA, 18 bp, Homo sapiens
atgaagatgtttttagag

SEQ ID NO: 5372707 - DNA, 22 bp, Homo sapiens
atgaagattctcctgtgctaga

SEQ ID NO: 5372708 - DNA, 21 bp, Homo sapiens
atgaagcaaatgtcatgctgc

SEQ ID NO: 5372709 - DNA, 20 bp, Homo sapiens
atgaagcaacgataaaatta

SEQ ID NO: 5372710 - DNA, 13 bp, Homo sapiens
atgaagcaagaat

SEQ ID NO: 5372711 - DNA, 15 bp, Homo sapiens
atgaagcaagctgtg

SEQ ID NO: 5372712 - DNA, 16 bp, Homo sapiens
atgaagcaagctgtgt

SEQ ID NO: 5372713 - DNA, 21 bp, Homo sapiens
atgaagcaagctgtgttactt

SEQ ID NO: 5372714 - DNA, 22 bp, Homo sapiens
atgaagcaagctgtgttacttg

SEQ ID NO: 5372715 - DNA, 23 bp, Homo sapiens
atgaagcaagctgtgttacttga

SEQ ID NO: 5372716 - DNA, 14 bp, Homo sapiens
atgaagcaatgctt

SEQ ID NO: 5372717 - DNA, 15 bp, Homo sapiens
atgaagcaatgcttc

SEQ ID NO: 5372718 - DNA, 17 bp, Homo sapiens
atgaagcaattagtctg

SEQ ID NO: 5372719 - DNA, 23 bp, Homo sapiens
atgaagcaattagtctgaaactg

SEQ ID NO: 5372720 - DNA, 15 bp, Homo sapiens
atgaagcaatttata

SEQ ID NO: 5372721 - DNA, 17 bp, Homo sapiens
atgaagcaatttatatc

SEQ ID NO: 5372722 - DNA, 22 bp, Homo sapiens
atgaagcagaaccttctttggt

SEQ ID NO: 5372723 - DNA, 13 bp, Homo sapiens
atgaagcagcttt

SEQ ID NO: 5372724 - DNA, 22 bp, Homo sapiens
atgaagcagctttaaacaaatt

SEQ ID NO: 5372725 - DNA, 17 bp, Homo sapiens
atgaagccaactgacaa

SEQ ID NO: 5372726 - DNA, 17 bp, Homo sapiens
atgaagccacagcccag

SEQ ID NO: 5372727 - DNA, 18 bp, Homo sapiens
atgaagccgaccttagat

SEQ ID NO: 5372728 - DNA, 15 bp, Homo sapiens
atgaagcctgtgcca

SEQ ID NO: 5372729 - DNA, 20 bp, Homo sapiens
atgaagcctgtgccacctgc

SEQ ID NO: 5372730 - DNA, 22 bp, Homo sapiens
atgaagcctgtggatgatcaat

SEQ ID NO: 5372731 - DNA, 16 bp, Homo sapiens
atgaagccttagccag

SEQ ID NO: 5372732 - DNA, 15 bp, Homo sapiens
atgaagccttctgac

SEQ ID NO: 5372733 - DNA, 12 bp, Homo sapiens
atgaagcctttg

SEQ ID NO: 5372734 - DNA, 22 bp, Homo sapiens
atgaagctaataaaattcgctt

SEQ ID NO: 5372735 - DNA, 23 bp, Homo sapiens
atgaagctcacctgttgcttaca

SEQ ID NO: 5372736 - DNA, 16 bp, Homo sapiens
atgaagctctggccaa

SEQ ID NO: 5372737 - DNA, 14 bp, Homo sapiens
atgaagctgaggct

SEQ ID NO: 5372738 - DNA, 16 bp, Homo sapiens
atgaagctgaggctgc

SEQ ID NO: 5372739 - DNA, 22 bp, Homo sapiens
atgaagctgccatccttgctgc

SEQ ID NO: 5372740 - DNA, 17 bp, Homo sapiens
atgaagctggccctcag

SEQ ID NO: 5372741 - DNA, 13 bp, Homo sapiens
atgaagctgttgt

SEQ ID NO: 5372742 - DNA, 23 bp, Homo sapiens
atgaagctgtttttgtgctcttt

SEQ ID NO: 5372743 - DNA, 23 bp, Homo sapiens
atgaagcttggaggtcacagctg

SEQ ID NO: 5372744 - DNA, 18 bp, Homo sapiens
atgaagcttgtgtatcca

SEQ ID NO: 5372745 - DNA, 18 bp, Homo sapiens
atgaagctttggccctca

SEQ ID NO: 5372746 - DNA, 18 bp, Homo sapiens
atgaagcttttatgtgaa

SEQ ID NO: 5372747 - DNA, 17 bp, Homo sapiens
atgaaggaatcattcca

SEQ ID NO: 5372748 - DNA, 17 bp, Homo sapiens
atgaaggaatgcaataa

SEQ ID NO: 5372749 - DNA, 13 bp, Homo sapiens
atgaaggaattac

SEQ ID NO: 5372750 - DNA, 19 bp, Homo sapiens
atgaaggagttttttttaa

SEQ ID NO: 5372751 - DNA, 16 bp, Homo sapiens
atgaaggatccatctt

SEQ ID NO: 5372752 - DNA, 22 bp, Homo sapiens
atgaaggcaaaaactgtactgt

SEQ ID NO: 5372753 - DNA, 22 bp, Homo sapiens
atgaaggcagaaaaatgtcatt

SEQ ID NO: 5372754 - DNA, 22 bp, Homo sapiens
atgaaggctgaatcaaagacat

SEQ ID NO: 5372755 - DNA, 17 bp, Homo sapiens
atgaaggcttttggtct

SEQ ID NO: 5372756 - DNA, 23 bp, Homo sapiens
atgaagggccagcatatatactt

SEQ ID NO: 5372757 - DNA, 22 bp, Homo sapiens
atgaagggccttgagcatctgg

SEQ ID NO: 5372758 - DNA, 17 bp, Homo sapiens
atgaagggcgagtgaat

SEQ ID NO: 5372759 - DNA, 17 bp, Homo sapiens
atgaagggtcatttctc

SEQ ID NO: 5372760 - DNA, 15 bp, Homo sapiens
atgaaggtaaataaa

SEQ ID NO: 5372761 - DNA, 20 bp, Homo sapiens
atgaaggtaatattgataag

SEQ ID NO: 5372762 - DNA, 18 bp, Homo sapiens
atgaaggtcactcgtggt

SEQ ID NO: 5372763 - DNA, 16 bp, Homo sapiens
atgaaggtgtgctaca

SEQ ID NO: 5372764 - DNA, 17 bp, Homo sapiens
atgaaggtgtgctacag

SEQ ID NO: 5372765 - DNA, 18 bp, Homo sapiens
atgaaggttttcatttgc

SEQ ID NO: 5372766 - DNA, 14 bp, Homo sapiens
atgaagtaaagttt

SEQ ID NO: 5372767 - DNA, 17 bp, Homo sapiens
atgaagtaaagtttctg

SEQ ID NO: 5372768 - DNA, 19 bp, Homo sapiens
atgaagtaaattatgtaac

SEQ ID NO: 5372769 - DNA, 17 bp, Homo sapiens
atgaagtaactgaggct

SEQ ID NO: 5372770 - DNA, 23 bp, Homo sapiens
atgaagtacagtagtttccctac

SEQ ID NO: 5372771 - DNA, 14 bp, Homo sapiens
atgaagtagaagtt

SEQ ID NO: 5372772 - DNA, 15 bp, Homo sapiens
atgaagtataaatct

SEQ ID NO: 5372773 - DNA, 17 bp, Homo sapiens
atgaagtatataatggt

SEQ ID NO: 5372774 - DNA, 21 bp, Homo sapiens
atgaagtatctaaaagtgtca

SEQ ID NO: 5372775 - DNA, 12 bp, Homo sapiens
atgaagtatttt

SEQ ID NO: 5372776 - DNA, 20 bp, Homo sapiens
atgaagtcataggttacaga

SEQ ID NO: 5372777 - DNA, 18 bp, Homo sapiens
atgaagtctgagggaaac

SEQ ID NO: 5372778 - DNA, 19 bp, Homo sapiens
atgaagtgctacagaaagc

SEQ ID NO: 5372779 - DNA, 23 bp, Homo sapiens
atgaagtgtgtttccttcagtgc

SEQ ID NO: 5372780 - DNA, 15 bp, Homo sapiens
atgaagtgttagata

SEQ ID NO: 5372781 - DNA, 20 bp, Homo sapiens
atgaagtgttttacaatgat

SEQ ID NO: 5372782 - DNA, 22 bp, Homo sapiens
atgaagtgttttacaatgattt

SEQ ID NO: 5372783 - DNA, 17 bp, Homo sapiens
atgaagttactttctta

SEQ ID NO: 5372784 - DNA, 16 bp, Homo sapiens
atgaagttgattcata

SEQ ID NO: 5372785 - DNA, 20 bp, Homo sapiens
atgaagttgattcatattgc

SEQ ID NO: 5372786 - DNA, 23 bp, Homo sapiens
atgaagttgattcatattgcatc

SEQ ID NO: 5372787 - DNA, 14 bp, Homo sapiens
atgaagttgctgtt

SEQ ID NO: 5372788 - DNA, 22 bp, Homo sapiens
atgaagttgctgtttatttttt

SEQ ID NO: 5372789 - DNA, 15 bp, Homo sapiens
atgaagttgtaggta

SEQ ID NO: 5372790 - DNA, 15 bp, Homo sapiens
atgaagtttaaaaca

SEQ ID NO: 5372791 - DNA, 20 bp, Homo sapiens
atgaagtttaaaacagtatt

SEQ ID NO: 5372792 - DNA, 22 bp, Homo sapiens
atgaagtttaaaacagtattta

SEQ ID NO: 5372793 - DNA, 16 bp, Homo sapiens
atgacgtgtgtggctg

SEQ ID NO: 5372794 - DNA, 14 bp, Homo sapiens
atgactaaaaatat

SEQ ID NO: 5372795 - DNA, 16 bp, Homo sapiens
atgactaaaaatatta

SEQ ID NO: 5372796 - DNA, 12 bp, Homo sapiens
atgactaaagag

SEQ ID NO: 5372797 - DNA, 13 bp, Homo sapiens
atgactaaagaga

SEQ ID NO: 5372798 - DNA, 18 bp, Homo sapiens
atgactaaagagagaatg

SEQ ID NO: 5372799 - DNA, 20 bp, Homo sapiens
atgactaaagagagaatgta

SEQ ID NO: 5372800 - DNA, 21 bp, Homo sapiens
atgactaaagagagaatgtag

SEQ ID NO: 5372801 - DNA, 14 bp, Homo sapiens
atgactaacaagat

SEQ ID NO: 5372802 - DNA, 15 bp, Homo sapiens
atgactaagccaagc

SEQ ID NO: 5372803 - DNA, 22 bp, Homo sapiens
atgactaagtacttgctctctg

SEQ ID NO: 5372804 - DNA, 14 bp, Homo sapiens
atgactaatcctta

SEQ ID NO: 5372805 - DNA, 21 bp, Homo sapiens
atgactaatccttaataacta

SEQ ID NO: 5372806 - DNA, 22 bp, Homo sapiens
atgactaattcagggaatatat

SEQ ID NO: 5372807 - DNA, 17 bp, Homo sapiens
atgactaattcttgcat

SEQ ID NO: 5372808 - DNA, 14 bp, Homo sapiens
atgactacatagta

SEQ ID NO: 5372809 - DNA, 16 bp, Homo sapiens
atgactacatagtaag

SEQ ID NO: 5372810 - DNA, 16 bp, Homo sapiens
atgactacattttgag

SEQ ID NO: 5372811 - DNA, 23 bp, Homo sapiens
atgactagaagtatgtaagaaat

SEQ ID NO: 5372812 - DNA, 19 bp, Homo sapiens
atgactagaggcagggagg

SEQ ID NO: 5372813 - DNA, 18 bp, Homo sapiens
atgactagcaaacaaaaa

SEQ ID NO: 5372814 - DNA, 20 bp, Homo sapiens
atgactagggtcctcaggca

SEQ ID NO: 5372815 - DNA, 22 bp, Homo sapiens
atgactagggtcctcaggcagt

SEQ ID NO: 5372816 - DNA, 22 bp, Homo sapiens
atgactatgcgtggctggaacc

SEQ ID NO: 5372817 - DNA, 16 bp, Homo sapiens
atgactatgtattttt

SEQ ID NO: 5372818 - DNA, 19 bp, Homo sapiens
atgactatgtatttttcta

SEQ ID NO: 5372819 - DNA, 15 bp, Homo sapiens
atgactatgtccaga

SEQ ID NO: 5372820 - DNA, 18 bp, Homo sapiens
atgactattcagtggcta

SEQ ID NO: 5372821 - DNA, 13 bp, Homo sapiens
atgactattgtaa

SEQ ID NO: 5372822 - DNA, 14 bp, Homo sapiens
atgactattgtaat

SEQ ID NO: 5372823 - DNA, 14 bp, Homo sapiens
atgactcaaagtct

SEQ ID NO: 5372824 - DNA, 16 bp, Homo sapiens
atgactcaagattccc

SEQ ID NO: 5372825 - DNA, 19 bp, Homo sapiens
atgactcaggacatccccc

SEQ ID NO: 5372826 - DNA, 13 bp, Homo sapiens
atgactcatgcct

SEQ ID NO: 5372827 - DNA, 15 bp, Homo sapiens
atgactcatgcctct

SEQ ID NO: 5372828 - DNA, 15 bp, Homo sapiens
atgactcgaaactga

SEQ ID NO: 5372829 - DNA, 18 bp, Homo sapiens
atgactctaaagaaacag

SEQ ID NO: 5372830 - DNA, 14 bp, Homo sapiens
atgactctcatttt

SEQ ID NO: 5372831 - DNA, 23 bp, Homo sapiens
atgactctctccaagagggcagg

SEQ ID NO: 5372832 - DNA, 12 bp, Homo sapiens
atgactcttgga

SEQ ID NO: 5372833 - DNA, 14 bp, Homo sapiens
atgactctttattg

SEQ ID NO: 5372834 - DNA, 15 bp, Homo sapiens
atgactctttattgt

SEQ ID NO: 5372835 - DNA, 20 bp, Homo sapiens
atgactctttctgaaggaag

SEQ ID NO: 5372836 - DNA, 23 bp, Homo sapiens
atgactgaaagaagaacagctgt

SEQ ID NO: 5372837 - DNA, 15 bp, Homo sapiens
atgactgaagacagg

SEQ ID NO: 5372838 - DNA, 14 bp, Homo sapiens
atgactgaagggaa

SEQ ID NO: 5372839 - DNA, 14 bp, Homo sapiens
atgactgaagggac

SEQ ID NO: 5372840 - DNA, 13 bp, Homo sapiens
atgactgaatggg

SEQ ID NO: 5372841 - DNA, 15 bp, Homo sapiens
atgactgaatttcta

SEQ ID NO: 5372842 - DNA, 19 bp, Homo sapiens
atgactgacccaaaatgtg

SEQ ID NO: 5372843 - DNA, 22 bp, Homo sapiens
atgactgagatttgtaaatctt

SEQ ID NO: 5372844 - DNA, 18 bp, Homo sapiens
atgactgagtctggcaaa

SEQ ID NO: 5372845 - DNA, 13 bp, Homo sapiens
atgactgattact

SEQ ID NO: 5372846 - DNA, 18 bp, Homo sapiens
atgactgcacccagctcc

SEQ ID NO: 5372847 - DNA, 14 bp, Homo sapiens
atgactgccttgcc

SEQ ID NO: 5372848 - DNA, 23 bp, Homo sapiens
atgactgccttgcctcctcagta

SEQ ID NO: 5372849 - DNA, 14 bp, Homo sapiens
atgactgctgattt

SEQ ID NO: 5372850 - DNA, 13 bp, Homo sapiens
atgactgcttgcc

SEQ ID NO: 5372851 - DNA, 18 bp, Homo sapiens
atgactgctttgtttgga

SEQ ID NO: 5372852 - DNA, 15 bp, Homo sapiens
atgactggaaacaag

SEQ ID NO: 5372853 - DNA, 13 bp, Homo sapiens
atgactggaattt

SEQ ID NO: 5372854 - DNA, 20 bp, Homo sapiens
atgactggacagcggttgta

SEQ ID NO: 5372855 - DNA, 22 bp, Homo sapiens
atgactggatacagaatgaatc

SEQ ID NO: 5372856 - DNA, 13 bp, Homo sapiens
atgactggcattt

SEQ ID NO: 5372857 - DNA, 14 bp, Homo sapiens
atgactggcatttt

SEQ ID NO: 5372858 - DNA, 20 bp, Homo sapiens
atgactggcattttatagac

SEQ ID NO: 5372859 - DNA, 18 bp, Homo sapiens
atgactggctaattttct

SEQ ID NO: 5372860 - DNA, 13 bp, Homo sapiens
atgactggctcct

SEQ ID NO: 5372861 - DNA, 12 bp, Homo sapiens
atgactggctgt

SEQ ID NO: 5372862 - DNA, 17 bp, Homo sapiens
atgactggtcttcctta

SEQ ID NO: 5372863 - DNA, 19 bp, Homo sapiens
atgactggtgcgttcctaa

SEQ ID NO: 5372864 - DNA, 18 bp, Homo sapiens
atgactgtaaacatagat

SEQ ID NO: 5372865 - DNA, 17 bp, Homo sapiens
atgactgtagaatttgt

SEQ ID NO: 5372866 - DNA, 17 bp, Homo sapiens
atgactgtgaccacctt

SEQ ID NO: 5372867 - DNA, 20 bp, Homo sapiens
atgactgtgaccaccttctg

SEQ ID NO: 5372868 - DNA, 22 bp, Homo sapiens
atgactgtgctactgtctttgg

SEQ ID NO: 5372869 - DNA, 23 bp, Homo sapiens
atgactgtgtctgcctgtcccca

SEQ ID NO: 5372870 - DNA, 18 bp, Homo sapiens
atgactgtttttgtagtg

SEQ ID NO: 5372871 - DNA, 16 bp, Homo sapiens
atgacttagaaacaat

SEQ ID NO: 5372872 - DNA, 18 bp, Homo sapiens
atgacttagaaacaatgt

SEQ ID NO: 5372873 - DNA, 21 bp, Homo sapiens
atgacttagcgtcaagacatt

SEQ ID NO: 5372874 - DNA, 22 bp, Homo sapiens
atgacttagcgtcaagacattt

SEQ ID NO: 5372875 - DNA, 17 bp, Homo sapiens
atgacttagtacaaagt

SEQ ID NO: 5372876 - DNA, 22 bp, Homo sapiens
atgacttattgtggataacaaa

SEQ ID NO: 5372877 - DNA, 21 bp, Homo sapiens
atgacttatttctgctctgga

SEQ ID NO: 5372878 - DNA, 22 bp, Homo sapiens
atgacttcagtgaaattttcag

SEQ ID NO: 5372879 - DNA, 17 bp, Homo sapiens
atgacttcatttctgat

SEQ ID NO: 5372880 - DNA, 19 bp, Homo sapiens
atgacttcatttctgatgt

SEQ ID NO: 5372881 - DNA, 19 bp, Homo sapiens
atgacttcccctgcctcct

SEQ ID NO: 5372882 - DNA, 12 bp, Homo sapiens
atgacttgagat

SEQ ID NO: 5372883 - DNA, 14 bp, Homo sapiens
atgacttgagatga

SEQ ID NO: 5372884 - DNA, 17 bp, Homo sapiens
atgacttgattgtactt

SEQ ID NO: 5372885 - DNA, 23 bp, Homo sapiens
atgacttgggcacccccagcctg

SEQ ID NO: 5372886 - DNA, 23 bp, Homo sapiens
atgacttggtggcttttccttga

SEQ ID NO: 5372887 - DNA, 18 bp, Homo sapiens
atgacttggtgtctaatg

SEQ ID NO: 5372888 - DNA, 23 bp, Homo sapiens
atgacttggtgtctaatgtgtag

SEQ ID NO: 5372889 - DNA, 14 bp, Homo sapiens
atgactttagaata

SEQ ID NO: 5372890 - DNA, 14 bp, Homo sapiens
atgactttatgtat

SEQ ID NO: 5372891 - DNA, 17 bp, Homo sapiens
atgactttattatttat

SEQ ID NO: 5372892 - DNA, 16 bp, Homo sapiens
atgactttattgcatc

SEQ ID NO: 5372893 - DNA, 20 bp, Homo sapiens
atgactttatttttctaagt

SEQ ID NO: 5372894 - DNA, 21 bp, Homo sapiens
atgactttctttttgtagctg

SEQ ID NO: 5372895 - DNA, 14 bp, Homo sapiens
atgactttgaactg

SEQ ID NO: 5372896 - DNA, 15 bp, Homo sapiens
atgacttttattatg

SEQ ID NO: 5372897 - DNA, 20 bp, Homo sapiens
atgacttttccatgtatcta

SEQ ID NO: 5372898 - DNA, 15 bp, Homo sapiens
atgacttttctgccc

SEQ ID NO: 5372899 - DNA, 16 bp, Homo sapiens
atgacttttctgccct

SEQ ID NO: 5372900 - DNA, 14 bp, Homo sapiens
atgacttttcttaa

SEQ ID NO: 5372901 - DNA, 15 bp, Homo sapiens
atgacttttgaatta

SEQ ID NO: 5372902 - DNA, 17 bp, Homo sapiens
atgacttttgaattaca

SEQ ID NO: 5372903 - DNA, 23 bp, Homo sapiens
atgacttttgaattacagagata

SEQ ID NO: 5372904 - DNA, 13 bp, Homo sapiens
atgactttttata

SEQ ID NO: 5372905 - DNA, 18 bp, Homo sapiens
atgactttttgaaagtaa

SEQ ID NO: 5372906 - DNA, 19 bp, Homo sapiens
atgacttttttaaactaag

SEQ ID NO: 5372907 - DNA, 17 bp, Homo sapiens
atgactttttttctgat

SEQ ID NO: 5372908 - DNA, 11 bp, Homo sapiens
atgagaaaaaa

SEQ ID NO: 5372909 - DNA, 17 bp, Homo sapiens
atgagaaaaaaacagca

SEQ ID NO: 5372910 - DNA, 12 bp, Homo sapiens
atgagaaaaaac

SEQ ID NO: 5372911 - DNA, 14 bp, Homo sapiens
atgagaaaaataaa

SEQ ID NO: 5372912 - DNA, 22 bp, Homo sapiens
atgagaaaaataaatggaaaca

SEQ ID NO: 5372913 - DNA, 15 bp, Homo sapiens
atgagaaacaacaga

SEQ ID NO: 5372914 - DNA, 20 bp, Homo sapiens
atgagaaacagctcagccag

SEQ ID NO: 5372915 - DNA, 11 bp, Homo sapiens
atgagaaactg

SEQ ID NO: 5372916 - DNA, 14 bp, Homo sapiens
atgagaaactgcat

SEQ ID NO: 5372917 - DNA, 20 bp, Homo sapiens
atgagaaactggcaaagcag

SEQ ID NO: 5372918 - DNA, 20 bp, Homo sapiens
atgagaaacttaaatgttat

SEQ ID NO: 5372919 - DNA, 11 bp, Homo sapiens
atgagaaagaa

SEQ ID NO: 5372920 - DNA, 12 bp, Homo sapiens
atgagaaagaaa

SEQ ID NO: 5372921 - DNA, 14 bp, Homo sapiens
atgagaaagaaaag

SEQ ID NO: 5372922 - DNA, 19 bp, Homo sapiens
atgagaaagcttttattcc

SEQ ID NO: 5372923 - DNA, 21 bp, Homo sapiens
atgagaaagcttttattcctt

SEQ ID NO: 5372924 - DNA, 18 bp, Homo sapiens
atgagaaaggacagagcc

SEQ ID NO: 5372925 - DNA, 19 bp, Homo sapiens
atgagaaaggacagagcca

SEQ ID NO: 5372926 - DNA, 15 bp, Homo sapiens
atgagaaatacagaa

SEQ ID NO: 5372927 - DNA, 20 bp, Homo sapiens
atgagaaatacagaagaaaa

SEQ ID NO: 5372928 - DNA, 22 bp, Homo sapiens
atgagaaatacagaagaaaata

SEQ ID NO: 5372929 - DNA, 15 bp, Homo sapiens
atgagaaatcatgtt

SEQ ID NO: 5372930 - DNA, 18 bp, Homo sapiens
atgagaaatctaaaaaac

SEQ ID NO: 5372931 - DNA, 12 bp, Homo sapiens
atgagaaatgta

SEQ ID NO: 5372932 - DNA, 13 bp, Homo sapiens
atgagaacaaagc

SEQ ID NO: 5372933 - DNA, 15 bp, Homo sapiens
atgagaacaaagctg

SEQ ID NO: 5372934 - DNA, 20 bp, Homo sapiens
atgagaacaaagctgttaaa

SEQ ID NO: 5372935 - DNA, 23 bp, Homo sapiens
atgagaacaagtcacagctgcag

SEQ ID NO: 5372936 - DNA, 16 bp, Homo sapiens
atgagaacacactgag

SEQ ID NO: 5372937 - DNA, 13 bp, Homo sapiens
atgagaacagact

SEQ ID NO: 5372938 - DNA, 14 bp, Homo sapiens
atgagaacagactg

SEQ ID NO: 5372939 - DNA, 19 bp, Homo sapiens
atgagaacagactggcctg

SEQ ID NO: 5372940 - DNA, 22 bp, Homo sapiens
atgagaacagataaagattgtg

SEQ ID NO: 5372941 - DNA, 12 bp, Homo sapiens
atgagaacatgt

SEQ ID NO: 5372942 - DNA, 13 bp, Homo sapiens
atgagaactaaat

SEQ ID NO: 5372943 - DNA, 17 bp, Homo sapiens
atgagaactaaatagat

SEQ ID NO: 5372944 - DNA, 18 bp, Homo sapiens
atgagaagagggcctgtg

SEQ ID NO: 5372945 - DNA, 19 bp, Homo sapiens
atgagaagatcctgtcaca

SEQ ID NO: 5372946 - DNA, 12 bp, Homo sapiens
atgagaagccag

SEQ ID NO: 5372947 - DNA, 14 bp, Homo sapiens
atgagaagccagga

SEQ ID NO: 5372948 - DNA, 22 bp, Homo sapiens
atgagaagttgatatagaacag

SEQ ID NO: 5372949 - DNA, 14 bp, Homo sapiens
atgagaatgtcatt

SEQ ID NO: 5372950 - DNA, 15 bp, Homo sapiens
atgagaatgtgccat

SEQ ID NO: 5372951 - DNA, 18 bp, Homo sapiens
atgagaattcagctgccc

SEQ ID NO: 5372952 - DNA, 16 bp, Homo sapiens
atgagacaacacacac

SEQ ID NO: 5372953 - DNA, 19 bp, Homo sapiens
atgagacaggaaaaaccaa

SEQ ID NO: 5372954 - DNA, 18 bp, Homo sapiens
atgagacaggacctagga

SEQ ID NO: 5372955 - DNA, 13 bp, Homo sapiens
atgagaccccttt

SEQ ID NO: 5372956 - DNA, 21 bp, Homo sapiens
atgagacccttacgtgattgt

SEQ ID NO: 5372957 - DNA, 15 bp, Homo sapiens
atgagactaagagaa

SEQ ID NO: 5372958 - DNA, 16 bp, Homo sapiens
atgagactcagtgcag

SEQ ID NO: 5372959 - DNA, 15 bp, Homo sapiens
atgagactctagggt

SEQ ID NO: 5372960 - DNA, 18 bp, Homo sapiens
atgagactctagggtcca

SEQ ID NO: 5372961 - DNA, 16 bp, Homo sapiens
atgagactcttaaata

SEQ ID NO: 5372962 - DNA, 16 bp, Homo sapiens
atgagactgaactgtg

SEQ ID NO: 5372963 - DNA, 17 bp, Homo sapiens
atgagactgatccctgg

SEQ ID NO: 5372964 - DNA, 16 bp, Homo sapiens
atgagactgccctgcc

SEQ ID NO: 5372965 - DNA, 14 bp, Homo sapiens
atgagactgtttat

SEQ ID NO: 5372966 - DNA, 15 bp, Homo sapiens
atgagactgtttatt

SEQ ID NO: 5372967 - DNA, 14 bp, Homo sapiens
atgagacttaattt

SEQ ID NO: 5372968 - DNA, 16 bp, Homo sapiens
atgagacttaattttg

SEQ ID NO: 5372969 - DNA, 16 bp, Homo sapiens
atgagacttgccttcc

SEQ ID NO: 5372970 - DNA, 17 bp, Homo sapiens
atgagactttctgctgg

SEQ ID NO: 5372971 - DNA, 18 bp, Homo sapiens
atgagagaatcacacaag

SEQ ID NO: 5372972 - DNA, 13 bp, Homo sapiens
atgagagaatggg

SEQ ID NO: 5372973 - DNA, 19 bp, Homo sapiens
atgatagttttctagatga

SEQ ID NO: 5372974 - DNA, 17 bp, Homo sapiens
atgatataactttagaa

SEQ ID NO: 5372975 - DNA, 18 bp, Homo sapiens
atgatataataaatatat

SEQ ID NO: 5372976 - DNA, 20 bp, Homo sapiens
atgatataggaaaatacatt

SEQ ID NO: 5372977 - DNA, 13 bp, Homo sapiens
atgatatatttat

SEQ ID NO: 5372978 - DNA, 17 bp, Homo sapiens
atgatatatttatatca

SEQ ID NO: 5372979 - DNA, 15 bp, Homo sapiens
atgatatcattgttg

SEQ ID NO: 5372980 - DNA, 15 bp, Homo sapiens
atgatatctatattc

SEQ ID NO: 5372981 - DNA, 11 bp, Homo sapiens
atgatatgcat

SEQ ID NO: 5372982 - DNA, 17 bp, Homo sapiens
atgatatgcttgtaact

SEQ ID NO: 5372983 - DNA, 13 bp, Homo sapiens
atgatatgtaaac

SEQ ID NO: 5372984 - DNA, 20 bp, Homo sapiens
atgatatgtctttaaaatga

SEQ ID NO: 5372985 - DNA, 15 bp, Homo sapiens
atgatatgtgcttgt

SEQ ID NO: 5372986 - DNA, 20 bp, Homo sapiens
atgatatgtgcttgtgtgta

SEQ ID NO: 5372987 - DNA, 17 bp, Homo sapiens
atgatattcatattcaa

SEQ ID NO: 5372988 - DNA, 16 bp, Homo sapiens
atgatattccatagta

SEQ ID NO: 5372989 - DNA, 20 bp, Homo sapiens
atgatattccccatttcctg

SEQ ID NO: 5372990 - DNA, 17 bp, Homo sapiens
atgatattgacactgtc

SEQ ID NO: 5372991 - DNA, 15 bp, Homo sapiens
atgatattgtttaaa

SEQ ID NO: 5372992 - DNA, 20 bp, Homo sapiens
atgatattgtttaaaattca

SEQ ID NO: 5372993 - DNA, 18 bp, Homo sapiens
atgatatttcttgctttc

SEQ ID NO: 5372994 - DNA, 14 bp, Homo sapiens
atgatattttcaga

SEQ ID NO: 5372995 - DNA, 20 bp, Homo sapiens
atgatattttgtctcctacc

SEQ ID NO: 5372996 - DNA, 21 bp, Homo sapiens
atgatatttttttaagtcttt

SEQ ID NO: 5372997 - DNA, 13 bp, Homo sapiens
atgatcaaaaata

SEQ ID NO: 5372998 - DNA, 13 bp, Homo sapiens
atgatcaaaacat

SEQ ID NO: 5372999 - DNA, 20 bp, Homo sapiens
atgatcaaaacctgtgccag

SEQ ID NO: 5373000 - DNA, 17 bp, Homo sapiens
atgatcaaaatgcatac

SEQ ID NO: 5373001 - DNA, 12 bp, Homo sapiens
atgatcaaatgt

SEQ ID NO: 5373002 - DNA, 15 bp, Homo sapiens
atgatcaaatgttta

SEQ ID NO: 5373003 - DNA, 16 bp, Homo sapiens
atgatcaaatgtttaa

SEQ ID NO: 5373004 - DNA, 15 bp, Homo sapiens
atgatcaagatatat

SEQ ID NO: 5373005 - DNA, 18 bp, Homo sapiens
atgatcaaggagggagaa

SEQ ID NO: 5373006 - DNA, 23 bp, Homo sapiens
atgatcaaggagggagaaaggca

SEQ ID NO: 5373007 - DNA, 17 bp, Homo sapiens
atgatcaatcctttatt

SEQ ID NO: 5373008 - DNA, 18 bp, Homo sapiens
atgatcaatcctttatta

SEQ ID NO: 5373009 - DNA, 15 bp, Homo sapiens
atgatcacacagcta

SEQ ID NO: 5373010 - DNA, 22 bp, Homo sapiens
atgatcaccatgttagccttag

SEQ ID NO: 5373011 - DNA, 19 bp, Homo sapiens
atgatcacggctcactgca

SEQ ID NO: 5373012 - DNA, 19 bp, Homo sapiens
atgatcacttatcagtttg

SEQ ID NO: 5373013 - DNA, 23 bp, Homo sapiens
atgatcagaactgggaaaacagt

SEQ ID NO: 5373014 - DNA, 16 bp, Homo sapiens
atgatcagcaaaaaga

SEQ ID NO: 5373015 - DNA, 20 bp, Homo sapiens
atgatcagctgtttgtcata

SEQ ID NO: 5373016 - DNA, 13 bp, Homo sapiens
atgatcagggatc

SEQ ID NO: 5373017 - DNA, 14 bp, Homo sapiens
atgatcagtactga

SEQ ID NO: 5373018 - DNA, 17 bp, Homo sapiens
atgatcagtgttactgc

SEQ ID NO: 5373019 - DNA, 21 bp, Homo sapiens
atgatcattgaaagtaaaaaa

SEQ ID NO: 5373020 - DNA, 17 bp, Homo sapiens
atgatccaagtatttta

SEQ ID NO: 5373021 - DNA, 21 bp, Homo sapiens
atgatccccgtctctgccctg

SEQ ID NO: 5373022 - DNA, 21 bp, Homo sapiens
atgatccctcagtctgagagg

SEQ ID NO: 5373023 - DNA, 24 bp, Homo sapiens
atgatcccttccccctgctgatca

SEQ ID NO: 5373024 - DNA, 18 bp, Homo sapiens
atgatcctctatttcctg

SEQ ID NO: 5373025 - DNA, 16 bp, Homo sapiens
atgatcctgaaaaaat

SEQ ID NO: 5373026 - DNA, 23 bp, Homo sapiens
atgatccttgttttaagattgta

SEQ ID NO: 5373027 - DNA, 22 bp, Homo sapiens
atgatccttttttgtcatttta

SEQ ID NO: 5373028 - DNA, 23 bp, Homo sapiens
atgatccttttttgtcattttat

SEQ ID NO: 5373029 - DNA, 15 bp, Homo sapiens
atgatcgctgtattt

SEQ ID NO: 5373030 - DNA, 17 bp, Homo sapiens
atgatcggcaggacacc

SEQ ID NO: 5373031 - DNA, 15 bp, Homo sapiens
atgatctaataaact

SEQ ID NO: 5373032 - DNA, 18 bp, Homo sapiens
atgatctaataaacttta

SEQ ID NO: 5373033 - DNA, 18 bp, Homo sapiens
atgatctaatacaaagat

SEQ ID NO: 5373034 - DNA, 15 bp, Homo sapiens
atgatctactcagaa

SEQ ID NO: 5373035 - DNA, 17 bp, Homo sapiens
atgatctaggaagactt

SEQ ID NO: 5373036 - DNA, 20 bp, Homo sapiens
atgatctaggaagactttgg

SEQ ID NO: 5373037 - DNA, 19 bp, Homo sapiens
atgatctaggtttaactca

SEQ ID NO: 5373038 - DNA, 13 bp, Homo sapiens
atgatctcaggag

SEQ ID NO: 5373039 - DNA, 15 bp, Homo sapiens
atgatctcaggagct

SEQ ID NO: 5373040 - DNA, 20 bp, Homo sapiens
atgatctcggatgaccaaac

SEQ ID NO: 5373041 - DNA, 23 bp, Homo sapiens
atgatctctccacggtagcactt

SEQ ID NO: 5373042 - DNA, 15 bp, Homo sapiens
atgatctgactttaa

SEQ ID NO: 5373043 - DNA, 18 bp, Homo sapiens
atgatctgcaggggtctg

SEQ ID NO: 5373044 - DNA, 19 bp, Homo sapiens
atgatctgcctctaaaagc

SEQ ID NO: 5373045 - DNA, 18 bp, Homo sapiens
atgatctggacttcctat

SEQ ID NO: 5373046 - DNA, 22 bp, Homo sapiens
atgatctgtatttaatggtttt

SEQ ID NO: 5373047 - DNA, 14 bp, Homo sapiens
atgatctgtcaaag

SEQ ID NO: 5373048 - DNA, 23 bp, Homo sapiens
atgatctgtgccttttttatatc

SEQ ID NO: 5373049 - DNA, 21 bp, Homo sapiens
atgatcttcatgggcccacag

SEQ ID NO: 5373050 - DNA, 13 bp, Homo sapiens
atgatcttccaaa

SEQ ID NO: 5373051 - DNA, 18 bp, Homo sapiens
atgatcttctttataatt

SEQ ID NO: 5373052 - DNA, 15 bp, Homo sapiens
atgatcttggaccat

SEQ ID NO: 5373053 - DNA, 17 bp, Homo sapiens
atgatctttgcagacag

SEQ ID NO: 5373054 - DNA, 18 bp, Homo sapiens
atgatctttgcagacagg

SEQ ID NO: 5373055 - DNA, 14 bp, Homo sapiens
atgatgaaaataat

SEQ ID NO: 5373056 - DNA, 19 bp, Homo sapiens
atgatgaaaatatttaaag

SEQ ID NO: 5373057 - DNA, 12 bp, Homo sapiens
atgatgaaaatt

SEQ ID NO: 5373058 - DNA, 14 bp, Homo sapiens
atgatgaaacattc

SEQ ID NO: 5373059 - DNA, 17 bp, Homo sapiens
atgatgaaatctttctt

SEQ ID NO: 5373060 - DNA, 18 bp, Homo sapiens
atgatgaacttataatga

SEQ ID NO: 5373061 - DNA, 22 bp, Homo sapiens
atgatgaacttataatgattaa

SEQ ID NO: 5373062 - DNA, 15 bp, Homo sapiens
atgatgaatgagaat

SEQ ID NO: 5373063 - DNA, 20 bp, Homo sapiens
atgatgacaactacagaaaa

SEQ ID NO: 5373064 - DNA, 16 bp, Homo sapiens
atgatgaccaagaatt

SEQ ID NO: 5373065 - DNA, 18 bp, Homo sapiens
atgatgacccactaaaga

SEQ ID NO: 5373066 - DNA, 20 bp, Homo sapiens
atgatgacccactaaagagt

SEQ ID NO: 5373067 - DNA, 17 bp, Homo sapiens
atgatgactcaaggcca

SEQ ID NO: 5373068 - DNA, 21 bp, Homo sapiens
atgatgactcttcttatcaca

SEQ ID NO: 5373069 - DNA, 21 bp, Homo sapiens
atgatgacttgagccctgcca

SEQ ID NO: 5373070 - DNA, 20 bp, Homo sapiens
atgatgagccttcgtgcccc

SEQ ID NO: 5373071 - DNA, 16 bp, Homo sapiens
atgatgataataataa

SEQ ID NO: 5373072 - DNA, 14 bp, Homo sapiens
atgatgatctcatt

SEQ ID NO: 5373073 - DNA, 14 bp, Homo sapiens
atgatgatgatgat

SEQ ID NO: 5373074 - DNA, 15 bp, Homo sapiens
atgatgatgatgata

SEQ ID NO: 5373075 - DNA, 15 bp, Homo sapiens
atgatgatggtgttg

SEQ ID NO: 5373076 - DNA, 13 bp, Homo sapiens
atgatgatgttaa

SEQ ID NO: 5373077 - DNA, 23 bp, Homo sapiens
atgatgattaaacacctgacaca

SEQ ID NO: 5373078 - DNA, 14 bp, Homo sapiens
atgatgattttaac

SEQ ID NO: 5373079 - DNA, 16 bp, Homo sapiens
atgatgattttaacag

SEQ ID NO: 5373080 - DNA, 18 bp, Homo sapiens
atgatgattttaacagtt

SEQ ID NO: 5373081 - DNA, 21 bp, Homo sapiens
atgatgattttaacagtttta

SEQ ID NO: 5373082 - DNA, 20 bp, Homo sapiens
atgatgcaaccaaaagggaa

SEQ ID NO: 5373083 - DNA, 21 bp, Homo sapiens
atgatgcaaccaaaagggaaa

SEQ ID NO: 5373084 - DNA, 12 bp, Homo sapiens
atgatgcaagcc

SEQ ID NO: 5373085 - DNA, 20 bp, Homo sapiens
atgatgcaagccagcttcct

SEQ ID NO: 5373086 - DNA, 12 bp, Homo sapiens
atgatgcacagt

SEQ ID NO: 5373087 - DNA, 21 bp, Homo sapiens
atgatgcacagtatctgctgt

SEQ ID NO: 5373088 - DNA, 15 bp, Homo sapiens
atgatgcatggagtg

SEQ ID NO: 5373089 - DNA, 21 bp, Homo sapiens
atgatgcatggagtgtttgac

SEQ ID NO: 5373090 - DNA, 12 bp, Homo sapiens
atgatgccacac

SEQ ID NO: 5373091 - DNA, 22 bp, Homo sapiens
atgatgccgaacattaggaatt

SEQ ID NO: 5373092 - DNA, 22 bp, Homo sapiens
atgatgcctctgtcttctggac

SEQ ID NO: 5373093 - DNA, 17 bp, Homo sapiens
atgatgctatttgcaat

SEQ ID NO: 5373094 - DNA, 10 bp, Homo sapiens
atgatgctca

SEQ ID NO: 5373095 - DNA, 12 bp, Homo sapiens
atgatgctgccg

SEQ ID NO: 5373096 - DNA, 21 bp, Homo sapiens
atgatgctgccggcacagctg

SEQ ID NO: 5373097 - DNA, 21 bp, Homo sapiens
atgatgcttgtaacaagaaaa

SEQ ID NO: 5373098 - DNA, 14 bp, Homo sapiens
atgatgctttggaa

SEQ ID NO: 5373099 - DNA, 16 bp, Homo sapiens
atgatgctttggaaga

SEQ ID NO: 5373100 - DNA, 16 bp, Homo sapiens
atgatgcttttactga

SEQ ID NO: 5373101 - DNA, 15 bp, Homo sapiens
atgatggaaaaatca

SEQ ID NO: 5373102 - DNA, 21 bp, Homo sapiens
atgatggaaacgcacttacaa

SEQ ID NO: 5373103 - DNA, 14 bp, Homo sapiens
atgatggaaaggaa

SEQ ID NO: 5373104 - DNA, 19 bp, Homo sapiens
atgatggaacttagactcc

SEQ ID NO: 5373105 - DNA, 14 bp, Homo sapiens
atgatggaagtgtt

SEQ ID NO: 5373106 - DNA, 18 bp, Homo sapiens
atgatggaagtgttcaga

SEQ ID NO: 5373107 - DNA, 12 bp, Homo sapiens
atgatggagcaa

SEQ ID NO: 5373108 - DNA, 15 bp, Homo sapiens
atgatggagcaactg

SEQ ID NO: 5373109 - DNA, 19 bp, Homo sapiens
atgatggatgccaatatta

SEQ ID NO: 5373110 - DNA, 16 bp, Homo sapiens
atgatggatggcagac

SEQ ID NO: 5373111 - DNA, 13 bp, Homo sapiens
atgatggcagagg

SEQ ID NO: 5373112 - DNA, 16 bp, Homo sapiens
atgatgggaaaatatt

SEQ ID NO: 5373113 - DNA, 21 bp, Homo sapiens
atgatgggaatagggagacag

SEQ ID NO: 5373114 - DNA, 15 bp, Homo sapiens
atgatgggcctgaac

SEQ ID NO: 5373115 - DNA, 17 bp, Homo sapiens
atgatgggctccccagg

SEQ ID NO: 5373116 - DNA, 23 bp, Homo sapiens
atgatgggcttctgttctctgct

SEQ ID NO: 5373117 - DNA, 20 bp, Homo sapiens
atgatgggcttttgttctga

SEQ ID NO: 5373118 - DNA, 14 bp, Homo sapiens
atgatggggtcagc

SEQ ID NO: 5373119 - DNA, 17 bp, Homo sapiens
atgatggggtcagcagg

SEQ ID NO: 5373120 - DNA, 20 bp, Homo sapiens
atgatggggtcagcaggccc

SEQ ID NO: 5373121 - DNA, 23 bp, Homo sapiens
atgatggggtgggagactttcca

SEQ ID NO: 5373122 - DNA, 16 bp, Homo sapiens
atgatgggtcagttgt

SEQ ID NO: 5373123 - DNA, 16 bp, Homo sapiens
atgatgggtgttttta

SEQ ID NO: 5373124 - DNA, 16 bp, Homo sapiens
atgatggtgttaaagc

SEQ ID NO: 5373125 - DNA, 18 bp, Homo sapiens
atgatggtgttaaagctg

SEQ ID NO: 5373126 - DNA, 23 bp, Homo sapiens
atgatggtgttaaagctgtacac

SEQ ID NO: 5373127 - DNA, 16 bp, Homo sapiens
atgatgtaaaaaatac

SEQ ID NO: 5373128 - DNA, 21 bp, Homo sapiens
atgatgtaatctctctgcagc

SEQ ID NO: 5373129 - DNA, 21 bp, Homo sapiens
atgatgtacagattctttcag

SEQ ID NO: 5373130 - DNA, 17 bp, Homo sapiens
atgatgtacaggcagat

SEQ ID NO: 5373131 - DNA, 15 bp, Homo sapiens
atgatgtactaaagt

SEQ ID NO: 5373132 - DNA, 16 bp, Homo sapiens
atgatgtatttttgta

SEQ ID NO: 5373133 - DNA, 18 bp, Homo sapiens
atgatgtccagaagaata

SEQ ID NO: 5373134 - DNA, 17 bp, Homo sapiens
atgatgtccttgttatt

SEQ ID NO: 5373135 - DNA, 16 bp, Homo sapiens
atgatgtctacagaaa

SEQ ID NO: 5373136 - DNA, 18 bp, Homo sapiens
atgatgtctacagaaaat

SEQ ID NO: 5373137 - DNA, 13 bp, Homo sapiens
atgatgtcttctg

SEQ ID NO: 5373138 - DNA, 22 bp, Homo sapiens
atgatgtgcaaaaccttttact

SEQ ID NO: 5373139 - DNA, 11 bp, Homo sapiens
atgatgtgctt

SEQ ID NO: 5373140 - DNA, 22 bp, Homo sapiens
atgatgtggacatatgtatact

SEQ ID NO: 5373141 - DNA, 23 bp, Homo sapiens
atgatgtggagtggggcagtaga

SEQ ID NO: 5373142 - DNA, 20 bp, Homo sapiens
atgatgtggtgcctgaggtc

SEQ ID NO: 5373143 - DNA, 14 bp, Homo sapiens
atgatgttaaaaaa

SEQ ID NO: 5373144 - DNA, 22 bp, Homo sapiens
atgatgttaaaaaaataagaag

SEQ ID NO: 5373145 - DNA, 18 bp, Homo sapiens
atgatgttacattaggaa

SEQ ID NO: 5373146 - DNA, 22 bp, Homo sapiens
atgatgttatacatcaatatgt

SEQ ID NO: 5373147 - DNA, 20 bp, Homo sapiens
atgatgttatcttaacactg

SEQ ID NO: 5373148 - DNA, 21 bp, Homo sapiens
atgatgttatcttaacactga

SEQ ID NO: 5373149 - DNA, 17 bp, Homo sapiens
atgatgttctgaaatgg

SEQ ID NO: 5373150 - DNA, 20 bp, Homo sapiens
atgcaccagtgccgcctgtg

SEQ ID NO: 5373151 - DNA, 14 bp, Homo sapiens
atgcaccattagaa

SEQ ID NO: 5373152 - DNA, 19 bp, Homo sapiens
atgcacccatcagcactct

SEQ ID NO: 5373153 - DNA, 21 bp, Homo sapiens
atgcacccatcagcactctgt

SEQ ID NO: 5373154 - DNA, 18 bp, Homo sapiens
atgcacccgcatgtacaa

SEQ ID NO: 5373155 - DNA, 20 bp, Homo sapiens
atgcaccctcatacacagaa

SEQ ID NO: 5373156 - DNA, 13 bp, Homo sapiens
atgcacctaaaat

SEQ ID NO: 5373157 - DNA, 15 bp, Homo sapiens
atgcacctaaagaaa

SEQ ID NO: 5373158 - DNA, 16 bp, Homo sapiens
atgcacctaaagaaaa

SEQ ID NO: 5373159 - DNA, 23 bp, Homo sapiens
atgcacctaaagaaaaacaaact

SEQ ID NO: 5373160 - DNA, 15 bp, Homo sapiens
atgcacctataaata

SEQ ID NO: 5373161 - DNA, 16 bp, Homo sapiens
atgcacctataaatac

SEQ ID NO: 5373162 - DNA, 16 bp, Homo sapiens
atgcacctcagggcca

SEQ ID NO: 5373163 - DNA, 16 bp, Homo sapiens
atgcacctggaatata

SEQ ID NO: 5373164 - DNA, 21 bp, Homo sapiens
atgcaccttatatttctgtgt

SEQ ID NO: 5373165 - DNA, 24 bp, Homo sapiens
atgcaccttatatttctgtgtaca

SEQ ID NO: 5373166 - DNA, 18 bp, Homo sapiens
atgcaccttgtgtctgta

SEQ ID NO: 5373167 - DNA, 16 bp, Homo sapiens
atgcacgaccttggga

SEQ ID NO: 5373168 - DNA, 14 bp, Homo sapiens
atgcacgcaccccg

SEQ ID NO: 5373169 - DNA, 22 bp, Homo sapiens
atgcacgcaccccgcccctgca

SEQ ID NO: 5373170 - DNA, 17 bp, Homo sapiens
atgcacgtggggcccac

SEQ ID NO: 5373171 - DNA, 19 bp, Homo sapiens
atgcacgtggggcccactg

SEQ ID NO: 5373172 - DNA, 18 bp, Homo sapiens
atgcacgttaacagcgtg

SEQ ID NO: 5373173 - DNA, 23 bp, Homo sapiens
atgcacgtttcaaagctttcctg

SEQ ID NO: 5373174 - DNA, 21 bp, Homo sapiens
atgcactaatcaatactttga

SEQ ID NO: 5373175 - DNA, 22 bp, Homo sapiens
atgcactactgaaatttacaca

SEQ ID NO: 5373176 - DNA, 23 bp, Homo sapiens
atgcactatatgtttacacaatt

SEQ ID NO: 5373177 - DNA, 16 bp, Homo sapiens
atgcactatgaggaat

SEQ ID NO: 5373178 - DNA, 14 bp, Homo sapiens
atgcactatgtata

SEQ ID NO: 5373179 - DNA, 14 bp, Homo sapiens
atgcactcgcactg

SEQ ID NO: 5373180 - DNA, 22 bp, Homo sapiens
atgcactgaaaacttagccaga

SEQ ID NO: 5373181 - DNA, 23 bp, Homo sapiens
atgcactgaaaacttagccagag

SEQ ID NO: 5373182 - DNA, 19 bp, Homo sapiens
atgcactgaagagctcttg

SEQ ID NO: 5373183 - DNA, 22 bp, Homo sapiens
atgcactgaagagctcttggcc

SEQ ID NO: 5373184 - DNA, 22 bp, Homo sapiens
atgcactgacccttccagacat

SEQ ID NO: 5373185 - DNA, 13 bp, Homo sapiens
atgcactggcctg

SEQ ID NO: 5373186 - DNA, 13 bp, Homo sapiens
atgcactgtgaag

SEQ ID NO: 5373187 - DNA, 14 bp, Homo sapiens
atgcactgtggttt

SEQ ID NO: 5373188 - DNA, 15 bp, Homo sapiens
atgcactgtggtttc

SEQ ID NO: 5373189 - DNA, 21 bp, Homo sapiens
atgcactgttccccctgtgca

SEQ ID NO: 5373190 - DNA, 17 bp, Homo sapiens
atgcactgtttttaatc

SEQ ID NO: 5373191 - DNA, 20 bp, Homo sapiens
atgcacttcaaataattaaa

SEQ ID NO: 5373192 - DNA, 23 bp, Homo sapiens
atgcacttcaaataattaaatct

SEQ ID NO: 5373193 - DNA, 14 bp, Homo sapiens
atgcacttctattt

SEQ ID NO: 5373194 - DNA, 22 bp, Homo sapiens
atgcactttaattgaagaactg

SEQ ID NO: 5373195 - DNA, 16 bp, Homo sapiens
atgcactttccctaga

SEQ ID NO: 5373196 - DNA, 22 bp, Homo sapiens
atgcactttccctagaaagcca

SEQ ID NO: 5373197 - DNA, 12 bp, Homo sapiens
atgcactttgct

SEQ ID NO: 5373198 - DNA, 18 bp, Homo sapiens
atgcactttgctttaata

SEQ ID NO: 5373199 - DNA, 21 bp, Homo sapiens
atgcactttgctttaatataa

SEQ ID NO: 5373200 - DNA, 23 bp, Homo sapiens
atgcactttgctttaatataaat

SEQ ID NO: 5373201 - DNA, 15 bp, Homo sapiens
atgcactttgttctg

SEQ ID NO: 5373202 - DNA, 16 bp, Homo sapiens
atgcactttgttctgg

SEQ ID NO: 5373203 - DNA, 16 bp, Homo sapiens
atgcacttttagaaat

SEQ ID NO: 5373204 - DNA, 17 bp, Homo sapiens
atgcacttttgggcctt

SEQ ID NO: 5373205 - DNA, 20 bp, Homo sapiens
atgcacttttttgtgtgttc

SEQ ID NO: 5373206 - DNA, 15 bp, Homo sapiens
atgcagaaagcatcc

SEQ ID NO: 5373207 - DNA, 21 bp, Homo sapiens
atgcagaaatagacaaaaagt

SEQ ID NO: 5373208 - DNA, 22 bp, Homo sapiens
atgcagaaatgtggatgctctt

SEQ ID NO: 5373209 - DNA, 19 bp, Homo sapiens
atgcagaacaaatgaagac

SEQ ID NO: 5373210 - DNA, 21 bp, Homo sapiens
atgcagaacaggcagaaatat

SEQ ID NO: 5373211 - DNA, 18 bp, Homo sapiens
atgcagaaccacaaacaa

SEQ ID NO: 5373212 - DNA, 15 bp, Homo sapiens
atgcagaacgtattt

SEQ ID NO: 5373213 - DNA, 18 bp, Homo sapiens
atgcagaacttccctcca

SEQ ID NO: 5373214 - DNA, 17 bp, Homo sapiens
atgcagaactttctctt

SEQ ID NO: 5373215 - DNA, 13 bp, Homo sapiens
atgcagaaggtat

SEQ ID NO: 5373216 - DNA, 18 bp, Homo sapiens
atgcagaaggtatttttg

SEQ ID NO: 5373217 - DNA, 21 bp, Homo sapiens
atgcagaatgttgattacagt

SEQ ID NO: 5373218 - DNA, 20 bp, Homo sapiens
atgcagaatgtttttaaaat

SEQ ID NO: 5373219 - DNA, 19 bp, Homo sapiens
atgcagacaaagccctgtc

SEQ ID NO: 5373220 - DNA, 11 bp, Homo sapiens
atgcagacaca

SEQ ID NO: 5373221 - DNA, 12 bp, Homo sapiens
atgcagacacag

SEQ ID NO: 5373222 - DNA, 16 bp, Homo sapiens
atgcagacagtctgtt

SEQ ID NO: 5373223 - DNA, 23 bp, Homo sapiens
atgcagacagtctgttatgcact

SEQ ID NO: 5373224 - DNA, 18 bp, Homo sapiens
atgcagacatctctggag

SEQ ID NO: 5373225 - DNA, 20 bp, Homo sapiens
atgcagacatctctggagcc

SEQ ID NO: 5373226 - DNA, 21 bp, Homo sapiens
atgcagacatctctggagcca

SEQ ID NO: 5373227 - DNA, 22 bp, Homo sapiens
atgcagacatgagtgcgtgctc

SEQ ID NO: 5373228 - DNA, 18 bp, Homo sapiens
atgcagagacagctgttt

SEQ ID NO: 5373229 - DNA, 14 bp, Homo sapiens
atgcagagagccat

SEQ ID NO: 5373230 - DNA, 19 bp, Homo sapiens
atgcagagagccattttgt

SEQ ID NO: 5373231 - DNA, 22 bp, Homo sapiens
atgcagagagccattttgtgaa

SEQ ID NO: 5373232 - DNA, 23 bp, Homo sapiens
atgcagagcgccgtgagttctca

SEQ ID NO: 5373233 - DNA, 22 bp, Homo sapiens
atgcagaggaggtgagagtggg

SEQ ID NO: 5373234 - DNA, 15 bp, Homo sapiens
atgcagaggcctgca

SEQ ID NO: 5373235 - DNA, 21 bp, Homo sapiens
atgcagaggggtgctgctcct

SEQ ID NO: 5373236 - DNA, 15 bp, Homo sapiens
atgcagagtaagtat

SEQ ID NO: 5373237 - DNA, 15 bp, Homo sapiens
atgcagagtcagcag

SEQ ID NO: 5373238 - DNA, 16 bp, Homo sapiens
atgcagagtcagcaga

SEQ ID NO: 5373239 - DNA, 19 bp, Homo sapiens
atgcagagttgacatgaga

SEQ ID NO: 5373240 - DNA, 16 bp, Homo sapiens
atgcagataaatacat

SEQ ID NO: 5373241 - DNA, 17 bp, Homo sapiens
atgcagataaatacatt

SEQ ID NO: 5373242 - DNA, 14 bp, Homo sapiens
atgcagatgccaga

SEQ ID NO: 5373243 - DNA, 15 bp, Homo sapiens
atgcagatgcctggg

SEQ ID NO: 5373244 - DNA, 16 bp, Homo sapiens
atgcagattacactga

SEQ ID NO: 5373245 - DNA, 19 bp, Homo sapiens
atgcagattcctgggcctg

SEQ ID NO: 5373246 - DNA, 21 bp, Homo sapiens
atgcagcaacacccaagtcca

SEQ ID NO: 5373247 - DNA, 13 bp, Homo sapiens
atgcagcactgct

SEQ ID NO: 5373248 - DNA, 16 bp, Homo sapiens
atgcagcactgctgcc

SEQ ID NO: 5373249 - DNA, 21 bp, Homo sapiens
atgcagcacttcagatcaagt

SEQ ID NO: 5373250 - DNA, 19 bp, Homo sapiens
atgcagcagcttgctgcac

SEQ ID NO: 5373251 - DNA, 17 bp, Homo sapiens
atgcagcatacaaaaat

SEQ ID NO: 5373252 - DNA, 18 bp, Homo sapiens
atgcagcatacaaaaata

SEQ ID NO: 5373253 - DNA, 20 bp, Homo sapiens
atgcagcatacaaaaatata

SEQ ID NO: 5373254 - DNA, 22 bp, Homo sapiens
atgcagcatacaaaaatatatt

SEQ ID NO: 5373255 - DNA, 17 bp, Homo sapiens
atgcagcatggggtttt

SEQ ID NO: 5373256 - DNA, 14 bp, Homo sapiens
atgcagcatttgat

SEQ ID NO: 5373257 - DNA, 19 bp, Homo sapiens
atgcagccacgattggaga

SEQ ID NO: 5373258 - DNA, 20 bp, Homo sapiens
atgcagccacgattggagaa

SEQ ID NO: 5373259 - DNA, 21 bp, Homo sapiens
atgcagccacgattggagaat

SEQ ID NO: 5373260 - DNA, 17 bp, Homo sapiens
atgcagccacttaggac

SEQ ID NO: 5373261 - DNA, 14 bp, Homo sapiens
atgcagcccctggg

SEQ ID NO: 5373262 - DNA, 15 bp, Homo sapiens
atgcagcccctgggc

SEQ ID NO: 5373263 - DNA, 17 bp, Homo sapiens
atgcagcccctgggccc

SEQ ID NO: 5373264 - DNA, 20 bp, Homo sapiens
atgcagcccctgggcccttg

SEQ ID NO: 5373265 - DNA, 13 bp, Homo sapiens
atgcagcctgctc

SEQ ID NO: 5373266 - DNA, 13 bp, Homo sapiens
atgcagcctgtgg

SEQ ID NO: 5373267 - DNA, 20 bp, Homo sapiens
atgcagcgaattcagaaaga

SEQ ID NO: 5373268 - DNA, 15 bp, Homo sapiens
atgcagctactggaa

SEQ ID NO: 5373269 - DNA, 13 bp, Homo sapiens
atgcagctcaact

SEQ ID NO: 5373270 - DNA, 15 bp, Homo sapiens
atgcagctgcctggg

SEQ ID NO: 5373271 - DNA, 20 bp, Homo sapiens
atgcagctgcctggggccca

SEQ ID NO: 5373272 - DNA, 17 bp, Homo sapiens
atgcagctgctccccag

SEQ ID NO: 5373273 - DNA, 15 bp, Homo sapiens
atgcagctgtggcag

SEQ ID NO: 5373274 - DNA, 21 bp, Homo sapiens
atgcagctgttgagaaaacga

SEQ ID NO: 5373275 - DNA, 16 bp, Homo sapiens
atgcagcttatacgaa

SEQ ID NO: 5373276 - DNA, 21 bp, Homo sapiens
atgcagcttatacgaaataat

SEQ ID NO: 5373277 - DNA, 18 bp, Homo sapiens
atgcagcttcatcaattt

SEQ ID NO: 5373278 - DNA, 21 bp, Homo sapiens
atgcagcttcatcaattttta

SEQ ID NO: 5373279 - DNA, 18 bp, Homo sapiens
atgcagcttggagacagg

SEQ ID NO: 5373280 - DNA, 17 bp, Homo sapiens
atgcagcttgtccttgc

SEQ ID NO: 5373281 - DNA, 14 bp, Homo sapiens
atgcagctttgcaa

SEQ ID NO: 5373282 - DNA, 15 bp, Homo sapiens
atgcaggaactgaaa

SEQ ID NO: 5373283 - DNA, 16 bp, Homo sapiens
atgcaggaagaccaca

SEQ ID NO: 5373284 - DNA, 15 bp, Homo sapiens
atgcaggaagaggcc

SEQ ID NO: 5373285 - DNA, 16 bp, Homo sapiens
atgcaggaagaggccc

SEQ ID NO: 5373286 - DNA, 17 bp, Homo sapiens
atgcaggaagaggccca

SEQ ID NO: 5373287 - DNA, 15 bp, Homo sapiens
atgcaggacaggagg

SEQ ID NO: 5373288 - DNA, 20 bp, Homo sapiens
atgcaggaggtggagaaaat

SEQ ID NO: 5373289 - DNA, 20 bp, Homo sapiens
atgcagggaatgcaatcctt

SEQ ID NO: 5373290 - DNA, 15 bp, Homo sapiens
atgcagggaggccac

SEQ ID NO: 5373291 - DNA, 16 bp, Homo sapiens
atgcagggaggccacg

SEQ ID NO: 5373292 - DNA, 21 bp, Homo sapiens
atgcagggcccccacaggagc

SEQ ID NO: 5373293 - DNA, 17 bp, Homo sapiens
atgcagggggctcctgg

SEQ ID NO: 5373294 - DNA, 16 bp, Homo sapiens
atgcaggggtcagtgc

SEQ ID NO: 5373295 - DNA, 18 bp, Homo sapiens
atgcaggggtcagtgcag

SEQ ID NO: 5373296 - DNA, 17 bp, Homo sapiens
atgcaggtgaaacccag

SEQ ID NO: 5373297 - DNA, 18 bp, Homo sapiens
atgcaggtgaaacccagt

SEQ ID NO: 5373298 - DNA, 17 bp, Homo sapiens
atgcaggtgaacttttt

SEQ ID NO: 5373299 - DNA, 21 bp, Homo sapiens
atgcaggtggatctccttgag

SEQ ID NO: 5373300 - DNA, 23 bp, Homo sapiens
atgcaggtttgaccaggaaagca

SEQ ID NO: 5373301 - DNA, 14 bp, Homo sapiens
atgcaggttttcta

SEQ ID NO: 5373302 - DNA, 19 bp, Homo sapiens
atgcagtacaggacatata

SEQ ID NO: 5373303 - DNA, 17 bp, Homo sapiens
atgcagtactaaaatta

SEQ ID NO: 5373304 - DNA, 13 bp, Homo sapiens
atgcagtataaaa

SEQ ID NO: 5373305 - DNA, 14 bp, Homo sapiens
atgcagtataaaat

SEQ ID NO: 5373306 - DNA, 16 bp, Homo sapiens
atgcagtataaaatgt

SEQ ID NO: 5373307 - DNA, 22 bp, Homo sapiens
atgcagtatggtacatttttca

SEQ ID NO: 5373308 - DNA, 15 bp, Homo sapiens
atgcagtattgagca

SEQ ID NO: 5373309 - DNA, 16 bp, Homo sapiens
atgcagtattgagtgt

SEQ ID NO: 5373310 - DNA, 16 bp, Homo sapiens
atgcagtattgccaca

SEQ ID NO: 5373311 - DNA, 21 bp, Homo sapiens
atgcagtcagtgtttctttta

SEQ ID NO: 5373312 - DNA, 17 bp, Homo sapiens
atgcagtccagaataag

SEQ ID NO: 5373313 - DNA, 20 bp, Homo sapiens
atgcagtccagaataagtgc

SEQ ID NO: 5373314 - DNA, 16 bp, Homo sapiens
atgcagtccagtgaga

SEQ ID NO: 5373315 - DNA, 15 bp, Homo sapiens
atgcagtcctcagga

SEQ ID NO: 5373316 - DNA, 14 bp, Homo sapiens
atgcagtcctgagg

SEQ ID NO: 5373317 - DNA, 13 bp, Homo sapiens
atgcagtctcctc

SEQ ID NO: 5373318 - DNA, 19 bp, Homo sapiens
atgcagtctcctctttaaa

SEQ ID NO: 5373319 - DNA, 13 bp, Homo sapiens
atgcagtcttaga

SEQ ID NO: 5373320 - DNA, 22 bp, Homo sapiens
atgcagtcttagatcatagttt

SEQ ID NO: 5373321 - DNA, 18 bp, Homo sapiens
atgcagtgatatggcaga

SEQ ID NO: 5373322 - DNA, 14 bp, Homo sapiens
atgcagtgccctag

SEQ ID NO: 5373323 - DNA, 17 bp, Homo sapiens
atgcagtgcctttcttc

SEQ ID NO: 5373324 - DNA, 13 bp, Homo sapiens
atgcagtgctcgc

SEQ ID NO: 5373325 - DNA, 20 bp, Homo sapiens
atgcagtgctcgctgttgct

SEQ ID NO: 5373326 - DNA, 14 bp, Homo sapiens
atgcagtgtattta

SEQ ID NO: 5373327 - DNA, 21 bp, Homo sapiens
atgcccctggccctgcctcac

SEQ ID NO: 5373328 - DNA, 19 bp, Homo sapiens
atgccccttcttgggcccc

SEQ ID NO: 5373329 - DNA, 16 bp, Homo sapiens
atgccccttggctgga

SEQ ID NO: 5373330 - DNA, 19 bp, Homo sapiens
atgccccttggctggatca

SEQ ID NO: 5373331 - DNA, 16 bp, Homo sapiens
atgccccttggtcctg

SEQ ID NO: 5373332 - DNA, 21 bp, Homo sapiens
atgcccgagtccgcccatccc

SEQ ID NO: 5373333 - DNA, 16 bp, Homo sapiens
atgcccgcccggggag

SEQ ID NO: 5373334 - DNA, 14 bp, Homo sapiens
atgcccgcctagtt

SEQ ID NO: 5373335 - DNA, 17 bp, Homo sapiens
atgcccggctaattttt

SEQ ID NO: 5373336 - DNA, 20 bp, Homo sapiens
atgcccgggggacgcctgcc

SEQ ID NO: 5373337 - DNA, 23 bp, Homo sapiens
atgcccgggggacgcctgccctg

SEQ ID NO: 5373338 - DNA, 19 bp, Homo sapiens
atgccctaaaatgtagtga

SEQ ID NO: 5373339 - DNA, 23 bp, Homo sapiens
atgccctactctcttatgcatta

SEQ ID NO: 5373340 - DNA, 20 bp, Homo sapiens
atgccctataacccctgcct

SEQ ID NO: 5373341 - DNA, 23 bp, Homo sapiens
atgccctataacccctgcctgga

SEQ ID NO: 5373342 - DNA, 19 bp, Homo sapiens
atgccctatcttagtagag

SEQ ID NO: 5373343 - DNA, 19 bp, Homo sapiens
atgccctcaagtaaaagaa

SEQ ID NO: 5373344 - DNA, 16 bp, Homo sapiens
atgccctcagctctta

SEQ ID NO: 5373345 - DNA, 19 bp, Homo sapiens
atgccctcatacccatgca

SEQ ID NO: 5373346 - DNA, 14 bp, Homo sapiens
atgccctcccagga

SEQ ID NO: 5373347 - DNA, 16 bp, Homo sapiens
atgccctcccctcagc

SEQ ID NO: 5373348 - DNA, 13 bp, Homo sapiens
atgccctcccttc

SEQ ID NO: 5373349 - DNA, 16 bp, Homo sapiens
atgccctcccttctcc

SEQ ID NO: 5373350 - DNA, 22 bp, Homo sapiens
atgccctcccttctccctggat

SEQ ID NO: 5373351 - DNA, 14 bp, Homo sapiens
atgccctcctggtg

SEQ ID NO: 5373352 - DNA, 13 bp, Homo sapiens
atgccctctcagg

SEQ ID NO: 5373353 - DNA, 13 bp, Homo sapiens
atgccctctctga

SEQ ID NO: 5373354 - DNA, 23 bp, Homo sapiens
atgccctctctgagtctggactt

SEQ ID NO: 5373355 - DNA, 22 bp, Homo sapiens
atgccctgaaactactgtatct

SEQ ID NO: 5373356 - DNA, 17 bp, Homo sapiens
atgccctgcagagcaat

SEQ ID NO: 5373357 - DNA, 19 bp, Homo sapiens
atgccctgcagagcaataa

SEQ ID NO: 5373358 - DNA, 16 bp, Homo sapiens
atgccctgcccttcct

SEQ ID NO: 5373359 - DNA, 11 bp, Homo sapiens
atgccctgcct

SEQ ID NO: 5373360 - DNA, 19 bp, Homo sapiens
atgccctgccttgctgcct

SEQ ID NO: 5373361 - DNA, 21 bp, Homo sapiens
atgccctgccttgtccctctc

SEQ ID NO: 5373362 - DNA, 16 bp, Homo sapiens
atgccctgcggctctg

SEQ ID NO: 5373363 - DNA, 18 bp, Homo sapiens
atgccctgcggctctgga

SEQ ID NO: 5373364 - DNA, 15 bp, Homo sapiens
atgccctgctggcct

SEQ ID NO: 5373365 - DNA, 12 bp, Homo sapiens
atgccctggacc

SEQ ID NO: 5373366 - DNA, 16 bp, Homo sapiens
atgccctgggatgcct

SEQ ID NO: 5373367 - DNA, 19 bp, Homo sapiens
atgccctgtccctagctca

SEQ ID NO: 5373368 - DNA, 23 bp, Homo sapiens
atgccctgttggtttcacagata

SEQ ID NO: 5373369 - DNA, 12 bp, Homo sapiens
atgcccttcact

SEQ ID NO: 5373370 - DNA, 13 bp, Homo sapiens
atgcccttccccc

SEQ ID NO: 5373371 - DNA, 15 bp, Homo sapiens
atgcccttcctttct

SEQ ID NO: 5373372 - DNA, 23 bp, Homo sapiens
atgcccttctgattcccctccac

SEQ ID NO: 5373373 - DNA, 13 bp, Homo sapiens
atgcccttgctgg

SEQ ID NO: 5373374 - DNA, 19 bp, Homo sapiens
atgccctttggaaagccat

SEQ ID NO: 5373375 - DNA, 21 bp, Homo sapiens
atgccgaatgccctcagggga

SEQ ID NO: 5373376 - DNA, 20 bp, Homo sapiens
atgccgaatttggtacacat

SEQ ID NO: 5373377 - DNA, 23 bp, Homo sapiens
atgccgaatttggtacacatgtg

SEQ ID NO: 5373378 - DNA, 17 bp, Homo sapiens
atgccgagacctcaagc

SEQ ID NO: 5373379 - DNA, 16 bp, Homo sapiens
atgccgatttctgtaa

SEQ ID NO: 5373380 - DNA, 19 bp, Homo sapiens
atgccgcagggagggctgt

SEQ ID NO: 5373381 - DNA, 20 bp, Homo sapiens
atgccgcagggagggctgtg

SEQ ID NO: 5373382 - DNA, 16 bp, Homo sapiens
atgccgccgcagctgg

SEQ ID NO: 5373383 - DNA, 20 bp, Homo sapiens
atgccgccgcagctggttgg

SEQ ID NO: 5373384 - DNA, 14 bp, Homo sapiens
atgccgcctgtcaa

SEQ ID NO: 5373385 - DNA, 18 bp, Homo sapiens
atgccgcgggcggccagg

SEQ ID NO: 5373386 - DNA, 19 bp, Homo sapiens
atgccgcgggcggccaggc

SEQ ID NO: 5373387 - DNA, 14 bp, Homo sapiens
atgccgctcttctg

SEQ ID NO: 5373388 - DNA, 20 bp, Homo sapiens
atgccgctcttctgtcatcc

SEQ ID NO: 5373389 - DNA, 14 bp, Homo sapiens
atgccgctgtgtct

SEQ ID NO: 5373390 - DNA, 22 bp, Homo sapiens
atgccgctgtgtctatgaacta

SEQ ID NO: 5373391 - DNA, 17 bp, Homo sapiens
atgccggatgtgctttt

SEQ ID NO: 5373392 - DNA, 15 bp, Homo sapiens
atgccgggcgccagg

SEQ ID NO: 5373393 - DNA, 16 bp, Homo sapiens
atgccggtacacagcc

SEQ ID NO: 5373394 - DNA, 17 bp, Homo sapiens
atgccggtacacagcca

SEQ ID NO: 5373395 - DNA, 22 bp, Homo sapiens
atgccgtataggatgtcagaca

SEQ ID NO: 5373396 - DNA, 14 bp, Homo sapiens
atgccgtcttctgc

SEQ ID NO: 5373397 - DNA, 13 bp, Homo sapiens
atgccgtgcgggc

SEQ ID NO: 5373398 - DNA, 22 bp, Homo sapiens
atgccgtggattgcacgtggcc

SEQ ID NO: 5373399 - DNA, 17 bp, Homo sapiens
atgccgtgtagtttctg

SEQ ID NO: 5373400 - DNA, 14 bp, Homo sapiens
atgccgttactttt

SEQ ID NO: 5373401 - DNA, 20 bp, Homo sapiens
atgccgttacttttcatatt

SEQ ID NO: 5373402 - DNA, 15 bp, Homo sapiens
atgccgttctgttcc

SEQ ID NO: 5373403 - DNA, 20 bp, Homo sapiens
atgccgttctgttccaacct

SEQ ID NO: 5373404 - DNA, 21 bp, Homo sapiens
atgccgttctgttccaacctc

SEQ ID NO: 5373405 - DNA, 16 bp, Homo sapiens
atgcctaagaagatga

SEQ ID NO: 5373406 - DNA, 19 bp, Homo sapiens
atgcctacaaccatccctg

SEQ ID NO: 5373407 - DNA, 15 bp, Homo sapiens
atgcctacagataat

SEQ ID NO: 5373408 - DNA, 15 bp, Homo sapiens
atgcctacagctgtc

SEQ ID NO: 5373409 - DNA, 19 bp, Homo sapiens
atgcctacattagtgagat

SEQ ID NO: 5373410 - DNA, 23 bp, Homo sapiens
atgcctaccaatatttaatcttt

SEQ ID NO: 5373411 - DNA, 18 bp, Homo sapiens
atgcctacttgtaatttc

SEQ ID NO: 5373412 - DNA, 17 bp, Homo sapiens
atgcctagcagagtgct

SEQ ID NO: 5373413 - DNA, 18 bp, Homo sapiens
atgcctagcagagtgctg

SEQ ID NO: 5373414 - DNA, 17 bp, Homo sapiens
atgcctaggccagctcc

SEQ ID NO: 5373415 - DNA, 16 bp, Homo sapiens
atgcctagtccaacat

SEQ ID NO: 5373416 - DNA, 23 bp, Homo sapiens
atgcctagtttcttacacactgt

SEQ ID NO: 5373417 - DNA, 18 bp, Homo sapiens
atgcctagtttttagtaa

SEQ ID NO: 5373418 - DNA, 22 bp, Homo sapiens
atgcctatattatcataagaat

SEQ ID NO: 5373419 - DNA, 19 bp, Homo sapiens
atgcctatggtggatccaa

SEQ ID NO: 5373420 - DNA, 19 bp, Homo sapiens
atgcctatgtagtgtcttt

SEQ ID NO: 5373421 - DNA, 14 bp, Homo sapiens
atgcctatttactg

SEQ ID NO: 5373422 - DNA, 15 bp, Homo sapiens
atgcctatttactgg

SEQ ID NO: 5373423 - DNA, 20 bp, Homo sapiens
atgcctcactaatttttgta

SEQ ID NO: 5373424 - DNA, 21 bp, Homo sapiens
atgcctcactaatttttgtat

SEQ ID NO: 5373425 - DNA, 23 bp, Homo sapiens
atgcctcactaatttttgtatta

SEQ ID NO: 5373426 - DNA, 23 bp, Homo sapiens
atgcctcactttcttctagctga

SEQ ID NO: 5373427 - DNA, 15 bp, Homo sapiens
atgcctcagaagtgc

SEQ ID NO: 5373428 - DNA, 23 bp, Homo sapiens
atgcctcagaagtgcatctggag

SEQ ID NO: 5373429 - DNA, 14 bp, Homo sapiens
atgcctcagccagc

SEQ ID NO: 5373430 - DNA, 15 bp, Homo sapiens
atgcctcagccagcc

SEQ ID NO: 5373431 - DNA, 19 bp, Homo sapiens
atgcctcagtgtatttgta

SEQ ID NO: 5373432 - DNA, 20 bp, Homo sapiens
atgcctcagtgtatttgtat

SEQ ID NO: 5373433 - DNA, 14 bp, Homo sapiens
atgcctcagtttcc

SEQ ID NO: 5373434 - DNA, 16 bp, Homo sapiens
atgcctcattttattc

SEQ ID NO: 5373435 - DNA, 19 bp, Homo sapiens
atgcctccaagccattcac

SEQ ID NO: 5373436 - DNA, 12 bp, Homo sapiens
atgcctccagct

SEQ ID NO: 5373437 - DNA, 16 bp, Homo sapiens
atgcctccatttcaga

SEQ ID NO: 5373438 - DNA, 13 bp, Homo sapiens
atgcctcccaggc

SEQ ID NO: 5373439 - DNA, 14 bp, Homo sapiens
atgcctcccaggcc

SEQ ID NO: 5373440 - DNA, 12 bp, Homo sapiens
atgcctccccaa

SEQ ID NO: 5373441 - DNA, 12 bp, Homo sapiens
atgcctccctgg

SEQ ID NO: 5373442 - DNA, 19 bp, Homo sapiens
atgcctccctgggccacct

SEQ ID NO: 5373443 - DNA, 22 bp, Homo sapiens
atgcctccctgggccacctcct

SEQ ID NO: 5373444 - DNA, 14 bp, Homo sapiens
atgcctcctcagga

SEQ ID NO: 5373445 - DNA, 18 bp, Homo sapiens
atgcctcctcaggagccg

SEQ ID NO: 5373446 - DNA, 19 bp, Homo sapiens
atgcctcctcctgccctcc

SEQ ID NO: 5373447 - DNA, 15 bp, Homo sapiens
atgcctcctctgtcc

SEQ ID NO: 5373448 - DNA, 15 bp, Homo sapiens
atgcctcctgaggct

SEQ ID NO: 5373449 - DNA, 15 bp, Homo sapiens
atgcctcctgtgggg

SEQ ID NO: 5373450 - DNA, 14 bp, Homo sapiens
atgcctccttcctc

SEQ ID NO: 5373451 - DNA, 13 bp, Homo sapiens
atgcctccttggc

SEQ ID NO: 5373452 - DNA, 14 bp, Homo sapiens
atgcctccttggcc

SEQ ID NO: 5373453 - DNA, 11 bp, Homo sapiens
atgcctctccc

SEQ ID NO: 5373454 - DNA, 15 bp, Homo sapiens
atgcctctcccgcac

SEQ ID NO: 5373455 - DNA, 20 bp, Homo sapiens
atgcctctcctttgtatatt

SEQ ID NO: 5373456 - DNA, 21 bp, Homo sapiens
atgcctctcctttgtatatta

SEQ ID NO: 5373457 - DNA, 13 bp, Homo sapiens
atgcctctctcag

SEQ ID NO: 5373458 - DNA, 20 bp, Homo sapiens
atgcctctgacagtccacag

SEQ ID NO: 5373459 - DNA, 12 bp, Homo sapiens
atgcctctgagg

SEQ ID NO: 5373460 - DNA, 14 bp, Homo sapiens
atgcctctgaggcc

SEQ ID NO: 5373461 - DNA, 17 bp, Homo sapiens
atgcctctgaggccagc

SEQ ID NO: 5373462 - DNA, 20 bp, Homo sapiens
atgcctctgaggccagcctg

SEQ ID NO: 5373463 - DNA, 21 bp, Homo sapiens
atgcctctgaggccagcctgg

SEQ ID NO: 5373464 - DNA, 23 bp, Homo sapiens
atgcctctgaggccagcctggcc

SEQ ID NO: 5373465 - DNA, 21 bp, Homo sapiens
atgcctctgatatgggactga

SEQ ID NO: 5373466 - DNA, 14 bp, Homo sapiens
atgcctctgccttg

SEQ ID NO: 5373467 - DNA, 11 bp, Homo sapiens
atgcctctgga

SEQ ID NO: 5373468 - DNA, 20 bp, Homo sapiens
atgcctctggaggcctctgg

SEQ ID NO: 5373469 - DNA, 13 bp, Homo sapiens
atgcctctgtcta

SEQ ID NO: 5373470 - DNA, 22 bp, Homo sapiens
atgcctctgtctagcatgccaa

SEQ ID NO: 5373471 - DNA, 16 bp, Homo sapiens
atgcctcttctacctc

SEQ ID NO: 5373472 - DNA, 22 bp, Homo sapiens
atgcctgagaatgcctaggcca

SEQ ID NO: 5373473 - DNA, 23 bp, Homo sapiens
atgcctgagaatgcctaggccag

SEQ ID NO: 5373474 - DNA, 12 bp, Homo sapiens
atgcctgagggt

SEQ ID NO: 5373475 - DNA, 22 bp, Homo sapiens
atgcctgagttataaatatttt

SEQ ID NO: 5373476 - DNA, 20 bp, Homo sapiens
atgcctgattcggacggcca

SEQ ID NO: 5373477 - DNA, 14 bp, Homo sapiens
atgcctgcactggg

SEQ ID NO: 5373478 - DNA, 12 bp, Homo sapiens
atgcctgccaaa

SEQ ID NO: 5373479 - DNA, 19 bp, Homo sapiens
atgcctgcccattagagaa

SEQ ID NO: 5373480 - DNA, 23 bp, Homo sapiens
atgcctgcccgcaccctggcctg

SEQ ID NO: 5373481 - DNA, 12 bp, Homo sapiens
atgcctgcctga

SEQ ID NO: 5373482 - DNA, 16 bp, Homo sapiens
atgcctgcgcctgctg

SEQ ID NO: 5373483 - DNA, 13 bp, Homo sapiens
atgcctgctccct

SEQ ID NO: 5373484 - DNA, 20 bp, Homo sapiens
atgcctgctccctgtctgtg

SEQ ID NO: 5373485 - DNA, 13 bp, Homo sapiens
atgcctgctgctg

SEQ ID NO: 5373486 - DNA, 17 bp, Homo sapiens
atgcctgctgctgccaa

SEQ ID NO: 5373487 - DNA, 23 bp, Homo sapiens
atgcctggaagctttgtcccctg

SEQ ID NO: 5373488 - DNA, 10 bp, Homo sapiens
atgcctggag

SEQ ID NO: 5373489 - DNA, 20 bp, Homo sapiens
atgcctggcccccctccagg

SEQ ID NO: 5373490 - DNA, 15 bp, Homo sapiens
atgcctggcccctcc

SEQ ID NO: 5373491 - DNA, 21 bp, Homo sapiens
atgcctggcccctcctcctag

SEQ ID NO: 5373492 - DNA, 17 bp, Homo sapiens
atgcctggcctgaggac

SEQ ID NO: 5373493 - DNA, 16 bp, Homo sapiens
atgcctggcctgccag

SEQ ID NO: 5373494 - DNA, 18 bp, Homo sapiens
atgcctgggcccaggccc

SEQ ID NO: 5373495 - DNA, 19 bp, Homo sapiens
atgcctgggcccaggccca

SEQ ID NO: 5373496 - DNA, 14 bp, Homo sapiens
atgcctgggcctga

SEQ ID NO: 5373497 - DNA, 15 bp, Homo sapiens
atgcctgggcctgat

SEQ ID NO: 5373498 - DNA, 18 bp, Homo sapiens
atgcctggtctttcctct

SEQ ID NO: 5373499 - DNA, 17 bp, Homo sapiens
atgcctggtggcagctg

SEQ ID NO: 5373500 - DNA, 21 bp, Homo sapiens
atgcctggtggcagctgcggt

SEQ ID NO: 5373501 - DNA, 12 bp, Homo sapiens
atgcctgtaatc

SEQ ID NO: 5373502 - DNA, 16 bp, Homo sapiens
atgcctgtaatcccag

SEQ ID NO: 5373503 - DNA, 17 bp, Homo sapiens
atgcctgtaatcccagc

SEQ ID NO: 5373504 - DNA, 18 bp, Homo sapiens
atgcctgtaatcccagca

SEQ ID NO: 5373505 - DNA, 13 bp, Homo sapiens
atgctgcctgcct

SEQ ID NO: 5373506 - DNA, 17 bp, Homo sapiens
atgctgcctgcctgtct

SEQ ID NO: 5373507 - DNA, 11 bp, Homo sapiens
atgctgcctgg

SEQ ID NO: 5373508 - DNA, 13 bp, Homo sapiens
atgctgcctggca

SEQ ID NO: 5373509 - DNA, 14 bp, Homo sapiens
atgctgcctggcac

SEQ ID NO: 5373510 - DNA, 23 bp, Homo sapiens
atgctgcctgggagccagggtga

SEQ ID NO: 5373511 - DNA, 12 bp, Homo sapiens
atgctgccttca

SEQ ID NO: 5373512 - DNA, 22 bp, Homo sapiens
atgctgccttcccatgaatctg

SEQ ID NO: 5373513 - DNA, 18 bp, Homo sapiens
atgctgccttttctttaa

SEQ ID NO: 5373514 - DNA, 17 bp, Homo sapiens
atgctgcgcttcgcttg

SEQ ID NO: 5373515 - DNA, 19 bp, Homo sapiens
atgctgctaattcaaagct

SEQ ID NO: 5373516 - DNA, 16 bp, Homo sapiens
atgctgctagatcttt

SEQ ID NO: 5373517 - DNA, 17 bp, Homo sapiens
atgctgctagatcttta

SEQ ID NO: 5373518 - DNA, 15 bp, Homo sapiens
atgctgctatacaca

SEQ ID NO: 5373519 - DNA, 15 bp, Homo sapiens
atgctgctgaagaga

SEQ ID NO: 5373520 - DNA, 15 bp, Homo sapiens
atgctgctgagcaca

SEQ ID NO: 5373521 - DNA, 13 bp, Homo sapiens
atgctgctgcccc

SEQ ID NO: 5373522 - DNA, 13 bp, Homo sapiens
atgctgctggaca

SEQ ID NO: 5373523 - DNA, 12 bp, Homo sapiens
atgctgctggcc

SEQ ID NO: 5373524 - DNA, 17 bp, Homo sapiens
atgctgctggggaagac

SEQ ID NO: 5373525 - DNA, 18 bp, Homo sapiens
atgctgctggggaagaca

SEQ ID NO: 5373526 - DNA, 20 bp, Homo sapiens
atgctgctggggaagacagt

SEQ ID NO: 5373527 - DNA, 14 bp, Homo sapiens
atgctgctgtgaat

SEQ ID NO: 5373528 - DNA, 16 bp, Homo sapiens
atgctgcttccactca

SEQ ID NO: 5373529 - DNA, 21 bp, Homo sapiens
atgctgcttccactcagggct

SEQ ID NO: 5373530 - DNA, 20 bp, Homo sapiens
atgctgcttctcctcccagc

SEQ ID NO: 5373531 - DNA, 22 bp, Homo sapiens
atgctgctttaacagtggagct

SEQ ID NO: 5373532 - DNA, 19 bp, Homo sapiens
atgctgctttaattgtgaa

SEQ ID NO: 5373533 - DNA, 17 bp, Homo sapiens
atgctgctttcccctgt

SEQ ID NO: 5373534 - DNA, 23 bp, Homo sapiens
atgctgctttcccctgtggggat

SEQ ID NO: 5373535 - DNA, 15 bp, Homo sapiens
atgctgctttgtcca

SEQ ID NO: 5373536 - DNA, 17 bp, Homo sapiens
atgctgctttgtccagg

SEQ ID NO: 5373537 - DNA, 11 bp, Homo sapiens
atgctgctttt

SEQ ID NO: 5373538 - DNA, 18 bp, Homo sapiens
atgctgcttttatatctg

SEQ ID NO: 5373539 - DNA, 21 bp, Homo sapiens
atgctgcttttatatctgtat

SEQ ID NO: 5373540 - DNA, 22 bp, Homo sapiens
atgctgctttttggcacagttg

SEQ ID NO: 5373541 - DNA, 17 bp, Homo sapiens
atgctggaacctgcaaa

SEQ ID NO: 5373542 - DNA, 23 bp, Homo sapiens
atgctggacaggtctgggagagg

SEQ ID NO: 5373543 - DNA, 21 bp, Homo sapiens
atgctggacggcattcctgct

SEQ ID NO: 5373544 - DNA, 22 bp, Homo sapiens
atgctggactggaggcccctgg

SEQ ID NO: 5373545 - DNA, 15 bp, Homo sapiens
atgctggagaagaga

SEQ ID NO: 5373546 - DNA, 16 bp, Homo sapiens
atgctggagaagagag

SEQ ID NO: 5373547 - DNA, 18 bp, Homo sapiens
atgctggagaagagagga

SEQ ID NO: 5373548 - DNA, 19 bp, Homo sapiens
atgctggagaagagaggag

SEQ ID NO: 5373549 - DNA, 12 bp, Homo sapiens
atgctggagcct

SEQ ID NO: 5373550 - DNA, 13 bp, Homo sapiens
atgctggagcctg

SEQ ID NO: 5373551 - DNA, 14 bp, Homo sapiens
atgctggagcggct

SEQ ID NO: 5373552 - DNA, 15 bp, Homo sapiens
atgctggaggcagag

SEQ ID NO: 5373553 - DNA, 20 bp, Homo sapiens
atgctggagtacccagccta

SEQ ID NO: 5373554 - DNA, 17 bp, Homo sapiens
atgctggatgagcaact

SEQ ID NO: 5373555 - DNA, 19 bp, Homo sapiens
atgctggatgtctgccaat

SEQ ID NO: 5373556 - DNA, 19 bp, Homo sapiens
atgctggcaaatccaggct

SEQ ID NO: 5373557 - DNA, 20 bp, Homo sapiens
atgctggcaaatccaggctg

SEQ ID NO: 5373558 - DNA, 21 bp, Homo sapiens
atgctggcatagagcagcact

SEQ ID NO: 5373559 - DNA, 16 bp, Homo sapiens
atgctggcatctctgc

SEQ ID NO: 5373560 - DNA, 13 bp, Homo sapiens
atgctggccagca

SEQ ID NO: 5373561 - DNA, 15 bp, Homo sapiens
atgctggccagcacc

SEQ ID NO: 5373562 - DNA, 20 bp, Homo sapiens
atgctggccagcaccctctc

SEQ ID NO: 5373563 - DNA, 14 bp, Homo sapiens
atgctggccagcct

SEQ ID NO: 5373564 - DNA, 17 bp, Homo sapiens
atgctggccagcctggg

SEQ ID NO: 5373565 - DNA, 23 bp, Homo sapiens
atgctggcccagggcccagagcc

SEQ ID NO: 5373566 - DNA, 18 bp, Homo sapiens
atgctggccgctcctccc

SEQ ID NO: 5373567 - DNA, 14 bp, Homo sapiens
atgctggcctcttg

SEQ ID NO: 5373568 - DNA, 20 bp, Homo sapiens
atgctggcctcttggcacct

SEQ ID NO: 5373569 - DNA, 21 bp, Homo sapiens
atgctggcctcttggcacctg

SEQ ID NO: 5373570 - DNA, 23 bp, Homo sapiens
atgctggcctcttggcacctgcc

SEQ ID NO: 5373571 - DNA, 19 bp, Homo sapiens
atgctggcctgtggcaggc

SEQ ID NO: 5373572 - DNA, 21 bp, Homo sapiens
atgctggcctgtggcaggcct

SEQ ID NO: 5373573 - DNA, 17 bp, Homo sapiens
atgctggcctttgctct

SEQ ID NO: 5373574 - DNA, 21 bp, Homo sapiens
atgctggcggcgcagagggaa

SEQ ID NO: 5373575 - DNA, 22 bp, Homo sapiens
atgctggctatagatgtctttt

SEQ ID NO: 5373576 - DNA, 22 bp, Homo sapiens
atgctggctggggccggggctg

SEQ ID NO: 5373577 - DNA, 19 bp, Homo sapiens
atgctggctgttggctggg

SEQ ID NO: 5373578 - DNA, 16 bp, Homo sapiens
atgctggcttgtacat

SEQ ID NO: 5373579 - DNA, 15 bp, Homo sapiens
atgctgggactcagc

SEQ ID NO: 5373580 - DNA, 20 bp, Homo sapiens
atgctgggagggctgaaccc

SEQ ID NO: 5373581 - DNA, 19 bp, Homo sapiens
atgctgggattacaggcgt

SEQ ID NO: 5373582 - DNA, 14 bp, Homo sapiens
atgctgggccactg

SEQ ID NO: 5373583 - DNA, 20 bp, Homo sapiens
atgctgggcccccagcctgg

SEQ ID NO: 5373584 - DNA, 22 bp, Homo sapiens
atgctgggcccccagcctggcc

SEQ ID NO: 5373585 - DNA, 14 bp, Homo sapiens
atgctgggctggct

SEQ ID NO: 5373586 - DNA, 14 bp, Homo sapiens
atgctgggctgggt

SEQ ID NO: 5373587 - DNA, 15 bp, Homo sapiens
atgctgggctgggtg

SEQ ID NO: 5373588 - DNA, 23 bp, Homo sapiens
atgctgggctgtctctcccttcc

SEQ ID NO: 5373589 - DNA, 20 bp, Homo sapiens
atgctggggacacacattct

SEQ ID NO: 5373590 - DNA, 18 bp, Homo sapiens
atgctggggagaatgaag

SEQ ID NO: 5373591 - DNA, 21 bp, Homo sapiens
atgctggggtacacagtgaga

SEQ ID NO: 5373592 - DNA, 20 bp, Homo sapiens
atgctgggtatgctctgtga

SEQ ID NO: 5373593 - DNA, 18 bp, Homo sapiens
atgctgggttctggggct

SEQ ID NO: 5373594 - DNA, 11 bp, Homo sapiens
atgctgggttg

SEQ ID NO: 5373595 - DNA, 22 bp, Homo sapiens
atgctgggtttatagatgtgag

SEQ ID NO: 5373596 - DNA, 21 bp, Homo sapiens
atgctggtactattgtgacca

SEQ ID NO: 5373597 - DNA, 21 bp, Homo sapiens
atgctggtatatggcttcaag

SEQ ID NO: 5373598 - DNA, 17 bp, Homo sapiens
atgctggtcatcctggg

SEQ ID NO: 5373599 - DNA, 19 bp, Homo sapiens
atgctggtctaggagctgt

SEQ ID NO: 5373600 - DNA, 14 bp, Homo sapiens
atgctggtgagcca

SEQ ID NO: 5373601 - DNA, 14 bp, Homo sapiens
atgctggtggagga

SEQ ID NO: 5373602 - DNA, 22 bp, Homo sapiens
atgctggtggctggtgagaccc

SEQ ID NO: 5373603 - DNA, 21 bp, Homo sapiens
atgctggtgtggccaaggctg

SEQ ID NO: 5373604 - DNA, 22 bp, Homo sapiens
atgctggtgtggccaaggctga

SEQ ID NO: 5373605 - DNA, 21 bp, Homo sapiens
atgctggttacctgttccatt

SEQ ID NO: 5373606 - DNA, 22 bp, Homo sapiens
atgctggttacctgttccattg

SEQ ID NO: 5373607 - DNA, 22 bp, Homo sapiens
atgctggttttcctaaatgcag

SEQ ID NO: 5373608 - DNA, 22 bp, Homo sapiens
atgctgtaactttctgaaataa

SEQ ID NO: 5373609 - DNA, 12 bp, Homo sapiens
atgctgtacata

SEQ ID NO: 5373610 - DNA, 18 bp, Homo sapiens
atgctgtacatacttttt

SEQ ID NO: 5373611 - DNA, 15 bp, Homo sapiens
atgctgtacctggct

SEQ ID NO: 5373612 - DNA, 20 bp, Homo sapiens
atgctgtacgtactgcattt

SEQ ID NO: 5373613 - DNA, 12 bp, Homo sapiens
atgctgtagaat

SEQ ID NO: 5373614 - DNA, 19 bp, Homo sapiens
atgctgtagaatgcttggc

SEQ ID NO: 5373615 - DNA, 18 bp, Homo sapiens
atgctgtaggtggtatgt

SEQ ID NO: 5373616 - DNA, 18 bp, Homo sapiens
atgctgtagtaactgcct

SEQ ID NO: 5373617 - DNA, 14 bp, Homo sapiens
atgctgtatctgtg

SEQ ID NO: 5373618 - DNA, 15 bp, Homo sapiens
atgctgtatctgtgc

SEQ ID NO: 5373619 - DNA, 17 bp, Homo sapiens
atgctgtatttctttgt

SEQ ID NO: 5373620 - DNA, 13 bp, Homo sapiens
atgctgtatttta

SEQ ID NO: 5373621 - DNA, 19 bp, Homo sapiens
atgctgtattttaaaagaa

SEQ ID NO: 5373622 - DNA, 22 bp, Homo sapiens
atgctgtattttaaaagaatga

SEQ ID NO: 5373623 - DNA, 18 bp, Homo sapiens
atgctgtattttaacact

SEQ ID NO: 5373624 - DNA, 17 bp, Homo sapiens
atgctgtatttttacag

SEQ ID NO: 5373625 - DNA, 19 bp, Homo sapiens
atgctgtccctatacacta

SEQ ID NO: 5373626 - DNA, 23 bp, Homo sapiens
atgctgtccctgtgggctcacac

SEQ ID NO: 5373627 - DNA, 21 bp, Homo sapiens
atgctgtctctaattgattca

SEQ ID NO: 5373628 - DNA, 19 bp, Homo sapiens
atgctgtctggcacagcct

SEQ ID NO: 5373629 - DNA, 22 bp, Homo sapiens
atgctgtctggcacagcctgca

SEQ ID NO: 5373630 - DNA, 23 bp, Homo sapiens
atgctgtctttcttgctccctga

SEQ ID NO: 5373631 - DNA, 14 bp, Homo sapiens
atgctgtctttgtg

SEQ ID NO: 5373632 - DNA, 20 bp, Homo sapiens
atgctgtctttgtggactgt

SEQ ID NO: 5373633 - DNA, 21 bp, Homo sapiens
atgctgtgacaataagtttga

SEQ ID NO: 5373634 - DNA, 23 bp, Homo sapiens
atgctgtgacacatggcccctcc

SEQ ID NO: 5373635 - DNA, 22 bp, Homo sapiens
atgctgtgagtctttggttcta

SEQ ID NO: 5373636 - DNA, 17 bp, Homo sapiens
atgctgtgatacactga

SEQ ID NO: 5373637 - DNA, 23 bp, Homo sapiens
atgctgtgcattttttttttcat

SEQ ID NO: 5373638 - DNA, 13 bp, Homo sapiens
atgctgtgcccct

SEQ ID NO: 5373639 - DNA, 17 bp, Homo sapiens
atgctgtgcccctggcc

SEQ ID NO: 5373640 - DNA, 20 bp, Homo sapiens
atgctgtgcgcccagggctg

SEQ ID NO: 5373641 - DNA, 13 bp, Homo sapiens
atgctgtgctacg

SEQ ID NO: 5373642 - DNA, 20 bp, Homo sapiens
atgctgtgctacgtgtgaaa

SEQ ID NO: 5373643 - DNA, 17 bp, Homo sapiens
atgctgtgctatgaatt

SEQ ID NO: 5373644 - DNA, 18 bp, Homo sapiens
atgctgtgctatgaattt

SEQ ID NO: 5373645 - DNA, 16 bp, Homo sapiens
atgctgtgctctttga

SEQ ID NO: 5373646 - DNA, 18 bp, Homo sapiens
atgctgtggagtcccaac

SEQ ID NO: 5373647 - DNA, 21 bp, Homo sapiens
atgctgtggagtcccaacccc

SEQ ID NO: 5373648 - DNA, 21 bp, Homo sapiens
atgctgtggcatgggtgaaga

SEQ ID NO: 5373649 - DNA, 20 bp, Homo sapiens
atgctgtgggaaggcaattt

SEQ ID NO: 5373650 - DNA, 19 bp, Homo sapiens
atgctgtgggggactggct

SEQ ID NO: 5373651 - DNA, 17 bp, Homo sapiens
atgctgtggttcactgc

SEQ ID NO: 5373652 - DNA, 20 bp, Homo sapiens
atgctgtggttcactgcact

SEQ ID NO: 5373653 - DNA, 21 bp, Homo sapiens
atgctgtgtacaacaatgctt

SEQ ID NO: 5373654 - DNA, 22 bp, Homo sapiens
atgctgtgtacaacaatgcttt

SEQ ID NO: 5373655 - DNA, 12 bp, Homo sapiens
atgctgtgtgca

SEQ ID NO: 5373656 - DNA, 16 bp, Homo sapiens
atgctgtgtgcagagt

SEQ ID NO: 5373657 - DNA, 21 bp, Homo sapiens
atgctgtgtgcccaagtgggc

SEQ ID NO: 5373658 - DNA, 20 bp, Homo sapiens
atgctgttagtaaatttctg

SEQ ID NO: 5373659 - DNA, 17 bp, Homo sapiens
atgctgttctcaatcat

SEQ ID NO: 5373660 - DNA, 18 bp, Homo sapiens
atgctgttctcttcttca

SEQ ID NO: 5373661 - DNA, 14 bp, Homo sapiens
atgctgttgagggc

SEQ ID NO: 5373662 - DNA, 12 bp, Homo sapiens
atgctgttgatt

SEQ ID NO: 5373663 - DNA, 15 bp, Homo sapiens
atgctgttgattgct

SEQ ID NO: 5373664 - DNA, 17 bp, Homo sapiens
atgctgttgattgctaa

SEQ ID NO: 5373665 - DNA, 22 bp, Homo sapiens
atgctgttgattgctaaatgta

SEQ ID NO: 5373666 - DNA, 14 bp, Homo sapiens
atgctgttgcctca

SEQ ID NO: 5373667 - DNA, 17 bp, Homo sapiens
atgctgttggtgagaat

SEQ ID NO: 5373668 - DNA, 14 bp, Homo sapiens
atgctgttgtaaac

SEQ ID NO: 5373669 - DNA, 15 bp, Homo sapiens
atgctgttgtaaaca

SEQ ID NO: 5373670 - DNA, 22 bp, Homo sapiens
atgctgtttctaagaaaatgta

SEQ ID NO: 5373671 - DNA, 22 bp, Homo sapiens
atgctgtttgtacaaactattt

SEQ ID NO: 5373672 - DNA, 22 bp, Homo sapiens
atgctgtttgtagtgaaataat

SEQ ID NO: 5373673 - DNA, 14 bp, Homo sapiens
atgctgttttaata

SEQ ID NO: 5373674 - DNA, 17 bp, Homo sapiens
atgcttaaaatatgtat

SEQ ID NO: 5373675 - DNA, 19 bp, Homo sapiens
atgcttaaactaaataatg

SEQ ID NO: 5373676 - DNA, 19 bp, Homo sapiens
atgcttaaagaattcaaat

SEQ ID NO: 5373677 - DNA, 13 bp, Homo sapiens
atgcttaaatttt

SEQ ID NO: 5373678 - DNA, 15 bp, Homo sapiens
atgcttaacataaac

SEQ ID NO: 5373679 - DNA, 13 bp, Homo sapiens
atgcttaagattt

SEQ ID NO: 5373680 - DNA, 19 bp, Homo sapiens
atgcttaataaaagaacat

SEQ ID NO: 5373681 - DNA, 12 bp, Homo sapiens
atggacttgctt

SEQ ID NO: 5373682 - DNA, 15 bp, Homo sapiens
atggacttggggcct

SEQ ID NO: 5373683 - DNA, 17 bp, Homo sapiens
atggacttggggcctct

SEQ ID NO: 5373684 - DNA, 16 bp, Homo sapiens
atggacttgtatattt

SEQ ID NO: 5373685 - DNA, 22 bp, Homo sapiens
atggacttgtatatttgtacaa

SEQ ID NO: 5373686 - DNA, 20 bp, Homo sapiens
atggacttgtgattggctgc

SEQ ID NO: 5373687 - DNA, 22 bp, Homo sapiens
atggacttgtgattggctgcag

SEQ ID NO: 5373688 - DNA, 17 bp, Homo sapiens
atggactttataagcca

SEQ ID NO: 5373689 - DNA, 17 bp, Homo sapiens
atggactttggaagcag

SEQ ID NO: 5373690 - DNA, 18 bp, Homo sapiens
atggactttggaagcagg

SEQ ID NO: 5373691 - DNA, 20 bp, Homo sapiens
atggacttttgttcatggga

SEQ ID NO: 5373692 - DNA, 12 bp, Homo sapiens
atggagaaaatg

SEQ ID NO: 5373693 - DNA, 16 bp, Homo sapiens
atggagaaaccctgtc

SEQ ID NO: 5373694 - DNA, 13 bp, Homo sapiens
atggagaaagaag

SEQ ID NO: 5373695 - DNA, 15 bp, Homo sapiens
atggagaaagaagtg

SEQ ID NO: 5373696 - DNA, 21 bp, Homo sapiens
atggagaaagaagtggagaca

SEQ ID NO: 5373697 - DNA, 13 bp, Homo sapiens
atggagaaagctg

SEQ ID NO: 5373698 - DNA, 23 bp, Homo sapiens
atggagaaagctgacttggctgg

SEQ ID NO: 5373699 - DNA, 15 bp, Homo sapiens
atggagaaagctgtg

SEQ ID NO: 5373700 - DNA, 15 bp, Homo sapiens
atggagaaccaccta

SEQ ID NO: 5373701 - DNA, 14 bp, Homo sapiens
atggagaagctgca

SEQ ID NO: 5373702 - DNA, 21 bp, Homo sapiens
atggagaaggaaaaggctggc

SEQ ID NO: 5373703 - DNA, 14 bp, Homo sapiens
atggagaaggaagg

SEQ ID NO: 5373704 - DNA, 15 bp, Homo sapiens
atggagaagggttct

SEQ ID NO: 5373705 - DNA, 18 bp, Homo sapiens
atggagaagggttctgcc

SEQ ID NO: 5373706 - DNA, 21 bp, Homo sapiens
atggagaagggttctgccctg

SEQ ID NO: 5373707 - DNA, 14 bp, Homo sapiens
atggagaatcactt

SEQ ID NO: 5373708 - DNA, 20 bp, Homo sapiens
atggagaatctgctgcatag

SEQ ID NO: 5373709 - DNA, 16 bp, Homo sapiens
atggagaatgccagcc

SEQ ID NO: 5373710 - DNA, 18 bp, Homo sapiens
atggagaatgccagccca

SEQ ID NO: 5373711 - DNA, 14 bp, Homo sapiens
atggagaatgggac

SEQ ID NO: 5373712 - DNA, 19 bp, Homo sapiens
atggagacaataaacagct

SEQ ID NO: 5373713 - DNA, 20 bp, Homo sapiens
atggagacaccctctggggg

SEQ ID NO: 5373714 - DNA, 18 bp, Homo sapiens
atggagactcctgccctg

SEQ ID NO: 5373715 - DNA, 14 bp, Homo sapiens
atggagactctgag

SEQ ID NO: 5373716 - DNA, 18 bp, Homo sapiens
atggagactgtctcaaga

SEQ ID NO: 5373717 - DNA, 14 bp, Homo sapiens
atggagacttctaa

SEQ ID NO: 5373718 - DNA, 17 bp, Homo sapiens
atggagactttgctgtt

SEQ ID NO: 5373719 - DNA, 18 bp, Homo sapiens
atggagagaaaacagacc

SEQ ID NO: 5373720 - DNA, 14 bp, Homo sapiens
atggagagagactc

SEQ ID NO: 5373721 - DNA, 15 bp, Homo sapiens
atggagagagcctta

SEQ ID NO: 5373722 - DNA, 18 bp, Homo sapiens
atggagagccctgggacc

SEQ ID NO: 5373723 - DNA, 14 bp, Homo sapiens
atggagaggaagaa

SEQ ID NO: 5373724 - DNA, 16 bp, Homo sapiens
atggagaggacagagc

SEQ ID NO: 5373725 - DNA, 12 bp, Homo sapiens
atggagaggaga

SEQ ID NO: 5373726 - DNA, 13 bp, Homo sapiens
atggagaggctga

SEQ ID NO: 5373727 - DNA, 18 bp, Homo sapiens
atggagagggcttgaaat

SEQ ID NO: 5373728 - DNA, 23 bp, Homo sapiens
atggagaggtttgtcaacacaaa

SEQ ID NO: 5373729 - DNA, 20 bp, Homo sapiens
atggagatatgcattcaaga

SEQ ID NO: 5373730 - DNA, 15 bp, Homo sapiens
atggagatgggaagg

SEQ ID NO: 5373731 - DNA, 18 bp, Homo sapiens
atggagattctgattcag

SEQ ID NO: 5373732 - DNA, 17 bp, Homo sapiens
atggagattgacctgga

SEQ ID NO: 5373733 - DNA, 19 bp, Homo sapiens
atggagatttggaattgaa

SEQ ID NO: 5373734 - DNA, 15 bp, Homo sapiens
atggagcaaatgtcc

SEQ ID NO: 5373735 - DNA, 17 bp, Homo sapiens
atggagcaagctcttcc

SEQ ID NO: 5373736 - DNA, 16 bp, Homo sapiens
atggagcagcccccaa

SEQ ID NO: 5373737 - DNA, 19 bp, Homo sapiens
atggagcagtacatgggaa

SEQ ID NO: 5373738 - DNA, 23 bp, Homo sapiens
atggagccagctccctctattta

SEQ ID NO: 5373739 - DNA, 14 bp, Homo sapiens
atggagcccaggcg

SEQ ID NO: 5373740 - DNA, 19 bp, Homo sapiens
atggagcccagttggaaaa

SEQ ID NO: 5373741 - DNA, 21 bp, Homo sapiens
atggagcccagttggaaaatt

SEQ ID NO: 5373742 - DNA, 21 bp, Homo sapiens
atggagcccataggccacccc

SEQ ID NO: 5373743 - DNA, 16 bp, Homo sapiens
atggagccccaccttg

SEQ ID NO: 5373744 - DNA, 21 bp, Homo sapiens
atggagccccaccttgtctgc

SEQ ID NO: 5373745 - DNA, 20 bp, Homo sapiens
atggagcctctgcagactcg

SEQ ID NO: 5373746 - DNA, 22 bp, Homo sapiens
atggagcctggcacaggactga

SEQ ID NO: 5373747 - DNA, 17 bp, Homo sapiens
atggagctacgaaagga

SEQ ID NO: 5373748 - DNA, 22 bp, Homo sapiens
atggagctcagtaacataactg

SEQ ID NO: 5373749 - DNA, 13 bp, Homo sapiens
atggagcttgtac

SEQ ID NO: 5373750 - DNA, 13 bp, Homo sapiens
atggaggaaaaag

SEQ ID NO: 5373751 - DNA, 22 bp, Homo sapiens
atggaggaaaaccaagccgtgg

SEQ ID NO: 5373752 - DNA, 18 bp, Homo sapiens
atggaggaagaacaacaa

SEQ ID NO: 5373753 - DNA, 18 bp, Homo sapiens
atggaggactccaggcag

SEQ ID NO: 5373754 - DNA, 19 bp, Homo sapiens
atggaggactccaggcagc

SEQ ID NO: 5373755 - DNA, 13 bp, Homo sapiens
atggaggagaaga

SEQ ID NO: 5373756 - DNA, 15 bp, Homo sapiens
atggaggagacagga

SEQ ID NO: 5373757 - DNA, 17 bp, Homo sapiens
atggaggagagtgttta

SEQ ID NO: 5373758 - DNA, 15 bp, Homo sapiens
atggaggagccaggc

SEQ ID NO: 5373759 - DNA, 18 bp, Homo sapiens
atggaggagccaggcccc

SEQ ID NO: 5373760 - DNA, 14 bp, Homo sapiens
atggaggaggaaga

SEQ ID NO: 5373761 - DNA, 19 bp, Homo sapiens
atggaggatctctaaagag

SEQ ID NO: 5373762 - DNA, 21 bp, Homo sapiens
atggaggatctctaaagagca

SEQ ID NO: 5373763 - DNA, 16 bp, Homo sapiens
atggaggatggagaga

SEQ ID NO: 5373764 - DNA, 18 bp, Homo sapiens
atggaggatggagagagg

SEQ ID NO: 5373765 - DNA, 23 bp, Homo sapiens
atggaggattctttccccagagg

SEQ ID NO: 5373766 - DNA, 17 bp, Homo sapiens
atggaggcagaatcctg

SEQ ID NO: 5373767 - DNA, 16 bp, Homo sapiens
atggaggcagagacct

SEQ ID NO: 5373768 - DNA, 15 bp, Homo sapiens
atggaggcagatgcc

SEQ ID NO: 5373769 - DNA, 20 bp, Homo sapiens
atggaggcaggctccccctg

SEQ ID NO: 5373770 - DNA, 12 bp, Homo sapiens
atggaggcaggg

SEQ ID NO: 5373771 - DNA, 14 bp, Homo sapiens
atggaggccaagcc

SEQ ID NO: 5373772 - DNA, 16 bp, Homo sapiens
atggaggccaagcctg

SEQ ID NO: 5373773 - DNA, 19 bp, Homo sapiens
atggaggccaagcctgcag

SEQ ID NO: 5373774 - DNA, 12 bp, Homo sapiens
atggaggccaga

SEQ ID NO: 5373775 - DNA, 18 bp, Homo sapiens
atggaggctatgtggagt

SEQ ID NO: 5373776 - DNA, 16 bp, Homo sapiens
atggagggaagacctg

SEQ ID NO: 5373777 - DNA, 13 bp, Homo sapiens
atggagggagcca

SEQ ID NO: 5373778 - DNA, 14 bp, Homo sapiens
atggagggcttggc

SEQ ID NO: 5373779 - DNA, 15 bp, Homo sapiens
atggaggggaattca

SEQ ID NO: 5373780 - DNA, 14 bp, Homo sapiens
atggagggggctgg

SEQ ID NO: 5373781 - DNA, 15 bp, Homo sapiens
atggagggggctggg

SEQ ID NO: 5373782 - DNA, 17 bp, Homo sapiens
atggagggggctggggt

SEQ ID NO: 5373783 - DNA, 18 bp, Homo sapiens
atggaggggtggtcctga

SEQ ID NO: 5373784 - DNA, 22 bp, Homo sapiens
atggagggtggaaataatttga

SEQ ID NO: 5373785 - DNA, 14 bp, Homo sapiens
atggagggtttagt

SEQ ID NO: 5373786 - DNA, 16 bp, Homo sapiens
atggaggtagggctgg

SEQ ID NO: 5373787 - DNA, 17 bp, Homo sapiens
atggaggtagggctggc

SEQ ID NO: 5373788 - DNA, 17 bp, Homo sapiens
atggaggtcccagccct

SEQ ID NO: 5373789 - DNA, 18 bp, Homo sapiens
atggaggtcccagccctg

SEQ ID NO: 5373790 - DNA, 19 bp, Homo sapiens
atggaggtcccagccctgg

SEQ ID NO: 5373791 - DNA, 13 bp, Homo sapiens
atggaggttctaa

SEQ ID NO: 5373792 - DNA, 17 bp, Homo sapiens
atggaggttctcagagc

SEQ ID NO: 5373793 - DNA, 18 bp, Homo sapiens
atggaggttctcagagcc

SEQ ID NO: 5373794 - DNA, 22 bp, Homo sapiens
atggaggttctcagagccaagt

SEQ ID NO: 5373795 - DNA, 24 bp, Homo sapiens
atggaggtttcatactctagattt

SEQ ID NO: 5373796 - DNA, 17 bp, Homo sapiens
atggagtacatggaaga

SEQ ID NO: 5373797 - DNA, 22 bp, Homo sapiens
atggagtacggctggtgtgtca

SEQ ID NO: 5373798 - DNA, 17 bp, Homo sapiens
atggagtagacccctgg

SEQ ID NO: 5373799 - DNA, 13 bp, Homo sapiens
atggagtagaggt

SEQ ID NO: 5373800 - DNA, 15 bp, Homo sapiens
atggagtagagtcag

SEQ ID NO: 5373801 - DNA, 18 bp, Homo sapiens
atggagtattttaagtct

SEQ ID NO: 5373802 - DNA, 21 bp, Homo sapiens
atggagtcatttgagtctctt

SEQ ID NO: 5373803 - DNA, 17 bp, Homo sapiens
atggagtccagacctgg

SEQ ID NO: 5373804 - DNA, 20 bp, Homo sapiens
atggagtccagacctgggcc

SEQ ID NO: 5373805 - DNA, 13 bp, Homo sapiens
atggagtctcact

SEQ ID NO: 5373806 - DNA, 20 bp, Homo sapiens
atggagtctcactcttgtca

SEQ ID NO: 5373807 - DNA, 14 bp, Homo sapiens
atggagtctgcagt

SEQ ID NO: 5373808 - DNA, 19 bp, Homo sapiens
atggagtcttgctctgtca

SEQ ID NO: 5373809 - DNA, 16 bp, Homo sapiens
atggagtcttgtgaaa

SEQ ID NO: 5373810 - DNA, 18 bp, Homo sapiens
atggagtgagtcacctgc

SEQ ID NO: 5373811 - DNA, 20 bp, Homo sapiens
atggagtgagtcacctgctc

SEQ ID NO: 5373812 - DNA, 13 bp, Homo sapiens
atggagtgctgtt

SEQ ID NO: 5373813 - DNA, 20 bp, Homo sapiens
atggagtgctgttttgttat

SEQ ID NO: 5373814 - DNA, 19 bp, Homo sapiens
atggagtggcaatatagaa

SEQ ID NO: 5373815 - DNA, 20 bp, Homo sapiens
atggagtggcagcccagcca

SEQ ID NO: 5373816 - DNA, 22 bp, Homo sapiens
atggagtggcagcccagccagc

SEQ ID NO: 5373817 - DNA, 21 bp, Homo sapiens
atggagtgggagatcagccac

SEQ ID NO: 5373818 - DNA, 17 bp, Homo sapiens
atggagtgtgcagacag

SEQ ID NO: 5373819 - DNA, 21 bp, Homo sapiens
atggagtgtgtattgttccca

SEQ ID NO: 5373820 - DNA, 19 bp, Homo sapiens
atggagtgtttgaaaactg

SEQ ID NO: 5373821 - DNA, 20 bp, Homo sapiens
atggagttaaactttagtgc

SEQ ID NO: 5373822 - DNA, 17 bp, Homo sapiens
atggagttccttctggt

SEQ ID NO: 5373823 - DNA, 15 bp, Homo sapiens
atggagttcttgtgc

SEQ ID NO: 5373824 - DNA, 17 bp, Homo sapiens
atggagtttacaaagat

SEQ ID NO: 5373825 - DNA, 13 bp, Homo sapiens
atggagtttctaa

SEQ ID NO: 5373826 - DNA, 14 bp, Homo sapiens
atggagtttctctc

SEQ ID NO: 5373827 - DNA, 21 bp, Homo sapiens
atggagttttactcttgttgc

SEQ ID NO: 5373828 - DNA, 21 bp, Homo sapiens
atggataaaataatgctgcaa

SEQ ID NO: 5373829 - DNA, 19 bp, Homo sapiens
atggataagatgatgttaa

SEQ ID NO: 5373830 - DNA, 15 bp, Homo sapiens
atggataatctgagc

SEQ ID NO: 5373831 - DNA, 21 bp, Homo sapiens
atggataatctgagcaggtac

SEQ ID NO: 5373832 - DNA, 22 bp, Homo sapiens
atggataatctgagcaggtaca

SEQ ID NO: 5373833 - DNA, 22 bp, Homo sapiens
atggataatgccggtgagaata

SEQ ID NO: 5373834 - DNA, 15 bp, Homo sapiens
atggataatgtgtat

SEQ ID NO: 5373835 - DNA, 17 bp, Homo sapiens
atggatacttcctgggt

SEQ ID NO: 5373836 - DNA, 16 bp, Homo sapiens
atggatagagtattga

SEQ ID NO: 5373837 - DNA, 13 bp, Homo sapiens
atggatatatttg

SEQ ID NO: 5373838 - DNA, 18 bp, Homo sapiens
atggatatatttgaaata

SEQ ID NO: 5373839 - DNA, 20 bp, Homo sapiens
atggatatatttgaaatagt

SEQ ID NO: 5373840 - DNA, 23 bp, Homo sapiens
atggatatatttgaaatagtata

SEQ ID NO: 5373841 - DNA, 15 bp, Homo sapiens
atggatatgaaagag

SEQ ID NO: 5373842 - DNA, 16 bp, Homo sapiens
atggatattagatgcc

SEQ ID NO: 5373843 - DNA, 18 bp, Homo sapiens
atggatattagatgcccg

SEQ ID NO: 5373844 - DNA, 16 bp, Homo sapiens
atggatattagtcata

SEQ ID NO: 5373845 - DNA, 21 bp, Homo sapiens
atggatatttgtactgtttaa

SEQ ID NO: 5373846 - DNA, 20 bp, Homo sapiens
atggatatttgtcaacagat

SEQ ID NO: 5373847 - DNA, 13 bp, Homo sapiens
atggatatttttg

SEQ ID NO: 5373848 - DNA, 20 bp, Homo sapiens
atggatcccaatctgagaaa

SEQ ID NO: 5373849 - DNA, 16 bp, Homo sapiens
atggatcctggaggat

SEQ ID NO: 5373850 - DNA, 20 bp, Homo sapiens
atggatcgatattaatgtat

SEQ ID NO: 5373851 - DNA, 20 bp, Homo sapiens
atggatgaatctcccactcc

SEQ ID NO: 5373852 - DNA, 21 bp, Homo sapiens
atggatgaattttccagacct

SEQ ID NO: 5373853 - DNA, 16 bp, Homo sapiens
atggatgagtaaactg

SEQ ID NO: 5373854 - DNA, 13 bp, Homo sapiens
atggatgattcag

SEQ ID NO: 5373855 - DNA, 18 bp, Homo sapiens
atggatgattcagaaatt

SEQ ID NO: 5373856 - DNA, 20 bp, Homo sapiens
atggatgattcttttcccat

SEQ ID NO: 5373857 - DNA, 19 bp, Homo sapiens
atggatgcaaagtacaatg

SEQ ID NO: 5373858 - DNA, 16 bp, Homo sapiens
atggatgcgaggacca

SEQ ID NO: 5373859 - DNA, 13 bp, Homo sapiens
atggccaggagtg

SEQ ID NO: 5373860 - DNA, 18 bp, Homo sapiens
atggccaggatcctctcc

SEQ ID NO: 5373861 - DNA, 19 bp, Homo sapiens
atggccaggatcctctcct

SEQ ID NO: 5373862 - DNA, 18 bp, Homo sapiens
atggccaggcctcaggga

SEQ ID NO: 5373863 - DNA, 21 bp, Homo sapiens
atggccagtgagatcaatgtg

SEQ ID NO: 5373864 - DNA, 22 bp, Homo sapiens
atggccagtgagatcaatgtga

SEQ ID NO: 5373865 - DNA, 14 bp, Homo sapiens
atggccagtgctgc

SEQ ID NO: 5373866 - DNA, 22 bp, Homo sapiens
atggccagtttgaagcctgtgc

SEQ ID NO: 5373867 - DNA, 16 bp, Homo sapiens
atggccagttttctgg

SEQ ID NO: 5373868 - DNA, 15 bp, Homo sapiens
atggccatagaggcc

SEQ ID NO: 5373869 - DNA, 16 bp, Homo sapiens
atggccatagaggccc

SEQ ID NO: 5373870 - DNA, 18 bp, Homo sapiens
atggccatagaggcccag

SEQ ID NO: 5373871 - DNA, 20 bp, Homo sapiens
atggccatagaggcccaggc

SEQ ID NO: 5373872 - DNA, 17 bp, Homo sapiens
atggccatcttctttct

SEQ ID NO: 5373873 - DNA, 18 bp, Homo sapiens
atggccatcttctttctt

SEQ ID NO: 5373874 - DNA, 16 bp, Homo sapiens
atggccatgcaggagg

SEQ ID NO: 5373875 - DNA, 13 bp, Homo sapiens
atggccatgccct

SEQ ID NO: 5373876 - DNA, 19 bp, Homo sapiens
atggccattgagctgtttc

SEQ ID NO: 5373877 - DNA, 21 bp, Homo sapiens
atggccattgagctgtttcct

SEQ ID NO: 5373878 - DNA, 23 bp, Homo sapiens
atggccattgagctgtttcctca

SEQ ID NO: 5373879 - DNA, 16 bp, Homo sapiens
atggccattttaaaat

SEQ ID NO: 5373880 - DNA, 18 bp, Homo sapiens
atggcccaagggatggca

SEQ ID NO: 5373881 - DNA, 21 bp, Homo sapiens
atggcccagcagcttggctga

SEQ ID NO: 5373882 - DNA, 14 bp, Homo sapiens
atggcccagccact

SEQ ID NO: 5373883 - DNA, 13 bp, Homo sapiens
atggcccagcctt

SEQ ID NO: 5373884 - DNA, 14 bp, Homo sapiens
atggcccaggcagc

SEQ ID NO: 5373885 - DNA, 21 bp, Homo sapiens
atggcccaggcagcctcaagg

SEQ ID NO: 5373886 - DNA, 20 bp, Homo sapiens
atggcccattggagcacctg

SEQ ID NO: 5373887 - DNA, 22 bp, Homo sapiens
atggcccatttaatgattgatt

SEQ ID NO: 5373888 - DNA, 19 bp, Homo sapiens
atggccccaacaagcaccc

SEQ ID NO: 5373889 - DNA, 13 bp, Homo sapiens
atggccccagctg

SEQ ID NO: 5373890 - DNA, 22 bp, Homo sapiens
atggccccatctggatgtaaat

SEQ ID NO: 5373891 - DNA, 15 bp, Homo sapiens
atggcccccaggggc

SEQ ID NO: 5373892 - DNA, 19 bp, Homo sapiens
atggcccccaggggcagga

SEQ ID NO: 5373893 - DNA, 16 bp, Homo sapiens
atggcccctccagcac

SEQ ID NO: 5373894 - DNA, 21 bp, Homo sapiens
atggcccctccagcacacaca

SEQ ID NO: 5373895 - DNA, 14 bp, Homo sapiens
atggcccctccagg

SEQ ID NO: 5373896 - DNA, 14 bp, Homo sapiens
atggcccctccttg

SEQ ID NO: 5373897 - DNA, 15 bp, Homo sapiens
atggcccctccttgc

SEQ ID NO: 5373898 - DNA, 23 bp, Homo sapiens
atggcccctctgacctgcactgg

SEQ ID NO: 5373899 - DNA, 18 bp, Homo sapiens
atggcccggcccctcctg

SEQ ID NO: 5373900 - DNA, 12 bp, Homo sapiens
atggccctcgga

SEQ ID NO: 5373901 - DNA, 15 bp, Homo sapiens
atggccctgctgccc

SEQ ID NO: 5373902 - DNA, 19 bp, Homo sapiens
atggccctgctgcccctcc

SEQ ID NO: 5373903 - DNA, 17 bp, Homo sapiens
atggccctgtagctctg

SEQ ID NO: 5373904 - DNA, 19 bp, Homo sapiens
atggccctgtagctctgaa

SEQ ID NO: 5373905 - DNA, 11 bp, Homo sapiens
atggccctgtc

SEQ ID NO: 5373906 - DNA, 16 bp, Homo sapiens
atggccctgtcccagg

SEQ ID NO: 5373907 - DNA, 17 bp, Homo sapiens
atggccctgtcccaggc

SEQ ID NO: 5373908 - DNA, 18 bp, Homo sapiens
atggccctgtcccaggcc

SEQ ID NO: 5373909 - DNA, 20 bp, Homo sapiens
atggccctgtcccaggccgg

SEQ ID NO: 5373910 - DNA, 17 bp, Homo sapiens
atggcccttcaaattgg

SEQ ID NO: 5373911 - DNA, 21 bp, Homo sapiens
atggccgcaacttcccaggcc

SEQ ID NO: 5373912 - DNA, 22 bp, Homo sapiens
atggccgcaacttcccaggccg

SEQ ID NO: 5373913 - DNA, 13 bp, Homo sapiens
atggccgctgccc

SEQ ID NO: 5373914 - DNA, 19 bp, Homo sapiens
atggccgggccctgctgag

SEQ ID NO: 5373915 - DNA, 20 bp, Homo sapiens
atggccgggctgctgctgat

SEQ ID NO: 5373916 - DNA, 17 bp, Homo sapiens
atggccgtatcaaatgg

SEQ ID NO: 5373917 - DNA, 22 bp, Homo sapiens
atggccgttgcctctctgccag

SEQ ID NO: 5373918 - DNA, 24 bp, Homo sapiens
atggccgttgcctctctgccagcc

SEQ ID NO: 5373919 - DNA, 15 bp, Homo sapiens
atggccgttggccac

SEQ ID NO: 5373920 - DNA, 20 bp, Homo sapiens
atggcctattatattaaaat

SEQ ID NO: 5373921 - DNA, 21 bp, Homo sapiens
atggcctattatattaaaata

SEQ ID NO: 5373922 - DNA, 23 bp, Homo sapiens
atggcctcagatgatggggtcag

SEQ ID NO: 5373923 - DNA, 18 bp, Homo sapiens
atggcctcagccctgctc

SEQ ID NO: 5373924 - DNA, 22 bp, Homo sapiens
atggcctcagccctgctccctg

SEQ ID NO: 5373925 - DNA, 16 bp, Homo sapiens
atggcctcagctgcct

SEQ ID NO: 5373926 - DNA, 17 bp, Homo sapiens
atggcctcagctgcctc

SEQ ID NO: 5373927 - DNA, 18 bp, Homo sapiens
atggcctcatgtggctgg

SEQ ID NO: 5373928 - DNA, 19 bp, Homo sapiens
atggcctcatgtggctgga

SEQ ID NO: 5373929 - DNA, 20 bp, Homo sapiens
atggcctcatgtggctggaa

SEQ ID NO: 5373930 - DNA, 17 bp, Homo sapiens
atggcctctaagagtgc

SEQ ID NO: 5373931 - DNA, 18 bp, Homo sapiens
atggcctctctccactac

SEQ ID NO: 5373932 - DNA, 17 bp, Homo sapiens
atggcctctggccaggc

SEQ ID NO: 5373933 - DNA, 21 bp, Homo sapiens
atggcctctggggcaggacca

SEQ ID NO: 5373934 - DNA, 22 bp, Homo sapiens
atggcctctggggcaggaccac

SEQ ID NO: 5373935 - DNA, 19 bp, Homo sapiens
atggcctcttaaaaattat

SEQ ID NO: 5373936 - DNA, 17 bp, Homo sapiens
atggcctcttgaagaga

SEQ ID NO: 5373937 - DNA, 19 bp, Homo sapiens
atggcctgagactttcttt

SEQ ID NO: 5373938 - DNA, 19 bp, Homo sapiens
atggcctggagggactttt

SEQ ID NO: 5373939 - DNA, 22 bp, Homo sapiens
atggcctggattcacgccctct

SEQ ID NO: 5373940 - DNA, 21 bp, Homo sapiens
atggcctgtccctagggctct

SEQ ID NO: 5373941 - DNA, 13 bp, Homo sapiens
atggcctgtgctg

SEQ ID NO: 5373942 - DNA, 23 bp, Homo sapiens
atggccttcatatcatccacaca

SEQ ID NO: 5373943 - DNA, 22 bp, Homo sapiens
atggccttccacgtcttcctcc

SEQ ID NO: 5373944 - DNA, 13 bp, Homo sapiens
atggccttcccgc

SEQ ID NO: 5373945 - DNA, 20 bp, Homo sapiens
atggccttcccgccggaggc

SEQ ID NO: 5373946 - DNA, 12 bp, Homo sapiens
atggccttccct

SEQ ID NO: 5373947 - DNA, 13 bp, Homo sapiens
atggccttgaaac

SEQ ID NO: 5373948 - DNA, 14 bp, Homo sapiens
atggccttgaaaca

SEQ ID NO: 5373949 - DNA, 12 bp, Homo sapiens
atggccttgaag

SEQ ID NO: 5373950 - DNA, 15 bp, Homo sapiens
atggcctttccttcc

SEQ ID NO: 5373951 - DNA, 22 bp, Homo sapiens
atggcctttccttccctctctg

SEQ ID NO: 5373952 - DNA, 23 bp, Homo sapiens
atggcctttccttccctctctga

SEQ ID NO: 5373953 - DNA, 14 bp, Homo sapiens
atggcctttctaat

SEQ ID NO: 5373954 - DNA, 18 bp, Homo sapiens
atggcctttgataaatgt

SEQ ID NO: 5373955 - DNA, 20 bp, Homo sapiens
atggcctttgcttgaaagaa

SEQ ID NO: 5373956 - DNA, 20 bp, Homo sapiens
atggcctttggacccagggc

SEQ ID NO: 5373957 - DNA, 15 bp, Homo sapiens
atggcgaacatgtgt

SEQ ID NO: 5373958 - DNA, 15 bp, Homo sapiens
atggcgacactaaag

SEQ ID NO: 5373959 - DNA, 18 bp, Homo sapiens
atggcgaccaccaaagtc

SEQ ID NO: 5373960 - DNA, 16 bp, Homo sapiens
atggcgatgtgttata

SEQ ID NO: 5373961 - DNA, 13 bp, Homo sapiens
atggcgcacccgg

SEQ ID NO: 5373962 - DNA, 19 bp, Homo sapiens
atggcgcctgctccctcca

SEQ ID NO: 5373963 - DNA, 20 bp, Homo sapiens
atggcgcctgctccctccag

SEQ ID NO: 5373964 - DNA, 15 bp, Homo sapiens
atggcggaggccatg

SEQ ID NO: 5373965 - DNA, 20 bp, Homo sapiens
atggcggcacacatctgtaa

SEQ ID NO: 5373966 - DNA, 17 bp, Homo sapiens
atggcgtaagtacagag

SEQ ID NO: 5373967 - DNA, 19 bp, Homo sapiens
atggcgtaagtacagagaa

SEQ ID NO: 5373968 - DNA, 20 bp, Homo sapiens
atggcgtaagtacagagaag

SEQ ID NO: 5373969 - DNA, 19 bp, Homo sapiens
atggcgtaatgggcctgcc

SEQ ID NO: 5373970 - DNA, 20 bp, Homo sapiens
atggcgtaatgggcctgccc

SEQ ID NO: 5373971 - DNA, 22 bp, Homo sapiens
atggcgtccgtgggttgctaac

SEQ ID NO: 5373972 - DNA, 17 bp, Homo sapiens
atggcgtgatctcggct

SEQ ID NO: 5373973 - DNA, 18 bp, Homo sapiens
atggcgtggtcaagcact

SEQ ID NO: 5373974 - DNA, 19 bp, Homo sapiens
atggcgtgtcccctgcctg

SEQ ID NO: 5373975 - DNA, 15 bp, Homo sapiens
atggcgttgcaggcc

SEQ ID NO: 5373976 - DNA, 19 bp, Homo sapiens
atggcgttttgtctgtgtt

SEQ ID NO: 5373977 - DNA, 22 bp, Homo sapiens
atggcgttttgtctgtgttgct

SEQ ID NO: 5373978 - DNA, 17 bp, Homo sapiens
atggctaacctgttaca

SEQ ID NO: 5373979 - DNA, 23 bp, Homo sapiens
atggctaacctgttacactgggc

SEQ ID NO: 5373980 - DNA, 18 bp, Homo sapiens
atggctaactgatgaatt

SEQ ID NO: 5373981 - DNA, 19 bp, Homo sapiens
atggctaacttacaaagat

SEQ ID NO: 5373982 - DNA, 15 bp, Homo sapiens
atggctaaggcacca

SEQ ID NO: 5373983 - DNA, 15 bp, Homo sapiens
atggctaataaactg

SEQ ID NO: 5373984 - DNA, 17 bp, Homo sapiens
atggctaattcccagag

SEQ ID NO: 5373985 - DNA, 17 bp, Homo sapiens
atggctagattctaaca

SEQ ID NO: 5373986 - DNA, 16 bp, Homo sapiens
atggctataggtgcta

SEQ ID NO: 5373987 - DNA, 19 bp, Homo sapiens
atggctataggtgctacaa

SEQ ID NO: 5373988 - DNA, 19 bp, Homo sapiens
atggctatatggcaagaaa

SEQ ID NO: 5373989 - DNA, 16 bp, Homo sapiens
atggctatgccttgca

SEQ ID NO: 5373990 - DNA, 15 bp, Homo sapiens
atggctcaaggattc

SEQ ID NO: 5373991 - DNA, 16 bp, Homo sapiens
atggctcaaggattca

SEQ ID NO: 5373992 - DNA, 22 bp, Homo sapiens
atggctcaagtagaaaagcagt

SEQ ID NO: 5373993 - DNA, 19 bp, Homo sapiens
atggctcagagcttgaaga

SEQ ID NO: 5373994 - DNA, 16 bp, Homo sapiens
atggctcaggcaagcc

SEQ ID NO: 5373995 - DNA, 20 bp, Homo sapiens
atggctcaggcaagcccctc

SEQ ID NO: 5373996 - DNA, 22 bp, Homo sapiens
atggctcaggcaagcccctcag

SEQ ID NO: 5373997 - DNA, 15 bp, Homo sapiens
atggctcatcaacaa

SEQ ID NO: 5373998 - DNA, 17 bp, Homo sapiens
atggctcccaaggttcc

SEQ ID NO: 5373999 - DNA, 23 bp, Homo sapiens
atggctcccctttttcttcctca

SEQ ID NO: 5374000 - DNA, 15 bp, Homo sapiens
atggctccctgggct

SEQ ID NO: 5374001 - DNA, 18 bp, Homo sapiens
atggctccctgggctggc

SEQ ID NO: 5374002 - DNA, 17 bp, Homo sapiens
atggctcctgtctggct

SEQ ID NO: 5374003 - DNA, 20 bp, Homo sapiens
atggctcgtgggctctggct

SEQ ID NO: 5374004 - DNA, 18 bp, Homo sapiens
atggctctaaaaagtttt

SEQ ID NO: 5374005 - DNA, 22 bp, Homo sapiens
atggctctctattccctcagcc

SEQ ID NO: 5374006 - DNA, 14 bp, Homo sapiens
atggctctgcaccc

SEQ ID NO: 5374007 - DNA, 17 bp, Homo sapiens
atggctctgcacccctc

SEQ ID NO: 5374008 - DNA, 23 bp, Homo sapiens
atggctctgcacccctctgccct

SEQ ID NO: 5374009 - DNA, 12 bp, Homo sapiens
atggctctggac

SEQ ID NO: 5374010 - DNA, 17 bp, Homo sapiens
atggctctggactctaa

SEQ ID NO: 5374011 - DNA, 19 bp, Homo sapiens
atggctctggactctaaag

SEQ ID NO: 5374012 - DNA, 22 bp, Homo sapiens
atggctctggactctaaagacc

SEQ ID NO: 5374013 - DNA, 13 bp, Homo sapiens
atggctctggcta

SEQ ID NO: 5374014 - DNA, 21 bp, Homo sapiens
atggctctgggctatatgcct

SEQ ID NO: 5374015 - DNA, 17 bp, Homo sapiens
atggctcttagaaactc

SEQ ID NO: 5374016 - DNA, 17 bp, Homo sapiens
atggctgaagaaacaca

SEQ ID NO: 5374017 - DNA, 21 bp, Homo sapiens
atggctgaagaaacacagcat

SEQ ID NO: 5374018 - DNA, 14 bp, Homo sapiens
atggctgaagctgg

SEQ ID NO: 5374019 - DNA, 22 bp, Homo sapiens
atggctgaaggaaaccagtgca

SEQ ID NO: 5374020 - DNA, 19 bp, Homo sapiens
atggctgcacctttttgca

SEQ ID NO: 5374021 - DNA, 15 bp, Homo sapiens
atggctgctagattt

SEQ ID NO: 5374022 - DNA, 12 bp, Homo sapiens
atggctgctgaa

SEQ ID NO: 5374023 - DNA, 14 bp, Homo sapiens
atggctgctgaagc

SEQ ID NO: 5374024 - DNA, 13 bp, Homo sapiens
atggctgctgcct

SEQ ID NO: 5374025 - DNA, 15 bp, Homo sapiens
atggctgctgttgct

SEQ ID NO: 5374026 - DNA, 21 bp, Homo sapiens
atggctgcttttgtctccctt

SEQ ID NO: 5374027 - DNA, 20 bp, Homo sapiens
atggctggaacactgtactg

SEQ ID NO: 5374028 - DNA, 17 bp, Homo sapiens
atggctggatgtgcatc

SEQ ID NO: 5374029 - DNA, 18 bp, Homo sapiens
atggctggatgtgcatct

SEQ ID NO: 5374030 - DNA, 21 bp, Homo sapiens
atggctggccactgcacagag

SEQ ID NO: 5374031 - DNA, 22 bp, Homo sapiens
atggctggccactgcacagagc

SEQ ID NO: 5374032 - DNA, 12 bp, Homo sapiens
atggctggcctg

SEQ ID NO: 5374033 - DNA, 13 bp, Homo sapiens
atggctggcctgg

SEQ ID NO: 5374034 - DNA, 19 bp, Homo sapiens
atggctgggagggggccct

SEQ ID NO: 5374035 - DNA, 23 bp, Homo sapiens
atgggcagttctcccagggagtg

SEQ ID NO: 5374036 - DNA, 21 bp, Homo sapiens
atgggcataggtaagctgtgc

SEQ ID NO: 5374037 - DNA, 21 bp, Homo sapiens
atgggcatcttttgtattaag

SEQ ID NO: 5374038 - DNA, 15 bp, Homo sapiens
atgggcatgaatgga

SEQ ID NO: 5374039 - DNA, 13 bp, Homo sapiens
atgggcatggtgt

SEQ ID NO: 5374040 - DNA, 14 bp, Homo sapiens
atgggcattgacaa

SEQ ID NO: 5374041 - DNA, 16 bp, Homo sapiens
atgggcattgacaaat

SEQ ID NO: 5374042 - DNA, 18 bp, Homo sapiens
atgggcattgcagccttg

SEQ ID NO: 5374043 - DNA, 16 bp, Homo sapiens
atgggcattgggctga

SEQ ID NO: 5374044 - DNA, 19 bp, Homo sapiens
atgggcattgggctgacac

SEQ ID NO: 5374045 - DNA, 17 bp, Homo sapiens
atgggcatttattttat

SEQ ID NO: 5374046 - DNA, 20 bp, Homo sapiens
atgggcatttattttataac

SEQ ID NO: 5374047 - DNA, 22 bp, Homo sapiens
atgggcatttgtttagagccaa

SEQ ID NO: 5374048 - DNA, 14 bp, Homo sapiens
atgggccaagccag

SEQ ID NO: 5374049 - DNA, 21 bp, Homo sapiens
atgggccaattaaaatatata

SEQ ID NO: 5374050 - DNA, 18 bp, Homo sapiens
atgggccacccaccaggg

SEQ ID NO: 5374051 - DNA, 19 bp, Homo sapiens
atgggccacccaccagggc

SEQ ID NO: 5374052 - DNA, 20 bp, Homo sapiens
atgggccacccaccagggct

SEQ ID NO: 5374053 - DNA, 12 bp, Homo sapiens
atgggccaccgc

SEQ ID NO: 5374054 - DNA, 22 bp, Homo sapiens
atgggccaccgccttgcccagc

SEQ ID NO: 5374055 - DNA, 19 bp, Homo sapiens
atgggccactgaaatctgt

SEQ ID NO: 5374056 - DNA, 15 bp, Homo sapiens
atgggccagcccttg

SEQ ID NO: 5374057 - DNA, 16 bp, Homo sapiens
atgggccagcctagcc

SEQ ID NO: 5374058 - DNA, 19 bp, Homo sapiens
atgggccagcctagccctt

SEQ ID NO: 5374059 - DNA, 11 bp, Homo sapiens
atgggccaggg

SEQ ID NO: 5374060 - DNA, 13 bp, Homo sapiens
atgggccccagat

SEQ ID NO: 5374061 - DNA, 17 bp, Homo sapiens
atgggccccccatgcat

SEQ ID NO: 5374062 - DNA, 20 bp, Homo sapiens
atgggccccgccttcctggg

SEQ ID NO: 5374063 - DNA, 19 bp, Homo sapiens
atgggcccgctgcctcttg

SEQ ID NO: 5374064 - DNA, 15 bp, Homo sapiens
atgggccctctgagc

SEQ ID NO: 5374065 - DNA, 15 bp, Homo sapiens
atgggccgtcccctc

SEQ ID NO: 5374066 - DNA, 16 bp, Homo sapiens
atgggccgtcccctct

SEQ ID NO: 5374067 - DNA, 12 bp, Homo sapiens
atgggcctcagc

SEQ ID NO: 5374068 - DNA, 18 bp, Homo sapiens
atgggcctcatgaataaa

SEQ ID NO: 5374069 - DNA, 12 bp, Homo sapiens
atgggcctgagt

SEQ ID NO: 5374070 - DNA, 15 bp, Homo sapiens
atgggcctgcctgcc

SEQ ID NO: 5374071 - DNA, 13 bp, Homo sapiens
atgggcctgctgc

SEQ ID NO: 5374072 - DNA, 17 bp, Homo sapiens
atgggcctgggcctgct

SEQ ID NO: 5374073 - DNA, 18 bp, Homo sapiens
atgggcctgggcctgctt

SEQ ID NO: 5374074 - DNA, 12 bp, Homo sapiens
atgggccttgct

SEQ ID NO: 5374075 - DNA, 15 bp, Homo sapiens
atgggccttgctttg

SEQ ID NO: 5374076 - DNA, 19 bp, Homo sapiens
atgggccttgctttgggct

SEQ ID NO: 5374077 - DNA, 21 bp, Homo sapiens
atgggcctttaagaaccttaa

SEQ ID NO: 5374078 - DNA, 18 bp, Homo sapiens
atgggcgcaggcccagtg

SEQ ID NO: 5374079 - DNA, 19 bp, Homo sapiens
atgggcgcaggcccagtga

SEQ ID NO: 5374080 - DNA, 21 bp, Homo sapiens
atgggcgggcagtcgctgcag

SEQ ID NO: 5374081 - DNA, 23 bp, Homo sapiens
atgggctagtgtgagtggcagcc

SEQ ID NO: 5374082 - DNA, 11 bp, Homo sapiens
atgggctcagg

SEQ ID NO: 5374083 - DNA, 15 bp, Homo sapiens
atgggctccccagga

SEQ ID NO: 5374084 - DNA, 14 bp, Homo sapiens
atgggctctacctc

SEQ ID NO: 5374085 - DNA, 14 bp, Homo sapiens
atgggctcttcact

SEQ ID NO: 5374086 - DNA, 21 bp, Homo sapiens
atgggctgagctagcctccag

SEQ ID NO: 5374087 - DNA, 23 bp, Homo sapiens
atgggctggggcaggggcctggg

SEQ ID NO: 5374088 - DNA, 13 bp, Homo sapiens
atgggctgtgatt

SEQ ID NO: 5374089 - DNA, 16 bp, Homo sapiens
atgggctgtgattact

SEQ ID NO: 5374090 - DNA, 17 bp, Homo sapiens
atgggctgtgtcctaag

SEQ ID NO: 5374091 - DNA, 19 bp, Homo sapiens
atgggcttcactgtataaa

SEQ ID NO: 5374092 - DNA, 20 bp, Homo sapiens
atgggcttcactgtataaat

SEQ ID NO: 5374093 - DNA, 17 bp, Homo sapiens
atgggcttctgttctct

SEQ ID NO: 5374094 - DNA, 21 bp, Homo sapiens
atgggcttctgttctctgctg

SEQ ID NO: 5374095 - DNA, 13 bp, Homo sapiens
atgggcttggact

SEQ ID NO: 5374096 - DNA, 22 bp, Homo sapiens
atgggcttggacttcctggggc

SEQ ID NO: 5374097 - DNA, 23 bp, Homo sapiens
atgggcttgttttcttgccaatg

SEQ ID NO: 5374098 - DNA, 20 bp, Homo sapiens
atgggctttcccaacagctc

SEQ ID NO: 5374099 - DNA, 17 bp, Homo sapiens
atgggcttttgttctga

SEQ ID NO: 5374100 - DNA, 19 bp, Homo sapiens
atgggcttttgttctgagg

SEQ ID NO: 5374101 - DNA, 20 bp, Homo sapiens
atgggcttttgttctgaggg

SEQ ID NO: 5374102 - DNA, 17 bp, Homo sapiens
atggggaaaaaaatcat

SEQ ID NO: 5374103 - DNA, 22 bp, Homo sapiens
atggggaaaccctggagccatc

SEQ ID NO: 5374104 - DNA, 22 bp, Homo sapiens
atggggaacccgctctcccaga

SEQ ID NO: 5374105 - DNA, 19 bp, Homo sapiens
atggggaactcccccagag

SEQ ID NO: 5374106 - DNA, 17 bp, Homo sapiens
atggggaaggcagaggc

SEQ ID NO: 5374107 - DNA, 19 bp, Homo sapiens
atggggaagggagtctctc

SEQ ID NO: 5374108 - DNA, 18 bp, Homo sapiens
atggggaagtgctcccca

SEQ ID NO: 5374109 - DNA, 23 bp, Homo sapiens
atggggacagactgaagacagag

SEQ ID NO: 5374110 - DNA, 13 bp, Homo sapiens
atggggaccctcc

SEQ ID NO: 5374111 - DNA, 15 bp, Homo sapiens
atggggactctccag

SEQ ID NO: 5374112 - DNA, 11 bp, Homo sapiens
atggggagaaa

SEQ ID NO: 5374113 - DNA, 15 bp, Homo sapiens
atggggagaaaagac

SEQ ID NO: 5374114 - DNA, 12 bp, Homo sapiens
atggggagaaag

SEQ ID NO: 5374115 - DNA, 22 bp, Homo sapiens
atggggagaaagggcaaattat

SEQ ID NO: 5374116 - DNA, 14 bp, Homo sapiens
atggggagacaaag

SEQ ID NO: 5374117 - DNA, 16 bp, Homo sapiens
atggggagaggaactc

SEQ ID NO: 5374118 - DNA, 12 bp, Homo sapiens
atggggagaggc

SEQ ID NO: 5374119 - DNA, 19 bp, Homo sapiens
atggggagaggcaaatgca

SEQ ID NO: 5374120 - DNA, 23 bp, Homo sapiens
atggggagatcggggccagaggc

SEQ ID NO: 5374121 - DNA, 16 bp, Homo sapiens
atggggagcagctggg

SEQ ID NO: 5374122 - DNA, 14 bp, Homo sapiens
atggggagctggcc

SEQ ID NO: 5374123 - DNA, 15 bp, Homo sapiens
atggggaggaagaga

SEQ ID NO: 5374124 - DNA, 13 bp, Homo sapiens
atggggaggacaa

SEQ ID NO: 5374125 - DNA, 13 bp, Homo sapiens
atggggaggccct

SEQ ID NO: 5374126 - DNA, 14 bp, Homo sapiens
atggggaggccctg

SEQ ID NO: 5374127 - DNA, 16 bp, Homo sapiens
atggggaggccctgcc

SEQ ID NO: 5374128 - DNA, 14 bp, Homo sapiens
atggggaggggaga

SEQ ID NO: 5374129 - DNA, 22 bp, Homo sapiens
atggggaggggagagaaggtgg

SEQ ID NO: 5374130 - DNA, 12 bp, Homo sapiens
atggggaggggc

SEQ ID NO: 5374131 - DNA, 15 bp, Homo sapiens
atggggaggggctct

SEQ ID NO: 5374132 - DNA, 16 bp, Homo sapiens
atggggaggggctctg

SEQ ID NO: 5374133 - DNA, 16 bp, Homo sapiens
atggggagtcccaaag

SEQ ID NO: 5374134 - DNA, 15 bp, Homo sapiens
atggggatagaggaa

SEQ ID NO: 5374135 - DNA, 16 bp, Homo sapiens
atggggatagaggaaa

SEQ ID NO: 5374136 - DNA, 18 bp, Homo sapiens
atggggatagtctgggtc

SEQ ID NO: 5374137 - DNA, 16 bp, Homo sapiens
atggggatcacagaga

SEQ ID NO: 5374138 - DNA, 19 bp, Homo sapiens
atggggatcacagagacat

SEQ ID NO: 5374139 - DNA, 14 bp, Homo sapiens
atggggatctgggg

SEQ ID NO: 5374140 - DNA, 18 bp, Homo sapiens
atggggatctggggggtg

SEQ ID NO: 5374141 - DNA, 22 bp, Homo sapiens
atggggattcaggggctttggg

SEQ ID NO: 5374142 - DNA, 15 bp, Homo sapiens
atggggcaagccagg

SEQ ID NO: 5374143 - DNA, 16 bp, Homo sapiens
atggggcaagccaggg

SEQ ID NO: 5374144 - DNA, 22 bp, Homo sapiens
atggggcacggactgtccacct

SEQ ID NO: 5374145 - DNA, 15 bp, Homo sapiens
atggggcacggctct

SEQ ID NO: 5374146 - DNA, 18 bp, Homo sapiens
atggggcacggctctggg

SEQ ID NO: 5374147 - DNA, 16 bp, Homo sapiens
atggggcagaagagaa

SEQ ID NO: 5374148 - DNA, 13 bp, Homo sapiens
atggggcagcctc

SEQ ID NO: 5374149 - DNA, 17 bp, Homo sapiens
atggggcaggccacctg

SEQ ID NO: 5374150 - DNA, 13 bp, Homo sapiens
atggggccacagc

SEQ ID NO: 5374151 - DNA, 14 bp, Homo sapiens
atggggccagatcc

SEQ ID NO: 5374152 - DNA, 22 bp, Homo sapiens
atggggccagatccagcctggg

SEQ ID NO: 5374153 - DNA, 14 bp, Homo sapiens
atggggccagcact

SEQ ID NO: 5374154 - DNA, 14 bp, Homo sapiens
atggggcccacatt

SEQ ID NO: 5374155 - DNA, 13 bp, Homo sapiens
atggggccctgcc

SEQ ID NO: 5374156 - DNA, 22 bp, Homo sapiens
atggggcctccctccttgggtc

SEQ ID NO: 5374157 - DNA, 15 bp, Homo sapiens
atggggcggcaattg

SEQ ID NO: 5374158 - DNA, 16 bp, Homo sapiens
atggggcggggcttct

SEQ ID NO: 5374159 - DNA, 19 bp, Homo sapiens
atggggctgacagcactaa

SEQ ID NO: 5374160 - DNA, 23 bp, Homo sapiens
atggggcttggagcaccgaggcc

SEQ ID NO: 5374161 - DNA, 16 bp, Homo sapiens
atgggggaaaattatt

SEQ ID NO: 5374162 - DNA, 17 bp, Homo sapiens
atgggggaaaattattt

SEQ ID NO: 5374163 - DNA, 16 bp, Homo sapiens
atgggggaaagcacag

SEQ ID NO: 5374164 - DNA, 18 bp, Homo sapiens
atgggggaaatggtgcct

SEQ ID NO: 5374165 - DNA, 15 bp, Homo sapiens
atgggggaacaatga

SEQ ID NO: 5374166 - DNA, 18 bp, Homo sapiens
atgggggaactcagatcc

SEQ ID NO: 5374167 - DNA, 19 bp, Homo sapiens
atgggggaactcagatcca

SEQ ID NO: 5374168 - DNA, 18 bp, Homo sapiens
atgggggaccccttccca

SEQ ID NO: 5374169 - DNA, 15 bp, Homo sapiens
atgggggagagaagg

SEQ ID NO: 5374170 - DNA, 13 bp, Homo sapiens
atgggggagaggg

SEQ ID NO: 5374171 - DNA, 20 bp, Homo sapiens
atgggggagtctgaagcaga

SEQ ID NO: 5374172 - DNA, 14 bp, Homo sapiens
atgggggcaagaag

SEQ ID NO: 5374173 - DNA, 15 bp, Homo sapiens
atgggggcagggctg

SEQ ID NO: 5374174 - DNA, 16 bp, Homo sapiens
atgggggcagggctgt

SEQ ID NO: 5374175 - DNA, 21 bp, Homo sapiens
atgggggcagtctccccttcc

SEQ ID NO: 5374176 - DNA, 16 bp, Homo sapiens
atgggggccaggctga

SEQ ID NO: 5374177 - DNA, 14 bp, Homo sapiens
atgggggcctccgc

SEQ ID NO: 5374178 - DNA, 16 bp, Homo sapiens
atgggggctgccagcg

SEQ ID NO: 5374179 - DNA, 20 bp, Homo sapiens
atggggggcgggccagggtg

SEQ ID NO: 5374180 - DNA, 22 bp, Homo sapiens
atggggggcgggccagggtggg

SEQ ID NO: 5374181 - DNA, 17 bp, Homo sapiens
atgggggggagggaggg

SEQ ID NO: 5374182 - DNA, 14 bp, Homo sapiens
atgggggggcgggg

SEQ ID NO: 5374183 - DNA, 18 bp, Homo sapiens
atgggggtagcagctgga

SEQ ID NO: 5374184 - DNA, 21 bp, Homo sapiens
atgggggtgcaggcagccttg

SEQ ID NO: 5374185 - DNA, 14 bp, Homo sapiens
atgggggtgcattt

SEQ ID NO: 5374186 - DNA, 19 bp, Homo sapiens
atggggtcagcaggcccag

SEQ ID NO: 5374187 - DNA, 13 bp, Homo sapiens
atggggtcagccc

SEQ ID NO: 5374188 - DNA, 18 bp, Homo sapiens
atggggtcagccccaagg

SEQ ID NO: 5374189 - DNA, 22 bp, Homo sapiens
atggggtccatccccttccccc

SEQ ID NO: 5374190 - DNA, 21 bp, Homo sapiens
atggggtctctcacagacagg

SEQ ID NO: 5374191 - DNA, 17 bp, Homo sapiens
atggggtctgtaaaatc

SEQ ID NO: 5374192 - DNA, 18 bp, Homo sapiens
atggggtctgtgactgga

SEQ ID NO: 5374193 - DNA, 21 bp, Homo sapiens
atggggtcttgctatgttgcc

SEQ ID NO: 5374194 - DNA, 23 bp, Homo sapiens
atggggtgagaagtacagggcag

SEQ ID NO: 5374195 - DNA, 18 bp, Homo sapiens
atggggtgggagccacag

SEQ ID NO: 5374196 - DNA, 17 bp, Homo sapiens
atggggtgggcagggct

SEQ ID NO: 5374197 - DNA, 20 bp, Homo sapiens
atggggtgggcagggctggg

SEQ ID NO: 5374198 - DNA, 12 bp, Homo sapiens
atggggtggggt

SEQ ID NO: 5374199 - DNA, 19 bp, Homo sapiens
atggggtggggtagggctg

SEQ ID NO: 5374200 - DNA, 16 bp, Homo sapiens
atggggttcctgctgt

SEQ ID NO: 5374201 - DNA, 17 bp, Homo sapiens
atggggttcctgctgtg

SEQ ID NO: 5374202 - DNA, 22 bp, Homo sapiens
atggggttcctggttgttcctg

SEQ ID NO: 5374203 - DNA, 14 bp, Homo sapiens
atggggttctggaa

SEQ ID NO: 5374204 - DNA, 17 bp, Homo sapiens
atggggttgggctctgc

SEQ ID NO: 5374205 - DNA, 15 bp, Homo sapiens
atgggtaaataaatg

SEQ ID NO: 5374206 - DNA, 16 bp, Homo sapiens
atgggtaaataaatgc

SEQ ID NO: 5374207 - DNA, 18 bp, Homo sapiens
atgggtaaataaatgctg

SEQ ID NO: 5374208 - DNA, 15 bp, Homo sapiens
atgggtaagggaggg

SEQ ID NO: 5374209 - DNA, 13 bp, Homo sapiens
atgggtacagagg

SEQ ID NO: 5374210 - DNA, 20 bp, Homo sapiens
atgggtacccagactctaaa

SEQ ID NO: 5374211 - DNA, 22 bp, Homo sapiens
atgggtagggctctgacaaagc

SEQ ID NO: 5374212 - DNA, 19 bp, Homo sapiens
atgggtatacctctaactg

SEQ ID NO: 5374213 - DNA, 23 bp, Homo sapiens
atgggtatattgataaattttaa

SEQ ID NO: 5374214 - DNA, 15 bp, Homo sapiens
atgtaaaatgaattg

SEQ ID NO: 5374215 - DNA, 13 bp, Homo sapiens
atgtaaaatgagt

SEQ ID NO: 5374216 - DNA, 14 bp, Homo sapiens
atgtaaaatgcagt

SEQ ID NO: 5374217 - DNA, 15 bp, Homo sapiens
atgtaaaatgcagtc

SEQ ID NO: 5374218 - DNA, 16 bp, Homo sapiens
atgtaaaatgttgaat

SEQ ID NO: 5374219 - DNA, 19 bp, Homo sapiens
atgtaaacaaaatttagtt

SEQ ID NO: 5374220 - DNA, 16 bp, Homo sapiens
atgtaaacaaatattt

SEQ ID NO: 5374221 - DNA, 14 bp, Homo sapiens
atgtaaacaggaga

SEQ ID NO: 5374222 - DNA, 13 bp, Homo sapiens
atgtaaacagtga

SEQ ID NO: 5374223 - DNA, 20 bp, Homo sapiens
atgtaaacagtgagaaaaga

SEQ ID NO: 5374224 - DNA, 18 bp, Homo sapiens
atgtaaacataccaacat

SEQ ID NO: 5374225 - DNA, 20 bp, Homo sapiens
atgtaaacataccaacatgt

SEQ ID NO: 5374226 - DNA, 15 bp, Homo sapiens
atgtaaaccagaaaa

SEQ ID NO: 5374227 - DNA, 17 bp, Homo sapiens
atgtaaactatttgtgg

SEQ ID NO: 5374228 - DNA, 21 bp, Homo sapiens
atgtaaactcgggggtgctgg

SEQ ID NO: 5374229 - DNA, 14 bp, Homo sapiens
atgtaaactctctt

SEQ ID NO: 5374230 - DNA, 18 bp, Homo sapiens
atgtaaactctcttctct

SEQ ID NO: 5374231 - DNA, 19 bp, Homo sapiens
atgtaaactcttcaccttg

SEQ ID NO: 5374232 - DNA, 14 bp, Homo sapiens
atgtaaactgccat

SEQ ID NO: 5374233 - DNA, 15 bp, Homo sapiens
atgtaaactgccata

SEQ ID NO: 5374234 - DNA, 19 bp, Homo sapiens
atgtaaactgtttctttaa

SEQ ID NO: 5374235 - DNA, 16 bp, Homo sapiens
atgtaaactttaactt

SEQ ID NO: 5374236 - DNA, 16 bp, Homo sapiens
atgtaaagatgattta

SEQ ID NO: 5374237 - DNA, 21 bp, Homo sapiens
atgtaaagcaaccaaaaagaa

SEQ ID NO: 5374238 - DNA, 19 bp, Homo sapiens
atgtaaagcgggaaggaca

SEQ ID NO: 5374239 - DNA, 14 bp, Homo sapiens
atgtaaagctgtta

SEQ ID NO: 5374240 - DNA, 23 bp, Homo sapiens
atgtaaagctgttaaaatacata

SEQ ID NO: 5374241 - DNA, 14 bp, Homo sapiens
atgtaaagcttgtc

SEQ ID NO: 5374242 - DNA, 16 bp, Homo sapiens
atgtaaagcttgtctg

SEQ ID NO: 5374243 - DNA, 16 bp, Homo sapiens
atgtaaaggaaacata

SEQ ID NO: 5374244 - DNA, 14 bp, Homo sapiens
atgtaaaggaggga

SEQ ID NO: 5374245 - DNA, 16 bp, Homo sapiens
atgtaaaggagggaga

SEQ ID NO: 5374246 - DNA, 19 bp, Homo sapiens
atgtaaaggtatattgtga

SEQ ID NO: 5374247 - DNA, 16 bp, Homo sapiens
atgtaaaggttttctc

SEQ ID NO: 5374248 - DNA, 17 bp, Homo sapiens
atgtaaagtatgtaaac

SEQ ID NO: 5374249 - DNA, 18 bp, Homo sapiens
atgtaaagtctagaaaat

SEQ ID NO: 5374250 - DNA, 19 bp, Homo sapiens
atgtaaagtctagaaaata

SEQ ID NO: 5374251 - DNA, 12 bp, Homo sapiens
atgtaaagttat

SEQ ID NO: 5374252 - DNA, 22 bp, Homo sapiens
atgtaaagttatgtatttaaag

SEQ ID NO: 5374253 - DNA, 22 bp, Homo sapiens
atgtaaagttgttaagagacat

SEQ ID NO: 5374254 - DNA, 14 bp, Homo sapiens
atgtaaataaacta

SEQ ID NO: 5374255 - DNA, 23 bp, Homo sapiens
atgtaaataaactatttatatca

SEQ ID NO: 5374256 - DNA, 14 bp, Homo sapiens
atgtaaataactct

SEQ ID NO: 5374257 - DNA, 13 bp, Homo sapiens
atgtaaataatct

SEQ ID NO: 5374258 - DNA, 14 bp, Homo sapiens
atgtaaataattct

SEQ ID NO: 5374259 - DNA, 17 bp, Homo sapiens
atgtaaatacaatttgt

SEQ ID NO: 5374260 - DNA, 14 bp, Homo sapiens
atgtaaatagatga

SEQ ID NO: 5374261 - DNA, 20 bp, Homo sapiens
atgtaaatagattttaagct

SEQ ID NO: 5374262 - DNA, 18 bp, Homo sapiens
atgtaaatagctaagata

SEQ ID NO: 5374263 - DNA, 18 bp, Homo sapiens
atgtaaataggtttctaa

SEQ ID NO: 5374264 - DNA, 12 bp, Homo sapiens
atgtaaatagtg

SEQ ID NO: 5374265 - DNA, 11 bp, Homo sapiens
atgtaaatatt

SEQ ID NO: 5374266 - DNA, 17 bp, Homo sapiens
atgtaaatattgttctg

SEQ ID NO: 5374267 - DNA, 15 bp, Homo sapiens
atgtaaatattttaa

SEQ ID NO: 5374268 - DNA, 23 bp, Homo sapiens
atgtaaatattttaaagaattgt

SEQ ID NO: 5374269 - DNA, 22 bp, Homo sapiens
atgtaaatcacttcattgtttt

SEQ ID NO: 5374270 - DNA, 22 bp, Homo sapiens
atgtaaatcccattattcaaag

SEQ ID NO: 5374271 - DNA, 14 bp, Homo sapiens
atgtaaatccccac

SEQ ID NO: 5374272 - DNA, 18 bp, Homo sapiens
atgtaaatcgggaaggat

SEQ ID NO: 5374273 - DNA, 20 bp, Homo sapiens
atgtaaatctgctttgtggt

SEQ ID NO: 5374274 - DNA, 13 bp, Homo sapiens
atgtaaatgaagt

SEQ ID NO: 5374275 - DNA, 21 bp, Homo sapiens
atgtaaatgcatctgtcctca

SEQ ID NO: 5374276 - DNA, 21 bp, Homo sapiens
atgtaaatgtctcactgagca

SEQ ID NO: 5374277 - DNA, 13 bp, Homo sapiens
atgtaaatgtgtt

SEQ ID NO: 5374278 - DNA, 12 bp, Homo sapiens
atgtaaatgtta

SEQ ID NO: 5374279 - DNA, 13 bp, Homo sapiens
atgtaaatgttat

SEQ ID NO: 5374280 - DNA, 16 bp, Homo sapiens
atgtaaattaagtgtg

SEQ ID NO: 5374281 - DNA, 19 bp, Homo sapiens
atgtaaattacaaatgtgg

SEQ ID NO: 5374282 - DNA, 13 bp, Homo sapiens
atgtaaattagtt

SEQ ID NO: 5374283 - DNA, 16 bp, Homo sapiens
atgtaaattattgtaa

SEQ ID NO: 5374284 - DNA, 17 bp, Homo sapiens
atgtaaattattgtaaa

SEQ ID NO: 5374285 - DNA, 19 bp, Homo sapiens
atgtaaattattgtaaact

SEQ ID NO: 5374286 - DNA, 21 bp, Homo sapiens
atgtaaattattgtaaacttt

SEQ ID NO: 5374287 - DNA, 14 bp, Homo sapiens
atgtaaattgaaga

SEQ ID NO: 5374288 - DNA, 15 bp, Homo sapiens
atgtaaattgaagaa

SEQ ID NO: 5374289 - DNA, 13 bp, Homo sapiens
atgtaaatttgta

SEQ ID NO: 5374290 - DNA, 14 bp, Homo sapiens
atgtaaatttgtac

SEQ ID NO: 5374291 - DNA, 15 bp, Homo sapiens
atgtaaatttgttga

SEQ ID NO: 5374292 - DNA, 13 bp, Homo sapiens
atgtaacaaccag

SEQ ID NO: 5374293 - DNA, 17 bp, Homo sapiens
atgtaacacataaacaa

SEQ ID NO: 5374294 - DNA, 22 bp, Homo sapiens
atgtaacagcaattttcataat

SEQ ID NO: 5374295 - DNA, 21 bp, Homo sapiens
atgtaacagccaggagtgtta

SEQ ID NO: 5374296 - DNA, 15 bp, Homo sapiens
atgtaacagtttaaa

SEQ ID NO: 5374297 - DNA, 14 bp, Homo sapiens
atgtaacatcataa

SEQ ID NO: 5374298 - DNA, 18 bp, Homo sapiens
atgtaacatcataattac

SEQ ID NO: 5374299 - DNA, 20 bp, Homo sapiens
atgtaacatcataattacat

SEQ ID NO: 5374300 - DNA, 12 bp, Homo sapiens
atgtaacatgaa

SEQ ID NO: 5374301 - DNA, 16 bp, Homo sapiens
atgtaacatgaagcaa

SEQ ID NO: 5374302 - DNA, 16 bp, Homo sapiens
atgtaacatgtctaaa

SEQ ID NO: 5374303 - DNA, 14 bp, Homo sapiens
atgtaacattggtg

SEQ ID NO: 5374304 - DNA, 14 bp, Homo sapiens
atgtaaccaagctg

SEQ ID NO: 5374305 - DNA, 15 bp, Homo sapiens
atgtaaccaagctgt

SEQ ID NO: 5374306 - DNA, 16 bp, Homo sapiens
atgtaaccaagctgta

SEQ ID NO: 5374307 - DNA, 14 bp, Homo sapiens
atgtaaccactgca

SEQ ID NO: 5374308 - DNA, 19 bp, Homo sapiens
atgtaactaggtttttgct

SEQ ID NO: 5374309 - DNA, 14 bp, Homo sapiens
atgtaactattgaa

SEQ ID NO: 5374310 - DNA, 17 bp, Homo sapiens
atgtaactccagataga

SEQ ID NO: 5374311 - DNA, 24 bp, Homo sapiens
atgtaactccagatagagaaatag

SEQ ID NO: 5374312 - DNA, 13 bp, Homo sapiens
atgtaactctcca

SEQ ID NO: 5374313 - DNA, 14 bp, Homo sapiens
atgtaactctccag

SEQ ID NO: 5374314 - DNA, 15 bp, Homo sapiens
atgtaactgaagcat

SEQ ID NO: 5374315 - DNA, 19 bp, Homo sapiens
atgtaactgcctagaaaca

SEQ ID NO: 5374316 - DNA, 20 bp, Homo sapiens
atgtaactgctcttgggcaa

SEQ ID NO: 5374317 - DNA, 13 bp, Homo sapiens
atgtaactgttac

SEQ ID NO: 5374318 - DNA, 17 bp, Homo sapiens
atgtaactgttaccatt

SEQ ID NO: 5374319 - DNA, 22 bp, Homo sapiens
atgtaacttaattataagctat

SEQ ID NO: 5374320 - DNA, 13 bp, Homo sapiens
atgtaacttcaga

SEQ ID NO: 5374321 - DNA, 15 bp, Homo sapiens
atgtaacttcagatg

SEQ ID NO: 5374322 - DNA, 16 bp, Homo sapiens
atgtaacttcagatgt

SEQ ID NO: 5374323 - DNA, 20 bp, Homo sapiens
atgtaacttcagatgtttcc

SEQ ID NO: 5374324 - DNA, 20 bp, Homo sapiens
atgtaactttggttaaaatc

SEQ ID NO: 5374325 - DNA, 18 bp, Homo sapiens
atgtaacttttgtaagac

SEQ ID NO: 5374326 - DNA, 17 bp, Homo sapiens
atgtaagaaaagctgat

SEQ ID NO: 5374327 - DNA, 17 bp, Homo sapiens
atgtaagaaaatgttac

SEQ ID NO: 5374328 - DNA, 14 bp, Homo sapiens
atgtaagaaataag

SEQ ID NO: 5374329 - DNA, 14 bp, Homo sapiens
atgtaagaacacat

SEQ ID NO: 5374330 - DNA, 18 bp, Homo sapiens
atgtaagaagaaactgct

SEQ ID NO: 5374331 - DNA, 15 bp, Homo sapiens
atgtaagaatcattg

SEQ ID NO: 5374332 - DNA, 20 bp, Homo sapiens
atgtaagaatccaaagtgga

SEQ ID NO: 5374333 - DNA, 20 bp, Homo sapiens
atgtaagagcaccttcctca

SEQ ID NO: 5374334 - DNA, 23 bp, Homo sapiens
atgtaagagctttacaaaaagac

SEQ ID NO: 5374335 - DNA, 20 bp, Homo sapiens
atgtaagattatagattcta

SEQ ID NO: 5374336 - DNA, 16 bp, Homo sapiens
atgtaagcatactttg

SEQ ID NO: 5374337 - DNA, 19 bp, Homo sapiens
atgtaagcatactttgtaa

SEQ ID NO: 5374338 - DNA, 22 bp, Homo sapiens
atgtaagcatactttgtaaata

SEQ ID NO: 5374339 - DNA, 15 bp, Homo sapiens
atgtaagctgtttat

SEQ ID NO: 5374340 - DNA, 12 bp, Homo sapiens
atgtaaggaatt

SEQ ID NO: 5374341 - DNA, 15 bp, Homo sapiens
atgtaaggactgtaa

SEQ ID NO: 5374342 - DNA, 22 bp, Homo sapiens
atgtaaggaggtttgtataagt

SEQ ID NO: 5374343 - DNA, 15 bp, Homo sapiens
atgtaaggcactgtc

SEQ ID NO: 5374344 - DNA, 12 bp, Homo sapiens
atgtaaggcctt

SEQ ID NO: 5374345 - DNA, 17 bp, Homo sapiens
atgtaaggccttagcca

SEQ ID NO: 5374346 - DNA, 16 bp, Homo sapiens
atgtaagggaaactgc

SEQ ID NO: 5374347 - DNA, 22 bp, Homo sapiens
atgtaagggaaactgccagcaa

SEQ ID NO: 5374348 - DNA, 16 bp, Homo sapiens
atgtaagggctttaaa

SEQ ID NO: 5374349 - DNA, 19 bp, Homo sapiens
atgtaagggctttaaataa

SEQ ID NO: 5374350 - DNA, 23 bp, Homo sapiens
atgtaagggctttaaataaaaga

SEQ ID NO: 5374351 - DNA, 21 bp, Homo sapiens
atgtaagggtctttggtgttt

SEQ ID NO: 5374352 - DNA, 18 bp, Homo sapiens
atgtaaggtaatttctgt

SEQ ID NO: 5374353 - DNA, 15 bp, Homo sapiens
atgtaagtgggccca

SEQ ID NO: 5374354 - DNA, 18 bp, Homo sapiens
atgtaagtgggcccaccc

SEQ ID NO: 5374355 - DNA, 22 bp, Homo sapiens
atgtaagttgagaaaaatttat

SEQ ID NO: 5374356 - DNA, 23 bp, Homo sapiens
atgtaagtttaattatctgcatt

SEQ ID NO: 5374357 - DNA, 18 bp, Homo sapiens
atgtaagtttacctatgt

SEQ ID NO: 5374358 - DNA, 13 bp, Homo sapiens
atgtaagtttcta

SEQ ID NO: 5374359 - DNA, 14 bp, Homo sapiens
atgtaagtttctaa

SEQ ID NO: 5374360 - DNA, 16 bp, Homo sapiens
atgtaagtttctaaga

SEQ ID NO: 5374361 - DNA, 20 bp, Homo sapiens
atgtaagtttctaagaattt

SEQ ID NO: 5374362 - DNA, 21 bp, Homo sapiens
atgtaagtttctaagaattta

SEQ ID NO: 5374363 - DNA, 20 bp, Homo sapiens
atgtaagtttgcatatcagt

SEQ ID NO: 5374364 - DNA, 14 bp, Homo sapiens
atgtaataaacttt

SEQ ID NO: 5374365 - DNA, 22 bp, Homo sapiens
atgtaataagcacttgcctgga

SEQ ID NO: 5374366 - DNA, 22 bp, Homo sapiens
atgtaataaggttgaacacttt

SEQ ID NO: 5374367 - DNA, 18 bp, Homo sapiens
atgtaataatcattttag

SEQ ID NO: 5374368 - DNA, 23 bp, Homo sapiens
atgtaataatcattttagaatta

SEQ ID NO: 5374369 - DNA, 17 bp, Homo sapiens
atgtaataatgtacaga

SEQ ID NO: 5374370 - DNA, 16 bp, Homo sapiens
atgtaataatgtgaat

SEQ ID NO: 5374371 - DNA, 16 bp, Homo sapiens
atgtaatactgtagaa

SEQ ID NO: 5374372 - DNA, 18 bp, Homo sapiens
atgtaatactgtagaaat

SEQ ID NO: 5374373 - DNA, 19 bp, Homo sapiens
atgtaatactgtagaaata

SEQ ID NO: 5374374 - DNA, 22 bp, Homo sapiens
atgtaatactgtagaaatattg

SEQ ID NO: 5374375 - DNA, 13 bp, Homo sapiens
atgtaatataaat

SEQ ID NO: 5374376 - DNA, 14 bp, Homo sapiens
atgtaatataatgt

SEQ ID NO: 5374377 - DNA, 19 bp, Homo sapiens
atgtaatataatgtatttt

SEQ ID NO: 5374378 - DNA, 13 bp, Homo sapiens
atgtaatatatac

SEQ ID NO: 5374379 - DNA, 19 bp, Homo sapiens
atgtaatatatacatattc

SEQ ID NO: 5374380 - DNA, 18 bp, Homo sapiens
atgtaatatatttcagac

SEQ ID NO: 5374381 - DNA, 16 bp, Homo sapiens
atgtaatcaatgtttc

SEQ ID NO: 5374382 - DNA, 19 bp, Homo sapiens
atgtaatcggcttgaattt

SEQ ID NO: 5374383 - DNA, 20 bp, Homo sapiens
atgtaatctctctgcagctg

SEQ ID NO: 5374384 - DNA, 21 bp, Homo sapiens
atgtaatctctctgcagctgc

SEQ ID NO: 5374385 - DNA, 23 bp, Homo sapiens
atgtaatctgatggcttctccag

SEQ ID NO: 5374386 - DNA, 17 bp, Homo sapiens
atgtaatgaagtaaagc

SEQ ID NO: 5374387 - DNA, 16 bp, Homo sapiens
atgtaatgacagagag

SEQ ID NO: 5374388 - DNA, 18 bp, Homo sapiens
atgtaatgacagagagtt

SEQ ID NO: 5374389 - DNA, 16 bp, Homo sapiens
atgtaatgcactttgg

SEQ ID NO: 5374390 - DNA, 22 bp, Homo sapiens
atgtaatgcgattttattactg

SEQ ID NO: 5374391 - DNA, 19 bp, Homo sapiens
atgtaatgcttatgtgttg

SEQ ID NO: 5374392 - DNA, 18 bp, Homo sapiens
atgtaatgttaatgttat

SEQ ID NO: 5374393 - DNA, 18 bp, Homo sapiens
atgtcacatttgaattct

SEQ ID NO: 5374394 - DNA, 13 bp, Homo sapiens
atgtcaccacctt

SEQ ID NO: 5374395 - DNA, 18 bp, Homo sapiens
atgtcaccaccttcccag

SEQ ID NO: 5374396 - DNA, 23 bp, Homo sapiens
atgtcaccaccttcccagctctc

SEQ ID NO: 5374397 - DNA, 19 bp, Homo sapiens
atgtcaccggatcctgggt

SEQ ID NO: 5374398 - DNA, 18 bp, Homo sapiens
atgtcaccggtcagtgcc

SEQ ID NO: 5374399 - DNA, 19 bp, Homo sapiens
atgtcaccggtcagtgcct

SEQ ID NO: 5374400 - DNA, 21 bp, Homo sapiens
atgtcaccggtcagtgccttt

SEQ ID NO: 5374401 - DNA, 21 bp, Homo sapiens
atgtcaccgtggaccttcctg

SEQ ID NO: 5374402 - DNA, 16 bp, Homo sapiens
atgtcacctacatatg

SEQ ID NO: 5374403 - DNA, 13 bp, Homo sapiens
atgtcacctggct

SEQ ID NO: 5374404 - DNA, 16 bp, Homo sapiens
atgtcacgtactgtct

SEQ ID NO: 5374405 - DNA, 20 bp, Homo sapiens
atgtcacgtactgtctgatt

SEQ ID NO: 5374406 - DNA, 21 bp, Homo sapiens
atgtcacgtactgtctgattg

SEQ ID NO: 5374407 - DNA, 17 bp, Homo sapiens
atgtcacgtcttgaaaa

SEQ ID NO: 5374408 - DNA, 16 bp, Homo sapiens
atgtcactaaagcagg

SEQ ID NO: 5374409 - DNA, 16 bp, Homo sapiens
atgtcactagaatgga

SEQ ID NO: 5374410 - DNA, 17 bp, Homo sapiens
atgtcactatttgttgg

SEQ ID NO: 5374411 - DNA, 22 bp, Homo sapiens
atgtcactcagccccttcccgg

SEQ ID NO: 5374412 - DNA, 19 bp, Homo sapiens
atgtcactgaagtgattga

SEQ ID NO: 5374413 - DNA, 16 bp, Homo sapiens
atgtcactgtggtcct

SEQ ID NO: 5374414 - DNA, 15 bp, Homo sapiens
atgtcactgttataa

SEQ ID NO: 5374415 - DNA, 14 bp, Homo sapiens
atgtcacttcatat

SEQ ID NO: 5374416 - DNA, 10 bp, Homo sapiens
atgtcacttt

SEQ ID NO: 5374417 - DNA, 21 bp, Homo sapiens
atgtcactttttgaggcaaaa

SEQ ID NO: 5374418 - DNA, 21 bp, Homo sapiens
atgtcagaaactcgatgaatg

SEQ ID NO: 5374419 - DNA, 23 bp, Homo sapiens
atgtcagaagtttctttttacat

SEQ ID NO: 5374420 - DNA, 15 bp, Homo sapiens
atgtcagacacagat

SEQ ID NO: 5374421 - DNA, 14 bp, Homo sapiens
atgtcagacatgaa

SEQ ID NO: 5374422 - DNA, 16 bp, Homo sapiens
atgtcagactggctgg

SEQ ID NO: 5374423 - DNA, 18 bp, Homo sapiens
atgtcagactttgctgca

SEQ ID NO: 5374424 - DNA, 23 bp, Homo sapiens
atgtcagactttgctgcatttta

SEQ ID NO: 5374425 - DNA, 21 bp, Homo sapiens
atgtcagagccaggctctgcc

SEQ ID NO: 5374426 - DNA, 15 bp, Homo sapiens
atgtcagagctatgt

SEQ ID NO: 5374427 - DNA, 18 bp, Homo sapiens
atgtcagaggaccccagg

SEQ ID NO: 5374428 - DNA, 14 bp, Homo sapiens
atgtcagatacaat

SEQ ID NO: 5374429 - DNA, 18 bp, Homo sapiens
atgtcagatacaatgtat

SEQ ID NO: 5374430 - DNA, 15 bp, Homo sapiens
atgtcagattccttt

SEQ ID NO: 5374431 - DNA, 17 bp, Homo sapiens
atgtcagatttctggtt

SEQ ID NO: 5374432 - DNA, 15 bp, Homo sapiens
atgtcagcaaaaagc

SEQ ID NO: 5374433 - DNA, 16 bp, Homo sapiens
atgtcagcaaatgtaa

SEQ ID NO: 5374434 - DNA, 20 bp, Homo sapiens
atgtcagcaaatgtaaaaat

SEQ ID NO: 5374435 - DNA, 15 bp, Homo sapiens
atgtcagcagacaca

SEQ ID NO: 5374436 - DNA, 13 bp, Homo sapiens
atgtcagccactg

SEQ ID NO: 5374437 - DNA, 23 bp, Homo sapiens
atgtcagccgagccgggcctggg

SEQ ID NO: 5374438 - DNA, 11 bp, Homo sapiens
atgtcagcctt

SEQ ID NO: 5374439 - DNA, 12 bp, Homo sapiens
atgtcagccttt

SEQ ID NO: 5374440 - DNA, 13 bp, Homo sapiens
atgtcagcctttg

SEQ ID NO: 5374441 - DNA, 17 bp, Homo sapiens
atgtcaggaacagaagg

SEQ ID NO: 5374442 - DNA, 20 bp, Homo sapiens
atgtcaggaacagaaggatg

SEQ ID NO: 5374443 - DNA, 15 bp, Homo sapiens
atgtcaggaatttaa

SEQ ID NO: 5374444 - DNA, 19 bp, Homo sapiens
atgtcaggaatttaagaat

SEQ ID NO: 5374445 - DNA, 12 bp, Homo sapiens
atgtcaggccag

SEQ ID NO: 5374446 - DNA, 16 bp, Homo sapiens
atgtcagggccaggtg

SEQ ID NO: 5374447 - DNA, 20 bp, Homo sapiens
atgtcagggccaggtgcaga

SEQ ID NO: 5374448 - DNA, 22 bp, Homo sapiens
atgtcagggctgagtgaatcaa

SEQ ID NO: 5374449 - DNA, 17 bp, Homo sapiens
atgtcaggggtttgctt

SEQ ID NO: 5374450 - DNA, 19 bp, Homo sapiens
atgtcaggtcagccaactg

SEQ ID NO: 5374451 - DNA, 16 bp, Homo sapiens
atgtcagtagtgcctg

SEQ ID NO: 5374452 - DNA, 13 bp, Homo sapiens
atgtcagtatgtg

SEQ ID NO: 5374453 - DNA, 23 bp, Homo sapiens
atgtcagtatttcaactgctgta

SEQ ID NO: 5374454 - DNA, 16 bp, Homo sapiens
atgtcagtatttcagt

SEQ ID NO: 5374455 - DNA, 15 bp, Homo sapiens
atgtcagtattttaa

SEQ ID NO: 5374456 - DNA, 16 bp, Homo sapiens
atgtcagtattttaat

SEQ ID NO: 5374457 - DNA, 19 bp, Homo sapiens
atgtcagtctgcttagaaa

SEQ ID NO: 5374458 - DNA, 16 bp, Homo sapiens
atgtcagtctggttta

SEQ ID NO: 5374459 - DNA, 12 bp, Homo sapiens
atgtcagtctgt

SEQ ID NO: 5374460 - DNA, 22 bp, Homo sapiens
atgtcagtgctataaatgccag

SEQ ID NO: 5374461 - DNA, 15 bp, Homo sapiens
atgtcagtggtttct

SEQ ID NO: 5374462 - DNA, 12 bp, Homo sapiens
atgtcagtgtga

SEQ ID NO: 5374463 - DNA, 15 bp, Homo sapiens
atgtcagtgtgactg

SEQ ID NO: 5374464 - DNA, 16 bp, Homo sapiens
atgtcagtgtgactga

SEQ ID NO: 5374465 - DNA, 16 bp, Homo sapiens
atgtcagttctgatat

SEQ ID NO: 5374466 - DNA, 21 bp, Homo sapiens
atgtcagttctgatatggaag

SEQ ID NO: 5374467 - DNA, 15 bp, Homo sapiens
atgtcagttgaaaat

SEQ ID NO: 5374468 - DNA, 20 bp, Homo sapiens
atgtcagttggccctttaat

SEQ ID NO: 5374469 - DNA, 15 bp, Homo sapiens
atgtcagttgttatt

SEQ ID NO: 5374470 - DNA, 14 bp, Homo sapiens
atgtcataaacgat

SEQ ID NO: 5374471 - DNA, 11 bp, Homo sapiens
atgtcataaat

SEQ ID NO: 5374472 - DNA, 12 bp, Homo sapiens
atgtcataaatg

SEQ ID NO: 5374473 - DNA, 20 bp, Homo sapiens
atgtcataaatgtcacaata

SEQ ID NO: 5374474 - DNA, 16 bp, Homo sapiens
atgtcataaattactg

SEQ ID NO: 5374475 - DNA, 20 bp, Homo sapiens
atgtcataaattactgtttt

SEQ ID NO: 5374476 - DNA, 13 bp, Homo sapiens
atgtcatacagag

SEQ ID NO: 5374477 - DNA, 14 bp, Homo sapiens
atgtcatacagaga

SEQ ID NO: 5374478 - DNA, 16 bp, Homo sapiens
atgtcatacagagaag

SEQ ID NO: 5374479 - DNA, 14 bp, Homo sapiens
atgtcatactctgt

SEQ ID NO: 5374480 - DNA, 17 bp, Homo sapiens
atgtcatactctgtgta

SEQ ID NO: 5374481 - DNA, 22 bp, Homo sapiens
atgtcatagaaatattgactca

SEQ ID NO: 5374482 - DNA, 20 bp, Homo sapiens
atgtcatagtcttgaaatga

SEQ ID NO: 5374483 - DNA, 22 bp, Homo sapiens
atgtcatatactgccatgtact

SEQ ID NO: 5374484 - DNA, 17 bp, Homo sapiens
atgtcatatattactag

SEQ ID NO: 5374485 - DNA, 22 bp, Homo sapiens
atgtcatattttgccactgcct

SEQ ID NO: 5374486 - DNA, 15 bp, Homo sapiens
atgtcatcatacatg

SEQ ID NO: 5374487 - DNA, 22 bp, Homo sapiens
atgtcatgtcttccattaagaa

SEQ ID NO: 5374488 - DNA, 13 bp, Homo sapiens
atgtcatgtgttc

SEQ ID NO: 5374489 - DNA, 16 bp, Homo sapiens
atgtcattaaagtgca

SEQ ID NO: 5374490 - DNA, 22 bp, Homo sapiens
atgtcattaaagtgcactgtgt

SEQ ID NO: 5374491 - DNA, 13 bp, Homo sapiens
atgtcattaaatg

SEQ ID NO: 5374492 - DNA, 16 bp, Homo sapiens
atgtcattaatgtgtt

SEQ ID NO: 5374493 - DNA, 23 bp, Homo sapiens
atgtcattatgtagaaatattat

SEQ ID NO: 5374494 - DNA, 20 bp, Homo sapiens
atgtcattatttattgttaa

SEQ ID NO: 5374495 - DNA, 17 bp, Homo sapiens
atgtcattgcccacttc

SEQ ID NO: 5374496 - DNA, 23 bp, Homo sapiens
atgtcattgcccacttctgtgta

SEQ ID NO: 5374497 - DNA, 19 bp, Homo sapiens
atgtcatttcatacaaatt

SEQ ID NO: 5374498 - DNA, 15 bp, Homo sapiens
atgtcatttcatttc

SEQ ID NO: 5374499 - DNA, 18 bp, Homo sapiens
atgtcatttcatttccta

SEQ ID NO: 5374500 - DNA, 21 bp, Homo sapiens
atgtcatttccaccagcagtt

SEQ ID NO: 5374501 - DNA, 13 bp, Homo sapiens
atgtcatttgcac

SEQ ID NO: 5374502 - DNA, 20 bp, Homo sapiens
atgtcatttgcacacaaaaa

SEQ ID NO: 5374503 - DNA, 13 bp, Homo sapiens
atgtcatttgcta

SEQ ID NO: 5374504 - DNA, 21 bp, Homo sapiens
atgtcatttgctaatgaattt

SEQ ID NO: 5374505 - DNA, 13 bp, Homo sapiens
atgtcattttcag

SEQ ID NO: 5374506 - DNA, 21 bp, Homo sapiens
atgtcatttttaatgtatcta

SEQ ID NO: 5374507 - DNA, 14 bp, Homo sapiens
atgtccaaaattta

SEQ ID NO: 5374508 - DNA, 14 bp, Homo sapiens
atgtccaaacctgg

SEQ ID NO: 5374509 - DNA, 12 bp, Homo sapiens
atgtccaaagag

SEQ ID NO: 5374510 - DNA, 15 bp, Homo sapiens
atgtccaaagaggct

SEQ ID NO: 5374511 - DNA, 20 bp, Homo sapiens
atgtccaaagaggctgcccc

SEQ ID NO: 5374512 - DNA, 19 bp, Homo sapiens
atgtccaagaagcccagga

SEQ ID NO: 5374513 - DNA, 19 bp, Homo sapiens
atgtccaagcatcagcaag

SEQ ID NO: 5374514 - DNA, 22 bp, Homo sapiens
atgtccaagcatcagcaagaca

SEQ ID NO: 5374515 - DNA, 23 bp, Homo sapiens
atgtccaagtccaacctgcctgt

SEQ ID NO: 5374516 - DNA, 22 bp, Homo sapiens
atgtccaagttcttcacctcta

SEQ ID NO: 5374517 - DNA, 13 bp, Homo sapiens
atgtccaatcttt

SEQ ID NO: 5374518 - DNA, 16 bp, Homo sapiens
atgtccacagatgcct

SEQ ID NO: 5374519 - DNA, 20 bp, Homo sapiens
atgtccacagatgcctccac

SEQ ID NO: 5374520 - DNA, 21 bp, Homo sapiens
atgtccactgttctgttctca

SEQ ID NO: 5374521 - DNA, 21 bp, Homo sapiens
atgtccagcaccttgtgcctg

SEQ ID NO: 5374522 - DNA, 14 bp, Homo sapiens
atgtccagccaccc

SEQ ID NO: 5374523 - DNA, 20 bp, Homo sapiens
atgtccagccacccccaggc

SEQ ID NO: 5374524 - DNA, 18 bp, Homo sapiens
atgtccagctgctgtcag

SEQ ID NO: 5374525 - DNA, 12 bp, Homo sapiens
atgtccaggaaa

SEQ ID NO: 5374526 - DNA, 17 bp, Homo sapiens
atgtccagggggagaag

SEQ ID NO: 5374527 - DNA, 16 bp, Homo sapiens
atgtccaggtcacagg

SEQ ID NO: 5374528 - DNA, 23 bp, Homo sapiens
atgtccagtcatcctgccctgca

SEQ ID NO: 5374529 - DNA, 12 bp, Homo sapiens
atgtccagtgag

SEQ ID NO: 5374530 - DNA, 19 bp, Homo sapiens
atgtccatatctaaccagt

SEQ ID NO: 5374531 - DNA, 14 bp, Homo sapiens
atgtccatcccttt

SEQ ID NO: 5374532 - DNA, 19 bp, Homo sapiens
atgtccatcccttttcctg

SEQ ID NO: 5374533 - DNA, 21 bp, Homo sapiens
atgtccatcccttttcctgtc

SEQ ID NO: 5374534 - DNA, 14 bp, Homo sapiens
atgtccattctcat

SEQ ID NO: 5374535 - DNA, 22 bp, Homo sapiens
atgtcccaagagccataagggg

SEQ ID NO: 5374536 - DNA, 16 bp, Homo sapiens
atgtcccacagggacc

SEQ ID NO: 5374537 - DNA, 19 bp, Homo sapiens
atgtcccaccctccctaga

SEQ ID NO: 5374538 - DNA, 18 bp, Homo sapiens
atgtcccacctctctgag

SEQ ID NO: 5374539 - DNA, 23 bp, Homo sapiens
atgtcccagtgctcaccagccct

SEQ ID NO: 5374540 - DNA, 12 bp, Homo sapiens
atgtcccagtgt

SEQ ID NO: 5374541 - DNA, 22 bp, Homo sapiens
atgtcccatcacgtgtactggc

SEQ ID NO: 5374542 - DNA, 15 bp, Homo sapiens
atgtcccatctgctc

SEQ ID NO: 5374543 - DNA, 17 bp, Homo sapiens
atgtcccatctgctcct

SEQ ID NO: 5374544 - DNA, 22 bp, Homo sapiens
atgtcccatctgctcctcccat

SEQ ID NO: 5374545 - DNA, 17 bp, Homo sapiens
atgtcccattttcagac

SEQ ID NO: 5374546 - DNA, 23 bp, Homo sapiens
atgtccccagtgtggactctgga

SEQ ID NO: 5374547 - DNA, 16 bp, Homo sapiens
atgtccccattctata

SEQ ID NO: 5374548 - DNA, 23 bp, Homo sapiens
atgtcccccactgctaaggctgc

SEQ ID NO: 5374549 - DNA, 15 bp, Homo sapiens
atgtccccccctaac

SEQ ID NO: 5374550 - DNA, 20 bp, Homo sapiens
atgtccccctcacccccacc

SEQ ID NO: 5374551 - DNA, 14 bp, Homo sapiens
atgtcccctgtccc

SEQ ID NO: 5374552 - DNA, 21 bp, Homo sapiens
atgtcccctgtcccaccaact

SEQ ID NO: 5374553 - DNA, 16 bp, Homo sapiens
atgtccctccaacaca

SEQ ID NO: 5374554 - DNA, 17 bp, Homo sapiens
atgtccctccaacacag

SEQ ID NO: 5374555 - DNA, 19 bp, Homo sapiens
atgtccctctcttggctat

SEQ ID NO: 5374556 - DNA, 20 bp, Homo sapiens
atgtccctgaagtcttgcat

SEQ ID NO: 5374557 - DNA, 14 bp, Homo sapiens
atgtccctgggcca

SEQ ID NO: 5374558 - DNA, 17 bp, Homo sapiens
atgtccctgggccaggg

SEQ ID NO: 5374559 - DNA, 20 bp, Homo sapiens
atgtccctgtccccaggccc

SEQ ID NO: 5374560 - DNA, 19 bp, Homo sapiens
atgtcccttgatgcacaga

SEQ ID NO: 5374561 - DNA, 23 bp, Homo sapiens
atgtcccttgatgcacagagaag

SEQ ID NO: 5374562 - DNA, 17 bp, Homo sapiens
atgtccggctttaacta

SEQ ID NO: 5374563 - DNA, 14 bp, Homo sapiens
atgtccgttccagg

SEQ ID NO: 5374564 - DNA, 19 bp, Homo sapiens
atgtcctaaagaagacatt

SEQ ID NO: 5374565 - DNA, 16 bp, Homo sapiens
atgtcctaatggtgat

SEQ ID NO: 5374566 - DNA, 20 bp, Homo sapiens
atgtcctactatcactgaac

SEQ ID NO: 5374567 - DNA, 15 bp, Homo sapiens
atgtcctagacaggt

SEQ ID NO: 5374568 - DNA, 23 bp, Homo sapiens
atgtcctaggggccgagggaaat

SEQ ID NO: 5374569 - DNA, 23 bp, Homo sapiens
atgtcctatgtatatcttctaca

SEQ ID NO: 5374570 - DNA, 13 bp, Homo sapiens
atgtgatgtcatg

SEQ ID NO: 5374571 - DNA, 18 bp, Homo sapiens
atgtgatgtcatgaaact

SEQ ID NO: 5374572 - DNA, 21 bp, Homo sapiens
atgtgatgtcatgaaactgta

SEQ ID NO: 5374573 - DNA, 16 bp, Homo sapiens
atgtgatgtggcagga

SEQ ID NO: 5374574 - DNA, 23 bp, Homo sapiens
atgtgatgtggcaggagggcagt

SEQ ID NO: 5374575 - DNA, 14 bp, Homo sapiens
atgtgatgttaact

SEQ ID NO: 5374576 - DNA, 15 bp, Homo sapiens
atgtgatgttctaag

SEQ ID NO: 5374577 - DNA, 16 bp, Homo sapiens
atgtgatgttctaagg

SEQ ID NO: 5374578 - DNA, 19 bp, Homo sapiens
atgtgatgttctaaggctc

SEQ ID NO: 5374579 - DNA, 23 bp, Homo sapiens
atgtgattaatgttttcattatg

SEQ ID NO: 5374580 - DNA, 23 bp, Homo sapiens
atgtgattcactgccttcctctc

SEQ ID NO: 5374581 - DNA, 23 bp, Homo sapiens
atgtgattcctttgaagaggaaa

SEQ ID NO: 5374582 - DNA, 19 bp, Homo sapiens
atgtgattggcagcttcaa

SEQ ID NO: 5374583 - DNA, 17 bp, Homo sapiens
atgtgattgtggaatgg

SEQ ID NO: 5374584 - DNA, 22 bp, Homo sapiens
atgtgattgtggaatggagatt

SEQ ID NO: 5374585 - DNA, 14 bp, Homo sapiens
atgtgattgttcca

SEQ ID NO: 5374586 - DNA, 15 bp, Homo sapiens
atgtgatttaaacaa

SEQ ID NO: 5374587 - DNA, 17 bp, Homo sapiens
atgtgatttaatagtgt

SEQ ID NO: 5374588 - DNA, 19 bp, Homo sapiens
atgtgatttataacgcaca

SEQ ID NO: 5374589 - DNA, 14 bp, Homo sapiens
atgtgatttatgca

SEQ ID NO: 5374590 - DNA, 21 bp, Homo sapiens
atgtgatttgtgtaatactaa

SEQ ID NO: 5374591 - DNA, 16 bp, Homo sapiens
atgtgattttaactct

SEQ ID NO: 5374592 - DNA, 11 bp, Homo sapiens
atgtgattttc

SEQ ID NO: 5374593 - DNA, 15 bp, Homo sapiens
atgtgatttttctga

SEQ ID NO: 5374594 - DNA, 16 bp, Homo sapiens
atgtgatttttgtaat

SEQ ID NO: 5374595 - DNA, 20 bp, Homo sapiens
atgtgatttttgtaatatgt

SEQ ID NO: 5374596 - DNA, 15 bp, Homo sapiens
atgtgcaaaaatttt

SEQ ID NO: 5374597 - DNA, 16 bp, Homo sapiens
atgtgcaaaaattttt

SEQ ID NO: 5374598 - DNA, 13 bp, Homo sapiens
atgtgcaaaacag

SEQ ID NO: 5374599 - DNA, 18 bp, Homo sapiens
atgtgcaaaaccttttac

SEQ ID NO: 5374600 - DNA, 19 bp, Homo sapiens
atgtgcaaaatctgttata

SEQ ID NO: 5374601 - DNA, 23 bp, Homo sapiens
atgtgcaaaatctgttatagctt

SEQ ID NO: 5374602 - DNA, 18 bp, Homo sapiens
atgtgcaaaggtgtgctt

SEQ ID NO: 5374603 - DNA, 15 bp, Homo sapiens
atgtgcaaattttgc

SEQ ID NO: 5374604 - DNA, 18 bp, Homo sapiens
atgtgcaacctgtggctc

SEQ ID NO: 5374605 - DNA, 20 bp, Homo sapiens
atgtgcaacctgtggctcag

SEQ ID NO: 5374606 - DNA, 22 bp, Homo sapiens
atgtgcaacctgtggctcaggg

SEQ ID NO: 5374607 - DNA, 20 bp, Homo sapiens
atgtgcaagagtatactttg

SEQ ID NO: 5374608 - DNA, 21 bp, Homo sapiens
atgtgcaagagtatactttgt

SEQ ID NO: 5374609 - DNA, 15 bp, Homo sapiens
atgtgcaagtttatc

SEQ ID NO: 5374610 - DNA, 10 bp, Homo sapiens
atgtgcaata

SEQ ID NO: 5374611 - DNA, 16 bp, Homo sapiens
atgtgcaatacatttt

SEQ ID NO: 5374612 - DNA, 17 bp, Homo sapiens
atgtgcaatacattttt

SEQ ID NO: 5374613 - DNA, 18 bp, Homo sapiens
atgtgcaatagaaggtga

SEQ ID NO: 5374614 - DNA, 18 bp, Homo sapiens
atgtgcaattgatttctt

SEQ ID NO: 5374615 - DNA, 13 bp, Homo sapiens
atgtgcaattgtg

SEQ ID NO: 5374616 - DNA, 19 bp, Homo sapiens
atgtgcacatctgttttgt

SEQ ID NO: 5374617 - DNA, 16 bp, Homo sapiens
atgtgcacccatgggc

SEQ ID NO: 5374618 - DNA, 18 bp, Homo sapiens
atgtgcacccggcctgga

SEQ ID NO: 5374619 - DNA, 23 bp, Homo sapiens
atgtgcactgaatcgtttcatgt

SEQ ID NO: 5374620 - DNA, 20 bp, Homo sapiens
atgtgcagaaaatatttaat

SEQ ID NO: 5374621 - DNA, 22 bp, Homo sapiens
atgtgcagaaaatatttaatat

SEQ ID NO: 5374622 - DNA, 21 bp, Homo sapiens
atgtgcagacactcaagagcc

SEQ ID NO: 5374623 - DNA, 21 bp, Homo sapiens
atgtgcagatatccaaacaag

SEQ ID NO: 5374624 - DNA, 13 bp, Homo sapiens
atgtgcagcaaaa

SEQ ID NO: 5374625 - DNA, 22 bp, Homo sapiens
atgtgcagcagattggaaggag

SEQ ID NO: 5374626 - DNA, 17 bp, Homo sapiens
atgtgcagggatattgc

SEQ ID NO: 5374627 - DNA, 20 bp, Homo sapiens
atgtgcagggatattgcctt

SEQ ID NO: 5374628 - DNA, 12 bp, Homo sapiens
atgtgcagtctt

SEQ ID NO: 5374629 - DNA, 23 bp, Homo sapiens
atgtgcagtgtagcccacacttg

SEQ ID NO: 5374630 - DNA, 21 bp, Homo sapiens
atgtgcagtgtcttgtaacaa

SEQ ID NO: 5374631 - DNA, 23 bp, Homo sapiens
atgtgcagttcagtttgtctctt

SEQ ID NO: 5374632 - DNA, 20 bp, Homo sapiens
atgtgcatacgtatgagata

SEQ ID NO: 5374633 - DNA, 17 bp, Homo sapiens
atgtgcatcaggaaaca

SEQ ID NO: 5374634 - DNA, 17 bp, Homo sapiens
atgtgcatctggcctat

SEQ ID NO: 5374635 - DNA, 18 bp, Homo sapiens
atgtgcatctggcctatg

SEQ ID NO: 5374636 - DNA, 16 bp, Homo sapiens
atgtgcatctggtgta

SEQ ID NO: 5374637 - DNA, 14 bp, Homo sapiens
atgtgcatgcatac

SEQ ID NO: 5374638 - DNA, 17 bp, Homo sapiens
atgtgcatgcataccac

SEQ ID NO: 5374639 - DNA, 18 bp, Homo sapiens
atgtgcattattcataaa

SEQ ID NO: 5374640 - DNA, 20 bp, Homo sapiens
atgtgcattcttttaaaaga

SEQ ID NO: 5374641 - DNA, 18 bp, Homo sapiens
atgtgcatttcacctgtg

SEQ ID NO: 5374642 - DNA, 13 bp, Homo sapiens
atgtgcatttctt

SEQ ID NO: 5374643 - DNA, 17 bp, Homo sapiens
atgtgccaaagctttac

SEQ ID NO: 5374644 - DNA, 13 bp, Homo sapiens
atgtgccacagag

SEQ ID NO: 5374645 - DNA, 16 bp, Homo sapiens
atgtgccacagaggcc

SEQ ID NO: 5374646 - DNA, 22 bp, Homo sapiens
atgtgccacagaggccccacct

SEQ ID NO: 5374647 - DNA, 16 bp, Homo sapiens
atgtgccacattttct

SEQ ID NO: 5374648 - DNA, 23 bp, Homo sapiens
atgtgccaccaacataaaacaaa

SEQ ID NO: 5374649 - DNA, 22 bp, Homo sapiens
atgtgccacctgtccggcccag

SEQ ID NO: 5374650 - DNA, 15 bp, Homo sapiens
atgtgccagttcctg

SEQ ID NO: 5374651 - DNA, 16 bp, Homo sapiens
atgtgccagttcctgt

SEQ ID NO: 5374652 - DNA, 18 bp, Homo sapiens
atgtgccagttgcctgga

SEQ ID NO: 5374653 - DNA, 14 bp, Homo sapiens
atgtgccatactaa

SEQ ID NO: 5374654 - DNA, 19 bp, Homo sapiens
atgtgccatactaatgatg

SEQ ID NO: 5374655 - DNA, 20 bp, Homo sapiens
atgtgccatactaatgatga

SEQ ID NO: 5374656 - DNA, 14 bp, Homo sapiens
atgtgccatctgta

SEQ ID NO: 5374657 - DNA, 11 bp, Homo sapiens
atgtgccatgt

SEQ ID NO: 5374658 - DNA, 15 bp, Homo sapiens
atgtgccatgtataa

SEQ ID NO: 5374659 - DNA, 20 bp, Homo sapiens
atgtgccatgtataattttt

SEQ ID NO: 5374660 - DNA, 17 bp, Homo sapiens
atgtgccatttttcaga

SEQ ID NO: 5374661 - DNA, 16 bp, Homo sapiens
atgtgcccacagggac

SEQ ID NO: 5374662 - DNA, 13 bp, Homo sapiens
atgtgcccagagt

SEQ ID NO: 5374663 - DNA, 14 bp, Homo sapiens
atgtgcccagagta

SEQ ID NO: 5374664 - DNA, 20 bp, Homo sapiens
atgtgcccagagtagcccag

SEQ ID NO: 5374665 - DNA, 21 bp, Homo sapiens
atgtgcccagagtagcccagg

SEQ ID NO: 5374666 - DNA, 16 bp, Homo sapiens
atgtgcccaggggagc

SEQ ID NO: 5374667 - DNA, 19 bp, Homo sapiens
atgtgcccagttaatcttg

SEQ ID NO: 5374668 - DNA, 18 bp, Homo sapiens
atgtgccccatgtccaag

SEQ ID NO: 5374669 - DNA, 15 bp, Homo sapiens
atgtgcccccacccc

SEQ ID NO: 5374670 - DNA, 22 bp, Homo sapiens
atgtgcccccacccccaccctc

SEQ ID NO: 5374671 - DNA, 15 bp, Homo sapiens
atgtgcccctcctgg

SEQ ID NO: 5374672 - DNA, 18 bp, Homo sapiens
atgtgcccctcctgggtg

SEQ ID NO: 5374673 - DNA, 13 bp, Homo sapiens
atgtgcccctgcc

SEQ ID NO: 5374674 - DNA, 14 bp, Homo sapiens
atgtgcccgcctct

SEQ ID NO: 5374675 - DNA, 17 bp, Homo sapiens
atgtgccctcctgaggg

SEQ ID NO: 5374676 - DNA, 18 bp, Homo sapiens
atgtgccgaatgtgcagg

SEQ ID NO: 5374677 - DNA, 14 bp, Homo sapiens
atgtgcctaaataa

SEQ ID NO: 5374678 - DNA, 18 bp, Homo sapiens
atgtgcctctgcggggca

SEQ ID NO: 5374679 - DNA, 20 bp, Homo sapiens
atgtgcctgatccagcctct

SEQ ID NO: 5374680 - DNA, 17 bp, Homo sapiens
atgtgcctgcaccagga

SEQ ID NO: 5374681 - DNA, 15 bp, Homo sapiens
atgtgcctgcttcag

SEQ ID NO: 5374682 - DNA, 23 bp, Homo sapiens
atgtgcctgcttcagcctcccac

SEQ ID NO: 5374683 - DNA, 13 bp, Homo sapiens
atgtgcctggaaa

SEQ ID NO: 5374684 - DNA, 18 bp, Homo sapiens
atgtgcctgtattcccag

SEQ ID NO: 5374685 - DNA, 20 bp, Homo sapiens
atgtgcctgtattcccagct

SEQ ID NO: 5374686 - DNA, 13 bp, Homo sapiens
atgtgcctgtcac

SEQ ID NO: 5374687 - DNA, 20 bp, Homo sapiens
atgtgcctgtcacgctctgg

SEQ ID NO: 5374688 - DNA, 17 bp, Homo sapiens
atgtgcctgtgggaggg

SEQ ID NO: 5374689 - DNA, 19 bp, Homo sapiens
atgtgcctgtgggaggggg

SEQ ID NO: 5374690 - DNA, 12 bp, Homo sapiens
atgtgccttaag

SEQ ID NO: 5374691 - DNA, 20 bp, Homo sapiens
atgtgccttaagttttagtc

SEQ ID NO: 5374692 - DNA, 18 bp, Homo sapiens
atgtgccttgtccaggaa

SEQ ID NO: 5374693 - DNA, 14 bp, Homo sapiens
atgtgcctttcttt

SEQ ID NO: 5374694 - DNA, 15 bp, Homo sapiens
atgtgcgaacacagt

SEQ ID NO: 5374695 - DNA, 19 bp, Homo sapiens
atgtgcgaacacagtgaca

SEQ ID NO: 5374696 - DNA, 16 bp, Homo sapiens
atgtgcgcacacacag

SEQ ID NO: 5374697 - DNA, 18 bp, Homo sapiens
atgtgcggctgaactgag

SEQ ID NO: 5374698 - DNA, 15 bp, Homo sapiens
atgtgcgtgctgtct

SEQ ID NO: 5374699 - DNA, 20 bp, Homo sapiens
atgtgcgtgtgcgtgttcct

SEQ ID NO: 5374700 - DNA, 14 bp, Homo sapiens
atgtgcgtgtgtgc

SEQ ID NO: 5374701 - DNA, 18 bp, Homo sapiens
atgtgcgtgtgtgcaagt

SEQ ID NO: 5374702 - DNA, 13 bp, Homo sapiens
atgtgctacaggg

SEQ ID NO: 5374703 - DNA, 23 bp, Homo sapiens
atgtgctacaggggccagaagat

SEQ ID NO: 5374704 - DNA, 14 bp, Homo sapiens
atgtgctactgatt

SEQ ID NO: 5374705 - DNA, 20 bp, Homo sapiens
atgtgctactgattgtttca

SEQ ID NO: 5374706 - DNA, 14 bp, Homo sapiens
atgtgctagagtta

SEQ ID NO: 5374707 - DNA, 17 bp, Homo sapiens
atgtgctagagttaaaa

SEQ ID NO: 5374708 - DNA, 20 bp, Homo sapiens
atgtgctagagttaaaagtt

SEQ ID NO: 5374709 - DNA, 19 bp, Homo sapiens
atgtgctagtcactggcag

SEQ ID NO: 5374710 - DNA, 21 bp, Homo sapiens
atgtgctagtcactggcagcc

SEQ ID NO: 5374711 - DNA, 15 bp, Homo sapiens
atgtgctagtggcaa

SEQ ID NO: 5374712 - DNA, 22 bp, Homo sapiens
atgtgctataatctgtttttac

SEQ ID NO: 5374713 - DNA, 18 bp, Homo sapiens
atgtgctatactgcatac

SEQ ID NO: 5374714 - DNA, 18 bp, Homo sapiens
atgtgctatataaatatg

SEQ ID NO: 5374715 - DNA, 22 bp, Homo sapiens
atgtgctatgcaaaatagacat

SEQ ID NO: 5374716 - DNA, 16 bp, Homo sapiens
atgtgctatggagagg

SEQ ID NO: 5374717 - DNA, 17 bp, Homo sapiens
atgtgctatggagagga

SEQ ID NO: 5374718 - DNA, 15 bp, Homo sapiens
atgtgctattgaact

SEQ ID NO: 5374719 - DNA, 16 bp, Homo sapiens
atgtgctcagccaaat

SEQ ID NO: 5374720 - DNA, 21 bp, Homo sapiens
atgtgctcagccaaatttcct

SEQ ID NO: 5374721 - DNA, 17 bp, Homo sapiens
atgtgctcatcagaaac

SEQ ID NO: 5374722 - DNA, 19 bp, Homo sapiens
atgtgctcccaccaggcag

SEQ ID NO: 5374723 - DNA, 18 bp, Homo sapiens
atgtgctctcggcttcac

SEQ ID NO: 5374724 - DNA, 14 bp, Homo sapiens
atgtgctgcaaaga

SEQ ID NO: 5374725 - DNA, 14 bp, Homo sapiens
atgtgctgctgtgg

SEQ ID NO: 5374726 - DNA, 16 bp, Homo sapiens
atgtgctgctgtggca

SEQ ID NO: 5374727 - DNA, 14 bp, Homo sapiens
atgtgctgctttga

SEQ ID NO: 5374728 - DNA, 20 bp, Homo sapiens
atgtgctgctttgatatata

SEQ ID NO: 5374729 - DNA, 18 bp, Homo sapiens
atgtgctgggaaatgcag

SEQ ID NO: 5374730 - DNA, 20 bp, Homo sapiens
atgtgctgggaaatgcagaa

SEQ ID NO: 5374731 - DNA, 15 bp, Homo sapiens
atgtgctgggtgcct

SEQ ID NO: 5374732 - DNA, 21 bp, Homo sapiens
atgtgctggtgaacactgtga

SEQ ID NO: 5374733 - DNA, 12 bp, Homo sapiens
atgtgctgtgca

SEQ ID NO: 5374734 - DNA, 14 bp, Homo sapiens
atgtgctgtgcacc

SEQ ID NO: 5374735 - DNA, 13 bp, Homo sapiens
atgtgctgtgtaa

SEQ ID NO: 5374736 - DNA, 16 bp, Homo sapiens
atgtgctgtgtgacat

SEQ ID NO: 5374737 - DNA, 17 bp, Homo sapiens
atgtgctgttagaatat

SEQ ID NO: 5374738 - DNA, 18 bp, Homo sapiens
atgtgctgttagaatatg

SEQ ID NO: 5374739 - DNA, 19 bp, Homo sapiens
atgtgctgttgattctttc

SEQ ID NO: 5374740 - DNA, 21 bp, Homo sapiens
atgtgctgttgattctttcaa

SEQ ID NO: 5374741 - DNA, 17 bp, Homo sapiens
atgtgctgttttctgta

SEQ ID NO: 5374742 - DNA, 22 bp, Homo sapiens
atgtgctgttttctgtaaattc

SEQ ID NO: 5374743 - DNA, 21 bp, Homo sapiens
atgtgcttaacagggaacgtg

SEQ ID NO: 5374744 - DNA, 14 bp, Homo sapiens
atgtgcttcattgt

SEQ ID NO: 5374745 - DNA, 22 bp, Homo sapiens
atgtgcttctcagttgcagaaa

SEQ ID NO: 5374746 - DNA, 22 bp, Homo sapiens
atgtgcttgtgctcatgtgtgt

SEQ ID NO: 5374747 - DNA, 20 bp, Homo sapiens
attacaagcctggaaaaaaa

SEQ ID NO: 5374748 - DNA, 18 bp, Homo sapiens
attacaaggcaatggaaa

SEQ ID NO: 5374749 - DNA, 18 bp, Homo sapiens
attacaaggtgtcctcag

SEQ ID NO: 5374750 - DNA, 18 bp, Homo sapiens
attacaagtattcagttc

SEQ ID NO: 5374751 - DNA, 22 bp, Homo sapiens
attacaagtattcagttccaat

SEQ ID NO: 5374752 - DNA, 13 bp, Homo sapiens
attacaagtggct

SEQ ID NO: 5374753 - DNA, 20 bp, Homo sapiens
attacaagtggctccccacc

SEQ ID NO: 5374754 - DNA, 13 bp, Homo sapiens
attacaagtttca

SEQ ID NO: 5374755 - DNA, 16 bp, Homo sapiens
attacaagtttcagta

SEQ ID NO: 5374756 - DNA, 13 bp, Homo sapiens
attacaatacaaa

SEQ ID NO: 5374757 - DNA, 23 bp, Homo sapiens
attacaatacaaaggttccattc

SEQ ID NO: 5374758 - DNA, 14 bp, Homo sapiens
attacaattttatc

SEQ ID NO: 5374759 - DNA, 13 bp, Homo sapiens
attacaattttta

SEQ ID NO: 5374760 - DNA, 18 bp, Homo sapiens
attacaatttttaataaa

SEQ ID NO: 5374761 - DNA, 18 bp, Homo sapiens
attacacaaaacaaatgc

SEQ ID NO: 5374762 - DNA, 15 bp, Homo sapiens
attacacaaactatg

SEQ ID NO: 5374763 - DNA, 13 bp, Homo sapiens
attacacaaagaa

SEQ ID NO: 5374764 - DNA, 18 bp, Homo sapiens
attacacaaatacttatt

SEQ ID NO: 5374765 - DNA, 16 bp, Homo sapiens
attacacaagtttaaa

SEQ ID NO: 5374766 - DNA, 16 bp, Homo sapiens
attacacaataaagca

SEQ ID NO: 5374767 - DNA, 17 bp, Homo sapiens
attacacaataaagcag

SEQ ID NO: 5374768 - DNA, 20 bp, Homo sapiens
attacacagtcaaatttaca

SEQ ID NO: 5374769 - DNA, 18 bp, Homo sapiens
attacaccacaagtatct

SEQ ID NO: 5374770 - DNA, 18 bp, Homo sapiens
attacaccacagcattgt

SEQ ID NO: 5374771 - DNA, 17 bp, Homo sapiens
attacacccaaatattg

SEQ ID NO: 5374772 - DNA, 18 bp, Homo sapiens
attacacctcagaaattg

SEQ ID NO: 5374773 - DNA, 19 bp, Homo sapiens
attacacctcagaaattga

SEQ ID NO: 5374774 - DNA, 18 bp, Homo sapiens
attacactaaattattag

SEQ ID NO: 5374775 - DNA, 17 bp, Homo sapiens
attacactccagcctgg

SEQ ID NO: 5374776 - DNA, 18 bp, Homo sapiens
attacactccagcctggg

SEQ ID NO: 5374777 - DNA, 15 bp, Homo sapiens
attacactgtaagaa

SEQ ID NO: 5374778 - DNA, 12 bp, Homo sapiens
attacagaaaat

SEQ ID NO: 5374779 - DNA, 19 bp, Homo sapiens
attacagaaaatttgcaac

SEQ ID NO: 5374780 - DNA, 14 bp, Homo sapiens
attacagaaactga

SEQ ID NO: 5374781 - DNA, 17 bp, Homo sapiens
attacagaaactgatgc

SEQ ID NO: 5374782 - DNA, 17 bp, Homo sapiens
attacagaaccaaatcg

SEQ ID NO: 5374783 - DNA, 18 bp, Homo sapiens
attacagagaggagaaac

SEQ ID NO: 5374784 - DNA, 19 bp, Homo sapiens
attacagagaggagaaaca

SEQ ID NO: 5374785 - DNA, 21 bp, Homo sapiens
attacagagaggagaaacaca

SEQ ID NO: 5374786 - DNA, 22 bp, Homo sapiens
attacagagaggagaaacacat

SEQ ID NO: 5374787 - DNA, 13 bp, Homo sapiens
attacagagatat

SEQ ID NO: 5374788 - DNA, 17 bp, Homo sapiens
attacagagatataaat

SEQ ID NO: 5374789 - DNA, 20 bp, Homo sapiens
attacagagatataaatgaa

SEQ ID NO: 5374790 - DNA, 22 bp, Homo sapiens
attacagagatataaatgaagt

SEQ ID NO: 5374791 - DNA, 15 bp, Homo sapiens
attacagatgtgaaa

SEQ ID NO: 5374792 - DNA, 15 bp, Homo sapiens
attacagattaaaga

SEQ ID NO: 5374793 - DNA, 15 bp, Homo sapiens
attacagatttagtt

SEQ ID NO: 5374794 - DNA, 13 bp, Homo sapiens
attacagcttcac

SEQ ID NO: 5374795 - DNA, 14 bp, Homo sapiens
attacagcttttat

SEQ ID NO: 5374796 - DNA, 15 bp, Homo sapiens
attacaggaaatgca

SEQ ID NO: 5374797 - DNA, 19 bp, Homo sapiens
attacaggagggaacattt

SEQ ID NO: 5374798 - DNA, 22 bp, Homo sapiens
attacaggcacctgccaccatg

SEQ ID NO: 5374799 - DNA, 19 bp, Homo sapiens
attacaggcgtgagccacc

SEQ ID NO: 5374800 - DNA, 22 bp, Homo sapiens
attacaggcgtgagccacctcg

SEQ ID NO: 5374801 - DNA, 15 bp, Homo sapiens
attacaggctcctgc

SEQ ID NO: 5374802 - DNA, 17 bp, Homo sapiens
attacaggcttgagcct

SEQ ID NO: 5374803 - DNA, 17 bp, Homo sapiens
attacaggtgcccacca

SEQ ID NO: 5374804 - DNA, 13 bp, Homo sapiens
attacaggtgtga

SEQ ID NO: 5374805 - DNA, 14 bp, Homo sapiens
attacagtataatt

SEQ ID NO: 5374806 - DNA, 16 bp, Homo sapiens
attacagtataattaa

SEQ ID NO: 5374807 - DNA, 21 bp, Homo sapiens
attacagtatggcaatatcta

SEQ ID NO: 5374808 - DNA, 12 bp, Homo sapiens
attacagtattg

SEQ ID NO: 5374809 - DNA, 22 bp, Homo sapiens
attacagtattgctatttatat

SEQ ID NO: 5374810 - DNA, 19 bp, Homo sapiens
attacagtcttatttaacc

SEQ ID NO: 5374811 - DNA, 12 bp, Homo sapiens
attacagtgaaa

SEQ ID NO: 5374812 - DNA, 18 bp, Homo sapiens
attacagtgcctaaaata

SEQ ID NO: 5374813 - DNA, 23 bp, Homo sapiens
attacagtgtcctaccactctaa

SEQ ID NO: 5374814 - DNA, 15 bp, Homo sapiens
attacagttcacact

SEQ ID NO: 5374815 - DNA, 14 bp, Homo sapiens
attacataaataaa

SEQ ID NO: 5374816 - DNA, 15 bp, Homo sapiens
attacataacaggca

SEQ ID NO: 5374817 - DNA, 18 bp, Homo sapiens
attacataactgatctat

SEQ ID NO: 5374818 - DNA, 19 bp, Homo sapiens
attacataactgatctatt

SEQ ID NO: 5374819 - DNA, 19 bp, Homo sapiens
attacataatcaaagctac

SEQ ID NO: 5374820 - DNA, 23 bp, Homo sapiens
attacataatttagttgtttcta

SEQ ID NO: 5374821 - DNA, 21 bp, Homo sapiens
attacatacagattttaccta

SEQ ID NO: 5374822 - DNA, 16 bp, Homo sapiens
attacatagaacactt

SEQ ID NO: 5374823 - DNA, 13 bp, Homo sapiens
attacatatttga

SEQ ID NO: 5374824 - DNA, 22 bp, Homo sapiens
attacatatttgactctttcaa

SEQ ID NO: 5374825 - DNA, 21 bp, Homo sapiens
attacatatttgcatatgtat

SEQ ID NO: 5374826 - DNA, 15 bp, Homo sapiens
attacatattttttg

SEQ ID NO: 5374827 - DNA, 14 bp, Homo sapiens
attacatccttgtg

SEQ ID NO: 5374828 - DNA, 17 bp, Homo sapiens
attacatccttgtggca

SEQ ID NO: 5374829 - DNA, 14 bp, Homo sapiens
attacatctctaat

SEQ ID NO: 5374830 - DNA, 23 bp, Homo sapiens
attacatctctaattttggataa

SEQ ID NO: 5374831 - DNA, 14 bp, Homo sapiens
attacatgaagatt

SEQ ID NO: 5374832 - DNA, 18 bp, Homo sapiens
attacatgcatgagcacc

SEQ ID NO: 5374833 - DNA, 11 bp, Homo sapiens
attacatgtaa

SEQ ID NO: 5374834 - DNA, 12 bp, Homo sapiens
attacatgtaaa

SEQ ID NO: 5374835 - DNA, 15 bp, Homo sapiens
attacatgtaaacaa

SEQ ID NO: 5374836 - DNA, 19 bp, Homo sapiens
attacatgtaaagctgtta

SEQ ID NO: 5374837 - DNA, 22 bp, Homo sapiens
attacatgtaaattaagtgtgt

SEQ ID NO: 5374838 - DNA, 18 bp, Homo sapiens
attacatgtttaaattgt

SEQ ID NO: 5374839 - DNA, 20 bp, Homo sapiens
attacatgttttttcatttg

SEQ ID NO: 5374840 - DNA, 22 bp, Homo sapiens
attacatgttttttcatttgta

SEQ ID NO: 5374841 - DNA, 13 bp, Homo sapiens
attacattaacat

SEQ ID NO: 5374842 - DNA, 14 bp, Homo sapiens
attacattaacatt

SEQ ID NO: 5374843 - DNA, 17 bp, Homo sapiens
attacattattaaacga

SEQ ID NO: 5374844 - DNA, 19 bp, Homo sapiens
attacattcctaactagaa

SEQ ID NO: 5374845 - DNA, 15 bp, Homo sapiens
attacattgccattt

SEQ ID NO: 5374846 - DNA, 11 bp, Homo sapiens
attacatttaa

SEQ ID NO: 5374847 - DNA, 11 bp, Homo sapiens
attacatttca

SEQ ID NO: 5374848 - DNA, 15 bp, Homo sapiens
attacatttcattta

SEQ ID NO: 5374849 - DNA, 15 bp, Homo sapiens
attacatttctgaat

SEQ ID NO: 5374850 - DNA, 15 bp, Homo sapiens
attacatttgtaatt

SEQ ID NO: 5374851 - DNA, 18 bp, Homo sapiens
attacatttgtaatttaa

SEQ ID NO: 5374852 - DNA, 19 bp, Homo sapiens
attacatttgtaatttaag

SEQ ID NO: 5374853 - DNA, 16 bp, Homo sapiens
attacatttgtataaa

SEQ ID NO: 5374854 - DNA, 20 bp, Homo sapiens
attacatttgtataaaataa

SEQ ID NO: 5374855 - DNA, 16 bp, Homo sapiens
attacattttactgat

SEQ ID NO: 5374856 - DNA, 23 bp, Homo sapiens
attacattttactgattaacaaa

SEQ ID NO: 5374857 - DNA, 15 bp, Homo sapiens
attacatttttaagc

SEQ ID NO: 5374858 - DNA, 17 bp, Homo sapiens
attaccaaaaaagtatt

SEQ ID NO: 5374859 - DNA, 13 bp, Homo sapiens
attaccaaaacag

SEQ ID NO: 5374860 - DNA, 11 bp, Homo sapiens
attaccaaagc

SEQ ID NO: 5374861 - DNA, 17 bp, Homo sapiens
attaccaccacctgctc

SEQ ID NO: 5374862 - DNA, 14 bp, Homo sapiens
attaccaccctttc

SEQ ID NO: 5374863 - DNA, 22 bp, Homo sapiens
attaccactcaagaagacactt

SEQ ID NO: 5374864 - DNA, 19 bp, Homo sapiens
attaccactgaagatagaa

SEQ ID NO: 5374865 - DNA, 22 bp, Homo sapiens
attaccactgaagatagaagaa

SEQ ID NO: 5374866 - DNA, 23 bp, Homo sapiens
attaccagattcacttctgaatt

SEQ ID NO: 5374867 - DNA, 18 bp, Homo sapiens
attaccagcaagaataaa

SEQ ID NO: 5374868 - DNA, 22 bp, Homo sapiens
attaccagggactatctttgct

SEQ ID NO: 5374869 - DNA, 23 bp, Homo sapiens
attaccagggactatctttgctg

SEQ ID NO: 5374870 - DNA, 21 bp, Homo sapiens
attaccagtggcgttgttgca

SEQ ID NO: 5374871 - DNA, 15 bp, Homo sapiens
attaccatcttaatc

SEQ ID NO: 5374872 - DNA, 16 bp, Homo sapiens
attaccatcttaatct

SEQ ID NO: 5374873 - DNA, 17 bp, Homo sapiens
attaccatcttaatctt

SEQ ID NO: 5374874 - DNA, 20 bp, Homo sapiens
attaccatcttaatctttat

SEQ ID NO: 5374875 - DNA, 20 bp, Homo sapiens
attaccatgagaagagggcc

SEQ ID NO: 5374876 - DNA, 13 bp, Homo sapiens
attaccatggaga

SEQ ID NO: 5374877 - DNA, 21 bp, Homo sapiens
attaccatgtaaataatctgt

SEQ ID NO: 5374878 - DNA, 17 bp, Homo sapiens
attaccattaattacat

SEQ ID NO: 5374879 - DNA, 22 bp, Homo sapiens
attacccaaacccatggctcta

SEQ ID NO: 5374880 - DNA, 13 bp, Homo sapiens
attacccaatgga

SEQ ID NO: 5374881 - DNA, 19 bp, Homo sapiens
attacccacccgacctggc

SEQ ID NO: 5374882 - DNA, 21 bp, Homo sapiens
attacccacccgacctggctg

SEQ ID NO: 5374883 - DNA, 24 bp, Homo sapiens
attacccagagatatctatgaaaa

SEQ ID NO: 5374884 - DNA, 14 bp, Homo sapiens
attacccagtgccg

SEQ ID NO: 5374885 - DNA, 15 bp, Homo sapiens
attacccataaacag

SEQ ID NO: 5374886 - DNA, 17 bp, Homo sapiens
attacccataaacagca

SEQ ID NO: 5374887 - DNA, 23 bp, Homo sapiens
attaccccataccccttattgct

SEQ ID NO: 5374888 - DNA, 23 bp, Homo sapiens
attacccccagtcctccctagct

SEQ ID NO: 5374889 - DNA, 13 bp, Homo sapiens
attaccccctcct

SEQ ID NO: 5374890 - DNA, 20 bp, Homo sapiens
attacccctatacctgagcc

SEQ ID NO: 5374891 - DNA, 21 bp, Homo sapiens
attacccctatacctgagcct

SEQ ID NO: 5374892 - DNA, 16 bp, Homo sapiens
attaccccttcatgtc

SEQ ID NO: 5374893 - DNA, 16 bp, Homo sapiens
attaccctcaaatgct

SEQ ID NO: 5374894 - DNA, 13 bp, Homo sapiens
attacccttcctc

SEQ ID NO: 5374895 - DNA, 19 bp, Homo sapiens
attaccgcgttgtaaaata

SEQ ID NO: 5374896 - DNA, 21 bp, Homo sapiens
attacctagtagtcatttcat

SEQ ID NO: 5374897 - DNA, 12 bp, Homo sapiens
attacctcctga

SEQ ID NO: 5374898 - DNA, 20 bp, Homo sapiens
attacctctttggaaaagga

SEQ ID NO: 5374899 - DNA, 18 bp, Homo sapiens
attacctgataagggaga

SEQ ID NO: 5374900 - DNA, 12 bp, Homo sapiens
attacctgccaa

SEQ ID NO: 5374901 - DNA, 20 bp, Homo sapiens
attacctgccaattgctacc

SEQ ID NO: 5374902 - DNA, 21 bp, Homo sapiens
attacctggagaagaatggct

SEQ ID NO: 5374903 - DNA, 24 bp, Homo sapiens
attacctggtgagtaacttagaaa

SEQ ID NO: 5374904 - DNA, 15 bp, Homo sapiens
attacctgtagcttt

SEQ ID NO: 5374905 - DNA, 19 bp, Homo sapiens
attacctgtggagttgcat

SEQ ID NO: 5374906 - DNA, 18 bp, Homo sapiens
attacctgtgtgagattt

SEQ ID NO: 5374907 - DNA, 19 bp, Homo sapiens
attaccttctattggtctc

SEQ ID NO: 5374908 - DNA, 13 bp, Homo sapiens
attaccttctttc

SEQ ID NO: 5374909 - DNA, 14 bp, Homo sapiens
attaccttctttct

SEQ ID NO: 5374910 - DNA, 15 bp, Homo sapiens
attacctttacatat

SEQ ID NO: 5374911 - DNA, 17 bp, Homo sapiens
attacctttacatatat

SEQ ID NO: 5374912 - DNA, 22 bp, Homo sapiens
attaccttttaccagcttttaa

SEQ ID NO: 5374913 - DNA, 20 bp, Homo sapiens
attaccttttttgataaagt

SEQ ID NO: 5374914 - DNA, 22 bp, Homo sapiens
attacgaagttcaagatcaaaa

SEQ ID NO: 5374915 - DNA, 13 bp, Homo sapiens
attacgataaaca

SEQ ID NO: 5374916 - DNA, 19 bp, Homo sapiens
attacgataaggaagaaac

SEQ ID NO: 5374917 - DNA, 14 bp, Homo sapiens
attacgatgtaaat

SEQ ID NO: 5374918 - DNA, 16 bp, Homo sapiens
attacggctcctctct

SEQ ID NO: 5374919 - DNA, 21 bp, Homo sapiens
attacggtgtacagtttaaca

SEQ ID NO: 5374920 - DNA, 23 bp, Homo sapiens
attacggtgtacagtttaacaga

SEQ ID NO: 5374921 - DNA, 20 bp, Homo sapiens
attacgtagcaggccatggc

SEQ ID NO: 5374922 - DNA, 21 bp, Homo sapiens
attacgtatgcaagtctgtga

SEQ ID NO: 5374923 - DNA, 16 bp, Homo sapiens
attacgtgagccaggt

SEQ ID NO: 5374924 - DNA, 15 bp, Homo sapiens
attacgtgcatttaa

SEQ ID NO: 5374925 - DNA, 12 bp, Homo sapiens
attagtattttg

SEQ ID NO: 5374926 - DNA, 14 bp, Homo sapiens
attagtattttgag

SEQ ID NO: 5374927 - DNA, 19 bp, Homo sapiens
attagtcatagaagaacta

SEQ ID NO: 5374928 - DNA, 16 bp, Homo sapiens
attagtcatatttttg

SEQ ID NO: 5374929 - DNA, 16 bp, Homo sapiens
attagtccaaatgtga

SEQ ID NO: 5374930 - DNA, 13 bp, Homo sapiens
attagtccctggc

SEQ ID NO: 5374931 - DNA, 16 bp, Homo sapiens
attagtcctcacagcc

SEQ ID NO: 5374932 - DNA, 20 bp, Homo sapiens
attagtcgggcatgagtctg

SEQ ID NO: 5374933 - DNA, 21 bp, Homo sapiens
attagtcgggcatgagtctgt

SEQ ID NO: 5374934 - DNA, 19 bp, Homo sapiens
attagtgaaccaaaaatag

SEQ ID NO: 5374935 - DNA, 18 bp, Homo sapiens
attagtgaagtatgcact

SEQ ID NO: 5374936 - DNA, 19 bp, Homo sapiens
attagtgagacatcaggga

SEQ ID NO: 5374937 - DNA, 19 bp, Homo sapiens
attagtgagatttgtattt

SEQ ID NO: 5374938 - DNA, 20 bp, Homo sapiens
attagtgagatttgtattta

SEQ ID NO: 5374939 - DNA, 22 bp, Homo sapiens
attagtgatatagtgctgttta

SEQ ID NO: 5374940 - DNA, 13 bp, Homo sapiens
attagtgatattt

SEQ ID NO: 5374941 - DNA, 13 bp, Homo sapiens
attagtgattctg

SEQ ID NO: 5374942 - DNA, 19 bp, Homo sapiens
attagtgattctgatttca

SEQ ID NO: 5374943 - DNA, 23 bp, Homo sapiens
attagtgcagccaagtagcctct

SEQ ID NO: 5374944 - DNA, 19 bp, Homo sapiens
attagtgccacttaatgta

SEQ ID NO: 5374945 - DNA, 21 bp, Homo sapiens
attagtgccagaattttagga

SEQ ID NO: 5374946 - DNA, 12 bp, Homo sapiens
attagtgctatg

SEQ ID NO: 5374947 - DNA, 18 bp, Homo sapiens
attagtggtcataaaata

SEQ ID NO: 5374948 - DNA, 20 bp, Homo sapiens
attagtggtcataaaataga

SEQ ID NO: 5374949 - DNA, 20 bp, Homo sapiens
attagtgtgacagtttccaa

SEQ ID NO: 5374950 - DNA, 21 bp, Homo sapiens
attagtgtgacagtttccaaa

SEQ ID NO: 5374951 - DNA, 22 bp, Homo sapiens
attagtgtgacagtttccaaat

SEQ ID NO: 5374952 - DNA, 23 bp, Homo sapiens
attagtgtgacagtttccaaatt

SEQ ID NO: 5374953 - DNA, 16 bp, Homo sapiens
attagtgttatatgaa

SEQ ID NO: 5374954 - DNA, 17 bp, Homo sapiens
attagtgttatatgaac

SEQ ID NO: 5374955 - DNA, 21 bp, Homo sapiens
attagtgttctttatatacct

SEQ ID NO: 5374956 - DNA, 22 bp, Homo sapiens
attagtgttgtgcacttcatgt

SEQ ID NO: 5374957 - DNA, 14 bp, Homo sapiens
attagtgttttcat

SEQ ID NO: 5374958 - DNA, 20 bp, Homo sapiens
attagttacttgctataaat

SEQ ID NO: 5374959 - DNA, 19 bp, Homo sapiens
attagttccagtttctcct

SEQ ID NO: 5374960 - DNA, 20 bp, Homo sapiens
attagttccagtttctcctt

SEQ ID NO: 5374961 - DNA, 18 bp, Homo sapiens
attagttccccaaataca

SEQ ID NO: 5374962 - DNA, 17 bp, Homo sapiens
attagttctttttgcca

SEQ ID NO: 5374963 - DNA, 21 bp, Homo sapiens
attagttgaaaggcctcaaga

SEQ ID NO: 5374964 - DNA, 13 bp, Homo sapiens
attagttgacagt

SEQ ID NO: 5374965 - DNA, 14 bp, Homo sapiens
attagttgacagta

SEQ ID NO: 5374966 - DNA, 17 bp, Homo sapiens
attagttgacagtatta

SEQ ID NO: 5374967 - DNA, 23 bp, Homo sapiens
attagttgcattggtttgagaaa

SEQ ID NO: 5374968 - DNA, 14 bp, Homo sapiens
attagttgccaata

SEQ ID NO: 5374969 - DNA, 16 bp, Homo sapiens
attagttgccaatatg

SEQ ID NO: 5374970 - DNA, 18 bp, Homo sapiens
attagttgccaatatgcc

SEQ ID NO: 5374971 - DNA, 19 bp, Homo sapiens
attagttgccaatatgcca

SEQ ID NO: 5374972 - DNA, 18 bp, Homo sapiens
attagttggagctagaaa

SEQ ID NO: 5374973 - DNA, 19 bp, Homo sapiens
attagttggagctagaaaa

SEQ ID NO: 5374974 - DNA, 23 bp, Homo sapiens
attagttggcagagaaaatgctg

SEQ ID NO: 5374975 - DNA, 20 bp, Homo sapiens
attagttggctttcataaat

SEQ ID NO: 5374976 - DNA, 13 bp, Homo sapiens
attagtttagaac

SEQ ID NO: 5374977 - DNA, 21 bp, Homo sapiens
attagtttcacatgatatacc

SEQ ID NO: 5374978 - DNA, 18 bp, Homo sapiens
attagtttcctttttaat

SEQ ID NO: 5374979 - DNA, 11 bp, Homo sapiens
attagtttgac

SEQ ID NO: 5374980 - DNA, 16 bp, Homo sapiens
attagttttaaaatga

SEQ ID NO: 5374981 - DNA, 16 bp, Homo sapiens
attagttttcttgttg

SEQ ID NO: 5374982 - DNA, 21 bp, Homo sapiens
attagttttgaagattctatg

SEQ ID NO: 5374983 - DNA, 13 bp, Homo sapiens
attagttttgatt

SEQ ID NO: 5374984 - DNA, 14 bp, Homo sapiens
attataaaaaatta

SEQ ID NO: 5374985 - DNA, 19 bp, Homo sapiens
attataaaaacacttatag

SEQ ID NO: 5374986 - DNA, 23 bp, Homo sapiens
attataaaaagccactagactct

SEQ ID NO: 5374987 - DNA, 11 bp, Homo sapiens
attataaaaat

SEQ ID NO: 5374988 - DNA, 19 bp, Homo sapiens
attataaaaatatcaaaaa

SEQ ID NO: 5374989 - DNA, 15 bp, Homo sapiens
attataaaaatgaat

SEQ ID NO: 5374990 - DNA, 13 bp, Homo sapiens
attataaaaatta

SEQ ID NO: 5374991 - DNA, 12 bp, Homo sapiens
attataaaacca

SEQ ID NO: 5374992 - DNA, 13 bp, Homo sapiens
attataaaaccat

SEQ ID NO: 5374993 - DNA, 13 bp, Homo sapiens
attataaaatatt

SEQ ID NO: 5374994 - DNA, 14 bp, Homo sapiens
attataaaatattg

SEQ ID NO: 5374995 - DNA, 16 bp, Homo sapiens
attataaaatgctcct

SEQ ID NO: 5374996 - DNA, 21 bp, Homo sapiens
attataaaatgctcctagaag

SEQ ID NO: 5374997 - DNA, 18 bp, Homo sapiens
attataaaattgaaaaca

SEQ ID NO: 5374998 - DNA, 12 bp, Homo sapiens
attataaacagc

SEQ ID NO: 5374999 - DNA, 16 bp, Homo sapiens
attataaacagcaggg

SEQ ID NO: 5375000 - DNA, 17 bp, Homo sapiens
attataaacagcagggt

SEQ ID NO: 5375001 - DNA, 12 bp, Homo sapiens
attataaactat

SEQ ID NO: 5375002 - DNA, 18 bp, Homo sapiens
attataaactataaactt

SEQ ID NO: 5375003 - DNA, 19 bp, Homo sapiens
attataaactcattttgct

SEQ ID NO: 5375004 - DNA, 12 bp, Homo sapiens
attataaacttt

SEQ ID NO: 5375005 - DNA, 13 bp, Homo sapiens
attataaactttt

SEQ ID NO: 5375006 - DNA, 14 bp, Homo sapiens
attataaactttta

SEQ ID NO: 5375007 - DNA, 19 bp, Homo sapiens
attataaagccttcagagg

SEQ ID NO: 5375008 - DNA, 11 bp, Homo sapiens
attataaagct

SEQ ID NO: 5375009 - DNA, 13 bp, Homo sapiens
attataaataaat

SEQ ID NO: 5375010 - DNA, 16 bp, Homo sapiens
attataaatattttcc

SEQ ID NO: 5375011 - DNA, 18 bp, Homo sapiens
attataaatccaaagtaa

SEQ ID NO: 5375012 - DNA, 11 bp, Homo sapiens
attataaatga

SEQ ID NO: 5375013 - DNA, 15 bp, Homo sapiens
attataaatgaaatt

SEQ ID NO: 5375014 - DNA, 15 bp, Homo sapiens
attataaatgacaac

SEQ ID NO: 5375015 - DNA, 14 bp, Homo sapiens
attataaattgtgt

SEQ ID NO: 5375016 - DNA, 15 bp, Homo sapiens
attataacaactatt

SEQ ID NO: 5375017 - DNA, 12 bp, Homo sapiens
attataacagtt

SEQ ID NO: 5375018 - DNA, 14 bp, Homo sapiens
attataacagttat

SEQ ID NO: 5375019 - DNA, 13 bp, Homo sapiens
attataacataaa

SEQ ID NO: 5375020 - DNA, 16 bp, Homo sapiens
attataacataaaagc

SEQ ID NO: 5375021 - DNA, 21 bp, Homo sapiens
attataactctgtataataga

SEQ ID NO: 5375022 - DNA, 21 bp, Homo sapiens
attataactgaaggagaaggt

SEQ ID NO: 5375023 - DNA, 16 bp, Homo sapiens
attataacttaaaata

SEQ ID NO: 5375024 - DNA, 20 bp, Homo sapiens
attataacttaaaatatttt

SEQ ID NO: 5375025 - DNA, 15 bp, Homo sapiens
attataagaagagga

SEQ ID NO: 5375026 - DNA, 12 bp, Homo sapiens
attataagacaa

SEQ ID NO: 5375027 - DNA, 21 bp, Homo sapiens
attataagccctgcataatgt

SEQ ID NO: 5375028 - DNA, 10 bp, Homo sapiens
attataagga

SEQ ID NO: 5375029 - DNA, 18 bp, Homo sapiens
attataaggactgcatgg

SEQ ID NO: 5375030 - DNA, 15 bp, Homo sapiens
attataagggagagc

SEQ ID NO: 5375031 - DNA, 23 bp, Homo sapiens
attataagggagagctgagccag

SEQ ID NO: 5375032 - DNA, 15 bp, Homo sapiens
attataagggccctg

SEQ ID NO: 5375033 - DNA, 14 bp, Homo sapiens
attataagtaactt

SEQ ID NO: 5375034 - DNA, 19 bp, Homo sapiens
attataagtcttacataaa

SEQ ID NO: 5375035 - DNA, 21 bp, Homo sapiens
attataagtgagagaaatgaa

SEQ ID NO: 5375036 - DNA, 22 bp, Homo sapiens
attataataaaggtcacataaa

SEQ ID NO: 5375037 - DNA, 14 bp, Homo sapiens
attataataaattg

SEQ ID NO: 5375038 - DNA, 23 bp, Homo sapiens
attataataacatagccagatgt

SEQ ID NO: 5375039 - DNA, 20 bp, Homo sapiens
attataataagcaaaaagat

SEQ ID NO: 5375040 - DNA, 20 bp, Homo sapiens
attataataatgttctctgg

SEQ ID NO: 5375041 - DNA, 18 bp, Homo sapiens
attataatactaaaactc

SEQ ID NO: 5375042 - DNA, 22 bp, Homo sapiens
attataatatactatatttatg

SEQ ID NO: 5375043 - DNA, 15 bp, Homo sapiens
attataatatagaaa

SEQ ID NO: 5375044 - DNA, 17 bp, Homo sapiens
attataatatgtgcctt

SEQ ID NO: 5375045 - DNA, 12 bp, Homo sapiens
attataatattt

SEQ ID NO: 5375046 - DNA, 14 bp, Homo sapiens
attataatcttata

SEQ ID NO: 5375047 - DNA, 14 bp, Homo sapiens
attataatgccaga

SEQ ID NO: 5375048 - DNA, 14 bp, Homo sapiens
attataatgtattc

SEQ ID NO: 5375049 - DNA, 22 bp, Homo sapiens
attataatgtattcatatttgt

SEQ ID NO: 5375050 - DNA, 23 bp, Homo sapiens
attataattgtatcagaggccta

SEQ ID NO: 5375051 - DNA, 16 bp, Homo sapiens
attataattgttgata

SEQ ID NO: 5375052 - DNA, 17 bp, Homo sapiens
attataattgttgatat

SEQ ID NO: 5375053 - DNA, 12 bp, Homo sapiens
attataatttta

SEQ ID NO: 5375054 - DNA, 14 bp, Homo sapiens
attataattttgac

SEQ ID NO: 5375055 - DNA, 12 bp, Homo sapiens
attatacaaaag

SEQ ID NO: 5375056 - DNA, 18 bp, Homo sapiens
attatacaaattaaaaag

SEQ ID NO: 5375057 - DNA, 15 bp, Homo sapiens
attatacaccatttt

SEQ ID NO: 5375058 - DNA, 17 bp, Homo sapiens
attatacagacctaata

SEQ ID NO: 5375059 - DNA, 16 bp, Homo sapiens
attatacataataaag

SEQ ID NO: 5375060 - DNA, 22 bp, Homo sapiens
attatacatgtgatacattttt

SEQ ID NO: 5375061 - DNA, 15 bp, Homo sapiens
attataccaaaatgt

SEQ ID NO: 5375062 - DNA, 23 bp, Homo sapiens
attataccaagagtatgagaaat

SEQ ID NO: 5375063 - DNA, 19 bp, Homo sapiens
attataccagatgaacatt

SEQ ID NO: 5375064 - DNA, 19 bp, Homo sapiens
attataccccctgcaaagc

SEQ ID NO: 5375065 - DNA, 18 bp, Homo sapiens
attataccgcagagtatt

SEQ ID NO: 5375066 - DNA, 16 bp, Homo sapiens
attatacgtacataca

SEQ ID NO: 5375067 - DNA, 19 bp, Homo sapiens
attatacgtatgcattttt

SEQ ID NO: 5375068 - DNA, 21 bp, Homo sapiens
attatactctctgaaatatag

SEQ ID NO: 5375069 - DNA, 12 bp, Homo sapiens
attatactgtag

SEQ ID NO: 5375070 - DNA, 13 bp, Homo sapiens
attatactgtgtg

SEQ ID NO: 5375071 - DNA, 15 bp, Homo sapiens
attatactgtgtgtg

SEQ ID NO: 5375072 - DNA, 18 bp, Homo sapiens
attatactgttatccata

SEQ ID NO: 5375073 - DNA, 12 bp, Homo sapiens
attatacttgag

SEQ ID NO: 5375074 - DNA, 23 bp, Homo sapiens
attatacttgagattttcctcca

SEQ ID NO: 5375075 - DNA, 21 bp, Homo sapiens
attatactttatatctgtaat

SEQ ID NO: 5375076 - DNA, 20 bp, Homo sapiens
attatactttgttgttttta

SEQ ID NO: 5375077 - DNA, 11 bp, Homo sapiens
attatagaaaa

SEQ ID NO: 5375078 - DNA, 21 bp, Homo sapiens
attatagaaaattatttgtat

SEQ ID NO: 5375079 - DNA, 15 bp, Homo sapiens
attatagaaattctg

SEQ ID NO: 5375080 - DNA, 18 bp, Homo sapiens
attatagaaattctgaat

SEQ ID NO: 5375081 - DNA, 20 bp, Homo sapiens
attatagaaattctgaattt

SEQ ID NO: 5375082 - DNA, 14 bp, Homo sapiens
attatagaatctac

SEQ ID NO: 5375083 - DNA, 14 bp, Homo sapiens
attatagaattgca

SEQ ID NO: 5375084 - DNA, 23 bp, Homo sapiens
attatagacaacgatgaatttct

SEQ ID NO: 5375085 - DNA, 14 bp, Homo sapiens
attatagagcagaa

SEQ ID NO: 5375086 - DNA, 20 bp, Homo sapiens
attatagagtatactaaaaa

SEQ ID NO: 5375087 - DNA, 15 bp, Homo sapiens
attatagatatataa

SEQ ID NO: 5375088 - DNA, 15 bp, Homo sapiens
attatagattctaaa

SEQ ID NO: 5375089 - DNA, 21 bp, Homo sapiens
attatagcaatgtgattttgt

SEQ ID NO: 5375090 - DNA, 12 bp, Homo sapiens
attatagcatgt

SEQ ID NO: 5375091 - DNA, 15 bp, Homo sapiens
attatagcatgtaat

SEQ ID NO: 5375092 - DNA, 17 bp, Homo sapiens
attatagcgcctgtata

SEQ ID NO: 5375093 - DNA, 19 bp, Homo sapiens
attatagctctaatgtttg

SEQ ID NO: 5375094 - DNA, 16 bp, Homo sapiens
attataggaagttctt

SEQ ID NO: 5375095 - DNA, 19 bp, Homo sapiens
attataggagccttaattt

SEQ ID NO: 5375096 - DNA, 18 bp, Homo sapiens
attatagtaaatctatga

SEQ ID NO: 5375097 - DNA, 16 bp, Homo sapiens
attatagtaccactgc

SEQ ID NO: 5375098 - DNA, 15 bp, Homo sapiens
attatagtctgtact

SEQ ID NO: 5375099 - DNA, 14 bp, Homo sapiens
attatagtgaaaca

SEQ ID NO: 5375100 - DNA, 14 bp, Homo sapiens
attatagtgtagaa

SEQ ID NO: 5375101 - DNA, 15 bp, Homo sapiens
attatagtttcaagc

SEQ ID NO: 5375102 - DNA, 14 bp, Homo sapiens
attatagtttgaca

SEQ ID NO: 5375103 - DNA, 18 bp, Homo sapiens
attatataaaatacataa

SEQ ID NO: 5375104 - DNA, 18 bp, Homo sapiens
attatataaatatatatt

SEQ ID NO: 5375105 - DNA, 15 bp, Homo sapiens
attatgatctaataa

SEQ ID NO: 5375106 - DNA, 18 bp, Homo sapiens
attatgatgcatacagtt

SEQ ID NO: 5375107 - DNA, 21 bp, Homo sapiens
attatgatgcatacagttttc

SEQ ID NO: 5375108 - DNA, 16 bp, Homo sapiens
attatgatggaagaca

SEQ ID NO: 5375109 - DNA, 18 bp, Homo sapiens
attatgatgttttgcaaa

SEQ ID NO: 5375110 - DNA, 14 bp, Homo sapiens
attatgatttcatt

SEQ ID NO: 5375111 - DNA, 21 bp, Homo sapiens
attatgatttgggttggggaa

SEQ ID NO: 5375112 - DNA, 12 bp, Homo sapiens
attatgatttta

SEQ ID NO: 5375113 - DNA, 23 bp, Homo sapiens
attatgattttatttaaactatt

SEQ ID NO: 5375114 - DNA, 14 bp, Homo sapiens
attatgcaaaagca

SEQ ID NO: 5375115 - DNA, 18 bp, Homo sapiens
attatgcaaaagcagcta

SEQ ID NO: 5375116 - DNA, 20 bp, Homo sapiens
attatgcaaaatttagaaga

SEQ ID NO: 5375117 - DNA, 24 bp, Homo sapiens
attatgcaacgtttaacattgatt

SEQ ID NO: 5375118 - DNA, 18 bp, Homo sapiens
attatgcaatttttatat

SEQ ID NO: 5375119 - DNA, 18 bp, Homo sapiens
attatgcactaaatatga

SEQ ID NO: 5375120 - DNA, 20 bp, Homo sapiens
attatgcactggccacccaa

SEQ ID NO: 5375121 - DNA, 21 bp, Homo sapiens
attatgcacttttagaaatgc

SEQ ID NO: 5375122 - DNA, 15 bp, Homo sapiens
attatgcagtgtttc

SEQ ID NO: 5375123 - DNA, 14 bp, Homo sapiens
attatgccactgct

SEQ ID NO: 5375124 - DNA, 17 bp, Homo sapiens
attatgcctgaatgact

SEQ ID NO: 5375125 - DNA, 16 bp, Homo sapiens
attatgccttgagaat

SEQ ID NO: 5375126 - DNA, 19 bp, Homo sapiens
attatgccttttttgatca

SEQ ID NO: 5375127 - DNA, 18 bp, Homo sapiens
attatgcggaaaggtatt

SEQ ID NO: 5375128 - DNA, 16 bp, Homo sapiens
attatgctaagaattt

SEQ ID NO: 5375129 - DNA, 12 bp, Homo sapiens
attatgctgctt

SEQ ID NO: 5375130 - DNA, 17 bp, Homo sapiens
attatgctgctttaaca

SEQ ID NO: 5375131 - DNA, 18 bp, Homo sapiens
attatgctgtattttctt

SEQ ID NO: 5375132 - DNA, 15 bp, Homo sapiens
attatgcttcttgga

SEQ ID NO: 5375133 - DNA, 16 bp, Homo sapiens
attatgctttctttgg

SEQ ID NO: 5375134 - DNA, 13 bp, Homo sapiens
attatgctttgaa

SEQ ID NO: 5375135 - DNA, 19 bp, Homo sapiens
attatggaaaaataaaact

SEQ ID NO: 5375136 - DNA, 22 bp, Homo sapiens
attatggaaaaataaaactgtc

SEQ ID NO: 5375137 - DNA, 14 bp, Homo sapiens
attatggaaaactg

SEQ ID NO: 5375138 - DNA, 14 bp, Homo sapiens
attatggaaatcca

SEQ ID NO: 5375139 - DNA, 16 bp, Homo sapiens
attatggaatatcatc

SEQ ID NO: 5375140 - DNA, 16 bp, Homo sapiens
attatggcaagtgata

SEQ ID NO: 5375141 - DNA, 22 bp, Homo sapiens
attatggcatatattaaaagca

SEQ ID NO: 5375142 - DNA, 16 bp, Homo sapiens
attatggcctttttaa

SEQ ID NO: 5375143 - DNA, 19 bp, Homo sapiens
attatggcctttttaagta

SEQ ID NO: 5375144 - DNA, 15 bp, Homo sapiens
attatggcttgtgaa

SEQ ID NO: 5375145 - DNA, 17 bp, Homo sapiens
attatgggtcacaggaa

SEQ ID NO: 5375146 - DNA, 19 bp, Homo sapiens
attatggtaaaattttgta

SEQ ID NO: 5375147 - DNA, 11 bp, Homo sapiens
attatggtgaa

SEQ ID NO: 5375148 - DNA, 19 bp, Homo sapiens
attatggtgggtgattatt

SEQ ID NO: 5375149 - DNA, 21 bp, Homo sapiens
attatggtgtaatgcacaatt

SEQ ID NO: 5375150 - DNA, 23 bp, Homo sapiens
attatggtgtaatgcacaattta

SEQ ID NO: 5375151 - DNA, 20 bp, Homo sapiens
attatgtaaatacaatttgt

SEQ ID NO: 5375152 - DNA, 15 bp, Homo sapiens
attatgtaaatatga

SEQ ID NO: 5375153 - DNA, 17 bp, Homo sapiens
attatgtaaatcccatt

SEQ ID NO: 5375154 - DNA, 23 bp, Homo sapiens
attatgtaaatcccattattcaa

SEQ ID NO: 5375155 - DNA, 17 bp, Homo sapiens
attatgtaacatccaga

SEQ ID NO: 5375156 - DNA, 19 bp, Homo sapiens
attatgtaacatccagaag

SEQ ID NO: 5375157 - DNA, 15 bp, Homo sapiens
attatgtaacctatt

SEQ ID NO: 5375158 - DNA, 19 bp, Homo sapiens
attatgtaccatgaatatt

SEQ ID NO: 5375159 - DNA, 15 bp, Homo sapiens
attatgtagctcttt

SEQ ID NO: 5375160 - DNA, 19 bp, Homo sapiens
attatgtagctctttgtca

SEQ ID NO: 5375161 - DNA, 13 bp, Homo sapiens
attatgtataaaa

SEQ ID NO: 5375162 - DNA, 14 bp, Homo sapiens
attatgtatagaaa

SEQ ID NO: 5375163 - DNA, 13 bp, Homo sapiens
attatgtatctta

SEQ ID NO: 5375164 - DNA, 21 bp, Homo sapiens
attatgtcaaatggatgtaat

SEQ ID NO: 5375165 - DNA, 15 bp, Homo sapiens
attatgtcaaccagg

SEQ ID NO: 5375166 - DNA, 21 bp, Homo sapiens
attatgtcaattcattaataa

SEQ ID NO: 5375167 - DNA, 17 bp, Homo sapiens
attatgtccactgtgta

SEQ ID NO: 5375168 - DNA, 17 bp, Homo sapiens
attatgtctcaaaataa

SEQ ID NO: 5375169 - DNA, 12 bp, Homo sapiens
attatgtctctt

SEQ ID NO: 5375170 - DNA, 16 bp, Homo sapiens
attatgtcttatttta

SEQ ID NO: 5375171 - DNA, 14 bp, Homo sapiens
attatgtcttcttt

SEQ ID NO: 5375172 - DNA, 19 bp, Homo sapiens
attatgtcttttatatttg

SEQ ID NO: 5375173 - DNA, 17 bp, Homo sapiens
attatgtgaagaattta

SEQ ID NO: 5375174 - DNA, 23 bp, Homo sapiens
attatgtgaagaatttagatctt

SEQ ID NO: 5375175 - DNA, 15 bp, Homo sapiens
attatgtgacaacct

SEQ ID NO: 5375176 - DNA, 23 bp, Homo sapiens
attatgtgacaacctttgtgtaa

SEQ ID NO: 5375177 - DNA, 24 bp, Homo sapiens
attatgtgacaacctttgtgtaat

SEQ ID NO: 5375178 - DNA, 12 bp, Homo sapiens
attatgtgactt

SEQ ID NO: 5375179 - DNA, 15 bp, Homo sapiens
attatgtgcaacatt

SEQ ID NO: 5375180 - DNA, 16 bp, Homo sapiens
attatgtggaataata

SEQ ID NO: 5375181 - DNA, 19 bp, Homo sapiens
attatgtgtgcatgtgtgt

SEQ ID NO: 5375182 - DNA, 15 bp, Homo sapiens
attatgtgtgttttg

SEQ ID NO: 5375183 - DNA, 21 bp, Homo sapiens
attatgtgttgccaaaaccaa

SEQ ID NO: 5375184 - DNA, 22 bp, Homo sapiens
attatgttaaactagcatatct

SEQ ID NO: 5375185 - DNA, 13 bp, Homo sapiens
attatgttaatat

SEQ ID NO: 5375186 - DNA, 17 bp, Homo sapiens
attatgttaatatttct

SEQ ID NO: 5375187 - DNA, 15 bp, Homo sapiens
attatgttattggaa

SEQ ID NO: 5375188 - DNA, 17 bp, Homo sapiens
attatgttattggaatt

SEQ ID NO: 5375189 - DNA, 20 bp, Homo sapiens
attatgttattggaattttc

SEQ ID NO: 5375190 - DNA, 19 bp, Homo sapiens
attatgttcatgtaagaag

SEQ ID NO: 5375191 - DNA, 16 bp, Homo sapiens
attatgttcctgctgt

SEQ ID NO: 5375192 - DNA, 19 bp, Homo sapiens
attatgttggtactttcca

SEQ ID NO: 5375193 - DNA, 18 bp, Homo sapiens
attatgtttacctcactg

SEQ ID NO: 5375194 - DNA, 15 bp, Homo sapiens
attatgtttattaca

SEQ ID NO: 5375195 - DNA, 19 bp, Homo sapiens
attatgtttattacaattt

SEQ ID NO: 5375196 - DNA, 19 bp, Homo sapiens
attatgtttatttcatgtg

SEQ ID NO: 5375197 - DNA, 22 bp, Homo sapiens
attatgtttcctaactgtgatt

SEQ ID NO: 5375198 - DNA, 15 bp, Homo sapiens
attatgtttgaaaat

SEQ ID NO: 5375199 - DNA, 17 bp, Homo sapiens
attatgtttgaaaatag

SEQ ID NO: 5375200 - DNA, 16 bp, Homo sapiens
attatgttttttaaaa

SEQ ID NO: 5375201 - DNA, 14 bp, Homo sapiens
attattaaagtttt

SEQ ID NO: 5375202 - DNA, 21 bp, Homo sapiens
attattaaatcggcaacaggg

SEQ ID NO: 5375203 - DNA, 18 bp, Homo sapiens
attattaaattgtgtaca

SEQ ID NO: 5375204 - DNA, 11 bp, Homo sapiens
attattaacaa

SEQ ID NO: 5375205 - DNA, 14 bp, Homo sapiens
attattaagctgtt

SEQ ID NO: 5375206 - DNA, 22 bp, Homo sapiens
attattaaggtaactactgcta

SEQ ID NO: 5375207 - DNA, 23 bp, Homo sapiens
attattaataaattttaacattt

SEQ ID NO: 5375208 - DNA, 16 bp, Homo sapiens
attattaataatgaag

SEQ ID NO: 5375209 - DNA, 15 bp, Homo sapiens
attattaatgctttg

SEQ ID NO: 5375210 - DNA, 13 bp, Homo sapiens
attattaattgtc

SEQ ID NO: 5375211 - DNA, 17 bp, Homo sapiens
attattaatttattggg

SEQ ID NO: 5375212 - DNA, 13 bp, Homo sapiens
attattacaaata

SEQ ID NO: 5375213 - DNA, 15 bp, Homo sapiens
attattacaaatatt

SEQ ID NO: 5375214 - DNA, 16 bp, Homo sapiens
attattacaacaagca

SEQ ID NO: 5375215 - DNA, 21 bp, Homo sapiens
attattacaacaagcaaactg

SEQ ID NO: 5375216 - DNA, 22 bp, Homo sapiens
attattaccagcatttgtcctt

SEQ ID NO: 5375217 - DNA, 20 bp, Homo sapiens
attattaccttacagaagtt

SEQ ID NO: 5375218 - DNA, 14 bp, Homo sapiens
attattactacaaa

SEQ ID NO: 5375219 - DNA, 20 bp, Homo sapiens
attattactctacactgaaa

SEQ ID NO: 5375220 - DNA, 15 bp, Homo sapiens
attattactgttgat

SEQ ID NO: 5375221 - DNA, 21 bp, Homo sapiens
attattactgttgataattct

SEQ ID NO: 5375222 - DNA, 23 bp, Homo sapiens
attattactgttgataattctta

SEQ ID NO: 5375223 - DNA, 21 bp, Homo sapiens
attattacttatttttgacag

SEQ ID NO: 5375224 - DNA, 14 bp, Homo sapiens
attattacttgtaa

SEQ ID NO: 5375225 - DNA, 17 bp, Homo sapiens
attattacttgtaaata

SEQ ID NO: 5375226 - DNA, 19 bp, Homo sapiens
attattacttgtaaatata

SEQ ID NO: 5375227 - DNA, 12 bp, Homo sapiens
attattagaaat

SEQ ID NO: 5375228 - DNA, 12 bp, Homo sapiens
attattagaaca

SEQ ID NO: 5375229 - DNA, 20 bp, Homo sapiens
attattagaacattcacttt

SEQ ID NO: 5375230 - DNA, 13 bp, Homo sapiens
attattagaatat

SEQ ID NO: 5375231 - DNA, 22 bp, Homo sapiens
attattagaatataaaaaatgt

SEQ ID NO: 5375232 - DNA, 23 bp, Homo sapiens
attattagaatcaaacattttga

SEQ ID NO: 5375233 - DNA, 17 bp, Homo sapiens
attattagataatattt

SEQ ID NO: 5375234 - DNA, 16 bp, Homo sapiens
attattagattgccaa

SEQ ID NO: 5375235 - DNA, 22 bp, Homo sapiens
attattagccaggtaatgtgaa

SEQ ID NO: 5375236 - DNA, 18 bp, Homo sapiens
attattaggagtaattct

SEQ ID NO: 5375237 - DNA, 21 bp, Homo sapiens
attattagtaagaaaacatca

SEQ ID NO: 5375238 - DNA, 15 bp, Homo sapiens
attattagtactgct

SEQ ID NO: 5375239 - DNA, 22 bp, Homo sapiens
attattagttgaccaactatat

SEQ ID NO: 5375240 - DNA, 14 bp, Homo sapiens
attattataaaaat

SEQ ID NO: 5375241 - DNA, 16 bp, Homo sapiens
attattataaaaatat

SEQ ID NO: 5375242 - DNA, 15 bp, Homo sapiens
attattataaactat

SEQ ID NO: 5375243 - DNA, 15 bp, Homo sapiens
attattataggtaat

SEQ ID NO: 5375244 - DNA, 14 bp, Homo sapiens
attattatatattt

SEQ ID NO: 5375245 - DNA, 12 bp, Homo sapiens
attattatcatt

SEQ ID NO: 5375246 - DNA, 13 bp, Homo sapiens
attattatgcaaa

SEQ ID NO: 5375247 - DNA, 13 bp, Homo sapiens
attattatgttct

SEQ ID NO: 5375248 - DNA, 14 bp, Homo sapiens
attattatgttctt

SEQ ID NO: 5375249 - DNA, 12 bp, Homo sapiens
attattatgttt

SEQ ID NO: 5375250 - DNA, 15 bp, Homo sapiens
attattattaattac

SEQ ID NO: 5375251 - DNA, 13 bp, Homo sapiens
attattattatat

SEQ ID NO: 5375252 - DNA, 17 bp, Homo sapiens
attattattattgctga

SEQ ID NO: 5375253 - DNA, 16 bp, Homo sapiens
attattattgctgaag

SEQ ID NO: 5375254 - DNA, 10 bp, Homo sapiens
attattattt

SEQ ID NO: 5375255 - DNA, 15 bp, Homo sapiens
attattatttaactc

SEQ ID NO: 5375256 - DNA, 18 bp, Homo sapiens
attattatttaactctta

SEQ ID NO: 5375257 - DNA, 13 bp, Homo sapiens
attattatttctg

SEQ ID NO: 5375258 - DNA, 14 bp, Homo sapiens
attattatttctgt

SEQ ID NO: 5375259 - DNA, 14 bp, Homo sapiens
attattatttgctt

SEQ ID NO: 5375260 - DNA, 15 bp, Homo sapiens
attattatttggccc

SEQ ID NO: 5375261 - DNA, 15 bp, Homo sapiens
attattatttgtact

SEQ ID NO: 5375262 - DNA, 15 bp, Homo sapiens
attattcaaagttgc

SEQ ID NO: 5375263 - DNA, 16 bp, Homo sapiens
attattcaacagagag

SEQ ID NO: 5375264 - DNA, 16 bp, Homo sapiens
attattcaagaatgaa

SEQ ID NO: 5375265 - DNA, 19 bp, Homo sapiens
attattcaagaatgaaaaa

SEQ ID NO: 5375266 - DNA, 20 bp, Homo sapiens
attattcaagaatgaaaaat

SEQ ID NO: 5375267 - DNA, 23 bp, Homo sapiens
attattcaagaatgaaaaatata

SEQ ID NO: 5375268 - DNA, 21 bp, Homo sapiens
attattcaagtgcctcttgtt

SEQ ID NO: 5375269 - DNA, 13 bp, Homo sapiens
attattcagaact

SEQ ID NO: 5375270 - DNA, 21 bp, Homo sapiens
attattcagttaagaaaaaaa

SEQ ID NO: 5375271 - DNA, 15 bp, Homo sapiens
attattcataatgtg

SEQ ID NO: 5375272 - DNA, 15 bp, Homo sapiens
attattcatagctgt

SEQ ID NO: 5375273 - DNA, 19 bp, Homo sapiens
attattcatagctgtatat

SEQ ID NO: 5375274 - DNA, 14 bp, Homo sapiens
attattcatttaaa

SEQ ID NO: 5375275 - DNA, 20 bp, Homo sapiens
attattcatttaaaatgatt

SEQ ID NO: 5375276 - DNA, 21 bp, Homo sapiens
attattcatttaaaatgatta

SEQ ID NO: 5375277 - DNA, 13 bp, Homo sapiens
attattcatttag

SEQ ID NO: 5375278 - DNA, 15 bp, Homo sapiens
attattcatttagtg

SEQ ID NO: 5375279 - DNA, 16 bp, Homo sapiens
attattccaaagttat

SEQ ID NO: 5375280 - DNA, 20 bp, Homo sapiens
attattccaaagttatttca

SEQ ID NO: 5375281 - DNA, 15 bp, Homo sapiens
attattccagatctg

SEQ ID NO: 5375282 - DNA, 12 bp, Homo sapiens
attattcccatg

SEQ ID NO: 5375283 - DNA, 12 bp, Homo sapiens
attattccctct

SEQ ID NO: 5375284 - DNA, 19 bp, Homo sapiens
attcacaagacccaaaagg

SEQ ID NO: 5375285 - DNA, 17 bp, Homo sapiens
attcacaagcctcctgt

SEQ ID NO: 5375286 - DNA, 18 bp, Homo sapiens
attcacaagcctcctgta

SEQ ID NO: 5375287 - DNA, 13 bp, Homo sapiens
attcacaagctgc

SEQ ID NO: 5375288 - DNA, 15 bp, Homo sapiens
attcacaagctgcct

SEQ ID NO: 5375289 - DNA, 20 bp, Homo sapiens
attcacaagtcctgccaagt

SEQ ID NO: 5375290 - DNA, 13 bp, Homo sapiens
attcacaatagaa

SEQ ID NO: 5375291 - DNA, 20 bp, Homo sapiens
attcacaatggaaactttag

SEQ ID NO: 5375292 - DNA, 13 bp, Homo sapiens
attcacacacaca

SEQ ID NO: 5375293 - DNA, 18 bp, Homo sapiens
attcacacacagcctggc

SEQ ID NO: 5375294 - DNA, 14 bp, Homo sapiens
attcacacacccct

SEQ ID NO: 5375295 - DNA, 20 bp, Homo sapiens
attcacacacccctcaaaaa

SEQ ID NO: 5375296 - DNA, 18 bp, Homo sapiens
attcacacagggctcttt

SEQ ID NO: 5375297 - DNA, 16 bp, Homo sapiens
attcacaccccacctg

SEQ ID NO: 5375298 - DNA, 18 bp, Homo sapiens
attcacaccccacctgcg

SEQ ID NO: 5375299 - DNA, 19 bp, Homo sapiens
attcacacctcacgctctg

SEQ ID NO: 5375300 - DNA, 13 bp, Homo sapiens
attcacactgtgc

SEQ ID NO: 5375301 - DNA, 18 bp, Homo sapiens
attcacactgtgcgtttt

SEQ ID NO: 5375302 - DNA, 19 bp, Homo sapiens
attcacactttttatttaa

SEQ ID NO: 5375303 - DNA, 21 bp, Homo sapiens
attcacactttttatttaatt

SEQ ID NO: 5375304 - DNA, 21 bp, Homo sapiens
attcacagaaagctagatatg

SEQ ID NO: 5375305 - DNA, 15 bp, Homo sapiens
attcacagagccttt

SEQ ID NO: 5375306 - DNA, 21 bp, Homo sapiens
attcacagcacgggcacagct

SEQ ID NO: 5375307 - DNA, 19 bp, Homo sapiens
attcacagtgctcttttct

SEQ ID NO: 5375308 - DNA, 20 bp, Homo sapiens
attcacagtgctcttttctc

SEQ ID NO: 5375309 - DNA, 21 bp, Homo sapiens
attcacagtgctcttttctcc

SEQ ID NO: 5375310 - DNA, 20 bp, Homo sapiens
attcacagttttttaaaaat

SEQ ID NO: 5375311 - DNA, 13 bp, Homo sapiens
attcacataataa

SEQ ID NO: 5375312 - DNA, 16 bp, Homo sapiens
attcacatatgtctta

SEQ ID NO: 5375313 - DNA, 21 bp, Homo sapiens
attcacatccaatgcatagtt

SEQ ID NO: 5375314 - DNA, 16 bp, Homo sapiens
attcacatcctcagaa

SEQ ID NO: 5375315 - DNA, 16 bp, Homo sapiens
attcacatctcatttt

SEQ ID NO: 5375316 - DNA, 20 bp, Homo sapiens
attcacatgctggctcctga

SEQ ID NO: 5375317 - DNA, 16 bp, Homo sapiens
attcacatgttttcaa

SEQ ID NO: 5375318 - DNA, 17 bp, Homo sapiens
attcacatgttttcaaa

SEQ ID NO: 5375319 - DNA, 17 bp, Homo sapiens
attcacattgaccgcaa

SEQ ID NO: 5375320 - DNA, 18 bp, Homo sapiens
attcacattgttaagaaa

SEQ ID NO: 5375321 - DNA, 15 bp, Homo sapiens
attcacatttagaaa

SEQ ID NO: 5375322 - DNA, 18 bp, Homo sapiens
attcacatttgatgtaca

SEQ ID NO: 5375323 - DNA, 23 bp, Homo sapiens
attcacatttgatgtacatgtgt

SEQ ID NO: 5375324 - DNA, 21 bp, Homo sapiens
attcaccaaaatagtcttctc

SEQ ID NO: 5375325 - DNA, 16 bp, Homo sapiens
attcaccaaaattatc

SEQ ID NO: 5375326 - DNA, 22 bp, Homo sapiens
attcaccaacacagttgggacc

SEQ ID NO: 5375327 - DNA, 23 bp, Homo sapiens
attcaccaatttcctttaaaaca

SEQ ID NO: 5375328 - DNA, 14 bp, Homo sapiens
attcaccaccctgg

SEQ ID NO: 5375329 - DNA, 14 bp, Homo sapiens
attcaccatccttt

SEQ ID NO: 5375330 - DNA, 15 bp, Homo sapiens
attcaccatgtaaaa

SEQ ID NO: 5375331 - DNA, 16 bp, Homo sapiens
attcacccactccctt

SEQ ID NO: 5375332 - DNA, 19 bp, Homo sapiens
attcacccagaaaaaagac

SEQ ID NO: 5375333 - DNA, 17 bp, Homo sapiens
attcaccccacacccag

SEQ ID NO: 5375334 - DNA, 11 bp, Homo sapiens
attcaccccca

SEQ ID NO: 5375335 - DNA, 12 bp, Homo sapiens
attcacccccat

SEQ ID NO: 5375336 - DNA, 19 bp, Homo sapiens
attcacccccctctgctgc

SEQ ID NO: 5375337 - DNA, 22 bp, Homo sapiens
attcaccccctttcctggacac

SEQ ID NO: 5375338 - DNA, 12 bp, Homo sapiens
attcacccctcc

SEQ ID NO: 5375339 - DNA, 16 bp, Homo sapiens
attcacctaagagatt

SEQ ID NO: 5375340 - DNA, 16 bp, Homo sapiens
attcacctcagcctgg

SEQ ID NO: 5375341 - DNA, 18 bp, Homo sapiens
attcacctcagtagaaaa

SEQ ID NO: 5375342 - DNA, 16 bp, Homo sapiens
attcacctcttcctct

SEQ ID NO: 5375343 - DNA, 22 bp, Homo sapiens
attcacctgggtttgcaagaat

SEQ ID NO: 5375344 - DNA, 14 bp, Homo sapiens
attcacctgtaaaa

SEQ ID NO: 5375345 - DNA, 13 bp, Homo sapiens
attcacctgtgga

SEQ ID NO: 5375346 - DNA, 19 bp, Homo sapiens
attcacctttcttttgtaa

SEQ ID NO: 5375347 - DNA, 14 bp, Homo sapiens
attcaccttttctt

SEQ ID NO: 5375348 - DNA, 23 bp, Homo sapiens
attcacctttttaataaaaatac

SEQ ID NO: 5375349 - DNA, 20 bp, Homo sapiens
attcacgcatacttggatat

SEQ ID NO: 5375350 - DNA, 15 bp, Homo sapiens
attcacgccgtaatt

SEQ ID NO: 5375351 - DNA, 16 bp, Homo sapiens
attcacgccgtaattc

SEQ ID NO: 5375352 - DNA, 19 bp, Homo sapiens
attcacgccgtaattcttt

SEQ ID NO: 5375353 - DNA, 23 bp, Homo sapiens
attcacgccgtaattctttctgt

SEQ ID NO: 5375354 - DNA, 16 bp, Homo sapiens
attcacggcctggcat

SEQ ID NO: 5375355 - DNA, 21 bp, Homo sapiens
attcacggcctggcatgcagc

SEQ ID NO: 5375356 - DNA, 18 bp, Homo sapiens
attcacgttctagtgaaa

SEQ ID NO: 5375357 - DNA, 20 bp, Homo sapiens
attcactaagccatgccatg

SEQ ID NO: 5375358 - DNA, 16 bp, Homo sapiens
attcactattagagaa

SEQ ID NO: 5375359 - DNA, 14 bp, Homo sapiens
attcactattggct

SEQ ID NO: 5375360 - DNA, 14 bp, Homo sapiens
attcactcactgga

SEQ ID NO: 5375361 - DNA, 21 bp, Homo sapiens
attcactccacttggacatgg

SEQ ID NO: 5375362 - DNA, 22 bp, Homo sapiens
attcactccacttggacatggg

SEQ ID NO: 5375363 - DNA, 19 bp, Homo sapiens
attcactccagtcaacaga

SEQ ID NO: 5375364 - DNA, 21 bp, Homo sapiens
attcactccagtcaacagatt

SEQ ID NO: 5375365 - DNA, 13 bp, Homo sapiens
attcactcccaca

SEQ ID NO: 5375366 - DNA, 23 bp, Homo sapiens
attcactcccaggtgagaattca

SEQ ID NO: 5375367 - DNA, 15 bp, Homo sapiens
attcactctccatta

SEQ ID NO: 5375368 - DNA, 15 bp, Homo sapiens
attcactgcccccag

SEQ ID NO: 5375369 - DNA, 15 bp, Homo sapiens
attcactgccttcct

SEQ ID NO: 5375370 - DNA, 18 bp, Homo sapiens
attcactgccttcctctc

SEQ ID NO: 5375371 - DNA, 14 bp, Homo sapiens
attcactggcctgg

SEQ ID NO: 5375372 - DNA, 18 bp, Homo sapiens
attcactggttttacaca

SEQ ID NO: 5375373 - DNA, 15 bp, Homo sapiens
attcactgtaagttt

SEQ ID NO: 5375374 - DNA, 13 bp, Homo sapiens
attcactgtgcac

SEQ ID NO: 5375375 - DNA, 19 bp, Homo sapiens
attcacttaagtttttcca

SEQ ID NO: 5375376 - DNA, 12 bp, Homo sapiens
attcacttcacg

SEQ ID NO: 5375377 - DNA, 16 bp, Homo sapiens
attcacttcactgtgc

SEQ ID NO: 5375378 - DNA, 17 bp, Homo sapiens
attcacttcactgtgct

SEQ ID NO: 5375379 - DNA, 18 bp, Homo sapiens
attcacttcactgtgctg

SEQ ID NO: 5375380 - DNA, 20 bp, Homo sapiens
attcacttcactgtgctgtt

SEQ ID NO: 5375381 - DNA, 16 bp, Homo sapiens
attcacttccagagag

SEQ ID NO: 5375382 - DNA, 16 bp, Homo sapiens
attcacttctatttat

SEQ ID NO: 5375383 - DNA, 13 bp, Homo sapiens
attcacttctgaa

SEQ ID NO: 5375384 - DNA, 16 bp, Homo sapiens
attcacttctgaattg

SEQ ID NO: 5375385 - DNA, 18 bp, Homo sapiens
attcactttagagtgact

SEQ ID NO: 5375386 - DNA, 15 bp, Homo sapiens
attcactttcatttt

SEQ ID NO: 5375387 - DNA, 20 bp, Homo sapiens
attcactttgtttatgcata

SEQ ID NO: 5375388 - DNA, 20 bp, Homo sapiens
attcagaaaatgttctgttt

SEQ ID NO: 5375389 - DNA, 12 bp, Homo sapiens
attcagaaatat

SEQ ID NO: 5375390 - DNA, 20 bp, Homo sapiens
attcagaaatccttgtattt

SEQ ID NO: 5375391 - DNA, 14 bp, Homo sapiens
attcagaaatgtgg

SEQ ID NO: 5375392 - DNA, 14 bp, Homo sapiens
attcagaaattaaa

SEQ ID NO: 5375393 - DNA, 17 bp, Homo sapiens
attcagaaattaaaata

SEQ ID NO: 5375394 - DNA, 19 bp, Homo sapiens
attcagaacataaatgcac

SEQ ID NO: 5375395 - DNA, 23 bp, Homo sapiens
attcagaaccccaactactgtgt

SEQ ID NO: 5375396 - DNA, 19 bp, Homo sapiens
attcagaactctcagactc

SEQ ID NO: 5375397 - DNA, 17 bp, Homo sapiens
attcagaattatacaga

SEQ ID NO: 5375398 - DNA, 22 bp, Homo sapiens
attcagaattatacagacctaa

SEQ ID NO: 5375399 - DNA, 14 bp, Homo sapiens
attcagacaaaatg

SEQ ID NO: 5375400 - DNA, 18 bp, Homo sapiens
attcagacaacattatga

SEQ ID NO: 5375401 - DNA, 17 bp, Homo sapiens
attcagacagagacttt

SEQ ID NO: 5375402 - DNA, 13 bp, Homo sapiens
attcagacagctg

SEQ ID NO: 5375403 - DNA, 19 bp, Homo sapiens
attcagacagctgcctggg

SEQ ID NO: 5375404 - DNA, 15 bp, Homo sapiens
attcagactgcttca

SEQ ID NO: 5375405 - DNA, 12 bp, Homo sapiens
attcagagaaat

SEQ ID NO: 5375406 - DNA, 16 bp, Homo sapiens
attcagagactgccct

SEQ ID NO: 5375407 - DNA, 14 bp, Homo sapiens
attcagagagcagc

SEQ ID NO: 5375408 - DNA, 22 bp, Homo sapiens
attcagagtggtttcattgcct

SEQ ID NO: 5375409 - DNA, 16 bp, Homo sapiens
attcagataatggtaa

SEQ ID NO: 5375410 - DNA, 20 bp, Homo sapiens
attcagataatggtaattta

SEQ ID NO: 5375411 - DNA, 20 bp, Homo sapiens
attcagatccagtgtaaact

SEQ ID NO: 5375412 - DNA, 14 bp, Homo sapiens
attcagatctgaag

SEQ ID NO: 5375413 - DNA, 15 bp, Homo sapiens
attcagattgtcttg

SEQ ID NO: 5375414 - DNA, 17 bp, Homo sapiens
attcagattgttatcta

SEQ ID NO: 5375415 - DNA, 24 bp, Homo sapiens
attcagatttaccataatgttcct

SEQ ID NO: 5375416 - DNA, 15 bp, Homo sapiens
attcagatttctaca

SEQ ID NO: 5375417 - DNA, 19 bp, Homo sapiens
attcagattttaaaaagtc

SEQ ID NO: 5375418 - DNA, 15 bp, Homo sapiens
attcagcaaaccatt

SEQ ID NO: 5375419 - DNA, 14 bp, Homo sapiens
attcagcaaatatt

SEQ ID NO: 5375420 - DNA, 15 bp, Homo sapiens
attcagcaaatgcct

SEQ ID NO: 5375421 - DNA, 18 bp, Homo sapiens
attcagcaaatgcctttt

SEQ ID NO: 5375422 - DNA, 21 bp, Homo sapiens
attcagcaaatgccttttcaa

SEQ ID NO: 5375423 - DNA, 21 bp, Homo sapiens
attcagcaaggcgctaacttg

SEQ ID NO: 5375424 - DNA, 16 bp, Homo sapiens
attcagcaattaaaga

SEQ ID NO: 5375425 - DNA, 12 bp, Homo sapiens
attcagcacaca

SEQ ID NO: 5375426 - DNA, 18 bp, Homo sapiens
attcagcacactgtgaaa

SEQ ID NO: 5375427 - DNA, 16 bp, Homo sapiens
attcagcaccctgggt

SEQ ID NO: 5375428 - DNA, 17 bp, Homo sapiens
attcagcaccctgggtg

SEQ ID NO: 5375429 - DNA, 19 bp, Homo sapiens
attcagcactgatttcaca

SEQ ID NO: 5375430 - DNA, 17 bp, Homo sapiens
attcagcagtgtctgtt

SEQ ID NO: 5375431 - DNA, 16 bp, Homo sapiens
attcagcatcactaaa

SEQ ID NO: 5375432 - DNA, 22 bp, Homo sapiens
attcagcatcactaaaccgata

SEQ ID NO: 5375433 - DNA, 21 bp, Homo sapiens
attcagcatcgtgtgggtccc

SEQ ID NO: 5375434 - DNA, 23 bp, Homo sapiens
attcagcatctactctaaagaaa

SEQ ID NO: 5375435 - DNA, 15 bp, Homo sapiens
attcagccagcttaa

SEQ ID NO: 5375436 - DNA, 17 bp, Homo sapiens
attcagccatgtacaga

SEQ ID NO: 5375437 - DNA, 20 bp, Homo sapiens
attcagcccatttcacacct

SEQ ID NO: 5375438 - DNA, 18 bp, Homo sapiens
attcagccctcagaagaa

SEQ ID NO: 5375439 - DNA, 20 bp, Homo sapiens
attcagccctcagaagaaaa

SEQ ID NO: 5375440 - DNA, 17 bp, Homo sapiens
attcagcctcgtctctt

SEQ ID NO: 5375441 - DNA, 17 bp, Homo sapiens
attcagcctggccatcc

SEQ ID NO: 5375442 - DNA, 19 bp, Homo sapiens
attcagcctggccatcccc

SEQ ID NO: 5375443 - DNA, 12 bp, Homo sapiens
attcagccttct

SEQ ID NO: 5375444 - DNA, 15 bp, Homo sapiens
attcagccttctttt

SEQ ID NO: 5375445 - DNA, 20 bp, Homo sapiens
attcagccttctttttctgg

SEQ ID NO: 5375446 - DNA, 18 bp, Homo sapiens
attcagcgaagtctcatg

SEQ ID NO: 5375447 - DNA, 18 bp, Homo sapiens
attcagctagaatttctg

SEQ ID NO: 5375448 - DNA, 15 bp, Homo sapiens
attcagctcagcttc

SEQ ID NO: 5375449 - DNA, 14 bp, Homo sapiens
attcagctcattat

SEQ ID NO: 5375450 - DNA, 15 bp, Homo sapiens
attcagctcattatg

SEQ ID NO: 5375451 - DNA, 22 bp, Homo sapiens
attcagctcattatgaaaaaca

SEQ ID NO: 5375452 - DNA, 12 bp, Homo sapiens
attcagcttcat

SEQ ID NO: 5375453 - DNA, 20 bp, Homo sapiens
attcagcttcatttgtgtca

SEQ ID NO: 5375454 - DNA, 22 bp, Homo sapiens
attcaggaaatgttcactgaat

SEQ ID NO: 5375455 - DNA, 12 bp, Homo sapiens
attcaggaagct

SEQ ID NO: 5375456 - DNA, 14 bp, Homo sapiens
attcaggaagctca

SEQ ID NO: 5375457 - DNA, 19 bp, Homo sapiens
attcaggaagctcagggcc

SEQ ID NO: 5375458 - DNA, 21 bp, Homo sapiens
attcaggaagctcagggcctg

SEQ ID NO: 5375459 - DNA, 15 bp, Homo sapiens
attcaggactggctc

SEQ ID NO: 5375460 - DNA, 19 bp, Homo sapiens
attcaggacttgaaagaaa

SEQ ID NO: 5375461 - DNA, 17 bp, Homo sapiens
attcaggaggctgaggc

SEQ ID NO: 5375462 - DNA, 18 bp, Homo sapiens
attccagtccaattttcc

SEQ ID NO: 5375463 - DNA, 17 bp, Homo sapiens
attccagtcccctttct

SEQ ID NO: 5375464 - DNA, 22 bp, Homo sapiens
attccagttatttatttccaaa

SEQ ID NO: 5375465 - DNA, 14 bp, Homo sapiens
attccagttgcaat

SEQ ID NO: 5375466 - DNA, 20 bp, Homo sapiens
attccataatacataacatt

SEQ ID NO: 5375467 - DNA, 17 bp, Homo sapiens
attccatacttctctca

SEQ ID NO: 5375468 - DNA, 16 bp, Homo sapiens
attccatagtatatta

SEQ ID NO: 5375469 - DNA, 21 bp, Homo sapiens
attccatattagaaaactttg

SEQ ID NO: 5375470 - DNA, 22 bp, Homo sapiens
attccatattagaaaactttgt

SEQ ID NO: 5375471 - DNA, 23 bp, Homo sapiens
attccatattagaaaactttgtt

SEQ ID NO: 5375472 - DNA, 14 bp, Homo sapiens
attccatcacagcc

SEQ ID NO: 5375473 - DNA, 15 bp, Homo sapiens
attccatcacagcca

SEQ ID NO: 5375474 - DNA, 18 bp, Homo sapiens
attccatcacagccagcc

SEQ ID NO: 5375475 - DNA, 21 bp, Homo sapiens
attccatcacagccagcccag

SEQ ID NO: 5375476 - DNA, 15 bp, Homo sapiens
attccatccataaat

SEQ ID NO: 5375477 - DNA, 22 bp, Homo sapiens
attccatccctaagaattccca

SEQ ID NO: 5375478 - DNA, 17 bp, Homo sapiens
attccatctagtttttg

SEQ ID NO: 5375479 - DNA, 11 bp, Homo sapiens
attccatctcc

SEQ ID NO: 5375480 - DNA, 12 bp, Homo sapiens
attccatctcct

SEQ ID NO: 5375481 - DNA, 18 bp, Homo sapiens
attccatgaatcgcttct

SEQ ID NO: 5375482 - DNA, 17 bp, Homo sapiens
attccatgaatgtatca

SEQ ID NO: 5375483 - DNA, 23 bp, Homo sapiens
attccatgaatgtatcaggaaat

SEQ ID NO: 5375484 - DNA, 13 bp, Homo sapiens
attccatgactgc

SEQ ID NO: 5375485 - DNA, 17 bp, Homo sapiens
attccatgactgcttgc

SEQ ID NO: 5375486 - DNA, 21 bp, Homo sapiens
attccatgagctgctcattac

SEQ ID NO: 5375487 - DNA, 12 bp, Homo sapiens
attccatgattt

SEQ ID NO: 5375488 - DNA, 18 bp, Homo sapiens
attccatgattttacaga

SEQ ID NO: 5375489 - DNA, 17 bp, Homo sapiens
attccatgctaagcaag

SEQ ID NO: 5375490 - DNA, 16 bp, Homo sapiens
attccatggaaataaa

SEQ ID NO: 5375491 - DNA, 18 bp, Homo sapiens
attccatggaatttctag

SEQ ID NO: 5375492 - DNA, 17 bp, Homo sapiens
attccatggatcttgct

SEQ ID NO: 5375493 - DNA, 18 bp, Homo sapiens
attccatgggatgttaag

SEQ ID NO: 5375494 - DNA, 22 bp, Homo sapiens
attccatgggttgaacaagcca

SEQ ID NO: 5375495 - DNA, 16 bp, Homo sapiens
attccatgtcagataa

SEQ ID NO: 5375496 - DNA, 14 bp, Homo sapiens
attccatgtccctg

SEQ ID NO: 5375497 - DNA, 11 bp, Homo sapiens
attccatgttt

SEQ ID NO: 5375498 - DNA, 13 bp, Homo sapiens
attccatgtttta

SEQ ID NO: 5375499 - DNA, 19 bp, Homo sapiens
attccattaataactgaat

SEQ ID NO: 5375500 - DNA, 20 bp, Homo sapiens
attccattagagagtggcaa

SEQ ID NO: 5375501 - DNA, 14 bp, Homo sapiens
attccattatctta

SEQ ID NO: 5375502 - DNA, 21 bp, Homo sapiens
attccattctggaagtgactt

SEQ ID NO: 5375503 - DNA, 22 bp, Homo sapiens
attccattgaccttaatttctt

SEQ ID NO: 5375504 - DNA, 15 bp, Homo sapiens
attccatttatcttt

SEQ ID NO: 5375505 - DNA, 18 bp, Homo sapiens
attccatttatctttcta

SEQ ID NO: 5375506 - DNA, 21 bp, Homo sapiens
attccatttgaggatttagaa

SEQ ID NO: 5375507 - DNA, 13 bp, Homo sapiens
attccattttgga

SEQ ID NO: 5375508 - DNA, 16 bp, Homo sapiens
attcccaaatcctaga

SEQ ID NO: 5375509 - DNA, 21 bp, Homo sapiens
attcccaactagacattacca

SEQ ID NO: 5375510 - DNA, 20 bp, Homo sapiens
attcccaactgctctgccca

SEQ ID NO: 5375511 - DNA, 15 bp, Homo sapiens
attcccaagatgcct

SEQ ID NO: 5375512 - DNA, 19 bp, Homo sapiens
attcccaagccgaccttcc

SEQ ID NO: 5375513 - DNA, 15 bp, Homo sapiens
attcccaagctccct

SEQ ID NO: 5375514 - DNA, 14 bp, Homo sapiens
attcccaagctctg

SEQ ID NO: 5375515 - DNA, 15 bp, Homo sapiens
attcccaagctctgc

SEQ ID NO: 5375516 - DNA, 16 bp, Homo sapiens
attcccaagctctgct

SEQ ID NO: 5375517 - DNA, 17 bp, Homo sapiens
attcccaagctctgctc

SEQ ID NO: 5375518 - DNA, 19 bp, Homo sapiens
attcccaagctctgctcct

SEQ ID NO: 5375519 - DNA, 22 bp, Homo sapiens
attcccaagctgaatgttcttg

SEQ ID NO: 5375520 - DNA, 22 bp, Homo sapiens
attcccaagggagactgaccat

SEQ ID NO: 5375521 - DNA, 18 bp, Homo sapiens
attcccaagtatgcctta

SEQ ID NO: 5375522 - DNA, 18 bp, Homo sapiens
attcccacacctccacag

SEQ ID NO: 5375523 - DNA, 15 bp, Homo sapiens
attcccaccaaggtc

SEQ ID NO: 5375524 - DNA, 18 bp, Homo sapiens
attcccactcaccagccc

SEQ ID NO: 5375525 - DNA, 21 bp, Homo sapiens
attcccactcaccagccctag

SEQ ID NO: 5375526 - DNA, 14 bp, Homo sapiens
attcccactgcact

SEQ ID NO: 5375527 - DNA, 16 bp, Homo sapiens
attcccactgcacttg

SEQ ID NO: 5375528 - DNA, 14 bp, Homo sapiens
attcccactgccag

SEQ ID NO: 5375529 - DNA, 21 bp, Homo sapiens
attcccagaccttaagacact

SEQ ID NO: 5375530 - DNA, 23 bp, Homo sapiens
attcccagaccttaagacactgt

SEQ ID NO: 5375531 - DNA, 17 bp, Homo sapiens
attcccagagcaaaata

SEQ ID NO: 5375532 - DNA, 21 bp, Homo sapiens
attcccaggagttctgctcat

SEQ ID NO: 5375533 - DNA, 14 bp, Homo sapiens
attcccaggcaggg

SEQ ID NO: 5375534 - DNA, 16 bp, Homo sapiens
attcccatcactgctg

SEQ ID NO: 5375535 - DNA, 15 bp, Homo sapiens
attcccatctttact

SEQ ID NO: 5375536 - DNA, 20 bp, Homo sapiens
attcccatggtagactgtga

SEQ ID NO: 5375537 - DNA, 21 bp, Homo sapiens
attcccatggtagactgtgac

SEQ ID NO: 5375538 - DNA, 22 bp, Homo sapiens
attcccatggtagactgtgaca

SEQ ID NO: 5375539 - DNA, 14 bp, Homo sapiens
attcccatgtggaa

SEQ ID NO: 5375540 - DNA, 16 bp, Homo sapiens
attcccattccttttc

SEQ ID NO: 5375541 - DNA, 22 bp, Homo sapiens
attcccattgaaaatgtaagta

SEQ ID NO: 5375542 - DNA, 17 bp, Homo sapiens
attcccattggttctcc

SEQ ID NO: 5375543 - DNA, 15 bp, Homo sapiens
attcccattttgcaa

SEQ ID NO: 5375544 - DNA, 18 bp, Homo sapiens
attcccattttgcaaaat

SEQ ID NO: 5375545 - DNA, 20 bp, Homo sapiens
attccccaacggggtgggga

SEQ ID NO: 5375546 - DNA, 22 bp, Homo sapiens
attccccaacggggtggggagg

SEQ ID NO: 5375547 - DNA, 14 bp, Homo sapiens
attccccagagtgg

SEQ ID NO: 5375548 - DNA, 20 bp, Homo sapiens
attccccaggaggccagcct

SEQ ID NO: 5375549 - DNA, 14 bp, Homo sapiens
attccccagtgact

SEQ ID NO: 5375550 - DNA, 19 bp, Homo sapiens
attccccagtgactccagg

SEQ ID NO: 5375551 - DNA, 20 bp, Homo sapiens
attccccatatttgtgttca

SEQ ID NO: 5375552 - DNA, 15 bp, Homo sapiens
attccccatttcctg

SEQ ID NO: 5375553 - DNA, 21 bp, Homo sapiens
attcccccagccaaactgtct

SEQ ID NO: 5375554 - DNA, 21 bp, Homo sapiens
attcccccatgtggctgaaga

SEQ ID NO: 5375555 - DNA, 19 bp, Homo sapiens
attccccccatctccattg

SEQ ID NO: 5375556 - DNA, 17 bp, Homo sapiens
attcccccccctttcct

SEQ ID NO: 5375557 - DNA, 21 bp, Homo sapiens
attcccccccctttcctaaag

SEQ ID NO: 5375558 - DNA, 17 bp, Homo sapiens
attccccctgccctgtg

SEQ ID NO: 5375559 - DNA, 21 bp, Homo sapiens
attccccctgccctgtgccgc

SEQ ID NO: 5375560 - DNA, 19 bp, Homo sapiens
attcccccttaaacttcca

SEQ ID NO: 5375561 - DNA, 16 bp, Homo sapiens
attccccgctgcccaa

SEQ ID NO: 5375562 - DNA, 15 bp, Homo sapiens
attccccggagctgg

SEQ ID NO: 5375563 - DNA, 22 bp, Homo sapiens
attcccctcccacctctccttt

SEQ ID NO: 5375564 - DNA, 15 bp, Homo sapiens
attcccctctgctgc

SEQ ID NO: 5375565 - DNA, 15 bp, Homo sapiens
attcccgcagtggga

SEQ ID NO: 5375566 - DNA, 20 bp, Homo sapiens
attcccgggcccttcagtcc

SEQ ID NO: 5375567 - DNA, 20 bp, Homo sapiens
attcccgggtgcagaattgt

SEQ ID NO: 5375568 - DNA, 17 bp, Homo sapiens
attcccgtgttgcttca

SEQ ID NO: 5375569 - DNA, 18 bp, Homo sapiens
attcccgttttgtcactt

SEQ ID NO: 5375570 - DNA, 15 bp, Homo sapiens
attccctatcaaaac

SEQ ID NO: 5375571 - DNA, 16 bp, Homo sapiens
attccctatcaaaaca

SEQ ID NO: 5375572 - DNA, 17 bp, Homo sapiens
attccctcactcgtctc

SEQ ID NO: 5375573 - DNA, 20 bp, Homo sapiens
attccctcactcgtctcccc

SEQ ID NO: 5375574 - DNA, 13 bp, Homo sapiens
attccctcagcct

SEQ ID NO: 5375575 - DNA, 13 bp, Homo sapiens
attccctccaccc

SEQ ID NO: 5375576 - DNA, 15 bp, Homo sapiens
attccctccacccac

SEQ ID NO: 5375577 - DNA, 21 bp, Homo sapiens
attccctcctcgtcagtctct

SEQ ID NO: 5375578 - DNA, 20 bp, Homo sapiens
attccctctcatccaggtcc

SEQ ID NO: 5375579 - DNA, 13 bp, Homo sapiens
attccctctccca

SEQ ID NO: 5375580 - DNA, 17 bp, Homo sapiens
attccctctcccaccca

SEQ ID NO: 5375581 - DNA, 21 bp, Homo sapiens
attccctctcccacccaagga

SEQ ID NO: 5375582 - DNA, 18 bp, Homo sapiens
attccctctcccaggccc

SEQ ID NO: 5375583 - DNA, 23 bp, Homo sapiens
attccctctctcagcacagcctg

SEQ ID NO: 5375584 - DNA, 13 bp, Homo sapiens
attccctctctct

SEQ ID NO: 5375585 - DNA, 22 bp, Homo sapiens
attccctctctctgactctcaa

SEQ ID NO: 5375586 - DNA, 13 bp, Homo sapiens
attccctctggag

SEQ ID NO: 5375587 - DNA, 14 bp, Homo sapiens
attccctctggagt

SEQ ID NO: 5375588 - DNA, 13 bp, Homo sapiens
attccctcttgtc

SEQ ID NO: 5375589 - DNA, 19 bp, Homo sapiens
attccctgagtcaccagga

SEQ ID NO: 5375590 - DNA, 17 bp, Homo sapiens
attccctgatttaatat

SEQ ID NO: 5375591 - DNA, 13 bp, Homo sapiens
attccctgcccaa

SEQ ID NO: 5375592 - DNA, 17 bp, Homo sapiens
attccctgccttgctga

SEQ ID NO: 5375593 - DNA, 15 bp, Homo sapiens
attccctggaattca

SEQ ID NO: 5375594 - DNA, 16 bp, Homo sapiens
attccctggaattcac

SEQ ID NO: 5375595 - DNA, 22 bp, Homo sapiens
attccctggccgcttctcccca

SEQ ID NO: 5375596 - DNA, 13 bp, Homo sapiens
attccctggcctg

SEQ ID NO: 5375597 - DNA, 19 bp, Homo sapiens
attccctggcctggctctc

SEQ ID NO: 5375598 - DNA, 13 bp, Homo sapiens
attccctggcctt

SEQ ID NO: 5375599 - DNA, 16 bp, Homo sapiens
attccctgggatctgg

SEQ ID NO: 5375600 - DNA, 19 bp, Homo sapiens
attccctgtacaatattta

SEQ ID NO: 5375601 - DNA, 20 bp, Homo sapiens
attccctgtaggagtaaaga

SEQ ID NO: 5375602 - DNA, 17 bp, Homo sapiens
attcccttatcttttac

SEQ ID NO: 5375603 - DNA, 12 bp, Homo sapiens
attcccttcagg

SEQ ID NO: 5375604 - DNA, 13 bp, Homo sapiens
attcccttcctgt

SEQ ID NO: 5375605 - DNA, 22 bp, Homo sapiens
attcccttcctgttccctcctg

SEQ ID NO: 5375606 - DNA, 14 bp, Homo sapiens
attcccttccttct

SEQ ID NO: 5375607 - DNA, 14 bp, Homo sapiens
attcccttcggcca

SEQ ID NO: 5375608 - DNA, 14 bp, Homo sapiens
attcccttgtattt

SEQ ID NO: 5375609 - DNA, 16 bp, Homo sapiens
attcccttgttattca

SEQ ID NO: 5375610 - DNA, 15 bp, Homo sapiens
attcccttttatttc

SEQ ID NO: 5375611 - DNA, 21 bp, Homo sapiens
attccgaaaaaaaaatgttca

SEQ ID NO: 5375612 - DNA, 21 bp, Homo sapiens
attccgacaaccgatgctcca

SEQ ID NO: 5375613 - DNA, 16 bp, Homo sapiens
attccgagcattccag

SEQ ID NO: 5375614 - DNA, 22 bp, Homo sapiens
attccgagcattccagtaactt

SEQ ID NO: 5375615 - DNA, 17 bp, Homo sapiens
attccgagggtgaaaca

SEQ ID NO: 5375616 - DNA, 23 bp, Homo sapiens
attccgattagacctttatccag

SEQ ID NO: 5375617 - DNA, 20 bp, Homo sapiens
attccggactggcagaagca

SEQ ID NO: 5375618 - DNA, 16 bp, Homo sapiens
attccggatcctaagc

SEQ ID NO: 5375619 - DNA, 21 bp, Homo sapiens
attccggccacatcattctgt

SEQ ID NO: 5375620 - DNA, 14 bp, Homo sapiens
attccgtttacatt

SEQ ID NO: 5375621 - DNA, 19 bp, Homo sapiens
attccgtttacattttaga

SEQ ID NO: 5375622 - DNA, 17 bp, Homo sapiens
attcctaaaactctgcc

SEQ ID NO: 5375623 - DNA, 22 bp, Homo sapiens
attcctaaaactctgccagccc

SEQ ID NO: 5375624 - DNA, 18 bp, Homo sapiens
attcctaaagaaaaatat

SEQ ID NO: 5375625 - DNA, 21 bp, Homo sapiens
attcctaaatattttcaagaa

SEQ ID NO: 5375626 - DNA, 15 bp, Homo sapiens
attcctaacctgtca

SEQ ID NO: 5375627 - DNA, 17 bp, Homo sapiens
attcctaacctgtcaga

SEQ ID NO: 5375628 - DNA, 18 bp, Homo sapiens
attcctaacctgtcagaa

SEQ ID NO: 5375629 - DNA, 14 bp, Homo sapiens
attcctaagaatca

SEQ ID NO: 5375630 - DNA, 18 bp, Homo sapiens
attcctaagagtggagga

SEQ ID NO: 5375631 - DNA, 19 bp, Homo sapiens
attcctaaggcccagctgc

SEQ ID NO: 5375632 - DNA, 14 bp, Homo sapiens
attcctaattctat

SEQ ID NO: 5375633 - DNA, 23 bp, Homo sapiens
attcctaattctatgattaaact

SEQ ID NO: 5375634 - DNA, 16 bp, Homo sapiens
attcctacagcactac

SEQ ID NO: 5375635 - DNA, 17 bp, Homo sapiens
attcctacctccctgca

SEQ ID NO: 5375636 - DNA, 13 bp, Homo sapiens
attcctactccct

SEQ ID NO: 5375637 - DNA, 14 bp, Homo sapiens
attcctactccctc

SEQ ID NO: 5375638 - DNA, 20 bp, Homo sapiens
attcctactccctcttccaa

SEQ ID NO: 5375639 - DNA, 15 bp, Homo sapiens
attctcagtgccaac

SEQ ID NO: 5375640 - DNA, 22 bp, Homo sapiens
attctcagtgccaactgtggct

SEQ ID NO: 5375641 - DNA, 14 bp, Homo sapiens
attctcagtttttc

SEQ ID NO: 5375642 - DNA, 18 bp, Homo sapiens
attctcagtttttcttaa

SEQ ID NO: 5375643 - DNA, 21 bp, Homo sapiens
attctcataatccttctgcaa

SEQ ID NO: 5375644 - DNA, 17 bp, Homo sapiens
attctcataattcctac

SEQ ID NO: 5375645 - DNA, 19 bp, Homo sapiens
attctcataggagactgcg

SEQ ID NO: 5375646 - DNA, 15 bp, Homo sapiens
attctcatctgcacc

SEQ ID NO: 5375647 - DNA, 21 bp, Homo sapiens
attctcatgcctcagcctcct

SEQ ID NO: 5375648 - DNA, 15 bp, Homo sapiens
attctcatgtctcag

SEQ ID NO: 5375649 - DNA, 11 bp, Homo sapiens
attctcattgg

SEQ ID NO: 5375650 - DNA, 23 bp, Homo sapiens
attctcattggaaatttagcatt

SEQ ID NO: 5375651 - DNA, 22 bp, Homo sapiens
attctcattggggttgcaacaa

SEQ ID NO: 5375652 - DNA, 13 bp, Homo sapiens
attctcatttagt

SEQ ID NO: 5375653 - DNA, 14 bp, Homo sapiens
attctccacagcaa

SEQ ID NO: 5375654 - DNA, 16 bp, Homo sapiens
attctccacagcaacc

SEQ ID NO: 5375655 - DNA, 21 bp, Homo sapiens
attctccacctgccagggaca

SEQ ID NO: 5375656 - DNA, 19 bp, Homo sapiens
attctccagaaaaatcaat

SEQ ID NO: 5375657 - DNA, 22 bp, Homo sapiens
attctccagaaaaatcaatcat

SEQ ID NO: 5375658 - DNA, 11 bp, Homo sapiens
attctccagac

SEQ ID NO: 5375659 - DNA, 12 bp, Homo sapiens
attctccagaca

SEQ ID NO: 5375660 - DNA, 21 bp, Homo sapiens
attctccagaccaaagcaatc

SEQ ID NO: 5375661 - DNA, 20 bp, Homo sapiens
attctccaggattccaaagt

SEQ ID NO: 5375662 - DNA, 20 bp, Homo sapiens
attctccagtttcagaagca

SEQ ID NO: 5375663 - DNA, 16 bp, Homo sapiens
attctccatttgttat

SEQ ID NO: 5375664 - DNA, 19 bp, Homo sapiens
attctccatttgttatctg

SEQ ID NO: 5375665 - DNA, 13 bp, Homo sapiens
attctcccagcgt

SEQ ID NO: 5375666 - DNA, 24 bp, Homo sapiens
attctcccaggtaccagctgcgct

SEQ ID NO: 5375667 - DNA, 17 bp, Homo sapiens
attctcccgcctcagcc

SEQ ID NO: 5375668 - DNA, 22 bp, Homo sapiens
attctcccgcctcagcctcctg

SEQ ID NO: 5375669 - DNA, 23 bp, Homo sapiens
attctcccgcctcagcctcctga

SEQ ID NO: 5375670 - DNA, 21 bp, Homo sapiens
attctcccgcttcctggcctc

SEQ ID NO: 5375671 - DNA, 17 bp, Homo sapiens
attctcccgggactctg

SEQ ID NO: 5375672 - DNA, 18 bp, Homo sapiens
attctccctaaagtgttg

SEQ ID NO: 5375673 - DNA, 19 bp, Homo sapiens
attctccctaaagtgttgt

SEQ ID NO: 5375674 - DNA, 12 bp, Homo sapiens
attctccctggg

SEQ ID NO: 5375675 - DNA, 21 bp, Homo sapiens
attctcccttctctcttttct

SEQ ID NO: 5375676 - DNA, 18 bp, Homo sapiens
attctcctcagtggcttc

SEQ ID NO: 5375677 - DNA, 19 bp, Homo sapiens
attctcctcagtggcttct

SEQ ID NO: 5375678 - DNA, 21 bp, Homo sapiens
attctcctcagtggcttctcc

SEQ ID NO: 5375679 - DNA, 11 bp, Homo sapiens
attctcctcct

SEQ ID NO: 5375680 - DNA, 12 bp, Homo sapiens
attctcctcctc

SEQ ID NO: 5375681 - DNA, 13 bp, Homo sapiens
attctcctcctcc

SEQ ID NO: 5375682 - DNA, 20 bp, Homo sapiens
attctcctcctcctccctcc

SEQ ID NO: 5375683 - DNA, 17 bp, Homo sapiens
attctcctgcctcagcc

SEQ ID NO: 5375684 - DNA, 18 bp, Homo sapiens
attctcctgcctcagcct

SEQ ID NO: 5375685 - DNA, 19 bp, Homo sapiens
attctcctgcctcagcctc

SEQ ID NO: 5375686 - DNA, 20 bp, Homo sapiens
attctcctgcctcagcctcc

SEQ ID NO: 5375687 - DNA, 19 bp, Homo sapiens
attctcctgtctcagcctc

SEQ ID NO: 5375688 - DNA, 15 bp, Homo sapiens
attctccttcagccc

SEQ ID NO: 5375689 - DNA, 16 bp, Homo sapiens
attctccttcagccct

SEQ ID NO: 5375690 - DNA, 17 bp, Homo sapiens
attctccttcagccctc

SEQ ID NO: 5375691 - DNA, 23 bp, Homo sapiens
attctccttcagccctcacccct

SEQ ID NO: 5375692 - DNA, 17 bp, Homo sapiens
attctccttgtgttact

SEQ ID NO: 5375693 - DNA, 18 bp, Homo sapiens
attctccttgtgttacta

SEQ ID NO: 5375694 - DNA, 16 bp, Homo sapiens
attctccttttatgtg

SEQ ID NO: 5375695 - DNA, 18 bp, Homo sapiens
attctccttttatgtgta

SEQ ID NO: 5375696 - DNA, 15 bp, Homo sapiens
attctcgattctttg

SEQ ID NO: 5375697 - DNA, 17 bp, Homo sapiens
attctcgcttccctgaa

SEQ ID NO: 5375698 - DNA, 19 bp, Homo sapiens
attctcgtgagtcatttaa

SEQ ID NO: 5375699 - DNA, 19 bp, Homo sapiens
attctcgtttaaacaacaa

SEQ ID NO: 5375700 - DNA, 15 bp, Homo sapiens
attctctaagatgaa

SEQ ID NO: 5375701 - DNA, 16 bp, Homo sapiens
attctctaattagaaa

SEQ ID NO: 5375702 - DNA, 21 bp, Homo sapiens
attctctaattagaaatttat

SEQ ID NO: 5375703 - DNA, 21 bp, Homo sapiens
attctctaccaacaataaacc

SEQ ID NO: 5375704 - DNA, 22 bp, Homo sapiens
attctctagtcatttgttaata

SEQ ID NO: 5375705 - DNA, 17 bp, Homo sapiens
attctctagtttgatta

SEQ ID NO: 5375706 - DNA, 16 bp, Homo sapiens
attctctatttattgg

SEQ ID NO: 5375707 - DNA, 22 bp, Homo sapiens
attctctatttgaattatttct

SEQ ID NO: 5375708 - DNA, 15 bp, Homo sapiens
attctctccaaaaat

SEQ ID NO: 5375709 - DNA, 24 bp, Homo sapiens
attctctccagtgtgtgtaacagg

SEQ ID NO: 5375710 - DNA, 19 bp, Homo sapiens
attctctcctaatgatgac

SEQ ID NO: 5375711 - DNA, 23 bp, Homo sapiens
attctctcctaatgatgacttga

SEQ ID NO: 5375712 - DNA, 19 bp, Homo sapiens
attctctcctgtacctctt

SEQ ID NO: 5375713 - DNA, 15 bp, Homo sapiens
attctctccttccct

SEQ ID NO: 5375714 - DNA, 17 bp, Homo sapiens
attctctctaaaaataa

SEQ ID NO: 5375715 - DNA, 17 bp, Homo sapiens
attctctctaacataac

SEQ ID NO: 5375716 - DNA, 21 bp, Homo sapiens
attctctctcactcacatttt

SEQ ID NO: 5375717 - DNA, 15 bp, Homo sapiens
attctctctcctgta

SEQ ID NO: 5375718 - DNA, 15 bp, Homo sapiens
attctctctcctgtc

SEQ ID NO: 5375719 - DNA, 15 bp, Homo sapiens
attctctctgcccaa

SEQ ID NO: 5375720 - DNA, 22 bp, Homo sapiens
attctctcttcctgcagtgttt

SEQ ID NO: 5375721 - DNA, 17 bp, Homo sapiens
attctctgagctgtgca

SEQ ID NO: 5375722 - DNA, 12 bp, Homo sapiens
attctctgagtg

SEQ ID NO: 5375723 - DNA, 13 bp, Homo sapiens
attctctgcaatt

SEQ ID NO: 5375724 - DNA, 13 bp, Homo sapiens
attctctgcagcc

SEQ ID NO: 5375725 - DNA, 21 bp, Homo sapiens
attctctggctgtaaggctct

SEQ ID NO: 5375726 - DNA, 17 bp, Homo sapiens
attctctgggtcaacaa

SEQ ID NO: 5375727 - DNA, 22 bp, Homo sapiens
attctctgtaagtgtagctcaa

SEQ ID NO: 5375728 - DNA, 20 bp, Homo sapiens
attctctgtccagggcttca

SEQ ID NO: 5375729 - DNA, 14 bp, Homo sapiens
attctctgtctcat

SEQ ID NO: 5375730 - DNA, 16 bp, Homo sapiens
attctctgtctcatcc

SEQ ID NO: 5375731 - DNA, 17 bp, Homo sapiens
attctctgtctcatcca

SEQ ID NO: 5375732 - DNA, 11 bp, Homo sapiens
attctctgtgg

SEQ ID NO: 5375733 - DNA, 21 bp, Homo sapiens
attctctgtggttttttttga

SEQ ID NO: 5375734 - DNA, 23 bp, Homo sapiens
attctctgtgtctaagattctag

SEQ ID NO: 5375735 - DNA, 14 bp, Homo sapiens
attctctgtttgct

SEQ ID NO: 5375736 - DNA, 15 bp, Homo sapiens
attctctgtttgctt

SEQ ID NO: 5375737 - DNA, 14 bp, Homo sapiens
attctcttaaattt

SEQ ID NO: 5375738 - DNA, 20 bp, Homo sapiens
attctcttaatcactactgt

SEQ ID NO: 5375739 - DNA, 21 bp, Homo sapiens
attctcttaatcactactgta

SEQ ID NO: 5375740 - DNA, 18 bp, Homo sapiens
attctcttactttttgta

SEQ ID NO: 5375741 - DNA, 14 bp, Homo sapiens
attctcttatccaa

SEQ ID NO: 5375742 - DNA, 18 bp, Homo sapiens
attctcttcgctgtgatg

SEQ ID NO: 5375743 - DNA, 21 bp, Homo sapiens
attctcttctttttctttttt

SEQ ID NO: 5375744 - DNA, 21 bp, Homo sapiens
attctcttgaaggtgctgcca

SEQ ID NO: 5375745 - DNA, 14 bp, Homo sapiens
attctcttgaataa

SEQ ID NO: 5375746 - DNA, 22 bp, Homo sapiens
attctcttgagataaggtttta

SEQ ID NO: 5375747 - DNA, 16 bp, Homo sapiens
attctcttgcattgtg

SEQ ID NO: 5375748 - DNA, 17 bp, Homo sapiens
attctcttgcctcagct

SEQ ID NO: 5375749 - DNA, 17 bp, Homo sapiens
attctcttggctggctt

SEQ ID NO: 5375750 - DNA, 20 bp, Homo sapiens
attctcttggctggcttcct

SEQ ID NO: 5375751 - DNA, 22 bp, Homo sapiens
attctcttgtataagatcctag

SEQ ID NO: 5375752 - DNA, 17 bp, Homo sapiens
attctcttgtctggctg

SEQ ID NO: 5375753 - DNA, 18 bp, Homo sapiens
attctcttgtctggctgc

SEQ ID NO: 5375754 - DNA, 17 bp, Homo sapiens
attctctttaaaaaaga

SEQ ID NO: 5375755 - DNA, 20 bp, Homo sapiens
attctctttaaaaaagactg

SEQ ID NO: 5375756 - DNA, 21 bp, Homo sapiens
attctctttaaaaaagactga

SEQ ID NO: 5375757 - DNA, 20 bp, Homo sapiens
attctctttaccttctaaaa

SEQ ID NO: 5375758 - DNA, 14 bp, Homo sapiens
attctctttgataa

SEQ ID NO: 5375759 - DNA, 19 bp, Homo sapiens
attctctttgcctgaagaa

SEQ ID NO: 5375760 - DNA, 18 bp, Homo sapiens
attctctttggtcattga

SEQ ID NO: 5375761 - DNA, 12 bp, Homo sapiens
attctcttttaa

SEQ ID NO: 5375762 - DNA, 17 bp, Homo sapiens
attctcttttatctgtt

SEQ ID NO: 5375763 - DNA, 12 bp, Homo sapiens
attctcttttca

SEQ ID NO: 5375764 - DNA, 20 bp, Homo sapiens
attctcttttcaaacacaca

SEQ ID NO: 5375765 - DNA, 22 bp, Homo sapiens
attctcttttcaaacacacaca

SEQ ID NO: 5375766 - DNA, 14 bp, Homo sapiens
attctgaaaaagac

SEQ ID NO: 5375767 - DNA, 14 bp, Homo sapiens
attctgaaaactga

SEQ ID NO: 5375768 - DNA, 19 bp, Homo sapiens
attctgaaaatagcaggac

SEQ ID NO: 5375769 - DNA, 16 bp, Homo sapiens
attctgaaaccacagt

SEQ ID NO: 5375770 - DNA, 18 bp, Homo sapiens
attctgaaaccacagttt

SEQ ID NO: 5375771 - DNA, 19 bp, Homo sapiens
attctgaaaccacagtttc

SEQ ID NO: 5375772 - DNA, 21 bp, Homo sapiens
attctgaaaccacagtttcat

SEQ ID NO: 5375773 - DNA, 22 bp, Homo sapiens
attctgaaaccacagtttcatt

SEQ ID NO: 5375774 - DNA, 21 bp, Homo sapiens
attctgaaatacttttgagta

SEQ ID NO: 5375775 - DNA, 20 bp, Homo sapiens
attctgaaatttttttccta

SEQ ID NO: 5375776 - DNA, 17 bp, Homo sapiens
attctgaaccctccaaa

SEQ ID NO: 5375777 - DNA, 18 bp, Homo sapiens
attctgaaccctccaaag

SEQ ID NO: 5375778 - DNA, 21 bp, Homo sapiens
attctgaagcttatgtttctt

SEQ ID NO: 5375779 - DNA, 16 bp, Homo sapiens
attctgaaggagcccc

SEQ ID NO: 5375780 - DNA, 14 bp, Homo sapiens
attctgaaggggaa

SEQ ID NO: 5375781 - DNA, 23 bp, Homo sapiens
attctgaaggggaaaacctcagt

SEQ ID NO: 5375782 - DNA, 12 bp, Homo sapiens
attctgaagtta

SEQ ID NO: 5375783 - DNA, 18 bp, Homo sapiens
attctgaagttatatttc

SEQ ID NO: 5375784 - DNA, 20 bp, Homo sapiens
attctgaagttatatttcct

SEQ ID NO: 5375785 - DNA, 16 bp, Homo sapiens
attctgaagttttatt

SEQ ID NO: 5375786 - DNA, 22 bp, Homo sapiens
attctgaatcaagcacactgta

SEQ ID NO: 5375787 - DNA, 15 bp, Homo sapiens
attctgaatcaccaa

SEQ ID NO: 5375788 - DNA, 22 bp, Homo sapiens
attctgaatcaccaattaaaaa

SEQ ID NO: 5375789 - DNA, 14 bp, Homo sapiens
attctgaatctcaa

SEQ ID NO: 5375790 - DNA, 14 bp, Homo sapiens
attctgaatgaata

SEQ ID NO: 5375791 - DNA, 15 bp, Homo sapiens
attctgaatgcttct

SEQ ID NO: 5375792 - DNA, 17 bp, Homo sapiens
attctgaatgcttctaa

SEQ ID NO: 5375793 - DNA, 20 bp, Homo sapiens
attctgaattggctaaaaga

SEQ ID NO: 5375794 - DNA, 15 bp, Homo sapiens
attctgaatttgcaa

SEQ ID NO: 5375795 - DNA, 17 bp, Homo sapiens
attctgaatttgcaaag

SEQ ID NO: 5375796 - DNA, 19 bp, Homo sapiens
attctgaatttgcaaagta

SEQ ID NO: 5375797 - DNA, 14 bp, Homo sapiens
attctgacatgtaa

SEQ ID NO: 5375798 - DNA, 22 bp, Homo sapiens
attctgacatgtaagaaaatgt

SEQ ID NO: 5375799 - DNA, 16 bp, Homo sapiens
attctgacatttatat

SEQ ID NO: 5375800 - DNA, 20 bp, Homo sapiens
attctgaccacccttctcat

SEQ ID NO: 5375801 - DNA, 21 bp, Homo sapiens
attctgaccagagctatgaat

SEQ ID NO: 5375802 - DNA, 17 bp, Homo sapiens
attctgacccagggcct

SEQ ID NO: 5375803 - DNA, 20 bp, Homo sapiens
attctgactcggtttctcca

SEQ ID NO: 5375804 - DNA, 16 bp, Homo sapiens
attctgacttctccca

SEQ ID NO: 5375805 - DNA, 14 bp, Homo sapiens
attctgagaaaaca

SEQ ID NO: 5375806 - DNA, 18 bp, Homo sapiens
attctgagcaaaggccct

SEQ ID NO: 5375807 - DNA, 19 bp, Homo sapiens
attctgagcaaaggccctg

SEQ ID NO: 5375808 - DNA, 17 bp, Homo sapiens
attctgagccacactga

SEQ ID NO: 5375809 - DNA, 22 bp, Homo sapiens
attctgagcccccttcctgtcc

SEQ ID NO: 5375810 - DNA, 17 bp, Homo sapiens
attctgaggaagtctta

SEQ ID NO: 5375811 - DNA, 15 bp, Homo sapiens
attctgataatgtat

SEQ ID NO: 5375812 - DNA, 17 bp, Homo sapiens
attctgatacagcctta

SEQ ID NO: 5375813 - DNA, 15 bp, Homo sapiens
attctgatcaatcat

SEQ ID NO: 5375814 - DNA, 16 bp, Homo sapiens
attctgatgtttctgt

SEQ ID NO: 5375815 - DNA, 15 bp, Homo sapiens
attgaaaaaaaaaat

SEQ ID NO: 5375816 - DNA, 22 bp, Homo sapiens
attgaaaaaaagggcactctga

SEQ ID NO: 5375817 - DNA, 13 bp, Homo sapiens
attgaaaaaaata

SEQ ID NO: 5375818 - DNA, 15 bp, Homo sapiens
attgaaaaaagagaa

SEQ ID NO: 5375819 - DNA, 14 bp, Homo sapiens
attgaaaaaataga

SEQ ID NO: 5375820 - DNA, 18 bp, Homo sapiens
attgaaaaaatagagcct

SEQ ID NO: 5375821 - DNA, 19 bp, Homo sapiens
attgaaaaacaattttctg

SEQ ID NO: 5375822 - DNA, 15 bp, Homo sapiens
attgaaaaaccattt

SEQ ID NO: 5375823 - DNA, 16 bp, Homo sapiens
attgaaaaactcttta

SEQ ID NO: 5375824 - DNA, 14 bp, Homo sapiens
attgaaaaaggaaa

SEQ ID NO: 5375825 - DNA, 16 bp, Homo sapiens
attgaaaaaggaaaaa

SEQ ID NO: 5375826 - DNA, 19 bp, Homo sapiens
attgaaaaataaaaaccat

SEQ ID NO: 5375827 - DNA, 13 bp, Homo sapiens
attgaaaaatcag

SEQ ID NO: 5375828 - DNA, 15 bp, Homo sapiens
attgaaaaattatca

SEQ ID NO: 5375829 - DNA, 22 bp, Homo sapiens
attgaaaacactaacaaaattt

SEQ ID NO: 5375830 - DNA, 22 bp, Homo sapiens
attgaaaacagtgtcttgagct

SEQ ID NO: 5375831 - DNA, 17 bp, Homo sapiens
attgaaaacttcaaagc

SEQ ID NO: 5375832 - DNA, 18 bp, Homo sapiens
attgaaaagaagaaagtc

SEQ ID NO: 5375833 - DNA, 20 bp, Homo sapiens
attgaaaagaagtagtgtct

SEQ ID NO: 5375834 - DNA, 21 bp, Homo sapiens
attgaaaaggaacttgccctg

SEQ ID NO: 5375835 - DNA, 22 bp, Homo sapiens
attgaaaataggagagagatca

SEQ ID NO: 5375836 - DNA, 14 bp, Homo sapiens
attgaaaatcatat

SEQ ID NO: 5375837 - DNA, 19 bp, Homo sapiens
attgaaaatgcattaggga

SEQ ID NO: 5375838 - DNA, 21 bp, Homo sapiens
attgaaaatggctttctcagc

SEQ ID NO: 5375839 - DNA, 13 bp, Homo sapiens
attgaaaatgtca

SEQ ID NO: 5375840 - DNA, 14 bp, Homo sapiens
attgaaaatgtcac

SEQ ID NO: 5375841 - DNA, 17 bp, Homo sapiens
attgaaaatgtcactgt

SEQ ID NO: 5375842 - DNA, 18 bp, Homo sapiens
attgaaaatgtcactgtt

SEQ ID NO: 5375843 - DNA, 22 bp, Homo sapiens
attgaaaatgtcactgttataa

SEQ ID NO: 5375844 - DNA, 16 bp, Homo sapiens
attgaaaattgaaaag

SEQ ID NO: 5375845 - DNA, 14 bp, Homo sapiens
attgaaacatgaaa

SEQ ID NO: 5375846 - DNA, 13 bp, Homo sapiens
attgaaactagtt

SEQ ID NO: 5375847 - DNA, 17 bp, Homo sapiens
attgaaactgagtataa

SEQ ID NO: 5375848 - DNA, 17 bp, Homo sapiens
attgaaactgtatttac

SEQ ID NO: 5375849 - DNA, 10 bp, Homo sapiens
attgaaagaa

SEQ ID NO: 5375850 - DNA, 21 bp, Homo sapiens
attgaaagaaaaaaaaatact

SEQ ID NO: 5375851 - DNA, 13 bp, Homo sapiens
attgaaagaactt

SEQ ID NO: 5375852 - DNA, 19 bp, Homo sapiens
attgaaagaacttaagtct

SEQ ID NO: 5375853 - DNA, 17 bp, Homo sapiens
attgaaagaatgtaaag

SEQ ID NO: 5375854 - DNA, 18 bp, Homo sapiens
attgaaagaatgtaaagc

SEQ ID NO: 5375855 - DNA, 16 bp, Homo sapiens
attgaaagaattatcc

SEQ ID NO: 5375856 - DNA, 15 bp, Homo sapiens
attgaaagagaacca

SEQ ID NO: 5375857 - DNA, 16 bp, Homo sapiens
attgaaagcttttaaa

SEQ ID NO: 5375858 - DNA, 22 bp, Homo sapiens
attgaaaggacctcttctgaag

SEQ ID NO: 5375859 - DNA, 19 bp, Homo sapiens
attgaaagggacaagtatc

SEQ ID NO: 5375860 - DNA, 13 bp, Homo sapiens
attgaaagggagg

SEQ ID NO: 5375861 - DNA, 23 bp, Homo sapiens
attgaaaggggacacctgtacat

SEQ ID NO: 5375862 - DNA, 15 bp, Homo sapiens
attgaaagtataatt

SEQ ID NO: 5375863 - DNA, 20 bp, Homo sapiens
attgaaagtggggtgttgaa

SEQ ID NO: 5375864 - DNA, 16 bp, Homo sapiens
attgaaagttgctttt

SEQ ID NO: 5375865 - DNA, 19 bp, Homo sapiens
attgaaataaataaaaatg

SEQ ID NO: 5375866 - DNA, 20 bp, Homo sapiens
attgaaatcagcatgacaaa

SEQ ID NO: 5375867 - DNA, 21 bp, Homo sapiens
attgaaatcagcatgacaaaa

SEQ ID NO: 5375868 - DNA, 12 bp, Homo sapiens
attgaaatcttt

SEQ ID NO: 5375869 - DNA, 20 bp, Homo sapiens
attgaaatgatttcacagtg

SEQ ID NO: 5375870 - DNA, 21 bp, Homo sapiens
attgaaatgatttcacagtgt

SEQ ID NO: 5375871 - DNA, 20 bp, Homo sapiens
attgaaatgctgtattttta

SEQ ID NO: 5375872 - DNA, 17 bp, Homo sapiens
attgaaatggggcgctg

SEQ ID NO: 5375873 - DNA, 22 bp, Homo sapiens
attgaaattaacttttaaatgt

SEQ ID NO: 5375874 - DNA, 12 bp, Homo sapiens
attgaaattcta

SEQ ID NO: 5375875 - DNA, 13 bp, Homo sapiens
attgaaattctga

SEQ ID NO: 5375876 - DNA, 17 bp, Homo sapiens
attgaaattctgagaaa

SEQ ID NO: 5375877 - DNA, 17 bp, Homo sapiens
attgaaattgtacatat

SEQ ID NO: 5375878 - DNA, 22 bp, Homo sapiens
attgaacaagttgtttcattga

SEQ ID NO: 5375879 - DNA, 17 bp, Homo sapiens
attgaacaataaagttt

SEQ ID NO: 5375880 - DNA, 22 bp, Homo sapiens
attgaacaataaagtttgcttt

SEQ ID NO: 5375881 - DNA, 15 bp, Homo sapiens
attgaacacaaactg

SEQ ID NO: 5375882 - DNA, 18 bp, Homo sapiens
attgaacacaaactgtaa

SEQ ID NO: 5375883 - DNA, 23 bp, Homo sapiens
attgaacacaggcaaagaggtgc

SEQ ID NO: 5375884 - DNA, 19 bp, Homo sapiens
attgaacactgcaccctcc

SEQ ID NO: 5375885 - DNA, 15 bp, Homo sapiens
attgaaccagctcat

SEQ ID NO: 5375886 - DNA, 22 bp, Homo sapiens
attgaaccatttgggatggaga

SEQ ID NO: 5375887 - DNA, 17 bp, Homo sapiens
attgaaccgtcaatgtg

SEQ ID NO: 5375888 - DNA, 19 bp, Homo sapiens
attgaaccgtcaatgtgaa

SEQ ID NO: 5375889 - DNA, 20 bp, Homo sapiens
attgaaccgtcaatgtgaaa

SEQ ID NO: 5375890 - DNA, 18 bp, Homo sapiens
attgaacgactgtatatt

SEQ ID NO: 5375891 - DNA, 23 bp, Homo sapiens
attgaactctttgaatgacaaag

SEQ ID NO: 5375892 - DNA, 15 bp, Homo sapiens
attgaactgcaggtg

SEQ ID NO: 5375893 - DNA, 22 bp, Homo sapiens
attgaactgtattctagtggct

SEQ ID NO: 5375894 - DNA, 14 bp, Homo sapiens
attgaacttaaatg

SEQ ID NO: 5375895 - DNA, 16 bp, Homo sapiens
attgaacttgaaatct

SEQ ID NO: 5375896 - DNA, 11 bp, Homo sapiens
attgaactttc

SEQ ID NO: 5375897 - DNA, 17 bp, Homo sapiens
attgaacttttgtactg

SEQ ID NO: 5375898 - DNA, 19 bp, Homo sapiens
attgaacttttgtactgaa

SEQ ID NO: 5375899 - DNA, 17 bp, Homo sapiens
attgaagaaacagatac

SEQ ID NO: 5375900 - DNA, 10 bp, Homo sapiens
attgaagaat

SEQ ID NO: 5375901 - DNA, 16 bp, Homo sapiens
attgaagaatgttaga

SEQ ID NO: 5375902 - DNA, 20 bp, Homo sapiens
attgaagacaatttgataca

SEQ ID NO: 5375903 - DNA, 22 bp, Homo sapiens
attgaagacaatttgatacata

SEQ ID NO: 5375904 - DNA, 19 bp, Homo sapiens
attgaagagagatatatct

SEQ ID NO: 5375905 - DNA, 21 bp, Homo sapiens
attgaagagatttcaacatat

SEQ ID NO: 5375906 - DNA, 20 bp, Homo sapiens
attgaagaggatattcttct

SEQ ID NO: 5375907 - DNA, 18 bp, Homo sapiens
attgaagaggtgaaatgg

SEQ ID NO: 5375908 - DNA, 15 bp, Homo sapiens
attgaagatacacaa

SEQ ID NO: 5375909 - DNA, 17 bp, Homo sapiens
attgaagatgctgcctg

SEQ ID NO: 5375910 - DNA, 22 bp, Homo sapiens
attgaagatgctgcctgtattt

SEQ ID NO: 5375911 - DNA, 19 bp, Homo sapiens
attgaagatgtaaggaatt

SEQ ID NO: 5375912 - DNA, 18 bp, Homo sapiens
attgaagctttttaaaaa

SEQ ID NO: 5375913 - DNA, 20 bp, Homo sapiens
attgaaggaagccaaattta

SEQ ID NO: 5375914 - DNA, 20 bp, Homo sapiens
attgaaggaatttgggagga

SEQ ID NO: 5375915 - DNA, 12 bp, Homo sapiens
attgaaggcctg

SEQ ID NO: 5375916 - DNA, 15 bp, Homo sapiens
attgaaggcttaaac

SEQ ID NO: 5375917 - DNA, 17 bp, Homo sapiens
attgaaggcttaattga

SEQ ID NO: 5375918 - DNA, 15 bp, Homo sapiens
attgaaggggcttct

SEQ ID NO: 5375919 - DNA, 22 bp, Homo sapiens
attgaaggggcttctaatgacc

SEQ ID NO: 5375920 - DNA, 18 bp, Homo sapiens
attgaagggtctgtttaa

SEQ ID NO: 5375921 - DNA, 13 bp, Homo sapiens
attgaaggttttt

SEQ ID NO: 5375922 - DNA, 14 bp, Homo sapiens
attgaagtaaaatg

SEQ ID NO: 5375923 - DNA, 15 bp, Homo sapiens
attgaagtaaacttt

SEQ ID NO: 5375924 - DNA, 16 bp, Homo sapiens
attgaagtaaactttt

SEQ ID NO: 5375925 - DNA, 14 bp, Homo sapiens
attgaagtaatgaa

SEQ ID NO: 5375926 - DNA, 13 bp, Homo sapiens
attgaagtatatt

SEQ ID NO: 5375927 - DNA, 19 bp, Homo sapiens
attgaagtatggtgtgttc

SEQ ID NO: 5375928 - DNA, 18 bp, Homo sapiens
attgaagtcatcataaaa

SEQ ID NO: 5375929 - DNA, 17 bp, Homo sapiens
attgaagtcttcttatc

SEQ ID NO: 5375930 - DNA, 23 bp, Homo sapiens
attgaagtcttcttatctaaacc

SEQ ID NO: 5375931 - DNA, 22 bp, Homo sapiens
attgaagtgtataatataaaaa

SEQ ID NO: 5375932 - DNA, 18 bp, Homo sapiens
attgaagtgtcttctgtt

SEQ ID NO: 5375933 - DNA, 18 bp, Homo sapiens
attgaagttgtttatcaa

SEQ ID NO: 5375934 - DNA, 15 bp, Homo sapiens
attgaagtttcaagt

SEQ ID NO: 5375935 - DNA, 16 bp, Homo sapiens
attgaagtttcaagtt

SEQ ID NO: 5375936 - DNA, 13 bp, Homo sapiens
attgaataaagag

SEQ ID NO: 5375937 - DNA, 14 bp, Homo sapiens
attgaataatggta

SEQ ID NO: 5375938 - DNA, 21 bp, Homo sapiens
attgaataatgttttttgaag

SEQ ID NO: 5375939 - DNA, 22 bp, Homo sapiens
attgaataatgttttttgaagt

SEQ ID NO: 5375940 - DNA, 19 bp, Homo sapiens
attgaatactttatgggaa

SEQ ID NO: 5375941 - DNA, 15 bp, Homo sapiens
attgaatactttgaa

SEQ ID NO: 5375942 - DNA, 18 bp, Homo sapiens
attgaatactttgaatgt

SEQ ID NO: 5375943 - DNA, 17 bp, Homo sapiens
attgaatagtttatttc

SEQ ID NO: 5375944 - DNA, 19 bp, Homo sapiens
attgaatagtttatttctg

SEQ ID NO: 5375945 - DNA, 16 bp, Homo sapiens
attgaatatatatgat

SEQ ID NO: 5375946 - DNA, 14 bp, Homo sapiens
attgaatatatcag

SEQ ID NO: 5375947 - DNA, 16 bp, Homo sapiens
attgaatattgtaagt

SEQ ID NO: 5375948 - DNA, 15 bp, Homo sapiens
attgaatattgtgtt

SEQ ID NO: 5375949 - DNA, 14 bp, Homo sapiens
attgaatcatgtag

SEQ ID NO: 5375950 - DNA, 16 bp, Homo sapiens
attgaatctatttaag

SEQ ID NO: 5375951 - DNA, 16 bp, Homo sapiens
attgaatctctaaaat

SEQ ID NO: 5375952 - DNA, 17 bp, Homo sapiens
attgaatctctaaaatg

SEQ ID NO: 5375953 - DNA, 22 bp, Homo sapiens
attgaatgatatataaatatat

SEQ ID NO: 5375954 - DNA, 13 bp, Homo sapiens
attgaatgcctta

SEQ ID NO: 5375955 - DNA, 13 bp, Homo sapiens
attgaatgctgcc

SEQ ID NO: 5375956 - DNA, 22 bp, Homo sapiens
attgaatggaagcaaaattata

SEQ ID NO: 5375957 - DNA, 20 bp, Homo sapiens
attgaatggatcaatacaca

SEQ ID NO: 5375958 - DNA, 22 bp, Homo sapiens
attgaatggctatgtttttaat

SEQ ID NO: 5375959 - DNA, 16 bp, Homo sapiens
attgaatgttatatca

SEQ ID NO: 5375960 - DNA, 15 bp, Homo sapiens
attgaattagaaaat

SEQ ID NO: 5375961 - DNA, 21 bp, Homo sapiens
attgaattatcttggttgaaa

SEQ ID NO: 5375962 - DNA, 12 bp, Homo sapiens
attgaattcatt

SEQ ID NO: 5375963 - DNA, 13 bp, Homo sapiens
attgaattcatta

SEQ ID NO: 5375964 - DNA, 17 bp, Homo sapiens
attgaattcgtttctga

SEQ ID NO: 5375965 - DNA, 20 bp, Homo sapiens
attgaattcttggttgagga

SEQ ID NO: 5375966 - DNA, 22 bp, Homo sapiens
attgaattcttggttgaggaaa

SEQ ID NO: 5375967 - DNA, 14 bp, Homo sapiens
attgaatttaacaa

SEQ ID NO: 5375968 - DNA, 16 bp, Homo sapiens
attgaatttaacaatg

SEQ ID NO: 5375969 - DNA, 16 bp, Homo sapiens
attgaatttagtcatt

SEQ ID NO: 5375970 - DNA, 22 bp, Homo sapiens
attgaatttgcacggtttgtga

SEQ ID NO: 5375971 - DNA, 18 bp, Homo sapiens
attgaatttttaagcaaa

SEQ ID NO: 5375972 - DNA, 14 bp, Homo sapiens
attgaatttttcct

SEQ ID NO: 5375973 - DNA, 23 bp, Homo sapiens
attgaatttttcctatgctattg

SEQ ID NO: 5375974 - DNA, 13 bp, Homo sapiens
attgacaaaatgt

SEQ ID NO: 5375975 - DNA, 16 bp, Homo sapiens
attgacaaaatgttat

SEQ ID NO: 5375976 - DNA, 13 bp, Homo sapiens
attgacaaactct

SEQ ID NO: 5375977 - DNA, 14 bp, Homo sapiens
attgacaaactctc

SEQ ID NO: 5375978 - DNA, 13 bp, Homo sapiens
attgacaaatctg

SEQ ID NO: 5375979 - DNA, 15 bp, Homo sapiens
attgacaaatctgtg

SEQ ID NO: 5375980 - DNA, 16 bp, Homo sapiens
attgacaaatctgtgt

SEQ ID NO: 5375981 - DNA, 21 bp, Homo sapiens
attgacaaatctgtgtatatt

SEQ ID NO: 5375982 - DNA, 17 bp, Homo sapiens
attgacaacacccattt

SEQ ID NO: 5375983 - DNA, 15 bp, Homo sapiens
attgacaacatttta

SEQ ID NO: 5375984 - DNA, 15 bp, Homo sapiens
attgacaagaactga

SEQ ID NO: 5375985 - DNA, 18 bp, Homo sapiens
attgacaaggtagacatg

SEQ ID NO: 5375986 - DNA, 15 bp, Homo sapiens
attgacaagtcattt

SEQ ID NO: 5375987 - DNA, 16 bp, Homo sapiens
attgacaagtgtcttt

SEQ ID NO: 5375988 - DNA, 12 bp, Homo sapiens
attgacaagttt

SEQ ID NO: 5375989 - DNA, 17 bp, Homo sapiens
attgacaataatttcag

SEQ ID NO: 5375990 - DNA, 20 bp, Homo sapiens
attgacacacagaaatgtgt

SEQ ID NO: 5375991 - DNA, 13 bp, Homo sapiens
attgacacacagc

SEQ ID NO: 5375992 - DNA, 17 bp, Homo sapiens
attgacacacagcactc

SEQ ID NO: 5375993 - DNA, 16 bp, Homo sapiens
attgacaccaaaatga

SEQ ID NO: 5375994 - DNA, 13 bp, Homo sapiens
attgatatttgtg

SEQ ID NO: 5375995 - DNA, 19 bp, Homo sapiens
attgatatttgtgcatttt

SEQ ID NO: 5375996 - DNA, 16 bp, Homo sapiens
attgatcaaaatcaaa

SEQ ID NO: 5375997 - DNA, 17 bp, Homo sapiens
attgatcacagatgtgc

SEQ ID NO: 5375998 - DNA, 17 bp, Homo sapiens
attgatccagaaagaaa

SEQ ID NO: 5375999 - DNA, 22 bp, Homo sapiens
attgatccagaaagaaaacttg

SEQ ID NO: 5376000 - DNA, 16 bp, Homo sapiens
attgatcccttctcct

SEQ ID NO: 5376001 - DNA, 20 bp, Homo sapiens
attgatcctagtgtctttaa

SEQ ID NO: 5376002 - DNA, 22 bp, Homo sapiens
attgatcctttgatcccagaaa

SEQ ID NO: 5376003 - DNA, 23 bp, Homo sapiens
attgatcggagcctcctctctca

SEQ ID NO: 5376004 - DNA, 13 bp, Homo sapiens
attgatctgtatt

SEQ ID NO: 5376005 - DNA, 13 bp, Homo sapiens
attgatctgtttt

SEQ ID NO: 5376006 - DNA, 21 bp, Homo sapiens
attgatctgttttacaggaaa

SEQ ID NO: 5376007 - DNA, 19 bp, Homo sapiens
attgatctgttttggatgt

SEQ ID NO: 5376008 - DNA, 19 bp, Homo sapiens
attgatgagcactcctgat

SEQ ID NO: 5376009 - DNA, 21 bp, Homo sapiens
attgatgataacacttaaaat

SEQ ID NO: 5376010 - DNA, 14 bp, Homo sapiens
attgatgatccatt

SEQ ID NO: 5376011 - DNA, 12 bp, Homo sapiens
attgatgatgtt

SEQ ID NO: 5376012 - DNA, 14 bp, Homo sapiens
attgatgcaaataa

SEQ ID NO: 5376013 - DNA, 16 bp, Homo sapiens
attgatgcaatataag

SEQ ID NO: 5376014 - DNA, 18 bp, Homo sapiens
attgatgcaatataagca

SEQ ID NO: 5376015 - DNA, 23 bp, Homo sapiens
attgatgcactacacttttgatg

SEQ ID NO: 5376016 - DNA, 22 bp, Homo sapiens
attgatgggagaaatgaggaaa

SEQ ID NO: 5376017 - DNA, 16 bp, Homo sapiens
attgatggggaaggag

SEQ ID NO: 5376018 - DNA, 13 bp, Homo sapiens
attgatgtaagga

SEQ ID NO: 5376019 - DNA, 16 bp, Homo sapiens
attgatgtacagaaca

SEQ ID NO: 5376020 - DNA, 21 bp, Homo sapiens
attgatgtacagaacacaaat

SEQ ID NO: 5376021 - DNA, 13 bp, Homo sapiens
attgatgtgaaat

SEQ ID NO: 5376022 - DNA, 16 bp, Homo sapiens
attgatgtgcaaaaat

SEQ ID NO: 5376023 - DNA, 16 bp, Homo sapiens
attgatgtgcactgca

SEQ ID NO: 5376024 - DNA, 12 bp, Homo sapiens
attgatgtgttt

SEQ ID NO: 5376025 - DNA, 16 bp, Homo sapiens
attgatgttgatgcaa

SEQ ID NO: 5376026 - DNA, 18 bp, Homo sapiens
attgatgttgatgcaatc

SEQ ID NO: 5376027 - DNA, 17 bp, Homo sapiens
attgatgtttacatgtc

SEQ ID NO: 5376028 - DNA, 17 bp, Homo sapiens
attgatgtttccagaaa

SEQ ID NO: 5376029 - DNA, 19 bp, Homo sapiens
attgatgtttccagaaaat

SEQ ID NO: 5376030 - DNA, 22 bp, Homo sapiens
attgatgtttccagaaaatata

SEQ ID NO: 5376031 - DNA, 14 bp, Homo sapiens
attgattaaaagca

SEQ ID NO: 5376032 - DNA, 17 bp, Homo sapiens
attgattaaaatctctt

SEQ ID NO: 5376033 - DNA, 19 bp, Homo sapiens
attgattaaaatctcttga

SEQ ID NO: 5376034 - DNA, 13 bp, Homo sapiens
attgattaaactg

SEQ ID NO: 5376035 - DNA, 15 bp, Homo sapiens
attgattaaactgta

SEQ ID NO: 5376036 - DNA, 19 bp, Homo sapiens
attgattaaactgtatgtc

SEQ ID NO: 5376037 - DNA, 13 bp, Homo sapiens
attgattacaatt

SEQ ID NO: 5376038 - DNA, 20 bp, Homo sapiens
attgattattactggcaaaa

SEQ ID NO: 5376039 - DNA, 13 bp, Homo sapiens
attgattcagtat

SEQ ID NO: 5376040 - DNA, 14 bp, Homo sapiens
attgattcagtctt

SEQ ID NO: 5376041 - DNA, 17 bp, Homo sapiens
attgattcatgttcatc

SEQ ID NO: 5376042 - DNA, 23 bp, Homo sapiens
attgattctgaaatttttttcct

SEQ ID NO: 5376043 - DNA, 15 bp, Homo sapiens
attgattgaaaaaag

SEQ ID NO: 5376044 - DNA, 21 bp, Homo sapiens
attgattgctgcattttacct

SEQ ID NO: 5376045 - DNA, 13 bp, Homo sapiens
attgattgggaaa

SEQ ID NO: 5376046 - DNA, 18 bp, Homo sapiens
attgattgggaaaacatt

SEQ ID NO: 5376047 - DNA, 23 bp, Homo sapiens
attgattgggaaaacatttgctg

SEQ ID NO: 5376048 - DNA, 20 bp, Homo sapiens
attgattgtgaattccttaa

SEQ ID NO: 5376049 - DNA, 21 bp, Homo sapiens
attgatttaaaagtgtatttt

SEQ ID NO: 5376050 - DNA, 14 bp, Homo sapiens
attgatttaccttt

SEQ ID NO: 5376051 - DNA, 18 bp, Homo sapiens
attgatttcccttcttct

SEQ ID NO: 5376052 - DNA, 21 bp, Homo sapiens
attgatttccgttaaaatacc

SEQ ID NO: 5376053 - DNA, 12 bp, Homo sapiens
attgatttctgc

SEQ ID NO: 5376054 - DNA, 14 bp, Homo sapiens
attgatttgaaaag

SEQ ID NO: 5376055 - DNA, 14 bp, Homo sapiens
attgatttgaagtg

SEQ ID NO: 5376056 - DNA, 15 bp, Homo sapiens
attgatttgattttt

SEQ ID NO: 5376057 - DNA, 12 bp, Homo sapiens
attgatttgcat

SEQ ID NO: 5376058 - DNA, 15 bp, Homo sapiens
attgatttgcattga

SEQ ID NO: 5376059 - DNA, 15 bp, Homo sapiens
attgattttaaaatg

SEQ ID NO: 5376060 - DNA, 20 bp, Homo sapiens
attgattttaaaatgtacat

SEQ ID NO: 5376061 - DNA, 18 bp, Homo sapiens
attgatttttaaagttta

SEQ ID NO: 5376062 - DNA, 22 bp, Homo sapiens
attgatttttaaagtttaaata

SEQ ID NO: 5376063 - DNA, 17 bp, Homo sapiens
attgatttttaagaaag

SEQ ID NO: 5376064 - DNA, 18 bp, Homo sapiens
attgatttttaagaaagt

SEQ ID NO: 5376065 - DNA, 20 bp, Homo sapiens
attgatttttaagaaagtaa

SEQ ID NO: 5376066 - DNA, 19 bp, Homo sapiens
attgatttttataaatact

SEQ ID NO: 5376067 - DNA, 23 bp, Homo sapiens
attgatttttctataatcacttg

SEQ ID NO: 5376068 - DNA, 12 bp, Homo sapiens
attgatttttgg

SEQ ID NO: 5376069 - DNA, 12 bp, Homo sapiens
attgcaaaacta

SEQ ID NO: 5376070 - DNA, 15 bp, Homo sapiens
attgcaaaaggttaa

SEQ ID NO: 5376071 - DNA, 16 bp, Homo sapiens
attgcaaaatacatga

SEQ ID NO: 5376072 - DNA, 19 bp, Homo sapiens
attgcaaaatagcatttgt

SEQ ID NO: 5376073 - DNA, 14 bp, Homo sapiens
attgcaaacaactg

SEQ ID NO: 5376074 - DNA, 18 bp, Homo sapiens
attgcaaagggacattga

SEQ ID NO: 5376075 - DNA, 12 bp, Homo sapiens
attgcaaatctt

SEQ ID NO: 5376076 - DNA, 16 bp, Homo sapiens
attgcaaatcttgaaa

SEQ ID NO: 5376077 - DNA, 16 bp, Homo sapiens
attgcaacaaaataca

SEQ ID NO: 5376078 - DNA, 17 bp, Homo sapiens
attgcaacaaaatacat

SEQ ID NO: 5376079 - DNA, 17 bp, Homo sapiens
attgcaacaggctgggc

SEQ ID NO: 5376080 - DNA, 19 bp, Homo sapiens
attgcaacaggctgggctt

SEQ ID NO: 5376081 - DNA, 23 bp, Homo sapiens
attgcaacccagggcaaatggaa

SEQ ID NO: 5376082 - DNA, 20 bp, Homo sapiens
attgcaactcttttaagtgc

SEQ ID NO: 5376083 - DNA, 12 bp, Homo sapiens
attgcaatagaa

SEQ ID NO: 5376084 - DNA, 14 bp, Homo sapiens
attgcaatatctga

SEQ ID NO: 5376085 - DNA, 17 bp, Homo sapiens
attgcaatatctgaagc

SEQ ID NO: 5376086 - DNA, 12 bp, Homo sapiens
attgcaatattt

SEQ ID NO: 5376087 - DNA, 16 bp, Homo sapiens
attgcaatgaaggaaa

SEQ ID NO: 5376088 - DNA, 22 bp, Homo sapiens
attgcacaatattgaacttttt

SEQ ID NO: 5376089 - DNA, 12 bp, Homo sapiens
attgcacaattt

SEQ ID NO: 5376090 - DNA, 15 bp, Homo sapiens
attgcacaatttgag

SEQ ID NO: 5376091 - DNA, 12 bp, Homo sapiens
attgcacacaga

SEQ ID NO: 5376092 - DNA, 14 bp, Homo sapiens
attgcacagagtga

SEQ ID NO: 5376093 - DNA, 20 bp, Homo sapiens
attgcacatgtcttaatgaa

SEQ ID NO: 5376094 - DNA, 21 bp, Homo sapiens
attgcacatgtcttaatgaag

SEQ ID NO: 5376095 - DNA, 14 bp, Homo sapiens
attgcacattgttc

SEQ ID NO: 5376096 - DNA, 18 bp, Homo sapiens
attgcacatttttttcta

SEQ ID NO: 5376097 - DNA, 22 bp, Homo sapiens
attgcacctatctcagccatag

SEQ ID NO: 5376098 - DNA, 17 bp, Homo sapiens
attgcacctggatgtac

SEQ ID NO: 5376099 - DNA, 15 bp, Homo sapiens
attgcacgtggcctc

SEQ ID NO: 5376100 - DNA, 17 bp, Homo sapiens
attgcacgtggcctctt

SEQ ID NO: 5376101 - DNA, 13 bp, Homo sapiens
attgcactaaata

SEQ ID NO: 5376102 - DNA, 13 bp, Homo sapiens
attgcactagaga

SEQ ID NO: 5376103 - DNA, 14 bp, Homo sapiens
attgcactaggaat

SEQ ID NO: 5376104 - DNA, 15 bp, Homo sapiens
attgcactaggaatt

SEQ ID NO: 5376105 - DNA, 17 bp, Homo sapiens
attgcactccagcctgg

SEQ ID NO: 5376106 - DNA, 13 bp, Homo sapiens
attgcactccagt

SEQ ID NO: 5376107 - DNA, 17 bp, Homo sapiens
attgcactcccgcctgg

SEQ ID NO: 5376108 - DNA, 20 bp, Homo sapiens
attgcactctaaaaggttca

SEQ ID NO: 5376109 - DNA, 23 bp, Homo sapiens
attgcactctaaaaggttcaggg

SEQ ID NO: 5376110 - DNA, 14 bp, Homo sapiens
attgcactgaagtt

SEQ ID NO: 5376111 - DNA, 18 bp, Homo sapiens
attgcactgaagtttttg

SEQ ID NO: 5376112 - DNA, 20 bp, Homo sapiens
attgcactgaagtttttgaa

SEQ ID NO: 5376113 - DNA, 19 bp, Homo sapiens
attgcactgatcttactct

SEQ ID NO: 5376114 - DNA, 17 bp, Homo sapiens
attgcactgctgttcct

SEQ ID NO: 5376115 - DNA, 21 bp, Homo sapiens
attgcacttggcctcatgctg

SEQ ID NO: 5376116 - DNA, 20 bp, Homo sapiens
attgcactttataaacactg

SEQ ID NO: 5376117 - DNA, 21 bp, Homo sapiens
attgcactttcctttcaataa

SEQ ID NO: 5376118 - DNA, 20 bp, Homo sapiens
attgcactttttaagtttga

SEQ ID NO: 5376119 - DNA, 22 bp, Homo sapiens
attgcagaacatgagtgctgat

SEQ ID NO: 5376120 - DNA, 19 bp, Homo sapiens
attgcagagtgaccagcac

SEQ ID NO: 5376121 - DNA, 21 bp, Homo sapiens
attgcagatcccagcccaccc

SEQ ID NO: 5376122 - DNA, 16 bp, Homo sapiens
attgcagatgccaaaa

SEQ ID NO: 5376123 - DNA, 19 bp, Homo sapiens
attgcagattgaatatata

SEQ ID NO: 5376124 - DNA, 21 bp, Homo sapiens
attgcagcagacccagcagca

SEQ ID NO: 5376125 - DNA, 14 bp, Homo sapiens
attgcagcctaaga

SEQ ID NO: 5376126 - DNA, 23 bp, Homo sapiens
attgcagccttgcgctgtcccag

SEQ ID NO: 5376127 - DNA, 14 bp, Homo sapiens
attgcagctttatg

SEQ ID NO: 5376128 - DNA, 17 bp, Homo sapiens
attgcaggacacaagca

SEQ ID NO: 5376129 - DNA, 21 bp, Homo sapiens
attgcaggaccttgggcacat

SEQ ID NO: 5376130 - DNA, 18 bp, Homo sapiens
attgcaggagacattttc

SEQ ID NO: 5376131 - DNA, 17 bp, Homo sapiens
attgcaggatggtgtct

SEQ ID NO: 5376132 - DNA, 17 bp, Homo sapiens
attgcaggtgcctggct

SEQ ID NO: 5376133 - DNA, 16 bp, Homo sapiens
attgcaggtggaactc

SEQ ID NO: 5376134 - DNA, 17 bp, Homo sapiens
attgcaggtggaactca

SEQ ID NO: 5376135 - DNA, 16 bp, Homo sapiens
attgcagtaaagtctt

SEQ ID NO: 5376136 - DNA, 17 bp, Homo sapiens
attgcagtatggtgtgg

SEQ ID NO: 5376137 - DNA, 16 bp, Homo sapiens
attgcagtcactttga

SEQ ID NO: 5376138 - DNA, 19 bp, Homo sapiens
attgcagtcatagaagaga

SEQ ID NO: 5376139 - DNA, 22 bp, Homo sapiens
attgcagtctaaaacttcaaaa

SEQ ID NO: 5376140 - DNA, 15 bp, Homo sapiens
attgcagtgcggctc

SEQ ID NO: 5376141 - DNA, 19 bp, Homo sapiens
attgcagtgtgaatgctgg

SEQ ID NO: 5376142 - DNA, 23 bp, Homo sapiens
attgcagttagccccagaaaatg

SEQ ID NO: 5376143 - DNA, 24 bp, Homo sapiens
attgcagttagccccagaaaatga

SEQ ID NO: 5376144 - DNA, 14 bp, Homo sapiens
attgcagtttatca

SEQ ID NO: 5376145 - DNA, 17 bp, Homo sapiens
attgcagtttatcattc

SEQ ID NO: 5376146 - DNA, 18 bp, Homo sapiens
attgcagtttatcattca

SEQ ID NO: 5376147 - DNA, 14 bp, Homo sapiens
attgcataaagcat

SEQ ID NO: 5376148 - DNA, 18 bp, Homo sapiens
attgcatactattaaaca

SEQ ID NO: 5376149 - DNA, 19 bp, Homo sapiens
attgcatactattaaacat

SEQ ID NO: 5376150 - DNA, 22 bp, Homo sapiens
attgcatactattaaacatgct

SEQ ID NO: 5376151 - DNA, 18 bp, Homo sapiens
attgcatataacttatat

SEQ ID NO: 5376152 - DNA, 18 bp, Homo sapiens
attgcatatagatttagt

SEQ ID NO: 5376153 - DNA, 16 bp, Homo sapiens
attgcatcaaagcatc

SEQ ID NO: 5376154 - DNA, 22 bp, Homo sapiens
attgcatcacctctgtaatttt

SEQ ID NO: 5376155 - DNA, 14 bp, Homo sapiens
attgcatcactgta

SEQ ID NO: 5376156 - DNA, 15 bp, Homo sapiens
attgcatcactgtat

SEQ ID NO: 5376157 - DNA, 19 bp, Homo sapiens
attgcatcactgtatcatt

SEQ ID NO: 5376158 - DNA, 13 bp, Homo sapiens
attgcatcctgct

SEQ ID NO: 5376159 - DNA, 19 bp, Homo sapiens
attgcatcctgctggggct

SEQ ID NO: 5376160 - DNA, 19 bp, Homo sapiens
attgcatctcaaaattatt

SEQ ID NO: 5376161 - DNA, 15 bp, Homo sapiens
attgcatctgtataa

SEQ ID NO: 5376162 - DNA, 13 bp, Homo sapiens
attgcatgaaact

SEQ ID NO: 5376163 - DNA, 23 bp, Homo sapiens
attgcatgaattcacaaacaaat

SEQ ID NO: 5376164 - DNA, 16 bp, Homo sapiens
attgcatgctgcttta

SEQ ID NO: 5376165 - DNA, 17 bp, Homo sapiens
attgcatgctgctttaa

SEQ ID NO: 5376166 - DNA, 20 bp, Homo sapiens
attgcatgctgctttaattg

SEQ ID NO: 5376167 - DNA, 15 bp, Homo sapiens
attgcatggtgtgaa

SEQ ID NO: 5376168 - DNA, 13 bp, Homo sapiens
attgcattctatt

SEQ ID NO: 5376169 - DNA, 16 bp, Homo sapiens
attgcattctattgcc

SEQ ID NO: 5376170 - DNA, 18 bp, Homo sapiens
attgcattctattgcctt

SEQ ID NO: 5376171 - DNA, 19 bp, Homo sapiens
attgcattctgaatgaata

SEQ ID NO: 5376172 - DNA, 16 bp, Homo sapiens
attggttccctttgct

SEQ ID NO: 5376173 - DNA, 14 bp, Homo sapiens
attggttcttcccc

SEQ ID NO: 5376174 - DNA, 16 bp, Homo sapiens
attggttggcaaacta

SEQ ID NO: 5376175 - DNA, 18 bp, Homo sapiens
attggttgggggctcctg

SEQ ID NO: 5376176 - DNA, 22 bp, Homo sapiens
attggttggtgtgaagaaagcc

SEQ ID NO: 5376177 - DNA, 19 bp, Homo sapiens
attggttgtgccttccctt

SEQ ID NO: 5376178 - DNA, 17 bp, Homo sapiens
attggttgttgtattga

SEQ ID NO: 5376179 - DNA, 17 bp, Homo sapiens
attggttgtttaacact

SEQ ID NO: 5376180 - DNA, 17 bp, Homo sapiens
attggtttctcttctcc

SEQ ID NO: 5376181 - DNA, 19 bp, Homo sapiens
attggtttctcttctcccc

SEQ ID NO: 5376182 - DNA, 14 bp, Homo sapiens
attggtttctgttt

SEQ ID NO: 5376183 - DNA, 23 bp, Homo sapiens
attggtttctgtttgaattttca

SEQ ID NO: 5376184 - DNA, 14 bp, Homo sapiens
attggtttgcacaa

SEQ ID NO: 5376185 - DNA, 20 bp, Homo sapiens
attggtttgcacaagttccc

SEQ ID NO: 5376186 - DNA, 21 bp, Homo sapiens
attggtttggcaagaacttgt

SEQ ID NO: 5376187 - DNA, 17 bp, Homo sapiens
attggttttatgatgac

SEQ ID NO: 5376188 - DNA, 15 bp, Homo sapiens
attggttttcctgtg

SEQ ID NO: 5376189 - DNA, 12 bp, Homo sapiens
attggttttgaa

SEQ ID NO: 5376190 - DNA, 11 bp, Homo sapiens
attgtaaaaaa

SEQ ID NO: 5376191 - DNA, 20 bp, Homo sapiens
attgtaaaaaaaaatgcctt

SEQ ID NO: 5376192 - DNA, 23 bp, Homo sapiens
attgtaaaaaaaaatgcctttga

SEQ ID NO: 5376193 - DNA, 15 bp, Homo sapiens
attgtaaaacattca

SEQ ID NO: 5376194 - DNA, 23 bp, Homo sapiens
attgtaaaaccccatctctacta

SEQ ID NO: 5376195 - DNA, 20 bp, Homo sapiens
attgtaaaacctgtcaatga

SEQ ID NO: 5376196 - DNA, 14 bp, Homo sapiens
attgtaaaactttg

SEQ ID NO: 5376197 - DNA, 20 bp, Homo sapiens
attgtaaaagcattttgtaa

SEQ ID NO: 5376198 - DNA, 15 bp, Homo sapiens
attgtaaaataaagt

SEQ ID NO: 5376199 - DNA, 22 bp, Homo sapiens
attgtaaaatagcttgtatagt

SEQ ID NO: 5376200 - DNA, 14 bp, Homo sapiens
attgtaaaatggtg

SEQ ID NO: 5376201 - DNA, 19 bp, Homo sapiens
attgtaaacagaaattgca

SEQ ID NO: 5376202 - DNA, 20 bp, Homo sapiens
attgtaaacagaaattgcaa

SEQ ID NO: 5376203 - DNA, 15 bp, Homo sapiens
attgtaaacagaagg

SEQ ID NO: 5376204 - DNA, 16 bp, Homo sapiens
attgtaaacagaagga

SEQ ID NO: 5376205 - DNA, 17 bp, Homo sapiens
attgtaaacagaaggag

SEQ ID NO: 5376206 - DNA, 15 bp, Homo sapiens
attgtaaacatgtgt

SEQ ID NO: 5376207 - DNA, 18 bp, Homo sapiens
attgtaaaccattaatga

SEQ ID NO: 5376208 - DNA, 19 bp, Homo sapiens
attgtaaaccgctttggcc

SEQ ID NO: 5376209 - DNA, 16 bp, Homo sapiens
attgtaaactagtact

SEQ ID NO: 5376210 - DNA, 17 bp, Homo sapiens
attgtaaactagtacta

SEQ ID NO: 5376211 - DNA, 17 bp, Homo sapiens
attgtaaactgtactag

SEQ ID NO: 5376212 - DNA, 19 bp, Homo sapiens
attgtaaactttttcaatg

SEQ ID NO: 5376213 - DNA, 23 bp, Homo sapiens
attgtaaaggtgatgaatttacc

SEQ ID NO: 5376214 - DNA, 10 bp, Homo sapiens
attgtaaata

SEQ ID NO: 5376215 - DNA, 16 bp, Homo sapiens
attgtaaatacaagtt

SEQ ID NO: 5376216 - DNA, 21 bp, Homo sapiens
attgtaaatactggactcagg

SEQ ID NO: 5376217 - DNA, 22 bp, Homo sapiens
attgtaaatactggactcagga

SEQ ID NO: 5376218 - DNA, 15 bp, Homo sapiens
attgtaaatatttga

SEQ ID NO: 5376219 - DNA, 21 bp, Homo sapiens
attgtaaatatttgactttag

SEQ ID NO: 5376220 - DNA, 14 bp, Homo sapiens
attgtaaatatttt

SEQ ID NO: 5376221 - DNA, 16 bp, Homo sapiens
attgtaaatattttga

SEQ ID NO: 5376222 - DNA, 22 bp, Homo sapiens
attgtaaatattttgatacaaa

SEQ ID NO: 5376223 - DNA, 14 bp, Homo sapiens
attgtaaatcactt

SEQ ID NO: 5376224 - DNA, 18 bp, Homo sapiens
attgtaaatcacttgttt

SEQ ID NO: 5376225 - DNA, 16 bp, Homo sapiens
attgtaaatcctgtgt

SEQ ID NO: 5376226 - DNA, 13 bp, Homo sapiens
attgtaaatgaac

SEQ ID NO: 5376227 - DNA, 15 bp, Homo sapiens
attgtaaatgtggat

SEQ ID NO: 5376228 - DNA, 23 bp, Homo sapiens
attgtaaatgtggattttgtaga

SEQ ID NO: 5376229 - DNA, 18 bp, Homo sapiens
attgtaaatgtttaatat

SEQ ID NO: 5376230 - DNA, 21 bp, Homo sapiens
attgtaaattatatttgtgct

SEQ ID NO: 5376231 - DNA, 16 bp, Homo sapiens
attgtaaattgaatca

SEQ ID NO: 5376232 - DNA, 23 bp, Homo sapiens
attgtaaattgaatcagtataaa

SEQ ID NO: 5376233 - DNA, 23 bp, Homo sapiens
attgtaacttggatgtagccatg

SEQ ID NO: 5376234 - DNA, 12 bp, Homo sapiens
attgtaagaaat

SEQ ID NO: 5376235 - DNA, 20 bp, Homo sapiens
attgtaagaaatactgtaca

SEQ ID NO: 5376236 - DNA, 13 bp, Homo sapiens
attgtaagataaa

SEQ ID NO: 5376237 - DNA, 16 bp, Homo sapiens
attgtaagataaaaaa

SEQ ID NO: 5376238 - DNA, 14 bp, Homo sapiens
attgtaagccagag

SEQ ID NO: 5376239 - DNA, 15 bp, Homo sapiens
attgtaagccagagt

SEQ ID NO: 5376240 - DNA, 19 bp, Homo sapiens
attgtaagccagagtcaac

SEQ ID NO: 5376241 - DNA, 16 bp, Homo sapiens
attgtaaggtctttgt

SEQ ID NO: 5376242 - DNA, 17 bp, Homo sapiens
attgtaagtgaaattaa

SEQ ID NO: 5376243 - DNA, 20 bp, Homo sapiens
attgtaagtgaaattaagca

SEQ ID NO: 5376244 - DNA, 19 bp, Homo sapiens
attgtaagtggaaaatgca

SEQ ID NO: 5376245 - DNA, 15 bp, Homo sapiens
attgtaagttgtaca

SEQ ID NO: 5376246 - DNA, 16 bp, Homo sapiens
attgtaagttgtacaa

SEQ ID NO: 5376247 - DNA, 17 bp, Homo sapiens
attgtaagttgtacaaa

SEQ ID NO: 5376248 - DNA, 22 bp, Homo sapiens
attgtaagttgtacaaatgtat

SEQ ID NO: 5376249 - DNA, 21 bp, Homo sapiens
attgtaataatgctaaagaaa

SEQ ID NO: 5376250 - DNA, 19 bp, Homo sapiens
attgtaatacacatatcta

SEQ ID NO: 5376251 - DNA, 15 bp, Homo sapiens
attgtaatacagaca

SEQ ID NO: 5376252 - DNA, 18 bp, Homo sapiens
attgtaatatgacagata

SEQ ID NO: 5376253 - DNA, 12 bp, Homo sapiens
attgtaatcact

SEQ ID NO: 5376254 - DNA, 15 bp, Homo sapiens
attgtaatcgtgtgc

SEQ ID NO: 5376255 - DNA, 13 bp, Homo sapiens
attgtaatctgct

SEQ ID NO: 5376256 - DNA, 13 bp, Homo sapiens
attgtaatgaata

SEQ ID NO: 5376257 - DNA, 21 bp, Homo sapiens
attgtaatgccaatatgacac

SEQ ID NO: 5376258 - DNA, 23 bp, Homo sapiens
attgtaatgtaataaaaatagtt

SEQ ID NO: 5376259 - DNA, 15 bp, Homo sapiens
attgtaatgttactg

SEQ ID NO: 5376260 - DNA, 14 bp, Homo sapiens
attgtaatgttgtg

SEQ ID NO: 5376261 - DNA, 23 bp, Homo sapiens
attgtaatgttgtgaataattac

SEQ ID NO: 5376262 - DNA, 18 bp, Homo sapiens
attgtaattaataataga

SEQ ID NO: 5376263 - DNA, 20 bp, Homo sapiens
attgtaattcaagctttccg

SEQ ID NO: 5376264 - DNA, 22 bp, Homo sapiens
attgtaatttgggaacataaaa

SEQ ID NO: 5376265 - DNA, 12 bp, Homo sapiens
attgtaattttg

SEQ ID NO: 5376266 - DNA, 17 bp, Homo sapiens
attgtaattttgttcct

SEQ ID NO: 5376267 - DNA, 14 bp, Homo sapiens
attgtacaaaaaag

SEQ ID NO: 5376268 - DNA, 23 bp, Homo sapiens
attgtacaaaaaagttataagaa

SEQ ID NO: 5376269 - DNA, 16 bp, Homo sapiens
attgtacaaagtatta

SEQ ID NO: 5376270 - DNA, 23 bp, Homo sapiens
attgtacaaagtattaagcatat

SEQ ID NO: 5376271 - DNA, 13 bp, Homo sapiens
attgtacaaatgt

SEQ ID NO: 5376272 - DNA, 14 bp, Homo sapiens
attgtacaaatgta

SEQ ID NO: 5376273 - DNA, 20 bp, Homo sapiens
attgtacaaggtatttacac

SEQ ID NO: 5376274 - DNA, 12 bp, Homo sapiens
attgtacacttt

SEQ ID NO: 5376275 - DNA, 17 bp, Homo sapiens
attgtacagactgtttt

SEQ ID NO: 5376276 - DNA, 20 bp, Homo sapiens
attgtacagctgtttaagat

SEQ ID NO: 5376277 - DNA, 14 bp, Homo sapiens
attgtacagtttgt

SEQ ID NO: 5376278 - DNA, 21 bp, Homo sapiens
attgtacagtttgtttacaca

SEQ ID NO: 5376279 - DNA, 12 bp, Homo sapiens
attgtacataaa

SEQ ID NO: 5376280 - DNA, 15 bp, Homo sapiens
attgtacataaaaga

SEQ ID NO: 5376281 - DNA, 19 bp, Homo sapiens
attgtacatagcatgttta

SEQ ID NO: 5376282 - DNA, 20 bp, Homo sapiens
attgtacattttgtaaaata

SEQ ID NO: 5376283 - DNA, 23 bp, Homo sapiens
attgtaccaaagctgtttttata

SEQ ID NO: 5376284 - DNA, 16 bp, Homo sapiens
attgtaccagaactat

SEQ ID NO: 5376285 - DNA, 17 bp, Homo sapiens
attgtaccatcatttta

SEQ ID NO: 5376286 - DNA, 16 bp, Homo sapiens
attgtacctatttctg

SEQ ID NO: 5376287 - DNA, 12 bp, Homo sapiens
attgtacctctc

SEQ ID NO: 5376288 - DNA, 19 bp, Homo sapiens
attgtacctctcttataga

SEQ ID NO: 5376289 - DNA, 15 bp, Homo sapiens
attgtaccttttaac

SEQ ID NO: 5376290 - DNA, 22 bp, Homo sapiens
attgtaccttttaacacctgat

SEQ ID NO: 5376291 - DNA, 16 bp, Homo sapiens
attgtacgaagagtat

SEQ ID NO: 5376292 - DNA, 19 bp, Homo sapiens
attgtacgcgccaccgagt

SEQ ID NO: 5376293 - DNA, 17 bp, Homo sapiens
attgtactccagcctgg

SEQ ID NO: 5376294 - DNA, 19 bp, Homo sapiens
attgtactctgctttatca

SEQ ID NO: 5376295 - DNA, 12 bp, Homo sapiens
attgtactgtgt

SEQ ID NO: 5376296 - DNA, 15 bp, Homo sapiens
attgtactttgaaaa

SEQ ID NO: 5376297 - DNA, 18 bp, Homo sapiens
attgtagaaaaacccaaa

SEQ ID NO: 5376298 - DNA, 18 bp, Homo sapiens
attgtagaacttgttgct

SEQ ID NO: 5376299 - DNA, 17 bp, Homo sapiens
attgtagactgatgttt

SEQ ID NO: 5376300 - DNA, 18 bp, Homo sapiens
attgtagactgatgtttt

SEQ ID NO: 5376301 - DNA, 13 bp, Homo sapiens
attgtagagaaaa

SEQ ID NO: 5376302 - DNA, 17 bp, Homo sapiens
attgtagagcacattta

SEQ ID NO: 5376303 - DNA, 17 bp, Homo sapiens
attgtagagccagaggt

SEQ ID NO: 5376304 - DNA, 14 bp, Homo sapiens
attgtagatgaaca

SEQ ID NO: 5376305 - DNA, 21 bp, Homo sapiens
attgtagatgaacatctctgt

SEQ ID NO: 5376306 - DNA, 13 bp, Homo sapiens
attgtagcagtta

SEQ ID NO: 5376307 - DNA, 22 bp, Homo sapiens
attgtagcagttacagctctgt

SEQ ID NO: 5376308 - DNA, 19 bp, Homo sapiens
attgtagcctaatattcat

SEQ ID NO: 5376309 - DNA, 18 bp, Homo sapiens
attgtagctttttattaa

SEQ ID NO: 5376310 - DNA, 20 bp, Homo sapiens
attgtaggcagtggccccta

SEQ ID NO: 5376311 - DNA, 18 bp, Homo sapiens
attgtagggctttagctt

SEQ ID NO: 5376312 - DNA, 15 bp, Homo sapiens
attgtaggtgcaaga

SEQ ID NO: 5376313 - DNA, 17 bp, Homo sapiens
attgtagtatttagtat

SEQ ID NO: 5376314 - DNA, 23 bp, Homo sapiens
attgtagtgctttgagagagaaa

SEQ ID NO: 5376315 - DNA, 19 bp, Homo sapiens
attgtagtggcctgtgctt

SEQ ID NO: 5376316 - DNA, 14 bp, Homo sapiens
attgtagttaatga

SEQ ID NO: 5376317 - DNA, 19 bp, Homo sapiens
attgtagttctgtgtactt

SEQ ID NO: 5376318 - DNA, 14 bp, Homo sapiens
attgtagttcttag

SEQ ID NO: 5376319 - DNA, 14 bp, Homo sapiens
attgtagtttgaaa

SEQ ID NO: 5376320 - DNA, 14 bp, Homo sapiens
attgtataaaaata

SEQ ID NO: 5376321 - DNA, 21 bp, Homo sapiens
attgtataaaaatagaagaat

SEQ ID NO: 5376322 - DNA, 21 bp, Homo sapiens
attgtataaactatcagtttg

SEQ ID NO: 5376323 - DNA, 22 bp, Homo sapiens
attgtataaactatcagtttgt

SEQ ID NO: 5376324 - DNA, 13 bp, Homo sapiens
attgtataaatta

SEQ ID NO: 5376325 - DNA, 22 bp, Homo sapiens
attgtataaattactttgattc

SEQ ID NO: 5376326 - DNA, 14 bp, Homo sapiens
attgtataacaggt

SEQ ID NO: 5376327 - DNA, 15 bp, Homo sapiens
attgtataacaggtt

SEQ ID NO: 5376328 - DNA, 18 bp, Homo sapiens
attgtataacaggttatt

SEQ ID NO: 5376329 - DNA, 21 bp, Homo sapiens
attgtataagattagaatgaa

SEQ ID NO: 5376330 - DNA, 20 bp, Homo sapiens
attgtataagcatgctttct

SEQ ID NO: 5376331 - DNA, 14 bp, Homo sapiens
attgtataagtcaa

SEQ ID NO: 5376332 - DNA, 18 bp, Homo sapiens
attgtataatgtgatttt

SEQ ID NO: 5376333 - DNA, 19 bp, Homo sapiens
attgtataatgtgattttt

SEQ ID NO: 5376334 - DNA, 15 bp, Homo sapiens
attgtatacattttg

SEQ ID NO: 5376335 - DNA, 20 bp, Homo sapiens
attgtataggccatctgtaa

SEQ ID NO: 5376336 - DNA, 14 bp, Homo sapiens
attgtatatatatg

SEQ ID NO: 5376337 - DNA, 16 bp, Homo sapiens
attgtatatatatgtg

SEQ ID NO: 5376338 - DNA, 21 bp, Homo sapiens
attgtatatatatgtgaactt

SEQ ID NO: 5376339 - DNA, 16 bp, Homo sapiens
attgtatatatggata

SEQ ID NO: 5376340 - DNA, 17 bp, Homo sapiens
attgtatattacaatga

SEQ ID NO: 5376341 - DNA, 14 bp, Homo sapiens
attgtatattcact

SEQ ID NO: 5376342 - DNA, 15 bp, Homo sapiens
attgtatattctgga

SEQ ID NO: 5376343 - DNA, 15 bp, Homo sapiens
attgtatattgtaat

SEQ ID NO: 5376344 - DNA, 17 bp, Homo sapiens
attgtatattgtgtttg

SEQ ID NO: 5376345 - DNA, 19 bp, Homo sapiens
attgtatatttttatctat

SEQ ID NO: 5376346 - DNA, 17 bp, Homo sapiens
attgtatcagaggccta

SEQ ID NO: 5376347 - DNA, 21 bp, Homo sapiens
attgtatcagaggcctataat

SEQ ID NO: 5376348 - DNA, 22 bp, Homo sapiens
attgtatctacattaaaatgac

SEQ ID NO: 5376349 - DNA, 23 bp, Homo sapiens
attgtatctacattaaaatgaca

SEQ ID NO: 5376350 - DNA, 23 bp, Homo sapiens
attgtttcagtgccatttgttaa

SEQ ID NO: 5376351 - DNA, 13 bp, Homo sapiens
attgtttccaaag

SEQ ID NO: 5376352 - DNA, 16 bp, Homo sapiens
attgtttccaaagtgc

SEQ ID NO: 5376353 - DNA, 19 bp, Homo sapiens
attgtttccaacttgtctg

SEQ ID NO: 5376354 - DNA, 21 bp, Homo sapiens
attgtttccaacttgtctggg

SEQ ID NO: 5376355 - DNA, 17 bp, Homo sapiens
attgtttcctcttccaa

SEQ ID NO: 5376356 - DNA, 15 bp, Homo sapiens
attgtttctatacaa

SEQ ID NO: 5376357 - DNA, 19 bp, Homo sapiens
attgtttctatacaaatat

SEQ ID NO: 5376358 - DNA, 16 bp, Homo sapiens
attgtttctctgaaag

SEQ ID NO: 5376359 - DNA, 17 bp, Homo sapiens
attgtttctgcattcat

SEQ ID NO: 5376360 - DNA, 19 bp, Homo sapiens
attgtttcttcttcatgct

SEQ ID NO: 5376361 - DNA, 19 bp, Homo sapiens
attgtttctttaagaaagt

SEQ ID NO: 5376362 - DNA, 13 bp, Homo sapiens
attgtttgaaatg

SEQ ID NO: 5376363 - DNA, 15 bp, Homo sapiens
attgtttgaaatgtc

SEQ ID NO: 5376364 - DNA, 20 bp, Homo sapiens
attgtttgaaatgtcgatca

SEQ ID NO: 5376365 - DNA, 12 bp, Homo sapiens
attgtttgaacc

SEQ ID NO: 5376366 - DNA, 20 bp, Homo sapiens
attgtttgatattgtcacct

SEQ ID NO: 5376367 - DNA, 14 bp, Homo sapiens
attgtttgatgaat

SEQ ID NO: 5376368 - DNA, 13 bp, Homo sapiens
attgtttgcttat

SEQ ID NO: 5376369 - DNA, 18 bp, Homo sapiens
attgtttgcttattgttc

SEQ ID NO: 5376370 - DNA, 22 bp, Homo sapiens
attgtttgcttattgttccaag

SEQ ID NO: 5376371 - DNA, 14 bp, Homo sapiens
attgtttggatttc

SEQ ID NO: 5376372 - DNA, 18 bp, Homo sapiens
attgtttggcttcctcct

SEQ ID NO: 5376373 - DNA, 21 bp, Homo sapiens
attgtttggggatgagaaagg

SEQ ID NO: 5376374 - DNA, 19 bp, Homo sapiens
attgtttggtaaatgtttc

SEQ ID NO: 5376375 - DNA, 24 bp, Homo sapiens
attgtttgttgattttctagactt

SEQ ID NO: 5376376 - DNA, 19 bp, Homo sapiens
attgtttgttgcactaaaa

SEQ ID NO: 5376377 - DNA, 22 bp, Homo sapiens
attgttttaaaaagaaacaaga

SEQ ID NO: 5376378 - DNA, 13 bp, Homo sapiens
attgttttaatct

SEQ ID NO: 5376379 - DNA, 20 bp, Homo sapiens
attgttttaatctgaaattc

SEQ ID NO: 5376380 - DNA, 19 bp, Homo sapiens
attgttttacaatagttct

SEQ ID NO: 5376381 - DNA, 17 bp, Homo sapiens
attgttttaccagctcc

SEQ ID NO: 5376382 - DNA, 13 bp, Homo sapiens
attgttttagtaa

SEQ ID NO: 5376383 - DNA, 14 bp, Homo sapiens
attgttttataaat

SEQ ID NO: 5376384 - DNA, 13 bp, Homo sapiens
attgttttatcat

SEQ ID NO: 5376385 - DNA, 16 bp, Homo sapiens
attgttttatgttcta

SEQ ID NO: 5376386 - DNA, 10 bp, Homo sapiens
attgttttca

SEQ ID NO: 5376387 - DNA, 20 bp, Homo sapiens
attgttttcaacctagaaac

SEQ ID NO: 5376388 - DNA, 18 bp, Homo sapiens
attgttttcagtgtacat

SEQ ID NO: 5376389 - DNA, 18 bp, Homo sapiens
attgttttctatttatgc

SEQ ID NO: 5376390 - DNA, 17 bp, Homo sapiens
attgttttctgtaaata

SEQ ID NO: 5376391 - DNA, 21 bp, Homo sapiens
attgttttctgtaaataacct

SEQ ID NO: 5376392 - DNA, 19 bp, Homo sapiens
attgttttctttaaagatg

SEQ ID NO: 5376393 - DNA, 17 bp, Homo sapiens
attgttttcttttacag

SEQ ID NO: 5376394 - DNA, 20 bp, Homo sapiens
attgttttcttttacagact

SEQ ID NO: 5376395 - DNA, 19 bp, Homo sapiens
attgttttctttttctacc

SEQ ID NO: 5376396 - DNA, 17 bp, Homo sapiens
attgttttgaatattac

SEQ ID NO: 5376397 - DNA, 13 bp, Homo sapiens
attgttttgcaaa

SEQ ID NO: 5376398 - DNA, 15 bp, Homo sapiens
attgttttgcattgt

SEQ ID NO: 5376399 - DNA, 19 bp, Homo sapiens
attgttttgcattgtctgt

SEQ ID NO: 5376400 - DNA, 13 bp, Homo sapiens
attgttttggaat

SEQ ID NO: 5376401 - DNA, 16 bp, Homo sapiens
attgttttggaataaa

SEQ ID NO: 5376402 - DNA, 13 bp, Homo sapiens
attgttttgttaa

SEQ ID NO: 5376403 - DNA, 21 bp, Homo sapiens
attgttttgttaacaatggca

SEQ ID NO: 5376404 - DNA, 15 bp, Homo sapiens
attgtttttaaacct

SEQ ID NO: 5376405 - DNA, 20 bp, Homo sapiens
attgtttttaagaaaaacat

SEQ ID NO: 5376406 - DNA, 21 bp, Homo sapiens
attgtttttaatttgaatcag

SEQ ID NO: 5376407 - DNA, 16 bp, Homo sapiens
attgtttttagaaatt

SEQ ID NO: 5376408 - DNA, 19 bp, Homo sapiens
attgtttttatatattata

SEQ ID NO: 5376409 - DNA, 23 bp, Homo sapiens
attgtttttatatattataagtt

SEQ ID NO: 5376410 - DNA, 18 bp, Homo sapiens
attgtttttattctgtat

SEQ ID NO: 5376411 - DNA, 14 bp, Homo sapiens
attgtttttctttc

SEQ ID NO: 5376412 - DNA, 16 bp, Homo sapiens
attgtttttgaattta

SEQ ID NO: 5376413 - DNA, 19 bp, Homo sapiens
attgtttttgaatttaaat

SEQ ID NO: 5376414 - DNA, 22 bp, Homo sapiens
attgtttttgaatttaaataaa

SEQ ID NO: 5376415 - DNA, 15 bp, Homo sapiens
attgtttttgtatat

SEQ ID NO: 5376416 - DNA, 15 bp, Homo sapiens
attgtttttgtattt

SEQ ID NO: 5376417 - DNA, 15 bp, Homo sapiens
attgttttttaaaga

SEQ ID NO: 5376418 - DNA, 16 bp, Homo sapiens
attgttttttaaagaa

SEQ ID NO: 5376419 - DNA, 16 bp, Homo sapiens
attgttttttaaagca

SEQ ID NO: 5376420 - DNA, 20 bp, Homo sapiens
attgttttttcctaaggaaa

SEQ ID NO: 5376421 - DNA, 20 bp, Homo sapiens
atttaaaaaaaaagaattct

SEQ ID NO: 5376422 - DNA, 16 bp, Homo sapiens
atttaaaaaaaagaaa

SEQ ID NO: 5376423 - DNA, 13 bp, Homo sapiens
atttaaaaaaaga

SEQ ID NO: 5376424 - DNA, 22 bp, Homo sapiens
atttaaaaaaagaaatttgatg

SEQ ID NO: 5376425 - DNA, 21 bp, Homo sapiens
atttaaaaaaatcacaaaaat

SEQ ID NO: 5376426 - DNA, 16 bp, Homo sapiens
atttaaaaaacatttt

SEQ ID NO: 5376427 - DNA, 22 bp, Homo sapiens
atttaaaaaactaaaaactaga

SEQ ID NO: 5376428 - DNA, 23 bp, Homo sapiens
atttaaaaaataaaaaaatacag

SEQ ID NO: 5376429 - DNA, 22 bp, Homo sapiens
atttaaaaaataaataaaaact

SEQ ID NO: 5376430 - DNA, 19 bp, Homo sapiens
atttaaaaaataaatataa

SEQ ID NO: 5376431 - DNA, 15 bp, Homo sapiens
atttaaaaaataact

SEQ ID NO: 5376432 - DNA, 22 bp, Homo sapiens
atttaaaaaatcccttcctgag

SEQ ID NO: 5376433 - DNA, 19 bp, Homo sapiens
atttaaaaaatgaatagta

SEQ ID NO: 5376434 - DNA, 18 bp, Homo sapiens
atttaaaaaattatggaa

SEQ ID NO: 5376435 - DNA, 15 bp, Homo sapiens
atttaaaaacacaaa

SEQ ID NO: 5376436 - DNA, 13 bp, Homo sapiens
atttaaaaacatt

SEQ ID NO: 5376437 - DNA, 15 bp, Homo sapiens
atttaaaaacttaaa

SEQ ID NO: 5376438 - DNA, 19 bp, Homo sapiens
atttaaaaacttaaatatt

SEQ ID NO: 5376439 - DNA, 14 bp, Homo sapiens
atttaaaaacttgt

SEQ ID NO: 5376440 - DNA, 15 bp, Homo sapiens
atttaaaaagcccaa

SEQ ID NO: 5376441 - DNA, 19 bp, Homo sapiens
atttaaaaagcccaacctc

SEQ ID NO: 5376442 - DNA, 18 bp, Homo sapiens
atttaaaaagctaatgac

SEQ ID NO: 5376443 - DNA, 16 bp, Homo sapiens
atttaaaaagctcttt

SEQ ID NO: 5376444 - DNA, 21 bp, Homo sapiens
atttaaaaagtgctatactaa

SEQ ID NO: 5376445 - DNA, 14 bp, Homo sapiens
atttaaaaataaag

SEQ ID NO: 5376446 - DNA, 16 bp, Homo sapiens
atttaaaaataaagct

SEQ ID NO: 5376447 - DNA, 19 bp, Homo sapiens
atttaaaaataaagctact

SEQ ID NO: 5376448 - DNA, 21 bp, Homo sapiens
atttaaaaataaagctactga

SEQ ID NO: 5376449 - DNA, 16 bp, Homo sapiens
atttaaaaataagaaa

SEQ ID NO: 5376450 - DNA, 18 bp, Homo sapiens
atttaaaaataagtcaac

SEQ ID NO: 5376451 - DNA, 23 bp, Homo sapiens
atttaaaaataagtcaacagtaa

SEQ ID NO: 5376452 - DNA, 16 bp, Homo sapiens
atttaaaaatatttca

SEQ ID NO: 5376453 - DNA, 19 bp, Homo sapiens
atttaaaaatctttcagaa

SEQ ID NO: 5376454 - DNA, 14 bp, Homo sapiens
atttaaaaatgatc

SEQ ID NO: 5376455 - DNA, 15 bp, Homo sapiens
atttaaaaatgttag

SEQ ID NO: 5376456 - DNA, 20 bp, Homo sapiens
atttaaaaattgtttcttga

SEQ ID NO: 5376457 - DNA, 12 bp, Homo sapiens
atttaaaacaaa

SEQ ID NO: 5376458 - DNA, 18 bp, Homo sapiens
atttaaaacaagacttca

SEQ ID NO: 5376459 - DNA, 14 bp, Homo sapiens
atttaaaacaagct

SEQ ID NO: 5376460 - DNA, 15 bp, Homo sapiens
atttaaaacaagctg

SEQ ID NO: 5376461 - DNA, 18 bp, Homo sapiens
atttaaaacaagctgata

SEQ ID NO: 5376462 - DNA, 20 bp, Homo sapiens
atttaaaacaagctgatagt

SEQ ID NO: 5376463 - DNA, 13 bp, Homo sapiens
atttaaaacaatc

SEQ ID NO: 5376464 - DNA, 17 bp, Homo sapiens
atttaaaacacagtatt

SEQ ID NO: 5376465 - DNA, 14 bp, Homo sapiens
atttaaaacagaca

SEQ ID NO: 5376466 - DNA, 23 bp, Homo sapiens
atttaaaacagacactggcatgg

SEQ ID NO: 5376467 - DNA, 15 bp, Homo sapiens
atttaaaacatgtaa

SEQ ID NO: 5376468 - DNA, 19 bp, Homo sapiens
atttaaaacattaaaatat

SEQ ID NO: 5376469 - DNA, 20 bp, Homo sapiens
atttaaaacattaaaatata

SEQ ID NO: 5376470 - DNA, 22 bp, Homo sapiens
atttaaaacatttcatgtattt

SEQ ID NO: 5376471 - DNA, 16 bp, Homo sapiens
atttaaaactctggtg

SEQ ID NO: 5376472 - DNA, 13 bp, Homo sapiens
atttaaaagacaa

SEQ ID NO: 5376473 - DNA, 14 bp, Homo sapiens
atttaaaagacaaa

SEQ ID NO: 5376474 - DNA, 14 bp, Homo sapiens
atttaaaagacagc

SEQ ID NO: 5376475 - DNA, 17 bp, Homo sapiens
atttaaaagacagcttt

SEQ ID NO: 5376476 - DNA, 17 bp, Homo sapiens
atttaaaagagcaggcc

SEQ ID NO: 5376477 - DNA, 13 bp, Homo sapiens
atttaaaagatac

SEQ ID NO: 5376478 - DNA, 14 bp, Homo sapiens
atttaaaagataca

SEQ ID NO: 5376479 - DNA, 16 bp, Homo sapiens
atttaaaagatacagt

SEQ ID NO: 5376480 - DNA, 17 bp, Homo sapiens
atttaaaagcagagcat

SEQ ID NO: 5376481 - DNA, 21 bp, Homo sapiens
atttaaaagcagagcattttt

SEQ ID NO: 5376482 - DNA, 14 bp, Homo sapiens
atttaaaagcctgc

SEQ ID NO: 5376483 - DNA, 15 bp, Homo sapiens
atttaaaagctccta

SEQ ID NO: 5376484 - DNA, 21 bp, Homo sapiens
atttaaaagtaaaatgtcttt

SEQ ID NO: 5376485 - DNA, 16 bp, Homo sapiens
atttaaaataattata

SEQ ID NO: 5376486 - DNA, 13 bp, Homo sapiens
atttaaaatagca

SEQ ID NO: 5376487 - DNA, 18 bp, Homo sapiens
atttaaaatagcaaaaga

SEQ ID NO: 5376488 - DNA, 14 bp, Homo sapiens
atttaaaatagttc

SEQ ID NO: 5376489 - DNA, 20 bp, Homo sapiens
atttaaaatagttccagata

SEQ ID NO: 5376490 - DNA, 14 bp, Homo sapiens
atttaaaatgatta

SEQ ID NO: 5376491 - DNA, 19 bp, Homo sapiens
atttaaaatggacttttgt

SEQ ID NO: 5376492 - DNA, 12 bp, Homo sapiens
atttaaaatgta

SEQ ID NO: 5376493 - DNA, 13 bp, Homo sapiens
atttaaaatgtag

SEQ ID NO: 5376494 - DNA, 11 bp, Homo sapiens
atttaaaatta

SEQ ID NO: 5376495 - DNA, 15 bp, Homo sapiens
atttaaaattaaatt

SEQ ID NO: 5376496 - DNA, 21 bp, Homo sapiens
atttaaaattaagtagaacaa

SEQ ID NO: 5376497 - DNA, 21 bp, Homo sapiens
atttaaaattccattatctta

SEQ ID NO: 5376498 - DNA, 22 bp, Homo sapiens
atttaaaattccattatcttat

SEQ ID NO: 5376499 - DNA, 15 bp, Homo sapiens
atttaaaattgtgat

SEQ ID NO: 5376500 - DNA, 19 bp, Homo sapiens
atttaaaattgtgatgtgt

SEQ ID NO: 5376501 - DNA, 13 bp, Homo sapiens
atttaaacaaatg

SEQ ID NO: 5376502 - DNA, 21 bp, Homo sapiens
atttaaacaaatttagaagaa

SEQ ID NO: 5376503 - DNA, 13 bp, Homo sapiens
atttaaacacaca

SEQ ID NO: 5376504 - DNA, 14 bp, Homo sapiens
atttaaacacacag

SEQ ID NO: 5376505 - DNA, 18 bp, Homo sapiens
atttaaacagatgtccat

SEQ ID NO: 5376506 - DNA, 14 bp, Homo sapiens
atttaaacagcagt

SEQ ID NO: 5376507 - DNA, 17 bp, Homo sapiens
atttaaacaggcccagc

SEQ ID NO: 5376508 - DNA, 19 bp, Homo sapiens
atttaaacatttgttcctg

SEQ ID NO: 5376509 - DNA, 20 bp, Homo sapiens
atttaaacatttgttcctgg

SEQ ID NO: 5376510 - DNA, 12 bp, Homo sapiens
atttaaaccagc

SEQ ID NO: 5376511 - DNA, 20 bp, Homo sapiens
atttaaaccagcagaaaagt

SEQ ID NO: 5376512 - DNA, 16 bp, Homo sapiens
atttaaacccaatcag

SEQ ID NO: 5376513 - DNA, 17 bp, Homo sapiens
atttaaacccattttag

SEQ ID NO: 5376514 - DNA, 18 bp, Homo sapiens
atttaaacccattttagt

SEQ ID NO: 5376515 - DNA, 20 bp, Homo sapiens
atttaaacccattttagtca

SEQ ID NO: 5376516 - DNA, 19 bp, Homo sapiens
atttaaaccgctaaaagaa

SEQ ID NO: 5376517 - DNA, 22 bp, Homo sapiens
atttaaaccgctaaaagaaact

SEQ ID NO: 5376518 - DNA, 11 bp, Homo sapiens
atttaaacctt

SEQ ID NO: 5376519 - DNA, 20 bp, Homo sapiens
atttaaaccttttattataa

SEQ ID NO: 5376520 - DNA, 15 bp, Homo sapiens
atttaaacctttttc

SEQ ID NO: 5376521 - DNA, 19 bp, Homo sapiens
atttaaacctttttcttga

SEQ ID NO: 5376522 - DNA, 23 bp, Homo sapiens
atttaaacgtgatttttaaatta

SEQ ID NO: 5376523 - DNA, 14 bp, Homo sapiens
atttaaactaaatt

SEQ ID NO: 5376524 - DNA, 21 bp, Homo sapiens
atttaaactaaattactgttt

SEQ ID NO: 5376525 - DNA, 20 bp, Homo sapiens
atttaaactaaccttttatc

SEQ ID NO: 5376526 - DNA, 19 bp, Homo sapiens
atttaaactataagcaaga

SEQ ID NO: 5376527 - DNA, 22 bp, Homo sapiens
atttaaactatgataaattatg

SEQ ID NO: 5376528 - DNA, 17 bp, Homo sapiens
atttaccataatgttcc

SEQ ID NO: 5376529 - DNA, 17 bp, Homo sapiens
atttaccatcaaacaaa

SEQ ID NO: 5376530 - DNA, 16 bp, Homo sapiens
atttaccatcatctct

SEQ ID NO: 5376531 - DNA, 19 bp, Homo sapiens
atttacccttcttttctga

SEQ ID NO: 5376532 - DNA, 14 bp, Homo sapiens
atttaccctttata

SEQ ID NO: 5376533 - DNA, 17 bp, Homo sapiens
atttacctaagattaca

SEQ ID NO: 5376534 - DNA, 13 bp, Homo sapiens
atttacctcagcc

SEQ ID NO: 5376535 - DNA, 14 bp, Homo sapiens
atttacctcagcct

SEQ ID NO: 5376536 - DNA, 15 bp, Homo sapiens
atttacctcagcctg

SEQ ID NO: 5376537 - DNA, 23 bp, Homo sapiens
atttacctccccttttctatgtt

SEQ ID NO: 5376538 - DNA, 17 bp, Homo sapiens
atttacctcgttctgct

SEQ ID NO: 5376539 - DNA, 21 bp, Homo sapiens
atttacctgcaggctgagcca

SEQ ID NO: 5376540 - DNA, 16 bp, Homo sapiens
atttacgactgaagaa

SEQ ID NO: 5376541 - DNA, 15 bp, Homo sapiens
atttacgcctgtaaa

SEQ ID NO: 5376542 - DNA, 17 bp, Homo sapiens
atttacgcctgtaaatg

SEQ ID NO: 5376543 - DNA, 17 bp, Homo sapiens
atttacgctttgattca

SEQ ID NO: 5376544 - DNA, 20 bp, Homo sapiens
atttactaaaatggactgtg

SEQ ID NO: 5376545 - DNA, 15 bp, Homo sapiens
atttactaacagtaa

SEQ ID NO: 5376546 - DNA, 15 bp, Homo sapiens
atttactaagccaca

SEQ ID NO: 5376547 - DNA, 23 bp, Homo sapiens
atttactaagccacaagaaattt

SEQ ID NO: 5376548 - DNA, 22 bp, Homo sapiens
atttactacaatatgtacattt

SEQ ID NO: 5376549 - DNA, 15 bp, Homo sapiens
atttactacagtagt

SEQ ID NO: 5376550 - DNA, 14 bp, Homo sapiens
atttactacagttt

SEQ ID NO: 5376551 - DNA, 18 bp, Homo sapiens
atttactaccttatcact

SEQ ID NO: 5376552 - DNA, 16 bp, Homo sapiens
atttactagctgtgca

SEQ ID NO: 5376553 - DNA, 15 bp, Homo sapiens
atttactatgcacaa

SEQ ID NO: 5376554 - DNA, 21 bp, Homo sapiens
atttactatgcacaacagagt

SEQ ID NO: 5376555 - DNA, 16 bp, Homo sapiens
atttactcaccatatt

SEQ ID NO: 5376556 - DNA, 21 bp, Homo sapiens
atttactcaccatatttgaat

SEQ ID NO: 5376557 - DNA, 16 bp, Homo sapiens
atttactctaaaaact

SEQ ID NO: 5376558 - DNA, 17 bp, Homo sapiens
atttactgagacttcga

SEQ ID NO: 5376559 - DNA, 15 bp, Homo sapiens
atttactgagagaag

SEQ ID NO: 5376560 - DNA, 14 bp, Homo sapiens
atttactgatgaga

SEQ ID NO: 5376561 - DNA, 19 bp, Homo sapiens
atttactgatgagagaatg

SEQ ID NO: 5376562 - DNA, 15 bp, Homo sapiens
atttactgcaatgtc

SEQ ID NO: 5376563 - DNA, 21 bp, Homo sapiens
atttactgctagtcttaagaa

SEQ ID NO: 5376564 - DNA, 21 bp, Homo sapiens
atttactgctctttattgcag

SEQ ID NO: 5376565 - DNA, 22 bp, Homo sapiens
atttactgctctttattgcaga

SEQ ID NO: 5376566 - DNA, 18 bp, Homo sapiens
atttactggaaacctgtt

SEQ ID NO: 5376567 - DNA, 14 bp, Homo sapiens
atttactggaatta

SEQ ID NO: 5376568 - DNA, 20 bp, Homo sapiens
atttactggacataacattt

SEQ ID NO: 5376569 - DNA, 20 bp, Homo sapiens
atttactgtcttaaatcagt

SEQ ID NO: 5376570 - DNA, 21 bp, Homo sapiens
atttactgtgagcttttgcct

SEQ ID NO: 5376571 - DNA, 16 bp, Homo sapiens
atttactgtttataat

SEQ ID NO: 5376572 - DNA, 21 bp, Homo sapiens
atttactgtttataataggtg

SEQ ID NO: 5376573 - DNA, 15 bp, Homo sapiens
atttacttaagtgtt

SEQ ID NO: 5376574 - DNA, 14 bp, Homo sapiens
atttacttcagtat

SEQ ID NO: 5376575 - DNA, 18 bp, Homo sapiens
atttacttctaatcttaa

SEQ ID NO: 5376576 - DNA, 19 bp, Homo sapiens
atttacttctaatcttaaa

SEQ ID NO: 5376577 - DNA, 14 bp, Homo sapiens
atttacttcttata

SEQ ID NO: 5376578 - DNA, 19 bp, Homo sapiens
atttacttcttatacattt

SEQ ID NO: 5376579 - DNA, 20 bp, Homo sapiens
atttacttcttatacatttg

SEQ ID NO: 5376580 - DNA, 13 bp, Homo sapiens
atttacttgaaag

SEQ ID NO: 5376581 - DNA, 22 bp, Homo sapiens
atttacttgccattactcaatt

SEQ ID NO: 5376582 - DNA, 19 bp, Homo sapiens
atttacttgtagaaatctg

SEQ ID NO: 5376583 - DNA, 12 bp, Homo sapiens
atttacttgttt

SEQ ID NO: 5376584 - DNA, 23 bp, Homo sapiens
atttacttgttttggatggcttg

SEQ ID NO: 5376585 - DNA, 14 bp, Homo sapiens
atttactttaaaaa

SEQ ID NO: 5376586 - DNA, 17 bp, Homo sapiens
atttactttaaaaagaa

SEQ ID NO: 5376587 - DNA, 14 bp, Homo sapiens
atttactttcttca

SEQ ID NO: 5376588 - DNA, 14 bp, Homo sapiens
atttactttgtaca

SEQ ID NO: 5376589 - DNA, 12 bp, Homo sapiens
atttacttttaa

SEQ ID NO: 5376590 - DNA, 13 bp, Homo sapiens
atttacttttaat

SEQ ID NO: 5376591 - DNA, 21 bp, Homo sapiens
atttacttttaccactattta

SEQ ID NO: 5376592 - DNA, 16 bp, Homo sapiens
atttactttttaaaaa

SEQ ID NO: 5376593 - DNA, 20 bp, Homo sapiens
atttactttttaaaaataac

SEQ ID NO: 5376594 - DNA, 21 bp, Homo sapiens
atttactttttaaaaataact

SEQ ID NO: 5376595 - DNA, 22 bp, Homo sapiens
atttagaaaaagaacatgcagt

SEQ ID NO: 5376596 - DNA, 20 bp, Homo sapiens
atttagaaaaagtcaatgta

SEQ ID NO: 5376597 - DNA, 17 bp, Homo sapiens
atttagaaaactttaaa

SEQ ID NO: 5376598 - DNA, 13 bp, Homo sapiens
atttagaaacaat

SEQ ID NO: 5376599 - DNA, 14 bp, Homo sapiens
atttagaaactgaa

SEQ ID NO: 5376600 - DNA, 17 bp, Homo sapiens
atttagaaactgatttc

SEQ ID NO: 5376601 - DNA, 23 bp, Homo sapiens
atttagaaactgatttcttcaga

SEQ ID NO: 5376602 - DNA, 18 bp, Homo sapiens
atttagaaatcaagcata

SEQ ID NO: 5376603 - DNA, 18 bp, Homo sapiens
atttagaacctaactttt

SEQ ID NO: 5376604 - DNA, 22 bp, Homo sapiens
atttagaacctgcatttaagaa

SEQ ID NO: 5376605 - DNA, 20 bp, Homo sapiens
atttagaacgagcctggaag

SEQ ID NO: 5376606 - DNA, 21 bp, Homo sapiens
atttagaacgagcctggaagc

SEQ ID NO: 5376607 - DNA, 14 bp, Homo sapiens
atttagaagaaaga

SEQ ID NO: 5376608 - DNA, 19 bp, Homo sapiens
atttagaagcagagggaca

SEQ ID NO: 5376609 - DNA, 22 bp, Homo sapiens
atttagaagccaactatgatta

SEQ ID NO: 5376610 - DNA, 23 bp, Homo sapiens
atttagaagccaactatgattat

SEQ ID NO: 5376611 - DNA, 21 bp, Homo sapiens
atttagaatggtgattttaaa

SEQ ID NO: 5376612 - DNA, 18 bp, Homo sapiens
atttagacaacctgaaat

SEQ ID NO: 5376613 - DNA, 16 bp, Homo sapiens
atttagacaagagatg

SEQ ID NO: 5376614 - DNA, 20 bp, Homo sapiens
atttagacaagagatgggaa

SEQ ID NO: 5376615 - DNA, 12 bp, Homo sapiens
atttagacacta

SEQ ID NO: 5376616 - DNA, 17 bp, Homo sapiens
atttagagatgaattaa

SEQ ID NO: 5376617 - DNA, 20 bp, Homo sapiens
atttagagcgtttggttaaa

SEQ ID NO: 5376618 - DNA, 19 bp, Homo sapiens
atttagaggtaaaagtaca

SEQ ID NO: 5376619 - DNA, 20 bp, Homo sapiens
atttagagtcaatttgctga

SEQ ID NO: 5376620 - DNA, 20 bp, Homo sapiens
atttagataacaagaataca

SEQ ID NO: 5376621 - DNA, 12 bp, Homo sapiens
atttagatattt

SEQ ID NO: 5376622 - DNA, 17 bp, Homo sapiens
atttagatattttccat

SEQ ID NO: 5376623 - DNA, 22 bp, Homo sapiens
atttagatattttccatatatt

SEQ ID NO: 5376624 - DNA, 16 bp, Homo sapiens
atttagatctcctgta

SEQ ID NO: 5376625 - DNA, 17 bp, Homo sapiens
atttagatcttatattg

SEQ ID NO: 5376626 - DNA, 13 bp, Homo sapiens
atttagatgtata

SEQ ID NO: 5376627 - DNA, 15 bp, Homo sapiens
atttagatttaatga

SEQ ID NO: 5376628 - DNA, 20 bp, Homo sapiens
atttagcaagcaactaattt

SEQ ID NO: 5376629 - DNA, 18 bp, Homo sapiens
atttagcaatgctgtgaa

SEQ ID NO: 5376630 - DNA, 21 bp, Homo sapiens
atttagcaatgctgtgaataa

SEQ ID NO: 5376631 - DNA, 14 bp, Homo sapiens
atttagcacaattt

SEQ ID NO: 5376632 - DNA, 12 bp, Homo sapiens
atttagcacagt

SEQ ID NO: 5376633 - DNA, 17 bp, Homo sapiens
atttagcacagtattta

SEQ ID NO: 5376634 - DNA, 18 bp, Homo sapiens
atttagcacagtatttaa

SEQ ID NO: 5376635 - DNA, 20 bp, Homo sapiens
atttagcacagtatttaaca

SEQ ID NO: 5376636 - DNA, 20 bp, Homo sapiens
atttagcacccttctgctgt

SEQ ID NO: 5376637 - DNA, 13 bp, Homo sapiens
atttagcactatt

SEQ ID NO: 5376638 - DNA, 17 bp, Homo sapiens
atttagcagtattgttc

SEQ ID NO: 5376639 - DNA, 13 bp, Homo sapiens
atttagcatgagt

SEQ ID NO: 5376640 - DNA, 18 bp, Homo sapiens
atttagcatgagttctgc

SEQ ID NO: 5376641 - DNA, 15 bp, Homo sapiens
atttagcatgttgtt

SEQ ID NO: 5376642 - DNA, 22 bp, Homo sapiens
atttagcattgtagtgctttga

SEQ ID NO: 5376643 - DNA, 18 bp, Homo sapiens
atttagccaccatctttg

SEQ ID NO: 5376644 - DNA, 17 bp, Homo sapiens
atttagccagaatgttt

SEQ ID NO: 5376645 - DNA, 18 bp, Homo sapiens
atttagccagaatgtttc

SEQ ID NO: 5376646 - DNA, 18 bp, Homo sapiens
atttagccagcgtttatt

SEQ ID NO: 5376647 - DNA, 14 bp, Homo sapiens
atttagcccctctc

SEQ ID NO: 5376648 - DNA, 16 bp, Homo sapiens
atttagcccctctctt

SEQ ID NO: 5376649 - DNA, 18 bp, Homo sapiens
atttagccctttaaaacg

SEQ ID NO: 5376650 - DNA, 16 bp, Homo sapiens
atttagccgggcgcgg

SEQ ID NO: 5376651 - DNA, 16 bp, Homo sapiens
atttagcctgtcctgt

SEQ ID NO: 5376652 - DNA, 18 bp, Homo sapiens
atttagctaacaaaagat

SEQ ID NO: 5376653 - DNA, 18 bp, Homo sapiens
atttagctacagcttgtt

SEQ ID NO: 5376654 - DNA, 13 bp, Homo sapiens
atttagctattta

SEQ ID NO: 5376655 - DNA, 14 bp, Homo sapiens
atttagctctgaag

SEQ ID NO: 5376656 - DNA, 22 bp, Homo sapiens
atttagctctgtggaattcagt

SEQ ID NO: 5376657 - DNA, 18 bp, Homo sapiens
atttagctgaagggcttg

SEQ ID NO: 5376658 - DNA, 17 bp, Homo sapiens
atttagctgtaaactga

SEQ ID NO: 5376659 - DNA, 18 bp, Homo sapiens
atttagctgtaaactgaa

SEQ ID NO: 5376660 - DNA, 15 bp, Homo sapiens
atttagctgtatcaa

SEQ ID NO: 5376661 - DNA, 19 bp, Homo sapiens
atttagctgtattcatata

SEQ ID NO: 5376662 - DNA, 22 bp, Homo sapiens
atttagctgtggctccctcctc

SEQ ID NO: 5376663 - DNA, 15 bp, Homo sapiens
atttagcttctttcc

SEQ ID NO: 5376664 - DNA, 14 bp, Homo sapiens
atttaggaaaatgc

SEQ ID NO: 5376665 - DNA, 12 bp, Homo sapiens
atttaggaactt

SEQ ID NO: 5376666 - DNA, 16 bp, Homo sapiens
atttaggaagttgact

SEQ ID NO: 5376667 - DNA, 12 bp, Homo sapiens
atttaggagaag

SEQ ID NO: 5376668 - DNA, 14 bp, Homo sapiens
atttaggagaagtt

SEQ ID NO: 5376669 - DNA, 15 bp, Homo sapiens
atttaggagaagttg

SEQ ID NO: 5376670 - DNA, 12 bp, Homo sapiens
atttaggagaat

SEQ ID NO: 5376671 - DNA, 21 bp, Homo sapiens
atttaggagtgtgtgacattc

SEQ ID NO: 5376672 - DNA, 20 bp, Homo sapiens
atttaggatattacaatggc

SEQ ID NO: 5376673 - DNA, 15 bp, Homo sapiens
atttaggatttgtgt

SEQ ID NO: 5376674 - DNA, 17 bp, Homo sapiens
atttaggatttgtgttt

SEQ ID NO: 5376675 - DNA, 22 bp, Homo sapiens
atttaggcatgagctcttggca

SEQ ID NO: 5376676 - DNA, 22 bp, Homo sapiens
atttaggccttaacacactggc

SEQ ID NO: 5376677 - DNA, 22 bp, Homo sapiens
atttaggcttttccaaatcaag

SEQ ID NO: 5376678 - DNA, 16 bp, Homo sapiens
atttagggaataatta

SEQ ID NO: 5376679 - DNA, 16 bp, Homo sapiens
atttagggagcagatg

SEQ ID NO: 5376680 - DNA, 19 bp, Homo sapiens
atttagggagtattctaat

SEQ ID NO: 5376681 - DNA, 24 bp, Homo sapiens
atttagggagtattctaataagct

SEQ ID NO: 5376682 - DNA, 15 bp, Homo sapiens
atttagggcaaggag

SEQ ID NO: 5376683 - DNA, 22 bp, Homo sapiens
atttagggcagcaaaacaagtg

SEQ ID NO: 5376684 - DNA, 19 bp, Homo sapiens
atttagggccttttctgtg

SEQ ID NO: 5376685 - DNA, 20 bp, Homo sapiens
atttagggccttttctgtgc

SEQ ID NO: 5376686 - DNA, 20 bp, Homo sapiens
atttaggggaaaaaaaagtt

SEQ ID NO: 5376687 - DNA, 19 bp, Homo sapiens
atttaggggtagaaaatgt

SEQ ID NO: 5376688 - DNA, 19 bp, Homo sapiens
atttagggtactaaattta

SEQ ID NO: 5376689 - DNA, 22 bp, Homo sapiens
atttagggtactaaatttaaat

SEQ ID NO: 5376690 - DNA, 22 bp, Homo sapiens
atttagggttctatatttactg

SEQ ID NO: 5376691 - DNA, 14 bp, Homo sapiens
atttaggtaaataa

SEQ ID NO: 5376692 - DNA, 17 bp, Homo sapiens
atttaggtaaataaagc

SEQ ID NO: 5376693 - DNA, 23 bp, Homo sapiens
atttaggtttctgagttcctgca

SEQ ID NO: 5376694 - DNA, 19 bp, Homo sapiens
atttaggtttttattagta

SEQ ID NO: 5376695 - DNA, 16 bp, Homo sapiens
atttagtaaaattatc

SEQ ID NO: 5376696 - DNA, 14 bp, Homo sapiens
atttagtaaaccaa

SEQ ID NO: 5376697 - DNA, 19 bp, Homo sapiens
atttagtaaagtttgttga

SEQ ID NO: 5376698 - DNA, 17 bp, Homo sapiens
atttagtaaataaacaa

SEQ ID NO: 5376699 - DNA, 13 bp, Homo sapiens
atttagtaaggat

SEQ ID NO: 5376700 - DNA, 19 bp, Homo sapiens
atttagtaatagcctgggt

SEQ ID NO: 5376701 - DNA, 22 bp, Homo sapiens
atttagtaatagtccaatattt

SEQ ID NO: 5376702 - DNA, 21 bp, Homo sapiens
atttagtaccctgcaggccag

SEQ ID NO: 5376703 - DNA, 14 bp, Homo sapiens
atttagtagtgtaa

SEQ ID NO: 5376704 - DNA, 18 bp, Homo sapiens
atttagtataccagagaa

SEQ ID NO: 5376705 - DNA, 15 bp, Homo sapiens
atttatttaattttc

SEQ ID NO: 5376706 - DNA, 13 bp, Homo sapiens
atttatttacaaa

SEQ ID NO: 5376707 - DNA, 15 bp, Homo sapiens
atttatttacaaatg

SEQ ID NO: 5376708 - DNA, 16 bp, Homo sapiens
atttatttacaaatgt

SEQ ID NO: 5376709 - DNA, 16 bp, Homo sapiens
atttatttacactctt

SEQ ID NO: 5376710 - DNA, 15 bp, Homo sapiens
atttatttagctatt

SEQ ID NO: 5376711 - DNA, 15 bp, Homo sapiens
atttatttatccaga

SEQ ID NO: 5376712 - DNA, 13 bp, Homo sapiens
atttatttatgaa

SEQ ID NO: 5376713 - DNA, 13 bp, Homo sapiens
atttatttatgta

SEQ ID NO: 5376714 - DNA, 15 bp, Homo sapiens
atttatttatgtact

SEQ ID NO: 5376715 - DNA, 18 bp, Homo sapiens
atttatttatgtactttt

SEQ ID NO: 5376716 - DNA, 16 bp, Homo sapiens
atttatttatgtgcaa

SEQ ID NO: 5376717 - DNA, 15 bp, Homo sapiens
atttatttatgttct

SEQ ID NO: 5376718 - DNA, 14 bp, Homo sapiens
atttatttattact

SEQ ID NO: 5376719 - DNA, 13 bp, Homo sapiens
atttatttattca

SEQ ID NO: 5376720 - DNA, 16 bp, Homo sapiens
atttatttattcatgt

SEQ ID NO: 5376721 - DNA, 13 bp, Homo sapiens
atttatttattga

SEQ ID NO: 5376722 - DNA, 13 bp, Homo sapiens
atttatttattgt

SEQ ID NO: 5376723 - DNA, 14 bp, Homo sapiens
atttatttatttat

SEQ ID NO: 5376724 - DNA, 14 bp, Homo sapiens
atttatttatttgt

SEQ ID NO: 5376725 - DNA, 15 bp, Homo sapiens
atttatttatttgtt

SEQ ID NO: 5376726 - DNA, 18 bp, Homo sapiens
atttatttcaataaatct

SEQ ID NO: 5376727 - DNA, 14 bp, Homo sapiens
atttatttcagatg

SEQ ID NO: 5376728 - DNA, 19 bp, Homo sapiens
atttatttcagcatggact

SEQ ID NO: 5376729 - DNA, 16 bp, Homo sapiens
atttatttcatccagt

SEQ ID NO: 5376730 - DNA, 15 bp, Homo sapiens
atttatttcatttac

SEQ ID NO: 5376731 - DNA, 17 bp, Homo sapiens
atttatttccaaaatgt

SEQ ID NO: 5376732 - DNA, 20 bp, Homo sapiens
atttatttccactaaaaata

SEQ ID NO: 5376733 - DNA, 22 bp, Homo sapiens
atttatttccactaaaaatatt

SEQ ID NO: 5376734 - DNA, 13 bp, Homo sapiens
atttatttccaga

SEQ ID NO: 5376735 - DNA, 14 bp, Homo sapiens
atttatttccagag

SEQ ID NO: 5376736 - DNA, 14 bp, Homo sapiens
atttatttccatat

SEQ ID NO: 5376737 - DNA, 23 bp, Homo sapiens
atttatttcctagttctgtagaa

SEQ ID NO: 5376738 - DNA, 12 bp, Homo sapiens
atttatttcctg

SEQ ID NO: 5376739 - DNA, 14 bp, Homo sapiens
atttatttcctgct

SEQ ID NO: 5376740 - DNA, 15 bp, Homo sapiens
atttatttcctgcta

SEQ ID NO: 5376741 - DNA, 12 bp, Homo sapiens
atttatttctag

SEQ ID NO: 5376742 - DNA, 22 bp, Homo sapiens
atttatttctagttctttcctc

SEQ ID NO: 5376743 - DNA, 13 bp, Homo sapiens
atttatttgaggt

SEQ ID NO: 5376744 - DNA, 20 bp, Homo sapiens
atttatttgattaggtatgt

SEQ ID NO: 5376745 - DNA, 15 bp, Homo sapiens
atttatttgtttgat

SEQ ID NO: 5376746 - DNA, 14 bp, Homo sapiens
atttattttaataa

SEQ ID NO: 5376747 - DNA, 19 bp, Homo sapiens
atttattttaataatgttt

SEQ ID NO: 5376748 - DNA, 20 bp, Homo sapiens
atttattttaataatgtttc

SEQ ID NO: 5376749 - DNA, 13 bp, Homo sapiens
atttattttacat

SEQ ID NO: 5376750 - DNA, 15 bp, Homo sapiens
atttattttacattt

SEQ ID NO: 5376751 - DNA, 19 bp, Homo sapiens
atttattttacatttagag

SEQ ID NO: 5376752 - DNA, 14 bp, Homo sapiens
atttattttagcaa

SEQ ID NO: 5376753 - DNA, 12 bp, Homo sapiens
atttattttatt

SEQ ID NO: 5376754 - DNA, 15 bp, Homo sapiens
atttattttattcta

SEQ ID NO: 5376755 - DNA, 16 bp, Homo sapiens
atttattttattctat

SEQ ID NO: 5376756 - DNA, 18 bp, Homo sapiens
atttattttattctatgt

SEQ ID NO: 5376757 - DNA, 19 bp, Homo sapiens
atttattttattctatgta

SEQ ID NO: 5376758 - DNA, 20 bp, Homo sapiens
atttattttattttagcagt

SEQ ID NO: 5376759 - DNA, 22 bp, Homo sapiens
atttattttcagtatactgtgt

SEQ ID NO: 5376760 - DNA, 15 bp, Homo sapiens
atttattttcctaaa

SEQ ID NO: 5376761 - DNA, 19 bp, Homo sapiens
atttattttcctaaagaga

SEQ ID NO: 5376762 - DNA, 21 bp, Homo sapiens
atttattttcttccccaagct

SEQ ID NO: 5376763 - DNA, 20 bp, Homo sapiens
atttattttgactgtgattt

SEQ ID NO: 5376764 - DNA, 15 bp, Homo sapiens
atttattttgagaag

SEQ ID NO: 5376765 - DNA, 16 bp, Homo sapiens
atttattttgctccct

SEQ ID NO: 5376766 - DNA, 20 bp, Homo sapiens
atttattttgctccctctgt

SEQ ID NO: 5376767 - DNA, 20 bp, Homo sapiens
atttattttgtaattaactg

SEQ ID NO: 5376768 - DNA, 23 bp, Homo sapiens
atttattttgtatttttgaataa

SEQ ID NO: 5376769 - DNA, 15 bp, Homo sapiens
atttattttgtgaac

SEQ ID NO: 5376770 - DNA, 23 bp, Homo sapiens
atttattttgtgaacacttttga

SEQ ID NO: 5376771 - DNA, 21 bp, Homo sapiens
atttatttttaaaataattta

SEQ ID NO: 5376772 - DNA, 18 bp, Homo sapiens
atttatttttaagaaaga

SEQ ID NO: 5376773 - DNA, 20 bp, Homo sapiens
atttatttttaagaaagaaa

SEQ ID NO: 5376774 - DNA, 14 bp, Homo sapiens
atttatttttacaa

SEQ ID NO: 5376775 - DNA, 22 bp, Homo sapiens
atttatttttcagttccaagaa

SEQ ID NO: 5376776 - DNA, 21 bp, Homo sapiens
atttatttttctcatgaatct

SEQ ID NO: 5376777 - DNA, 12 bp, Homo sapiens
atttatttttgt

SEQ ID NO: 5376778 - DNA, 15 bp, Homo sapiens
atttatttttgtact

SEQ ID NO: 5376779 - DNA, 19 bp, Homo sapiens
atttattttttaatcattt

SEQ ID NO: 5376780 - DNA, 21 bp, Homo sapiens
atttattttttaatcatttaa

SEQ ID NO: 5376781 - DNA, 14 bp, Homo sapiens
atttattttttaca

SEQ ID NO: 5376782 - DNA, 18 bp, Homo sapiens
atttattttttacattat

SEQ ID NO: 5376783 - DNA, 19 bp, Homo sapiens
atttattttttgtaactct

SEQ ID NO: 5376784 - DNA, 21 bp, Homo sapiens
atttattttttgtaactcttt

SEQ ID NO: 5376785 - DNA, 17 bp, Homo sapiens
atttattttttttaaag

SEQ ID NO: 5376786 - DNA, 18 bp, Homo sapiens
atttattttttttaaaga

SEQ ID NO: 5376787 - DNA, 14 bp, Homo sapiens
atttcaaaaaaaaa

SEQ ID NO: 5376788 - DNA, 16 bp, Homo sapiens
atttcaaaaacatgct

SEQ ID NO: 5376789 - DNA, 18 bp, Homo sapiens
atttcaaaaacatgcttt

SEQ ID NO: 5376790 - DNA, 15 bp, Homo sapiens
atttcaaaaatataa

SEQ ID NO: 5376791 - DNA, 16 bp, Homo sapiens
atttcaaaagaacatt

SEQ ID NO: 5376792 - DNA, 13 bp, Homo sapiens
atttcaaaagaca

SEQ ID NO: 5376793 - DNA, 14 bp, Homo sapiens
atttcaaaagacat

SEQ ID NO: 5376794 - DNA, 21 bp, Homo sapiens
atttcaaaagacatgttgtaa

SEQ ID NO: 5376795 - DNA, 17 bp, Homo sapiens
atttcaaaatatgtgta

SEQ ID NO: 5376796 - DNA, 14 bp, Homo sapiens
atttcaaaatctta

SEQ ID NO: 5376797 - DNA, 15 bp, Homo sapiens
atttcaaaatgattt

SEQ ID NO: 5376798 - DNA, 12 bp, Homo sapiens
atttcaaaatgc

SEQ ID NO: 5376799 - DNA, 17 bp, Homo sapiens
atttcaaaatgcatgtg

SEQ ID NO: 5376800 - DNA, 19 bp, Homo sapiens
atttcaaaatgcatgtgat

SEQ ID NO: 5376801 - DNA, 13 bp, Homo sapiens
atttcaaaatgct

SEQ ID NO: 5376802 - DNA, 11 bp, Homo sapiens
atttcaaaatt

SEQ ID NO: 5376803 - DNA, 20 bp, Homo sapiens
atttcaaaattaatagcttt

SEQ ID NO: 5376804 - DNA, 23 bp, Homo sapiens
atttcaaacatcagctgaattca

SEQ ID NO: 5376805 - DNA, 13 bp, Homo sapiens
atttcaaacattt

SEQ ID NO: 5376806 - DNA, 16 bp, Homo sapiens
atttcaaacatttgtc

SEQ ID NO: 5376807 - DNA, 21 bp, Homo sapiens
atttcaaaccattgctcttag

SEQ ID NO: 5376808 - DNA, 19 bp, Homo sapiens
atttcaaacttaaacaaaa

SEQ ID NO: 5376809 - DNA, 18 bp, Homo sapiens
atttcaaagttttgttgt

SEQ ID NO: 5376810 - DNA, 22 bp, Homo sapiens
atttcaaataaaggtacttctg

SEQ ID NO: 5376811 - DNA, 11 bp, Homo sapiens
atttcaaatgc

SEQ ID NO: 5376812 - DNA, 14 bp, Homo sapiens
atttcaaatgcaga

SEQ ID NO: 5376813 - DNA, 12 bp, Homo sapiens
atttcaaatgta

SEQ ID NO: 5376814 - DNA, 23 bp, Homo sapiens
atttcaaatgttagatattgcta

SEQ ID NO: 5376815 - DNA, 21 bp, Homo sapiens
atttcaacaagaatattgtat

SEQ ID NO: 5376816 - DNA, 18 bp, Homo sapiens
atttcaaccgcttgccat

SEQ ID NO: 5376817 - DNA, 14 bp, Homo sapiens
atttcaacttttga

SEQ ID NO: 5376818 - DNA, 23 bp, Homo sapiens
atttcaagaaaaaataaatggaa

SEQ ID NO: 5376819 - DNA, 12 bp, Homo sapiens
atttcaagaagt

SEQ ID NO: 5376820 - DNA, 18 bp, Homo sapiens
atttcaagatgttatatt

SEQ ID NO: 5376821 - DNA, 19 bp, Homo sapiens
atttcaagatgttatatta

SEQ ID NO: 5376822 - DNA, 12 bp, Homo sapiens
atttcaagctta

SEQ ID NO: 5376823 - DNA, 13 bp, Homo sapiens
atttcaaggccat

SEQ ID NO: 5376824 - DNA, 15 bp, Homo sapiens
atttcaaggttctaa

SEQ ID NO: 5376825 - DNA, 17 bp, Homo sapiens
atttcaaggttctaacc

SEQ ID NO: 5376826 - DNA, 11 bp, Homo sapiens
atttcaagtgc

SEQ ID NO: 5376827 - DNA, 14 bp, Homo sapiens
atttcaagtgccta

SEQ ID NO: 5376828 - DNA, 11 bp, Homo sapiens
atttcaagttc

SEQ ID NO: 5376829 - DNA, 17 bp, Homo sapiens
atttcaataacttagaa

SEQ ID NO: 5376830 - DNA, 23 bp, Homo sapiens
atttcaataagtgttgtaccata

SEQ ID NO: 5376831 - DNA, 16 bp, Homo sapiens
atttcaatactgctga

SEQ ID NO: 5376832 - DNA, 13 bp, Homo sapiens
atttcaatactta

SEQ ID NO: 5376833 - DNA, 23 bp, Homo sapiens
atttcaatagccccatctctcct

SEQ ID NO: 5376834 - DNA, 20 bp, Homo sapiens
atttcaatagctttgtagtt

SEQ ID NO: 5376835 - DNA, 13 bp, Homo sapiens
atttcaatcactg

SEQ ID NO: 5376836 - DNA, 16 bp, Homo sapiens
atttcaatcattgaag

SEQ ID NO: 5376837 - DNA, 22 bp, Homo sapiens
atttcaatcttttaaattgcaa

SEQ ID NO: 5376838 - DNA, 15 bp, Homo sapiens
atttcaatgcttctt

SEQ ID NO: 5376839 - DNA, 21 bp, Homo sapiens
atttcaatggtgttggcttcc

SEQ ID NO: 5376840 - DNA, 13 bp, Homo sapiens
atttcaatgtaat

SEQ ID NO: 5376841 - DNA, 19 bp, Homo sapiens
atttcaatgtccagtgagt

SEQ ID NO: 5376842 - DNA, 20 bp, Homo sapiens
atttcaatgtgtataaattg

SEQ ID NO: 5376843 - DNA, 22 bp, Homo sapiens
atttcaatgtgtataaattgtc

SEQ ID NO: 5376844 - DNA, 22 bp, Homo sapiens
atttcaattagatttaaaataa

SEQ ID NO: 5376845 - DNA, 16 bp, Homo sapiens
atttcaattgtttata

SEQ ID NO: 5376846 - DNA, 14 bp, Homo sapiens
atttcaatttcaat

SEQ ID NO: 5376847 - DNA, 21 bp, Homo sapiens
atttcaatttttaaatttctt

SEQ ID NO: 5376848 - DNA, 23 bp, Homo sapiens
atttcacaaatattaaaaagtct

SEQ ID NO: 5376849 - DNA, 15 bp, Homo sapiens
atttcacaagctatt

SEQ ID NO: 5376850 - DNA, 20 bp, Homo sapiens
atttcacaatataaagttct

SEQ ID NO: 5376851 - DNA, 13 bp, Homo sapiens
atttcacacaact

SEQ ID NO: 5376852 - DNA, 17 bp, Homo sapiens
atttcacacagtgaaac

SEQ ID NO: 5376853 - DNA, 22 bp, Homo sapiens
atttcacacagtgaaacgcaat

SEQ ID NO: 5376854 - DNA, 19 bp, Homo sapiens
atttcacacgctgttctaa

SEQ ID NO: 5376855 - DNA, 19 bp, Homo sapiens
atttcacagagcacgcctg

SEQ ID NO: 5376856 - DNA, 17 bp, Homo sapiens
atttcacagagtacaaa

SEQ ID NO: 5376857 - DNA, 14 bp, Homo sapiens
atttcacaggctgt

SEQ ID NO: 5376858 - DNA, 17 bp, Homo sapiens
atttcacaggctgtaaa

SEQ ID NO: 5376859 - DNA, 10 bp, Homo sapiens
atttcacagt

SEQ ID NO: 5376860 - DNA, 14 bp, Homo sapiens
atttcacagtattt

SEQ ID NO: 5376861 - DNA, 16 bp, Homo sapiens
atttcacagttctgta

SEQ ID NO: 5376862 - DNA, 21 bp, Homo sapiens
atttcacatgagtcaaaacaa

SEQ ID NO: 5376863 - DNA, 23 bp, Homo sapiens
atttcacatgagtcaaaacaaag

SEQ ID NO: 5376864 - DNA, 14 bp, Homo sapiens
atttcacatggact

SEQ ID NO: 5376865 - DNA, 21 bp, Homo sapiens
atttcaccactcaaaggccag

SEQ ID NO: 5376866 - DNA, 14 bp, Homo sapiens
atttcaccagcagc

SEQ ID NO: 5376867 - DNA, 23 bp, Homo sapiens
atttcaccccatccctccttaag

SEQ ID NO: 5376868 - DNA, 21 bp, Homo sapiens
atttcacctactaatgtctct

SEQ ID NO: 5376869 - DNA, 22 bp, Homo sapiens
atttcacctactaatgtctctt

SEQ ID NO: 5376870 - DNA, 18 bp, Homo sapiens
atttcacctgtaaacctg

SEQ ID NO: 5376871 - DNA, 19 bp, Homo sapiens
atttcacctgtaaacctga

SEQ ID NO: 5376872 - DNA, 19 bp, Homo sapiens
atttcacggagacagcaac

SEQ ID NO: 5376873 - DNA, 17 bp, Homo sapiens
atttcactaaatgtaaa

SEQ ID NO: 5376874 - DNA, 17 bp, Homo sapiens
atttcactaagctcctc

SEQ ID NO: 5376875 - DNA, 19 bp, Homo sapiens
atttcactaagctcctcct

SEQ ID NO: 5376876 - DNA, 18 bp, Homo sapiens
atttcactactagattga

SEQ ID NO: 5376877 - DNA, 16 bp, Homo sapiens
atttcactagagacaa

SEQ ID NO: 5376878 - DNA, 17 bp, Homo sapiens
atttcactagagacaaa

SEQ ID NO: 5376879 - DNA, 21 bp, Homo sapiens
atttcactagagacaaatctt

SEQ ID NO: 5376880 - DNA, 18 bp, Homo sapiens
atttcactatcttcttca

SEQ ID NO: 5376881 - DNA, 22 bp, Homo sapiens
atttcactgaatttcaaacatt

SEQ ID NO: 5376882 - DNA, 14 bp, Homo sapiens
atttcactggagca

SEQ ID NO: 5376883 - DNA, 16 bp, Homo sapiens
atttcactggagcaca

SEQ ID NO: 5376884 - DNA, 12 bp, Homo sapiens
atttcactgtct

SEQ ID NO: 5376885 - DNA, 20 bp, Homo sapiens
atttctgcttttgcatcttt

SEQ ID NO: 5376886 - DNA, 13 bp, Homo sapiens
atttctggaagaa

SEQ ID NO: 5376887 - DNA, 15 bp, Homo sapiens
atttctggaagaaag

SEQ ID NO: 5376888 - DNA, 17 bp, Homo sapiens
atttctggaatgcttct

SEQ ID NO: 5376889 - DNA, 15 bp, Homo sapiens
atttctggaatggaa

SEQ ID NO: 5376890 - DNA, 15 bp, Homo sapiens
atttctggcaaatat

SEQ ID NO: 5376891 - DNA, 20 bp, Homo sapiens
atttctggcaaatattttgt

SEQ ID NO: 5376892 - DNA, 16 bp, Homo sapiens
atttctggcctcagca

SEQ ID NO: 5376893 - DNA, 13 bp, Homo sapiens
atttctggcctcc

SEQ ID NO: 5376894 - DNA, 14 bp, Homo sapiens
atttctggcctcct

SEQ ID NO: 5376895 - DNA, 19 bp, Homo sapiens
atttctggctgggtcacca

SEQ ID NO: 5376896 - DNA, 18 bp, Homo sapiens
atttctgggatatttaac

SEQ ID NO: 5376897 - DNA, 16 bp, Homo sapiens
atttctgggtcttttg

SEQ ID NO: 5376898 - DNA, 16 bp, Homo sapiens
atttctggtgtatatt

SEQ ID NO: 5376899 - DNA, 17 bp, Homo sapiens
atttctggttctgatgc

SEQ ID NO: 5376900 - DNA, 16 bp, Homo sapiens
atttctgtaaatacca

SEQ ID NO: 5376901 - DNA, 17 bp, Homo sapiens
atttctgtacatttgca

SEQ ID NO: 5376902 - DNA, 19 bp, Homo sapiens
atttctgtacatttgcaat

SEQ ID NO: 5376903 - DNA, 16 bp, Homo sapiens
atttctgtagaatgct

SEQ ID NO: 5376904 - DNA, 11 bp, Homo sapiens
atttctgtata

SEQ ID NO: 5376905 - DNA, 15 bp, Homo sapiens
atttctgtatactgt

SEQ ID NO: 5376906 - DNA, 17 bp, Homo sapiens
atttctgtatatagatg

SEQ ID NO: 5376907 - DNA, 20 bp, Homo sapiens
atttctgtatatagatgtct

SEQ ID NO: 5376908 - DNA, 19 bp, Homo sapiens
atttctgtatatttgtcat

SEQ ID NO: 5376909 - DNA, 20 bp, Homo sapiens
atttctgtcacagtaaaaat

SEQ ID NO: 5376910 - DNA, 15 bp, Homo sapiens
atttctgtccagaaa

SEQ ID NO: 5376911 - DNA, 15 bp, Homo sapiens
atttctgtctactaa

SEQ ID NO: 5376912 - DNA, 14 bp, Homo sapiens
atttctgtctctaa

SEQ ID NO: 5376913 - DNA, 23 bp, Homo sapiens
atttctgtctctaaccattcaaa

SEQ ID NO: 5376914 - DNA, 19 bp, Homo sapiens
atttctgtgaagcaaaaag

SEQ ID NO: 5376915 - DNA, 16 bp, Homo sapiens
atttctgtgccctcct

SEQ ID NO: 5376916 - DNA, 23 bp, Homo sapiens
atttctgtggaaaacaatttgca

SEQ ID NO: 5376917 - DNA, 16 bp, Homo sapiens
atttctgtgtacacat

SEQ ID NO: 5376918 - DNA, 21 bp, Homo sapiens
atttctgtgtattttgagata

SEQ ID NO: 5376919 - DNA, 12 bp, Homo sapiens
atttctgtgtcc

SEQ ID NO: 5376920 - DNA, 13 bp, Homo sapiens
atttctgtgtcca

SEQ ID NO: 5376921 - DNA, 16 bp, Homo sapiens
atttctgtgtccagtt

SEQ ID NO: 5376922 - DNA, 11 bp, Homo sapiens
atttctgtgtt

SEQ ID NO: 5376923 - DNA, 15 bp, Homo sapiens
atttctgtgttgcca

SEQ ID NO: 5376924 - DNA, 14 bp, Homo sapiens
atttctgttatttt

SEQ ID NO: 5376925 - DNA, 16 bp, Homo sapiens
atttctgttccagtca

SEQ ID NO: 5376926 - DNA, 14 bp, Homo sapiens
atttctgttccttt

SEQ ID NO: 5376927 - DNA, 18 bp, Homo sapiens
atttctgttcctttttgt

SEQ ID NO: 5376928 - DNA, 18 bp, Homo sapiens
atttctgttgctggaggg

SEQ ID NO: 5376929 - DNA, 20 bp, Homo sapiens
atttctgttgctggaggggc

SEQ ID NO: 5376930 - DNA, 12 bp, Homo sapiens
atttctgtttag

SEQ ID NO: 5376931 - DNA, 14 bp, Homo sapiens
atttctgtttagat

SEQ ID NO: 5376932 - DNA, 19 bp, Homo sapiens
atttctgtttagataatac

SEQ ID NO: 5376933 - DNA, 22 bp, Homo sapiens
atttctgtttcctatttaatac

SEQ ID NO: 5376934 - DNA, 14 bp, Homo sapiens
atttctgtttctca

SEQ ID NO: 5376935 - DNA, 18 bp, Homo sapiens
atttcttaaaacacatga

SEQ ID NO: 5376936 - DNA, 21 bp, Homo sapiens
atttcttaaacaaatgtatga

SEQ ID NO: 5376937 - DNA, 23 bp, Homo sapiens
atttcttaaataatgcttcagat

SEQ ID NO: 5376938 - DNA, 22 bp, Homo sapiens
atttcttaaatctttcttcaaa

SEQ ID NO: 5376939 - DNA, 23 bp, Homo sapiens
atttcttaaatctttcttcaaat

SEQ ID NO: 5376940 - DNA, 13 bp, Homo sapiens
atttcttaaatta

SEQ ID NO: 5376941 - DNA, 13 bp, Homo sapiens
atttcttaaattt

SEQ ID NO: 5376942 - DNA, 23 bp, Homo sapiens
atttcttaacagtctccaatccc

SEQ ID NO: 5376943 - DNA, 17 bp, Homo sapiens
atttcttaacttcttgc

SEQ ID NO: 5376944 - DNA, 19 bp, Homo sapiens
atttcttaacttcttgctt

SEQ ID NO: 5376945 - DNA, 14 bp, Homo sapiens
atttcttaatgtaa

SEQ ID NO: 5376946 - DNA, 15 bp, Homo sapiens
atttcttaatgtctg

SEQ ID NO: 5376947 - DNA, 19 bp, Homo sapiens
atttcttaatgtctgtcag

SEQ ID NO: 5376948 - DNA, 20 bp, Homo sapiens
atttcttaatgtctgtcaga

SEQ ID NO: 5376949 - DNA, 22 bp, Homo sapiens
atttcttaattattataaaaat

SEQ ID NO: 5376950 - DNA, 13 bp, Homo sapiens
atttcttacaggc

SEQ ID NO: 5376951 - DNA, 18 bp, Homo sapiens
atttcttacgtacactgt

SEQ ID NO: 5376952 - DNA, 17 bp, Homo sapiens
atttcttagagattaaa

SEQ ID NO: 5376953 - DNA, 11 bp, Homo sapiens
atttcttaggg

SEQ ID NO: 5376954 - DNA, 13 bp, Homo sapiens
atttcttatactt

SEQ ID NO: 5376955 - DNA, 14 bp, Homo sapiens
atttcttatatatg

SEQ ID NO: 5376956 - DNA, 21 bp, Homo sapiens
atttcttatatatgtgaacat

SEQ ID NO: 5376957 - DNA, 16 bp, Homo sapiens
atttcttatcacataa

SEQ ID NO: 5376958 - DNA, 14 bp, Homo sapiens
atttcttatgtgac

SEQ ID NO: 5376959 - DNA, 15 bp, Homo sapiens
atttcttatttgaaa

SEQ ID NO: 5376960 - DNA, 22 bp, Homo sapiens
atttcttatttgtttggtcact

SEQ ID NO: 5376961 - DNA, 24 bp, Homo sapiens
atttcttatttgtttggtcactgc

SEQ ID NO: 5376962 - DNA, 14 bp, Homo sapiens
atttcttattttct

SEQ ID NO: 5376963 - DNA, 16 bp, Homo sapiens
atttcttcaaaatgta

SEQ ID NO: 5376964 - DNA, 20 bp, Homo sapiens
atttcttcaaaatgtatata

SEQ ID NO: 5376965 - DNA, 15 bp, Homo sapiens
atttcttcaaatctc

SEQ ID NO: 5376966 - DNA, 13 bp, Homo sapiens
atttcttcaccag

SEQ ID NO: 5376967 - DNA, 17 bp, Homo sapiens
atttcttcacttcaagc

SEQ ID NO: 5376968 - DNA, 22 bp, Homo sapiens
atttcttcaggaggagtcatgt

SEQ ID NO: 5376969 - DNA, 17 bp, Homo sapiens
atttcttcataggtaga

SEQ ID NO: 5376970 - DNA, 21 bp, Homo sapiens
atttcttccacgtaattcaat

SEQ ID NO: 5376971 - DNA, 12 bp, Homo sapiens
atttcttcccaa

SEQ ID NO: 5376972 - DNA, 13 bp, Homo sapiens
atttcttccctgc

SEQ ID NO: 5376973 - DNA, 20 bp, Homo sapiens
atttcttccctgctttgcat

SEQ ID NO: 5376974 - DNA, 18 bp, Homo sapiens
atttcttcctcactatga

SEQ ID NO: 5376975 - DNA, 14 bp, Homo sapiens
atttcttcctcagc

SEQ ID NO: 5376976 - DNA, 23 bp, Homo sapiens
atttcttccttcaaatcctgcca

SEQ ID NO: 5376977 - DNA, 16 bp, Homo sapiens
atttcttcgctgctct

SEQ ID NO: 5376978 - DNA, 23 bp, Homo sapiens
atttcttcgctgctctagctggc

SEQ ID NO: 5376979 - DNA, 21 bp, Homo sapiens
atttcttcgtgatgacatatc

SEQ ID NO: 5376980 - DNA, 18 bp, Homo sapiens
atttcttctctctgtgct

SEQ ID NO: 5376981 - DNA, 20 bp, Homo sapiens
atttcttctctctgttccct

SEQ ID NO: 5376982 - DNA, 24 bp, Homo sapiens
atttcttctctctgttcccttcct

SEQ ID NO: 5376983 - DNA, 22 bp, Homo sapiens
atttcttctcttatcctctctc

SEQ ID NO: 5376984 - DNA, 19 bp, Homo sapiens
atttcttcttcacatccat

SEQ ID NO: 5376985 - DNA, 20 bp, Homo sapiens
atttcttcttcacatccatt

SEQ ID NO: 5376986 - DNA, 18 bp, Homo sapiens
atttcttcttctaagaag

SEQ ID NO: 5376987 - DNA, 22 bp, Homo sapiens
atttcttcttctaagaagacat

SEQ ID NO: 5376988 - DNA, 19 bp, Homo sapiens
atttcttgaaaagccttgg

SEQ ID NO: 5376989 - DNA, 20 bp, Homo sapiens
atttcttgaaaagccttgga

SEQ ID NO: 5376990 - DNA, 14 bp, Homo sapiens
atttcttgaagaat

SEQ ID NO: 5376991 - DNA, 21 bp, Homo sapiens
atttcttgagttttgttttaa

SEQ ID NO: 5376992 - DNA, 19 bp, Homo sapiens
atttcttgcaatttgaagg

SEQ ID NO: 5376993 - DNA, 18 bp, Homo sapiens
atttcttgctaagctcca

SEQ ID NO: 5376994 - DNA, 11 bp, Homo sapiens
atttcttgctt

SEQ ID NO: 5376995 - DNA, 12 bp, Homo sapiens
atttcttgcttt

SEQ ID NO: 5376996 - DNA, 16 bp, Homo sapiens
atttcttggcaaattt

SEQ ID NO: 5376997 - DNA, 23 bp, Homo sapiens
atttcttggcaaattttaaaaca

SEQ ID NO: 5376998 - DNA, 17 bp, Homo sapiens
atttcttggcattggaa

SEQ ID NO: 5376999 - DNA, 22 bp, Homo sapiens
atttcttggcattggaattcta

SEQ ID NO: 5377000 - DNA, 23 bp, Homo sapiens
atttcttggcattggaattctac

SEQ ID NO: 5377001 - DNA, 13 bp, Homo sapiens
atttcttgggaaa

SEQ ID NO: 5377002 - DNA, 14 bp, Homo sapiens
atttcttgggccct

SEQ ID NO: 5377003 - DNA, 19 bp, Homo sapiens
atttcttggtaagaagccg

SEQ ID NO: 5377004 - DNA, 17 bp, Homo sapiens
atttcttggtgctttgt

SEQ ID NO: 5377005 - DNA, 16 bp, Homo sapiens
atttcttggtttatgt

SEQ ID NO: 5377006 - DNA, 13 bp, Homo sapiens
atttcttgtgttc

SEQ ID NO: 5377007 - DNA, 15 bp, Homo sapiens
atttcttgtgttctg

SEQ ID NO: 5377008 - DNA, 16 bp, Homo sapiens
atttcttgtgttctgt

SEQ ID NO: 5377009 - DNA, 17 bp, Homo sapiens
atttcttgtgttctgta

SEQ ID NO: 5377010 - DNA, 21 bp, Homo sapiens
atttcttgtgttctgtagact

SEQ ID NO: 5377011 - DNA, 13 bp, Homo sapiens
atttcttgtttgt

SEQ ID NO: 5377012 - DNA, 16 bp, Homo sapiens
atttctttaaaaaaga

SEQ ID NO: 5377013 - DNA, 17 bp, Homo sapiens
atttctttaaaaaagaa

SEQ ID NO: 5377014 - DNA, 15 bp, Homo sapiens
atttctttaaatgtg

SEQ ID NO: 5377015 - DNA, 17 bp, Homo sapiens
atttctttaaatgtgta

SEQ ID NO: 5377016 - DNA, 21 bp, Homo sapiens
atttctttaatctgttgtttg

SEQ ID NO: 5377017 - DNA, 15 bp, Homo sapiens
atttctttatataag

SEQ ID NO: 5377018 - DNA, 19 bp, Homo sapiens
atttctttatatttatcca

SEQ ID NO: 5377019 - DNA, 22 bp, Homo sapiens
atttctttatatttatccacta

SEQ ID NO: 5377020 - DNA, 16 bp, Homo sapiens
atttctttatttctgt

SEQ ID NO: 5377021 - DNA, 21 bp, Homo sapiens
atttctttattttcttctcca

SEQ ID NO: 5377022 - DNA, 14 bp, Homo sapiens
atttctttctcgaa

SEQ ID NO: 5377023 - DNA, 15 bp, Homo sapiens
atttctttgaaaaaa

SEQ ID NO: 5377024 - DNA, 20 bp, Homo sapiens
atttctttgatctggacaga

SEQ ID NO: 5377025 - DNA, 18 bp, Homo sapiens
atttctttgatttaactg

SEQ ID NO: 5377026 - DNA, 21 bp, Homo sapiens
atttctttgctgtaagatgtc

SEQ ID NO: 5377027 - DNA, 21 bp, Homo sapiens
atttcttttaaaagccccagt

SEQ ID NO: 5377028 - DNA, 15 bp, Homo sapiens
atttcttttaaaata

SEQ ID NO: 5377029 - DNA, 17 bp, Homo sapiens
atttcttttagaaaagg

SEQ ID NO: 5377030 - DNA, 20 bp, Homo sapiens
atttcttttagaaaaggcca

SEQ ID NO: 5377031 - DNA, 11 bp, Homo sapiens
atttcttttat

SEQ ID NO: 5377032 - DNA, 16 bp, Homo sapiens
atttcttttatacctt

SEQ ID NO: 5377033 - DNA, 19 bp, Homo sapiens
atttcttttatatataaaa

SEQ ID NO: 5377034 - DNA, 22 bp, Homo sapiens
atttcttttatatataaaataa

SEQ ID NO: 5377035 - DNA, 13 bp, Homo sapiens
atttcttttcctt

SEQ ID NO: 5377036 - DNA, 11 bp, Homo sapiens
atttcttttgt

SEQ ID NO: 5377037 - DNA, 15 bp, Homo sapiens
atttcttttttatgt

SEQ ID NO: 5377038 - DNA, 18 bp, Homo sapiens
atttcttttttatgtgat

SEQ ID NO: 5377039 - DNA, 16 bp, Homo sapiens
atttctttttttcctt

SEQ ID NO: 5377040 - DNA, 19 bp, Homo sapiens
atttcttttttttaataag

SEQ ID NO: 5377041 - DNA, 20 bp, Homo sapiens
atttcttttttttaataagg

SEQ ID NO: 5377042 - DNA, 14 bp, Homo sapiens
atttgaaaaaactt

SEQ ID NO: 5377043 - DNA, 16 bp, Homo sapiens
atttgaaaaaagaaga

SEQ ID NO: 5377044 - DNA, 18 bp, Homo sapiens
atttgaaaaaagaagagg

SEQ ID NO: 5377045 - DNA, 15 bp, Homo sapiens
atttgaaaaactttt

SEQ ID NO: 5377046 - DNA, 22 bp, Homo sapiens
atttgaaaacaccaagagtaca

SEQ ID NO: 5377047 - DNA, 23 bp, Homo sapiens
atttgaaaaccatattttattgt

SEQ ID NO: 5377048 - DNA, 19 bp, Homo sapiens
atttgaaaagaacagaagg

SEQ ID NO: 5377049 - DNA, 14 bp, Homo sapiens
atttgaaaagaatt

SEQ ID NO: 5377050 - DNA, 15 bp, Homo sapiens
atttgaaaagaattt

SEQ ID NO: 5377051 - DNA, 14 bp, Homo sapiens
atttgaaaatgtcc

SEQ ID NO: 5377052 - DNA, 16 bp, Homo sapiens
atttgaaaatgtcctt

SEQ ID NO: 5377053 - DNA, 18 bp, Homo sapiens
atttgaaaattaccttta

SEQ ID NO: 5377054 - DNA, 20 bp, Homo sapiens
atttgaaaattacctttaat

SEQ ID NO: 5377055 - DNA, 13 bp, Homo sapiens
atttgaaaattgt

SEQ ID NO: 5377056 - DNA, 15 bp, Homo sapiens
atttgaaaattttga

SEQ ID NO: 5377057 - DNA, 17 bp, Homo sapiens
atttgaaacattgcttt

SEQ ID NO: 5377058 - DNA, 15 bp, Homo sapiens
atttgaaagaagtca

SEQ ID NO: 5377059 - DNA, 15 bp, Homo sapiens
atttgaaaggaaaaa

SEQ ID NO: 5377060 - DNA, 10 bp, Homo sapiens
atttgaaagt

SEQ ID NO: 5377061 - DNA, 23 bp, Homo sapiens
atttgaaagtgtttttctttaat

SEQ ID NO: 5377062 - DNA, 16 bp, Homo sapiens
atttgaaataagaatt

SEQ ID NO: 5377063 - DNA, 18 bp, Homo sapiens
atttgaaataattttcaa

SEQ ID NO: 5377064 - DNA, 20 bp, Homo sapiens
atttggcagcccctgttttc

SEQ ID NO: 5377065 - DNA, 23 bp, Homo sapiens
atttggcaggatcggcttcctca

SEQ ID NO: 5377066 - DNA, 17 bp, Homo sapiens
atttggcatccctgggc

SEQ ID NO: 5377067 - DNA, 18 bp, Homo sapiens
atttggcatgcttaaata

SEQ ID NO: 5377068 - DNA, 19 bp, Homo sapiens
atttggcatgcttaaatat

SEQ ID NO: 5377069 - DNA, 18 bp, Homo sapiens
atttggcatgggacagac

SEQ ID NO: 5377070 - DNA, 15 bp, Homo sapiens
atttggccatgaaag

SEQ ID NO: 5377071 - DNA, 22 bp, Homo sapiens
atttggccgagtcagcacgtag

SEQ ID NO: 5377072 - DNA, 16 bp, Homo sapiens
atttggcctgcactaa

SEQ ID NO: 5377073 - DNA, 19 bp, Homo sapiens
atttggcctgcactaattt

SEQ ID NO: 5377074 - DNA, 15 bp, Homo sapiens
atttggctatgcctt

SEQ ID NO: 5377075 - DNA, 17 bp, Homo sapiens
atttggctatgccttca

SEQ ID NO: 5377076 - DNA, 15 bp, Homo sapiens
atttggctcgctgtg

SEQ ID NO: 5377077 - DNA, 15 bp, Homo sapiens
atttggcttcctctg

SEQ ID NO: 5377078 - DNA, 20 bp, Homo sapiens
atttggcttgctgtttactc

SEQ ID NO: 5377079 - DNA, 16 bp, Homo sapiens
atttggcttgttttat

SEQ ID NO: 5377080 - DNA, 19 bp, Homo sapiens
atttgggaaacttgtcact

SEQ ID NO: 5377081 - DNA, 18 bp, Homo sapiens
atttgggaagtgaagact

SEQ ID NO: 5377082 - DNA, 15 bp, Homo sapiens
atttgggactgtctt

SEQ ID NO: 5377083 - DNA, 16 bp, Homo sapiens
atttgggatggagaag

SEQ ID NO: 5377084 - DNA, 18 bp, Homo sapiens
atttgggctctgaaataa

SEQ ID NO: 5377085 - DNA, 19 bp, Homo sapiens
atttgggctctgaaataaa

SEQ ID NO: 5377086 - DNA, 22 bp, Homo sapiens
atttgggctctgaaataaaaat

SEQ ID NO: 5377087 - DNA, 14 bp, Homo sapiens
atttgggctctggt

SEQ ID NO: 5377088 - DNA, 17 bp, Homo sapiens
atttgggctgaatgtat

SEQ ID NO: 5377089 - DNA, 18 bp, Homo sapiens
atttgggctgaatgtatg

SEQ ID NO: 5377090 - DNA, 22 bp, Homo sapiens
atttgggctgaatgtatgtaaa

SEQ ID NO: 5377091 - DNA, 19 bp, Homo sapiens
atttggggacagattcagt

SEQ ID NO: 5377092 - DNA, 22 bp, Homo sapiens
atttggggattcagatttctct

SEQ ID NO: 5377093 - DNA, 19 bp, Homo sapiens
atttggggcatttgtaaaa

SEQ ID NO: 5377094 - DNA, 17 bp, Homo sapiens
atttgggggaggcttca

SEQ ID NO: 5377095 - DNA, 21 bp, Homo sapiens
atttgggggctcggggaggca

SEQ ID NO: 5377096 - DNA, 19 bp, Homo sapiens
atttgggggggaataagat

SEQ ID NO: 5377097 - DNA, 18 bp, Homo sapiens
atttgggggtgcaatgat

SEQ ID NO: 5377098 - DNA, 23 bp, Homo sapiens
atttggggtagctagaggaacca

SEQ ID NO: 5377099 - DNA, 21 bp, Homo sapiens
atttggggtataggtctcatc

SEQ ID NO: 5377100 - DNA, 15 bp, Homo sapiens
atttggggtatttat

SEQ ID NO: 5377101 - DNA, 22 bp, Homo sapiens
atttgggtacatggcccgcagt

SEQ ID NO: 5377102 - DNA, 19 bp, Homo sapiens
atttgggtattttgtcagt

SEQ ID NO: 5377103 - DNA, 14 bp, Homo sapiens
atttgggtgggagt

SEQ ID NO: 5377104 - DNA, 17 bp, Homo sapiens
atttgggttctgcctgc

SEQ ID NO: 5377105 - DNA, 15 bp, Homo sapiens
atttgggtttttaag

SEQ ID NO: 5377106 - DNA, 16 bp, Homo sapiens
atttgggtttttaagt

SEQ ID NO: 5377107 - DNA, 20 bp, Homo sapiens
atttggtaaaaatgctgctc

SEQ ID NO: 5377108 - DNA, 21 bp, Homo sapiens
atttggtaaaggtatgtaaac

SEQ ID NO: 5377109 - DNA, 23 bp, Homo sapiens
atttggtaaggggaattgaggac

SEQ ID NO: 5377110 - DNA, 15 bp, Homo sapiens
atttggtacacatgt

SEQ ID NO: 5377111 - DNA, 16 bp, Homo sapiens
atttggtacacatgtg

SEQ ID NO: 5377112 - DNA, 17 bp, Homo sapiens
atttggtacacatgtgt

SEQ ID NO: 5377113 - DNA, 17 bp, Homo sapiens
atttggtagatgacaaa

SEQ ID NO: 5377114 - DNA, 21 bp, Homo sapiens
atttggtagatgttcttttct

SEQ ID NO: 5377115 - DNA, 23 bp, Homo sapiens
atttggtatatactttgccactg

SEQ ID NO: 5377116 - DNA, 14 bp, Homo sapiens
atttggtattaaac

SEQ ID NO: 5377117 - DNA, 15 bp, Homo sapiens
atttggtcaccttcc

SEQ ID NO: 5377118 - DNA, 14 bp, Homo sapiens
atttggtcttagct

SEQ ID NO: 5377119 - DNA, 20 bp, Homo sapiens
atttggtcttagctttacat

SEQ ID NO: 5377120 - DNA, 21 bp, Homo sapiens
atttggtcttagctttacatt

SEQ ID NO: 5377121 - DNA, 20 bp, Homo sapiens
atttggtggtttcagaaatg

SEQ ID NO: 5377122 - DNA, 20 bp, Homo sapiens
atttggtgtaggtaggtctg

SEQ ID NO: 5377123 - DNA, 13 bp, Homo sapiens
atttggtgtgttc

SEQ ID NO: 5377124 - DNA, 16 bp, Homo sapiens
atttggtgttcctgga

SEQ ID NO: 5377125 - DNA, 21 bp, Homo sapiens
atttggttaagtttttttcct

SEQ ID NO: 5377126 - DNA, 21 bp, Homo sapiens
atttggttcattaattctata

SEQ ID NO: 5377127 - DNA, 14 bp, Homo sapiens
atttggttcttgac

SEQ ID NO: 5377128 - DNA, 18 bp, Homo sapiens
atttggtttagaacataa

SEQ ID NO: 5377129 - DNA, 14 bp, Homo sapiens
atttggtttctaga

SEQ ID NO: 5377130 - DNA, 16 bp, Homo sapiens
atttggtttctagatc

SEQ ID NO: 5377131 - DNA, 20 bp, Homo sapiens
atttggtttctagatcactg

SEQ ID NO: 5377132 - DNA, 23 bp, Homo sapiens
atttggtttgggatcaataggaa

SEQ ID NO: 5377133 - DNA, 19 bp, Homo sapiens
atttggttttacacaggaa

SEQ ID NO: 5377134 - DNA, 15 bp, Homo sapiens
atttggttttcacat

SEQ ID NO: 5377135 - DNA, 16 bp, Homo sapiens
atttggttttcctgta

SEQ ID NO: 5377136 - DNA, 17 bp, Homo sapiens
atttggtttttgtcttg

SEQ ID NO: 5377137 - DNA, 22 bp, Homo sapiens
atttggtttttgtcttgcattt

SEQ ID NO: 5377138 - DNA, 23 bp, Homo sapiens
atttggtttttgtcttgcatttt

SEQ ID NO: 5377139 - DNA, 14 bp, Homo sapiens
atttgtaaaaatac

SEQ ID NO: 5377140 - DNA, 20 bp, Homo sapiens
atttgtaaaaatgagacttt

SEQ ID NO: 5377141 - DNA, 21 bp, Homo sapiens
atttgtaaaaatgagtcattt

SEQ ID NO: 5377142 - DNA, 11 bp, Homo sapiens
atttgtaaaac

SEQ ID NO: 5377143 - DNA, 13 bp, Homo sapiens
atttgtaaaacat

SEQ ID NO: 5377144 - DNA, 14 bp, Homo sapiens
atttgtaaaacttc

SEQ ID NO: 5377145 - DNA, 14 bp, Homo sapiens
atttgtaaaagcta

SEQ ID NO: 5377146 - DNA, 15 bp, Homo sapiens
atttgtaaaatgaca

SEQ ID NO: 5377147 - DNA, 14 bp, Homo sapiens
atttgtaaaccatt

SEQ ID NO: 5377148 - DNA, 18 bp, Homo sapiens
atttgtaaaccattgtaa

SEQ ID NO: 5377149 - DNA, 15 bp, Homo sapiens
atttgtaaacttctg

SEQ ID NO: 5377150 - DNA, 17 bp, Homo sapiens
atttgtaaacttctgaa

SEQ ID NO: 5377151 - DNA, 18 bp, Homo sapiens
atttgtaaagctttacaa

SEQ ID NO: 5377152 - DNA, 20 bp, Homo sapiens
atttgtaaaggactatttat

SEQ ID NO: 5377153 - DNA, 22 bp, Homo sapiens
atttgtaaagttggttggataa

SEQ ID NO: 5377154 - DNA, 14 bp, Homo sapiens
atttgtaaatagct

SEQ ID NO: 5377155 - DNA, 15 bp, Homo sapiens
atttgtaaatattaa

SEQ ID NO: 5377156 - DNA, 21 bp, Homo sapiens
atttgtaaatattctatgagt

SEQ ID NO: 5377157 - DNA, 16 bp, Homo sapiens
atttgtaaatctgcca

SEQ ID NO: 5377158 - DNA, 11 bp, Homo sapiens
atttgtaaatg

SEQ ID NO: 5377159 - DNA, 19 bp, Homo sapiens
atttgtaaatttatgtgat

SEQ ID NO: 5377160 - DNA, 17 bp, Homo sapiens
atttgtaacattgtaaa

SEQ ID NO: 5377161 - DNA, 18 bp, Homo sapiens
atttgtaacattgtaaag

SEQ ID NO: 5377162 - DNA, 15 bp, Homo sapiens
atttgtaactttgca

SEQ ID NO: 5377163 - DNA, 19 bp, Homo sapiens
atttgtaactttgcatgtt

SEQ ID NO: 5377164 - DNA, 18 bp, Homo sapiens
atttgtaaggagctaaag

SEQ ID NO: 5377165 - DNA, 21 bp, Homo sapiens
atttgtaagggctctcaaaga

SEQ ID NO: 5377166 - DNA, 23 bp, Homo sapiens
atttgtaagtttatgtctaaaga

SEQ ID NO: 5377167 - DNA, 18 bp, Homo sapiens
atttgtaagtttcaggtg

SEQ ID NO: 5377168 - DNA, 16 bp, Homo sapiens
atttgtaataaaacta

SEQ ID NO: 5377169 - DNA, 14 bp, Homo sapiens
atttgtaataaagt

SEQ ID NO: 5377170 - DNA, 22 bp, Homo sapiens
atttgtaatagatgtttgatag

SEQ ID NO: 5377171 - DNA, 15 bp, Homo sapiens
atttgtaatatggaa

SEQ ID NO: 5377172 - DNA, 22 bp, Homo sapiens
atttgtaatatggaaatctttt

SEQ ID NO: 5377173 - DNA, 17 bp, Homo sapiens
atttgtaatatttttgt

SEQ ID NO: 5377174 - DNA, 19 bp, Homo sapiens
atttgtaattaaaagcaaa

SEQ ID NO: 5377175 - DNA, 23 bp, Homo sapiens
atttgtaattaaaagcaaatcat

SEQ ID NO: 5377176 - DNA, 12 bp, Homo sapiens
atttgtaatttt

SEQ ID NO: 5377177 - DNA, 14 bp, Homo sapiens
atttgtaattttag

SEQ ID NO: 5377178 - DNA, 13 bp, Homo sapiens
atttgtacaaaaa

SEQ ID NO: 5377179 - DNA, 19 bp, Homo sapiens
atttgtacaaataaacctg

SEQ ID NO: 5377180 - DNA, 20 bp, Homo sapiens
atttgtacaaggtaattgtt

SEQ ID NO: 5377181 - DNA, 13 bp, Homo sapiens
atttgtacaattt

SEQ ID NO: 5377182 - DNA, 18 bp, Homo sapiens
atttgtacaattttaaag

SEQ ID NO: 5377183 - DNA, 22 bp, Homo sapiens
atttgtacaggactgtaaagat

SEQ ID NO: 5377184 - DNA, 13 bp, Homo sapiens
atttgtacagttc

SEQ ID NO: 5377185 - DNA, 15 bp, Homo sapiens
atttgtacagttcag

SEQ ID NO: 5377186 - DNA, 16 bp, Homo sapiens
atttgtacatatgtaa

SEQ ID NO: 5377187 - DNA, 14 bp, Homo sapiens
atttgtacatcttc

SEQ ID NO: 5377188 - DNA, 21 bp, Homo sapiens
atttgtaccattccttcaaat

SEQ ID NO: 5377189 - DNA, 23 bp, Homo sapiens
atttgtaccattccttcaaataa

SEQ ID NO: 5377190 - DNA, 18 bp, Homo sapiens
atttgtactacagttctt

SEQ ID NO: 5377191 - DNA, 23 bp, Homo sapiens
atttgtactattagcaagaatca

SEQ ID NO: 5377192 - DNA, 17 bp, Homo sapiens
atttgtactatttaact

SEQ ID NO: 5377193 - DNA, 19 bp, Homo sapiens
atttgtactatttaactga

SEQ ID NO: 5377194 - DNA, 22 bp, Homo sapiens
atttgtactatttaactgacta

SEQ ID NO: 5377195 - DNA, 23 bp, Homo sapiens
atttgtactgaaaaatggtaatt

SEQ ID NO: 5377196 - DNA, 11 bp, Homo sapiens
atttgtacttc

SEQ ID NO: 5377197 - DNA, 20 bp, Homo sapiens
atttgtacttcttattgcaa

SEQ ID NO: 5377198 - DNA, 18 bp, Homo sapiens
atttgtactttctgttaa

SEQ ID NO: 5377199 - DNA, 23 bp, Homo sapiens
atttgtacttttttcttaaggca

SEQ ID NO: 5377200 - DNA, 21 bp, Homo sapiens
atttgtagataccgagaatga

SEQ ID NO: 5377201 - DNA, 15 bp, Homo sapiens
atttgtagatatata

SEQ ID NO: 5377202 - DNA, 16 bp, Homo sapiens
atttgtagatatatat

SEQ ID NO: 5377203 - DNA, 22 bp, Homo sapiens
atttgtagattaggattaaaat

SEQ ID NO: 5377204 - DNA, 9 bp, Homo sapiens
atttgtagc

SEQ ID NO: 5377205 - DNA, 19 bp, Homo sapiens
atttgtagcataactgtag

SEQ ID NO: 5377206 - DNA, 21 bp, Homo sapiens
atttgtagccaaagaaatttc

SEQ ID NO: 5377207 - DNA, 22 bp, Homo sapiens
atttgtagccaaagaaatttca

SEQ ID NO: 5377208 - DNA, 23 bp, Homo sapiens
atttgtagccaaagaaatttcaa

SEQ ID NO: 5377209 - DNA, 16 bp, Homo sapiens
atttgtagctttgccc

SEQ ID NO: 5377210 - DNA, 18 bp, Homo sapiens
atttgtaggtatactatg

SEQ ID NO: 5377211 - DNA, 20 bp, Homo sapiens
atttgtaggtatactatgta

SEQ ID NO: 5377212 - DNA, 19 bp, Homo sapiens
atttgtagtggaaacattt

SEQ ID NO: 5377213 - DNA, 20 bp, Homo sapiens
atttgtataaaaattaagct

SEQ ID NO: 5377214 - DNA, 21 bp, Homo sapiens
atttgtataaaaattaagctt

SEQ ID NO: 5377215 - DNA, 14 bp, Homo sapiens
atttgtataaaatg

SEQ ID NO: 5377216 - DNA, 15 bp, Homo sapiens
atttgtataaagaaa

SEQ ID NO: 5377217 - DNA, 19 bp, Homo sapiens
atttgtataaataagcact

SEQ ID NO: 5377218 - DNA, 18 bp, Homo sapiens
atttgtataaattaaata

SEQ ID NO: 5377219 - DNA, 14 bp, Homo sapiens
atttgtatatcatg

SEQ ID NO: 5377220 - DNA, 15 bp, Homo sapiens
atttgtatatcatga

SEQ ID NO: 5377221 - DNA, 16 bp, Homo sapiens
atttgtatatgactgc

SEQ ID NO: 5377222 - DNA, 21 bp, Homo sapiens
atttgtatatgactgcatttg

SEQ ID NO: 5377223 - DNA, 21 bp, Homo sapiens
atttgtatattaaaatagcat

SEQ ID NO: 5377224 - DNA, 14 bp, Homo sapiens
atttgtatattgtg

SEQ ID NO: 5377225 - DNA, 15 bp, Homo sapiens
atttgtatcatgttt

SEQ ID NO: 5377226 - DNA, 19 bp, Homo sapiens
atttgtatctctgaagcat

SEQ ID NO: 5377227 - DNA, 21 bp, Homo sapiens
atttgtatctctgaagcatgt

SEQ ID NO: 5377228 - DNA, 22 bp, Homo sapiens
atttgtatctctgaagcatgtt

SEQ ID NO: 5377229 - DNA, 23 bp, Homo sapiens
atttgtatctctgaagcatgttt

SEQ ID NO: 5377230 - DNA, 15 bp, Homo sapiens
atttgtatgatattt

SEQ ID NO: 5377231 - DNA, 15 bp, Homo sapiens
atttgtatgctaaat

SEQ ID NO: 5377232 - DNA, 21 bp, Homo sapiens
atttgtatgtattaaactttt

SEQ ID NO: 5377233 - DNA, 16 bp, Homo sapiens
atttgtatgttgtgaa

SEQ ID NO: 5377234 - DNA, 20 bp, Homo sapiens
atttgtatgtttttctgtat

SEQ ID NO: 5377235 - DNA, 14 bp, Homo sapiens
atttgtattaaaat

SEQ ID NO: 5377236 - DNA, 13 bp, Homo sapiens
atttgtattaata

SEQ ID NO: 5377237 - DNA, 15 bp, Homo sapiens
atttgtattaataaa

SEQ ID NO: 5377238 - DNA, 22 bp, Homo sapiens
atttgtattagtaataaaacat

SEQ ID NO: 5377239 - DNA, 23 bp, Homo sapiens
atttgtattagtaataaaacatt

SEQ ID NO: 5377240 - DNA, 15 bp, Homo sapiens
atttgttttgctttt

SEQ ID NO: 5377241 - DNA, 16 bp, Homo sapiens
atttgttttggatata

SEQ ID NO: 5377242 - DNA, 16 bp, Homo sapiens
atttgtttttaaactg

SEQ ID NO: 5377243 - DNA, 19 bp, Homo sapiens
atttgtttttacctgtatt

SEQ ID NO: 5377244 - DNA, 13 bp, Homo sapiens
atttgtttttctc

SEQ ID NO: 5377245 - DNA, 14 bp, Homo sapiens
atttgtttttctca

SEQ ID NO: 5377246 - DNA, 15 bp, Homo sapiens
atttgtttttctctt

SEQ ID NO: 5377247 - DNA, 14 bp, Homo sapiens
atttgtttttgcat

SEQ ID NO: 5377248 - DNA, 16 bp, Homo sapiens
atttgtttttgcattt

SEQ ID NO: 5377249 - DNA, 20 bp, Homo sapiens
atttgtttttgtagagattt

SEQ ID NO: 5377250 - DNA, 20 bp, Homo sapiens
attttaaaaaaattcatcat

SEQ ID NO: 5377251 - DNA, 15 bp, Homo sapiens
attttaaaaaataac

SEQ ID NO: 5377252 - DNA, 17 bp, Homo sapiens
attttaaaaaataacat

SEQ ID NO: 5377253 - DNA, 22 bp, Homo sapiens
attttaaaaaataacatattct

SEQ ID NO: 5377254 - DNA, 18 bp, Homo sapiens
attttaaaaacatgagaa

SEQ ID NO: 5377255 - DNA, 21 bp, Homo sapiens
attttaaaaacatgagaaatg

SEQ ID NO: 5377256 - DNA, 19 bp, Homo sapiens
attttaaaaagaagaaaaa

SEQ ID NO: 5377257 - DNA, 19 bp, Homo sapiens
attttaaaaagatttgttt

SEQ ID NO: 5377258 - DNA, 22 bp, Homo sapiens
attttaaaaagggtaacttgtt

SEQ ID NO: 5377259 - DNA, 21 bp, Homo sapiens
attttaaaaagtcttcactct

SEQ ID NO: 5377260 - DNA, 13 bp, Homo sapiens
attttaaaaataa

SEQ ID NO: 5377261 - DNA, 18 bp, Homo sapiens
attttaaaaatacatatc

SEQ ID NO: 5377262 - DNA, 17 bp, Homo sapiens
attttaaaaatgaaatt

SEQ ID NO: 5377263 - DNA, 13 bp, Homo sapiens
attttaaaaatgg

SEQ ID NO: 5377264 - DNA, 18 bp, Homo sapiens
attttaaaacaataggat

SEQ ID NO: 5377265 - DNA, 14 bp, Homo sapiens
attttaaaacattt

SEQ ID NO: 5377266 - DNA, 13 bp, Homo sapiens
attttaaaaccat

SEQ ID NO: 5377267 - DNA, 16 bp, Homo sapiens
attttaaaagaatgat

SEQ ID NO: 5377268 - DNA, 21 bp, Homo sapiens
attttaaaagcaattatattg

SEQ ID NO: 5377269 - DNA, 22 bp, Homo sapiens
attttaaaagcatatataaaac

SEQ ID NO: 5377270 - DNA, 14 bp, Homo sapiens
attttaaaagccac

SEQ ID NO: 5377271 - DNA, 19 bp, Homo sapiens
attttaaaagccacataga

SEQ ID NO: 5377272 - DNA, 20 bp, Homo sapiens
attttaaaaggttgactcaa

SEQ ID NO: 5377273 - DNA, 22 bp, Homo sapiens
attttaaaagtctattttatta

SEQ ID NO: 5377274 - DNA, 12 bp, Homo sapiens
attttaaaagtt

SEQ ID NO: 5377275 - DNA, 16 bp, Homo sapiens
attttaaaagttttgt

SEQ ID NO: 5377276 - DNA, 19 bp, Homo sapiens
attttaaaagttttgttct

SEQ ID NO: 5377277 - DNA, 20 bp, Homo sapiens
attttaaaagttttgttctt

SEQ ID NO: 5377278 - DNA, 19 bp, Homo sapiens
attttaaaataaactttct

SEQ ID NO: 5377279 - DNA, 18 bp, Homo sapiens
attttaaaatagcgttct

SEQ ID NO: 5377280 - DNA, 16 bp, Homo sapiens
attttaaaatatatga

SEQ ID NO: 5377281 - DNA, 15 bp, Homo sapiens
attttaaaatattta

SEQ ID NO: 5377282 - DNA, 13 bp, Homo sapiens
attttaaaatcag

SEQ ID NO: 5377283 - DNA, 12 bp, Homo sapiens
attttaaaatct

SEQ ID NO: 5377284 - DNA, 19 bp, Homo sapiens
attttaaaatctgatttaa

SEQ ID NO: 5377285 - DNA, 12 bp, Homo sapiens
attttaaaatga

SEQ ID NO: 5377286 - DNA, 12 bp, Homo sapiens
attttaaaatgt

SEQ ID NO: 5377287 - DNA, 18 bp, Homo sapiens
attttaaaatgtacatgt

SEQ ID NO: 5377288 - DNA, 14 bp, Homo sapiens
attttaaaattcat

SEQ ID NO: 5377289 - DNA, 13 bp, Homo sapiens
attttaaaatttc

SEQ ID NO: 5377290 - DNA, 15 bp, Homo sapiens
attttaaaatttcat

SEQ ID NO: 5377291 - DNA, 13 bp, Homo sapiens
attttaaaatttg

SEQ ID NO: 5377292 - DNA, 14 bp, Homo sapiens
attttaaaatttgt

SEQ ID NO: 5377293 - DNA, 15 bp, Homo sapiens
attttaaacaaaata

SEQ ID NO: 5377294 - DNA, 17 bp, Homo sapiens
attttaaacaaaataga

SEQ ID NO: 5377295 - DNA, 18 bp, Homo sapiens
attttaaacaaaatttat

SEQ ID NO: 5377296 - DNA, 14 bp, Homo sapiens
attttaaacatttt

SEQ ID NO: 5377297 - DNA, 15 bp, Homo sapiens
attttaaacattttt

SEQ ID NO: 5377298 - DNA, 21 bp, Homo sapiens
attttaaaccataaaaagctg

SEQ ID NO: 5377299 - DNA, 14 bp, Homo sapiens
attttaaactagat

SEQ ID NO: 5377300 - DNA, 22 bp, Homo sapiens
attttaaagacccaacttgcca

SEQ ID NO: 5377301 - DNA, 22 bp, Homo sapiens
attttaaagctgactttgttgc

SEQ ID NO: 5377302 - DNA, 16 bp, Homo sapiens
attttaaaggataatg

SEQ ID NO: 5377303 - DNA, 19 bp, Homo sapiens
attttaaagtaatttctaa

SEQ ID NO: 5377304 - DNA, 13 bp, Homo sapiens
attttaaagtatg

SEQ ID NO: 5377305 - DNA, 16 bp, Homo sapiens
attttaaagtggttct

SEQ ID NO: 5377306 - DNA, 22 bp, Homo sapiens
attttaaagttaaacattttta

SEQ ID NO: 5377307 - DNA, 17 bp, Homo sapiens
attttaaagttcttatt

SEQ ID NO: 5377308 - DNA, 18 bp, Homo sapiens
attttaaagttcttattt

SEQ ID NO: 5377309 - DNA, 21 bp, Homo sapiens
attttaaagttcttattttag

SEQ ID NO: 5377310 - DNA, 23 bp, Homo sapiens
attttaaagttcttattttagta

SEQ ID NO: 5377311 - DNA, 16 bp, Homo sapiens
attttaaataaaagaa

SEQ ID NO: 5377312 - DNA, 21 bp, Homo sapiens
attttaaataaaagtgatcaa

SEQ ID NO: 5377313 - DNA, 14 bp, Homo sapiens
attttaaataacct

SEQ ID NO: 5377314 - DNA, 22 bp, Homo sapiens
attttaaataacctctggccct

SEQ ID NO: 5377315 - DNA, 21 bp, Homo sapiens
attttaaataatgtatttact

SEQ ID NO: 5377316 - DNA, 18 bp, Homo sapiens
attttaaatataagtaat

SEQ ID NO: 5377317 - DNA, 18 bp, Homo sapiens
attttaaatattgtcatt

SEQ ID NO: 5377318 - DNA, 10 bp, Homo sapiens
attttaaatc

SEQ ID NO: 5377319 - DNA, 14 bp, Homo sapiens
attttaaatgaaag

SEQ ID NO: 5377320 - DNA, 14 bp, Homo sapiens
attttaaatgaagg

SEQ ID NO: 5377321 - DNA, 16 bp, Homo sapiens
attttaaatgatctgt

SEQ ID NO: 5377322 - DNA, 17 bp, Homo sapiens
attttaaatgtggtttt

SEQ ID NO: 5377323 - DNA, 13 bp, Homo sapiens
attttaaatgtgt

SEQ ID NO: 5377324 - DNA, 16 bp, Homo sapiens
attttaaatgttttac

SEQ ID NO: 5377325 - DNA, 22 bp, Homo sapiens
attttaaattataacttaaaat

SEQ ID NO: 5377326 - DNA, 14 bp, Homo sapiens
attttaaattccac

SEQ ID NO: 5377327 - DNA, 13 bp, Homo sapiens
attttaaattctc

SEQ ID NO: 5377328 - DNA, 15 bp, Homo sapiens
attttaaattctcag

SEQ ID NO: 5377329 - DNA, 19 bp, Homo sapiens
attttaaattctcataagt

SEQ ID NO: 5377330 - DNA, 21 bp, Homo sapiens
attttaaatttcttttattaa

SEQ ID NO: 5377331 - DNA, 23 bp, Homo sapiens
attttaaatttcttttattaata

SEQ ID NO: 5377332 - DNA, 14 bp, Homo sapiens
attttaaattttat

SEQ ID NO: 5377333 - DNA, 19 bp, Homo sapiens
attttaaattttatgtcat

SEQ ID NO: 5377334 - DNA, 13 bp, Homo sapiens
attttaacaaaag

SEQ ID NO: 5377335 - DNA, 16 bp, Homo sapiens
attttaacaaaagcaa

SEQ ID NO: 5377336 - DNA, 11 bp, Homo sapiens
attttaacaag

SEQ ID NO: 5377337 - DNA, 14 bp, Homo sapiens
attttaacaagaag

SEQ ID NO: 5377338 - DNA, 17 bp, Homo sapiens
attttaacaagaagatg

SEQ ID NO: 5377339 - DNA, 18 bp, Homo sapiens
attttaacaagaagatga

SEQ ID NO: 5377340 - DNA, 20 bp, Homo sapiens
attttaacaagaagatgaat

SEQ ID NO: 5377341 - DNA, 21 bp, Homo sapiens
attttaacaagaagatgaatg

SEQ ID NO: 5377342 - DNA, 14 bp, Homo sapiens
attttaacaataac

SEQ ID NO: 5377343 - DNA, 16 bp, Homo sapiens
attttaacaataacta

SEQ ID NO: 5377344 - DNA, 14 bp, Homo sapiens
attttaacacacat

SEQ ID NO: 5377345 - DNA, 15 bp, Homo sapiens
attttaacacacata

SEQ ID NO: 5377346 - DNA, 11 bp, Homo sapiens
attttaacact

SEQ ID NO: 5377347 - DNA, 13 bp, Homo sapiens
attttaacacttt

SEQ ID NO: 5377348 - DNA, 16 bp, Homo sapiens
attttaacactttgta

SEQ ID NO: 5377349 - DNA, 17 bp, Homo sapiens
attttaacagacatgta

SEQ ID NO: 5377350 - DNA, 18 bp, Homo sapiens
attttaacagtacctgtg

SEQ ID NO: 5377351 - DNA, 13 bp, Homo sapiens
attttaacatagc

SEQ ID NO: 5377352 - DNA, 20 bp, Homo sapiens
attttaacatagcagctggt

SEQ ID NO: 5377353 - DNA, 21 bp, Homo sapiens
attttaacatagcagctggtt

SEQ ID NO: 5377354 - DNA, 19 bp, Homo sapiens
attttaacatgatttcaaa

SEQ ID NO: 5377355 - DNA, 13 bp, Homo sapiens
attttaacatgga

SEQ ID NO: 5377356 - DNA, 21 bp, Homo sapiens
attttaacatggaactctagg

SEQ ID NO: 5377357 - DNA, 22 bp, Homo sapiens
attttaacctatgatattttct

SEQ ID NO: 5377358 - DNA, 21 bp, Homo sapiens
attttaacctgtatactcttg

SEQ ID NO: 5377359 - DNA, 13 bp, Homo sapiens
attttaactcata

SEQ ID NO: 5377360 - DNA, 19 bp, Homo sapiens
attttaactggcatgtcat

SEQ ID NO: 5377361 - DNA, 21 bp, Homo sapiens
attttaactggcatgtcattt

SEQ ID NO: 5377362 - DNA, 17 bp, Homo sapiens
attttaacttaaatttt

SEQ ID NO: 5377363 - DNA, 20 bp, Homo sapiens
attttaacttaactgaaatg

SEQ ID NO: 5377364 - DNA, 13 bp, Homo sapiens
attttaacttaga

SEQ ID NO: 5377365 - DNA, 13 bp, Homo sapiens
attttaacttgct

SEQ ID NO: 5377366 - DNA, 14 bp, Homo sapiens
attttaagaaacag

SEQ ID NO: 5377367 - DNA, 12 bp, Homo sapiens
attttaagaaag

SEQ ID NO: 5377368 - DNA, 16 bp, Homo sapiens
attttaagaagttgct

SEQ ID NO: 5377369 - DNA, 19 bp, Homo sapiens
attttaagaagttgctgca

SEQ ID NO: 5377370 - DNA, 23 bp, Homo sapiens
attttaagaagttgctgcagatt

SEQ ID NO: 5377371 - DNA, 17 bp, Homo sapiens
attttaagatccagaaa

SEQ ID NO: 5377372 - DNA, 22 bp, Homo sapiens
attttaagcactcttaaagcaa

SEQ ID NO: 5377373 - DNA, 13 bp, Homo sapiens
attttaagcataa

SEQ ID NO: 5377374 - DNA, 15 bp, Homo sapiens
attttaagcataatt

SEQ ID NO: 5377375 - DNA, 23 bp, Homo sapiens
attttaagcattactcttgtaag

SEQ ID NO: 5377376 - DNA, 24 bp, Homo sapiens
attttaagcattactcttgtaaga

SEQ ID NO: 5377377 - DNA, 18 bp, Homo sapiens
attttaagcattcttaga

SEQ ID NO: 5377378 - DNA, 21 bp, Homo sapiens
attttaagcattcttagacta

SEQ ID NO: 5377379 - DNA, 17 bp, Homo sapiens
attttaagccttcattt

SEQ ID NO: 5377380 - DNA, 20 bp, Homo sapiens
attttaagccttcatttgca

SEQ ID NO: 5377381 - DNA, 18 bp, Homo sapiens
attttaagcctttgttga

SEQ ID NO: 5377382 - DNA, 20 bp, Homo sapiens
attttaagctaggaaaagaa

SEQ ID NO: 5377383 - DNA, 22 bp, Homo sapiens
attttaagctaggaaaagaaat

SEQ ID NO: 5377384 - DNA, 18 bp, Homo sapiens
attttaagcttgaagatt

SEQ ID NO: 5377385 - DNA, 17 bp, Homo sapiens
attttaaggaaactttt

SEQ ID NO: 5377386 - DNA, 17 bp, Homo sapiens
attttaaggatgtcact

SEQ ID NO: 5377387 - DNA, 18 bp, Homo sapiens
attttaagggggaaaact

SEQ ID NO: 5377388 - DNA, 23 bp, Homo sapiens
attttaaggtgtacgtatcattt

SEQ ID NO: 5377389 - DNA, 17 bp, Homo sapiens
attttaaggttgcacac

SEQ ID NO: 5377390 - DNA, 17 bp, Homo sapiens
attttaagtaacgtgct

SEQ ID NO: 5377391 - DNA, 16 bp, Homo sapiens
attttaagtattgcat

SEQ ID NO: 5377392 - DNA, 20 bp, Homo sapiens
attttaagtattgcatctgt

SEQ ID NO: 5377393 - DNA, 13 bp, Homo sapiens
attttaagtgctt

SEQ ID NO: 5377394 - DNA, 16 bp, Homo sapiens
attttaagtgctttgt

SEQ ID NO: 5377395 - DNA, 19 bp, Homo sapiens
attttaagtgtttaaaagc

SEQ ID NO: 5377396 - DNA, 22 bp, Homo sapiens
attttaagtgtttaaaagcaaa

SEQ ID NO: 5377397 - DNA, 15 bp, Homo sapiens
attttaagttctatc

SEQ ID NO: 5377398 - DNA, 22 bp, Homo sapiens
attttaataaactttgaataaa

SEQ ID NO: 5377399 - DNA, 13 bp, Homo sapiens
attttaataacat

SEQ ID NO: 5377400 - DNA, 13 bp, Homo sapiens
attttaataatat

SEQ ID NO: 5377401 - DNA, 17 bp, Homo sapiens
attttaatacaagtaat

SEQ ID NO: 5377402 - DNA, 14 bp, Homo sapiens
attttaatacagat

SEQ ID NO: 5377403 - DNA, 14 bp, Homo sapiens
attttaataccttt

SEQ ID NO: 5377404 - DNA, 18 bp, Homo sapiens
attttaatacctttaaat

SEQ ID NO: 5377405 - DNA, 20 bp, Homo sapiens
attttaatacctttaaatat

SEQ ID NO: 5377406 - DNA, 20 bp, Homo sapiens
attttaatagaatttttaac

SEQ ID NO: 5377407 - DNA, 22 bp, Homo sapiens
attttaatagcctgtcataggt

SEQ ID NO: 5377408 - DNA, 13 bp, Homo sapiens
attttaatagctt

SEQ ID NO: 5377409 - DNA, 12 bp, Homo sapiens
attttaatatat

SEQ ID NO: 5377410 - DNA, 12 bp, Homo sapiens
attttaatatta

SEQ ID NO: 5377411 - DNA, 13 bp, Homo sapiens
attttaatattga

SEQ ID NO: 5377412 - DNA, 15 bp, Homo sapiens
attttaatattttgt

SEQ ID NO: 5377413 - DNA, 17 bp, Homo sapiens
attttaatattttgtat

SEQ ID NO: 5377414 - DNA, 14 bp, Homo sapiens
attttaatcaaatt

SEQ ID NO: 5377415 - DNA, 18 bp, Homo sapiens
attttaatcaagttgaat

SEQ ID NO: 5377416 - DNA, 14 bp, Homo sapiens
attttaatcattat

SEQ ID NO: 5377417 - DNA, 13 bp, Homo sapiens
attttaatctaat

SEQ ID NO: 5377418 - DNA, 14 bp, Homo sapiens
attttaatgaaatc

SEQ ID NO: 5377419 - DNA, 15 bp, Homo sapiens
attttaatgaatatt

SEQ ID NO: 5377420 - DNA, 22 bp, Homo sapiens
attttcagtcccctctctctgg

SEQ ID NO: 5377421 - DNA, 23 bp, Homo sapiens
attttcagtcccctctctctggg

SEQ ID NO: 5377422 - DNA, 15 bp, Homo sapiens
attttcagtcttgta

SEQ ID NO: 5377423 - DNA, 15 bp, Homo sapiens
attttcagtgcatca

SEQ ID NO: 5377424 - DNA, 18 bp, Homo sapiens
attttcagtgcatcatta

SEQ ID NO: 5377425 - DNA, 20 bp, Homo sapiens
attttcataagtatttcaaa

SEQ ID NO: 5377426 - DNA, 14 bp, Homo sapiens
attttcataataaa

SEQ ID NO: 5377427 - DNA, 16 bp, Homo sapiens
attttcataatcagta

SEQ ID NO: 5377428 - DNA, 23 bp, Homo sapiens
attttcatagtgacctgtgtttc

SEQ ID NO: 5377429 - DNA, 21 bp, Homo sapiens
attttcatatttaaagccaaa

SEQ ID NO: 5377430 - DNA, 16 bp, Homo sapiens
attttcatcaagtagc

SEQ ID NO: 5377431 - DNA, 13 bp, Homo sapiens
attttcatcccac

SEQ ID NO: 5377432 - DNA, 21 bp, Homo sapiens
attttcatgaaaataccattt

SEQ ID NO: 5377433 - DNA, 17 bp, Homo sapiens
attttcatgtatatgtg

SEQ ID NO: 5377434 - DNA, 20 bp, Homo sapiens
attttcatgtggtactactg

SEQ ID NO: 5377435 - DNA, 11 bp, Homo sapiens
attttcatgtt

SEQ ID NO: 5377436 - DNA, 15 bp, Homo sapiens
attttcatgttgatg

SEQ ID NO: 5377437 - DNA, 19 bp, Homo sapiens
attttcattaaacttgaag

SEQ ID NO: 5377438 - DNA, 15 bp, Homo sapiens
attttcattattcct

SEQ ID NO: 5377439 - DNA, 18 bp, Homo sapiens
attttcattatttcaagg

SEQ ID NO: 5377440 - DNA, 13 bp, Homo sapiens
attttcattctga

SEQ ID NO: 5377441 - DNA, 15 bp, Homo sapiens
attttcattctgaat

SEQ ID NO: 5377442 - DNA, 18 bp, Homo sapiens
attttcattctgaatctg

SEQ ID NO: 5377443 - DNA, 20 bp, Homo sapiens
attttcattggatgcagttg

SEQ ID NO: 5377444 - DNA, 14 bp, Homo sapiens
attttcattgtgat

SEQ ID NO: 5377445 - DNA, 16 bp, Homo sapiens
attttcattgtgattt

SEQ ID NO: 5377446 - DNA, 16 bp, Homo sapiens
attttcatttctaaca

SEQ ID NO: 5377447 - DNA, 17 bp, Homo sapiens
attttcatttgtacaag

SEQ ID NO: 5377448 - DNA, 13 bp, Homo sapiens
attttcatttgtt

SEQ ID NO: 5377449 - DNA, 16 bp, Homo sapiens
attttcattttaattt

SEQ ID NO: 5377450 - DNA, 14 bp, Homo sapiens
attttcattttaca

SEQ ID NO: 5377451 - DNA, 17 bp, Homo sapiens
attttcattttctgcaa

SEQ ID NO: 5377452 - DNA, 23 bp, Homo sapiens
attttccaaaatctaaaagctgt

SEQ ID NO: 5377453 - DNA, 17 bp, Homo sapiens
attttccaacaggggct

SEQ ID NO: 5377454 - DNA, 17 bp, Homo sapiens
attttccaagtaaagtg

SEQ ID NO: 5377455 - DNA, 15 bp, Homo sapiens
attttccaagtgtgc

SEQ ID NO: 5377456 - DNA, 17 bp, Homo sapiens
attttccaagtgtgcat

SEQ ID NO: 5377457 - DNA, 13 bp, Homo sapiens
attttccaataaa

SEQ ID NO: 5377458 - DNA, 22 bp, Homo sapiens
attttccaataaaattttcaaa

SEQ ID NO: 5377459 - DNA, 20 bp, Homo sapiens
attttccacaagattcccag

SEQ ID NO: 5377460 - DNA, 19 bp, Homo sapiens
attttccacgcagttcttt

SEQ ID NO: 5377461 - DNA, 22 bp, Homo sapiens
attttccacgctgatgtttatg

SEQ ID NO: 5377462 - DNA, 20 bp, Homo sapiens
attttccagagctaggctgt

SEQ ID NO: 5377463 - DNA, 13 bp, Homo sapiens
attttccagcctt

SEQ ID NO: 5377464 - DNA, 21 bp, Homo sapiens
attttccaggcttctgctggg

SEQ ID NO: 5377465 - DNA, 17 bp, Homo sapiens
attttccataaatttgg

SEQ ID NO: 5377466 - DNA, 13 bp, Homo sapiens
attttccatatat

SEQ ID NO: 5377467 - DNA, 16 bp, Homo sapiens
attttccatatattgg

SEQ ID NO: 5377468 - DNA, 15 bp, Homo sapiens
attttccattaattt

SEQ ID NO: 5377469 - DNA, 18 bp, Homo sapiens
attttccattaatttcaa

SEQ ID NO: 5377470 - DNA, 16 bp, Homo sapiens
attttccattacatga

SEQ ID NO: 5377471 - DNA, 21 bp, Homo sapiens
attttccatttttatttcaaa

SEQ ID NO: 5377472 - DNA, 20 bp, Homo sapiens
attttcccccactactgcag

SEQ ID NO: 5377473 - DNA, 14 bp, Homo sapiens
attttccccccact

SEQ ID NO: 5377474 - DNA, 21 bp, Homo sapiens
attttcccccttgcagttatg

SEQ ID NO: 5377475 - DNA, 23 bp, Homo sapiens
attttccccgtgacattcactgg

SEQ ID NO: 5377476 - DNA, 18 bp, Homo sapiens
attttcccttcatgtttt

SEQ ID NO: 5377477 - DNA, 19 bp, Homo sapiens
attttcccttcatgtttta

SEQ ID NO: 5377478 - DNA, 16 bp, Homo sapiens
attttccgggaacttt

SEQ ID NO: 5377479 - DNA, 20 bp, Homo sapiens
attttccgggaactttgcag

SEQ ID NO: 5377480 - DNA, 16 bp, Homo sapiens
attttccgtcacttaa

SEQ ID NO: 5377481 - DNA, 21 bp, Homo sapiens
attttcctaataaagttctgt

SEQ ID NO: 5377482 - DNA, 16 bp, Homo sapiens
attttcctaatggtct

SEQ ID NO: 5377483 - DNA, 15 bp, Homo sapiens
attttcctcattttg

SEQ ID NO: 5377484 - DNA, 16 bp, Homo sapiens
attttcctccccagca

SEQ ID NO: 5377485 - DNA, 15 bp, Homo sapiens
attttcctcctctgc

SEQ ID NO: 5377486 - DNA, 16 bp, Homo sapiens
attttcctcctctgcc

SEQ ID NO: 5377487 - DNA, 20 bp, Homo sapiens
attttcctcgcctaggcctg

SEQ ID NO: 5377488 - DNA, 18 bp, Homo sapiens
attttcctctaattaaaa

SEQ ID NO: 5377489 - DNA, 19 bp, Homo sapiens
attttcctctgctttgaaa

SEQ ID NO: 5377490 - DNA, 15 bp, Homo sapiens
attttcctctggccg

SEQ ID NO: 5377491 - DNA, 18 bp, Homo sapiens
attttcctcttgtcctgg

SEQ ID NO: 5377492 - DNA, 21 bp, Homo sapiens
attttcctgaatattaatccc

SEQ ID NO: 5377493 - DNA, 12 bp, Homo sapiens
attttcctgata

SEQ ID NO: 5377494 - DNA, 11 bp, Homo sapiens
attttcctgga

SEQ ID NO: 5377495 - DNA, 19 bp, Homo sapiens
attttcctggagtgaagaa

SEQ ID NO: 5377496 - DNA, 16 bp, Homo sapiens
attttcctggatttat

SEQ ID NO: 5377497 - DNA, 20 bp, Homo sapiens
attttcctggatttatagta

SEQ ID NO: 5377498 - DNA, 12 bp, Homo sapiens
attttcctggga

SEQ ID NO: 5377499 - DNA, 23 bp, Homo sapiens
attttcctggtgccaatttcaag

SEQ ID NO: 5377500 - DNA, 22 bp, Homo sapiens
attttcctgtcctctttcagct

SEQ ID NO: 5377501 - DNA, 14 bp, Homo sapiens
attttcctgtcttc

SEQ ID NO: 5377502 - DNA, 14 bp, Homo sapiens
attttcctgtggaa

SEQ ID NO: 5377503 - DNA, 20 bp, Homo sapiens
attttcctgttcagtgagat

SEQ ID NO: 5377504 - DNA, 17 bp, Homo sapiens
attttcctgtttactga

SEQ ID NO: 5377505 - DNA, 17 bp, Homo sapiens
attttccttaatcaaac

SEQ ID NO: 5377506 - DNA, 13 bp, Homo sapiens
attttccttccat

SEQ ID NO: 5377507 - DNA, 16 bp, Homo sapiens
attttccttccatgct

SEQ ID NO: 5377508 - DNA, 16 bp, Homo sapiens
attttccttctgaagt

SEQ ID NO: 5377509 - DNA, 23 bp, Homo sapiens
attttcctttaatatgaaatttt

SEQ ID NO: 5377510 - DNA, 14 bp, Homo sapiens
attttccttttcaa

SEQ ID NO: 5377511 - DNA, 22 bp, Homo sapiens
attttcctttttcatgtaagtt

SEQ ID NO: 5377512 - DNA, 17 bp, Homo sapiens
attttcctttttcttcg

SEQ ID NO: 5377513 - DNA, 17 bp, Homo sapiens
attttccttttttatac

SEQ ID NO: 5377514 - DNA, 22 bp, Homo sapiens
attttccttttttatacacata

SEQ ID NO: 5377515 - DNA, 17 bp, Homo sapiens
attttcgggctgagaag

SEQ ID NO: 5377516 - DNA, 18 bp, Homo sapiens
attttcgtatgaaaatga

SEQ ID NO: 5377517 - DNA, 16 bp, Homo sapiens
attttctaaactgttt

SEQ ID NO: 5377518 - DNA, 16 bp, Homo sapiens
attttctaaagtactg

SEQ ID NO: 5377519 - DNA, 12 bp, Homo sapiens
attttctaaata

SEQ ID NO: 5377520 - DNA, 22 bp, Homo sapiens
attttctaagaaacatttatat

SEQ ID NO: 5377521 - DNA, 16 bp, Homo sapiens
attttctaaggaatgc

SEQ ID NO: 5377522 - DNA, 17 bp, Homo sapiens
attttctacagtacatg

SEQ ID NO: 5377523 - DNA, 17 bp, Homo sapiens
attttctaccactggtg

SEQ ID NO: 5377524 - DNA, 21 bp, Homo sapiens
attttctacctggtctctcct

SEQ ID NO: 5377525 - DNA, 21 bp, Homo sapiens
attttctacgtcatgtatttt

SEQ ID NO: 5377526 - DNA, 16 bp, Homo sapiens
attttctacgtttctt

SEQ ID NO: 5377527 - DNA, 14 bp, Homo sapiens
attttctagaatac

SEQ ID NO: 5377528 - DNA, 16 bp, Homo sapiens
attttctagactttct

SEQ ID NO: 5377529 - DNA, 18 bp, Homo sapiens
attttctagactttctgt

SEQ ID NO: 5377530 - DNA, 19 bp, Homo sapiens
attttctagactttctgtt

SEQ ID NO: 5377531 - DNA, 19 bp, Homo sapiens
attttctagatacaataaa

SEQ ID NO: 5377532 - DNA, 17 bp, Homo sapiens
attttctagtttcctgc

SEQ ID NO: 5377533 - DNA, 17 bp, Homo sapiens
attttctatatttgtaa

SEQ ID NO: 5377534 - DNA, 20 bp, Homo sapiens
attttctatatttgtaactt

SEQ ID NO: 5377535 - DNA, 21 bp, Homo sapiens
attttctatgtactagtactg

SEQ ID NO: 5377536 - DNA, 23 bp, Homo sapiens
attttctatgtactagtactgtg

SEQ ID NO: 5377537 - DNA, 23 bp, Homo sapiens
attttctcccaggaagctttgat

SEQ ID NO: 5377538 - DNA, 22 bp, Homo sapiens
attttctccctggatttttacc

SEQ ID NO: 5377539 - DNA, 17 bp, Homo sapiens
attttctcctaggagaa

SEQ ID NO: 5377540 - DNA, 15 bp, Homo sapiens
attttctcctgtggg

SEQ ID NO: 5377541 - DNA, 15 bp, Homo sapiens
attttctctaaactg

SEQ ID NO: 5377542 - DNA, 20 bp, Homo sapiens
attttctctattctttccat

SEQ ID NO: 5377543 - DNA, 17 bp, Homo sapiens
attttctctcaggtgaa

SEQ ID NO: 5377544 - DNA, 12 bp, Homo sapiens
attttctctcca

SEQ ID NO: 5377545 - DNA, 18 bp, Homo sapiens
attttctctcctcggtgg

SEQ ID NO: 5377546 - DNA, 19 bp, Homo sapiens
attttctctgatacttttt

SEQ ID NO: 5377547 - DNA, 14 bp, Homo sapiens
attttctctgtact

SEQ ID NO: 5377548 - DNA, 15 bp, Homo sapiens
attttctctttagga

SEQ ID NO: 5377549 - DNA, 15 bp, Homo sapiens
attttctgaaactaa

SEQ ID NO: 5377550 - DNA, 19 bp, Homo sapiens
attttctgaaactaatgaa

SEQ ID NO: 5377551 - DNA, 22 bp, Homo sapiens
attttctgaaagttacccactg

SEQ ID NO: 5377552 - DNA, 12 bp, Homo sapiens
attttctgaatt

SEQ ID NO: 5377553 - DNA, 19 bp, Homo sapiens
attttctgaattcataaaa

SEQ ID NO: 5377554 - DNA, 17 bp, Homo sapiens
attttctgacatgcatt

SEQ ID NO: 5377555 - DNA, 18 bp, Homo sapiens
attttctgacatgcattg

SEQ ID NO: 5377556 - DNA, 23 bp, Homo sapiens
attttctgaccaaaatgtgtttc

SEQ ID NO: 5377557 - DNA, 18 bp, Homo sapiens
attttctgatgtattaca

SEQ ID NO: 5377558 - DNA, 13 bp, Homo sapiens
attttctgcagct

SEQ ID NO: 5377559 - DNA, 15 bp, Homo sapiens
attttctgcagctgt

SEQ ID NO: 5377560 - DNA, 22 bp, Homo sapiens
attttctgcagctgtttcaaag

SEQ ID NO: 5377561 - DNA, 20 bp, Homo sapiens
attttctgccaggctcaaca

SEQ ID NO: 5377562 - DNA, 22 bp, Homo sapiens
attttctggggctcctcacata

SEQ ID NO: 5377563 - DNA, 23 bp, Homo sapiens
attttctggggctcctcacatag

SEQ ID NO: 5377564 - DNA, 17 bp, Homo sapiens
attttctgggtgaaaga

SEQ ID NO: 5377565 - DNA, 17 bp, Homo sapiens
attttctggtagataga

SEQ ID NO: 5377566 - DNA, 19 bp, Homo sapiens
attttctggtaggaatagc

SEQ ID NO: 5377567 - DNA, 13 bp, Homo sapiens
attttctgtaaag

SEQ ID NO: 5377568 - DNA, 16 bp, Homo sapiens
attttctgtaaatgaa

SEQ ID NO: 5377569 - DNA, 13 bp, Homo sapiens
attttctgtattt

SEQ ID NO: 5377570 - DNA, 12 bp, Homo sapiens
attttctgtcag

SEQ ID NO: 5377571 - DNA, 18 bp, Homo sapiens
attttctgtggatcattt

SEQ ID NO: 5377572 - DNA, 19 bp, Homo sapiens
attttctgtgggcaggcct

SEQ ID NO: 5377573 - DNA, 21 bp, Homo sapiens
attttctgtgtaagcttttaa

SEQ ID NO: 5377574 - DNA, 12 bp, Homo sapiens
attttctgtgtg

SEQ ID NO: 5377575 - DNA, 14 bp, Homo sapiens
attttctgtgtgtt

SEQ ID NO: 5377576 - DNA, 16 bp, Homo sapiens
attttctgtgtgttcc

SEQ ID NO: 5377577 - DNA, 17 bp, Homo sapiens
attttctgttcagatta

SEQ ID NO: 5377578 - DNA, 23 bp, Homo sapiens
attttcttaaaaccaatcaataa

SEQ ID NO: 5377579 - DNA, 17 bp, Homo sapiens
attttcttaaccagttg

SEQ ID NO: 5377580 - DNA, 16 bp, Homo sapiens
attttcttaatataca

SEQ ID NO: 5377581 - DNA, 15 bp, Homo sapiens
attttcttatgtaag

SEQ ID NO: 5377582 - DNA, 16 bp, Homo sapiens
attttcttatgtaagt

SEQ ID NO: 5377583 - DNA, 21 bp, Homo sapiens
attttcttattgcgctgctac

SEQ ID NO: 5377584 - DNA, 15 bp, Homo sapiens
attttcttcagaatt

SEQ ID NO: 5377585 - DNA, 14 bp, Homo sapiens
attttcttcatgca

SEQ ID NO: 5377586 - DNA, 21 bp, Homo sapiens
attttcttccaagcaaaggtg

SEQ ID NO: 5377587 - DNA, 20 bp, Homo sapiens
attttcttcccaaatcaaaa

SEQ ID NO: 5377588 - DNA, 21 bp, Homo sapiens
attttcttccccaagctttag

SEQ ID NO: 5377589 - DNA, 22 bp, Homo sapiens
attttcttccttctcagcactt

SEQ ID NO: 5377590 - DNA, 12 bp, Homo sapiens
attttcttctct

SEQ ID NO: 5377591 - DNA, 11 bp, Homo sapiens
attttcttgaa

SEQ ID NO: 5377592 - DNA, 15 bp, Homo sapiens
attttcttgaatttt

SEQ ID NO: 5377593 - DNA, 16 bp, Homo sapiens
attttcttgaattttt

SEQ ID NO: 5377594 - DNA, 19 bp, Homo sapiens
attttcttgatgactggaa

SEQ ID NO: 5377595 - DNA, 21 bp, Homo sapiens
attttcttgatgactggaatt

SEQ ID NO: 5377596 - DNA, 15 bp, Homo sapiens
attttcttgcagttt

SEQ ID NO: 5377597 - DNA, 15 bp, Homo sapiens
attttcttgcctgag

SEQ ID NO: 5377598 - DNA, 12 bp, Homo sapiens
attttgtttcaa

SEQ ID NO: 5377599 - DNA, 13 bp, Homo sapiens
attttgtttcaaa

SEQ ID NO: 5377600 - DNA, 17 bp, Homo sapiens
attttgtttcaatctct

SEQ ID NO: 5377601 - DNA, 19 bp, Homo sapiens
attttgtttcactctttcc

SEQ ID NO: 5377602 - DNA, 20 bp, Homo sapiens
attttgtttcagaattttgt

SEQ ID NO: 5377603 - DNA, 14 bp, Homo sapiens
attttgtttctgta

SEQ ID NO: 5377604 - DNA, 16 bp, Homo sapiens
attttgtttctgtata

SEQ ID NO: 5377605 - DNA, 20 bp, Homo sapiens
attttgtttcttttaaagca

SEQ ID NO: 5377606 - DNA, 14 bp, Homo sapiens
attttgtttggtat

SEQ ID NO: 5377607 - DNA, 20 bp, Homo sapiens
attttgtttggtattgtatt

SEQ ID NO: 5377608 - DNA, 14 bp, Homo sapiens
attttgtttgtaat

SEQ ID NO: 5377609 - DNA, 23 bp, Homo sapiens
attttgttttacttttttaacat

SEQ ID NO: 5377610 - DNA, 20 bp, Homo sapiens
attttgttttattttgaatg

SEQ ID NO: 5377611 - DNA, 17 bp, Homo sapiens
attttgttttgctctga

SEQ ID NO: 5377612 - DNA, 24 bp, Homo sapiens
attttgttttgctttttctgactc

SEQ ID NO: 5377613 - DNA, 16 bp, Homo sapiens
attttgttttgttgga

SEQ ID NO: 5377614 - DNA, 14 bp, Homo sapiens
attttgtttttaaa

SEQ ID NO: 5377615 - DNA, 20 bp, Homo sapiens
attttgtttttattttcaag

SEQ ID NO: 5377616 - DNA, 22 bp, Homo sapiens
attttgtttttgtcttaaaaag

SEQ ID NO: 5377617 - DNA, 16 bp, Homo sapiens
attttgttttttaagt

SEQ ID NO: 5377618 - DNA, 19 bp, Homo sapiens
attttgttttttaagtaag

SEQ ID NO: 5377619 - DNA, 17 bp, Homo sapiens
atttttaaaaaacaatt

SEQ ID NO: 5377620 - DNA, 20 bp, Homo sapiens
atttttaaaaaagtgatctt

SEQ ID NO: 5377621 - DNA, 12 bp, Homo sapiens
atttttaaaaac

SEQ ID NO: 5377622 - DNA, 15 bp, Homo sapiens
atttttaaaactttt

SEQ ID NO: 5377623 - DNA, 18 bp, Homo sapiens
atttttaaaagaaaaaaa

SEQ ID NO: 5377624 - DNA, 21 bp, Homo sapiens
atttttaaaagaaaaaaacca

SEQ ID NO: 5377625 - DNA, 15 bp, Homo sapiens
atttttaaaataaac

SEQ ID NO: 5377626 - DNA, 19 bp, Homo sapiens
atttttaaaataaactgta

SEQ ID NO: 5377627 - DNA, 22 bp, Homo sapiens
atttttaaaataaactgtaaac

SEQ ID NO: 5377628 - DNA, 14 bp, Homo sapiens
atttttaaaatgta

SEQ ID NO: 5377629 - DNA, 19 bp, Homo sapiens
atttttaaacaaaatgtag

SEQ ID NO: 5377630 - DNA, 15 bp, Homo sapiens
atttttaaacaagta

SEQ ID NO: 5377631 - DNA, 21 bp, Homo sapiens
atttttaaacttgaaatatat

SEQ ID NO: 5377632 - DNA, 13 bp, Homo sapiens
atttttaaagatc

SEQ ID NO: 5377633 - DNA, 15 bp, Homo sapiens
atttttaaagcaaat

SEQ ID NO: 5377634 - DNA, 15 bp, Homo sapiens
atttttaaagcctgg

SEQ ID NO: 5377635 - DNA, 18 bp, Homo sapiens
atttttaaagcctggctt

SEQ ID NO: 5377636 - DNA, 13 bp, Homo sapiens
atttttaaagctt

SEQ ID NO: 5377637 - DNA, 20 bp, Homo sapiens
atttttaaaggaaaaatcat

SEQ ID NO: 5377638 - DNA, 19 bp, Homo sapiens
atttttaaaggacaaacag

SEQ ID NO: 5377639 - DNA, 20 bp, Homo sapiens
atttttaaaggacaaacagt

SEQ ID NO: 5377640 - DNA, 23 bp, Homo sapiens
atttttaaaggacaaacagtgaa

SEQ ID NO: 5377641 - DNA, 19 bp, Homo sapiens
atttttaaaggtacactgg

SEQ ID NO: 5377642 - DNA, 15 bp, Homo sapiens
atttttaaagtactt

SEQ ID NO: 5377643 - DNA, 19 bp, Homo sapiens
atttttaaagtagaagagg

SEQ ID NO: 5377644 - DNA, 21 bp, Homo sapiens
atttttaaagtttaaatacca

SEQ ID NO: 5377645 - DNA, 12 bp, Homo sapiens
atttttaaataa

SEQ ID NO: 5377646 - DNA, 15 bp, Homo sapiens
atttttaaataattt

SEQ ID NO: 5377647 - DNA, 14 bp, Homo sapiens
atttttaaatcatt

SEQ ID NO: 5377648 - DNA, 17 bp, Homo sapiens
atttttaaatcatttca

SEQ ID NO: 5377649 - DNA, 18 bp, Homo sapiens
atttttaaatcatttcat

SEQ ID NO: 5377650 - DNA, 20 bp, Homo sapiens
atttttaaatgcagttacaa

SEQ ID NO: 5377651 - DNA, 15 bp, Homo sapiens
atttttaaattaaat

SEQ ID NO: 5377652 - DNA, 12 bp, Homo sapiens
atttttaaattc

SEQ ID NO: 5377653 - DNA, 14 bp, Homo sapiens
atttttaaattctg

SEQ ID NO: 5377654 - DNA, 15 bp, Homo sapiens
atttttaacaaaaaa

SEQ ID NO: 5377655 - DNA, 14 bp, Homo sapiens
atttttaacaagtc

SEQ ID NO: 5377656 - DNA, 21 bp, Homo sapiens
atttttaacaagtcatttcaa

SEQ ID NO: 5377657 - DNA, 13 bp, Homo sapiens
atttttaaccact

SEQ ID NO: 5377658 - DNA, 17 bp, Homo sapiens
atttttaacctcaaaat

SEQ ID NO: 5377659 - DNA, 13 bp, Homo sapiens
atttttaactctt

SEQ ID NO: 5377660 - DNA, 16 bp, Homo sapiens
atttttaactgcttca

SEQ ID NO: 5377661 - DNA, 12 bp, Homo sapiens
atttttaactgt

SEQ ID NO: 5377662 - DNA, 13 bp, Homo sapiens
atttttaagaact

SEQ ID NO: 5377663 - DNA, 18 bp, Homo sapiens
atttttaagataataata

SEQ ID NO: 5377664 - DNA, 21 bp, Homo sapiens
atttttaagatttccttttgt

SEQ ID NO: 5377665 - DNA, 22 bp, Homo sapiens
atttttaaggtctaatcagtga

SEQ ID NO: 5377666 - DNA, 23 bp, Homo sapiens
atttttaaggtctaatcagtgat

SEQ ID NO: 5377667 - DNA, 13 bp, Homo sapiens
atttttaagtgct

SEQ ID NO: 5377668 - DNA, 16 bp, Homo sapiens
atttttaagtgctgca

SEQ ID NO: 5377669 - DNA, 19 bp, Homo sapiens
atttttaatatatactatg

SEQ ID NO: 5377670 - DNA, 15 bp, Homo sapiens
atttttaatcatgaa

SEQ ID NO: 5377671 - DNA, 15 bp, Homo sapiens
atttttaatgacttt

SEQ ID NO: 5377672 - DNA, 11 bp, Homo sapiens
atttttaatgg

SEQ ID NO: 5377673 - DNA, 23 bp, Homo sapiens
atttttaatgggggtagcagctg

SEQ ID NO: 5377674 - DNA, 15 bp, Homo sapiens
atttttaatgtatct

SEQ ID NO: 5377675 - DNA, 22 bp, Homo sapiens
atttttaattaattgggccagc

SEQ ID NO: 5377676 - DNA, 16 bp, Homo sapiens
atttttaatttaacaa

SEQ ID NO: 5377677 - DNA, 13 bp, Homo sapiens
atttttaatttgg

SEQ ID NO: 5377678 - DNA, 20 bp, Homo sapiens
atttttacaagatccatttg

SEQ ID NO: 5377679 - DNA, 19 bp, Homo sapiens
atttttacaataaataatc

SEQ ID NO: 5377680 - DNA, 15 bp, Homo sapiens
atttttacaataatt

SEQ ID NO: 5377681 - DNA, 16 bp, Homo sapiens
atttttacagcaaaag

SEQ ID NO: 5377682 - DNA, 17 bp, Homo sapiens
atttttacagcaaaaga

SEQ ID NO: 5377683 - DNA, 14 bp, Homo sapiens
atttttacatttaa

SEQ ID NO: 5377684 - DNA, 21 bp, Homo sapiens
atttttaccccctaaggaata

SEQ ID NO: 5377685 - DNA, 19 bp, Homo sapiens
atttttaccctaatgtctt

SEQ ID NO: 5377686 - DNA, 22 bp, Homo sapiens
atttttaccctaatgtcttcat

SEQ ID NO: 5377687 - DNA, 17 bp, Homo sapiens
atttttactaaagcagt

SEQ ID NO: 5377688 - DNA, 19 bp, Homo sapiens
atttttactaaagcagtgt

SEQ ID NO: 5377689 - DNA, 19 bp, Homo sapiens
atttttactaatatatatt

SEQ ID NO: 5377690 - DNA, 21 bp, Homo sapiens
atttttactactattctgtta

SEQ ID NO: 5377691 - DNA, 15 bp, Homo sapiens
atttttactattgaa

SEQ ID NO: 5377692 - DNA, 18 bp, Homo sapiens
atttttactcagtgactg

SEQ ID NO: 5377693 - DNA, 21 bp, Homo sapiens
atttttactgctttctgaatg

SEQ ID NO: 5377694 - DNA, 16 bp, Homo sapiens
atttttagaataagaa

SEQ ID NO: 5377695 - DNA, 22 bp, Homo sapiens
atttttagaattttagaagaga

SEQ ID NO: 5377696 - DNA, 13 bp, Homo sapiens
atttttagactag

SEQ ID NO: 5377697 - DNA, 15 bp, Homo sapiens
atttttagactattt

SEQ ID NO: 5377698 - DNA, 21 bp, Homo sapiens
atttttagattggttctgttt

SEQ ID NO: 5377699 - DNA, 22 bp, Homo sapiens
atttttagattggttctgtttt

SEQ ID NO: 5377700 - DNA, 22 bp, Homo sapiens
atttttagccataattttgcat

SEQ ID NO: 5377701 - DNA, 16 bp, Homo sapiens
atttttagcctgtgtc

SEQ ID NO: 5377702 - DNA, 22 bp, Homo sapiens
atttttaggaagttttctgtag

SEQ ID NO: 5377703 - DNA, 16 bp, Homo sapiens
atttttaggcaaagat

SEQ ID NO: 5377704 - DNA, 17 bp, Homo sapiens
atttttaggcaaagata

SEQ ID NO: 5377705 - DNA, 19 bp, Homo sapiens
atttttaggtgtcttttaa

SEQ ID NO: 5377706 - DNA, 16 bp, Homo sapiens
atttttagtaaagaca

SEQ ID NO: 5377707 - DNA, 19 bp, Homo sapiens
atttttagtttaaaatctt

SEQ ID NO: 5377708 - DNA, 15 bp, Homo sapiens
atttttataaaactg

SEQ ID NO: 5377709 - DNA, 20 bp, Homo sapiens
atttttataaactaccaaat

SEQ ID NO: 5377710 - DNA, 16 bp, Homo sapiens
atttttataaatactg

SEQ ID NO: 5377711 - DNA, 16 bp, Homo sapiens
atttttataaatatgt

SEQ ID NO: 5377712 - DNA, 21 bp, Homo sapiens
atttttataaatatgtgaaaa

SEQ ID NO: 5377713 - DNA, 23 bp, Homo sapiens
atttttataaatatgtgaaaatg

SEQ ID NO: 5377714 - DNA, 18 bp, Homo sapiens
atttttataacatcttta

SEQ ID NO: 5377715 - DNA, 11 bp, Homo sapiens
atttttataat

SEQ ID NO: 5377716 - DNA, 14 bp, Homo sapiens
atttttataataat

SEQ ID NO: 5377717 - DNA, 12 bp, Homo sapiens
atttttataatg

SEQ ID NO: 5377718 - DNA, 21 bp, Homo sapiens
atttttataattaaagatgcc

SEQ ID NO: 5377719 - DNA, 20 bp, Homo sapiens
atttttatacaaacctacca

SEQ ID NO: 5377720 - DNA, 23 bp, Homo sapiens
atttttatacaagtaatttcctg

SEQ ID NO: 5377721 - DNA, 12 bp, Homo sapiens
atttttatacag

SEQ ID NO: 5377722 - DNA, 16 bp, Homo sapiens
atttttatacatatca

SEQ ID NO: 5377723 - DNA, 20 bp, Homo sapiens
atttttatacatatcagaaa

SEQ ID NO: 5377724 - DNA, 21 bp, Homo sapiens
atttttatacatatcagaaaa

SEQ ID NO: 5377725 - DNA, 16 bp, Homo sapiens
atttttatacctgttt

SEQ ID NO: 5377726 - DNA, 23 bp, Homo sapiens
atttttatacggaaaaaattgta

SEQ ID NO: 5377727 - DNA, 15 bp, Homo sapiens
atttttatactttat

SEQ ID NO: 5377728 - DNA, 21 bp, Homo sapiens
atttttatagcaacaacaatt

SEQ ID NO: 5377729 - DNA, 22 bp, Homo sapiens
atttttatataatatgaatata

SEQ ID NO: 5377730 - DNA, 14 bp, Homo sapiens
atttttatatagct

SEQ ID NO: 5377731 - DNA, 18 bp, Homo sapiens
atttttatatcagcctga

SEQ ID NO: 5377732 - DNA, 13 bp, Homo sapiens
atttttatatcat

SEQ ID NO: 5377733 - DNA, 19 bp, Homo sapiens
atttttatatcatgcaaaa

SEQ ID NO: 5377734 - DNA, 23 bp, Homo sapiens
atttttatattaaccagatatat

SEQ ID NO: 5377735 - DNA, 18 bp, Homo sapiens
atttttatattagttgct

SEQ ID NO: 5377736 - DNA, 16 bp, Homo sapiens
atttttatatttacta

SEQ ID NO: 5377737 - DNA, 16 bp, Homo sapiens
atttttatatttcctt

SEQ ID NO: 5377738 - DNA, 11 bp, Homo sapiens
atttttatcag

SEQ ID NO: 5377739 - DNA, 15 bp, Homo sapiens
atttttatcaggatt

SEQ ID NO: 5377740 - DNA, 14 bp, Homo sapiens
atttttatcatgaa

SEQ ID NO: 5377741 - DNA, 17 bp, Homo sapiens
atttttatccatttctt

SEQ ID NO: 5377742 - DNA, 15 bp, Homo sapiens
atttttatcccagga

SEQ ID NO: 5377743 - DNA, 19 bp, Homo sapiens
atttttatcccatctcact

SEQ ID NO: 5377744 - DNA, 18 bp, Homo sapiens
atttttatcccttcctgt

SEQ ID NO: 5377745 - DNA, 16 bp, Homo sapiens
atttttatctatataa

SEQ ID NO: 5377746 - DNA, 19 bp, Homo sapiens
atttttatctatataaaat

SEQ ID NO: 5377747 - DNA, 16 bp, Homo sapiens
atttttatcttacttt

SEQ ID NO: 5377748 - DNA, 15 bp, Homo sapiens
atttttatctttcgt

SEQ ID NO: 5377749 - DNA, 12 bp, Homo sapiens
atttttatgcag

SEQ ID NO: 5377750 - DNA, 15 bp, Homo sapiens
atttttatgcagaca

SEQ ID NO: 5377751 - DNA, 17 bp, Homo sapiens
atttttatgcagacagt

SEQ ID NO: 5377752 - DNA, 14 bp, Homo sapiens
atttttatggaatt

SEQ ID NO: 5377753 - DNA, 15 bp, Homo sapiens
atttttatggaattt

SEQ ID NO: 5377754 - DNA, 16 bp, Homo sapiens
atttttattaaagcat

SEQ ID NO: 5377755 - DNA, 21 bp, Homo sapiens
atttttattaaagcatttcct

SEQ ID NO: 5377756 - DNA, 19 bp, Homo sapiens
atttttattaaataaatat

SEQ ID NO: 5377757 - DNA, 17 bp, Homo sapiens
atttttattaaatgtat

SEQ ID NO: 5377758 - DNA, 18 bp, Homo sapiens
atttttattaatttgtaa

SEQ ID NO: 5377759 - DNA, 12 bp, Homo sapiens
atttttattact

SEQ ID NO: 5377760 - DNA, 20 bp, Homo sapiens
atttttattactttttttgt

SEQ ID NO: 5377761 - DNA, 14 bp, Homo sapiens
atttttattatgca

SEQ ID NO: 5377762 - DNA, 17 bp, Homo sapiens
atttttattatgcataa

SEQ ID NO: 5377763 - DNA, 11 bp, Homo sapiens
atttttattca

SEQ ID NO: 5377764 - DNA, 19 bp, Homo sapiens
atttttatttcagattttg

SEQ ID NO: 5377765 - DNA, 13 bp, Homo sapiens
atttttatttcat

SEQ ID NO: 5377766 - DNA, 18 bp, Homo sapiens
atttttatttcattcaca

SEQ ID NO: 5377767 - DNA, 16 bp, Homo sapiens
atttttatttctgact

SEQ ID NO: 5377768 - DNA, 13 bp, Homo sapiens
atttttatttctt

SEQ ID NO: 5377769 - DNA, 15 bp, Homo sapiens
atttttatttgtaaa

SEQ ID NO: 5377770 - DNA, 17 bp, Homo sapiens
atttttatttgtaaagt

SEQ ID NO: 5377771 - DNA, 17 bp, Homo sapiens
atttttattttcttatg

SEQ ID NO: 5377772 - DNA, 15 bp, Homo sapiens
atttttatttttgca

SEQ ID NO: 5377773 - DNA, 18 bp, Homo sapiens
atttttatttttgctgag

SEQ ID NO: 5377774 - DNA, 19 bp, Homo sapiens
atttttattttttagtgca

SEQ ID NO: 5377775 - DNA, 14 bp, Homo sapiens
atttttcaaagcaa

SEQ ID NO: 5377776 - DNA, 15 bp, Homo sapiens
atttttcaaagcaat

SEQ ID NO: 5377777 - DNA, 20 bp, Homo sapiens
caaaaaaaaaaaaaaagtgt

SEQ ID NO: 5377778 - DNA, 17 bp, Homo sapiens
caaaaaaaaaaatgtca

SEQ ID NO: 5377779 - DNA, 20 bp, Homo sapiens
caaaaaaaaaagaagttact

SEQ ID NO: 5377780 - DNA, 16 bp, Homo sapiens
caaaaaaaaaatataa

SEQ ID NO: 5377781 - DNA, 21 bp, Homo sapiens
caaaaaaaaaattgtttttcc

SEQ ID NO: 5377782 - DNA, 18 bp, Homo sapiens
caaaaaaaaaccatgcat

SEQ ID NO: 5377783 - DNA, 14 bp, Homo sapiens
caaaaaaaaactta

SEQ ID NO: 5377784 - DNA, 23 bp, Homo sapiens
caaaaaaaaacttaaagcaaaat

SEQ ID NO: 5377785 - DNA, 14 bp, Homo sapiens
caaaaaaaaaggct

SEQ ID NO: 5377786 - DNA, 14 bp, Homo sapiens
caaaaaaaaataca

SEQ ID NO: 5377787 - DNA, 14 bp, Homo sapiens
caaaaaaaaatttt

SEQ ID NO: 5377788 - DNA, 22 bp, Homo sapiens
caaaaaaaaattttaaagaccc

SEQ ID NO: 5377789 - DNA, 21 bp, Homo sapiens
caaaaaaaaatttttttttct

SEQ ID NO: 5377790 - DNA, 23 bp, Homo sapiens
caaaaaaaaatttttttttctct

SEQ ID NO: 5377791 - DNA, 20 bp, Homo sapiens
caaaaaaaagaaaatgtctt

SEQ ID NO: 5377792 - DNA, 19 bp, Homo sapiens
caaaaaaaagaaagaaaaa

SEQ ID NO: 5377793 - DNA, 13 bp, Homo sapiens
caaaaaaaagaac

SEQ ID NO: 5377794 - DNA, 18 bp, Homo sapiens
caaaaaaaagcatgaata

SEQ ID NO: 5377795 - DNA, 22 bp, Homo sapiens
caaaaaaaagcatgaatatttc

SEQ ID NO: 5377796 - DNA, 15 bp, Homo sapiens
caaaaaaaagtctat

SEQ ID NO: 5377797 - DNA, 13 bp, Homo sapiens
caaaaaaaatctt

SEQ ID NO: 5377798 - DNA, 18 bp, Homo sapiens
caaaaaaaattagccggg

SEQ ID NO: 5377799 - DNA, 15 bp, Homo sapiens
caaaaaaacaaaaaa

SEQ ID NO: 5377800 - DNA, 18 bp, Homo sapiens
caaaaaaacaagtttaga

SEQ ID NO: 5377801 - DNA, 15 bp, Homo sapiens
caaaaaaacatttgt

SEQ ID NO: 5377802 - DNA, 11 bp, Homo sapiens
caaaaaaagac

SEQ ID NO: 5377803 - DNA, 20 bp, Homo sapiens
caaaaaaagcaacttttcca

SEQ ID NO: 5377804 - DNA, 14 bp, Homo sapiens
caaaaaaagcctcc

SEQ ID NO: 5377805 - DNA, 15 bp, Homo sapiens
caaaaaaagccttta

SEQ ID NO: 5377806 - DNA, 15 bp, Homo sapiens
caaaaaaaggaaaaa

SEQ ID NO: 5377807 - DNA, 14 bp, Homo sapiens
caaaaaaaggaagg

SEQ ID NO: 5377808 - DNA, 20 bp, Homo sapiens
caaaaaaagttgaaggcctt

SEQ ID NO: 5377809 - DNA, 16 bp, Homo sapiens
caaaaaaagttgtatg

SEQ ID NO: 5377810 - DNA, 21 bp, Homo sapiens
caaaaaaagttgtatgatctg

SEQ ID NO: 5377811 - DNA, 21 bp, Homo sapiens
caaaaaaagtttgttactttg

SEQ ID NO: 5377812 - DNA, 22 bp, Homo sapiens
caaaaaaagtttgttactttga

SEQ ID NO: 5377813 - DNA, 16 bp, Homo sapiens
caaaaaaataaggtgt

SEQ ID NO: 5377814 - DNA, 16 bp, Homo sapiens
caaaaaaataataaaa

SEQ ID NO: 5377815 - DNA, 18 bp, Homo sapiens
caaaaaaatatatttaat

SEQ ID NO: 5377816 - DNA, 23 bp, Homo sapiens
caaaaaaatatatttaatgataa

SEQ ID NO: 5377817 - DNA, 16 bp, Homo sapiens
caaaaaaatctgcaga

SEQ ID NO: 5377818 - DNA, 16 bp, Homo sapiens
caaaaaaatgttcatt

SEQ ID NO: 5377819 - DNA, 13 bp, Homo sapiens
caaaaaaatgttt

SEQ ID NO: 5377820 - DNA, 14 bp, Homo sapiens
caaaaaaattaaat

SEQ ID NO: 5377821 - DNA, 20 bp, Homo sapiens
caaaaaaatttaaaattacg

SEQ ID NO: 5377822 - DNA, 12 bp, Homo sapiens
caaaaaacaata

SEQ ID NO: 5377823 - DNA, 18 bp, Homo sapiens
caaaaaacaatatttatt

SEQ ID NO: 5377824 - DNA, 16 bp, Homo sapiens
caaaaaacagaaaaac

SEQ ID NO: 5377825 - DNA, 13 bp, Homo sapiens
caaaaaaccagga

SEQ ID NO: 5377826 - DNA, 16 bp, Homo sapiens
caaaaaactaaagcag

SEQ ID NO: 5377827 - DNA, 19 bp, Homo sapiens
caaaaaactatcaactaca

SEQ ID NO: 5377828 - DNA, 15 bp, Homo sapiens
caaaaaactcgagga

SEQ ID NO: 5377829 - DNA, 13 bp, Homo sapiens
caaaaaagaacag

SEQ ID NO: 5377830 - DNA, 23 bp, Homo sapiens
caaaaaagacttgagacaatgtt

SEQ ID NO: 5377831 - DNA, 13 bp, Homo sapiens
caaaaaagagaaa

SEQ ID NO: 5377832 - DNA, 22 bp, Homo sapiens
caaaaaaggctgccctgggcca

SEQ ID NO: 5377833 - DNA, 17 bp, Homo sapiens
caaaaaagggacagcat

SEQ ID NO: 5377834 - DNA, 17 bp, Homo sapiens
caaaaaaggtaactaac

SEQ ID NO: 5377835 - DNA, 22 bp, Homo sapiens
caaaaaaggtttcccaaaacaa

SEQ ID NO: 5377836 - DNA, 19 bp, Homo sapiens
caaaaaagtcaacaaactg

SEQ ID NO: 5377837 - DNA, 22 bp, Homo sapiens
caaaaaagtccaattttaattt

SEQ ID NO: 5377838 - DNA, 17 bp, Homo sapiens
caaaaaagttataagaa

SEQ ID NO: 5377839 - DNA, 12 bp, Homo sapiens
caaaaaagttta

SEQ ID NO: 5377840 - DNA, 14 bp, Homo sapiens
caaaaaataaaata

SEQ ID NO: 5377841 - DNA, 15 bp, Homo sapiens
caaaaaataaaataa

SEQ ID NO: 5377842 - DNA, 13 bp, Homo sapiens
caaaaaataaaga

SEQ ID NO: 5377843 - DNA, 19 bp, Homo sapiens
caaaaaataaattttaaaa

SEQ ID NO: 5377844 - DNA, 20 bp, Homo sapiens
caaaaaataaattttaaaaa

SEQ ID NO: 5377845 - DNA, 13 bp, Homo sapiens
caaaaaataatta

SEQ ID NO: 5377846 - DNA, 15 bp, Homo sapiens
caaaaaataattagt

SEQ ID NO: 5377847 - DNA, 11 bp, Homo sapiens
caaaaaataca

SEQ ID NO: 5377848 - DNA, 12 bp, Homo sapiens
caaaaaatacat

SEQ ID NO: 5377849 - DNA, 21 bp, Homo sapiens
caaaaaatatatatcactcta

SEQ ID NO: 5377850 - DNA, 23 bp, Homo sapiens
caaaaaatatatatcactctaga

SEQ ID NO: 5377851 - DNA, 13 bp, Homo sapiens
caaaaaatctata

SEQ ID NO: 5377852 - DNA, 19 bp, Homo sapiens
caaaaaatcttaatactgt

SEQ ID NO: 5377853 - DNA, 14 bp, Homo sapiens
caaaaaatgggaga

SEQ ID NO: 5377854 - DNA, 19 bp, Homo sapiens
caaaaaattaaagcattta

SEQ ID NO: 5377855 - DNA, 21 bp, Homo sapiens
caaaaaattagccagtcatgg

SEQ ID NO: 5377856 - DNA, 18 bp, Homo sapiens
caaaaaattagccgggcg

SEQ ID NO: 5377857 - DNA, 13 bp, Homo sapiens
caaaaaattagct

SEQ ID NO: 5377858 - DNA, 18 bp, Homo sapiens
caaaaaattctttagaga

SEQ ID NO: 5377859 - DNA, 14 bp, Homo sapiens
caaaaacaaaaaag

SEQ ID NO: 5377860 - DNA, 17 bp, Homo sapiens
caaaaacaaaaccagct

SEQ ID NO: 5377861 - DNA, 14 bp, Homo sapiens
caaaaacaaaatta

SEQ ID NO: 5377862 - DNA, 16 bp, Homo sapiens
caaaaacaaagctgat

SEQ ID NO: 5377863 - DNA, 16 bp, Homo sapiens
caaaaacaaagtgcaa

SEQ ID NO: 5377864 - DNA, 19 bp, Homo sapiens
caaaaacaaagtgcaaagc

SEQ ID NO: 5377865 - DNA, 21 bp, Homo sapiens
caaaaacaaagtgcaaagctg

SEQ ID NO: 5377866 - DNA, 15 bp, Homo sapiens
caaaaacaagacaga

SEQ ID NO: 5377867 - DNA, 19 bp, Homo sapiens
caaaaacaagactgcctcc

SEQ ID NO: 5377868 - DNA, 17 bp, Homo sapiens
caaaaacaataaacgaa

SEQ ID NO: 5377869 - DNA, 15 bp, Homo sapiens
caaaaacacaaatac

SEQ ID NO: 5377870 - DNA, 15 bp, Homo sapiens
caaaaacagcctcac

SEQ ID NO: 5377871 - DNA, 22 bp, Homo sapiens
caaaaacagcctcacagaagaa

SEQ ID NO: 5377872 - DNA, 16 bp, Homo sapiens
caaaaacatggccaca

SEQ ID NO: 5377873 - DNA, 15 bp, Homo sapiens
caaaaacatgtatgt

SEQ ID NO: 5377874 - DNA, 22 bp, Homo sapiens
caaaaacatgtatgtgcatttc

SEQ ID NO: 5377875 - DNA, 13 bp, Homo sapiens
caaaaacatttga

SEQ ID NO: 5377876 - DNA, 12 bp, Homo sapiens
caaaaaccaaat

SEQ ID NO: 5377877 - DNA, 14 bp, Homo sapiens
caaaaaccagcagg

SEQ ID NO: 5377878 - DNA, 15 bp, Homo sapiens
caaaaaccatgttgc

SEQ ID NO: 5377879 - DNA, 19 bp, Homo sapiens
caaaaaccatgttgcgttc

SEQ ID NO: 5377880 - DNA, 18 bp, Homo sapiens
caaaaaccattacaaaat

SEQ ID NO: 5377881 - DNA, 22 bp, Homo sapiens
caaaaaccctaattttgtacat

SEQ ID NO: 5377882 - DNA, 17 bp, Homo sapiens
caaaaacctattccact

SEQ ID NO: 5377883 - DNA, 19 bp, Homo sapiens
caaaaacgccttttcttgg

SEQ ID NO: 5377884 - DNA, 13 bp, Homo sapiens
caaaaactgactt

SEQ ID NO: 5377885 - DNA, 20 bp, Homo sapiens
caaaaactgactttatttat

SEQ ID NO: 5377886 - DNA, 19 bp, Homo sapiens
caaaaactgcgtcttggat

SEQ ID NO: 5377887 - DNA, 13 bp, Homo sapiens
caaaaactgtttt

SEQ ID NO: 5377888 - DNA, 13 bp, Homo sapiens
caaaaacttgtta

SEQ ID NO: 5377889 - DNA, 17 bp, Homo sapiens
caaaaactttcatgcct

SEQ ID NO: 5377890 - DNA, 16 bp, Homo sapiens
caaaaactttccatga

SEQ ID NO: 5377891 - DNA, 23 bp, Homo sapiens
caaaaactttggagtcccctcac

SEQ ID NO: 5377892 - DNA, 17 bp, Homo sapiens
caaaaactttttgttgt

SEQ ID NO: 5377893 - DNA, 22 bp, Homo sapiens
caaaaagaaaaaaaaaaagaaa

SEQ ID NO: 5377894 - DNA, 16 bp, Homo sapiens
caaaaagaaaaaaaga

SEQ ID NO: 5377895 - DNA, 20 bp, Homo sapiens
caaaaagaaaagaaaatttt

SEQ ID NO: 5377896 - DNA, 16 bp, Homo sapiens
caaaaagaaagctgtg

SEQ ID NO: 5377897 - DNA, 12 bp, Homo sapiens
caaaaagaacaa

SEQ ID NO: 5377898 - DNA, 14 bp, Homo sapiens
caaaaagaacaaaa

SEQ ID NO: 5377899 - DNA, 22 bp, Homo sapiens
caaaaagaatctgcatttagca

SEQ ID NO: 5377900 - DNA, 14 bp, Homo sapiens
caaaaagacaaaca

SEQ ID NO: 5377901 - DNA, 16 bp, Homo sapiens
caaaaagacaagtgct

SEQ ID NO: 5377902 - DNA, 22 bp, Homo sapiens
caaaaagagtcagacatttctt

SEQ ID NO: 5377903 - DNA, 20 bp, Homo sapiens
caaaaagataccttaaaatt

SEQ ID NO: 5377904 - DNA, 16 bp, Homo sapiens
caaaaagatttaacaa

SEQ ID NO: 5377905 - DNA, 14 bp, Homo sapiens
caaaaagatttatt

SEQ ID NO: 5377906 - DNA, 15 bp, Homo sapiens
caaaaagcaaaatca

SEQ ID NO: 5377907 - DNA, 16 bp, Homo sapiens
caaaaagcaaaatcat

SEQ ID NO: 5377908 - DNA, 20 bp, Homo sapiens
caaaaagcaagggagaaaag

SEQ ID NO: 5377909 - DNA, 21 bp, Homo sapiens
caaaaagcaagggagaaaaga

SEQ ID NO: 5377910 - DNA, 12 bp, Homo sapiens
caaaaagcacat

SEQ ID NO: 5377911 - DNA, 14 bp, Homo sapiens
caaaaagccacagc

SEQ ID NO: 5377912 - DNA, 19 bp, Homo sapiens
caaaaagccacagcagagc

SEQ ID NO: 5377913 - DNA, 16 bp, Homo sapiens
caaaaagctctgaaaa

SEQ ID NO: 5377914 - DNA, 22 bp, Homo sapiens
caaaaagctcttacactacatt

SEQ ID NO: 5377915 - DNA, 19 bp, Homo sapiens
caaaaagctgctatccaat

SEQ ID NO: 5377916 - DNA, 14 bp, Homo sapiens
caaaaagcttctgt

SEQ ID NO: 5377917 - DNA, 23 bp, Homo sapiens
caaaaagctttaaaaaataaagc

SEQ ID NO: 5377918 - DNA, 18 bp, Homo sapiens
caaaaaggaccaactggc

SEQ ID NO: 5377919 - DNA, 16 bp, Homo sapiens
caaaaaggactggaaa

SEQ ID NO: 5377920 - DNA, 21 bp, Homo sapiens
caaaaaggactggaaaaatga

SEQ ID NO: 5377921 - DNA, 22 bp, Homo sapiens
caaaaaggactggaaaaatgaa

SEQ ID NO: 5377922 - DNA, 18 bp, Homo sapiens
caaaaaggcaaatattga

SEQ ID NO: 5377923 - DNA, 21 bp, Homo sapiens
caaaaaggcaaatattgaagt

SEQ ID NO: 5377924 - DNA, 23 bp, Homo sapiens
caaaaaggcaaatattgaagttg

SEQ ID NO: 5377925 - DNA, 13 bp, Homo sapiens
caaaaaggcagga

SEQ ID NO: 5377926 - DNA, 13 bp, Homo sapiens
caaaaaggcttat

SEQ ID NO: 5377927 - DNA, 20 bp, Homo sapiens
caaaaagggaaactattgtc

SEQ ID NO: 5377928 - DNA, 21 bp, Homo sapiens
caaaaagggcttgaggtgaat

SEQ ID NO: 5377929 - DNA, 22 bp, Homo sapiens
caaaaagggcttgaggtgaatt

SEQ ID NO: 5377930 - DNA, 13 bp, Homo sapiens
caaaaaggttgct

SEQ ID NO: 5377931 - DNA, 22 bp, Homo sapiens
caaaaagtacatagtgaatttt

SEQ ID NO: 5377932 - DNA, 21 bp, Homo sapiens
caaaaagtggggcagagcctc

SEQ ID NO: 5377933 - DNA, 15 bp, Homo sapiens
caaaaagtttccata

SEQ ID NO: 5377934 - DNA, 12 bp, Homo sapiens
caaaaataaaaa

SEQ ID NO: 5377935 - DNA, 15 bp, Homo sapiens
caaaaataaactagt

SEQ ID NO: 5377936 - DNA, 12 bp, Homo sapiens
caaaaataaata

SEQ ID NO: 5377937 - DNA, 14 bp, Homo sapiens
caaaaataaattta

SEQ ID NO: 5377938 - DNA, 20 bp, Homo sapiens
caaaaataaccaagtcctcc

SEQ ID NO: 5377939 - DNA, 22 bp, Homo sapiens
caaaaataccatttatctacta

SEQ ID NO: 5377940 - DNA, 19 bp, Homo sapiens
caaaaatactctaattcta

SEQ ID NO: 5377941 - DNA, 20 bp, Homo sapiens
caaaaatactctaattctaa

SEQ ID NO: 5377942 - DNA, 20 bp, Homo sapiens
caaaaatactcttgatttca

SEQ ID NO: 5377943 - DNA, 14 bp, Homo sapiens
caaaaatagaatat

SEQ ID NO: 5377944 - DNA, 15 bp, Homo sapiens
caaaaatagccctgc

SEQ ID NO: 5377945 - DNA, 14 bp, Homo sapiens
caaaaatagctaaa

SEQ ID NO: 5377946 - DNA, 20 bp, Homo sapiens
caaaaatagctcttgctttg

SEQ ID NO: 5377947 - DNA, 18 bp, Homo sapiens
caaaaatagttaaaatgc

SEQ ID NO: 5377948 - DNA, 11 bp, Homo sapiens
caaaaatataa

SEQ ID NO: 5377949 - DNA, 15 bp, Homo sapiens
caaaaatataaaata

SEQ ID NO: 5377950 - DNA, 23 bp, Homo sapiens
caaaaatataaaatatgaagaca

SEQ ID NO: 5377951 - DNA, 15 bp, Homo sapiens
caaaaatataactta

SEQ ID NO: 5377952 - DNA, 16 bp, Homo sapiens
caaaaatatattaaaa

SEQ ID NO: 5377953 - DNA, 16 bp, Homo sapiens
caaaaatatctcctcc

SEQ ID NO: 5377954 - DNA, 22 bp, Homo sapiens
caaaaatatttataaaacttct

SEQ ID NO: 5377955 - DNA, 17 bp, Homo sapiens
caaaaatattttatgat

SEQ ID NO: 5377956 - DNA, 23 bp, Homo sapiens
caaaatagcacatccaccaaact

SEQ ID NO: 5377957 - DNA, 17 bp, Homo sapiens
caaaatagggtatattt

SEQ ID NO: 5377958 - DNA, 18 bp, Homo sapiens
caaaatagggtatatttt

SEQ ID NO: 5377959 - DNA, 19 bp, Homo sapiens
caaaatagtcatgtttctg

SEQ ID NO: 5377960 - DNA, 15 bp, Homo sapiens
caaaatagttctatt

SEQ ID NO: 5377961 - DNA, 16 bp, Homo sapiens
caaaatagttctattt

SEQ ID NO: 5377962 - DNA, 18 bp, Homo sapiens
caaaatagttctatttct

SEQ ID NO: 5377963 - DNA, 20 bp, Homo sapiens
caaaatagttctatttctat

SEQ ID NO: 5377964 - DNA, 23 bp, Homo sapiens
caaaatagttctatttctatctg

SEQ ID NO: 5377965 - DNA, 24 bp, Homo sapiens
caaaatagttctatttctatctgc

SEQ ID NO: 5377966 - DNA, 15 bp, Homo sapiens
caaaatataaatcac

SEQ ID NO: 5377967 - DNA, 14 bp, Homo sapiens
caaaatatacaaaa

SEQ ID NO: 5377968 - DNA, 18 bp, Homo sapiens
caaaatatacaaaacttt

SEQ ID NO: 5377969 - DNA, 23 bp, Homo sapiens
caaaatatataatggtttactgc

SEQ ID NO: 5377970 - DNA, 15 bp, Homo sapiens
caaaatatatgtttg

SEQ ID NO: 5377971 - DNA, 21 bp, Homo sapiens
caaaatatatgtttggctgaa

SEQ ID NO: 5377972 - DNA, 23 bp, Homo sapiens
caaaatatatgtttggctgaaat

SEQ ID NO: 5377973 - DNA, 19 bp, Homo sapiens
caaaatatattgaagtaag

SEQ ID NO: 5377974 - DNA, 15 bp, Homo sapiens
caaaatatgcccctt

SEQ ID NO: 5377975 - DNA, 16 bp, Homo sapiens
caaaatatgtttaaaa

SEQ ID NO: 5377976 - DNA, 17 bp, Homo sapiens
caaaatattatctgaac

SEQ ID NO: 5377977 - DNA, 15 bp, Homo sapiens
caaaatattatgtta

SEQ ID NO: 5377978 - DNA, 19 bp, Homo sapiens
caaaatattatgttatgaa

SEQ ID NO: 5377979 - DNA, 19 bp, Homo sapiens
caaaatattgcttatgtct

SEQ ID NO: 5377980 - DNA, 18 bp, Homo sapiens
caaaatattggtattaaa

SEQ ID NO: 5377981 - DNA, 19 bp, Homo sapiens
caaaatattggtattaaag

SEQ ID NO: 5377982 - DNA, 20 bp, Homo sapiens
caaaatattggtattaaaga

SEQ ID NO: 5377983 - DNA, 22 bp, Homo sapiens
caaaatattggtattaaagaat

SEQ ID NO: 5377984 - DNA, 12 bp, Homo sapiens
caaaatatttaa

SEQ ID NO: 5377985 - DNA, 13 bp, Homo sapiens
caaaatatttaaa

SEQ ID NO: 5377986 - DNA, 17 bp, Homo sapiens
caaaatatttaaaaatg

SEQ ID NO: 5377987 - DNA, 18 bp, Homo sapiens
caaaatatttaaaaatgt

SEQ ID NO: 5377988 - DNA, 19 bp, Homo sapiens
caaaatatttatttgtttt

SEQ ID NO: 5377989 - DNA, 15 bp, Homo sapiens
caaaatatttcccat

SEQ ID NO: 5377990 - DNA, 17 bp, Homo sapiens
caaaatatttctaagct

SEQ ID NO: 5377991 - DNA, 20 bp, Homo sapiens
caaaatatttctaagcttat

SEQ ID NO: 5377992 - DNA, 21 bp, Homo sapiens
caaaatatttctaagcttatt

SEQ ID NO: 5377993 - DNA, 17 bp, Homo sapiens
caaaatattttatcttt

SEQ ID NO: 5377994 - DNA, 18 bp, Homo sapiens
caaaatattttcctgcca

SEQ ID NO: 5377995 - DNA, 16 bp, Homo sapiens
caaaatattttttgca

SEQ ID NO: 5377996 - DNA, 16 bp, Homo sapiens
caaaatcaattaaaat

SEQ ID NO: 5377997 - DNA, 16 bp, Homo sapiens
caaaatcacaagcaat

SEQ ID NO: 5377998 - DNA, 21 bp, Homo sapiens
caaaatcacaagcaataatta

SEQ ID NO: 5377999 - DNA, 17 bp, Homo sapiens
caaaatcacttccatag

SEQ ID NO: 5378000 - DNA, 14 bp, Homo sapiens
caaaatcaggaaag

SEQ ID NO: 5378001 - DNA, 18 bp, Homo sapiens
caaaatcagtttttcata

SEQ ID NO: 5378002 - DNA, 22 bp, Homo sapiens
caaaatcatgaatatttcaaaa

SEQ ID NO: 5378003 - DNA, 11 bp, Homo sapiens
caaaatccaaa

SEQ ID NO: 5378004 - DNA, 22 bp, Homo sapiens
caaaatccaaaaagctctgaaa

SEQ ID NO: 5378005 - DNA, 20 bp, Homo sapiens
caaaatccaaaacttctctt

SEQ ID NO: 5378006 - DNA, 14 bp, Homo sapiens
caaaatccaaactg

SEQ ID NO: 5378007 - DNA, 18 bp, Homo sapiens
caaaatccaaactgctgt

SEQ ID NO: 5378008 - DNA, 21 bp, Homo sapiens
caaaatccatgtgaccattct

SEQ ID NO: 5378009 - DNA, 23 bp, Homo sapiens
caaaatccatgtgaccattctgc

SEQ ID NO: 5378010 - DNA, 18 bp, Homo sapiens
caaaatccattccaggta

SEQ ID NO: 5378011 - DNA, 12 bp, Homo sapiens
caaaatcccctc

SEQ ID NO: 5378012 - DNA, 16 bp, Homo sapiens
caaaatccccttctca

SEQ ID NO: 5378013 - DNA, 15 bp, Homo sapiens
caaaatcctcaggaa

SEQ ID NO: 5378014 - DNA, 15 bp, Homo sapiens
caaaatcctggaaga

SEQ ID NO: 5378015 - DNA, 18 bp, Homo sapiens
caaaatcctggaagattt

SEQ ID NO: 5378016 - DNA, 18 bp, Homo sapiens
caaaatccttccaaagaa

SEQ ID NO: 5378017 - DNA, 18 bp, Homo sapiens
caaaatcgattggcttta

SEQ ID NO: 5378018 - DNA, 12 bp, Homo sapiens
caaaatctaaaa

SEQ ID NO: 5378019 - DNA, 17 bp, Homo sapiens
caaaatctaaaatgttt

SEQ ID NO: 5378020 - DNA, 14 bp, Homo sapiens
caaaatctgaactc

SEQ ID NO: 5378021 - DNA, 18 bp, Homo sapiens
caaaatctgaactctcaa

SEQ ID NO: 5378022 - DNA, 17 bp, Homo sapiens
caaaatctgattagaag

SEQ ID NO: 5378023 - DNA, 19 bp, Homo sapiens
caaaatctgtacatgtctc

SEQ ID NO: 5378024 - DNA, 17 bp, Homo sapiens
caaaatctgttctaaca

SEQ ID NO: 5378025 - DNA, 11 bp, Homo sapiens
caaaatcttgt

SEQ ID NO: 5378026 - DNA, 22 bp, Homo sapiens
caaaatgaaacgcaaccaccac

SEQ ID NO: 5378027 - DNA, 11 bp, Homo sapiens
caaaatgaaag

SEQ ID NO: 5378028 - DNA, 22 bp, Homo sapiens
caaaatgaatgcaaaattgttt

SEQ ID NO: 5378029 - DNA, 17 bp, Homo sapiens
caaaatgaattgccttt

SEQ ID NO: 5378030 - DNA, 17 bp, Homo sapiens
caaaatgacaaggggag

SEQ ID NO: 5378031 - DNA, 16 bp, Homo sapiens
caaaatgacatctttt

SEQ ID NO: 5378032 - DNA, 18 bp, Homo sapiens
caaaatgacatcttttta

SEQ ID NO: 5378033 - DNA, 22 bp, Homo sapiens
caaaatgacatctttttaaagc

SEQ ID NO: 5378034 - DNA, 17 bp, Homo sapiens
caaaatgactggctcct

SEQ ID NO: 5378035 - DNA, 19 bp, Homo sapiens
caaaatgaggaatgtatat

SEQ ID NO: 5378036 - DNA, 16 bp, Homo sapiens
caaaatgattgtcttt

SEQ ID NO: 5378037 - DNA, 11 bp, Homo sapiens
caaaatgcaag

SEQ ID NO: 5378038 - DNA, 12 bp, Homo sapiens
caaaatgcagga

SEQ ID NO: 5378039 - DNA, 21 bp, Homo sapiens
caaaatgcatacgtattgtta

SEQ ID NO: 5378040 - DNA, 12 bp, Homo sapiens
caaaatgccaag

SEQ ID NO: 5378041 - DNA, 21 bp, Homo sapiens
caaaatgcctttttgtttacc

SEQ ID NO: 5378042 - DNA, 18 bp, Homo sapiens
caaaatgctctagtgcct

SEQ ID NO: 5378043 - DNA, 18 bp, Homo sapiens
caaaatgctttttatttc

SEQ ID NO: 5378044 - DNA, 19 bp, Homo sapiens
caaaatggaagcaaagaca

SEQ ID NO: 5378045 - DNA, 12 bp, Homo sapiens
caaaatggaagg

SEQ ID NO: 5378046 - DNA, 16 bp, Homo sapiens
caaaatggaataaaag

SEQ ID NO: 5378047 - DNA, 17 bp, Homo sapiens
caaaatggaataaaagg

SEQ ID NO: 5378048 - DNA, 15 bp, Homo sapiens
caaaatggataaaat

SEQ ID NO: 5378049 - DNA, 16 bp, Homo sapiens
caaaatggatacataa

SEQ ID NO: 5378050 - DNA, 19 bp, Homo sapiens
caaaatggatacataaaga

SEQ ID NO: 5378051 - DNA, 17 bp, Homo sapiens
caaaatggattttagtc

SEQ ID NO: 5378052 - DNA, 15 bp, Homo sapiens
caaaatggcttcagt

SEQ ID NO: 5378053 - DNA, 21 bp, Homo sapiens
caaaatggcttgtctttgcta

SEQ ID NO: 5378054 - DNA, 18 bp, Homo sapiens
caaaatggggcagaagag

SEQ ID NO: 5378055 - DNA, 20 bp, Homo sapiens
caaaatggggcagaagagaa

SEQ ID NO: 5378056 - DNA, 16 bp, Homo sapiens
caaaatggtttatttt

SEQ ID NO: 5378057 - DNA, 15 bp, Homo sapiens
caaaatggtttttgt

SEQ ID NO: 5378058 - DNA, 12 bp, Homo sapiens
caaaatgtaact

SEQ ID NO: 5378059 - DNA, 14 bp, Homo sapiens
caaaatgtaactgt

SEQ ID NO: 5378060 - DNA, 15 bp, Homo sapiens
caaaatgtaactgtt

SEQ ID NO: 5378061 - DNA, 18 bp, Homo sapiens
caaaatgtaatgtcagac

SEQ ID NO: 5378062 - DNA, 17 bp, Homo sapiens
caaaatgtacttaaatg

SEQ ID NO: 5378063 - DNA, 19 bp, Homo sapiens
caaaatgtacttaaatgag

SEQ ID NO: 5378064 - DNA, 18 bp, Homo sapiens
caaaatgtagaaataaat

SEQ ID NO: 5378065 - DNA, 23 bp, Homo sapiens
caaaatgtaggcttagtttgtgt

SEQ ID NO: 5378066 - DNA, 15 bp, Homo sapiens
caaaatgtagggtta

SEQ ID NO: 5378067 - DNA, 16 bp, Homo sapiens
caaaatgtatgtctgg

SEQ ID NO: 5378068 - DNA, 22 bp, Homo sapiens
caaaatgtattagaagatttta

SEQ ID NO: 5378069 - DNA, 22 bp, Homo sapiens
caaaatgtcacacttgtttctt

SEQ ID NO: 5378070 - DNA, 13 bp, Homo sapiens
caaaatgtcttgt

SEQ ID NO: 5378071 - DNA, 14 bp, Homo sapiens
caaaatgtcttgtg

SEQ ID NO: 5378072 - DNA, 17 bp, Homo sapiens
caaaatgtcttgtgtat

SEQ ID NO: 5378073 - DNA, 21 bp, Homo sapiens
caaaatgtgagtggttgaata

SEQ ID NO: 5378074 - DNA, 16 bp, Homo sapiens
caaaatgtgtatttct

SEQ ID NO: 5378075 - DNA, 14 bp, Homo sapiens
caaaatgtgtttca

SEQ ID NO: 5378076 - DNA, 20 bp, Homo sapiens
caaaatgtgtttcagccgta

SEQ ID NO: 5378077 - DNA, 10 bp, Homo sapiens
caaaatgtta

SEQ ID NO: 5378078 - DNA, 20 bp, Homo sapiens
caaaatgttatcttctcaag

SEQ ID NO: 5378079 - DNA, 22 bp, Homo sapiens
caaaatgttgaaatatgatgtt

SEQ ID NO: 5378080 - DNA, 17 bp, Homo sapiens
caaaatgttggtcattt

SEQ ID NO: 5378081 - DNA, 15 bp, Homo sapiens
caaaattaaacttca

SEQ ID NO: 5378082 - DNA, 16 bp, Homo sapiens
caaaattaaatctaga

SEQ ID NO: 5378083 - DNA, 20 bp, Homo sapiens
caaaattaaggtgtttgaaa

SEQ ID NO: 5378084 - DNA, 15 bp, Homo sapiens
caaaattaagtgttg

SEQ ID NO: 5378085 - DNA, 16 bp, Homo sapiens
caaaattacagttcac

SEQ ID NO: 5378086 - DNA, 18 bp, Homo sapiens
caaaattacagttcacac

SEQ ID NO: 5378087 - DNA, 15 bp, Homo sapiens
caaaattactggaca

SEQ ID NO: 5378088 - DNA, 15 bp, Homo sapiens
caaaattagaaatgt

SEQ ID NO: 5378089 - DNA, 16 bp, Homo sapiens
caaaattagccgggca

SEQ ID NO: 5378090 - DNA, 13 bp, Homo sapiens
caaaattataaag

SEQ ID NO: 5378091 - DNA, 20 bp, Homo sapiens
caaaattataagaagaggaa

SEQ ID NO: 5378092 - DNA, 19 bp, Homo sapiens
caaaattatagcttttaag

SEQ ID NO: 5378093 - DNA, 13 bp, Homo sapiens
caaaattatttgt

SEQ ID NO: 5378094 - DNA, 20 bp, Homo sapiens
caaaattcaaaaagaactaa

SEQ ID NO: 5378095 - DNA, 19 bp, Homo sapiens
caaaattcaaaatactttt

SEQ ID NO: 5378096 - DNA, 15 bp, Homo sapiens
caaaattcaaagcat

SEQ ID NO: 5378097 - DNA, 18 bp, Homo sapiens
caaaattcatttctaatt

SEQ ID NO: 5378098 - DNA, 18 bp, Homo sapiens
caaaattccagttattta

SEQ ID NO: 5378099 - DNA, 14 bp, Homo sapiens
caaaattccatccc

SEQ ID NO: 5378100 - DNA, 13 bp, Homo sapiens
caaaattcccagg

SEQ ID NO: 5378101 - DNA, 21 bp, Homo sapiens
caaaattcgacctgatttaca

SEQ ID NO: 5378102 - DNA, 14 bp, Homo sapiens
caaaattctgtttt

SEQ ID NO: 5378103 - DNA, 13 bp, Homo sapiens
caaaattgacatt

SEQ ID NO: 5378104 - DNA, 17 bp, Homo sapiens
caaaattgacattgctt

SEQ ID NO: 5378105 - DNA, 22 bp, Homo sapiens
caaaattgatgtgtttatttat

SEQ ID NO: 5378106 - DNA, 17 bp, Homo sapiens
caaaattgcaaatcttg

SEQ ID NO: 5378107 - DNA, 21 bp, Homo sapiens
caaaattgcctataatacttg

SEQ ID NO: 5378108 - DNA, 20 bp, Homo sapiens
caaaattgcctttttctcta

SEQ ID NO: 5378109 - DNA, 15 bp, Homo sapiens
caaaattgctgcacc

SEQ ID NO: 5378110 - DNA, 16 bp, Homo sapiens
caaaattgttacaaat

SEQ ID NO: 5378111 - DNA, 16 bp, Homo sapiens
caaaattgttttcact

SEQ ID NO: 5378112 - DNA, 20 bp, Homo sapiens
caaaatttaagttaactgtt

SEQ ID NO: 5378113 - DNA, 23 bp, Homo sapiens
caaaatttaattgtgtaactgtt

SEQ ID NO: 5378114 - DNA, 20 bp, Homo sapiens
caaaatttagtttttgttct

SEQ ID NO: 5378115 - DNA, 18 bp, Homo sapiens
caaaatttatattttaga

SEQ ID NO: 5378116 - DNA, 18 bp, Homo sapiens
caaaatttatgtcatttt

SEQ ID NO: 5378117 - DNA, 23 bp, Homo sapiens
caaaatttatgtcattttcagat

SEQ ID NO: 5378118 - DNA, 13 bp, Homo sapiens
caaaatttattct

SEQ ID NO: 5378119 - DNA, 21 bp, Homo sapiens
caaaatttcaaaagtgatctg

SEQ ID NO: 5378120 - DNA, 19 bp, Homo sapiens
caaaatttccagtaccttt

SEQ ID NO: 5378121 - DNA, 14 bp, Homo sapiens
caaaatttctatta

SEQ ID NO: 5378122 - DNA, 21 bp, Homo sapiens
caaaatttctgtatattccct

SEQ ID NO: 5378123 - DNA, 13 bp, Homo sapiens
caaaatttgacta

SEQ ID NO: 5378124 - DNA, 14 bp, Homo sapiens
caaaatttgactaa

SEQ ID NO: 5378125 - DNA, 13 bp, Homo sapiens
caaaatttgagaa

SEQ ID NO: 5378126 - DNA, 23 bp, Homo sapiens
caaaatttgatggtgaatattac

SEQ ID NO: 5378127 - DNA, 13 bp, Homo sapiens
caaaattttattc

SEQ ID NO: 5378128 - DNA, 19 bp, Homo sapiens
caaaatttttaaaactgca

SEQ ID NO: 5378129 - DNA, 23 bp, Homo sapiens
caaaatttttaggtgaagtcgag

SEQ ID NO: 5378130 - DNA, 18 bp, Homo sapiens
caaaatttttcaacccca

SEQ ID NO: 5378131 - DNA, 22 bp, Homo sapiens
caaaatttttcaaccccaccct

SEQ ID NO: 5378132 - DNA, 23 bp, Homo sapiens
caaaatttttcaaccccaccctg

SEQ ID NO: 5378133 - DNA, 16 bp, Homo sapiens
caaaattttttttaca

SEQ ID NO: 5378134 - DNA, 17 bp, Homo sapiens
caaactggggctgtgtt

SEQ ID NO: 5378135 - DNA, 21 bp, Homo sapiens
caaactggtattctgttctgg

SEQ ID NO: 5378136 - DNA, 22 bp, Homo sapiens
caaactggtttgaaatttttga

SEQ ID NO: 5378137 - DNA, 12 bp, Homo sapiens
caaactgtaaaa

SEQ ID NO: 5378138 - DNA, 14 bp, Homo sapiens
caaactgtaaataa

SEQ ID NO: 5378139 - DNA, 20 bp, Homo sapiens
caaactgtaaataaaaagaa

SEQ ID NO: 5378140 - DNA, 14 bp, Homo sapiens
caaactgtaataca

SEQ ID NO: 5378141 - DNA, 19 bp, Homo sapiens
caaactgtagtaattgtta

SEQ ID NO: 5378142 - DNA, 23 bp, Homo sapiens
caaactgtagtaattgttacaat

SEQ ID NO: 5378143 - DNA, 23 bp, Homo sapiens
caaactgtagttgttttggcgat

SEQ ID NO: 5378144 - DNA, 14 bp, Homo sapiens
caaactgtgaagca

SEQ ID NO: 5378145 - DNA, 15 bp, Homo sapiens
caaactgtgccctgc

SEQ ID NO: 5378146 - DNA, 16 bp, Homo sapiens
caaactgtgccctgcc

SEQ ID NO: 5378147 - DNA, 17 bp, Homo sapiens
caaactgtgccctgcct

SEQ ID NO: 5378148 - DNA, 20 bp, Homo sapiens
caaactgtgcttctctatga

SEQ ID NO: 5378149 - DNA, 23 bp, Homo sapiens
caaactgtgggtattgttaatat

SEQ ID NO: 5378150 - DNA, 18 bp, Homo sapiens
caaactgtgtaactgccc

SEQ ID NO: 5378151 - DNA, 20 bp, Homo sapiens
caaactgtgtaactgcccaa

SEQ ID NO: 5378152 - DNA, 22 bp, Homo sapiens
caaactgtgtcacgcaggctga

SEQ ID NO: 5378153 - DNA, 16 bp, Homo sapiens
caaactgttcaagaaa

SEQ ID NO: 5378154 - DNA, 20 bp, Homo sapiens
caaactgttctgagaaggtg

SEQ ID NO: 5378155 - DNA, 13 bp, Homo sapiens
caaacttaaacaa

SEQ ID NO: 5378156 - DNA, 19 bp, Homo sapiens
caaacttaagaaacactga

SEQ ID NO: 5378157 - DNA, 15 bp, Homo sapiens
caaacttactatttt

SEQ ID NO: 5378158 - DNA, 16 bp, Homo sapiens
caaacttactattttg

SEQ ID NO: 5378159 - DNA, 15 bp, Homo sapiens
caaacttagaaaggg

SEQ ID NO: 5378160 - DNA, 20 bp, Homo sapiens
caaacttagtttttatcttt

SEQ ID NO: 5378161 - DNA, 22 bp, Homo sapiens
caaacttatggacactgcctta

SEQ ID NO: 5378162 - DNA, 22 bp, Homo sapiens
caaacttccaaaggtttaaact

SEQ ID NO: 5378163 - DNA, 16 bp, Homo sapiens
caaacttctaaatgtt

SEQ ID NO: 5378164 - DNA, 21 bp, Homo sapiens
caaacttgggtagagtttaca

SEQ ID NO: 5378165 - DNA, 23 bp, Homo sapiens
caaacttgggtagagtttacagc

SEQ ID NO: 5378166 - DNA, 18 bp, Homo sapiens
caaacttgtgctgagaat

SEQ ID NO: 5378167 - DNA, 18 bp, Homo sapiens
caaacttgtggcctcaag

SEQ ID NO: 5378168 - DNA, 16 bp, Homo sapiens
caaactttaaaatgcg

SEQ ID NO: 5378169 - DNA, 23 bp, Homo sapiens
caaactttaggtttttttaatga

SEQ ID NO: 5378170 - DNA, 23 bp, Homo sapiens
caaactttgtgtataagttgtat

SEQ ID NO: 5378171 - DNA, 12 bp, Homo sapiens
caaactttgttt

SEQ ID NO: 5378172 - DNA, 17 bp, Homo sapiens
caaacttttataaatgt

SEQ ID NO: 5378173 - DNA, 16 bp, Homo sapiens
caaacttttattagcc

SEQ ID NO: 5378174 - DNA, 21 bp, Homo sapiens
caaacttttcaaggcttatat

SEQ ID NO: 5378175 - DNA, 12 bp, Homo sapiens
caaactttttcc

SEQ ID NO: 5378176 - DNA, 22 bp, Homo sapiens
caaactttttccagcaaaatgg

SEQ ID NO: 5378177 - DNA, 23 bp, Homo sapiens
caaactttttccagcaaaatgga

SEQ ID NO: 5378178 - DNA, 17 bp, Homo sapiens
caaactttttgttcatg

SEQ ID NO: 5378179 - DNA, 11 bp, Homo sapiens
caaagaaaaaa

SEQ ID NO: 5378180 - DNA, 21 bp, Homo sapiens
caaagaaaaaaaaaaaagcca

SEQ ID NO: 5378181 - DNA, 20 bp, Homo sapiens
caaagaaaaaaaatcttata

SEQ ID NO: 5378182 - DNA, 22 bp, Homo sapiens
caaagaaaaaaaatcttataaa

SEQ ID NO: 5378183 - DNA, 15 bp, Homo sapiens
caaagaaaaaagaag

SEQ ID NO: 5378184 - DNA, 13 bp, Homo sapiens
caaagaaaaacaa

SEQ ID NO: 5378185 - DNA, 14 bp, Homo sapiens
caaagaaaaattaa

SEQ ID NO: 5378186 - DNA, 13 bp, Homo sapiens
caaagaaaacaga

SEQ ID NO: 5378187 - DNA, 15 bp, Homo sapiens
caaagaaaaccctaa

SEQ ID NO: 5378188 - DNA, 22 bp, Homo sapiens
caaagaaaagacattgaaagct

SEQ ID NO: 5378189 - DNA, 21 bp, Homo sapiens
caaagaaaagtattgtttgga

SEQ ID NO: 5378190 - DNA, 14 bp, Homo sapiens
caaagaaaatgaaa

SEQ ID NO: 5378191 - DNA, 16 bp, Homo sapiens
caaagaaaatgaaatg

SEQ ID NO: 5378192 - DNA, 15 bp, Homo sapiens
caaagaaaatgccta

SEQ ID NO: 5378193 - DNA, 17 bp, Homo sapiens
caaagaaaattcctata

SEQ ID NO: 5378194 - DNA, 19 bp, Homo sapiens
caaagaaaattcctataag

SEQ ID NO: 5378195 - DNA, 17 bp, Homo sapiens
caaagaaacaaaatata

SEQ ID NO: 5378196 - DNA, 21 bp, Homo sapiens
caaagaaacaaaatataaatc

SEQ ID NO: 5378197 - DNA, 16 bp, Homo sapiens
caaagaaacaaagatg

SEQ ID NO: 5378198 - DNA, 16 bp, Homo sapiens
caaagaaacaaagcaa

SEQ ID NO: 5378199 - DNA, 21 bp, Homo sapiens
caaagaaacaaagcaaatttc

SEQ ID NO: 5378200 - DNA, 19 bp, Homo sapiens
caaagaaacaagctgtgca

SEQ ID NO: 5378201 - DNA, 20 bp, Homo sapiens
caaagaaacaagctgtgcag

SEQ ID NO: 5378202 - DNA, 22 bp, Homo sapiens
caaagaaacaccacttaatctt

SEQ ID NO: 5378203 - DNA, 22 bp, Homo sapiens
caaagaaacactaagctctctg

SEQ ID NO: 5378204 - DNA, 13 bp, Homo sapiens
caaagaaactcag

SEQ ID NO: 5378205 - DNA, 14 bp, Homo sapiens
caaagaaagactgt

SEQ ID NO: 5378206 - DNA, 13 bp, Homo sapiens
caaagaaagagat

SEQ ID NO: 5378207 - DNA, 12 bp, Homo sapiens
caaagaaatatt

SEQ ID NO: 5378208 - DNA, 18 bp, Homo sapiens
caaagaaatccaaatttc

SEQ ID NO: 5378209 - DNA, 17 bp, Homo sapiens
caaagaaatgaacattc

SEQ ID NO: 5378210 - DNA, 19 bp, Homo sapiens
caaagaaatgaacattcca

SEQ ID NO: 5378211 - DNA, 20 bp, Homo sapiens
caaagaaatgaacattccaa

SEQ ID NO: 5378212 - DNA, 23 bp, Homo sapiens
caaagaaatgggcctgcctgcct

SEQ ID NO: 5378213 - DNA, 12 bp, Homo sapiens
caaagaaattat

SEQ ID NO: 5378214 - DNA, 15 bp, Homo sapiens
caaagaaattatgtg

SEQ ID NO: 5378215 - DNA, 23 bp, Homo sapiens
caaagaaattcagaacagcctgc

SEQ ID NO: 5378216 - DNA, 19 bp, Homo sapiens
caaagaaccaaagaagaaa

SEQ ID NO: 5378217 - DNA, 15 bp, Homo sapiens
caaagaacccccctc

SEQ ID NO: 5378218 - DNA, 17 bp, Homo sapiens
caaagaacccccctccc

SEQ ID NO: 5378219 - DNA, 19 bp, Homo sapiens
caaagaacttgatttgcat

SEQ ID NO: 5378220 - DNA, 16 bp, Homo sapiens
caaagaacttgctgct

SEQ ID NO: 5378221 - DNA, 20 bp, Homo sapiens
caaagaacttgctgctgcct

SEQ ID NO: 5378222 - DNA, 11 bp, Homo sapiens
caaagaagagt

SEQ ID NO: 5378223 - DNA, 16 bp, Homo sapiens
caaagaagatagctct

SEQ ID NO: 5378224 - DNA, 13 bp, Homo sapiens
caaagaagattct

SEQ ID NO: 5378225 - DNA, 16 bp, Homo sapiens
caaagaagattcttac

SEQ ID NO: 5378226 - DNA, 14 bp, Homo sapiens
caaagaagcttcat

SEQ ID NO: 5378227 - DNA, 16 bp, Homo sapiens
caaagaaggaaaagag

SEQ ID NO: 5378228 - DNA, 17 bp, Homo sapiens
caaagaaggagctgaga

SEQ ID NO: 5378229 - DNA, 21 bp, Homo sapiens
caaagaaggcacaggtgtaaa

SEQ ID NO: 5378230 - DNA, 13 bp, Homo sapiens
caaagaagtcatg

SEQ ID NO: 5378231 - DNA, 13 bp, Homo sapiens
caaagaatagact

SEQ ID NO: 5378232 - DNA, 16 bp, Homo sapiens
caaagaatcaacagtg

SEQ ID NO: 5378233 - DNA, 15 bp, Homo sapiens
caaagaatgccttga

SEQ ID NO: 5378234 - DNA, 20 bp, Homo sapiens
caaagaatgttagagcacag

SEQ ID NO: 5378235 - DNA, 13 bp, Homo sapiens
caaagaattacag

SEQ ID NO: 5378236 - DNA, 18 bp, Homo sapiens
caaagaattccaaagcaa

SEQ ID NO: 5378237 - DNA, 22 bp, Homo sapiens
caaagaatttcaatttgttcag

SEQ ID NO: 5378238 - DNA, 20 bp, Homo sapiens
caaagacaaaagaaacttac

SEQ ID NO: 5378239 - DNA, 14 bp, Homo sapiens
caaagacaaaagtc

SEQ ID NO: 5378240 - DNA, 15 bp, Homo sapiens
caaagacaaatagta

SEQ ID NO: 5378241 - DNA, 18 bp, Homo sapiens
caaagacaatcactgaaa

SEQ ID NO: 5378242 - DNA, 14 bp, Homo sapiens
caaagacagaatgg

SEQ ID NO: 5378243 - DNA, 12 bp, Homo sapiens
caaagacaggca

SEQ ID NO: 5378244 - DNA, 14 bp, Homo sapiens
caaagacaggcaaa

SEQ ID NO: 5378245 - DNA, 15 bp, Homo sapiens
caaagacatggaagg

SEQ ID NO: 5378246 - DNA, 16 bp, Homo sapiens
caaagacatggaaggt

SEQ ID NO: 5378247 - DNA, 17 bp, Homo sapiens
caaagacatttcaaata

SEQ ID NO: 5378248 - DNA, 21 bp, Homo sapiens
caaagacatttcaaataactg

SEQ ID NO: 5378249 - DNA, 18 bp, Homo sapiens
caaagaccaaattccttg

SEQ ID NO: 5378250 - DNA, 17 bp, Homo sapiens
caaagaccaatgtgaag

SEQ ID NO: 5378251 - DNA, 17 bp, Homo sapiens
caaagaccctggctttc

SEQ ID NO: 5378252 - DNA, 18 bp, Homo sapiens
caaagaccctggctttca

SEQ ID NO: 5378253 - DNA, 21 bp, Homo sapiens
caaagacctccacttgcttaa

SEQ ID NO: 5378254 - DNA, 17 bp, Homo sapiens
caaagacgacctttacc

SEQ ID NO: 5378255 - DNA, 17 bp, Homo sapiens
caaagactatttcaaaa

SEQ ID NO: 5378256 - DNA, 20 bp, Homo sapiens
caaagactatttcaaaatgt

SEQ ID NO: 5378257 - DNA, 16 bp, Homo sapiens
caaagactcaaatttt

SEQ ID NO: 5378258 - DNA, 22 bp, Homo sapiens
caaagactcctctgggcctggg

SEQ ID NO: 5378259 - DNA, 12 bp, Homo sapiens
caaagactctga

SEQ ID NO: 5378260 - DNA, 14 bp, Homo sapiens
caaagactctgagc

SEQ ID NO: 5378261 - DNA, 15 bp, Homo sapiens
caaagactctgagcc

SEQ ID NO: 5378262 - DNA, 16 bp, Homo sapiens
caaagactctggaggt

SEQ ID NO: 5378263 - DNA, 21 bp, Homo sapiens
caaagactctggaggtcatct

SEQ ID NO: 5378264 - DNA, 19 bp, Homo sapiens
caaagactgagtgttcaaa

SEQ ID NO: 5378265 - DNA, 14 bp, Homo sapiens
caaagactgtactg

SEQ ID NO: 5378266 - DNA, 22 bp, Homo sapiens
caaagacttaagcccagtgcac

SEQ ID NO: 5378267 - DNA, 16 bp, Homo sapiens
caaagacttaatcata

SEQ ID NO: 5378268 - DNA, 19 bp, Homo sapiens
caaagacttagtatatttt

SEQ ID NO: 5378269 - DNA, 21 bp, Homo sapiens
caaagacttgttaaatgtata

SEQ ID NO: 5378270 - DNA, 16 bp, Homo sapiens
caaagagaaaaagaaa

SEQ ID NO: 5378271 - DNA, 13 bp, Homo sapiens
caaagagaaggcc

SEQ ID NO: 5378272 - DNA, 16 bp, Homo sapiens
caaagagaaggcctgg

SEQ ID NO: 5378273 - DNA, 16 bp, Homo sapiens
caaagagaatgccatt

SEQ ID NO: 5378274 - DNA, 18 bp, Homo sapiens
caaagagaatgcccttct

SEQ ID NO: 5378275 - DNA, 23 bp, Homo sapiens
caaagagaatgcccttctcctta

SEQ ID NO: 5378276 - DNA, 14 bp, Homo sapiens
caaagagaattgta

SEQ ID NO: 5378277 - DNA, 17 bp, Homo sapiens
caaagagacatttcaaa

SEQ ID NO: 5378278 - DNA, 16 bp, Homo sapiens
caaagagactggagca

SEQ ID NO: 5378279 - DNA, 17 bp, Homo sapiens
caaagagactggagcat

SEQ ID NO: 5378280 - DNA, 13 bp, Homo sapiens
caaagagactggg

SEQ ID NO: 5378281 - DNA, 14 bp, Homo sapiens
caaagagagttttt

SEQ ID NO: 5378282 - DNA, 11 bp, Homo sapiens
caaagagatgg

SEQ ID NO: 5378283 - DNA, 14 bp, Homo sapiens
caaagagattcgaa

SEQ ID NO: 5378284 - DNA, 16 bp, Homo sapiens
caaagagcacttgagc

SEQ ID NO: 5378285 - DNA, 20 bp, Homo sapiens
caaagagcacttgagctgtc

SEQ ID NO: 5378286 - DNA, 19 bp, Homo sapiens
caaagagcctcccaccaga

SEQ ID NO: 5378287 - DNA, 13 bp, Homo sapiens
caaagagcctgga

SEQ ID NO: 5378288 - DNA, 23 bp, Homo sapiens
caaagagccttcagaatgctcct

SEQ ID NO: 5378289 - DNA, 16 bp, Homo sapiens
caaagagcctttccaa

SEQ ID NO: 5378290 - DNA, 17 bp, Homo sapiens
caaagagcctttccaaa

SEQ ID NO: 5378291 - DNA, 19 bp, Homo sapiens
caaagagcctttccaaaga

SEQ ID NO: 5378292 - DNA, 22 bp, Homo sapiens
caaagagcgagtcccctgcccg

SEQ ID NO: 5378293 - DNA, 14 bp, Homo sapiens
caaagagctgccta

SEQ ID NO: 5378294 - DNA, 14 bp, Homo sapiens
caaagagctgtggc

SEQ ID NO: 5378295 - DNA, 13 bp, Homo sapiens
caaagaggacacc

SEQ ID NO: 5378296 - DNA, 15 bp, Homo sapiens
caaagaggcaagagg

SEQ ID NO: 5378297 - DNA, 23 bp, Homo sapiens
caaagaggcagttgcccagcctc

SEQ ID NO: 5378298 - DNA, 18 bp, Homo sapiens
caaagaggcattcagcaa

SEQ ID NO: 5378299 - DNA, 18 bp, Homo sapiens
caaagaggccagtacttt

SEQ ID NO: 5378300 - DNA, 22 bp, Homo sapiens
caaagaggctgaggctggcaca

SEQ ID NO: 5378301 - DNA, 13 bp, Homo sapiens
caaagaggctgcc

SEQ ID NO: 5378302 - DNA, 15 bp, Homo sapiens
caaagaggctgcccc

SEQ ID NO: 5378303 - DNA, 17 bp, Homo sapiens
caaagaggggcgctgtc

SEQ ID NO: 5378304 - DNA, 21 bp, Homo sapiens
caaagaggggcgctgtcctgc

SEQ ID NO: 5378305 - DNA, 22 bp, Homo sapiens
caaagagggtgagggccttctt

SEQ ID NO: 5378306 - DNA, 18 bp, Homo sapiens
caaagaggtgactgggcc

SEQ ID NO: 5378307 - DNA, 12 bp, Homo sapiens
caaagaggtgct

SEQ ID NO: 5378308 - DNA, 20 bp, Homo sapiens
caaagaggttttatgaaaag

SEQ ID NO: 5378309 - DNA, 18 bp, Homo sapiens
caaagagtagaactttaa

SEQ ID NO: 5378310 - DNA, 14 bp, Homo sapiens
caaagagtctctgg

SEQ ID NO: 5378311 - DNA, 13 bp, Homo sapiens
caaagagtgaaat

SEQ ID NO: 5378312 - DNA, 12 bp, Homo sapiens
caaagtttcaat

SEQ ID NO: 5378313 - DNA, 16 bp, Homo sapiens
caaagtttcagagtat

SEQ ID NO: 5378314 - DNA, 20 bp, Homo sapiens
caaagtttcagagtatattg

SEQ ID NO: 5378315 - DNA, 20 bp, Homo sapiens
caaagtttgacaggaacctt

SEQ ID NO: 5378316 - DNA, 14 bp, Homo sapiens
caaagtttgcaact

SEQ ID NO: 5378317 - DNA, 13 bp, Homo sapiens
caaagtttggaag

SEQ ID NO: 5378318 - DNA, 15 bp, Homo sapiens
caaagtttgtggcat

SEQ ID NO: 5378319 - DNA, 14 bp, Homo sapiens
caaagtttgtggta

SEQ ID NO: 5378320 - DNA, 12 bp, Homo sapiens
caaagttttaca

SEQ ID NO: 5378321 - DNA, 16 bp, Homo sapiens
caaagttttacagaga

SEQ ID NO: 5378322 - DNA, 14 bp, Homo sapiens
caaagttttatcaa

SEQ ID NO: 5378323 - DNA, 15 bp, Homo sapiens
caaagttttcagatt

SEQ ID NO: 5378324 - DNA, 16 bp, Homo sapiens
caaagttttcctttgt

SEQ ID NO: 5378325 - DNA, 19 bp, Homo sapiens
caaagttttgaaaagctat

SEQ ID NO: 5378326 - DNA, 20 bp, Homo sapiens
caaagttttgaaaagctatt

SEQ ID NO: 5378327 - DNA, 21 bp, Homo sapiens
caaagttttgaaaagctatta

SEQ ID NO: 5378328 - DNA, 21 bp, Homo sapiens
caaagtttttacagtgtatct

SEQ ID NO: 5378329 - DNA, 22 bp, Homo sapiens
caaataaaaaaataactgattt

SEQ ID NO: 5378330 - DNA, 18 bp, Homo sapiens
caaataaaaaacagaaac

SEQ ID NO: 5378331 - DNA, 19 bp, Homo sapiens
caaataaaaactaaattgt

SEQ ID NO: 5378332 - DNA, 15 bp, Homo sapiens
caaataaaaataaca

SEQ ID NO: 5378333 - DNA, 20 bp, Homo sapiens
caaataaaacccaatacttt

SEQ ID NO: 5378334 - DNA, 16 bp, Homo sapiens
caaataaaacgctttc

SEQ ID NO: 5378335 - DNA, 23 bp, Homo sapiens
caaataaaataaaaataaaaaca

SEQ ID NO: 5378336 - DNA, 15 bp, Homo sapiens
caaataaaatatcat

SEQ ID NO: 5378337 - DNA, 16 bp, Homo sapiens
caaataaaatatcata

SEQ ID NO: 5378338 - DNA, 14 bp, Homo sapiens
caaataaaatgttt

SEQ ID NO: 5378339 - DNA, 11 bp, Homo sapiens
caaataaacac

SEQ ID NO: 5378340 - DNA, 15 bp, Homo sapiens
caaataaacactgtg

SEQ ID NO: 5378341 - DNA, 20 bp, Homo sapiens
caaataaacactgtgtaagc

SEQ ID NO: 5378342 - DNA, 15 bp, Homo sapiens
caaataaacagctat

SEQ ID NO: 5378343 - DNA, 16 bp, Homo sapiens
caaataaacagctatt

SEQ ID NO: 5378344 - DNA, 15 bp, Homo sapiens
caaataaacagttgt

SEQ ID NO: 5378345 - DNA, 16 bp, Homo sapiens
caaataaacagttgtt

SEQ ID NO: 5378346 - DNA, 13 bp, Homo sapiens
caaataaacattt

SEQ ID NO: 5378347 - DNA, 12 bp, Homo sapiens
caaataaacctg

SEQ ID NO: 5378348 - DNA, 21 bp, Homo sapiens
caaataaacggactcagtgga

SEQ ID NO: 5378349 - DNA, 14 bp, Homo sapiens
caaataaactagtc

SEQ ID NO: 5378350 - DNA, 12 bp, Homo sapiens
caaataaagcct

SEQ ID NO: 5378351 - DNA, 15 bp, Homo sapiens
caaataaagcctttt

SEQ ID NO: 5378352 - DNA, 16 bp, Homo sapiens
caaataaagcctttta

SEQ ID NO: 5378353 - DNA, 20 bp, Homo sapiens
caaataaaggctctggaagc

SEQ ID NO: 5378354 - DNA, 14 bp, Homo sapiens
caaataaagttcaa

SEQ ID NO: 5378355 - DNA, 23 bp, Homo sapiens
caaataaagtttgtaagaaaatg

SEQ ID NO: 5378356 - DNA, 19 bp, Homo sapiens
caaataaatacgtgtcaaa

SEQ ID NO: 5378357 - DNA, 20 bp, Homo sapiens
caaataaatcatcctcatgt

SEQ ID NO: 5378358 - DNA, 12 bp, Homo sapiens
caaataaatgat

SEQ ID NO: 5378359 - DNA, 15 bp, Homo sapiens
caaataaatgattat

SEQ ID NO: 5378360 - DNA, 21 bp, Homo sapiens
caaataaatgattatattcac

SEQ ID NO: 5378361 - DNA, 13 bp, Homo sapiens
caaataaatgtgt

SEQ ID NO: 5378362 - DNA, 14 bp, Homo sapiens
caaataaatgtgta

SEQ ID NO: 5378363 - DNA, 20 bp, Homo sapiens
caaataaatgtgtaaatgtg

SEQ ID NO: 5378364 - DNA, 12 bp, Homo sapiens
caaataaatgtt

SEQ ID NO: 5378365 - DNA, 14 bp, Homo sapiens
caaataaattacac

SEQ ID NO: 5378366 - DNA, 15 bp, Homo sapiens
caaataaatttctgg

SEQ ID NO: 5378367 - DNA, 16 bp, Homo sapiens
caaataacaacttttt

SEQ ID NO: 5378368 - DNA, 20 bp, Homo sapiens
caaataaccctgaatcagag

SEQ ID NO: 5378369 - DNA, 19 bp, Homo sapiens
caaataactactgcaaaaa

SEQ ID NO: 5378370 - DNA, 23 bp, Homo sapiens
caaataacttcagtcctgctcca

SEQ ID NO: 5378371 - DNA, 13 bp, Homo sapiens
caaataagactct

SEQ ID NO: 5378372 - DNA, 14 bp, Homo sapiens
caaataagaggaca

SEQ ID NO: 5378373 - DNA, 22 bp, Homo sapiens
caaataagattaataagatttt

SEQ ID NO: 5378374 - DNA, 22 bp, Homo sapiens
caaataagcactcctttaaagc

SEQ ID NO: 5378375 - DNA, 22 bp, Homo sapiens
caaataagctctattatattcg

SEQ ID NO: 5378376 - DNA, 22 bp, Homo sapiens
caaataaggacagcagctggtg

SEQ ID NO: 5378377 - DNA, 17 bp, Homo sapiens
caaataagtatttataa

SEQ ID NO: 5378378 - DNA, 18 bp, Homo sapiens
caaataagtatttataat

SEQ ID NO: 5378379 - DNA, 12 bp, Homo sapiens
caaataagtcaa

SEQ ID NO: 5378380 - DNA, 14 bp, Homo sapiens
caaataagtcaaaa

SEQ ID NO: 5378381 - DNA, 16 bp, Homo sapiens
caaataagtgtatttt

SEQ ID NO: 5378382 - DNA, 13 bp, Homo sapiens
caaataataaagt

SEQ ID NO: 5378383 - DNA, 23 bp, Homo sapiens
caaataataaagtagcaaaacaa

SEQ ID NO: 5378384 - DNA, 11 bp, Homo sapiens
caaataataat

SEQ ID NO: 5378385 - DNA, 15 bp, Homo sapiens
caaataataataata

SEQ ID NO: 5378386 - DNA, 19 bp, Homo sapiens
caaataataccttagaagg

SEQ ID NO: 5378387 - DNA, 16 bp, Homo sapiens
caaataatactaattt

SEQ ID NO: 5378388 - DNA, 20 bp, Homo sapiens
caaataatactaatttataa

SEQ ID NO: 5378389 - DNA, 22 bp, Homo sapiens
caaataatatgtttccttccct

SEQ ID NO: 5378390 - DNA, 16 bp, Homo sapiens
caaataatattgcctt

SEQ ID NO: 5378391 - DNA, 23 bp, Homo sapiens
caaataatattgccttgatgttt

SEQ ID NO: 5378392 - DNA, 16 bp, Homo sapiens
caaataatgaacagca

SEQ ID NO: 5378393 - DNA, 16 bp, Homo sapiens
caaataatgtctctgt

SEQ ID NO: 5378394 - DNA, 23 bp, Homo sapiens
caaataatgtctctgtgagactc

SEQ ID NO: 5378395 - DNA, 21 bp, Homo sapiens
caaataattggctttgcagat

SEQ ID NO: 5378396 - DNA, 14 bp, Homo sapiens
caaataatttaagt

SEQ ID NO: 5378397 - DNA, 13 bp, Homo sapiens
caaataatttaga

SEQ ID NO: 5378398 - DNA, 20 bp, Homo sapiens
caaataatttgaactttgga

SEQ ID NO: 5378399 - DNA, 21 bp, Homo sapiens
caaataatttgaactttggaa

SEQ ID NO: 5378400 - DNA, 22 bp, Homo sapiens
caaataatttgaactttggaac

SEQ ID NO: 5378401 - DNA, 16 bp, Homo sapiens
caaatacaaagtaaat

SEQ ID NO: 5378402 - DNA, 24 bp, Homo sapiens
caaatacaaagtaaatacaagact

SEQ ID NO: 5378403 - DNA, 21 bp, Homo sapiens
caaatacaattcaaatgcttt

SEQ ID NO: 5378404 - DNA, 14 bp, Homo sapiens
caaatacacataca

SEQ ID NO: 5378405 - DNA, 15 bp, Homo sapiens
caaatacacatacat

SEQ ID NO: 5378406 - DNA, 17 bp, Homo sapiens
caaatacacatacatat

SEQ ID NO: 5378407 - DNA, 18 bp, Homo sapiens
caaatacacatacatata

SEQ ID NO: 5378408 - DNA, 17 bp, Homo sapiens
caaatacacatttcaca

SEQ ID NO: 5378409 - DNA, 21 bp, Homo sapiens
caaatacagtagtataatgta

SEQ ID NO: 5378410 - DNA, 13 bp, Homo sapiens
caaatacatacaa

SEQ ID NO: 5378411 - DNA, 21 bp, Homo sapiens
caaatacatacaacctatgta

SEQ ID NO: 5378412 - DNA, 23 bp, Homo sapiens
caaatacatacaacctatgtaat

SEQ ID NO: 5378413 - DNA, 19 bp, Homo sapiens
caaatacatgcacagtcat

SEQ ID NO: 5378414 - DNA, 22 bp, Homo sapiens
caaatacatgcacagtcataca

SEQ ID NO: 5378415 - DNA, 14 bp, Homo sapiens
caaatacatgcctt

SEQ ID NO: 5378416 - DNA, 13 bp, Homo sapiens
caaatacatttta

SEQ ID NO: 5378417 - DNA, 16 bp, Homo sapiens
caaataccaaagcagt

SEQ ID NO: 5378418 - DNA, 18 bp, Homo sapiens
caaataccagagcacaga

SEQ ID NO: 5378419 - DNA, 21 bp, Homo sapiens
caaatacccaaatgtccctgc

SEQ ID NO: 5378420 - DNA, 16 bp, Homo sapiens
caaatacccaccaggg

SEQ ID NO: 5378421 - DNA, 15 bp, Homo sapiens
caaatactaaaaaga

SEQ ID NO: 5378422 - DNA, 18 bp, Homo sapiens
caaatactatccaaataa

SEQ ID NO: 5378423 - DNA, 16 bp, Homo sapiens
caaatactcatgtgta

SEQ ID NO: 5378424 - DNA, 17 bp, Homo sapiens
caaatactcatgtgtat

SEQ ID NO: 5378425 - DNA, 18 bp, Homo sapiens
caaatactcatgtgtatg

SEQ ID NO: 5378426 - DNA, 21 bp, Homo sapiens
caaatactccaagcttcaagt

SEQ ID NO: 5378427 - DNA, 13 bp, Homo sapiens
caaatactctgaa

SEQ ID NO: 5378428 - DNA, 20 bp, Homo sapiens
caaatactgatggtgcattt

SEQ ID NO: 5378429 - DNA, 17 bp, Homo sapiens
caaatactgattttcaa

SEQ ID NO: 5378430 - DNA, 20 bp, Homo sapiens
caaatactgattttcaaaaa

SEQ ID NO: 5378431 - DNA, 21 bp, Homo sapiens
caaatactgtgtttcagaagc

SEQ ID NO: 5378432 - DNA, 22 bp, Homo sapiens
caaatacttagcaaaaagtggg

SEQ ID NO: 5378433 - DNA, 15 bp, Homo sapiens
caaatacttattcat

SEQ ID NO: 5378434 - DNA, 17 bp, Homo sapiens
caaatacttattcattg

SEQ ID NO: 5378435 - DNA, 18 bp, Homo sapiens
caaatacttattcattgt

SEQ ID NO: 5378436 - DNA, 21 bp, Homo sapiens
caaatacttattcattgtggt

SEQ ID NO: 5378437 - DNA, 16 bp, Homo sapiens
caaatactttaaagga

SEQ ID NO: 5378438 - DNA, 22 bp, Homo sapiens
caaatagagtttttatatttgt

SEQ ID NO: 5378439 - DNA, 23 bp, Homo sapiens
caaatagagtttttatatttgtt

SEQ ID NO: 5378440 - DNA, 23 bp, Homo sapiens
caaatagatttttgattcagctc

SEQ ID NO: 5378441 - DNA, 16 bp, Homo sapiens
caaatagcaaatgaaa

SEQ ID NO: 5378442 - DNA, 18 bp, Homo sapiens
caaatagcaaggccaggg

SEQ ID NO: 5378443 - DNA, 16 bp, Homo sapiens
caaatagccacaatta

SEQ ID NO: 5378444 - DNA, 19 bp, Homo sapiens
caaatagccaccttgattt

SEQ ID NO: 5378445 - DNA, 18 bp, Homo sapiens
caaatagccccagactgg

SEQ ID NO: 5378446 - DNA, 22 bp, Homo sapiens
caaatagcgtgggatagatttg

SEQ ID NO: 5378447 - DNA, 23 bp, Homo sapiens
caaataggagggagactgtggta

SEQ ID NO: 5378448 - DNA, 21 bp, Homo sapiens
caaataggagtgagtgtatgt

SEQ ID NO: 5378449 - DNA, 18 bp, Homo sapiens
caaataggatgcttggga

SEQ ID NO: 5378450 - DNA, 20 bp, Homo sapiens
caaatagggcaaagaatcaa

SEQ ID NO: 5378451 - DNA, 23 bp, Homo sapiens
caaatagtagagtatcagttgca

SEQ ID NO: 5378452 - DNA, 23 bp, Homo sapiens
caaatagtaggcaagatggcaca

SEQ ID NO: 5378453 - DNA, 15 bp, Homo sapiens
caaatagtatagaaa

SEQ ID NO: 5378454 - DNA, 18 bp, Homo sapiens
caaatagtatagaaaatg

SEQ ID NO: 5378455 - DNA, 15 bp, Homo sapiens
caaatagtgaaaagt

SEQ ID NO: 5378456 - DNA, 13 bp, Homo sapiens
caaatagtgattg

SEQ ID NO: 5378457 - DNA, 15 bp, Homo sapiens
caaatagtgctcgct

SEQ ID NO: 5378458 - DNA, 15 bp, Homo sapiens
caaatagtgtgaaat

SEQ ID NO: 5378459 - DNA, 23 bp, Homo sapiens
caaatagtgttgatcagatctta

SEQ ID NO: 5378460 - DNA, 15 bp, Homo sapiens
caaatataaacagca

SEQ ID NO: 5378461 - DNA, 15 bp, Homo sapiens
caaatataaacttgt

SEQ ID NO: 5378462 - DNA, 21 bp, Homo sapiens
caaatataacaagtataatta

SEQ ID NO: 5378463 - DNA, 18 bp, Homo sapiens
caaatataagaataaaat

SEQ ID NO: 5378464 - DNA, 22 bp, Homo sapiens
caaatataagaataaaatgttg

SEQ ID NO: 5378465 - DNA, 23 bp, Homo sapiens
caaatataagacatttgtttgct

SEQ ID NO: 5378466 - DNA, 18 bp, Homo sapiens
caaatatactcatttgga

SEQ ID NO: 5378467 - DNA, 19 bp, Homo sapiens
caaatatagcgttcccaac

SEQ ID NO: 5378468 - DNA, 19 bp, Homo sapiens
caaatatagttgaacaaga

SEQ ID NO: 5378469 - DNA, 19 bp, Homo sapiens
caaatatatatatgtatat

SEQ ID NO: 5378470 - DNA, 13 bp, Homo sapiens
caaatatatgtat

SEQ ID NO: 5378471 - DNA, 21 bp, Homo sapiens
caaatatatgtatatatattc

SEQ ID NO: 5378472 - DNA, 13 bp, Homo sapiens
caaatatattatt

SEQ ID NO: 5378473 - DNA, 23 bp, Homo sapiens
caaatatattcagcctggcttca

SEQ ID NO: 5378474 - DNA, 15 bp, Homo sapiens
caaatatattctctt

SEQ ID NO: 5378475 - DNA, 20 bp, Homo sapiens
caaatatattctctttggtg

SEQ ID NO: 5378476 - DNA, 11 bp, Homo sapiens
caaatatattg

SEQ ID NO: 5378477 - DNA, 14 bp, Homo sapiens
caaatatattgcaa

SEQ ID NO: 5378478 - DNA, 16 bp, Homo sapiens
caaatatatttaacta

SEQ ID NO: 5378479 - DNA, 14 bp, Homo sapiens
caaatatatttaat

SEQ ID NO: 5378480 - DNA, 21 bp, Homo sapiens
caaatatatttaattgtgtca

SEQ ID NO: 5378481 - DNA, 19 bp, Homo sapiens
caaatatatttaggccagg

SEQ ID NO: 5378482 - DNA, 15 bp, Homo sapiens
caaatatcaaaagga

SEQ ID NO: 5378483 - DNA, 19 bp, Homo sapiens
caaatatcaaaaggaagat

SEQ ID NO: 5378484 - DNA, 22 bp, Homo sapiens
caaatatcaaaaggaagattct

SEQ ID NO: 5378485 - DNA, 18 bp, Homo sapiens
caaatatcatttactctt

SEQ ID NO: 5378486 - DNA, 14 bp, Homo sapiens
caaatatctcagag

SEQ ID NO: 5378487 - DNA, 15 bp, Homo sapiens
caaatatgaaaaatg

SEQ ID NO: 5378488 - DNA, 21 bp, Homo sapiens
caaatatgagtacaaatgcct

SEQ ID NO: 5378489 - DNA, 17 bp, Homo sapiens
caaatgttgtatttcaa

SEQ ID NO: 5378490 - DNA, 12 bp, Homo sapiens
caaatgtttaaa

SEQ ID NO: 5378491 - DNA, 18 bp, Homo sapiens
caaatgtttaaacatttt

SEQ ID NO: 5378492 - DNA, 13 bp, Homo sapiens
caaatgtttaatc

SEQ ID NO: 5378493 - DNA, 16 bp, Homo sapiens
caaatgtttaatcata

SEQ ID NO: 5378494 - DNA, 17 bp, Homo sapiens
caaatgtttaatcatat

SEQ ID NO: 5378495 - DNA, 22 bp, Homo sapiens
caaatgtttaatcatataaata

SEQ ID NO: 5378496 - DNA, 11 bp, Homo sapiens
caaatgtttac

SEQ ID NO: 5378497 - DNA, 16 bp, Homo sapiens
caaatgtttacatttt

SEQ ID NO: 5378498 - DNA, 12 bp, Homo sapiens
caaatgtttact

SEQ ID NO: 5378499 - DNA, 12 bp, Homo sapiens
caaatgtttata

SEQ ID NO: 5378500 - DNA, 14 bp, Homo sapiens
caaatgtttataaa

SEQ ID NO: 5378501 - DNA, 23 bp, Homo sapiens
caaatgtttataactctagggat

SEQ ID NO: 5378502 - DNA, 18 bp, Homo sapiens
caaatgtttatttaaaag

SEQ ID NO: 5378503 - DNA, 21 bp, Homo sapiens
caaatgtttccttaaacatga

SEQ ID NO: 5378504 - DNA, 12 bp, Homo sapiens
caaatgtttcta

SEQ ID NO: 5378505 - DNA, 20 bp, Homo sapiens
caaatgtttgaaaacaaaaa

SEQ ID NO: 5378506 - DNA, 17 bp, Homo sapiens
caaatgttttaaagttt

SEQ ID NO: 5378507 - DNA, 15 bp, Homo sapiens
caaatgttttagtaa

SEQ ID NO: 5378508 - DNA, 14 bp, Homo sapiens
caaatgttttcatt

SEQ ID NO: 5378509 - DNA, 19 bp, Homo sapiens
caaattaaaaaaaaattgt

SEQ ID NO: 5378510 - DNA, 17 bp, Homo sapiens
caaattaaaaaagataa

SEQ ID NO: 5378511 - DNA, 13 bp, Homo sapiens
caaattaaaacat

SEQ ID NO: 5378512 - DNA, 13 bp, Homo sapiens
caaattaaataaa

SEQ ID NO: 5378513 - DNA, 22 bp, Homo sapiens
caaattaagggttaagaaaaga

SEQ ID NO: 5378514 - DNA, 15 bp, Homo sapiens
caaattaataatctt

SEQ ID NO: 5378515 - DNA, 14 bp, Homo sapiens
caaattaatatttg

SEQ ID NO: 5378516 - DNA, 18 bp, Homo sapiens
caaattaatgtgtaaaat

SEQ ID NO: 5378517 - DNA, 22 bp, Homo sapiens
caaattaatgtgtaaaattgga

SEQ ID NO: 5378518 - DNA, 15 bp, Homo sapiens
caaattaatgttcca

SEQ ID NO: 5378519 - DNA, 15 bp, Homo sapiens
caaattaattggcag

SEQ ID NO: 5378520 - DNA, 19 bp, Homo sapiens
caaattaattggcagcaga

SEQ ID NO: 5378521 - DNA, 20 bp, Homo sapiens
caaattaattgtgtgaactt

SEQ ID NO: 5378522 - DNA, 13 bp, Homo sapiens
caaattacaagta

SEQ ID NO: 5378523 - DNA, 12 bp, Homo sapiens
caaattacatga

SEQ ID NO: 5378524 - DNA, 15 bp, Homo sapiens
caaattactaatgat

SEQ ID NO: 5378525 - DNA, 17 bp, Homo sapiens
caaattagccagacatg

SEQ ID NO: 5378526 - DNA, 16 bp, Homo sapiens
caaattagttggtttg

SEQ ID NO: 5378527 - DNA, 13 bp, Homo sapiens
caaattataatgt

SEQ ID NO: 5378528 - DNA, 15 bp, Homo sapiens
caaattataatgtat

SEQ ID NO: 5378529 - DNA, 18 bp, Homo sapiens
caaattataatgtattca

SEQ ID NO: 5378530 - DNA, 20 bp, Homo sapiens
caaattatatgctaattaaa

SEQ ID NO: 5378531 - DNA, 14 bp, Homo sapiens
caaattatgtgaaa

SEQ ID NO: 5378532 - DNA, 22 bp, Homo sapiens
caaattattaattgtcctgtgt

SEQ ID NO: 5378533 - DNA, 23 bp, Homo sapiens
caaattattaattgtcctgtgtc

SEQ ID NO: 5378534 - DNA, 13 bp, Homo sapiens
caaattattctag

SEQ ID NO: 5378535 - DNA, 12 bp, Homo sapiens
caaattatttat

SEQ ID NO: 5378536 - DNA, 13 bp, Homo sapiens
caaattatttatt

SEQ ID NO: 5378537 - DNA, 16 bp, Homo sapiens
caaattatttattact

SEQ ID NO: 5378538 - DNA, 17 bp, Homo sapiens
caaattatttgtgtaat

SEQ ID NO: 5378539 - DNA, 19 bp, Homo sapiens
caaattatttttaaaagaa

SEQ ID NO: 5378540 - DNA, 21 bp, Homo sapiens
caaattatttttaaaagaaaa

SEQ ID NO: 5378541 - DNA, 15 bp, Homo sapiens
caaattatttttcct

SEQ ID NO: 5378542 - DNA, 18 bp, Homo sapiens
caaattcaaaagagagag

SEQ ID NO: 5378543 - DNA, 21 bp, Homo sapiens
caaattcaaggagatataaaa

SEQ ID NO: 5378544 - DNA, 15 bp, Homo sapiens
caaattcaaggcctt

SEQ ID NO: 5378545 - DNA, 21 bp, Homo sapiens
caaattcacgttctagtgaaa

SEQ ID NO: 5378546 - DNA, 12 bp, Homo sapiens
caaattcagctc

SEQ ID NO: 5378547 - DNA, 21 bp, Homo sapiens
caaattcagtggacatttgtt

SEQ ID NO: 5378548 - DNA, 12 bp, Homo sapiens
caaattcagttt

SEQ ID NO: 5378549 - DNA, 14 bp, Homo sapiens
caaattcagtttca

SEQ ID NO: 5378550 - DNA, 17 bp, Homo sapiens
caaattcagtttcataa

SEQ ID NO: 5378551 - DNA, 17 bp, Homo sapiens
caaattcatattctttt

SEQ ID NO: 5378552 - DNA, 14 bp, Homo sapiens
caaattcatttttt

SEQ ID NO: 5378553 - DNA, 22 bp, Homo sapiens
caaattccaaacttctaaatgt

SEQ ID NO: 5378554 - DNA, 13 bp, Homo sapiens
caaattccaatac

SEQ ID NO: 5378555 - DNA, 20 bp, Homo sapiens
caaattcccagatttgaaga

SEQ ID NO: 5378556 - DNA, 16 bp, Homo sapiens
caaattccctctggag

SEQ ID NO: 5378557 - DNA, 19 bp, Homo sapiens
caaattccctggacctctg

SEQ ID NO: 5378558 - DNA, 20 bp, Homo sapiens
caaattcctatttttaaata

SEQ ID NO: 5378559 - DNA, 13 bp, Homo sapiens
caaattcctgcaa

SEQ ID NO: 5378560 - DNA, 16 bp, Homo sapiens
caaattcctttcagag

SEQ ID NO: 5378561 - DNA, 20 bp, Homo sapiens
caaattctacaacttttcct

SEQ ID NO: 5378562 - DNA, 22 bp, Homo sapiens
caaattctacagcatacagagc

SEQ ID NO: 5378563 - DNA, 15 bp, Homo sapiens
caaattctcaccaaa

SEQ ID NO: 5378564 - DNA, 18 bp, Homo sapiens
caaattctcttctttttc

SEQ ID NO: 5378565 - DNA, 16 bp, Homo sapiens
caaattctgaatattt

SEQ ID NO: 5378566 - DNA, 19 bp, Homo sapiens
caaattctgaggtaagtgt

SEQ ID NO: 5378567 - DNA, 13 bp, Homo sapiens
caaattctgatta

SEQ ID NO: 5378568 - DNA, 21 bp, Homo sapiens
caaattctgattattacaaca

SEQ ID NO: 5378569 - DNA, 13 bp, Homo sapiens
caaattctgtctg

SEQ ID NO: 5378570 - DNA, 14 bp, Homo sapiens
caaattcttctgaa

SEQ ID NO: 5378571 - DNA, 13 bp, Homo sapiens
caaattctttagt

SEQ ID NO: 5378572 - DNA, 20 bp, Homo sapiens
caaattctttagtactcaat

SEQ ID NO: 5378573 - DNA, 14 bp, Homo sapiens
caaattcttttgaa

SEQ ID NO: 5378574 - DNA, 17 bp, Homo sapiens
caaattcttttgaattg

SEQ ID NO: 5378575 - DNA, 21 bp, Homo sapiens
caaattcttttgaattgttac

SEQ ID NO: 5378576 - DNA, 17 bp, Homo sapiens
caaattgaactctttga

SEQ ID NO: 5378577 - DNA, 20 bp, Homo sapiens
caaattgactcttatttata

SEQ ID NO: 5378578 - DNA, 14 bp, Homo sapiens
caaattgagacagt

SEQ ID NO: 5378579 - DNA, 22 bp, Homo sapiens
caaattgagataatgatactta

SEQ ID NO: 5378580 - DNA, 22 bp, Homo sapiens
caaattgagtttaacaataata

SEQ ID NO: 5378581 - DNA, 22 bp, Homo sapiens
caaattgcacagaagtcctgta

SEQ ID NO: 5378582 - DNA, 15 bp, Homo sapiens
caaattgcactgaag

SEQ ID NO: 5378583 - DNA, 17 bp, Homo sapiens
caaattgcactgaagtt

SEQ ID NO: 5378584 - DNA, 18 bp, Homo sapiens
caaattgcactgaagttt

SEQ ID NO: 5378585 - DNA, 20 bp, Homo sapiens
caaattgcactgaagttttt

SEQ ID NO: 5378586 - DNA, 14 bp, Homo sapiens
caaattgcagaaga

SEQ ID NO: 5378587 - DNA, 16 bp, Homo sapiens
caaattgccttcagcc

SEQ ID NO: 5378588 - DNA, 16 bp, Homo sapiens
caaattgctgagatgt

SEQ ID NO: 5378589 - DNA, 15 bp, Homo sapiens
caaattgctgcttgg

SEQ ID NO: 5378590 - DNA, 17 bp, Homo sapiens
caaattgcttaaaaaag

SEQ ID NO: 5378591 - DNA, 17 bp, Homo sapiens
caaattgcttgagcctg

SEQ ID NO: 5378592 - DNA, 15 bp, Homo sapiens
caaattggacagcta

SEQ ID NO: 5378593 - DNA, 19 bp, Homo sapiens
caaattggactttcaaaat

SEQ ID NO: 5378594 - DNA, 21 bp, Homo sapiens
caaattggagcttcatggcag

SEQ ID NO: 5378595 - DNA, 15 bp, Homo sapiens
caaattggtgtttct

SEQ ID NO: 5378596 - DNA, 17 bp, Homo sapiens
caaattggtgtttctga

SEQ ID NO: 5378597 - DNA, 17 bp, Homo sapiens
caaattgtaactacact

SEQ ID NO: 5378598 - DNA, 21 bp, Homo sapiens
caaattgtaagcatgcacaaa

SEQ ID NO: 5378599 - DNA, 15 bp, Homo sapiens
caaattgtaattaat

SEQ ID NO: 5378600 - DNA, 12 bp, Homo sapiens
caaattgtagcc

SEQ ID NO: 5378601 - DNA, 19 bp, Homo sapiens
caaattgtatctagtgcag

SEQ ID NO: 5378602 - DNA, 17 bp, Homo sapiens
caaattgtcgtttttat

SEQ ID NO: 5378603 - DNA, 20 bp, Homo sapiens
caaattgtctgtctgctctt

SEQ ID NO: 5378604 - DNA, 12 bp, Homo sapiens
caaattgtgaaa

SEQ ID NO: 5378605 - DNA, 17 bp, Homo sapiens
caaattgtgcaaaatat

SEQ ID NO: 5378606 - DNA, 14 bp, Homo sapiens
caaattgtgcttct

SEQ ID NO: 5378607 - DNA, 19 bp, Homo sapiens
caaattgtgcttctcccca

SEQ ID NO: 5378608 - DNA, 22 bp, Homo sapiens
caaattgtgcttctccccagaa

SEQ ID NO: 5378609 - DNA, 15 bp, Homo sapiens
caaattgtgtgaaag

SEQ ID NO: 5378610 - DNA, 16 bp, Homo sapiens
caaattgtttgtacag

SEQ ID NO: 5378611 - DNA, 20 bp, Homo sapiens
caaatttaaaggaaacacta

SEQ ID NO: 5378612 - DNA, 14 bp, Homo sapiens
caaatttaattaaa

SEQ ID NO: 5378613 - DNA, 20 bp, Homo sapiens
caaatttaattaaagcctta

SEQ ID NO: 5378614 - DNA, 14 bp, Homo sapiens
caaatttacattta

SEQ ID NO: 5378615 - DNA, 22 bp, Homo sapiens
caaatttagaaactaattgact

SEQ ID NO: 5378616 - DNA, 10 bp, Homo sapiens
caaatttagt

SEQ ID NO: 5378617 - DNA, 12 bp, Homo sapiens
caaatttagttt

SEQ ID NO: 5378618 - DNA, 16 bp, Homo sapiens
caaatttagtttgtta

SEQ ID NO: 5378619 - DNA, 16 bp, Homo sapiens
caaatttataatttta

SEQ ID NO: 5378620 - DNA, 17 bp, Homo sapiens
caaatttatatttttta

SEQ ID NO: 5378621 - DNA, 16 bp, Homo sapiens
caaatttatcaaagca

SEQ ID NO: 5378622 - DNA, 16 bp, Homo sapiens
caaatttatgcatttc

SEQ ID NO: 5378623 - DNA, 22 bp, Homo sapiens
caaatttatgcatttcattcaa

SEQ ID NO: 5378624 - DNA, 14 bp, Homo sapiens
caaatttatttcca

SEQ ID NO: 5378625 - DNA, 21 bp, Homo sapiens
caaatttattttaatgtaaag

SEQ ID NO: 5378626 - DNA, 21 bp, Homo sapiens
caaatttatttttttcttttg

SEQ ID NO: 5378627 - DNA, 19 bp, Homo sapiens
caaatttcatctttccaaa

SEQ ID NO: 5378628 - DNA, 20 bp, Homo sapiens
caaatttcattatctaatga

SEQ ID NO: 5378629 - DNA, 17 bp, Homo sapiens
caaatttcattgcactt

SEQ ID NO: 5378630 - DNA, 18 bp, Homo sapiens
caaatttcattgcacttt

SEQ ID NO: 5378631 - DNA, 13 bp, Homo sapiens
caaatttcctgtt

SEQ ID NO: 5378632 - DNA, 15 bp, Homo sapiens
caaatttctaaatct

SEQ ID NO: 5378633 - DNA, 22 bp, Homo sapiens
caaatttctaaatctccaaaat

SEQ ID NO: 5378634 - DNA, 15 bp, Homo sapiens
caaatttctctcttt

SEQ ID NO: 5378635 - DNA, 21 bp, Homo sapiens
caaatttgcaaaactgtgctt

SEQ ID NO: 5378636 - DNA, 13 bp, Homo sapiens
caaatttgctttg

SEQ ID NO: 5378637 - DNA, 14 bp, Homo sapiens
caaatttggcaaaa

SEQ ID NO: 5378638 - DNA, 16 bp, Homo sapiens
caaatttggccttaag

SEQ ID NO: 5378639 - DNA, 18 bp, Homo sapiens
caaatttggccttaagaa

SEQ ID NO: 5378640 - DNA, 13 bp, Homo sapiens
caaatttgtaaac

SEQ ID NO: 5378641 - DNA, 17 bp, Homo sapiens
caaatttgtaataaaac

SEQ ID NO: 5378642 - DNA, 19 bp, Homo sapiens
caaatttgtacaggactgt

SEQ ID NO: 5378643 - DNA, 15 bp, Homo sapiens
caaattttatctgga

SEQ ID NO: 5378644 - DNA, 17 bp, Homo sapiens
caaattttattaaaaga

SEQ ID NO: 5378645 - DNA, 13 bp, Homo sapiens
caaattttcaagt

SEQ ID NO: 5378646 - DNA, 15 bp, Homo sapiens
caaattttcaagttt

SEQ ID NO: 5378647 - DNA, 18 bp, Homo sapiens
caaattttccttcctgtt

SEQ ID NO: 5378648 - DNA, 13 bp, Homo sapiens
caaattttgagca

SEQ ID NO: 5378649 - DNA, 20 bp, Homo sapiens
caaattttgagcaaagaaac

SEQ ID NO: 5378650 - DNA, 15 bp, Homo sapiens
caaattttgcattgt

SEQ ID NO: 5378651 - DNA, 14 bp, Homo sapiens
caaattttgcattt

SEQ ID NO: 5378652 - DNA, 21 bp, Homo sapiens
caaattttggcgaatctcaaa

SEQ ID NO: 5378653 - DNA, 22 bp, Homo sapiens
caaattttggttttctactgtt

SEQ ID NO: 5378654 - DNA, 21 bp, Homo sapiens
caaattttgtaccaagtaaat

SEQ ID NO: 5378655 - DNA, 15 bp, Homo sapiens
caaatttttactcag

SEQ ID NO: 5378656 - DNA, 20 bp, Homo sapiens
caaatttttactcaggcttt

SEQ ID NO: 5378657 - DNA, 12 bp, Homo sapiens
caaatttttcat

SEQ ID NO: 5378658 - DNA, 17 bp, Homo sapiens
caaatttttcatctctt

SEQ ID NO: 5378659 - DNA, 21 bp, Homo sapiens
caaatttttcatctcttcaat

SEQ ID NO: 5378660 - DNA, 20 bp, Homo sapiens
caaatttttctcagtttgta

SEQ ID NO: 5378661 - DNA, 15 bp, Homo sapiens
caaattttttgactt

SEQ ID NO: 5378662 - DNA, 21 bp, Homo sapiens
caaatttttttcttaggagca

SEQ ID NO: 5378663 - DNA, 14 bp, Homo sapiens
caacaaaaaaagtt

SEQ ID NO: 5378664 - DNA, 13 bp, Homo sapiens
caacaaaaaataa

SEQ ID NO: 5378665 - DNA, 12 bp, Homo sapiens
caacaaaaacag

SEQ ID NO: 5378666 - DNA, 19 bp, Homo sapiens
caacaaaaagacatggaag

SEQ ID NO: 5378667 - DNA, 21 bp, Homo sapiens
caacaaaaagacatggaaggt

SEQ ID NO: 5378668 - DNA, 17 bp, Homo sapiens
caacaaaaagcttcccc

SEQ ID NO: 5378669 - DNA, 17 bp, Homo sapiens
caacattcaaagcagca

SEQ ID NO: 5378670 - DNA, 22 bp, Homo sapiens
caacattcattgccaagggccc

SEQ ID NO: 5378671 - DNA, 18 bp, Homo sapiens
caacattccagggatgag

SEQ ID NO: 5378672 - DNA, 19 bp, Homo sapiens
caacattcccccaacatta

SEQ ID NO: 5378673 - DNA, 11 bp, Homo sapiens
caacattcctt

SEQ ID NO: 5378674 - DNA, 16 bp, Homo sapiens
caacattcttgtgtct

SEQ ID NO: 5378675 - DNA, 22 bp, Homo sapiens
caacattgaatatcagttgaca

SEQ ID NO: 5378676 - DNA, 20 bp, Homo sapiens
caacattgatccagtcattt

SEQ ID NO: 5378677 - DNA, 18 bp, Homo sapiens
caacattgccttgcattt

SEQ ID NO: 5378678 - DNA, 17 bp, Homo sapiens
caacattgttcattctt

SEQ ID NO: 5378679 - DNA, 13 bp, Homo sapiens
caacatttatgtg

SEQ ID NO: 5378680 - DNA, 15 bp, Homo sapiens
caacatttattttga

SEQ ID NO: 5378681 - DNA, 16 bp, Homo sapiens
caacatttcaaaatga

SEQ ID NO: 5378682 - DNA, 14 bp, Homo sapiens
caacatttccgaag

SEQ ID NO: 5378683 - DNA, 22 bp, Homo sapiens
caacatttctatagccaaaaat

SEQ ID NO: 5378684 - DNA, 14 bp, Homo sapiens
caacatttctcatg

SEQ ID NO: 5378685 - DNA, 23 bp, Homo sapiens
caacatttctcatgttgaagctt

SEQ ID NO: 5378686 - DNA, 13 bp, Homo sapiens
caacatttctgcc

SEQ ID NO: 5378687 - DNA, 12 bp, Homo sapiens
caacatttctgt

SEQ ID NO: 5378688 - DNA, 13 bp, Homo sapiens
caacatttctgta

SEQ ID NO: 5378689 - DNA, 15 bp, Homo sapiens
caacatttggggaga

SEQ ID NO: 5378690 - DNA, 18 bp, Homo sapiens
caacattttcttgaattt

SEQ ID NO: 5378691 - DNA, 19 bp, Homo sapiens
caacattttgagaacaaag

SEQ ID NO: 5378692 - DNA, 21 bp, Homo sapiens
caacatttttgtacattatgt

SEQ ID NO: 5378693 - DNA, 17 bp, Homo sapiens
caacattttttcccagt

SEQ ID NO: 5378694 - DNA, 15 bp, Homo sapiens
caaccaaagatgctt

SEQ ID NO: 5378695 - DNA, 12 bp, Homo sapiens
caaccaaatggt

SEQ ID NO: 5378696 - DNA, 14 bp, Homo sapiens
caaccaaccagcag

SEQ ID NO: 5378697 - DNA, 14 bp, Homo sapiens
caaccaactttccc

SEQ ID NO: 5378698 - DNA, 22 bp, Homo sapiens
caaccaactttccccccaaccc

SEQ ID NO: 5378699 - DNA, 23 bp, Homo sapiens
caaccaactttccccccaacccg

SEQ ID NO: 5378700 - DNA, 23 bp, Homo sapiens
caaccaagatgcaaatgttttga

SEQ ID NO: 5378701 - DNA, 13 bp, Homo sapiens
caaccaaggaagg

SEQ ID NO: 5378702 - DNA, 15 bp, Homo sapiens
caaccaaggaaggag

SEQ ID NO: 5378703 - DNA, 18 bp, Homo sapiens
caaccaaggaatttaaaa

SEQ ID NO: 5378704 - DNA, 13 bp, Homo sapiens
caaccaagttaca

SEQ ID NO: 5378705 - DNA, 21 bp, Homo sapiens
caaccacacacacctgtctgt

SEQ ID NO: 5378706 - DNA, 21 bp, Homo sapiens
caaccacacttgtcggctcca

SEQ ID NO: 5378707 - DNA, 14 bp, Homo sapiens
caaccacagtgcca

SEQ ID NO: 5378708 - DNA, 22 bp, Homo sapiens
caaccacatacaacacaaagag

SEQ ID NO: 5378709 - DNA, 23 bp, Homo sapiens
caaccacatttagaaatgtttat

SEQ ID NO: 5378710 - DNA, 13 bp, Homo sapiens
caaccaccatgga

SEQ ID NO: 5378711 - DNA, 14 bp, Homo sapiens
caaccaccgctccc

SEQ ID NO: 5378712 - DNA, 21 bp, Homo sapiens
caaccacctaggcaatgaaga

SEQ ID NO: 5378713 - DNA, 15 bp, Homo sapiens
caaccacgtggagaa

SEQ ID NO: 5378714 - DNA, 21 bp, Homo sapiens
caaccacgttgggacagggag

SEQ ID NO: 5378715 - DNA, 18 bp, Homo sapiens
caaccactatcttttgtt

SEQ ID NO: 5378716 - DNA, 20 bp, Homo sapiens
caaccactcggggcccccat

SEQ ID NO: 5378717 - DNA, 15 bp, Homo sapiens
caaccactctgtggc

SEQ ID NO: 5378718 - DNA, 16 bp, Homo sapiens
caaccactctgtggcc

SEQ ID NO: 5378719 - DNA, 18 bp, Homo sapiens
caaccactctgtggccag

SEQ ID NO: 5378720 - DNA, 22 bp, Homo sapiens
caaccactctgtggccagcctg

SEQ ID NO: 5378721 - DNA, 17 bp, Homo sapiens
caaccactgtaaaatga

SEQ ID NO: 5378722 - DNA, 17 bp, Homo sapiens
caaccacttttaaacat

SEQ ID NO: 5378723 - DNA, 18 bp, Homo sapiens
caaccagaattgtcctca

SEQ ID NO: 5378724 - DNA, 18 bp, Homo sapiens
caaccagacagagggtca

SEQ ID NO: 5378725 - DNA, 12 bp, Homo sapiens
caaccagacagc

SEQ ID NO: 5378726 - DNA, 14 bp, Homo sapiens
caaccagacagcac

SEQ ID NO: 5378727 - DNA, 17 bp, Homo sapiens
caaccagacagcacagg

SEQ ID NO: 5378728 - DNA, 20 bp, Homo sapiens
caaccagagtcacccagttg

SEQ ID NO: 5378729 - DNA, 22 bp, Homo sapiens
caaccagcatcccttgaccagg

SEQ ID NO: 5378730 - DNA, 16 bp, Homo sapiens
caaccagcattttact

SEQ ID NO: 5378731 - DNA, 16 bp, Homo sapiens
caaccagccacacaga

SEQ ID NO: 5378732 - DNA, 20 bp, Homo sapiens
caaccagccacacagagcct

SEQ ID NO: 5378733 - DNA, 14 bp, Homo sapiens
caaccagccagcgt

SEQ ID NO: 5378734 - DNA, 12 bp, Homo sapiens
caaccagccttt

SEQ ID NO: 5378735 - DNA, 22 bp, Homo sapiens
caaccagctaagaaaagatttt

SEQ ID NO: 5378736 - DNA, 14 bp, Homo sapiens
caaccaggaaactg

SEQ ID NO: 5378737 - DNA, 18 bp, Homo sapiens
caaccaggaggggtctgc

SEQ ID NO: 5378738 - DNA, 21 bp, Homo sapiens
caaccaggaggggtctgcctc

SEQ ID NO: 5378739 - DNA, 11 bp, Homo sapiens
caaccaggcag

SEQ ID NO: 5378740 - DNA, 12 bp, Homo sapiens
caaccaggcaga

SEQ ID NO: 5378741 - DNA, 14 bp, Homo sapiens
caaccaggccctgc

SEQ ID NO: 5378742 - DNA, 18 bp, Homo sapiens
caaccaggctcctgtgat

SEQ ID NO: 5378743 - DNA, 17 bp, Homo sapiens
caaccagggagctgcag

SEQ ID NO: 5378744 - DNA, 19 bp, Homo sapiens
caaccagggccccggggcc

SEQ ID NO: 5378745 - DNA, 19 bp, Homo sapiens
caaccagtaggatatttct

SEQ ID NO: 5378746 - DNA, 19 bp, Homo sapiens
caaccagtgccaaggacct

SEQ ID NO: 5378747 - DNA, 15 bp, Homo sapiens
caaccatagaactgt

SEQ ID NO: 5378748 - DNA, 12 bp, Homo sapiens
caaccatattta

SEQ ID NO: 5378749 - DNA, 15 bp, Homo sapiens
caaccatatttagca

SEQ ID NO: 5378750 - DNA, 12 bp, Homo sapiens
caaccatcaatg

SEQ ID NO: 5378751 - DNA, 24 bp, Homo sapiens
caaccatcaatggaaacagggcag

SEQ ID NO: 5378752 - DNA, 15 bp, Homo sapiens
caaccatcatgtgta

SEQ ID NO: 5378753 - DNA, 18 bp, Homo sapiens
caaccatgagaccactgt

SEQ ID NO: 5378754 - DNA, 16 bp, Homo sapiens
caaccatgtcatttca

SEQ ID NO: 5378755 - DNA, 18 bp, Homo sapiens
caaccattataaccttaa

SEQ ID NO: 5378756 - DNA, 22 bp, Homo sapiens
caaccattccagactgcttcca

SEQ ID NO: 5378757 - DNA, 14 bp, Homo sapiens
caaccattgaaggg

SEQ ID NO: 5378758 - DNA, 13 bp, Homo sapiens
caaccatttcctc

SEQ ID NO: 5378759 - DNA, 14 bp, Homo sapiens
caaccatttgaaac

SEQ ID NO: 5378760 - DNA, 17 bp, Homo sapiens
caacccaaacctggaga

SEQ ID NO: 5378761 - DNA, 13 bp, Homo sapiens
caacccaaactga

SEQ ID NO: 5378762 - DNA, 21 bp, Homo sapiens
caacccaactgacttctgcta

SEQ ID NO: 5378763 - DNA, 16 bp, Homo sapiens
caacccaagctctggg

SEQ ID NO: 5378764 - DNA, 18 bp, Homo sapiens
caacccaagctctgggga

SEQ ID NO: 5378765 - DNA, 17 bp, Homo sapiens
caacccaataggagtct

SEQ ID NO: 5378766 - DNA, 22 bp, Homo sapiens
caacccaatccctctccactct

SEQ ID NO: 5378767 - DNA, 16 bp, Homo sapiens
caacccaatctggctg

SEQ ID NO: 5378768 - DNA, 21 bp, Homo sapiens
caacccacaccgtcttccttc

SEQ ID NO: 5378769 - DNA, 12 bp, Homo sapiens
caacccacagct

SEQ ID NO: 5378770 - DNA, 13 bp, Homo sapiens
caacccacatggg

SEQ ID NO: 5378771 - DNA, 23 bp, Homo sapiens
caacccacatggggttcctggtt

SEQ ID NO: 5378772 - DNA, 13 bp, Homo sapiens
caacccaccacaa

SEQ ID NO: 5378773 - DNA, 15 bp, Homo sapiens
caacccacctctggc

SEQ ID NO: 5378774 - DNA, 12 bp, Homo sapiens
caacccagccac

SEQ ID NO: 5378775 - DNA, 17 bp, Homo sapiens
caacccagccgctgccc

SEQ ID NO: 5378776 - DNA, 16 bp, Homo sapiens
caacccaggtgttgtc

SEQ ID NO: 5378777 - DNA, 17 bp, Homo sapiens
caacccaggtgttgtcc

SEQ ID NO: 5378778 - DNA, 20 bp, Homo sapiens
caacccataatcatgtaaat

SEQ ID NO: 5378779 - DNA, 16 bp, Homo sapiens
caacccatgagcgtcc

SEQ ID NO: 5378780 - DNA, 21 bp, Homo sapiens
caacccatgcccctgacagat

SEQ ID NO: 5378781 - DNA, 19 bp, Homo sapiens
caacccatgccctggacca

SEQ ID NO: 5378782 - DNA, 22 bp, Homo sapiens
caacccattaatcttttgtagt

SEQ ID NO: 5378783 - DNA, 14 bp, Homo sapiens
caaccccacaagca

SEQ ID NO: 5378784 - DNA, 23 bp, Homo sapiens
caaccccacacgctcctccctct

SEQ ID NO: 5378785 - DNA, 17 bp, Homo sapiens
caaccccacccagctcc

SEQ ID NO: 5378786 - DNA, 13 bp, Homo sapiens
caaccccagaccc

SEQ ID NO: 5378787 - DNA, 18 bp, Homo sapiens
caaccccagcagtcctgg

SEQ ID NO: 5378788 - DNA, 23 bp, Homo sapiens
caaccccagccgctcggaggccc

SEQ ID NO: 5378789 - DNA, 12 bp, Homo sapiens
caaccccagcct

SEQ ID NO: 5378790 - DNA, 13 bp, Homo sapiens
caaccccagggcc

SEQ ID NO: 5378791 - DNA, 22 bp, Homo sapiens
caaccccagggcccccacaggc

SEQ ID NO: 5378792 - DNA, 22 bp, Homo sapiens
caaccccagttctgctcctctc

SEQ ID NO: 5378793 - DNA, 23 bp, Homo sapiens
caaccccatcatatgacatgcca

SEQ ID NO: 5378794 - DNA, 13 bp, Homo sapiens
caacccccacccc

SEQ ID NO: 5378795 - DNA, 23 bp, Homo sapiens
caacccccaccgaagagccctga

SEQ ID NO: 5378796 - DNA, 12 bp, Homo sapiens
caacccccacct

SEQ ID NO: 5378797 - DNA, 15 bp, Homo sapiens
caacccccacctccc

SEQ ID NO: 5378798 - DNA, 17 bp, Homo sapiens
caacccccacctcccgg

SEQ ID NO: 5378799 - DNA, 15 bp, Homo sapiens
caacccccagaggtg

SEQ ID NO: 5378800 - DNA, 16 bp, Homo sapiens
caacccccagccccca

SEQ ID NO: 5378801 - DNA, 15 bp, Homo sapiens
caacccccagcctgc

SEQ ID NO: 5378802 - DNA, 16 bp, Homo sapiens
caacccccagcctgct

SEQ ID NO: 5378803 - DNA, 15 bp, Homo sapiens
caacccccatctccc

SEQ ID NO: 5378804 - DNA, 18 bp, Homo sapiens
caacccccatctccctag

SEQ ID NO: 5378805 - DNA, 17 bp, Homo sapiens
caaccccccacctgcca

SEQ ID NO: 5378806 - DNA, 13 bp, Homo sapiens
caacccccctcct

SEQ ID NO: 5378807 - DNA, 16 bp, Homo sapiens
caacccccctcctgct

SEQ ID NO: 5378808 - DNA, 22 bp, Homo sapiens
caacccccctcctgctcctccc

SEQ ID NO: 5378809 - DNA, 20 bp, Homo sapiens
caacccccgcaccaagcaga

SEQ ID NO: 5378810 - DNA, 17 bp, Homo sapiens
caaccccctcggagcct

SEQ ID NO: 5378811 - DNA, 18 bp, Homo sapiens
caaccccctcggagcctg

SEQ ID NO: 5378812 - DNA, 22 bp, Homo sapiens
caaccccctgtaaggttccatc

SEQ ID NO: 5378813 - DNA, 19 bp, Homo sapiens
caaccccgcggcccagacc

SEQ ID NO: 5378814 - DNA, 18 bp, Homo sapiens
caaccccgcggtgctctg

SEQ ID NO: 5378815 - DNA, 20 bp, Homo sapiens
caaccccgcggtgctctggc

SEQ ID NO: 5378816 - DNA, 21 bp, Homo sapiens
caaccccgcggtgctctggcg

SEQ ID NO: 5378817 - DNA, 11 bp, Homo sapiens
caacccctccc

SEQ ID NO: 5378818 - DNA, 13 bp, Homo sapiens
caacccctcctcc

SEQ ID NO: 5378819 - DNA, 15 bp, Homo sapiens
caacccctcctccct

SEQ ID NO: 5378820 - DNA, 23 bp, Homo sapiens
caacccctcctccctcagactca

SEQ ID NO: 5378821 - DNA, 13 bp, Homo sapiens
caacccctccttc

SEQ ID NO: 5378822 - DNA, 23 bp, Homo sapiens
caacccctccttccccagaccca

SEQ ID NO: 5378823 - DNA, 15 bp, Homo sapiens
caacccctcgcccag

SEQ ID NO: 5378824 - DNA, 13 bp, Homo sapiens
caacccctctcca

SEQ ID NO: 5378825 - DNA, 22 bp, Homo sapiens
caacccctctccaggcctgtca

SEQ ID NO: 5378826 - DNA, 10 bp, Homo sapiens
caacccctga

SEQ ID NO: 5378827 - DNA, 16 bp, Homo sapiens
caacccctgaggaaga

SEQ ID NO: 5378828 - DNA, 22 bp, Homo sapiens
caacccctggaccccagcctca

SEQ ID NO: 5378829 - DNA, 20 bp, Homo sapiens
caacccctgtacccagctcc

SEQ ID NO: 5378830 - DNA, 12 bp, Homo sapiens
caacccctgtgg

SEQ ID NO: 5378831 - DNA, 14 bp, Homo sapiens
caacccctgtggag

SEQ ID NO: 5378832 - DNA, 21 bp, Homo sapiens
caacccctgtggagcccgcac

SEQ ID NO: 5378833 - DNA, 17 bp, Homo sapiens
caaccccttcgctcctg

SEQ ID NO: 5378834 - DNA, 19 bp, Homo sapiens
caaccccttcgctcctgtg

SEQ ID NO: 5378835 - DNA, 22 bp, Homo sapiens
caaccccttcgctcctgtgtct

SEQ ID NO: 5378836 - DNA, 19 bp, Homo sapiens
caacccgctggagcccaca

SEQ ID NO: 5378837 - DNA, 16 bp, Homo sapiens
caacccgtgcccctgg

SEQ ID NO: 5378838 - DNA, 20 bp, Homo sapiens
caacccgtgcccctgggatc

SEQ ID NO: 5378839 - DNA, 17 bp, Homo sapiens
caacccgtggaggctgc

SEQ ID NO: 5378840 - DNA, 22 bp, Homo sapiens
caacccgtttcccggttcagga

SEQ ID NO: 5378841 - DNA, 16 bp, Homo sapiens
caaccctacagtatat

SEQ ID NO: 5378842 - DNA, 12 bp, Homo sapiens
caaccctaccct

SEQ ID NO: 5378843 - DNA, 15 bp, Homo sapiens
caaccctaccctggc

SEQ ID NO: 5378844 - DNA, 18 bp, Homo sapiens
caaccctaccctggcagg

SEQ ID NO: 5378845 - DNA, 19 bp, Homo sapiens
caaccctaggttccctgtt

SEQ ID NO: 5378846 - DNA, 22 bp, Homo sapiens
caaccctatctcctgacagaag

SEQ ID NO: 5378847 - DNA, 13 bp, Homo sapiens
caaccctcagctg

SEQ ID NO: 5378848 - DNA, 12 bp, Homo sapiens
caactttgaata

SEQ ID NO: 5378849 - DNA, 17 bp, Homo sapiens
caactttgaataaagaa

SEQ ID NO: 5378850 - DNA, 23 bp, Homo sapiens
caactttgaataaagaatacttg

SEQ ID NO: 5378851 - DNA, 23 bp, Homo sapiens
caactttgacgtaattaaatcca

SEQ ID NO: 5378852 - DNA, 11 bp, Homo sapiens
caactttggaa

SEQ ID NO: 5378853 - DNA, 18 bp, Homo sapiens
caactttggttcctgtga

SEQ ID NO: 5378854 - DNA, 14 bp, Homo sapiens
caactttgtgcttt

SEQ ID NO: 5378855 - DNA, 14 bp, Homo sapiens
caacttttaaagct

SEQ ID NO: 5378856 - DNA, 23 bp, Homo sapiens
caacttttatgcagcaaatatat

SEQ ID NO: 5378857 - DNA, 22 bp, Homo sapiens
caacttttccaacatacaattt

SEQ ID NO: 5378858 - DNA, 18 bp, Homo sapiens
caacttttctgctacctg

SEQ ID NO: 5378859 - DNA, 18 bp, Homo sapiens
caacttttgactaagaat

SEQ ID NO: 5378860 - DNA, 19 bp, Homo sapiens
caacttttgactaagaatt

SEQ ID NO: 5378861 - DNA, 21 bp, Homo sapiens
caacttttgtgtaatgaaaat

SEQ ID NO: 5378862 - DNA, 18 bp, Homo sapiens
caacttttgttttctgat

SEQ ID NO: 5378863 - DNA, 15 bp, Homo sapiens
caactttttaaagta

SEQ ID NO: 5378864 - DNA, 19 bp, Homo sapiens
caactttttaaagtaaatt

SEQ ID NO: 5378865 - DNA, 16 bp, Homo sapiens
caactttttattgcct

SEQ ID NO: 5378866 - DNA, 19 bp, Homo sapiens
caactttttattgccttct

SEQ ID NO: 5378867 - DNA, 21 bp, Homo sapiens
caactttttattgccttctca

SEQ ID NO: 5378868 - DNA, 19 bp, Homo sapiens
caactttttcattccctgc

SEQ ID NO: 5378869 - DNA, 15 bp, Homo sapiens
caactttttccaagt

SEQ ID NO: 5378870 - DNA, 15 bp, Homo sapiens
caacttttttatgtc

SEQ ID NO: 5378871 - DNA, 14 bp, Homo sapiens
caactttttttcct

SEQ ID NO: 5378872 - DNA, 15 bp, Homo sapiens
caagaaaaaaaaatg

SEQ ID NO: 5378873 - DNA, 16 bp, Homo sapiens
caagaaaaaaaaatgc

SEQ ID NO: 5378874 - DNA, 15 bp, Homo sapiens
caagaaaaaataaat

SEQ ID NO: 5378875 - DNA, 15 bp, Homo sapiens
caagaaaaagaaaaa

SEQ ID NO: 5378876 - DNA, 13 bp, Homo sapiens
caagaaaaagata

SEQ ID NO: 5378877 - DNA, 18 bp, Homo sapiens
caagaaaaagtagaaaaa

SEQ ID NO: 5378878 - DNA, 17 bp, Homo sapiens
caagaaaaataaagaaa

SEQ ID NO: 5378879 - DNA, 21 bp, Homo sapiens
caagaaaaatataaaaacaac

SEQ ID NO: 5378880 - DNA, 15 bp, Homo sapiens
caagaaaacaacttc

SEQ ID NO: 5378881 - DNA, 16 bp, Homo sapiens
caagaaaacaggcact

SEQ ID NO: 5378882 - DNA, 19 bp, Homo sapiens
caagaaaacaggcactgcc

SEQ ID NO: 5378883 - DNA, 20 bp, Homo sapiens
caagaaaacaggcactgccc

SEQ ID NO: 5378884 - DNA, 22 bp, Homo sapiens
caagaaaacaggcactgccctg

SEQ ID NO: 5378885 - DNA, 19 bp, Homo sapiens
caagaaaaccagtggaaga

SEQ ID NO: 5378886 - DNA, 21 bp, Homo sapiens
caagaaaacctgtttttaaca

SEQ ID NO: 5378887 - DNA, 12 bp, Homo sapiens
caagaaaatttt

SEQ ID NO: 5378888 - DNA, 20 bp, Homo sapiens
caagaaacaaacaaaagctg

SEQ ID NO: 5378889 - DNA, 18 bp, Homo sapiens
caagaaacactgcctgcc

SEQ ID NO: 5378890 - DNA, 13 bp, Homo sapiens
caagaaacagaag

SEQ ID NO: 5378891 - DNA, 19 bp, Homo sapiens
caagaaacagccagcaaga

SEQ ID NO: 5378892 - DNA, 14 bp, Homo sapiens
caagaaacaggata

SEQ ID NO: 5378893 - DNA, 20 bp, Homo sapiens
caagaaaccaaagtctgccg

SEQ ID NO: 5378894 - DNA, 22 bp, Homo sapiens
caagaaacctccatcctgccag

SEQ ID NO: 5378895 - DNA, 19 bp, Homo sapiens
caagaaactgaggaatttt

SEQ ID NO: 5378896 - DNA, 16 bp, Homo sapiens
caagaaactttggaag

SEQ ID NO: 5378897 - DNA, 22 bp, Homo sapiens
caagaaagaaacccgacagagg

SEQ ID NO: 5378898 - DNA, 15 bp, Homo sapiens
caagaaagaaatggc

SEQ ID NO: 5378899 - DNA, 19 bp, Homo sapiens
caagaaagaaatggctttt

SEQ ID NO: 5378900 - DNA, 14 bp, Homo sapiens
caagaaagagggtc

SEQ ID NO: 5378901 - DNA, 16 bp, Homo sapiens
caagaaagagggtccc

SEQ ID NO: 5378902 - DNA, 19 bp, Homo sapiens
caagaaagagggtcccagg

SEQ ID NO: 5378903 - DNA, 22 bp, Homo sapiens
caagaaagagggtcccagggct

SEQ ID NO: 5378904 - DNA, 22 bp, Homo sapiens
caagaaagatatctatgactgt

SEQ ID NO: 5378905 - DNA, 17 bp, Homo sapiens
caagaaagatccaccct

SEQ ID NO: 5378906 - DNA, 20 bp, Homo sapiens
caagaaagatgaagcttgga

SEQ ID NO: 5378907 - DNA, 17 bp, Homo sapiens
caagaaaggaaaccttt

SEQ ID NO: 5378908 - DNA, 18 bp, Homo sapiens
caagaaaggaggggagaa

SEQ ID NO: 5378909 - DNA, 18 bp, Homo sapiens
caagaaaggcaagagctc

SEQ ID NO: 5378910 - DNA, 19 bp, Homo sapiens
caagaaaggcagacacacc

SEQ ID NO: 5378911 - DNA, 20 bp, Homo sapiens
caagaaaggctgctgtactg

SEQ ID NO: 5378912 - DNA, 21 bp, Homo sapiens
caagaaagggccaggagatgg

SEQ ID NO: 5378913 - DNA, 12 bp, Homo sapiens
caagaaagtcca

SEQ ID NO: 5378914 - DNA, 14 bp, Homo sapiens
caagaaagtttccc

SEQ ID NO: 5378915 - DNA, 21 bp, Homo sapiens
caagaaataaaaggaagccaa

SEQ ID NO: 5378916 - DNA, 18 bp, Homo sapiens
caagaaataaatcagaga

SEQ ID NO: 5378917 - DNA, 21 bp, Homo sapiens
caagaaatcgccttatgagaa

SEQ ID NO: 5378918 - DNA, 13 bp, Homo sapiens
caagaaatgaaag

SEQ ID NO: 5378919 - DNA, 12 bp, Homo sapiens
caagaaatgctt

SEQ ID NO: 5378920 - DNA, 22 bp, Homo sapiens
caagaaatgtgacttggccggg

SEQ ID NO: 5378921 - DNA, 20 bp, Homo sapiens
caagaaattcattaaagaaa

SEQ ID NO: 5378922 - DNA, 13 bp, Homo sapiens
caagaaatttgat

SEQ ID NO: 5378923 - DNA, 12 bp, Homo sapiens
caagaacaacaa

SEQ ID NO: 5378924 - DNA, 16 bp, Homo sapiens
caagaacaagcaatga

SEQ ID NO: 5378925 - DNA, 21 bp, Homo sapiens
caagaaccactccttcatgtt

SEQ ID NO: 5378926 - DNA, 17 bp, Homo sapiens
caagaacccaagtgcct

SEQ ID NO: 5378927 - DNA, 21 bp, Homo sapiens
caagaacctatatcttacaaa

SEQ ID NO: 5378928 - DNA, 10 bp, Homo sapiens
caagaacctg

SEQ ID NO: 5378929 - DNA, 21 bp, Homo sapiens
caagaactcatcactgtggct

SEQ ID NO: 5378930 - DNA, 16 bp, Homo sapiens
caagaactcctcccac

SEQ ID NO: 5378931 - DNA, 12 bp, Homo sapiens
caagaactctaa

SEQ ID NO: 5378932 - DNA, 18 bp, Homo sapiens
caagaactctaaccagtg

SEQ ID NO: 5378933 - DNA, 20 bp, Homo sapiens
caagaactctaaccagtgta

SEQ ID NO: 5378934 - DNA, 14 bp, Homo sapiens
caagaactctgggc

SEQ ID NO: 5378935 - DNA, 21 bp, Homo sapiens
caagaactgaaaacataaaaa

SEQ ID NO: 5378936 - DNA, 21 bp, Homo sapiens
caagaactgcagatagcccag

SEQ ID NO: 5378937 - DNA, 12 bp, Homo sapiens
caagaactgcat

SEQ ID NO: 5378938 - DNA, 16 bp, Homo sapiens
caagaactgcatggac

SEQ ID NO: 5378939 - DNA, 17 bp, Homo sapiens
caagaacttgtttaata

SEQ ID NO: 5378940 - DNA, 16 bp, Homo sapiens
caagaacttgtttaca

SEQ ID NO: 5378941 - DNA, 20 bp, Homo sapiens
caagaactttccaggaaggc

SEQ ID NO: 5378942 - DNA, 13 bp, Homo sapiens
caagaagaaaaag

SEQ ID NO: 5378943 - DNA, 12 bp, Homo sapiens
caagaagaaata

SEQ ID NO: 5378944 - DNA, 16 bp, Homo sapiens
caagaagaaatatgaa

SEQ ID NO: 5378945 - DNA, 14 bp, Homo sapiens
caagaagaatttat

SEQ ID NO: 5378946 - DNA, 22 bp, Homo sapiens
caagaagaatttattacaaatc

SEQ ID NO: 5378947 - DNA, 21 bp, Homo sapiens
caagaagaccagactgtggag

SEQ ID NO: 5378948 - DNA, 14 bp, Homo sapiens
caagaagagagaac

SEQ ID NO: 5378949 - DNA, 19 bp, Homo sapiens
caagaagatcacgctcccc

SEQ ID NO: 5378950 - DNA, 11 bp, Homo sapiens
caagaagatga

SEQ ID NO: 5378951 - DNA, 19 bp, Homo sapiens
caagaagattctaaaacat

SEQ ID NO: 5378952 - DNA, 22 bp, Homo sapiens
caagaagcaattatttaaagaa

SEQ ID NO: 5378953 - DNA, 23 bp, Homo sapiens
caagaagcaattatttaaagaaa

SEQ ID NO: 5378954 - DNA, 15 bp, Homo sapiens
caagaagcagcctgt

SEQ ID NO: 5378955 - DNA, 20 bp, Homo sapiens
caagaagcaggctacactga

SEQ ID NO: 5378956 - DNA, 12 bp, Homo sapiens
caagaagccctc

SEQ ID NO: 5378957 - DNA, 23 bp, Homo sapiens
caagaagccctccttgccacccc

SEQ ID NO: 5378958 - DNA, 21 bp, Homo sapiens
caagaagcgtgagacgccacc

SEQ ID NO: 5378959 - DNA, 22 bp, Homo sapiens
caagaagctcccagatgctggg

SEQ ID NO: 5378960 - DNA, 13 bp, Homo sapiens
caagaagctgctt

SEQ ID NO: 5378961 - DNA, 12 bp, Homo sapiens
caagaaggattt

SEQ ID NO: 5378962 - DNA, 14 bp, Homo sapiens
caagaaggccagcc

SEQ ID NO: 5378963 - DNA, 21 bp, Homo sapiens
caagaaggccagcccactggg

SEQ ID NO: 5378964 - DNA, 14 bp, Homo sapiens
caagaaggctgggg

SEQ ID NO: 5378965 - DNA, 23 bp, Homo sapiens
caagaagggctagaacctggagg

SEQ ID NO: 5378966 - DNA, 21 bp, Homo sapiens
caagaagtacgaatcttattt

SEQ ID NO: 5378967 - DNA, 16 bp, Homo sapiens
caagaagtagcagtgt

SEQ ID NO: 5378968 - DNA, 23 bp, Homo sapiens
caagaagtcagagaaaacacttt

SEQ ID NO: 5378969 - DNA, 15 bp, Homo sapiens
caagaagtgaggcct

SEQ ID NO: 5378970 - DNA, 19 bp, Homo sapiens
caagaagtgaggcctgggg

SEQ ID NO: 5378971 - DNA, 14 bp, Homo sapiens
caagaagtgggatt

SEQ ID NO: 5378972 - DNA, 23 bp, Homo sapiens
caagaagttaaaaaacagctgca

SEQ ID NO: 5378973 - DNA, 18 bp, Homo sapiens
caagaataagcagcaaat

SEQ ID NO: 5378974 - DNA, 21 bp, Homo sapiens
caagaataatcacgctttcct

SEQ ID NO: 5378975 - DNA, 22 bp, Homo sapiens
caagaataatcacgctttcctg

SEQ ID NO: 5378976 - DNA, 14 bp, Homo sapiens
caagaatacttgaa

SEQ ID NO: 5378977 - DNA, 18 bp, Homo sapiens
caagaatagcatctgtac

SEQ ID NO: 5378978 - DNA, 13 bp, Homo sapiens
caagaatatagtt

SEQ ID NO: 5378979 - DNA, 16 bp, Homo sapiens
caagaatattcaaatg

SEQ ID NO: 5378980 - DNA, 13 bp, Homo sapiens
caagaatattgca

SEQ ID NO: 5378981 - DNA, 18 bp, Homo sapiens
caagaatattgcaaaata

SEQ ID NO: 5378982 - DNA, 23 bp, Homo sapiens
caagaatattgcaaaatacatga

SEQ ID NO: 5378983 - DNA, 15 bp, Homo sapiens
caagaatattgtatg

SEQ ID NO: 5378984 - DNA, 16 bp, Homo sapiens
caagaatcagaagaaa

SEQ ID NO: 5378985 - DNA, 19 bp, Homo sapiens
caagaatcagacagcagga

SEQ ID NO: 5378986 - DNA, 12 bp, Homo sapiens
caagaatcattg

SEQ ID NO: 5378987 - DNA, 22 bp, Homo sapiens
caagaatccacatttctaaaat

SEQ ID NO: 5378988 - DNA, 13 bp, Homo sapiens
caagaatcctctg

SEQ ID NO: 5378989 - DNA, 22 bp, Homo sapiens
caagaatcggcatgtatactta

SEQ ID NO: 5378990 - DNA, 10 bp, Homo sapiens
caagaatcta

SEQ ID NO: 5378991 - DNA, 15 bp, Homo sapiens
caagaatgaaatact

SEQ ID NO: 5378992 - DNA, 14 bp, Homo sapiens
caagaatgaaatga

SEQ ID NO: 5378993 - DNA, 18 bp, Homo sapiens
caagaatgaaatgaatga

SEQ ID NO: 5378994 - DNA, 23 bp, Homo sapiens
caagaatgacggaataagagacc

SEQ ID NO: 5378995 - DNA, 22 bp, Homo sapiens
caagaatgatgcctttcaggtc

SEQ ID NO: 5378996 - DNA, 23 bp, Homo sapiens
caagaatgcattccctgaatctg

SEQ ID NO: 5378997 - DNA, 15 bp, Homo sapiens
caagaatgcattgat

SEQ ID NO: 5378998 - DNA, 13 bp, Homo sapiens
caagaatgctgaa

SEQ ID NO: 5378999 - DNA, 17 bp, Homo sapiens
caagaatgctgaaacca

SEQ ID NO: 5379000 - DNA, 15 bp, Homo sapiens
caagaatggaagcct

SEQ ID NO: 5379001 - DNA, 14 bp, Homo sapiens
caagaatggatcac

SEQ ID NO: 5379002 - DNA, 22 bp, Homo sapiens
caagaatggatcacaagatgga

SEQ ID NO: 5379003 - DNA, 17 bp, Homo sapiens
caagaatgtctccattg

SEQ ID NO: 5379004 - DNA, 14 bp, Homo sapiens
caagaattaaaact

SEQ ID NO: 5379005 - DNA, 15 bp, Homo sapiens
caagaattaatattt

SEQ ID NO: 5379006 - DNA, 17 bp, Homo sapiens
caagaattctagaaaat

SEQ ID NO: 5379007 - DNA, 22 bp, Homo sapiens
caagaatttgatcgttccagtt

SEQ ID NO: 5379008 - DNA, 12 bp, Homo sapiens
caagacaaatca

SEQ ID NO: 5379009 - DNA, 13 bp, Homo sapiens
caagacaaatcaa

SEQ ID NO: 5379010 - DNA, 15 bp, Homo sapiens
caagacaaatcaaca

SEQ ID NO: 5379011 - DNA, 18 bp, Homo sapiens
caagacaaatcaacagaa

SEQ ID NO: 5379012 - DNA, 20 bp, Homo sapiens
caagacaaatcaacagaagc

SEQ ID NO: 5379013 - DNA, 21 bp, Homo sapiens
caagacaaatcaacagaagca

SEQ ID NO: 5379014 - DNA, 13 bp, Homo sapiens
caagacaagctcc

SEQ ID NO: 5379015 - DNA, 14 bp, Homo sapiens
caagacaagctcct

SEQ ID NO: 5379016 - DNA, 19 bp, Homo sapiens
caagacaagctcctccctt

SEQ ID NO: 5379017 - DNA, 19 bp, Homo sapiens
caagacaagtgattttcat

SEQ ID NO: 5379018 - DNA, 13 bp, Homo sapiens
caagacacatgct

SEQ ID NO: 5379019 - DNA, 13 bp, Homo sapiens
caagacacccaag

SEQ ID NO: 5379020 - DNA, 17 bp, Homo sapiens
caagacaccttcccagc

SEQ ID NO: 5379021 - DNA, 19 bp, Homo sapiens
caagacaccttttgtattt

SEQ ID NO: 5379022 - DNA, 24 bp, Homo sapiens
caagacactagttcagaggaagca

SEQ ID NO: 5379023 - DNA, 17 bp, Homo sapiens
caagacagaagctgaag

SEQ ID NO: 5379024 - DNA, 18 bp, Homo sapiens
caagacagagacgcagga

SEQ ID NO: 5379025 - DNA, 14 bp, Homo sapiens
caagacagagggga

SEQ ID NO: 5379026 - DNA, 20 bp, Homo sapiens
caagattttagggcttttat

SEQ ID NO: 5379027 - DNA, 22 bp, Homo sapiens
caagattttagggcttttattt

SEQ ID NO: 5379028 - DNA, 19 bp, Homo sapiens
caagattttcctcttgtga

SEQ ID NO: 5379029 - DNA, 15 bp, Homo sapiens
caagattttcctttt

SEQ ID NO: 5379030 - DNA, 16 bp, Homo sapiens
caagattttgaaggaa

SEQ ID NO: 5379031 - DNA, 17 bp, Homo sapiens
caagattttgaaggaaa

SEQ ID NO: 5379032 - DNA, 23 bp, Homo sapiens
caagattttgggagagtaaagct

SEQ ID NO: 5379033 - DNA, 23 bp, Homo sapiens
caagattttgtttcttacgcttg

SEQ ID NO: 5379034 - DNA, 18 bp, Homo sapiens
caagattttttaattgtt

SEQ ID NO: 5379035 - DNA, 20 bp, Homo sapiens
caagattttttttgtaactt

SEQ ID NO: 5379036 - DNA, 21 bp, Homo sapiens
caagattttttttgtaacttc

SEQ ID NO: 5379037 - DNA, 14 bp, Homo sapiens
caagcaaaatcatg

SEQ ID NO: 5379038 - DNA, 22 bp, Homo sapiens
caagcaaaatcatggaatggtt

SEQ ID NO: 5379039 - DNA, 15 bp, Homo sapiens
caagcaaaatttctg

SEQ ID NO: 5379040 - DNA, 14 bp, Homo sapiens
caagcaaacccaga

SEQ ID NO: 5379041 - DNA, 15 bp, Homo sapiens
caagcaaaccttctc

SEQ ID NO: 5379042 - DNA, 21 bp, Homo sapiens
caagcaaagacagtttcttgc

SEQ ID NO: 5379043 - DNA, 19 bp, Homo sapiens
caagcaaatgcctgccaaa

SEQ ID NO: 5379044 - DNA, 15 bp, Homo sapiens
caagcaaatgtgaat

SEQ ID NO: 5379045 - DNA, 17 bp, Homo sapiens
caagcaaatgtgaatca

SEQ ID NO: 5379046 - DNA, 15 bp, Homo sapiens
caagcaacagccttt

SEQ ID NO: 5379047 - DNA, 22 bp, Homo sapiens
caagcaacagcctttgaatgta

SEQ ID NO: 5379048 - DNA, 15 bp, Homo sapiens
caagcaacatttgta

SEQ ID NO: 5379049 - DNA, 16 bp, Homo sapiens
caagcaacctgggtcc

SEQ ID NO: 5379050 - DNA, 14 bp, Homo sapiens
caagcaactaattt

SEQ ID NO: 5379051 - DNA, 13 bp, Homo sapiens
caagcaagcaaaa

SEQ ID NO: 5379052 - DNA, 15 bp, Homo sapiens
caagcaagctctctt

SEQ ID NO: 5379053 - DNA, 17 bp, Homo sapiens
caagcaaggatatcaga

SEQ ID NO: 5379054 - DNA, 13 bp, Homo sapiens
caagcaataatta

SEQ ID NO: 5379055 - DNA, 13 bp, Homo sapiens
caagcaatcctcc

SEQ ID NO: 5379056 - DNA, 14 bp, Homo sapiens
caagcaatcctcct

SEQ ID NO: 5379057 - DNA, 15 bp, Homo sapiens
caagcaatcctccta

SEQ ID NO: 5379058 - DNA, 17 bp, Homo sapiens
caagcaatcctcctgag

SEQ ID NO: 5379059 - DNA, 17 bp, Homo sapiens
caagcaatcctcctgcc

SEQ ID NO: 5379060 - DNA, 20 bp, Homo sapiens
caagcaatcctcctgcctca

SEQ ID NO: 5379061 - DNA, 17 bp, Homo sapiens
caagcaatgatgaccca

SEQ ID NO: 5379062 - DNA, 20 bp, Homo sapiens
caagcaatgatgacccacta

SEQ ID NO: 5379063 - DNA, 13 bp, Homo sapiens
caagcaattctgc

SEQ ID NO: 5379064 - DNA, 19 bp, Homo sapiens
caagcacaaactgtcgtct

SEQ ID NO: 5379065 - DNA, 16 bp, Homo sapiens
caagcacaacccacca

SEQ ID NO: 5379066 - DNA, 16 bp, Homo sapiens
caagcacaattgatct

SEQ ID NO: 5379067 - DNA, 18 bp, Homo sapiens
caagcacaattgatctct

SEQ ID NO: 5379068 - DNA, 17 bp, Homo sapiens
caagcacactggaatat

SEQ ID NO: 5379069 - DNA, 18 bp, Homo sapiens
caagcacagagcctggcc

SEQ ID NO: 5379070 - DNA, 21 bp, Homo sapiens
caagcacagagcctggcccca

SEQ ID NO: 5379071 - DNA, 13 bp, Homo sapiens
caagcacagcagc

SEQ ID NO: 5379072 - DNA, 14 bp, Homo sapiens
caagcacagcagcc

SEQ ID NO: 5379073 - DNA, 14 bp, Homo sapiens
caagcacagccctt

SEQ ID NO: 5379074 - DNA, 13 bp, Homo sapiens
caagcacagtcag

SEQ ID NO: 5379075 - DNA, 17 bp, Homo sapiens
caagcacagtgcctgca

SEQ ID NO: 5379076 - DNA, 13 bp, Homo sapiens
caagcacagtggt

SEQ ID NO: 5379077 - DNA, 20 bp, Homo sapiens
caagcacagtggtggcaggg

SEQ ID NO: 5379078 - DNA, 21 bp, Homo sapiens
caagcacagtggtggcagggc

SEQ ID NO: 5379079 - DNA, 17 bp, Homo sapiens
caagcacatctgcattt

SEQ ID NO: 5379080 - DNA, 23 bp, Homo sapiens
caagcacatcttgtcaacatgca

SEQ ID NO: 5379081 - DNA, 19 bp, Homo sapiens
caagcaccaacctccagac

SEQ ID NO: 5379082 - DNA, 13 bp, Homo sapiens
caagcaccactct

SEQ ID NO: 5379083 - DNA, 15 bp, Homo sapiens
caagcacccagagct

SEQ ID NO: 5379084 - DNA, 24 bp, Homo sapiens
caagcaccccgcttttgcagcaga

SEQ ID NO: 5379085 - DNA, 13 bp, Homo sapiens
caagcacctcctg

SEQ ID NO: 5379086 - DNA, 17 bp, Homo sapiens
caagcacctgcagattc

SEQ ID NO: 5379087 - DNA, 18 bp, Homo sapiens
caagcacctgcagattct

SEQ ID NO: 5379088 - DNA, 19 bp, Homo sapiens
caagcacctgcagattctg

SEQ ID NO: 5379089 - DNA, 20 bp, Homo sapiens
caagcacctgggtgtgctcc

SEQ ID NO: 5379090 - DNA, 23 bp, Homo sapiens
caagcacctgggtgtgctccagg

SEQ ID NO: 5379091 - DNA, 22 bp, Homo sapiens
caagcactaaaaagttgaacca

SEQ ID NO: 5379092 - DNA, 22 bp, Homo sapiens
caagcactatgcccttttatat

SEQ ID NO: 5379093 - DNA, 14 bp, Homo sapiens
caagcactatttta

SEQ ID NO: 5379094 - DNA, 18 bp, Homo sapiens
caagcactattttatatt

SEQ ID NO: 5379095 - DNA, 20 bp, Homo sapiens
caagcactcgagaccatcct

SEQ ID NO: 5379096 - DNA, 20 bp, Homo sapiens
caagcactcggggtccctgg

SEQ ID NO: 5379097 - DNA, 22 bp, Homo sapiens
caagcacttcaggcctatgttt

SEQ ID NO: 5379098 - DNA, 17 bp, Homo sapiens
caagcacttcccaggat

SEQ ID NO: 5379099 - DNA, 21 bp, Homo sapiens
caagcactttacgctgtctgt

SEQ ID NO: 5379100 - DNA, 13 bp, Homo sapiens
caagcagaaaaat

SEQ ID NO: 5379101 - DNA, 15 bp, Homo sapiens
caagcagaagaccag

SEQ ID NO: 5379102 - DNA, 23 bp, Homo sapiens
caagcagacacacacatatatac

SEQ ID NO: 5379103 - DNA, 15 bp, Homo sapiens
caagcagacagccct

SEQ ID NO: 5379104 - DNA, 15 bp, Homo sapiens
caagcagactccagc

SEQ ID NO: 5379105 - DNA, 18 bp, Homo sapiens
caagcagactccagcccc

SEQ ID NO: 5379106 - DNA, 23 bp, Homo sapiens
caagcagactccagcccctggac

SEQ ID NO: 5379107 - DNA, 14 bp, Homo sapiens
caagcagaggacca

SEQ ID NO: 5379108 - DNA, 22 bp, Homo sapiens
caagcagaggaccagggccttt

SEQ ID NO: 5379109 - DNA, 20 bp, Homo sapiens
caagcagaggtggccagagc

SEQ ID NO: 5379110 - DNA, 19 bp, Homo sapiens
caagcagagtgcacagctg

SEQ ID NO: 5379111 - DNA, 17 bp, Homo sapiens
caagcagatactgctgt

SEQ ID NO: 5379112 - DNA, 15 bp, Homo sapiens
caagcagatgacaga

SEQ ID NO: 5379113 - DNA, 17 bp, Homo sapiens
caagcagcatcttctgg

SEQ ID NO: 5379114 - DNA, 14 bp, Homo sapiens
caagcagccaagct

SEQ ID NO: 5379115 - DNA, 12 bp, Homo sapiens
caagcagccagc

SEQ ID NO: 5379116 - DNA, 16 bp, Homo sapiens
caagcagccagccagt

SEQ ID NO: 5379117 - DNA, 18 bp, Homo sapiens
caagcagccagccagtct

SEQ ID NO: 5379118 - DNA, 22 bp, Homo sapiens
caagcagccagccagtcttgcc

SEQ ID NO: 5379119 - DNA, 18 bp, Homo sapiens
caagcagcctggagactt

SEQ ID NO: 5379120 - DNA, 23 bp, Homo sapiens
caagcagctgaagaaaaaatcag

SEQ ID NO: 5379121 - DNA, 19 bp, Homo sapiens
caagcagctggtcagtctt

SEQ ID NO: 5379122 - DNA, 13 bp, Homo sapiens
caagcagcttaga

SEQ ID NO: 5379123 - DNA, 17 bp, Homo sapiens
caagcagctttttattc

SEQ ID NO: 5379124 - DNA, 23 bp, Homo sapiens
caagcagctttttattccctgcc

SEQ ID NO: 5379125 - DNA, 17 bp, Homo sapiens
caagcaggaaatgaaaa

SEQ ID NO: 5379126 - DNA, 12 bp, Homo sapiens
caagcaggaagc

SEQ ID NO: 5379127 - DNA, 13 bp, Homo sapiens
caagcaggaagct

SEQ ID NO: 5379128 - DNA, 16 bp, Homo sapiens
caagcaggaagttcaa

SEQ ID NO: 5379129 - DNA, 14 bp, Homo sapiens
caagcaggacatgg

SEQ ID NO: 5379130 - DNA, 15 bp, Homo sapiens
caagcaggacctggc

SEQ ID NO: 5379131 - DNA, 17 bp, Homo sapiens
caagcaggacctggcat

SEQ ID NO: 5379132 - DNA, 19 bp, Homo sapiens
caagcaggacctggcatca

SEQ ID NO: 5379133 - DNA, 21 bp, Homo sapiens
caagcaggagtgtgcggtcaa

SEQ ID NO: 5379134 - DNA, 15 bp, Homo sapiens
caagcaggcactgta

SEQ ID NO: 5379135 - DNA, 16 bp, Homo sapiens
caagcaggccgccctc

SEQ ID NO: 5379136 - DNA, 21 bp, Homo sapiens
caagcagggaaagctccacgg

SEQ ID NO: 5379137 - DNA, 15 bp, Homo sapiens
caagcagggctctgc

SEQ ID NO: 5379138 - DNA, 10 bp, Homo sapiens
caagcagggg

SEQ ID NO: 5379139 - DNA, 22 bp, Homo sapiens
caagcaggggtcgtaccttgct

SEQ ID NO: 5379140 - DNA, 15 bp, Homo sapiens
caagcaggttagaga

SEQ ID NO: 5379141 - DNA, 16 bp, Homo sapiens
caagcaggttagagaa

SEQ ID NO: 5379142 - DNA, 18 bp, Homo sapiens
caagcagtcgtgcctgtg

SEQ ID NO: 5379143 - DNA, 20 bp, Homo sapiens
caagcagtcgtgcctgtgtc

SEQ ID NO: 5379144 - DNA, 21 bp, Homo sapiens
caagcagtcgtgcctgtgtcc

SEQ ID NO: 5379145 - DNA, 18 bp, Homo sapiens
caagcagtctaccctgtc

SEQ ID NO: 5379146 - DNA, 23 bp, Homo sapiens
caagcagtggatacgtgtcaatg

SEQ ID NO: 5379147 - DNA, 24 bp, Homo sapiens
caagcagttactccctacactgat

SEQ ID NO: 5379148 - DNA, 16 bp, Homo sapiens
caagcataccaacacg

SEQ ID NO: 5379149 - DNA, 22 bp, Homo sapiens
caagcatatttgagaacccttc

SEQ ID NO: 5379150 - DNA, 16 bp, Homo sapiens
caagcatcactgcccg

SEQ ID NO: 5379151 - DNA, 21 bp, Homo sapiens
caagcatcttgggggggtggc

SEQ ID NO: 5379152 - DNA, 19 bp, Homo sapiens
caagcatgaataaaattag

SEQ ID NO: 5379153 - DNA, 22 bp, Homo sapiens
caagcatgatcttgttactgtg

SEQ ID NO: 5379154 - DNA, 18 bp, Homo sapiens
caagcatggctattttat

SEQ ID NO: 5379155 - DNA, 18 bp, Homo sapiens
caagcatgggggacccct

SEQ ID NO: 5379156 - DNA, 19 bp, Homo sapiens
caagcatgggggacccctt

SEQ ID NO: 5379157 - DNA, 22 bp, Homo sapiens
caagcatgggggaccccttccc

SEQ ID NO: 5379158 - DNA, 13 bp, Homo sapiens
caagcatgtaact

SEQ ID NO: 5379159 - DNA, 15 bp, Homo sapiens
caagcatgtattttt

SEQ ID NO: 5379160 - DNA, 16 bp, Homo sapiens
caagcatgtctctctg

SEQ ID NO: 5379161 - DNA, 20 bp, Homo sapiens
caagcatgtctctctgccaa

SEQ ID NO: 5379162 - DNA, 13 bp, Homo sapiens
caagcatgtggat

SEQ ID NO: 5379163 - DNA, 17 bp, Homo sapiens
caagcattcaccaagtc

SEQ ID NO: 5379164 - DNA, 15 bp, Homo sapiens
caagcattctcctgt

SEQ ID NO: 5379165 - DNA, 18 bp, Homo sapiens
caagcattctgtgcataa

SEQ ID NO: 5379166 - DNA, 16 bp, Homo sapiens
caagcattgggtcaga

SEQ ID NO: 5379167 - DNA, 21 bp, Homo sapiens
caagcatttaatgtagccatg

SEQ ID NO: 5379168 - DNA, 22 bp, Homo sapiens
caagcatttaatgtagccatgg

SEQ ID NO: 5379169 - DNA, 19 bp, Homo sapiens
caagcatttagatgtatag

SEQ ID NO: 5379170 - DNA, 16 bp, Homo sapiens
caagcatttcatgaaa

SEQ ID NO: 5379171 - DNA, 17 bp, Homo sapiens
caagcatttgccctgtg

SEQ ID NO: 5379172 - DNA, 18 bp, Homo sapiens
caagcatttttccatctg

SEQ ID NO: 5379173 - DNA, 15 bp, Homo sapiens
caagccaaagagcct

SEQ ID NO: 5379174 - DNA, 23 bp, Homo sapiens
caagccaaagtggcatgttttgt

SEQ ID NO: 5379175 - DNA, 15 bp, Homo sapiens
caagccaaccttagc

SEQ ID NO: 5379176 - DNA, 15 bp, Homo sapiens
caagccaacttgtaa

SEQ ID NO: 5379177 - DNA, 18 bp, Homo sapiens
caagccaacttgtaaata

SEQ ID NO: 5379178 - DNA, 21 bp, Homo sapiens
caagccaacttgtaaatacac

SEQ ID NO: 5379179 - DNA, 14 bp, Homo sapiens
caagccaagcagcc

SEQ ID NO: 5379180 - DNA, 19 bp, Homo sapiens
caagccaagcagccaagct

SEQ ID NO: 5379181 - DNA, 18 bp, Homo sapiens
caagccaagggaacctgt

SEQ ID NO: 5379182 - DNA, 22 bp, Homo sapiens
caagccaagggaacctgtgtcc

SEQ ID NO: 5379183 - DNA, 15 bp, Homo sapiens
caagccaatcccctc

SEQ ID NO: 5379184 - DNA, 19 bp, Homo sapiens
caagccacaagctgacccc

SEQ ID NO: 5379185 - DNA, 20 bp, Homo sapiens
caagccacaagctgacccct

SEQ ID NO: 5379186 - DNA, 19 bp, Homo sapiens
caagccacaagtcttccag

SEQ ID NO: 5379187 - DNA, 18 bp, Homo sapiens
caagccacagaaatgtgt

SEQ ID NO: 5379188 - DNA, 16 bp, Homo sapiens
caagccaccgcagctg

SEQ ID NO: 5379189 - DNA, 14 bp, Homo sapiens
caagccactagccc

SEQ ID NO: 5379190 - DNA, 22 bp, Homo sapiens
caagccactcggcggcagcatg

SEQ ID NO: 5379191 - DNA, 14 bp, Homo sapiens
caagccagacctag

SEQ ID NO: 5379192 - DNA, 21 bp, Homo sapiens
caagccagagccgcaccctgg

SEQ ID NO: 5379193 - DNA, 23 bp, Homo sapiens
caagccagagccgcaccctggct

SEQ ID NO: 5379194 - DNA, 21 bp, Homo sapiens
caagccagagtttttaaagcc

SEQ ID NO: 5379195 - DNA, 22 bp, Homo sapiens
caagccagagtttttaaagcct

SEQ ID NO: 5379196 - DNA, 23 bp, Homo sapiens
caagccagagtttttaaagcctt

SEQ ID NO: 5379197 - DNA, 13 bp, Homo sapiens
caagccagccaac

SEQ ID NO: 5379198 - DNA, 12 bp, Homo sapiens
caagccagcccc

SEQ ID NO: 5379199 - DNA, 13 bp, Homo sapiens
caagccagcctgt

SEQ ID NO: 5379200 - DNA, 22 bp, Homo sapiens
caagccagcgggaatggcagct

SEQ ID NO: 5379201 - DNA, 17 bp, Homo sapiens
caagccagctctaggct

SEQ ID NO: 5379202 - DNA, 12 bp, Homo sapiens
caagccagctgc

SEQ ID NO: 5379203 - DNA, 12 bp, Homo sapiens
caaggaatttct

SEQ ID NO: 5379204 - DNA, 18 bp, Homo sapiens
caaggaatttcttaactt

SEQ ID NO: 5379205 - DNA, 21 bp, Homo sapiens
caaggaatttcttaacttctt

SEQ ID NO: 5379206 - DNA, 23 bp, Homo sapiens
caaggaatttcttaacttcttgc

SEQ ID NO: 5379207 - DNA, 22 bp, Homo sapiens
caaggacaaagtctccagccca

SEQ ID NO: 5379208 - DNA, 23 bp, Homo sapiens
caaggacaaagtctccagcccac

SEQ ID NO: 5379209 - DNA, 17 bp, Homo sapiens
caaggacaacctgcccc

SEQ ID NO: 5379210 - DNA, 20 bp, Homo sapiens
caaggacaacctgcccctcc

SEQ ID NO: 5379211 - DNA, 23 bp, Homo sapiens
caaggacaacctgcccctcccca

SEQ ID NO: 5379212 - DNA, 20 bp, Homo sapiens
caaggacaagcaattagaag

SEQ ID NO: 5379213 - DNA, 14 bp, Homo sapiens
caaggacactgatg

SEQ ID NO: 5379214 - DNA, 21 bp, Homo sapiens
caaggacagaaggctcctgcc

SEQ ID NO: 5379215 - DNA, 15 bp, Homo sapiens
caaggacagtcagca

SEQ ID NO: 5379216 - DNA, 19 bp, Homo sapiens
caaggacagttcagagatc

SEQ ID NO: 5379217 - DNA, 20 bp, Homo sapiens
caaggacagttcagagatca

SEQ ID NO: 5379218 - DNA, 16 bp, Homo sapiens
caaggacattcttgta

SEQ ID NO: 5379219 - DNA, 17 bp, Homo sapiens
caaggacattgccccaa

SEQ ID NO: 5379220 - DNA, 20 bp, Homo sapiens
caaggacattgccccaagat

SEQ ID NO: 5379221 - DNA, 21 bp, Homo sapiens
caaggacattgccccaagata

SEQ ID NO: 5379222 - DNA, 20 bp, Homo sapiens
caaggacattgtatgcaggg

SEQ ID NO: 5379223 - DNA, 16 bp, Homo sapiens
caaggaccaggactcc

SEQ ID NO: 5379224 - DNA, 17 bp, Homo sapiens
caaggacccagccctcg

SEQ ID NO: 5379225 - DNA, 17 bp, Homo sapiens
caaggacccctcacctt

SEQ ID NO: 5379226 - DNA, 20 bp, Homo sapiens
caaggacccctcaccttgca

SEQ ID NO: 5379227 - DNA, 19 bp, Homo sapiens
caaggaccctgttttccac

SEQ ID NO: 5379228 - DNA, 19 bp, Homo sapiens
caaggacctcctcttcccc

SEQ ID NO: 5379229 - DNA, 20 bp, Homo sapiens
caaggacctcctcttccccc

SEQ ID NO: 5379230 - DNA, 15 bp, Homo sapiens
caaggacctgcctcc

SEQ ID NO: 5379231 - DNA, 19 bp, Homo sapiens
caaggaccttacaggccct

SEQ ID NO: 5379232 - DNA, 22 bp, Homo sapiens
caaggacgctggctactgtcta

SEQ ID NO: 5379233 - DNA, 15 bp, Homo sapiens
caaggacgcttcaca

SEQ ID NO: 5379234 - DNA, 18 bp, Homo sapiens
caaggacggaaaatgctt

SEQ ID NO: 5379235 - DNA, 18 bp, Homo sapiens
caaggactagggtcctgg

SEQ ID NO: 5379236 - DNA, 19 bp, Homo sapiens
caaggactagggtcctggg

SEQ ID NO: 5379237 - DNA, 17 bp, Homo sapiens
caaggactcccggagcc

SEQ ID NO: 5379238 - DNA, 19 bp, Homo sapiens
caaggactcctgtctgtcc

SEQ ID NO: 5379239 - DNA, 12 bp, Homo sapiens
caaggactctgg

SEQ ID NO: 5379240 - DNA, 20 bp, Homo sapiens
caaggactgagcaccctctg

SEQ ID NO: 5379241 - DNA, 15 bp, Homo sapiens
caaggactgagggac

SEQ ID NO: 5379242 - DNA, 22 bp, Homo sapiens
caaggactgagggactctgaag

SEQ ID NO: 5379243 - DNA, 14 bp, Homo sapiens
caaggactgccgac

SEQ ID NO: 5379244 - DNA, 22 bp, Homo sapiens
caaggactggtaaaatacatat

SEQ ID NO: 5379245 - DNA, 15 bp, Homo sapiens
caaggacttccacat

SEQ ID NO: 5379246 - DNA, 21 bp, Homo sapiens
caaggacttccacatttttgc

SEQ ID NO: 5379247 - DNA, 23 bp, Homo sapiens
caaggacttcctgtccagctcca

SEQ ID NO: 5379248 - DNA, 18 bp, Homo sapiens
caaggactttccagtgag

SEQ ID NO: 5379249 - DNA, 18 bp, Homo sapiens
caaggagaaacagagaca

SEQ ID NO: 5379250 - DNA, 16 bp, Homo sapiens
caaggagaccaagtcc

SEQ ID NO: 5379251 - DNA, 13 bp, Homo sapiens
caaggagagcgga

SEQ ID NO: 5379252 - DNA, 16 bp, Homo sapiens
caaggagaggcaaaga

SEQ ID NO: 5379253 - DNA, 12 bp, Homo sapiens
caaggagataag

SEQ ID NO: 5379254 - DNA, 16 bp, Homo sapiens
caaggagatttacaac

SEQ ID NO: 5379255 - DNA, 19 bp, Homo sapiens
caaggagcaagaaatgaac

SEQ ID NO: 5379256 - DNA, 15 bp, Homo sapiens
caaggagcacaagcc

SEQ ID NO: 5379257 - DNA, 17 bp, Homo sapiens
caaggagcacaggtccc

SEQ ID NO: 5379258 - DNA, 18 bp, Homo sapiens
caaggagcacaggtccca

SEQ ID NO: 5379259 - DNA, 20 bp, Homo sapiens
caaggagcatccctaattct

SEQ ID NO: 5379260 - DNA, 17 bp, Homo sapiens
caaggagcatccttggc

SEQ ID NO: 5379261 - DNA, 18 bp, Homo sapiens
caaggagcatccttggca

SEQ ID NO: 5379262 - DNA, 22 bp, Homo sapiens
caaggagccccccaaagacact

SEQ ID NO: 5379263 - DNA, 16 bp, Homo sapiens
caaggagcgcggcggc

SEQ ID NO: 5379264 - DNA, 14 bp, Homo sapiens
caaggagctactga

SEQ ID NO: 5379265 - DNA, 14 bp, Homo sapiens
caaggagctcaccc

SEQ ID NO: 5379266 - DNA, 15 bp, Homo sapiens
caaggagctcaccct

SEQ ID NO: 5379267 - DNA, 20 bp, Homo sapiens
caaggagctcaccctgcccg

SEQ ID NO: 5379268 - DNA, 23 bp, Homo sapiens
caaggagctgagaatagaaggaa

SEQ ID NO: 5379269 - DNA, 11 bp, Homo sapiens
caaggagctgc

SEQ ID NO: 5379270 - DNA, 22 bp, Homo sapiens
caaggagctgctatagcctggg

SEQ ID NO: 5379271 - DNA, 13 bp, Homo sapiens
caaggaggaaaaa

SEQ ID NO: 5379272 - DNA, 14 bp, Homo sapiens
caaggaggaggagt

SEQ ID NO: 5379273 - DNA, 21 bp, Homo sapiens
caaggaggaggagtcagatga

SEQ ID NO: 5379274 - DNA, 16 bp, Homo sapiens
caaggaggcaggattc

SEQ ID NO: 5379275 - DNA, 13 bp, Homo sapiens
caaggaggcctgg

SEQ ID NO: 5379276 - DNA, 16 bp, Homo sapiens
caaggaggctggctgg

SEQ ID NO: 5379277 - DNA, 21 bp, Homo sapiens
caaggaggctggctggggcct

SEQ ID NO: 5379278 - DNA, 13 bp, Homo sapiens
caaggagggaaga

SEQ ID NO: 5379279 - DNA, 16 bp, Homo sapiens
caaggagggcctctgg

SEQ ID NO: 5379280 - DNA, 12 bp, Homo sapiens
caaggaggggcc

SEQ ID NO: 5379281 - DNA, 14 bp, Homo sapiens
caaggaggggccag

SEQ ID NO: 5379282 - DNA, 16 bp, Homo sapiens
caaggaggtcccagga

SEQ ID NO: 5379283 - DNA, 19 bp, Homo sapiens
caaggaggtggtgaatttt

SEQ ID NO: 5379284 - DNA, 16 bp, Homo sapiens
caaggagtgaagtaat

SEQ ID NO: 5379285 - DNA, 21 bp, Homo sapiens
caaggagttccatgaagacca

SEQ ID NO: 5379286 - DNA, 16 bp, Homo sapiens
caaggagttctcttcc

SEQ ID NO: 5379287 - DNA, 15 bp, Homo sapiens
caaggagtttattac

SEQ ID NO: 5379288 - DNA, 16 bp, Homo sapiens
caaggagtttattaca

SEQ ID NO: 5379289 - DNA, 17 bp, Homo sapiens
caaggagtttattacaa

SEQ ID NO: 5379290 - DNA, 19 bp, Homo sapiens
caaggataaatatcttacg

SEQ ID NO: 5379291 - DNA, 17 bp, Homo sapiens
caaggatacccggtggc

SEQ ID NO: 5379292 - DNA, 18 bp, Homo sapiens
caaggataccttcttatt

SEQ ID NO: 5379293 - DNA, 16 bp, Homo sapiens
caaggatagatgctgg

SEQ ID NO: 5379294 - DNA, 23 bp, Homo sapiens
caaggatagatgctggcccaggg

SEQ ID NO: 5379295 - DNA, 19 bp, Homo sapiens
caaggatcagattcttgct

SEQ ID NO: 5379296 - DNA, 21 bp, Homo sapiens
caaggatcctctccactccat

SEQ ID NO: 5379297 - DNA, 18 bp, Homo sapiens
caaggatcctgagccaga

SEQ ID NO: 5379298 - DNA, 15 bp, Homo sapiens
caaggatccttccct

SEQ ID NO: 5379299 - DNA, 15 bp, Homo sapiens
caaggatgaaagaaa

SEQ ID NO: 5379300 - DNA, 18 bp, Homo sapiens
caaggatgaaagacaaag

SEQ ID NO: 5379301 - DNA, 19 bp, Homo sapiens
caaggatgaaagacaaaga

SEQ ID NO: 5379302 - DNA, 21 bp, Homo sapiens
caaggatgaaagacaaagaag

SEQ ID NO: 5379303 - DNA, 23 bp, Homo sapiens
caaggatgaaagacaaagaagga

SEQ ID NO: 5379304 - DNA, 22 bp, Homo sapiens
caaggatgaattctttcaattc

SEQ ID NO: 5379305 - DNA, 19 bp, Homo sapiens
caaggatggggttcttgtc

SEQ ID NO: 5379306 - DNA, 19 bp, Homo sapiens
caaggatgggtccagaaga

SEQ ID NO: 5379307 - DNA, 13 bp, Homo sapiens
caaggatgttttt

SEQ ID NO: 5379308 - DNA, 13 bp, Homo sapiens
caaggattacaga

SEQ ID NO: 5379309 - DNA, 16 bp, Homo sapiens
caaggattacagaaac

SEQ ID NO: 5379310 - DNA, 19 bp, Homo sapiens
caaggattacagaaactga

SEQ ID NO: 5379311 - DNA, 14 bp, Homo sapiens
caaggattgaaaat

SEQ ID NO: 5379312 - DNA, 14 bp, Homo sapiens
caaggatttttaaa

SEQ ID NO: 5379313 - DNA, 16 bp, Homo sapiens
caaggatttttaaaac

SEQ ID NO: 5379314 - DNA, 17 bp, Homo sapiens
caaggatttttccatgt

SEQ ID NO: 5379315 - DNA, 18 bp, Homo sapiens
caaggcaaatgtccaagc

SEQ ID NO: 5379316 - DNA, 23 bp, Homo sapiens
caaggcaactagtggagagaact

SEQ ID NO: 5379317 - DNA, 18 bp, Homo sapiens
caaggcaagcatgaataa

SEQ ID NO: 5379318 - DNA, 15 bp, Homo sapiens
caaggcaaggcaggt

SEQ ID NO: 5379319 - DNA, 14 bp, Homo sapiens
caaggcaaggctgt

SEQ ID NO: 5379320 - DNA, 16 bp, Homo sapiens
caaggcaaggctgtca

SEQ ID NO: 5379321 - DNA, 18 bp, Homo sapiens
caaggcaaggctgtcaat

SEQ ID NO: 5379322 - DNA, 17 bp, Homo sapiens
caaggcacaggctcctg

SEQ ID NO: 5379323 - DNA, 18 bp, Homo sapiens
caaggcacaggctcctgt

SEQ ID NO: 5379324 - DNA, 20 bp, Homo sapiens
caaggcaccagcaaatttgg

SEQ ID NO: 5379325 - DNA, 15 bp, Homo sapiens
caaggcacctgcagg

SEQ ID NO: 5379326 - DNA, 15 bp, Homo sapiens
caaggcactctagat

SEQ ID NO: 5379327 - DNA, 20 bp, Homo sapiens
caaggcactgagcgcctgca

SEQ ID NO: 5379328 - DNA, 13 bp, Homo sapiens
caaggcactgcct

SEQ ID NO: 5379329 - DNA, 14 bp, Homo sapiens
caaggcactgcctg

SEQ ID NO: 5379330 - DNA, 16 bp, Homo sapiens
caaggcactgcctgat

SEQ ID NO: 5379331 - DNA, 24 bp, Homo sapiens
caaggcacttcatgtaaagtgtca

SEQ ID NO: 5379332 - DNA, 16 bp, Homo sapiens
caaggcacttgtcact

SEQ ID NO: 5379333 - DNA, 23 bp, Homo sapiens
caaggcagaagcttggaggaggg

SEQ ID NO: 5379334 - DNA, 17 bp, Homo sapiens
caaggcagaaggccagg

SEQ ID NO: 5379335 - DNA, 19 bp, Homo sapiens
caaggcagaggcctgggct

SEQ ID NO: 5379336 - DNA, 18 bp, Homo sapiens
caaggcagcctccagagc

SEQ ID NO: 5379337 - DNA, 18 bp, Homo sapiens
caaggcagcgaccccagg

SEQ ID NO: 5379338 - DNA, 22 bp, Homo sapiens
caaggcagctcttctggagttt

SEQ ID NO: 5379339 - DNA, 21 bp, Homo sapiens
caaggcaggaaacaaaagatt

SEQ ID NO: 5379340 - DNA, 15 bp, Homo sapiens
caaggcagggcccag

SEQ ID NO: 5379341 - DNA, 19 bp, Homo sapiens
caaggcaggtgcctccagg

SEQ ID NO: 5379342 - DNA, 12 bp, Homo sapiens
caaggcagtgag

SEQ ID NO: 5379343 - DNA, 13 bp, Homo sapiens
caaggcagtgcat

SEQ ID NO: 5379344 - DNA, 14 bp, Homo sapiens
caaggcagtgcatg

SEQ ID NO: 5379345 - DNA, 19 bp, Homo sapiens
caaggcagtgcatgcatgt

SEQ ID NO: 5379346 - DNA, 14 bp, Homo sapiens
caaggcagtgttcc

SEQ ID NO: 5379347 - DNA, 15 bp, Homo sapiens
caaggcagttctgtg

SEQ ID NO: 5379348 - DNA, 18 bp, Homo sapiens
caaggcatcacagttcac

SEQ ID NO: 5379349 - DNA, 20 bp, Homo sapiens
caaggcattcctcatcacca

SEQ ID NO: 5379350 - DNA, 17 bp, Homo sapiens
caaggccaaaagaagtt

SEQ ID NO: 5379351 - DNA, 17 bp, Homo sapiens
caaggccaaaggaagca

SEQ ID NO: 5379352 - DNA, 16 bp, Homo sapiens
caaggccacctctgcc

SEQ ID NO: 5379353 - DNA, 20 bp, Homo sapiens
caaggccacctcttcctggc

SEQ ID NO: 5379354 - DNA, 21 bp, Homo sapiens
caaggccacctcttcctggcc

SEQ ID NO: 5379355 - DNA, 17 bp, Homo sapiens
caaggccagagtggcct

SEQ ID NO: 5379356 - DNA, 22 bp, Homo sapiens
caaggccagagtggcctggcca

SEQ ID NO: 5379357 - DNA, 19 bp, Homo sapiens
caaggccagcaaggtggag

SEQ ID NO: 5379358 - DNA, 22 bp, Homo sapiens
caaggccagcaaggtggagtgg

SEQ ID NO: 5379359 - DNA, 21 bp, Homo sapiens
caaggccagcacccaaagggt

SEQ ID NO: 5379360 - DNA, 14 bp, Homo sapiens
caaggccagggcac

SEQ ID NO: 5379361 - DNA, 19 bp, Homo sapiens
caaggccagggcacagctg

SEQ ID NO: 5379362 - DNA, 21 bp, Homo sapiens
caaggccagtctgaacctgag

SEQ ID NO: 5379363 - DNA, 15 bp, Homo sapiens
caaggcccagacctg

SEQ ID NO: 5379364 - DNA, 16 bp, Homo sapiens
caaggcccagatgtgg

SEQ ID NO: 5379365 - DNA, 19 bp, Homo sapiens
caaggcccagccctgggca

SEQ ID NO: 5379366 - DNA, 12 bp, Homo sapiens
caaggcccagct

SEQ ID NO: 5379367 - DNA, 12 bp, Homo sapiens
caaggcccagga

SEQ ID NO: 5379368 - DNA, 23 bp, Homo sapiens
caaggcccaggagacctccagct

SEQ ID NO: 5379369 - DNA, 14 bp, Homo sapiens
caaggccccagaga

SEQ ID NO: 5379370 - DNA, 16 bp, Homo sapiens
caaggccccagagact

SEQ ID NO: 5379371 - DNA, 17 bp, Homo sapiens
caaggccccagagactc

SEQ ID NO: 5379372 - DNA, 15 bp, Homo sapiens
caaggccccagggac

SEQ ID NO: 5379373 - DNA, 17 bp, Homo sapiens
caaggccccagggacag

SEQ ID NO: 5379374 - DNA, 18 bp, Homo sapiens
caaggccccagggacaga

SEQ ID NO: 5379375 - DNA, 19 bp, Homo sapiens
caaggccccagggacagag

SEQ ID NO: 5379376 - DNA, 20 bp, Homo sapiens
caaggccccagggacagagg

SEQ ID NO: 5379377 - DNA, 23 bp, Homo sapiens
caaggccccagggacagaggcca

SEQ ID NO: 5379378 - DNA, 20 bp, Homo sapiens
caaggcccccacctctgtga

SEQ ID NO: 5379379 - DNA, 14 bp, Homo sapiens
caaggcccctgaca

SEQ ID NO: 5379380 - DNA, 17 bp, Homo sapiens
caagtagaacaaaaact

SEQ ID NO: 5379381 - DNA, 22 bp, Homo sapiens
caagtagaacaaaaactattat

SEQ ID NO: 5379382 - DNA, 23 bp, Homo sapiens
caagtagaatctcagttgatttt

SEQ ID NO: 5379383 - DNA, 16 bp, Homo sapiens
caagtagaccatggtc

SEQ ID NO: 5379384 - DNA, 21 bp, Homo sapiens
caagtagatcatggcagcatg

SEQ ID NO: 5379385 - DNA, 17 bp, Homo sapiens
caagtagcatttactgt

SEQ ID NO: 5379386 - DNA, 13 bp, Homo sapiens
caagtagctgaga

SEQ ID NO: 5379387 - DNA, 13 bp, Homo sapiens
caagtagctgcta

SEQ ID NO: 5379388 - DNA, 20 bp, Homo sapiens
caagtagctgctaccttctt

SEQ ID NO: 5379389 - DNA, 15 bp, Homo sapiens
caagtagctgggact

SEQ ID NO: 5379390 - DNA, 16 bp, Homo sapiens
caagtagctgggatta

SEQ ID NO: 5379391 - DNA, 20 bp, Homo sapiens
caagtagctgggattacagg

SEQ ID NO: 5379392 - DNA, 17 bp, Homo sapiens
caagtagctttccacat

SEQ ID NO: 5379393 - DNA, 18 bp, Homo sapiens
caagtagttctgtatttg

SEQ ID NO: 5379394 - DNA, 21 bp, Homo sapiens
caagtagttctgtatttgaaa

SEQ ID NO: 5379395 - DNA, 19 bp, Homo sapiens
caagtatactaagagtaaa

SEQ ID NO: 5379396 - DNA, 18 bp, Homo sapiens
caagtatactagggagcc

SEQ ID NO: 5379397 - DNA, 17 bp, Homo sapiens
caagtatataatttact

SEQ ID NO: 5379398 - DNA, 22 bp, Homo sapiens
caagtatataatttactttgta

SEQ ID NO: 5379399 - DNA, 18 bp, Homo sapiens
caagtatatacttttaaa

SEQ ID NO: 5379400 - DNA, 20 bp, Homo sapiens
caagtatatcagctactgta

SEQ ID NO: 5379401 - DNA, 19 bp, Homo sapiens
caagtatcatctaaatatt

SEQ ID NO: 5379402 - DNA, 19 bp, Homo sapiens
caagtatccttcattgtga

SEQ ID NO: 5379403 - DNA, 19 bp, Homo sapiens
caagtatgaataaagacac

SEQ ID NO: 5379404 - DNA, 21 bp, Homo sapiens
caagtatgaataaagacacct

SEQ ID NO: 5379405 - DNA, 17 bp, Homo sapiens
caagtatgaatctagtt

SEQ ID NO: 5379406 - DNA, 14 bp, Homo sapiens
caagtatgccttaa

SEQ ID NO: 5379407 - DNA, 16 bp, Homo sapiens
caagtatgctgtggag

SEQ ID NO: 5379408 - DNA, 22 bp, Homo sapiens
caagtattaaactgtaaatcat

SEQ ID NO: 5379409 - DNA, 22 bp, Homo sapiens
caagtattaagcagttcattct

SEQ ID NO: 5379410 - DNA, 14 bp, Homo sapiens
caagtattagaata

SEQ ID NO: 5379411 - DNA, 23 bp, Homo sapiens
caagtattaggggtaatatattg

SEQ ID NO: 5379412 - DNA, 12 bp, Homo sapiens
caagtattataa

SEQ ID NO: 5379413 - DNA, 22 bp, Homo sapiens
caagtattataccttttttaga

SEQ ID NO: 5379414 - DNA, 23 bp, Homo sapiens
caagtattctgcctttgcagaaa

SEQ ID NO: 5379415 - DNA, 17 bp, Homo sapiens
caagtattgagaacctg

SEQ ID NO: 5379416 - DNA, 22 bp, Homo sapiens
caagtatttaagcctaaagatt

SEQ ID NO: 5379417 - DNA, 22 bp, Homo sapiens
caagtatttgggaagtgaagac

SEQ ID NO: 5379418 - DNA, 19 bp, Homo sapiens
caagtatttgttaatttag

SEQ ID NO: 5379419 - DNA, 22 bp, Homo sapiens
caagtatttgttaatttagaaa

SEQ ID NO: 5379420 - DNA, 16 bp, Homo sapiens
caagtattttatattt

SEQ ID NO: 5379421 - DNA, 20 bp, Homo sapiens
caagtattttatctgtgttg

SEQ ID NO: 5379422 - DNA, 11 bp, Homo sapiens
caagtattttt

SEQ ID NO: 5379423 - DNA, 15 bp, Homo sapiens
caagtatttttaatt

SEQ ID NO: 5379424 - DNA, 13 bp, Homo sapiens
caagtatttttat

SEQ ID NO: 5379425 - DNA, 23 bp, Homo sapiens
caagtatttttatttaaattatt

SEQ ID NO: 5379426 - DNA, 15 bp, Homo sapiens
caagtcaaatggaga

SEQ ID NO: 5379427 - DNA, 15 bp, Homo sapiens
caagtcaaattaata

SEQ ID NO: 5379428 - DNA, 19 bp, Homo sapiens
caagtcaaccaatgtagaa

SEQ ID NO: 5379429 - DNA, 17 bp, Homo sapiens
caagtcaatcatttctc

SEQ ID NO: 5379430 - DNA, 14 bp, Homo sapiens
caagtcacaaagag

SEQ ID NO: 5379431 - DNA, 14 bp, Homo sapiens
caagtcacagctgc

SEQ ID NO: 5379432 - DNA, 16 bp, Homo sapiens
caagtcacagctgcag

SEQ ID NO: 5379433 - DNA, 22 bp, Homo sapiens
caagtcacagctgcagctgggc

SEQ ID NO: 5379434 - DNA, 23 bp, Homo sapiens
caagtcacagctgcagctgggcc

SEQ ID NO: 5379435 - DNA, 15 bp, Homo sapiens
caagtcactagaagt

SEQ ID NO: 5379436 - DNA, 15 bp, Homo sapiens
caagtcagaggatgg

SEQ ID NO: 5379437 - DNA, 19 bp, Homo sapiens
caagtcagaggatggccag

SEQ ID NO: 5379438 - DNA, 14 bp, Homo sapiens
caagtcagcatatg

SEQ ID NO: 5379439 - DNA, 21 bp, Homo sapiens
caagtcaggaatcattaattt

SEQ ID NO: 5379440 - DNA, 18 bp, Homo sapiens
caagtcaggccaggtggg

SEQ ID NO: 5379441 - DNA, 21 bp, Homo sapiens
caagtcagtcattcagatatg

SEQ ID NO: 5379442 - DNA, 23 bp, Homo sapiens
caagtcagtccaggatgctaaca

SEQ ID NO: 5379443 - DNA, 20 bp, Homo sapiens
caagtcataggttaatattt

SEQ ID NO: 5379444 - DNA, 12 bp, Homo sapiens
caagtcatggct

SEQ ID NO: 5379445 - DNA, 17 bp, Homo sapiens
caagtcatgggagaaga

SEQ ID NO: 5379446 - DNA, 16 bp, Homo sapiens
caagtcatgggtcaca

SEQ ID NO: 5379447 - DNA, 19 bp, Homo sapiens
caagtcatggtcacagtaa

SEQ ID NO: 5379448 - DNA, 17 bp, Homo sapiens
caagtcatgtaaatact

SEQ ID NO: 5379449 - DNA, 19 bp, Homo sapiens
caagtcatgtaaatactgt

SEQ ID NO: 5379450 - DNA, 13 bp, Homo sapiens
caagtcatgtgca

SEQ ID NO: 5379451 - DNA, 17 bp, Homo sapiens
caagtcatgtgcatttc

SEQ ID NO: 5379452 - DNA, 14 bp, Homo sapiens
caagtcattcctaa

SEQ ID NO: 5379453 - DNA, 12 bp, Homo sapiens
caagtcattgtt

SEQ ID NO: 5379454 - DNA, 14 bp, Homo sapiens
caagtccaacctgc

SEQ ID NO: 5379455 - DNA, 19 bp, Homo sapiens
caagtccaacctgcctgtg

SEQ ID NO: 5379456 - DNA, 20 bp, Homo sapiens
caagtccaacctgcctgtgc

SEQ ID NO: 5379457 - DNA, 14 bp, Homo sapiens
caagtccaagcata

SEQ ID NO: 5379458 - DNA, 18 bp, Homo sapiens
caagtccaataagacact

SEQ ID NO: 5379459 - DNA, 16 bp, Homo sapiens
caagtccacctgccta

SEQ ID NO: 5379460 - DNA, 13 bp, Homo sapiens
caagtccactgtc

SEQ ID NO: 5379461 - DNA, 23 bp, Homo sapiens
caagtccactgtcctccttggcg

SEQ ID NO: 5379462 - DNA, 12 bp, Homo sapiens
caagtccagagc

SEQ ID NO: 5379463 - DNA, 13 bp, Homo sapiens
caagtccagagcc

SEQ ID NO: 5379464 - DNA, 22 bp, Homo sapiens
caagtccagatttacactggga

SEQ ID NO: 5379465 - DNA, 21 bp, Homo sapiens
caagtccagctgggaagccct

SEQ ID NO: 5379466 - DNA, 17 bp, Homo sapiens
caagtccaggtcctggt

SEQ ID NO: 5379467 - DNA, 15 bp, Homo sapiens
caagtcccaccctct

SEQ ID NO: 5379468 - DNA, 22 bp, Homo sapiens
caagtcccaccctcttcccatg

SEQ ID NO: 5379469 - DNA, 17 bp, Homo sapiens
caagtcccagacaagga

SEQ ID NO: 5379470 - DNA, 20 bp, Homo sapiens
caagtccccgtctgcctggc

SEQ ID NO: 5379471 - DNA, 18 bp, Homo sapiens
caagtccccttctgtgtt

SEQ ID NO: 5379472 - DNA, 23 bp, Homo sapiens
caagtcccgaggcagcaacagga

SEQ ID NO: 5379473 - DNA, 11 bp, Homo sapiens
caagtccctgt

SEQ ID NO: 5379474 - DNA, 21 bp, Homo sapiens
caagtccctgttttctgagcc

SEQ ID NO: 5379475 - DNA, 23 bp, Homo sapiens
caagtccctgttttctgagcccg

SEQ ID NO: 5379476 - DNA, 14 bp, Homo sapiens
caagtcccttgacc

SEQ ID NO: 5379477 - DNA, 16 bp, Homo sapiens
caagtcccttgacctt

SEQ ID NO: 5379478 - DNA, 21 bp, Homo sapiens
caagtcctcctagaactccag

SEQ ID NO: 5379479 - DNA, 15 bp, Homo sapiens
caagtcctcgccccc

SEQ ID NO: 5379480 - DNA, 15 bp, Homo sapiens
caagtcctgaagagg

SEQ ID NO: 5379481 - DNA, 19 bp, Homo sapiens
caagtcctgaagaggcggg

SEQ ID NO: 5379482 - DNA, 20 bp, Homo sapiens
caagtcctgaagaggcgggc

SEQ ID NO: 5379483 - DNA, 23 bp, Homo sapiens
caagtcctgaagaggcgggccag

SEQ ID NO: 5379484 - DNA, 15 bp, Homo sapiens
caagtcctgcctttg

SEQ ID NO: 5379485 - DNA, 18 bp, Homo sapiens
caagtcctgctcctttct

SEQ ID NO: 5379486 - DNA, 12 bp, Homo sapiens
caagtcctggct

SEQ ID NO: 5379487 - DNA, 17 bp, Homo sapiens
caagtcctgtgaatttc

SEQ ID NO: 5379488 - DNA, 18 bp, Homo sapiens
caagtcctttaactcgtt

SEQ ID NO: 5379489 - DNA, 16 bp, Homo sapiens
caagtccttttgtaaa

SEQ ID NO: 5379490 - DNA, 18 bp, Homo sapiens
caagtccttttgtaaagt

SEQ ID NO: 5379491 - DNA, 15 bp, Homo sapiens
caagtcgccaggcag

SEQ ID NO: 5379492 - DNA, 17 bp, Homo sapiens
caagtcgcggctgcagg

SEQ ID NO: 5379493 - DNA, 18 bp, Homo sapiens
caagtcggggcctgggac

SEQ ID NO: 5379494 - DNA, 22 bp, Homo sapiens
caagtctaaaaagacctggcct

SEQ ID NO: 5379495 - DNA, 16 bp, Homo sapiens
caagtctaaacaatga

SEQ ID NO: 5379496 - DNA, 18 bp, Homo sapiens
caagtctaaacaatgaat

SEQ ID NO: 5379497 - DNA, 22 bp, Homo sapiens
caagtctaaacaatgaattctt

SEQ ID NO: 5379498 - DNA, 18 bp, Homo sapiens
caagtctatgatgctgtt

SEQ ID NO: 5379499 - DNA, 20 bp, Homo sapiens
caagtctatgatgctgttgc

SEQ ID NO: 5379500 - DNA, 21 bp, Homo sapiens
caagtctatgatgctgttgcc

SEQ ID NO: 5379501 - DNA, 14 bp, Homo sapiens
caagtctcagaaga

SEQ ID NO: 5379502 - DNA, 15 bp, Homo sapiens
caagtctcaggagga

SEQ ID NO: 5379503 - DNA, 14 bp, Homo sapiens
caagtctccttccc

SEQ ID NO: 5379504 - DNA, 19 bp, Homo sapiens
caagtctctgctggcccag

SEQ ID NO: 5379505 - DNA, 12 bp, Homo sapiens
caagtctgcagg

SEQ ID NO: 5379506 - DNA, 21 bp, Homo sapiens
caagtctgccgattttgtaaa

SEQ ID NO: 5379507 - DNA, 19 bp, Homo sapiens
caagtctggatctgggacc

SEQ ID NO: 5379508 - DNA, 16 bp, Homo sapiens
caagtctgtacctcaa

SEQ ID NO: 5379509 - DNA, 13 bp, Homo sapiens
caagtctgtgaaa

SEQ ID NO: 5379510 - DNA, 22 bp, Homo sapiens
caagtctgtgagtgcgtctgag

SEQ ID NO: 5379511 - DNA, 17 bp, Homo sapiens
caagtctgtgcctggag

SEQ ID NO: 5379512 - DNA, 14 bp, Homo sapiens
caagtcttaacaaa

SEQ ID NO: 5379513 - DNA, 23 bp, Homo sapiens
caagtcttaacaaaccaacatct

SEQ ID NO: 5379514 - DNA, 12 bp, Homo sapiens
caagtcttgctg

SEQ ID NO: 5379515 - DNA, 14 bp, Homo sapiens
caagtcttgctgtg

SEQ ID NO: 5379516 - DNA, 15 bp, Homo sapiens
caagtcttgctgtgc

SEQ ID NO: 5379517 - DNA, 18 bp, Homo sapiens
caagtcttgctgtgcttt

SEQ ID NO: 5379518 - DNA, 20 bp, Homo sapiens
caagtctttaggtctttgta

SEQ ID NO: 5379519 - DNA, 21 bp, Homo sapiens
caagtctttaggtctttgtaa

SEQ ID NO: 5379520 - DNA, 14 bp, Homo sapiens
caagtctttctcct

SEQ ID NO: 5379521 - DNA, 20 bp, Homo sapiens
caagtctttctctttccctg

SEQ ID NO: 5379522 - DNA, 21 bp, Homo sapiens
caagtctttgctattgtgaat

SEQ ID NO: 5379523 - DNA, 23 bp, Homo sapiens
caagtgaaaaaggaggaagagaa

SEQ ID NO: 5379524 - DNA, 15 bp, Homo sapiens
caagtgaacttggga

SEQ ID NO: 5379525 - DNA, 19 bp, Homo sapiens
caagtgaaggaccccctcc

SEQ ID NO: 5379526 - DNA, 22 bp, Homo sapiens
caagtgaatacattttataatt

SEQ ID NO: 5379527 - DNA, 13 bp, Homo sapiens
caagtgaatctaa

SEQ ID NO: 5379528 - DNA, 18 bp, Homo sapiens
caagtgaatctttctcct

SEQ ID NO: 5379529 - DNA, 19 bp, Homo sapiens
caagtgaatttttctctaa

SEQ ID NO: 5379530 - DNA, 15 bp, Homo sapiens
caagtgacatctctt

SEQ ID NO: 5379531 - DNA, 13 bp, Homo sapiens
caagtgaccaggg

SEQ ID NO: 5379532 - DNA, 14 bp, Homo sapiens
caagtgaccaggga

SEQ ID NO: 5379533 - DNA, 16 bp, Homo sapiens
caagtgaccagggaag

SEQ ID NO: 5379534 - DNA, 22 bp, Homo sapiens
caagtgaccccagggcctgtct

SEQ ID NO: 5379535 - DNA, 21 bp, Homo sapiens
caagtgacctatacctgtgtt

SEQ ID NO: 5379536 - DNA, 21 bp, Homo sapiens
caagtgactgtatctgtgtag

SEQ ID NO: 5379537 - DNA, 15 bp, Homo sapiens
caagtgagaccctgt

SEQ ID NO: 5379538 - DNA, 18 bp, Homo sapiens
caagtgagagctgggtgt

SEQ ID NO: 5379539 - DNA, 15 bp, Homo sapiens
caagtgagaggggag

SEQ ID NO: 5379540 - DNA, 17 bp, Homo sapiens
caagtgagaggggaggg

SEQ ID NO: 5379541 - DNA, 18 bp, Homo sapiens
caagtgagaggggaggga

SEQ ID NO: 5379542 - DNA, 20 bp, Homo sapiens
caagtgagaggggagggagg

SEQ ID NO: 5379543 - DNA, 21 bp, Homo sapiens
caagtgagaggggagggaggg

SEQ ID NO: 5379544 - DNA, 20 bp, Homo sapiens
caagtgagatagcttcccca

SEQ ID NO: 5379545 - DNA, 20 bp, Homo sapiens
caagtgagcaaacctgcccc

SEQ ID NO: 5379546 - DNA, 21 bp, Homo sapiens
caagtgagcaaacctgcccca

SEQ ID NO: 5379547 - DNA, 10 bp, Homo sapiens
caagtgagcc

SEQ ID NO: 5379548 - DNA, 21 bp, Homo sapiens
caagtgaggcaagagaaatga

SEQ ID NO: 5379549 - DNA, 14 bp, Homo sapiens
caagtgaggcagcc

SEQ ID NO: 5379550 - DNA, 15 bp, Homo sapiens
caagtgaggcagccg

SEQ ID NO: 5379551 - DNA, 16 bp, Homo sapiens
caagtgaggccggaga

SEQ ID NO: 5379552 - DNA, 23 bp, Homo sapiens
caagtgagtctggtggaggagct

SEQ ID NO: 5379553 - DNA, 12 bp, Homo sapiens
caagtgagtggc

SEQ ID NO: 5379554 - DNA, 20 bp, Homo sapiens
caagtgatatatgtatttat

SEQ ID NO: 5379555 - DNA, 17 bp, Homo sapiens
caagtgatatcacctct

SEQ ID NO: 5379556 - DNA, 16 bp, Homo sapiens
caataaagtttgcttt

SEQ ID NO: 5379557 - DNA, 11 bp, Homo sapiens
caataaataat

SEQ ID NO: 5379558 - DNA, 15 bp, Homo sapiens
caataaatactttaa

SEQ ID NO: 5379559 - DNA, 22 bp, Homo sapiens
caataaatagatgagtcctgtt

SEQ ID NO: 5379560 - DNA, 17 bp, Homo sapiens
caataaatatgtattac

SEQ ID NO: 5379561 - DNA, 14 bp, Homo sapiens
caataaatatttga

SEQ ID NO: 5379562 - DNA, 17 bp, Homo sapiens
caataaatctgacccag

SEQ ID NO: 5379563 - DNA, 20 bp, Homo sapiens
caataaatgacacccagacc

SEQ ID NO: 5379564 - DNA, 19 bp, Homo sapiens
caataaatgccctctctga

SEQ ID NO: 5379565 - DNA, 18 bp, Homo sapiens
caataaatgctctatttt

SEQ ID NO: 5379566 - DNA, 20 bp, Homo sapiens
caataaatgctgaatgaatc

SEQ ID NO: 5379567 - DNA, 18 bp, Homo sapiens
caataaatggccagtgct

SEQ ID NO: 5379568 - DNA, 22 bp, Homo sapiens
caataaatggccagtgctgctt

SEQ ID NO: 5379569 - DNA, 22 bp, Homo sapiens
caataaatggctcgtgggctct

SEQ ID NO: 5379570 - DNA, 18 bp, Homo sapiens
caataaatggtatagcaa

SEQ ID NO: 5379571 - DNA, 20 bp, Homo sapiens
caataaatgtatcatttttg

SEQ ID NO: 5379572 - DNA, 14 bp, Homo sapiens
caataaatgtattc

SEQ ID NO: 5379573 - DNA, 11 bp, Homo sapiens
caataaatgtt

SEQ ID NO: 5379574 - DNA, 13 bp, Homo sapiens
caataaatgttga

SEQ ID NO: 5379575 - DNA, 18 bp, Homo sapiens
caataaatgttgcttgga

SEQ ID NO: 5379576 - DNA, 23 bp, Homo sapiens
caataaattatttttaagaaatc

SEQ ID NO: 5379577 - DNA, 20 bp, Homo sapiens
caataaattccatgtttagc

SEQ ID NO: 5379578 - DNA, 22 bp, Homo sapiens
caataaattctaaattacaaag

SEQ ID NO: 5379579 - DNA, 20 bp, Homo sapiens
caataaattgctaatgttgc

SEQ ID NO: 5379580 - DNA, 15 bp, Homo sapiens
caataaatttgtaac

SEQ ID NO: 5379581 - DNA, 11 bp, Homo sapiens
caataaatttt

SEQ ID NO: 5379582 - DNA, 19 bp, Homo sapiens
caataaattttatctcagt

SEQ ID NO: 5379583 - DNA, 13 bp, Homo sapiens
caataaattttga

SEQ ID NO: 5379584 - DNA, 16 bp, Homo sapiens
caataaattttgaaaa

SEQ ID NO: 5379585 - DNA, 10 bp, Homo sapiens
caataacaac

SEQ ID NO: 5379586 - DNA, 14 bp, Homo sapiens
caataacactaaaa

SEQ ID NO: 5379587 - DNA, 21 bp, Homo sapiens
caataacagatggtgctgcta

SEQ ID NO: 5379588 - DNA, 14 bp, Homo sapiens
caataacagctgca

SEQ ID NO: 5379589 - DNA, 15 bp, Homo sapiens
caataacgtttaagc

SEQ ID NO: 5379590 - DNA, 15 bp, Homo sapiens
caataactactgtgt

SEQ ID NO: 5379591 - DNA, 16 bp, Homo sapiens
caataactactgtgtt

SEQ ID NO: 5379592 - DNA, 17 bp, Homo sapiens
caataactactgtgttc

SEQ ID NO: 5379593 - DNA, 18 bp, Homo sapiens
caataactatttttcctc

SEQ ID NO: 5379594 - DNA, 16 bp, Homo sapiens
caataactccaagcag

SEQ ID NO: 5379595 - DNA, 17 bp, Homo sapiens
caataactcctcccagg

SEQ ID NO: 5379596 - DNA, 19 bp, Homo sapiens
caataactcctcccagggt

SEQ ID NO: 5379597 - DNA, 14 bp, Homo sapiens
caataactctgatt

SEQ ID NO: 5379598 - DNA, 14 bp, Homo sapiens
caataactctggga

SEQ ID NO: 5379599 - DNA, 12 bp, Homo sapiens
caataacttcag

SEQ ID NO: 5379600 - DNA, 18 bp, Homo sapiens
caataacttcagagaagt

SEQ ID NO: 5379601 - DNA, 20 bp, Homo sapiens
caataacttcagagaagtca

SEQ ID NO: 5379602 - DNA, 21 bp, Homo sapiens
caataacttctatattttaat

SEQ ID NO: 5379603 - DNA, 23 bp, Homo sapiens
caataacttctatattttaatag

SEQ ID NO: 5379604 - DNA, 15 bp, Homo sapiens
caataacttctatgt

SEQ ID NO: 5379605 - DNA, 13 bp, Homo sapiens
caataacttttat

SEQ ID NO: 5379606 - DNA, 20 bp, Homo sapiens
caataagaaacagtttaaca

SEQ ID NO: 5379607 - DNA, 21 bp, Homo sapiens
caataagaaacagtttaacag

SEQ ID NO: 5379608 - DNA, 14 bp, Homo sapiens
caataagaaatgaa

SEQ ID NO: 5379609 - DNA, 18 bp, Homo sapiens
caataagaaatgaacaaa

SEQ ID NO: 5379610 - DNA, 18 bp, Homo sapiens
caataagaacaaatacaa

SEQ ID NO: 5379611 - DNA, 21 bp, Homo sapiens
caataagagaactctcctctt

SEQ ID NO: 5379612 - DNA, 17 bp, Homo sapiens
caataagagtctccttc

SEQ ID NO: 5379613 - DNA, 14 bp, Homo sapiens
caataagatattac

SEQ ID NO: 5379614 - DNA, 19 bp, Homo sapiens
caataagattgcgcctgag

SEQ ID NO: 5379615 - DNA, 20 bp, Homo sapiens
caataagattgcgcctgaga

SEQ ID NO: 5379616 - DNA, 18 bp, Homo sapiens
caataagcatcaaactct

SEQ ID NO: 5379617 - DNA, 18 bp, Homo sapiens
caataagctggactagtg

SEQ ID NO: 5379618 - DNA, 14 bp, Homo sapiens
caataaggagcatc

SEQ ID NO: 5379619 - DNA, 20 bp, Homo sapiens
caataaggatttattctcag

SEQ ID NO: 5379620 - DNA, 23 bp, Homo sapiens
caataagtgttgtaccatatgta

SEQ ID NO: 5379621 - DNA, 18 bp, Homo sapiens
caataagttacttgaaat

SEQ ID NO: 5379622 - DNA, 17 bp, Homo sapiens
caataagttcattaaac

SEQ ID NO: 5379623 - DNA, 17 bp, Homo sapiens
caataagttccatgtta

SEQ ID NO: 5379624 - DNA, 10 bp, Homo sapiens
caataataaa

SEQ ID NO: 5379625 - DNA, 23 bp, Homo sapiens
caataataaagtacttgactacc

SEQ ID NO: 5379626 - DNA, 12 bp, Homo sapiens
caataataaatg

SEQ ID NO: 5379627 - DNA, 23 bp, Homo sapiens
caataataagtccatctgtcact

SEQ ID NO: 5379628 - DNA, 16 bp, Homo sapiens
caataataataaatta

SEQ ID NO: 5379629 - DNA, 22 bp, Homo sapiens
caataatataataatagttatt

SEQ ID NO: 5379630 - DNA, 22 bp, Homo sapiens
caataatcagaaaagtaatttt

SEQ ID NO: 5379631 - DNA, 17 bp, Homo sapiens
caataatccacccccag

SEQ ID NO: 5379632 - DNA, 19 bp, Homo sapiens
caataatctctatttgaga

SEQ ID NO: 5379633 - DNA, 15 bp, Homo sapiens
caataatggaaaaaa

SEQ ID NO: 5379634 - DNA, 14 bp, Homo sapiens
caataatgtactca

SEQ ID NO: 5379635 - DNA, 16 bp, Homo sapiens
caataatgtactcaca

SEQ ID NO: 5379636 - DNA, 17 bp, Homo sapiens
caataatgtgcaaattt

SEQ ID NO: 5379637 - DNA, 22 bp, Homo sapiens
caataattaggatctatgcaat

SEQ ID NO: 5379638 - DNA, 23 bp, Homo sapiens
caataattaggatctatgcaatt

SEQ ID NO: 5379639 - DNA, 16 bp, Homo sapiens
caataattctacatgt

SEQ ID NO: 5379640 - DNA, 23 bp, Homo sapiens
caataattgtggagaggagagaa

SEQ ID NO: 5379641 - DNA, 14 bp, Homo sapiens
caataatttcaggt

SEQ ID NO: 5379642 - DNA, 16 bp, Homo sapiens
caataatttgtacaat

SEQ ID NO: 5379643 - DNA, 22 bp, Homo sapiens
caataatttgtacaatggttta

SEQ ID NO: 5379644 - DNA, 18 bp, Homo sapiens
caataatttgtggtgatt

SEQ ID NO: 5379645 - DNA, 14 bp, Homo sapiens
caataattttctac

SEQ ID NO: 5379646 - DNA, 19 bp, Homo sapiens
caatacaaacaatctctta

SEQ ID NO: 5379647 - DNA, 14 bp, Homo sapiens
caatacaaatggat

SEQ ID NO: 5379648 - DNA, 13 bp, Homo sapiens
caatacaaattga

SEQ ID NO: 5379649 - DNA, 16 bp, Homo sapiens
caatacaacaagaaca

SEQ ID NO: 5379650 - DNA, 17 bp, Homo sapiens
caatacaactttaccat

SEQ ID NO: 5379651 - DNA, 19 bp, Homo sapiens
caatacaagttacatacat

SEQ ID NO: 5379652 - DNA, 16 bp, Homo sapiens
caatacaagtttcatc

SEQ ID NO: 5379653 - DNA, 12 bp, Homo sapiens
caatacaatgta

SEQ ID NO: 5379654 - DNA, 21 bp, Homo sapiens
caatacaatgtacaattatgt

SEQ ID NO: 5379655 - DNA, 15 bp, Homo sapiens
caatacatatatcta

SEQ ID NO: 5379656 - DNA, 23 bp, Homo sapiens
caatacatctgaggtcctgtgat

SEQ ID NO: 5379657 - DNA, 15 bp, Homo sapiens
caatacatgctgcta

SEQ ID NO: 5379658 - DNA, 21 bp, Homo sapiens
caatacattattggacttcca

SEQ ID NO: 5379659 - DNA, 12 bp, Homo sapiens
caatacattgtt

SEQ ID NO: 5379660 - DNA, 12 bp, Homo sapiens
caatacatttga

SEQ ID NO: 5379661 - DNA, 17 bp, Homo sapiens
caatacatttgatttgt

SEQ ID NO: 5379662 - DNA, 16 bp, Homo sapiens
caataccaacctgaaa

SEQ ID NO: 5379663 - DNA, 18 bp, Homo sapiens
caataccagatcactcaa

SEQ ID NO: 5379664 - DNA, 22 bp, Homo sapiens
caatacccaaatcctctccagc

SEQ ID NO: 5379665 - DNA, 14 bp, Homo sapiens
caataccccatgga

SEQ ID NO: 5379666 - DNA, 19 bp, Homo sapiens
caataccctactgtgggga

SEQ ID NO: 5379667 - DNA, 12 bp, Homo sapiens
caataccctaga

SEQ ID NO: 5379668 - DNA, 17 bp, Homo sapiens
caataccctagaagaaa

SEQ ID NO: 5379669 - DNA, 18 bp, Homo sapiens
caatacctacaataaact

SEQ ID NO: 5379670 - DNA, 19 bp, Homo sapiens
caatacctgaatgctctgt

SEQ ID NO: 5379671 - DNA, 21 bp, Homo sapiens
caatacgggagtgacccagct

SEQ ID NO: 5379672 - DNA, 14 bp, Homo sapiens
caatactaaataaa

SEQ ID NO: 5379673 - DNA, 17 bp, Homo sapiens
caatactaattgagaaa

SEQ ID NO: 5379674 - DNA, 18 bp, Homo sapiens
caatactactgtaaatgt

SEQ ID NO: 5379675 - DNA, 17 bp, Homo sapiens
caatactagtcacccca

SEQ ID NO: 5379676 - DNA, 20 bp, Homo sapiens
caatactccctttaaagaga

SEQ ID NO: 5379677 - DNA, 14 bp, Homo sapiens
caatactgagccat

SEQ ID NO: 5379678 - DNA, 19 bp, Homo sapiens
caatactgccgctgccccc

SEQ ID NO: 5379679 - DNA, 13 bp, Homo sapiens
caatacttagaga

SEQ ID NO: 5379680 - DNA, 18 bp, Homo sapiens
caatacttgaatatggaa

SEQ ID NO: 5379681 - DNA, 20 bp, Homo sapiens
caatacttgaatatggaaca

SEQ ID NO: 5379682 - DNA, 17 bp, Homo sapiens
caatacttttgtgtatt

SEQ ID NO: 5379683 - DNA, 20 bp, Homo sapiens
caatacttttgtgtattctg

SEQ ID NO: 5379684 - DNA, 15 bp, Homo sapiens
caatagaaagaaact

SEQ ID NO: 5379685 - DNA, 14 bp, Homo sapiens
caatagaaagcaaa

SEQ ID NO: 5379686 - DNA, 18 bp, Homo sapiens
caatagaataatctatta

SEQ ID NO: 5379687 - DNA, 19 bp, Homo sapiens
caatagaataatctattat

SEQ ID NO: 5379688 - DNA, 15 bp, Homo sapiens
caatagacagaaaca

SEQ ID NO: 5379689 - DNA, 14 bp, Homo sapiens
caatagagactgta

SEQ ID NO: 5379690 - DNA, 15 bp, Homo sapiens
caatagataaggttt

SEQ ID NO: 5379691 - DNA, 15 bp, Homo sapiens
caatagatctccagc

SEQ ID NO: 5379692 - DNA, 16 bp, Homo sapiens
caatagatctccagcg

SEQ ID NO: 5379693 - DNA, 23 bp, Homo sapiens
caatagatttaggagcagaaatg

SEQ ID NO: 5379694 - DNA, 16 bp, Homo sapiens
caatagcacatatgga

SEQ ID NO: 5379695 - DNA, 14 bp, Homo sapiens
caatagcaccccta

SEQ ID NO: 5379696 - DNA, 17 bp, Homo sapiens
caatagcactttcattg

SEQ ID NO: 5379697 - DNA, 20 bp, Homo sapiens
caatagcagttataacagat

SEQ ID NO: 5379698 - DNA, 20 bp, Homo sapiens
caatagcatggatagagtat

SEQ ID NO: 5379699 - DNA, 24 bp, Homo sapiens
caatagccactaaccttgcctggt

SEQ ID NO: 5379700 - DNA, 21 bp, Homo sapiens
caatagctagctatatatggt

SEQ ID NO: 5379701 - DNA, 15 bp, Homo sapiens
caataggaaaaactg

SEQ ID NO: 5379702 - DNA, 18 bp, Homo sapiens
caataggaatgctaacag

SEQ ID NO: 5379703 - DNA, 20 bp, Homo sapiens
caataggagggatgttccag

SEQ ID NO: 5379704 - DNA, 18 bp, Homo sapiens
caataggatcccccttct

SEQ ID NO: 5379705 - DNA, 21 bp, Homo sapiens
caataggatgggcttctgtgc

SEQ ID NO: 5379706 - DNA, 20 bp, Homo sapiens
caataggcaaaagtgtaaca

SEQ ID NO: 5379707 - DNA, 16 bp, Homo sapiens
caatagggctaaatgt

SEQ ID NO: 5379708 - DNA, 18 bp, Homo sapiens
caataggtctttctctca

SEQ ID NO: 5379709 - DNA, 19 bp, Homo sapiens
caataggtctttctctcag

SEQ ID NO: 5379710 - DNA, 19 bp, Homo sapiens
caataggtgcaaaaataaa

SEQ ID NO: 5379711 - DNA, 23 bp, Homo sapiens
caataggtgcctagtaaatgtta

SEQ ID NO: 5379712 - DNA, 22 bp, Homo sapiens
caataggtggaaagagaaatga

SEQ ID NO: 5379713 - DNA, 22 bp, Homo sapiens
caataggtttgggggacgccca

SEQ ID NO: 5379714 - DNA, 18 bp, Homo sapiens
caatagtatagaagtctg

SEQ ID NO: 5379715 - DNA, 17 bp, Homo sapiens
caatagtattacccatg

SEQ ID NO: 5379716 - DNA, 15 bp, Homo sapiens
caatagtatttctcc

SEQ ID NO: 5379717 - DNA, 17 bp, Homo sapiens
caatagtatttctcctt

SEQ ID NO: 5379718 - DNA, 19 bp, Homo sapiens
caatagtcaaattgtgtga

SEQ ID NO: 5379719 - DNA, 16 bp, Homo sapiens
caatagtcattaaaaa

SEQ ID NO: 5379720 - DNA, 22 bp, Homo sapiens
caatagtccccatcagcaccat

SEQ ID NO: 5379721 - DNA, 20 bp, Homo sapiens
caatagttagatctaccctg

SEQ ID NO: 5379722 - DNA, 17 bp, Homo sapiens
caatagttcttaaaatt

SEQ ID NO: 5379723 - DNA, 15 bp, Homo sapiens
caatagttgaattag

SEQ ID NO: 5379724 - DNA, 20 bp, Homo sapiens
caatagttgccaatctaaaa

SEQ ID NO: 5379725 - DNA, 16 bp, Homo sapiens
caatagtttgcataga

SEQ ID NO: 5379726 - DNA, 23 bp, Homo sapiens
caatagttttagattattttatc

SEQ ID NO: 5379727 - DNA, 14 bp, Homo sapiens
caatataaaaatgt

SEQ ID NO: 5379728 - DNA, 22 bp, Homo sapiens
caatataaaaggcaaatgtgta

SEQ ID NO: 5379729 - DNA, 13 bp, Homo sapiens
caatataaattgg

SEQ ID NO: 5379730 - DNA, 16 bp, Homo sapiens
caatataaattggctt

SEQ ID NO: 5379731 - DNA, 13 bp, Homo sapiens
caatataagaagc

SEQ ID NO: 5379732 - DNA, 16 bp, Homo sapiens
caatataagaaggaaa

SEQ ID NO: 5379733 - DNA, 14 bp, Homo sapiens
caatataagagctt

SEQ ID NO: 5379734 - DNA, 17 bp, Homo sapiens
caatgaaagtcaaattt

SEQ ID NO: 5379735 - DNA, 20 bp, Homo sapiens
caatgaaagtcaaatttact

SEQ ID NO: 5379736 - DNA, 17 bp, Homo sapiens
caatgaaagtttgcact

SEQ ID NO: 5379737 - DNA, 22 bp, Homo sapiens
caatgaaatactgagatgctgg

SEQ ID NO: 5379738 - DNA, 20 bp, Homo sapiens
caatgaaatatgtgaagccc

SEQ ID NO: 5379739 - DNA, 21 bp, Homo sapiens
caatgaaatatgtgaagccca

SEQ ID NO: 5379740 - DNA, 22 bp, Homo sapiens
caatgaaatatgtgaagcccag

SEQ ID NO: 5379741 - DNA, 17 bp, Homo sapiens
caatgaaatatttgctt

SEQ ID NO: 5379742 - DNA, 13 bp, Homo sapiens
caatgaaatgaat

SEQ ID NO: 5379743 - DNA, 19 bp, Homo sapiens
caatgaaatgaattaaagt

SEQ ID NO: 5379744 - DNA, 23 bp, Homo sapiens
caatgaaatgaattaaagtggac

SEQ ID NO: 5379745 - DNA, 16 bp, Homo sapiens
caatgaaatgaattta

SEQ ID NO: 5379746 - DNA, 15 bp, Homo sapiens
caatgaacaaaggga

SEQ ID NO: 5379747 - DNA, 22 bp, Homo sapiens
caatgaacaaagggattctcca

SEQ ID NO: 5379748 - DNA, 14 bp, Homo sapiens
caatgaacagctcc

SEQ ID NO: 5379749 - DNA, 15 bp, Homo sapiens
caatgaacagctcct

SEQ ID NO: 5379750 - DNA, 16 bp, Homo sapiens
caatgaacggccttgc

SEQ ID NO: 5379751 - DNA, 14 bp, Homo sapiens
caatgaactctttc

SEQ ID NO: 5379752 - DNA, 15 bp, Homo sapiens
caatgaactctttcc

SEQ ID NO: 5379753 - DNA, 17 bp, Homo sapiens
caatgaactgcttttcc

SEQ ID NO: 5379754 - DNA, 18 bp, Homo sapiens
caatgaactgcttttcct

SEQ ID NO: 5379755 - DNA, 17 bp, Homo sapiens
caatgaagaagacaaag

SEQ ID NO: 5379756 - DNA, 17 bp, Homo sapiens
caatgaagataaatgct

SEQ ID NO: 5379757 - DNA, 23 bp, Homo sapiens
caatgaagataaatgctttaaat

SEQ ID NO: 5379758 - DNA, 20 bp, Homo sapiens
caatgaagcaaacacacaga

SEQ ID NO: 5379759 - DNA, 22 bp, Homo sapiens
caatgaaggaaaacctcacttg

SEQ ID NO: 5379760 - DNA, 22 bp, Homo sapiens
caatgaataaaaactcaaggag

SEQ ID NO: 5379761 - DNA, 17 bp, Homo sapiens
caatgaatatactcatt

SEQ ID NO: 5379762 - DNA, 16 bp, Homo sapiens
caatgaatattgtaaa

SEQ ID NO: 5379763 - DNA, 12 bp, Homo sapiens
caatgaatgtat

SEQ ID NO: 5379764 - DNA, 21 bp, Homo sapiens
caatgaatgtatattttgtgt

SEQ ID NO: 5379765 - DNA, 13 bp, Homo sapiens
caatgaattatta

SEQ ID NO: 5379766 - DNA, 14 bp, Homo sapiens
caatgaatttgttc

SEQ ID NO: 5379767 - DNA, 15 bp, Homo sapiens
caatgacaaaaagaa

SEQ ID NO: 5379768 - DNA, 16 bp, Homo sapiens
caatgacaaagcagat

SEQ ID NO: 5379769 - DNA, 19 bp, Homo sapiens
caatgacacagtcttggct

SEQ ID NO: 5379770 - DNA, 21 bp, Homo sapiens
caatgacacagtcttggctca

SEQ ID NO: 5379771 - DNA, 23 bp, Homo sapiens
caatgacacccatgccagagagg

SEQ ID NO: 5379772 - DNA, 15 bp, Homo sapiens
caatgacagggatgc

SEQ ID NO: 5379773 - DNA, 22 bp, Homo sapiens
caatgacatccagaaagctgag

SEQ ID NO: 5379774 - DNA, 23 bp, Homo sapiens
caatgacatccagaaagctgagg

SEQ ID NO: 5379775 - DNA, 15 bp, Homo sapiens
caatgaccagcagga

SEQ ID NO: 5379776 - DNA, 19 bp, Homo sapiens
caatgaccattcaattagt

SEQ ID NO: 5379777 - DNA, 21 bp, Homo sapiens
caatgacctttcaataggaaa

SEQ ID NO: 5379778 - DNA, 22 bp, Homo sapiens
caatgactaactttttgaattc

SEQ ID NO: 5379779 - DNA, 13 bp, Homo sapiens
caatgactaagcc

SEQ ID NO: 5379780 - DNA, 17 bp, Homo sapiens
caatgactaagccaagc

SEQ ID NO: 5379781 - DNA, 21 bp, Homo sapiens
caatgactaattcttgcatat

SEQ ID NO: 5379782 - DNA, 18 bp, Homo sapiens
caatgactagtcacctgg

SEQ ID NO: 5379783 - DNA, 21 bp, Homo sapiens
caatgactcgttacctgccgc

SEQ ID NO: 5379784 - DNA, 17 bp, Homo sapiens
caatgactgcgcagagt

SEQ ID NO: 5379785 - DNA, 13 bp, Homo sapiens
caatgactgtgag

SEQ ID NO: 5379786 - DNA, 20 bp, Homo sapiens
caatgactgtgctactgtct

SEQ ID NO: 5379787 - DNA, 21 bp, Homo sapiens
caatgactgtgctactgtctt

SEQ ID NO: 5379788 - DNA, 15 bp, Homo sapiens
caatgacttactgta

SEQ ID NO: 5379789 - DNA, 13 bp, Homo sapiens
caatgacttctaa

SEQ ID NO: 5379790 - DNA, 17 bp, Homo sapiens
caatgactttcctagac

SEQ ID NO: 5379791 - DNA, 19 bp, Homo sapiens
caatgagaaaaataaatgg

SEQ ID NO: 5379792 - DNA, 19 bp, Homo sapiens
caatgagagcataatttaa

SEQ ID NO: 5379793 - DNA, 15 bp, Homo sapiens
caatgagatgcatga

SEQ ID NO: 5379794 - DNA, 14 bp, Homo sapiens
caatgagcatgttt

SEQ ID NO: 5379795 - DNA, 18 bp, Homo sapiens
caatgagcatgtttagac

SEQ ID NO: 5379796 - DNA, 20 bp, Homo sapiens
caatgagcatgtttagactt

SEQ ID NO: 5379797 - DNA, 11 bp, Homo sapiens
caatgagccat

SEQ ID NO: 5379798 - DNA, 19 bp, Homo sapiens
caatgagctgtatctgtaa

SEQ ID NO: 5379799 - DNA, 17 bp, Homo sapiens
caatgagctttctgaac

SEQ ID NO: 5379800 - DNA, 21 bp, Homo sapiens
caatgagctttctgaacagct

SEQ ID NO: 5379801 - DNA, 20 bp, Homo sapiens
caatgaggtgtccaactggc

SEQ ID NO: 5379802 - DNA, 13 bp, Homo sapiens
caatgagtaaaat

SEQ ID NO: 5379803 - DNA, 15 bp, Homo sapiens
caatgagtaaaatca

SEQ ID NO: 5379804 - DNA, 15 bp, Homo sapiens
caatgataatgctaa

SEQ ID NO: 5379805 - DNA, 15 bp, Homo sapiens
caatgatataggaaa

SEQ ID NO: 5379806 - DNA, 20 bp, Homo sapiens
caatgatatatggataatgc

SEQ ID NO: 5379807 - DNA, 21 bp, Homo sapiens
caatgatcacatctaaagctt

SEQ ID NO: 5379808 - DNA, 20 bp, Homo sapiens
caatgatcaccgactgaaaa

SEQ ID NO: 5379809 - DNA, 18 bp, Homo sapiens
caatgatctaggtttaac

SEQ ID NO: 5379810 - DNA, 24 bp, Homo sapiens
caatgatctaggtttaactcagat

SEQ ID NO: 5379811 - DNA, 15 bp, Homo sapiens
caatgatgacccact

SEQ ID NO: 5379812 - DNA, 18 bp, Homo sapiens
caatgatgacccactaaa

SEQ ID NO: 5379813 - DNA, 19 bp, Homo sapiens
caatgatgacccactaaag

SEQ ID NO: 5379814 - DNA, 22 bp, Homo sapiens
caatgatgacccactaaagagt

SEQ ID NO: 5379815 - DNA, 23 bp, Homo sapiens
caatgatgaccccggcctgtctc

SEQ ID NO: 5379816 - DNA, 19 bp, Homo sapiens
caatgatgatgataatgat

SEQ ID NO: 5379817 - DNA, 20 bp, Homo sapiens
caatgatgattaaacacctg

SEQ ID NO: 5379818 - DNA, 19 bp, Homo sapiens
caatgatgctatttgcaat

SEQ ID NO: 5379819 - DNA, 13 bp, Homo sapiens
caatgatggcaat

SEQ ID NO: 5379820 - DNA, 24 bp, Homo sapiens
caatgatggcaattttgtaacgaa

SEQ ID NO: 5379821 - DNA, 13 bp, Homo sapiens
caatgatggtcac

SEQ ID NO: 5379822 - DNA, 14 bp, Homo sapiens
caatgatggtcacc

SEQ ID NO: 5379823 - DNA, 14 bp, Homo sapiens
caatgatgtccaga

SEQ ID NO: 5379824 - DNA, 18 bp, Homo sapiens
caatgatgtgaccctcaa

SEQ ID NO: 5379825 - DNA, 19 bp, Homo sapiens
caatgattaatcagctgtt

SEQ ID NO: 5379826 - DNA, 19 bp, Homo sapiens
caatgattgtttaattgta

SEQ ID NO: 5379827 - DNA, 17 bp, Homo sapiens
caatgatttggccaggc

SEQ ID NO: 5379828 - DNA, 16 bp, Homo sapiens
caatgatttgtaaagg

SEQ ID NO: 5379829 - DNA, 21 bp, Homo sapiens
caatgcaaaagccaagaaagt

SEQ ID NO: 5379830 - DNA, 22 bp, Homo sapiens
caatgcaaaccatcattgaaat

SEQ ID NO: 5379831 - DNA, 23 bp, Homo sapiens
caatgcaaaccatcattgaaatc

SEQ ID NO: 5379832 - DNA, 14 bp, Homo sapiens
caatgcaactttta

SEQ ID NO: 5379833 - DNA, 16 bp, Homo sapiens
caatgcaagagtgatt

SEQ ID NO: 5379834 - DNA, 21 bp, Homo sapiens
caatgcaagagtgattgcagc

SEQ ID NO: 5379835 - DNA, 16 bp, Homo sapiens
caatgcaatgaaacag

SEQ ID NO: 5379836 - DNA, 18 bp, Homo sapiens
caatgcaatgcatctgaa

SEQ ID NO: 5379837 - DNA, 22 bp, Homo sapiens
caatgcacacaaaacaacccta

SEQ ID NO: 5379838 - DNA, 17 bp, Homo sapiens
caatgcacctaaagaaa

SEQ ID NO: 5379839 - DNA, 12 bp, Homo sapiens
caatgcactgag

SEQ ID NO: 5379840 - DNA, 14 bp, Homo sapiens
caatgcactttgtt

SEQ ID NO: 5379841 - DNA, 17 bp, Homo sapiens
caatgcactttgttctg

SEQ ID NO: 5379842 - DNA, 20 bp, Homo sapiens
caatgcactttgttctggct

SEQ ID NO: 5379843 - DNA, 21 bp, Homo sapiens
caatgcactttgttctggctc

SEQ ID NO: 5379844 - DNA, 22 bp, Homo sapiens
caatgcactttgttctggctct

SEQ ID NO: 5379845 - DNA, 23 bp, Homo sapiens
caatgcactttgttctggctctt

SEQ ID NO: 5379846 - DNA, 12 bp, Homo sapiens
caatgcagcacc

SEQ ID NO: 5379847 - DNA, 16 bp, Homo sapiens
caatgcagtgcctttc

SEQ ID NO: 5379848 - DNA, 18 bp, Homo sapiens
caatgcagttgtctctgt

SEQ ID NO: 5379849 - DNA, 15 bp, Homo sapiens
caatgcatacaataa

SEQ ID NO: 5379850 - DNA, 16 bp, Homo sapiens
caatgcatacaataaa

SEQ ID NO: 5379851 - DNA, 20 bp, Homo sapiens
caatgcatacaataaaagag

SEQ ID NO: 5379852 - DNA, 21 bp, Homo sapiens
caatgcatacaataaaagagc

SEQ ID NO: 5379853 - DNA, 21 bp, Homo sapiens
caatgcatagagccctggcca

SEQ ID NO: 5379854 - DNA, 19 bp, Homo sapiens
caatgcatatatgaaaaca

SEQ ID NO: 5379855 - DNA, 17 bp, Homo sapiens
caatgcatctgaaagtt

SEQ ID NO: 5379856 - DNA, 22 bp, Homo sapiens
caatgcatgatgactcttctta

SEQ ID NO: 5379857 - DNA, 18 bp, Homo sapiens
caatgcatgtgctgtctc

SEQ ID NO: 5379858 - DNA, 19 bp, Homo sapiens
caatgcatgtgctgtctcc

SEQ ID NO: 5379859 - DNA, 20 bp, Homo sapiens
caatgcattctggagacaga

SEQ ID NO: 5379860 - DNA, 16 bp, Homo sapiens
caatgcattggcctct

SEQ ID NO: 5379861 - DNA, 17 bp, Homo sapiens
caatgcattggcctctg

SEQ ID NO: 5379862 - DNA, 12 bp, Homo sapiens
caatgcattttg

SEQ ID NO: 5379863 - DNA, 14 bp, Homo sapiens
caatgcatttttaa

SEQ ID NO: 5379864 - DNA, 14 bp, Homo sapiens
caatgccaagataa

SEQ ID NO: 5379865 - DNA, 17 bp, Homo sapiens
caatgccaattcatctc

SEQ ID NO: 5379866 - DNA, 19 bp, Homo sapiens
caatgccacagccctgtca

SEQ ID NO: 5379867 - DNA, 15 bp, Homo sapiens
caatgccacctagac

SEQ ID NO: 5379868 - DNA, 16 bp, Homo sapiens
caatgccagggcccag

SEQ ID NO: 5379869 - DNA, 21 bp, Homo sapiens
caatgccagggcccaggagga

SEQ ID NO: 5379870 - DNA, 13 bp, Homo sapiens
caatgccatcagc

SEQ ID NO: 5379871 - DNA, 15 bp, Homo sapiens
caatgccatcagccc

SEQ ID NO: 5379872 - DNA, 19 bp, Homo sapiens
caatgccatcagcccctgg

SEQ ID NO: 5379873 - DNA, 20 bp, Homo sapiens
caatgccatcagcccctggg

SEQ ID NO: 5379874 - DNA, 17 bp, Homo sapiens
caatgccatgaacaaat

SEQ ID NO: 5379875 - DNA, 16 bp, Homo sapiens
caatgccattgtgcag

SEQ ID NO: 5379876 - DNA, 16 bp, Homo sapiens
caatgcccagcagggg

SEQ ID NO: 5379877 - DNA, 18 bp, Homo sapiens
caatgccccctcccctcc

SEQ ID NO: 5379878 - DNA, 14 bp, Homo sapiens
caatgccctgccat

SEQ ID NO: 5379879 - DNA, 20 bp, Homo sapiens
caatgccctgccttgctgcc

SEQ ID NO: 5379880 - DNA, 21 bp, Homo sapiens
caatgccctgccttgctgcct

SEQ ID NO: 5379881 - DNA, 22 bp, Homo sapiens
caatgccctgccttgctgcctt

SEQ ID NO: 5379882 - DNA, 21 bp, Homo sapiens
caatgccctgcggctctggaa

SEQ ID NO: 5379883 - DNA, 18 bp, Homo sapiens
caatgccgcctgtcaata

SEQ ID NO: 5379884 - DNA, 21 bp, Homo sapiens
caatgccgcctgtcaataaat

SEQ ID NO: 5379885 - DNA, 22 bp, Homo sapiens
caatgccgcctgtcaataaatg

SEQ ID NO: 5379886 - DNA, 13 bp, Homo sapiens
caatgcctctccc

SEQ ID NO: 5379887 - DNA, 16 bp, Homo sapiens
caatgcctctcccacg

SEQ ID NO: 5379888 - DNA, 15 bp, Homo sapiens
caatgcctgcctgaa

SEQ ID NO: 5379889 - DNA, 13 bp, Homo sapiens
caatgcctggaga

SEQ ID NO: 5379890 - DNA, 14 bp, Homo sapiens
caatgcctgtgaag

SEQ ID NO: 5379891 - DNA, 17 bp, Homo sapiens
caatgccttgggagaga

SEQ ID NO: 5379892 - DNA, 15 bp, Homo sapiens
caatgccttgttgta

SEQ ID NO: 5379893 - DNA, 15 bp, Homo sapiens
caatgcgaatggtag

SEQ ID NO: 5379894 - DNA, 22 bp, Homo sapiens
caatgcgaggtcgcaactgaga

SEQ ID NO: 5379895 - DNA, 17 bp, Homo sapiens
caatgcggcccactttc

SEQ ID NO: 5379896 - DNA, 16 bp, Homo sapiens
caatgcgtcttgtgaa

SEQ ID NO: 5379897 - DNA, 19 bp, Homo sapiens
caatgcgtcttgtgaaatt

SEQ ID NO: 5379898 - DNA, 20 bp, Homo sapiens
caatgcgtcttgtgaaattg

SEQ ID NO: 5379899 - DNA, 22 bp, Homo sapiens
caatgcgtcttgtgaaattgtg

SEQ ID NO: 5379900 - DNA, 15 bp, Homo sapiens
caatgctatcactgt

SEQ ID NO: 5379901 - DNA, 14 bp, Homo sapiens
caatgctatggact

SEQ ID NO: 5379902 - DNA, 15 bp, Homo sapiens
caatgctatggactg

SEQ ID NO: 5379903 - DNA, 22 bp, Homo sapiens
caatgctatggactgcacaaaa

SEQ ID NO: 5379904 - DNA, 19 bp, Homo sapiens
caatgctgatgaatcactg

SEQ ID NO: 5379905 - DNA, 14 bp, Homo sapiens
caatgctgatttgg

SEQ ID NO: 5379906 - DNA, 20 bp, Homo sapiens
caatgctgcaggatggactg

SEQ ID NO: 5379907 - DNA, 17 bp, Homo sapiens
caatgctgccatgccca

SEQ ID NO: 5379908 - DNA, 18 bp, Homo sapiens
caatgctgccatgcccac

SEQ ID NO: 5379909 - DNA, 14 bp, Homo sapiens
caatgctgtatttt

SEQ ID NO: 5379910 - DNA, 14 bp, Homo sapiens
caatttgctattta

SEQ ID NO: 5379911 - DNA, 22 bp, Homo sapiens
caatttgctatttacaaatgaa

SEQ ID NO: 5379912 - DNA, 21 bp, Homo sapiens
caatttggatttaaaagcctg

SEQ ID NO: 5379913 - DNA, 23 bp, Homo sapiens
caatttggatttaaaagcctgct

SEQ ID NO: 5379914 - DNA, 18 bp, Homo sapiens
caatttggcaattttgtg

SEQ ID NO: 5379915 - DNA, 13 bp, Homo sapiens
caatttggtaaaa

SEQ ID NO: 5379916 - DNA, 21 bp, Homo sapiens
caatttggtaaaaatgctgct

SEQ ID NO: 5379917 - DNA, 22 bp, Homo sapiens
caatttggtaaaaatgctgctc

SEQ ID NO: 5379918 - DNA, 17 bp, Homo sapiens
caatttggtcttagctt

SEQ ID NO: 5379919 - DNA, 13 bp, Homo sapiens
caatttgtaaata

SEQ ID NO: 5379920 - DNA, 11 bp, Homo sapiens
caatttgtact

SEQ ID NO: 5379921 - DNA, 13 bp, Homo sapiens
caatttgtctttg

SEQ ID NO: 5379922 - DNA, 16 bp, Homo sapiens
caatttgtctttggaa

SEQ ID NO: 5379923 - DNA, 16 bp, Homo sapiens
caatttgttaacagag

SEQ ID NO: 5379924 - DNA, 18 bp, Homo sapiens
caatttgttaacagagca

SEQ ID NO: 5379925 - DNA, 23 bp, Homo sapiens
caatttgttcagtctttcattta

SEQ ID NO: 5379926 - DNA, 12 bp, Homo sapiens
caatttgttctg

SEQ ID NO: 5379927 - DNA, 17 bp, Homo sapiens
caatttgtttttgcatt

SEQ ID NO: 5379928 - DNA, 15 bp, Homo sapiens
caattttaaaaaata

SEQ ID NO: 5379929 - DNA, 18 bp, Homo sapiens
caattttaaaatgaaatg

SEQ ID NO: 5379930 - DNA, 15 bp, Homo sapiens
caattttaaacatat

SEQ ID NO: 5379931 - DNA, 14 bp, Homo sapiens
caattttaaataag

SEQ ID NO: 5379932 - DNA, 20 bp, Homo sapiens
caattttaacacacataaag

SEQ ID NO: 5379933 - DNA, 22 bp, Homo sapiens
caattttaacacacataaagga

SEQ ID NO: 5379934 - DNA, 15 bp, Homo sapiens
caattttaacatttg

SEQ ID NO: 5379935 - DNA, 23 bp, Homo sapiens
caattttaatttagtaaatgtta

SEQ ID NO: 5379936 - DNA, 22 bp, Homo sapiens
caattttaccctgaggtcactg

SEQ ID NO: 5379937 - DNA, 18 bp, Homo sapiens
caattttacctattctga

SEQ ID NO: 5379938 - DNA, 17 bp, Homo sapiens
caattttactgtgaaaa

SEQ ID NO: 5379939 - DNA, 21 bp, Homo sapiens
caattttagtcactaagactt

SEQ ID NO: 5379940 - DNA, 22 bp, Homo sapiens
caattttagtcactaagacttt

SEQ ID NO: 5379941 - DNA, 20 bp, Homo sapiens
caattttagtgtattaatca

SEQ ID NO: 5379942 - DNA, 22 bp, Homo sapiens
caattttagtgtattaatcata

SEQ ID NO: 5379943 - DNA, 15 bp, Homo sapiens
caattttatctgttt

SEQ ID NO: 5379944 - DNA, 20 bp, Homo sapiens
caattttcactgtgtccagg

SEQ ID NO: 5379945 - DNA, 21 bp, Homo sapiens
caattttcagacacatttttg

SEQ ID NO: 5379946 - DNA, 12 bp, Homo sapiens
caattttcagat

SEQ ID NO: 5379947 - DNA, 12 bp, Homo sapiens
caattttcaggt

SEQ ID NO: 5379948 - DNA, 23 bp, Homo sapiens
caattttcaggtttcttaaaaac

SEQ ID NO: 5379949 - DNA, 11 bp, Homo sapiens
caattttcctt

SEQ ID NO: 5379950 - DNA, 16 bp, Homo sapiens
caattttccttgaagc

SEQ ID NO: 5379951 - DNA, 16 bp, Homo sapiens
caattttctaagcaat

SEQ ID NO: 5379952 - DNA, 23 bp, Homo sapiens
caattttctaccactggtgtaaa

SEQ ID NO: 5379953 - DNA, 13 bp, Homo sapiens
caattttctccca

SEQ ID NO: 5379954 - DNA, 19 bp, Homo sapiens
caattttctggaatacatg

SEQ ID NO: 5379955 - DNA, 20 bp, Homo sapiens
caattttctggaatacatga

SEQ ID NO: 5379956 - DNA, 13 bp, Homo sapiens
caattttctgtaa

SEQ ID NO: 5379957 - DNA, 15 bp, Homo sapiens
caattttctgtaaga

SEQ ID NO: 5379958 - DNA, 15 bp, Homo sapiens
caattttctgtgcca

SEQ ID NO: 5379959 - DNA, 16 bp, Homo sapiens
caattttctttagctt

SEQ ID NO: 5379960 - DNA, 21 bp, Homo sapiens
caattttgatctttttatatt

SEQ ID NO: 5379961 - DNA, 13 bp, Homo sapiens
caattttgtatcc

SEQ ID NO: 5379962 - DNA, 16 bp, Homo sapiens
caattttgtatttaat

SEQ ID NO: 5379963 - DNA, 13 bp, Homo sapiens
caattttgtctct

SEQ ID NO: 5379964 - DNA, 12 bp, Homo sapiens
caattttgtctt

SEQ ID NO: 5379965 - DNA, 13 bp, Homo sapiens
caattttgtctta

SEQ ID NO: 5379966 - DNA, 20 bp, Homo sapiens
caattttgtcttaagtgttt

SEQ ID NO: 5379967 - DNA, 21 bp, Homo sapiens
caattttgtcttaagtgtttc

SEQ ID NO: 5379968 - DNA, 14 bp, Homo sapiens
caattttgtttctg

SEQ ID NO: 5379969 - DNA, 17 bp, Homo sapiens
caattttgtttctgtac

SEQ ID NO: 5379970 - DNA, 17 bp, Homo sapiens
caatttttaaaactttt

SEQ ID NO: 5379971 - DNA, 16 bp, Homo sapiens
caatttttaaatttct

SEQ ID NO: 5379972 - DNA, 12 bp, Homo sapiens
caatttttaata

SEQ ID NO: 5379973 - DNA, 15 bp, Homo sapiens
caatttttaataaat

SEQ ID NO: 5379974 - DNA, 13 bp, Homo sapiens
caatttttaatgg

SEQ ID NO: 5379975 - DNA, 22 bp, Homo sapiens
caatttttaatggcagcagaaa

SEQ ID NO: 5379976 - DNA, 13 bp, Homo sapiens
caatttttataca

SEQ ID NO: 5379977 - DNA, 15 bp, Homo sapiens
caatttttatacata

SEQ ID NO: 5379978 - DNA, 21 bp, Homo sapiens
caatttttatacatatcagaa

SEQ ID NO: 5379979 - DNA, 13 bp, Homo sapiens
caatttttatatt

SEQ ID NO: 5379980 - DNA, 13 bp, Homo sapiens
caatttttatttc

SEQ ID NO: 5379981 - DNA, 13 bp, Homo sapiens
caatttttcccag

SEQ ID NO: 5379982 - DNA, 17 bp, Homo sapiens
caatttttcccagtatt

SEQ ID NO: 5379983 - DNA, 18 bp, Homo sapiens
caatttttcccagtattt

SEQ ID NO: 5379984 - DNA, 13 bp, Homo sapiens
caatttttctgca

SEQ ID NO: 5379985 - DNA, 13 bp, Homo sapiens
caatttttcttta

SEQ ID NO: 5379986 - DNA, 19 bp, Homo sapiens
caatttttggttgaataaa

SEQ ID NO: 5379987 - DNA, 14 bp, Homo sapiens
caattttttaaacc

SEQ ID NO: 5379988 - DNA, 20 bp, Homo sapiens
caattttttaagtgaaaata

SEQ ID NO: 5379989 - DNA, 20 bp, Homo sapiens
caattttttttcaaatgtgc

SEQ ID NO: 5379990 - DNA, 22 bp, Homo sapiens
caattttttttcaaatgtgcaa

SEQ ID NO: 5379991 - DNA, 22 bp, Homo sapiens
caattttttttccgtaaatgtc

SEQ ID NO: 5379992 - DNA, 15 bp, Homo sapiens
caatttttttttcaa

SEQ ID NO: 5379993 - DNA, 16 bp, Homo sapiens
caatttttttttgtta

SEQ ID NO: 5379994 - DNA, 12 bp, Homo sapiens
cacaaaaaaaga

SEQ ID NO: 5379995 - DNA, 13 bp, Homo sapiens
cacaaaaaaagac

SEQ ID NO: 5379996 - DNA, 16 bp, Homo sapiens
cacaaaaaaagtaatt

SEQ ID NO: 5379997 - DNA, 18 bp, Homo sapiens
cacaaaaaaataataaaa

SEQ ID NO: 5379998 - DNA, 23 bp, Homo sapiens
cacaaaaaaatggaaagaaaaga

SEQ ID NO: 5379999 - DNA, 19 bp, Homo sapiens
cacaaaaacaaaaaaacta

SEQ ID NO: 5380000 - DNA, 12 bp, Homo sapiens
cacaaaaacaat

SEQ ID NO: 5380001 - DNA, 21 bp, Homo sapiens
cacaaaaagaaagctgtgaaa

SEQ ID NO: 5380002 - DNA, 20 bp, Homo sapiens
cacaaaaagagaagctgtgt

SEQ ID NO: 5380003 - DNA, 14 bp, Homo sapiens
cacaaaaagcacaa

SEQ ID NO: 5380004 - DNA, 16 bp, Homo sapiens
cacaaaaagcacaagc

SEQ ID NO: 5380005 - DNA, 17 bp, Homo sapiens
cacaaaaaggcaaatat

SEQ ID NO: 5380006 - DNA, 19 bp, Homo sapiens
cacaaaaaggcaaatattg

SEQ ID NO: 5380007 - DNA, 22 bp, Homo sapiens
cacaaaaaggcaaatattgaag

SEQ ID NO: 5380008 - DNA, 11 bp, Homo sapiens
cacaaaaagtc

SEQ ID NO: 5380009 - DNA, 21 bp, Homo sapiens
cacaaaaatggtggtttgtca

SEQ ID NO: 5380010 - DNA, 18 bp, Homo sapiens
cacaaaaatgttcacttc

SEQ ID NO: 5380011 - DNA, 16 bp, Homo sapiens
cacaaaaatgttgaac

SEQ ID NO: 5380012 - DNA, 22 bp, Homo sapiens
cacaaaacaaatgccacacatc

SEQ ID NO: 5380013 - DNA, 16 bp, Homo sapiens
cacaaaacaacaaaaa

SEQ ID NO: 5380014 - DNA, 22 bp, Homo sapiens
cacaaaacaacagcaacaacaa

SEQ ID NO: 5380015 - DNA, 19 bp, Homo sapiens
cacaaaacattcatgtaac

SEQ ID NO: 5380016 - DNA, 15 bp, Homo sapiens
cacaaaacatttttg

SEQ ID NO: 5380017 - DNA, 17 bp, Homo sapiens
cacaaaacctgtcctat

SEQ ID NO: 5380018 - DNA, 20 bp, Homo sapiens
cacaaaactccgcccccagc

SEQ ID NO: 5380019 - DNA, 21 bp, Homo sapiens
cacaaaactccgcccccagcc

SEQ ID NO: 5380020 - DNA, 18 bp, Homo sapiens
cacaaaacttcagtgtgg

SEQ ID NO: 5380021 - DNA, 16 bp, Homo sapiens
cacaaaacttgaaaga

SEQ ID NO: 5380022 - DNA, 18 bp, Homo sapiens
cacaaaagaaaaaaaact

SEQ ID NO: 5380023 - DNA, 17 bp, Homo sapiens
cacaaaagaagaaataa

SEQ ID NO: 5380024 - DNA, 20 bp, Homo sapiens
cacaaaagacaagcattggg

SEQ ID NO: 5380025 - DNA, 14 bp, Homo sapiens
cacaaaagattatg

SEQ ID NO: 5380026 - DNA, 19 bp, Homo sapiens
cacaaaagcaaaattttta

SEQ ID NO: 5380027 - DNA, 13 bp, Homo sapiens
cacaaaagcagat

SEQ ID NO: 5380028 - DNA, 16 bp, Homo sapiens
cacaaaagctgtgtct

SEQ ID NO: 5380029 - DNA, 20 bp, Homo sapiens
cacaaaagtatattcaaaaa

SEQ ID NO: 5380030 - DNA, 18 bp, Homo sapiens
cacaaaagttagctgagc

SEQ ID NO: 5380031 - DNA, 14 bp, Homo sapiens
cacaaaatatttct

SEQ ID NO: 5380032 - DNA, 12 bp, Homo sapiens
cacaaaatgaat

SEQ ID NO: 5380033 - DNA, 12 bp, Homo sapiens
cacaaaatgcaa

SEQ ID NO: 5380034 - DNA, 18 bp, Homo sapiens
cacaaaatgtcacacttg

SEQ ID NO: 5380035 - DNA, 14 bp, Homo sapiens
cacaaacaaacaag

SEQ ID NO: 5380036 - DNA, 19 bp, Homo sapiens
cacaaacaaacaagctagg

SEQ ID NO: 5380037 - DNA, 15 bp, Homo sapiens
cacaaacaaatggct

SEQ ID NO: 5380038 - DNA, 17 bp, Homo sapiens
cacaaacacacacacta

SEQ ID NO: 5380039 - DNA, 14 bp, Homo sapiens
cacaaacatagaca

SEQ ID NO: 5380040 - DNA, 17 bp, Homo sapiens
cacaaacatagacagat

SEQ ID NO: 5380041 - DNA, 18 bp, Homo sapiens
cacaaacatagacagatg

SEQ ID NO: 5380042 - DNA, 18 bp, Homo sapiens
cacaaaccacaactgaca

SEQ ID NO: 5380043 - DNA, 19 bp, Homo sapiens
cacaaaccacaactgacac

SEQ ID NO: 5380044 - DNA, 20 bp, Homo sapiens
cacaaaccaccctaaaatga

SEQ ID NO: 5380045 - DNA, 16 bp, Homo sapiens
cacaaaccagcctggg

SEQ ID NO: 5380046 - DNA, 15 bp, Homo sapiens
cacaaaccatgcaaa

SEQ ID NO: 5380047 - DNA, 13 bp, Homo sapiens
cacaaaccctggg

SEQ ID NO: 5380048 - DNA, 15 bp, Homo sapiens
cacaaaccctgggga

SEQ ID NO: 5380049 - DNA, 13 bp, Homo sapiens
cacaaacctgccc

SEQ ID NO: 5380050 - DNA, 15 bp, Homo sapiens
cacaaacctgcctgg

SEQ ID NO: 5380051 - DNA, 17 bp, Homo sapiens
cacaaacctgcctgggt

SEQ ID NO: 5380052 - DNA, 17 bp, Homo sapiens
cacaaaccttctgcctt

SEQ ID NO: 5380053 - DNA, 18 bp, Homo sapiens
cacaaacggagcccctga

SEQ ID NO: 5380054 - DNA, 23 bp, Homo sapiens
cacaaacgtttacttatcttatg

SEQ ID NO: 5380055 - DNA, 15 bp, Homo sapiens
cacaaactacctctg

SEQ ID NO: 5380056 - DNA, 16 bp, Homo sapiens
cacaaactacctctgg

SEQ ID NO: 5380057 - DNA, 15 bp, Homo sapiens
cacaaactgaatgac

SEQ ID NO: 5380058 - DNA, 22 bp, Homo sapiens
cacaaactgcttcctttcttga

SEQ ID NO: 5380059 - DNA, 12 bp, Homo sapiens
cacaaactgtaa

SEQ ID NO: 5380060 - DNA, 20 bp, Homo sapiens
cacaaactgtgaaaatagtg

SEQ ID NO: 5380061 - DNA, 23 bp, Homo sapiens
cacaaacttaacatggaagatat

SEQ ID NO: 5380062 - DNA, 16 bp, Homo sapiens
cacaaactttaaattc

SEQ ID NO: 5380063 - DNA, 19 bp, Homo sapiens
cacaaacttttatactctt

SEQ ID NO: 5380064 - DNA, 23 bp, Homo sapiens
cacaaagaaccaccaggaaagca

SEQ ID NO: 5380065 - DNA, 21 bp, Homo sapiens
cacaaagaacttgctgctgcc

SEQ ID NO: 5380066 - DNA, 22 bp, Homo sapiens
cacaaagaacttgctgctgcct

SEQ ID NO: 5380067 - DNA, 19 bp, Homo sapiens
cacaaagacacaggaagaa

SEQ ID NO: 5380068 - DNA, 20 bp, Homo sapiens
cacaaagacacaggaagaat

SEQ ID NO: 5380069 - DNA, 18 bp, Homo sapiens
cacaaagacatggaagat

SEQ ID NO: 5380070 - DNA, 16 bp, Homo sapiens
cacaaagaccaaaatg

SEQ ID NO: 5380071 - DNA, 18 bp, Homo sapiens
cacaaagaccaaaatgaa

SEQ ID NO: 5380072 - DNA, 20 bp, Homo sapiens
cacaaagaccaaaatgaaag

SEQ ID NO: 5380073 - DNA, 17 bp, Homo sapiens
cacaaagaccctggctt

SEQ ID NO: 5380074 - DNA, 17 bp, Homo sapiens
cacaaagactccttcgt

SEQ ID NO: 5380075 - DNA, 14 bp, Homo sapiens
cacaaagagaccag

SEQ ID NO: 5380076 - DNA, 12 bp, Homo sapiens
cacaaagagctg

SEQ ID NO: 5380077 - DNA, 15 bp, Homo sapiens
cacaaagattttcta

SEQ ID NO: 5380078 - DNA, 16 bp, Homo sapiens
cacaaagattttctaa

SEQ ID NO: 5380079 - DNA, 18 bp, Homo sapiens
cacaaagcacagtttgaa

SEQ ID NO: 5380080 - DNA, 15 bp, Homo sapiens
cacaaagcagatcct

SEQ ID NO: 5380081 - DNA, 18 bp, Homo sapiens
cacaaagcagtttttccc

SEQ ID NO: 5380082 - DNA, 11 bp, Homo sapiens
cacaaagccca

SEQ ID NO: 5380083 - DNA, 17 bp, Homo sapiens
cacaaagccccccagct

SEQ ID NO: 5380084 - DNA, 18 bp, Homo sapiens
cacaaagcggggggaggg

SEQ ID NO: 5380085 - DNA, 20 bp, Homo sapiens
cacaaagctaaatacatgga

SEQ ID NO: 5380086 - DNA, 16 bp, Homo sapiens
cacaaagcttctaaag

SEQ ID NO: 5380087 - DNA, 13 bp, Homo sapiens
cacaaagctttct

SEQ ID NO: 5380088 - DNA, 13 bp, Homo sapiens
cacaaagcttttg

SEQ ID NO: 5380089 - DNA, 11 bp, Homo sapiens
cacacacacaa

SEQ ID NO: 5380090 - DNA, 11 bp, Homo sapiens
cacacacacac

SEQ ID NO: 5380091 - DNA, 14 bp, Homo sapiens
cacacacacacaca

SEQ ID NO: 5380092 - DNA, 16 bp, Homo sapiens
cacacacacacacaaa

SEQ ID NO: 5380093 - DNA, 15 bp, Homo sapiens
cacacacacacacac

SEQ ID NO: 5380094 - DNA, 16 bp, Homo sapiens
cacacacacacacacg

SEQ ID NO: 5380095 - DNA, 16 bp, Homo sapiens
cacacacacacacagc

SEQ ID NO: 5380096 - DNA, 16 bp, Homo sapiens
cacacacacacacatg

SEQ ID NO: 5380097 - DNA, 15 bp, Homo sapiens
cacacacacacacgc

SEQ ID NO: 5380098 - DNA, 13 bp, Homo sapiens
cacacacacacag

SEQ ID NO: 5380099 - DNA, 15 bp, Homo sapiens
cacacacacacagcc

SEQ ID NO: 5380100 - DNA, 14 bp, Homo sapiens
cacacacacacagt

SEQ ID NO: 5380101 - DNA, 14 bp, Homo sapiens
cacacacacacata

SEQ ID NO: 5380102 - DNA, 15 bp, Homo sapiens
cacacacacacatat

SEQ ID NO: 5380103 - DNA, 12 bp, Homo sapiens
cacacacacacg

SEQ ID NO: 5380104 - DNA, 13 bp, Homo sapiens
cacacacacactg

SEQ ID NO: 5380105 - DNA, 13 bp, Homo sapiens
cacacacacagaa

SEQ ID NO: 5380106 - DNA, 14 bp, Homo sapiens
cacacacacagaaa

SEQ ID NO: 5380107 - DNA, 15 bp, Homo sapiens
cacacacacagaaaa

SEQ ID NO: 5380108 - DNA, 12 bp, Homo sapiens
cacacacacagc

SEQ ID NO: 5380109 - DNA, 14 bp, Homo sapiens
cacacacacaggag

SEQ ID NO: 5380110 - DNA, 14 bp, Homo sapiens
cacacacacaggtg

SEQ ID NO: 5380111 - DNA, 15 bp, Homo sapiens
cacacacacagtcct

SEQ ID NO: 5380112 - DNA, 15 bp, Homo sapiens
cacacacacatacag

SEQ ID NO: 5380113 - DNA, 12 bp, Homo sapiens
cacacacacatg

SEQ ID NO: 5380114 - DNA, 15 bp, Homo sapiens
cacacacacctgtct

SEQ ID NO: 5380115 - DNA, 16 bp, Homo sapiens
cacacacacgatgcat

SEQ ID NO: 5380116 - DNA, 13 bp, Homo sapiens
cacacacacgcac

SEQ ID NO: 5380117 - DNA, 11 bp, Homo sapiens
cacacacactc

SEQ ID NO: 5380118 - DNA, 15 bp, Homo sapiens
cacacacagaaaata

SEQ ID NO: 5380119 - DNA, 19 bp, Homo sapiens
cacacacagaaaatatact

SEQ ID NO: 5380120 - DNA, 18 bp, Homo sapiens
cacacacagacatatata

SEQ ID NO: 5380121 - DNA, 13 bp, Homo sapiens
cacacacagagat

SEQ ID NO: 5380122 - DNA, 14 bp, Homo sapiens
cacacacagaggaa

SEQ ID NO: 5380123 - DNA, 23 bp, Homo sapiens
cacacacagaggaagagcaggca

SEQ ID NO: 5380124 - DNA, 17 bp, Homo sapiens
cacacacagatgcacac

SEQ ID NO: 5380125 - DNA, 11 bp, Homo sapiens
cacacacagcc

SEQ ID NO: 5380126 - DNA, 13 bp, Homo sapiens
cacacacagccac

SEQ ID NO: 5380127 - DNA, 14 bp, Homo sapiens
cacacacagccaca

SEQ ID NO: 5380128 - DNA, 13 bp, Homo sapiens
cacacacaggagc

SEQ ID NO: 5380129 - DNA, 13 bp, Homo sapiens
cacacacaggcct

SEQ ID NO: 5380130 - DNA, 14 bp, Homo sapiens
cacacacaggcctt

SEQ ID NO: 5380131 - DNA, 12 bp, Homo sapiens
cacacacataca

SEQ ID NO: 5380132 - DNA, 13 bp, Homo sapiens
cacacacatacac

SEQ ID NO: 5380133 - DNA, 19 bp, Homo sapiens
cacacacatacacacatat

SEQ ID NO: 5380134 - DNA, 14 bp, Homo sapiens
cacacacatatata

SEQ ID NO: 5380135 - DNA, 13 bp, Homo sapiens
cacacacatgcat

SEQ ID NO: 5380136 - DNA, 18 bp, Homo sapiens
cacacacatgcttccctt

SEQ ID NO: 5380137 - DNA, 15 bp, Homo sapiens
cacacacccaggccc

SEQ ID NO: 5380138 - DNA, 14 bp, Homo sapiens
cacacacccctcaa

SEQ ID NO: 5380139 - DNA, 18 bp, Homo sapiens
cacacaccctacaagttg

SEQ ID NO: 5380140 - DNA, 14 bp, Homo sapiens
cacacacctcacca

SEQ ID NO: 5380141 - DNA, 16 bp, Homo sapiens
cacacacctgcacacc

SEQ ID NO: 5380142 - DNA, 22 bp, Homo sapiens
cacacacctgcacacccctgca

SEQ ID NO: 5380143 - DNA, 22 bp, Homo sapiens
cacacacctgcacaccgtccct

SEQ ID NO: 5380144 - DNA, 13 bp, Homo sapiens
cacacacctgtag

SEQ ID NO: 5380145 - DNA, 19 bp, Homo sapiens
cacacacctgtagtcccag

SEQ ID NO: 5380146 - DNA, 20 bp, Homo sapiens
cacacacctgtagtcccagc

SEQ ID NO: 5380147 - DNA, 17 bp, Homo sapiens
cacacacctgtctgtgc

SEQ ID NO: 5380148 - DNA, 20 bp, Homo sapiens
cacacacctgtctgtgcaga

SEQ ID NO: 5380149 - DNA, 16 bp, Homo sapiens
cacacaccttgcaaaa

SEQ ID NO: 5380150 - DNA, 14 bp, Homo sapiens
cacacacgcacgca

SEQ ID NO: 5380151 - DNA, 16 bp, Homo sapiens
cacacacgcacgcaca

SEQ ID NO: 5380152 - DNA, 19 bp, Homo sapiens
cacacacgcacggcttcct

SEQ ID NO: 5380153 - DNA, 18 bp, Homo sapiens
cacacacgcagacacaca

SEQ ID NO: 5380154 - DNA, 20 bp, Homo sapiens
cacacacgcagacacacaca

SEQ ID NO: 5380155 - DNA, 22 bp, Homo sapiens
cacacacgccagctcctctctg

SEQ ID NO: 5380156 - DNA, 21 bp, Homo sapiens
cacacacgcgtccacatacac

SEQ ID NO: 5380157 - DNA, 20 bp, Homo sapiens
cacacacggaggcatcctac

SEQ ID NO: 5380158 - DNA, 15 bp, Homo sapiens
cacacacggatgcac

SEQ ID NO: 5380159 - DNA, 24 bp, Homo sapiens
cacacacggatgcacacacagatg

SEQ ID NO: 5380160 - DNA, 15 bp, Homo sapiens
cacacacgtgagaat

SEQ ID NO: 5380161 - DNA, 20 bp, Homo sapiens
cacacacgttgacgggccgc

SEQ ID NO: 5380162 - DNA, 12 bp, Homo sapiens
cacacactcact

SEQ ID NO: 5380163 - DNA, 15 bp, Homo sapiens
cacacactcactgcg

SEQ ID NO: 5380164 - DNA, 16 bp, Homo sapiens
cacacactccctgctt

SEQ ID NO: 5380165 - DNA, 15 bp, Homo sapiens
cacacactccttccc

SEQ ID NO: 5380166 - DNA, 21 bp, Homo sapiens
cacacactcgcccgcccactg

SEQ ID NO: 5380167 - DNA, 12 bp, Homo sapiens
cacacactgacc

SEQ ID NO: 5380168 - DNA, 18 bp, Homo sapiens
cacacactgcctcccatc

SEQ ID NO: 5380169 - DNA, 12 bp, Homo sapiens
cacacactggac

SEQ ID NO: 5380170 - DNA, 18 bp, Homo sapiens
cacacactggaccccact

SEQ ID NO: 5380171 - DNA, 19 bp, Homo sapiens
cacacactggaccccactg

SEQ ID NO: 5380172 - DNA, 21 bp, Homo sapiens
cacacactggaccccactggc

SEQ ID NO: 5380173 - DNA, 14 bp, Homo sapiens
cacacactggctcc

SEQ ID NO: 5380174 - DNA, 21 bp, Homo sapiens
cacacactggctcctggacct

SEQ ID NO: 5380175 - DNA, 18 bp, Homo sapiens
cacacactgtgccccaca

SEQ ID NO: 5380176 - DNA, 21 bp, Homo sapiens
cacacacttagccattgaaat

SEQ ID NO: 5380177 - DNA, 23 bp, Homo sapiens
cacacacttagccattgaaatgt

SEQ ID NO: 5380178 - DNA, 12 bp, Homo sapiens
cacacactttcc

SEQ ID NO: 5380179 - DNA, 22 bp, Homo sapiens
cacacactttccatctctgcct

SEQ ID NO: 5380180 - DNA, 14 bp, Homo sapiens
cacacactttctga

SEQ ID NO: 5380181 - DNA, 14 bp, Homo sapiens
cacacactttggct

SEQ ID NO: 5380182 - DNA, 11 bp, Homo sapiens
cacacagaaaa

SEQ ID NO: 5380183 - DNA, 23 bp, Homo sapiens
cacacagaaaatatactgtaaag

SEQ ID NO: 5380184 - DNA, 15 bp, Homo sapiens
cacacagaaactctt

SEQ ID NO: 5380185 - DNA, 16 bp, Homo sapiens
cacacagaaatatata

SEQ ID NO: 5380186 - DNA, 17 bp, Homo sapiens
cacacagaatgctcagg

SEQ ID NO: 5380187 - DNA, 12 bp, Homo sapiens
cacacagacaca

SEQ ID NO: 5380188 - DNA, 15 bp, Homo sapiens
cacacagacatatat

SEQ ID NO: 5380189 - DNA, 16 bp, Homo sapiens
cacacagacggcctag

SEQ ID NO: 5380190 - DNA, 15 bp, Homo sapiens
cacacagagatgtcc

SEQ ID NO: 5380191 - DNA, 14 bp, Homo sapiens
cacacagagcctgc

SEQ ID NO: 5380192 - DNA, 14 bp, Homo sapiens
cacacagaggacct

SEQ ID NO: 5380193 - DNA, 14 bp, Homo sapiens
cacacagagtggtc

SEQ ID NO: 5380194 - DNA, 15 bp, Homo sapiens
cacacagagtggtct

SEQ ID NO: 5380195 - DNA, 17 bp, Homo sapiens
cacacagatcccctgga

SEQ ID NO: 5380196 - DNA, 17 bp, Homo sapiens
cacacagatgacaaatt

SEQ ID NO: 5380197 - DNA, 19 bp, Homo sapiens
cacacagatgcacacacag

SEQ ID NO: 5380198 - DNA, 18 bp, Homo sapiens
cacacagatggtcacaca

SEQ ID NO: 5380199 - DNA, 19 bp, Homo sapiens
cacacagcacttcaaagaa

SEQ ID NO: 5380200 - DNA, 19 bp, Homo sapiens
cacacagcagcactgcaga

SEQ ID NO: 5380201 - DNA, 20 bp, Homo sapiens
cacacagcagccccccagca

SEQ ID NO: 5380202 - DNA, 23 bp, Homo sapiens
cacacagcagccccccagcacta

SEQ ID NO: 5380203 - DNA, 13 bp, Homo sapiens
cacacagcagctc

SEQ ID NO: 5380204 - DNA, 12 bp, Homo sapiens
cacacagcagtg

SEQ ID NO: 5380205 - DNA, 16 bp, Homo sapiens
cacacagccacacaca

SEQ ID NO: 5380206 - DNA, 20 bp, Homo sapiens
cacacagccacacacacaga

SEQ ID NO: 5380207 - DNA, 21 bp, Homo sapiens
cacacagccacacacacagaa

SEQ ID NO: 5380208 - DNA, 15 bp, Homo sapiens
cacacagccaggtgc

SEQ ID NO: 5380209 - DNA, 19 bp, Homo sapiens
cacacagccaggtgccttg

SEQ ID NO: 5380210 - DNA, 21 bp, Homo sapiens
cacacagccaggtgccttgga

SEQ ID NO: 5380211 - DNA, 15 bp, Homo sapiens
cacacagcccagaag

SEQ ID NO: 5380212 - DNA, 13 bp, Homo sapiens
cacacagcccagt

SEQ ID NO: 5380213 - DNA, 15 bp, Homo sapiens
cacacagcccagttc

SEQ ID NO: 5380214 - DNA, 15 bp, Homo sapiens
cacacagcctagcac

SEQ ID NO: 5380215 - DNA, 12 bp, Homo sapiens
cacacagcctct

SEQ ID NO: 5380216 - DNA, 16 bp, Homo sapiens
cacacagcctggcctc

SEQ ID NO: 5380217 - DNA, 17 bp, Homo sapiens
cacacagcctggcctcc

SEQ ID NO: 5380218 - DNA, 13 bp, Homo sapiens
cacacagcctgtg

SEQ ID NO: 5380219 - DNA, 17 bp, Homo sapiens
cacacagcggctgcctc

SEQ ID NO: 5380220 - DNA, 13 bp, Homo sapiens
cacacagctcctc

SEQ ID NO: 5380221 - DNA, 13 bp, Homo sapiens
cacacagctctgt

SEQ ID NO: 5380222 - DNA, 15 bp, Homo sapiens
cacacagctctgtcc

SEQ ID NO: 5380223 - DNA, 12 bp, Homo sapiens
cacacagctgcc

SEQ ID NO: 5380224 - DNA, 16 bp, Homo sapiens
cacacagctgccctag

SEQ ID NO: 5380225 - DNA, 14 bp, Homo sapiens
cacacagctgggca

SEQ ID NO: 5380226 - DNA, 23 bp, Homo sapiens
cacacaggaactctgtgtgagag

SEQ ID NO: 5380227 - DNA, 17 bp, Homo sapiens
cacacaggacccccttc

SEQ ID NO: 5380228 - DNA, 17 bp, Homo sapiens
cacacaggagtcctttc

SEQ ID NO: 5380229 - DNA, 10 bp, Homo sapiens
cacacaggca

SEQ ID NO: 5380230 - DNA, 16 bp, Homo sapiens
cacacaggcaactgag

SEQ ID NO: 5380231 - DNA, 12 bp, Homo sapiens
cacacaggcagc

SEQ ID NO: 5380232 - DNA, 19 bp, Homo sapiens
cacacaggcagggcctggc

SEQ ID NO: 5380233 - DNA, 20 bp, Homo sapiens
cacacaggcagggcctggct

SEQ ID NO: 5380234 - DNA, 21 bp, Homo sapiens
cacacaggcagggcctggctc

SEQ ID NO: 5380235 - DNA, 24 bp, Homo sapiens
cacacaggcagggcctggctccag

SEQ ID NO: 5380236 - DNA, 10 bp, Homo sapiens
cacacaggcc

SEQ ID NO: 5380237 - DNA, 17 bp, Homo sapiens
cacacaggcccatgccc

SEQ ID NO: 5380238 - DNA, 14 bp, Homo sapiens
cacacaggcctggc

SEQ ID NO: 5380239 - DNA, 22 bp, Homo sapiens
cacacaggcctggcccagccag

SEQ ID NO: 5380240 - DNA, 23 bp, Homo sapiens
cacacaggcctggcccagccagc

SEQ ID NO: 5380241 - DNA, 17 bp, Homo sapiens
cacacaggccttctgtg

SEQ ID NO: 5380242 - DNA, 18 bp, Homo sapiens
cacacaggccttctgtgg

SEQ ID NO: 5380243 - DNA, 19 bp, Homo sapiens
cacacaggccttctgtggg

SEQ ID NO: 5380244 - DNA, 20 bp, Homo sapiens
cacacaggccttctgtgggg

SEQ ID NO: 5380245 - DNA, 21 bp, Homo sapiens
cacacaggccttctgtggggc

SEQ ID NO: 5380246 - DNA, 13 bp, Homo sapiens
cacacagggcagt

SEQ ID NO: 5380247 - DNA, 15 bp, Homo sapiens
cacacagggctcaca

SEQ ID NO: 5380248 - DNA, 21 bp, Homo sapiens
cacacagggctcacagggcag

SEQ ID NO: 5380249 - DNA, 22 bp, Homo sapiens
cacacaggggaggtgatagcat

SEQ ID NO: 5380250 - DNA, 20 bp, Homo sapiens
cacacaggggtggagtttct

SEQ ID NO: 5380251 - DNA, 17 bp, Homo sapiens
cacacaggtggccatca

SEQ ID NO: 5380252 - DNA, 23 bp, Homo sapiens
cacacaggtggccatcacagccc

SEQ ID NO: 5380253 - DNA, 19 bp, Homo sapiens
cacacaggtggggactggg

SEQ ID NO: 5380254 - DNA, 20 bp, Homo sapiens
cacacaggtggggactgggc

SEQ ID NO: 5380255 - DNA, 15 bp, Homo sapiens
cacacagtatagata

SEQ ID NO: 5380256 - DNA, 20 bp, Homo sapiens
cacacagtattacttctgct

SEQ ID NO: 5380257 - DNA, 15 bp, Homo sapiens
cacacagtcacccct

SEQ ID NO: 5380258 - DNA, 13 bp, Homo sapiens
cacacagtcccca

SEQ ID NO: 5380259 - DNA, 17 bp, Homo sapiens
cacacagtccccagact

SEQ ID NO: 5380260 - DNA, 22 bp, Homo sapiens
cacacagtccccagactcagct

SEQ ID NO: 5380261 - DNA, 16 bp, Homo sapiens
cacacagtcctcacac

SEQ ID NO: 5380262 - DNA, 19 bp, Homo sapiens
cacacagtctcagtccaga

SEQ ID NO: 5380263 - DNA, 20 bp, Homo sapiens
cacacagtctcagtccagat

SEQ ID NO: 5380264 - DNA, 20 bp, Homo sapiens
cacacagtgacaaaaggctc

SEQ ID NO: 5380265 - DNA, 15 bp, Homo sapiens
cacacagtgaccaag

SEQ ID NO: 5380266 - DNA, 18 bp, Homo sapiens
cacacagtgagtcgagga

SEQ ID NO: 5380267 - DNA, 19 bp, Homo sapiens
cacacagtggatggacgga

SEQ ID NO: 5380268 - DNA, 23 bp, Homo sapiens
cacacagttgttgaatgactgac

SEQ ID NO: 5380269 - DNA, 13 bp, Homo sapiens
cacacataacaca

SEQ ID NO: 5380270 - DNA, 17 bp, Homo sapiens
cacacataagcactgaa

SEQ ID NO: 5380271 - DNA, 17 bp, Homo sapiens
cacactggctcctggac

SEQ ID NO: 5380272 - DNA, 15 bp, Homo sapiens
cacactggggccccg

SEQ ID NO: 5380273 - DNA, 12 bp, Homo sapiens
cacactggggct

SEQ ID NO: 5380274 - DNA, 22 bp, Homo sapiens
cacactggggtgccgcctgccc

SEQ ID NO: 5380275 - DNA, 21 bp, Homo sapiens
cacactgggtgcccaagctca

SEQ ID NO: 5380276 - DNA, 21 bp, Homo sapiens
cacactgggtgcgtctccagt

SEQ ID NO: 5380277 - DNA, 22 bp, Homo sapiens
cacactgggtggtggcctggtc

SEQ ID NO: 5380278 - DNA, 16 bp, Homo sapiens
cacactggtacttaga

SEQ ID NO: 5380279 - DNA, 22 bp, Homo sapiens
cacactggtacttagagtttct

SEQ ID NO: 5380280 - DNA, 15 bp, Homo sapiens
cacactggtgactgc

SEQ ID NO: 5380281 - DNA, 16 bp, Homo sapiens
cacactggttctcaat

SEQ ID NO: 5380282 - DNA, 18 bp, Homo sapiens
cacactggtttgccaggc

SEQ ID NO: 5380283 - DNA, 21 bp, Homo sapiens
cacactggtttgccaggccaa

SEQ ID NO: 5380284 - DNA, 10 bp, Homo sapiens
cacactgtaa

SEQ ID NO: 5380285 - DNA, 12 bp, Homo sapiens
cacactgtcaga

SEQ ID NO: 5380286 - DNA, 14 bp, Homo sapiens
cacactgtctgggg

SEQ ID NO: 5380287 - DNA, 19 bp, Homo sapiens
cacactgtctggggcccca

SEQ ID NO: 5380288 - DNA, 13 bp, Homo sapiens
cacactgtcttcc

SEQ ID NO: 5380289 - DNA, 17 bp, Homo sapiens
cacactgtgacacacta

SEQ ID NO: 5380290 - DNA, 22 bp, Homo sapiens
cacactgtgacacactacacca

SEQ ID NO: 5380291 - DNA, 19 bp, Homo sapiens
cacactgtgattttgccct

SEQ ID NO: 5380292 - DNA, 21 bp, Homo sapiens
cacactgtgattttgccctcc

SEQ ID NO: 5380293 - DNA, 22 bp, Homo sapiens
cacactgtgattttgccctcct

SEQ ID NO: 5380294 - DNA, 20 bp, Homo sapiens
cacactgtgcgttttagagt

SEQ ID NO: 5380295 - DNA, 14 bp, Homo sapiens
cacactgtgctttc

SEQ ID NO: 5380296 - DNA, 20 bp, Homo sapiens
cacactgtgctttctattgt

SEQ ID NO: 5380297 - DNA, 22 bp, Homo sapiens
cacactgtgctttctattgtac

SEQ ID NO: 5380298 - DNA, 23 bp, Homo sapiens
cacactgtgctttctattgtaca

SEQ ID NO: 5380299 - DNA, 15 bp, Homo sapiens
cacactgtggcctga

SEQ ID NO: 5380300 - DNA, 19 bp, Homo sapiens
cacactgtgtcctggtgct

SEQ ID NO: 5380301 - DNA, 20 bp, Homo sapiens
cacactgttacacgtgcctg

SEQ ID NO: 5380302 - DNA, 19 bp, Homo sapiens
cacactgttactccacagc

SEQ ID NO: 5380303 - DNA, 15 bp, Homo sapiens
cacacttaaaagatg

SEQ ID NO: 5380304 - DNA, 23 bp, Homo sapiens
cacacttaagccctcgtgcacac

SEQ ID NO: 5380305 - DNA, 22 bp, Homo sapiens
cacacttactgtaagacattag

SEQ ID NO: 5380306 - DNA, 16 bp, Homo sapiens
cacacttactttttct

SEQ ID NO: 5380307 - DNA, 16 bp, Homo sapiens
cacacttatttatgaa

SEQ ID NO: 5380308 - DNA, 20 bp, Homo sapiens
cacacttatttttttcccaa

SEQ ID NO: 5380309 - DNA, 18 bp, Homo sapiens
cacacttcaggctcttct

SEQ ID NO: 5380310 - DNA, 20 bp, Homo sapiens
cacacttcaggctcttctcc

SEQ ID NO: 5380311 - DNA, 20 bp, Homo sapiens
cacacttcattgtaaatcac

SEQ ID NO: 5380312 - DNA, 19 bp, Homo sapiens
cacacttccaccagcctgc

SEQ ID NO: 5380313 - DNA, 18 bp, Homo sapiens
cacacttccccatctttg

SEQ ID NO: 5380314 - DNA, 14 bp, Homo sapiens
cacacttccctggc

SEQ ID NO: 5380315 - DNA, 14 bp, Homo sapiens
cacacttcctgtcc

SEQ ID NO: 5380316 - DNA, 15 bp, Homo sapiens
cacacttcctgtcca

SEQ ID NO: 5380317 - DNA, 16 bp, Homo sapiens
cacacttcctgtccag

SEQ ID NO: 5380318 - DNA, 20 bp, Homo sapiens
cacacttcctgtccagagag

SEQ ID NO: 5380319 - DNA, 13 bp, Homo sapiens
cacacttccttta

SEQ ID NO: 5380320 - DNA, 16 bp, Homo sapiens
cacacttcgctcttga

SEQ ID NO: 5380321 - DNA, 21 bp, Homo sapiens
cacacttcttgaaacagcctg

SEQ ID NO: 5380322 - DNA, 15 bp, Homo sapiens
cacacttgcaaatga

SEQ ID NO: 5380323 - DNA, 20 bp, Homo sapiens
cacacttgcaaatgaatgcc

SEQ ID NO: 5380324 - DNA, 20 bp, Homo sapiens
cacacttgggcgctctgccc

SEQ ID NO: 5380325 - DNA, 23 bp, Homo sapiens
cacacttgggcgctctgccctcc

SEQ ID NO: 5380326 - DNA, 15 bp, Homo sapiens
cacacttgggctggc

SEQ ID NO: 5380327 - DNA, 17 bp, Homo sapiens
cacacttgggctggcac

SEQ ID NO: 5380328 - DNA, 22 bp, Homo sapiens
cacacttggttgggtcctcaca

SEQ ID NO: 5380329 - DNA, 18 bp, Homo sapiens
cacacttgtacccacagg

SEQ ID NO: 5380330 - DNA, 22 bp, Homo sapiens
cacacttgtaggataagtgaaa

SEQ ID NO: 5380331 - DNA, 22 bp, Homo sapiens
cacacttgtcggctccagtccc

SEQ ID NO: 5380332 - DNA, 19 bp, Homo sapiens
cacacttgtgccagcccgg

SEQ ID NO: 5380333 - DNA, 13 bp, Homo sapiens
cacacttgtgtgt

SEQ ID NO: 5380334 - DNA, 23 bp, Homo sapiens
cacacttgtgtgtgggctgtgag

SEQ ID NO: 5380335 - DNA, 15 bp, Homo sapiens
cacacttgttccagc

SEQ ID NO: 5380336 - DNA, 17 bp, Homo sapiens
cacacttgttccagctc

SEQ ID NO: 5380337 - DNA, 20 bp, Homo sapiens
cacacttgttccagctcttt

SEQ ID NO: 5380338 - DNA, 16 bp, Homo sapiens
cacactttccatctct

SEQ ID NO: 5380339 - DNA, 15 bp, Homo sapiens
cacactttctcttca

SEQ ID NO: 5380340 - DNA, 21 bp, Homo sapiens
cacactttctcttcaatgaaa

SEQ ID NO: 5380341 - DNA, 17 bp, Homo sapiens
cacactttctgactgca

SEQ ID NO: 5380342 - DNA, 12 bp, Homo sapiens
cacactttggta

SEQ ID NO: 5380343 - DNA, 16 bp, Homo sapiens
cacacttttgcaagag

SEQ ID NO: 5380344 - DNA, 16 bp, Homo sapiens
cacacttttgcacata

SEQ ID NO: 5380345 - DNA, 15 bp, Homo sapiens
cacactttttgctta

SEQ ID NO: 5380346 - DNA, 13 bp, Homo sapiens
cacagaaaagcat

SEQ ID NO: 5380347 - DNA, 14 bp, Homo sapiens
cacagaaaataagg

SEQ ID NO: 5380348 - DNA, 17 bp, Homo sapiens
cacagaaaataaggcac

SEQ ID NO: 5380349 - DNA, 23 bp, Homo sapiens
cacagaaaataaggcacccatct

SEQ ID NO: 5380350 - DNA, 17 bp, Homo sapiens
cacagaaaatatactgt

SEQ ID NO: 5380351 - DNA, 21 bp, Homo sapiens
cacagaaaatatactgtaaag

SEQ ID NO: 5380352 - DNA, 13 bp, Homo sapiens
cacagaaacacaa

SEQ ID NO: 5380353 - DNA, 17 bp, Homo sapiens
cacagaaacactgcctt

SEQ ID NO: 5380354 - DNA, 18 bp, Homo sapiens
cacagaaacactgccttt

SEQ ID NO: 5380355 - DNA, 17 bp, Homo sapiens
cacagaaacttgaactc

SEQ ID NO: 5380356 - DNA, 11 bp, Homo sapiens
cacagaaagag

SEQ ID NO: 5380357 - DNA, 18 bp, Homo sapiens
cacagaaagctagatatg

SEQ ID NO: 5380358 - DNA, 15 bp, Homo sapiens
cacagaaagggcagc

SEQ ID NO: 5380359 - DNA, 17 bp, Homo sapiens
cacagaaagggcagctt

SEQ ID NO: 5380360 - DNA, 9 bp, Homo sapiens
cacagaaat

SEQ ID NO: 5380361 - DNA, 13 bp, Homo sapiens
cacagaaatatat

SEQ ID NO: 5380362 - DNA, 18 bp, Homo sapiens
cacagaaatatatataca

SEQ ID NO: 5380363 - DNA, 20 bp, Homo sapiens
cacagaaatatatatacata

SEQ ID NO: 5380364 - DNA, 17 bp, Homo sapiens
cacagaaatcacagtca

SEQ ID NO: 5380365 - DNA, 20 bp, Homo sapiens
cacagaaatcagaggagaga

SEQ ID NO: 5380366 - DNA, 15 bp, Homo sapiens
cacagaaatctctca

SEQ ID NO: 5380367 - DNA, 23 bp, Homo sapiens
cacagaaatctgaaaaatggcca

SEQ ID NO: 5380368 - DNA, 20 bp, Homo sapiens
cacagaaatgctgctggcca

SEQ ID NO: 5380369 - DNA, 22 bp, Homo sapiens
cacagaaatgctgctggccaaa

SEQ ID NO: 5380370 - DNA, 21 bp, Homo sapiens
cacagaacaggaggtgtgaat

SEQ ID NO: 5380371 - DNA, 21 bp, Homo sapiens
cacagaacctactgttccttt

SEQ ID NO: 5380372 - DNA, 15 bp, Homo sapiens
cacagaaccttcaac

SEQ ID NO: 5380373 - DNA, 21 bp, Homo sapiens
cacagaactgcttactagccc

SEQ ID NO: 5380374 - DNA, 18 bp, Homo sapiens
cacagaactggcaggagc

SEQ ID NO: 5380375 - DNA, 14 bp, Homo sapiens
cacagaagacacgt

SEQ ID NO: 5380376 - DNA, 17 bp, Homo sapiens
cacagaagacacgtgtt

SEQ ID NO: 5380377 - DNA, 12 bp, Homo sapiens
cacagaagagga

SEQ ID NO: 5380378 - DNA, 14 bp, Homo sapiens
cacagaagccagga

SEQ ID NO: 5380379 - DNA, 23 bp, Homo sapiens
cacagaagccaggagcaaatgtt

SEQ ID NO: 5380380 - DNA, 19 bp, Homo sapiens
cacagaagccccacaccag

SEQ ID NO: 5380381 - DNA, 15 bp, Homo sapiens
cacagaagcctagga

SEQ ID NO: 5380382 - DNA, 13 bp, Homo sapiens
cacagaaggctgg

SEQ ID NO: 5380383 - DNA, 19 bp, Homo sapiens
cacagaaggggactgccac

SEQ ID NO: 5380384 - DNA, 23 bp, Homo sapiens
cacagaaggggactgccacctcc

SEQ ID NO: 5380385 - DNA, 17 bp, Homo sapiens
cacagaaggtgaacttt

SEQ ID NO: 5380386 - DNA, 20 bp, Homo sapiens
cacagaaggtgaactttgtg

SEQ ID NO: 5380387 - DNA, 22 bp, Homo sapiens
cacagaaggtgaactttgtgct

SEQ ID NO: 5380388 - DNA, 13 bp, Homo sapiens
cacagaagtcctg

SEQ ID NO: 5380389 - DNA, 18 bp, Homo sapiens
cacagaatatttttatat

SEQ ID NO: 5380390 - DNA, 14 bp, Homo sapiens
cacagaatgctcag

SEQ ID NO: 5380391 - DNA, 14 bp, Homo sapiens
cacagacaagcagc

SEQ ID NO: 5380392 - DNA, 17 bp, Homo sapiens
cacagacaagcagccct

SEQ ID NO: 5380393 - DNA, 19 bp, Homo sapiens
cacagacaagcagcccttg

SEQ ID NO: 5380394 - DNA, 21 bp, Homo sapiens
cacagacaagcagcccttgct

SEQ ID NO: 5380395 - DNA, 22 bp, Homo sapiens
cacagacaagggggatgttgtg

SEQ ID NO: 5380396 - DNA, 21 bp, Homo sapiens
cacagacaattctaatggtaa

SEQ ID NO: 5380397 - DNA, 13 bp, Homo sapiens
cacagacacacac

SEQ ID NO: 5380398 - DNA, 17 bp, Homo sapiens
cacagacacacacacgc

SEQ ID NO: 5380399 - DNA, 15 bp, Homo sapiens
cacagacacgctcgc

SEQ ID NO: 5380400 - DNA, 15 bp, Homo sapiens
cacagacaggacccc

SEQ ID NO: 5380401 - DNA, 20 bp, Homo sapiens
cacagacattctgccaggcc

SEQ ID NO: 5380402 - DNA, 14 bp, Homo sapiens
cacagacattttgt

SEQ ID NO: 5380403 - DNA, 18 bp, Homo sapiens
cacagacattttgtgtga

SEQ ID NO: 5380404 - DNA, 19 bp, Homo sapiens
cacagacattttgtgtgag

SEQ ID NO: 5380405 - DNA, 20 bp, Homo sapiens
cacagacattttgtgtgaga

SEQ ID NO: 5380406 - DNA, 21 bp, Homo sapiens
cacagacattttgtgtgagac

SEQ ID NO: 5380407 - DNA, 20 bp, Homo sapiens
cacagaccacctgcttctga

SEQ ID NO: 5380408 - DNA, 15 bp, Homo sapiens
cacagaccaggcctt

SEQ ID NO: 5380409 - DNA, 14 bp, Homo sapiens
cacagacccaggac

SEQ ID NO: 5380410 - DNA, 16 bp, Homo sapiens
cacagaccccagctgg

SEQ ID NO: 5380411 - DNA, 18 bp, Homo sapiens
cacagaccccagctgggg

SEQ ID NO: 5380412 - DNA, 16 bp, Homo sapiens
cacagacccctaggga

SEQ ID NO: 5380413 - DNA, 17 bp, Homo sapiens
cacagacccctgggagc

SEQ ID NO: 5380414 - DNA, 22 bp, Homo sapiens
cacagaccctgccctgtgggcc

SEQ ID NO: 5380415 - DNA, 16 bp, Homo sapiens
cacagaccgcgcccct

SEQ ID NO: 5380416 - DNA, 16 bp, Homo sapiens
cacagacctctcccac

SEQ ID NO: 5380417 - DNA, 17 bp, Homo sapiens
cacagacctctcccacc

SEQ ID NO: 5380418 - DNA, 19 bp, Homo sapiens
cacagacctgctctggaca

SEQ ID NO: 5380419 - DNA, 18 bp, Homo sapiens
cacagacctggagcccct

SEQ ID NO: 5380420 - DNA, 21 bp, Homo sapiens
cacagacctggagcccctggg

SEQ ID NO: 5380421 - DNA, 23 bp, Homo sapiens
cacagacctggagcccctgggtg

SEQ ID NO: 5380422 - DNA, 17 bp, Homo sapiens
cacagacgccacctggc

SEQ ID NO: 5380423 - DNA, 20 bp, Homo sapiens
cacagacggcctaggggtgg

SEQ ID NO: 5380424 - DNA, 22 bp, Homo sapiens
cacagacgttaggcatttcctg

SEQ ID NO: 5380425 - DNA, 23 bp, Homo sapiens
cacagactattgacatcagcatc

SEQ ID NO: 5380426 - DNA, 21 bp, Homo sapiens
cacagactcaatgtgctctgt

SEQ ID NO: 5380427 - DNA, 14 bp, Homo sapiens
cacagactcatatt

SEQ ID NO: 5380428 - DNA, 15 bp, Homo sapiens
cacagactcatcctg

SEQ ID NO: 5380429 - DNA, 16 bp, Homo sapiens
cacagactcatcctga

SEQ ID NO: 5380430 - DNA, 22 bp, Homo sapiens
cacagactcatcctgaacagca

SEQ ID NO: 5380431 - DNA, 11 bp, Homo sapiens
cacagactccg

SEQ ID NO: 5380432 - DNA, 12 bp, Homo sapiens
cacagactctgt

SEQ ID NO: 5380433 - DNA, 19 bp, Homo sapiens
cacagactcttccaccaga

SEQ ID NO: 5380434 - DNA, 22 bp, Homo sapiens
cacagactcttccaccagagca

SEQ ID NO: 5380435 - DNA, 13 bp, Homo sapiens
cacagactctttc

SEQ ID NO: 5380436 - DNA, 13 bp, Homo sapiens
cacagactgctgt

SEQ ID NO: 5380437 - DNA, 13 bp, Homo sapiens
cacagactggcaa

SEQ ID NO: 5380438 - DNA, 18 bp, Homo sapiens
cacagactggcaataaac

SEQ ID NO: 5380439 - DNA, 19 bp, Homo sapiens
cacagactggcaataaact

SEQ ID NO: 5380440 - DNA, 15 bp, Homo sapiens
cacagactgttccct

SEQ ID NO: 5380441 - DNA, 17 bp, Homo sapiens
cacagacttcacacagc

SEQ ID NO: 5380442 - DNA, 17 bp, Homo sapiens
cacagacttctggaagg

SEQ ID NO: 5380443 - DNA, 19 bp, Homo sapiens
cacagacttgcactgaagc

SEQ ID NO: 5380444 - DNA, 21 bp, Homo sapiens
cacagagaaaaagttgtaatt

SEQ ID NO: 5380445 - DNA, 20 bp, Homo sapiens
cacagagaagacgggatttg

SEQ ID NO: 5380446 - DNA, 18 bp, Homo sapiens
cacagagaagctcctgct

SEQ ID NO: 5380447 - DNA, 14 bp, Homo sapiens
cacagagaagctgg

SEQ ID NO: 5380448 - DNA, 20 bp, Homo sapiens
cacagctctgtcctgggagt

SEQ ID NO: 5380449 - DNA, 23 bp, Homo sapiens
cacagctctgtcctgggagtgag

SEQ ID NO: 5380450 - DNA, 12 bp, Homo sapiens
cacagctcttca

SEQ ID NO: 5380451 - DNA, 13 bp, Homo sapiens
cacagctcttcac

SEQ ID NO: 5380452 - DNA, 21 bp, Homo sapiens
cacagctcttcacaccattca

SEQ ID NO: 5380453 - DNA, 18 bp, Homo sapiens
cacagctcttcattccat

SEQ ID NO: 5380454 - DNA, 17 bp, Homo sapiens
cacagctcttccagggc

SEQ ID NO: 5380455 - DNA, 20 bp, Homo sapiens
cacagctcttccagggcagc

SEQ ID NO: 5380456 - DNA, 17 bp, Homo sapiens
cacagctcttctccagg

SEQ ID NO: 5380457 - DNA, 20 bp, Homo sapiens
cacagctgaaagttcttgct

SEQ ID NO: 5380458 - DNA, 18 bp, Homo sapiens
cacagctgagcacttagc

SEQ ID NO: 5380459 - DNA, 18 bp, Homo sapiens
cacagctgagctggccta

SEQ ID NO: 5380460 - DNA, 20 bp, Homo sapiens
cacagctgaggaccctcagc

SEQ ID NO: 5380461 - DNA, 18 bp, Homo sapiens
cacagctgcagagacaga

SEQ ID NO: 5380462 - DNA, 12 bp, Homo sapiens
cacagctgcagc

SEQ ID NO: 5380463 - DNA, 13 bp, Homo sapiens
cacagctgcagct

SEQ ID NO: 5380464 - DNA, 13 bp, Homo sapiens
cacagctgccctg

SEQ ID NO: 5380465 - DNA, 14 bp, Homo sapiens
cacagctgccctgc

SEQ ID NO: 5380466 - DNA, 15 bp, Homo sapiens
cacagctgccctgct

SEQ ID NO: 5380467 - DNA, 23 bp, Homo sapiens
cacagctgccctgctgccacagc

SEQ ID NO: 5380468 - DNA, 14 bp, Homo sapiens
cacagctgcctctt

SEQ ID NO: 5380469 - DNA, 18 bp, Homo sapiens
cacagctgctctgtgacc

SEQ ID NO: 5380470 - DNA, 14 bp, Homo sapiens
cacagctgctggcc

SEQ ID NO: 5380471 - DNA, 14 bp, Homo sapiens
cacagctgctgtgc

SEQ ID NO: 5380472 - DNA, 19 bp, Homo sapiens
cacagctgctgttctcagg

SEQ ID NO: 5380473 - DNA, 12 bp, Homo sapiens
cacagctgcttg

SEQ ID NO: 5380474 - DNA, 17 bp, Homo sapiens
cacagctgcttgtcctg

SEQ ID NO: 5380475 - DNA, 21 bp, Homo sapiens
cacagctggagctctcaaact

SEQ ID NO: 5380476 - DNA, 13 bp, Homo sapiens
cacagctgggata

SEQ ID NO: 5380477 - DNA, 12 bp, Homo sapiens
cacagctgggca

SEQ ID NO: 5380478 - DNA, 19 bp, Homo sapiens
cacagctgggcaaagccac

SEQ ID NO: 5380479 - DNA, 17 bp, Homo sapiens
cacagctgggcagggtg

SEQ ID NO: 5380480 - DNA, 14 bp, Homo sapiens
cacagctggggccg

SEQ ID NO: 5380481 - DNA, 23 bp, Homo sapiens
cacagctggggtggggacctcag

SEQ ID NO: 5380482 - DNA, 14 bp, Homo sapiens
cacagctgtagtgg

SEQ ID NO: 5380483 - DNA, 18 bp, Homo sapiens
cacagctgtctgccaggc

SEQ ID NO: 5380484 - DNA, 22 bp, Homo sapiens
cacagcttaacaatgcaacttt

SEQ ID NO: 5380485 - DNA, 15 bp, Homo sapiens
cacagcttagatttc

SEQ ID NO: 5380486 - DNA, 18 bp, Homo sapiens
cacagcttatggcatctc

SEQ ID NO: 5380487 - DNA, 17 bp, Homo sapiens
cacagcttcagccagga

SEQ ID NO: 5380488 - DNA, 22 bp, Homo sapiens
cacagcttcagccaggagctgg

SEQ ID NO: 5380489 - DNA, 22 bp, Homo sapiens
cacagcttcatttcctgtgtct

SEQ ID NO: 5380490 - DNA, 22 bp, Homo sapiens
cacagcttcccctctctcctcc

SEQ ID NO: 5380491 - DNA, 23 bp, Homo sapiens
cacagcttcccctctctcctcct

SEQ ID NO: 5380492 - DNA, 15 bp, Homo sapiens
cacagcttcctgagt

SEQ ID NO: 5380493 - DNA, 14 bp, Homo sapiens
cacagcttctccaa

SEQ ID NO: 5380494 - DNA, 14 bp, Homo sapiens
cacagcttcttctg

SEQ ID NO: 5380495 - DNA, 12 bp, Homo sapiens
cacagcttcttt

SEQ ID NO: 5380496 - DNA, 20 bp, Homo sapiens
cacagcttgacctgaggctg

SEQ ID NO: 5380497 - DNA, 22 bp, Homo sapiens
cacagcttgacctgaggctgtg

SEQ ID NO: 5380498 - DNA, 15 bp, Homo sapiens
cacagcttggggcca

SEQ ID NO: 5380499 - DNA, 16 bp, Homo sapiens
cacagcttgggtcagg

SEQ ID NO: 5380500 - DNA, 20 bp, Homo sapiens
cacagcttgtctcttgcctg

SEQ ID NO: 5380501 - DNA, 22 bp, Homo sapiens
cacagcttgtctcttgcctgcc

SEQ ID NO: 5380502 - DNA, 15 bp, Homo sapiens
cacagcttgtgaatg

SEQ ID NO: 5380503 - DNA, 20 bp, Homo sapiens
cacagcttgttttggacttt

SEQ ID NO: 5380504 - DNA, 20 bp, Homo sapiens
cacagctttatcaccagaga

SEQ ID NO: 5380505 - DNA, 15 bp, Homo sapiens
cacagctttcccagg

SEQ ID NO: 5380506 - DNA, 16 bp, Homo sapiens
cacagctttcccaggt

SEQ ID NO: 5380507 - DNA, 14 bp, Homo sapiens
cacagctttgcacc

SEQ ID NO: 5380508 - DNA, 17 bp, Homo sapiens
cacagctttgcacccct

SEQ ID NO: 5380509 - DNA, 16 bp, Homo sapiens
cacagcttttccaaaa

SEQ ID NO: 5380510 - DNA, 15 bp, Homo sapiens
cacagcttttcttga

SEQ ID NO: 5380511 - DNA, 13 bp, Homo sapiens
cacagcttttgca

SEQ ID NO: 5380512 - DNA, 14 bp, Homo sapiens
cacagcttttgcaa

SEQ ID NO: 5380513 - DNA, 23 bp, Homo sapiens
cacaggaaaatgtatccagagga

SEQ ID NO: 5380514 - DNA, 12 bp, Homo sapiens
cacaggaaacag

SEQ ID NO: 5380515 - DNA, 23 bp, Homo sapiens
cacaggaaaccaacacccaaagc

SEQ ID NO: 5380516 - DNA, 13 bp, Homo sapiens
cacaggaaaccag

SEQ ID NO: 5380517 - DNA, 17 bp, Homo sapiens
cacaggaaccctaaagc

SEQ ID NO: 5380518 - DNA, 22 bp, Homo sapiens
cacaggaacggccctgcaggag

SEQ ID NO: 5380519 - DNA, 16 bp, Homo sapiens
cacaggaactctgtgt

SEQ ID NO: 5380520 - DNA, 18 bp, Homo sapiens
cacaggaactctgtgtga

SEQ ID NO: 5380521 - DNA, 21 bp, Homo sapiens
cacaggaactctgtgtgagag

SEQ ID NO: 5380522 - DNA, 15 bp, Homo sapiens
cacaggaagagaaga

SEQ ID NO: 5380523 - DNA, 18 bp, Homo sapiens
cacaggaagatgggaggt

SEQ ID NO: 5380524 - DNA, 19 bp, Homo sapiens
cacaggaagatgggaggtg

SEQ ID NO: 5380525 - DNA, 22 bp, Homo sapiens
cacaggaagcctgcagtcctgg

SEQ ID NO: 5380526 - DNA, 14 bp, Homo sapiens
cacaggaaggaaac

SEQ ID NO: 5380527 - DNA, 19 bp, Homo sapiens
cacaggacacagtcagatt

SEQ ID NO: 5380528 - DNA, 15 bp, Homo sapiens
cacaggacatttctc

SEQ ID NO: 5380529 - DNA, 17 bp, Homo sapiens
cacaggacatttctcta

SEQ ID NO: 5380530 - DNA, 23 bp, Homo sapiens
cacaggaccacctcctctgccag

SEQ ID NO: 5380531 - DNA, 17 bp, Homo sapiens
cacaggacccagaaaaa

SEQ ID NO: 5380532 - DNA, 17 bp, Homo sapiens
cacaggacccccttccc

SEQ ID NO: 5380533 - DNA, 14 bp, Homo sapiens
cacaggactctgca

SEQ ID NO: 5380534 - DNA, 16 bp, Homo sapiens
cacaggactgaaaagg

SEQ ID NO: 5380535 - DNA, 14 bp, Homo sapiens
cacaggactgagcc

SEQ ID NO: 5380536 - DNA, 20 bp, Homo sapiens
cacaggactgagccctctca

SEQ ID NO: 5380537 - DNA, 22 bp, Homo sapiens
cacaggactgagccctctcact

SEQ ID NO: 5380538 - DNA, 22 bp, Homo sapiens
cacaggactttgatgaagacca

SEQ ID NO: 5380539 - DNA, 12 bp, Homo sapiens
cacaggagacca

SEQ ID NO: 5380540 - DNA, 19 bp, Homo sapiens
cacaggagactccaaggag

SEQ ID NO: 5380541 - DNA, 21 bp, Homo sapiens
cacaggagagcacccacagcc

SEQ ID NO: 5380542 - DNA, 22 bp, Homo sapiens
cacaggagagcacccacagccg

SEQ ID NO: 5380543 - DNA, 15 bp, Homo sapiens
cacaggagcagacag

SEQ ID NO: 5380544 - DNA, 16 bp, Homo sapiens
cacaggagcagacaga

SEQ ID NO: 5380545 - DNA, 20 bp, Homo sapiens
cacaggagcagacagagaaa

SEQ ID NO: 5380546 - DNA, 18 bp, Homo sapiens
cacaggagcatgtcctat

SEQ ID NO: 5380547 - DNA, 12 bp, Homo sapiens
cacaggagccgc

SEQ ID NO: 5380548 - DNA, 14 bp, Homo sapiens
cacaggagccgcag

SEQ ID NO: 5380549 - DNA, 20 bp, Homo sapiens
cacaggagccgcagaggccc

SEQ ID NO: 5380550 - DNA, 15 bp, Homo sapiens
cacaggagctacctg

SEQ ID NO: 5380551 - DNA, 16 bp, Homo sapiens
cacaggagctacctgt

SEQ ID NO: 5380552 - DNA, 16 bp, Homo sapiens
cacaggagctcccttt

SEQ ID NO: 5380553 - DNA, 22 bp, Homo sapiens
cacaggaggagaaatctcactt

SEQ ID NO: 5380554 - DNA, 20 bp, Homo sapiens
cacaggaggcaagcaagctc

SEQ ID NO: 5380555 - DNA, 19 bp, Homo sapiens
cacaggaggcaggcatggc

SEQ ID NO: 5380556 - DNA, 22 bp, Homo sapiens
cacaggaggctccgtgagccct

SEQ ID NO: 5380557 - DNA, 14 bp, Homo sapiens
cacaggagggaggg

SEQ ID NO: 5380558 - DNA, 19 bp, Homo sapiens
cacaggagggcggcctcct

SEQ ID NO: 5380559 - DNA, 12 bp, Homo sapiens
cacaggaggggg

SEQ ID NO: 5380560 - DNA, 19 bp, Homo sapiens
cacaggagtcttcagaccc

SEQ ID NO: 5380561 - DNA, 21 bp, Homo sapiens
cacaggagtcttcagacccag

SEQ ID NO: 5380562 - DNA, 22 bp, Homo sapiens
cacaggagtcttcagacccaga

SEQ ID NO: 5380563 - DNA, 18 bp, Homo sapiens
cacaggagtgggaaaaca

SEQ ID NO: 5380564 - DNA, 16 bp, Homo sapiens
cacaggataaagttat

SEQ ID NO: 5380565 - DNA, 14 bp, Homo sapiens
cacaggatagataa

SEQ ID NO: 5380566 - DNA, 19 bp, Homo sapiens
cacaggataggactccatt

SEQ ID NO: 5380567 - DNA, 23 bp, Homo sapiens
cacaggatattaaacgtgtaaat

SEQ ID NO: 5380568 - DNA, 16 bp, Homo sapiens
cacaggatcagtctga

SEQ ID NO: 5380569 - DNA, 20 bp, Homo sapiens
cacaggatcctattctcacc

SEQ ID NO: 5380570 - DNA, 16 bp, Homo sapiens
cacaggatcctggcct

SEQ ID NO: 5380571 - DNA, 17 bp, Homo sapiens
cacaggatgcatattaa

SEQ ID NO: 5380572 - DNA, 19 bp, Homo sapiens
cacaggatgcatattaaag

SEQ ID NO: 5380573 - DNA, 20 bp, Homo sapiens
cacaggatgcatattaaaga

SEQ ID NO: 5380574 - DNA, 16 bp, Homo sapiens
cacaggatgctggcct

SEQ ID NO: 5380575 - DNA, 17 bp, Homo sapiens
cacaggatgctgtgttg

SEQ ID NO: 5380576 - DNA, 20 bp, Homo sapiens
cacaggcaaaatccttgctt

SEQ ID NO: 5380577 - DNA, 19 bp, Homo sapiens
cacaggcaaagaggtgctg

SEQ ID NO: 5380578 - DNA, 18 bp, Homo sapiens
cacaggcaacattacaaa

SEQ ID NO: 5380579 - DNA, 17 bp, Homo sapiens
cacaggcaactgaggca

SEQ ID NO: 5380580 - DNA, 19 bp, Homo sapiens
cacaggcaactgaggcaga

SEQ ID NO: 5380581 - DNA, 21 bp, Homo sapiens
cacaggcaagtccaccccata

SEQ ID NO: 5380582 - DNA, 20 bp, Homo sapiens
cacaggcaatgactgcgcag

SEQ ID NO: 5380583 - DNA, 12 bp, Homo sapiens
cacaggcactga

SEQ ID NO: 5380584 - DNA, 15 bp, Homo sapiens
cacaggcagcattta

SEQ ID NO: 5380585 - DNA, 18 bp, Homo sapiens
cacaggcagccagccgtg

SEQ ID NO: 5380586 - DNA, 16 bp, Homo sapiens
cacaggcagccagtgc

SEQ ID NO: 5380587 - DNA, 20 bp, Homo sapiens
cacaggcagccagtgccctg

SEQ ID NO: 5380588 - DNA, 23 bp, Homo sapiens
cacaggcagccagtgccctgagc

SEQ ID NO: 5380589 - DNA, 11 bp, Homo sapiens
cacaggcagct

SEQ ID NO: 5380590 - DNA, 15 bp, Homo sapiens
cacaggcagctctga

SEQ ID NO: 5380591 - DNA, 17 bp, Homo sapiens
cacaggcagctctgagc

SEQ ID NO: 5380592 - DNA, 21 bp, Homo sapiens
cacaggcagctggatgagact

SEQ ID NO: 5380593 - DNA, 12 bp, Homo sapiens
cacaggcagctt

SEQ ID NO: 5380594 - DNA, 16 bp, Homo sapiens
cacaggcagctttcta

SEQ ID NO: 5380595 - DNA, 18 bp, Homo sapiens
cacaggcagctttctaga

SEQ ID NO: 5380596 - DNA, 17 bp, Homo sapiens
cacaggcaggaagagag

SEQ ID NO: 5380597 - DNA, 16 bp, Homo sapiens
cacaggcagggcctgg

SEQ ID NO: 5380598 - DNA, 19 bp, Homo sapiens
cacaggcagggcctggctc

SEQ ID NO: 5380599 - DNA, 16 bp, Homo sapiens
cacaggcaggggtaga

SEQ ID NO: 5380600 - DNA, 14 bp, Homo sapiens
cacaggcaggtcca

SEQ ID NO: 5380601 - DNA, 22 bp, Homo sapiens
cacaggcatattccctgcacac

SEQ ID NO: 5380602 - DNA, 23 bp, Homo sapiens
cacaggcatttcctgggtggcta

SEQ ID NO: 5380603 - DNA, 23 bp, Homo sapiens
cacaggccaaatccttggagtcc

SEQ ID NO: 5380604 - DNA, 15 bp, Homo sapiens
cacaggccacacgct

SEQ ID NO: 5380605 - DNA, 19 bp, Homo sapiens
cacaggccacacgctgccc

SEQ ID NO: 5380606 - DNA, 21 bp, Homo sapiens
cacaggccacacgctgcccag

SEQ ID NO: 5380607 - DNA, 23 bp, Homo sapiens
cacaggccaccctgtgcagaagg

SEQ ID NO: 5380608 - DNA, 17 bp, Homo sapiens
cacaggccacttgctca

SEQ ID NO: 5380609 - DNA, 11 bp, Homo sapiens
cacaggccagc

SEQ ID NO: 5380610 - DNA, 20 bp, Homo sapiens
cacaggccccccgcagcacc

SEQ ID NO: 5380611 - DNA, 21 bp, Homo sapiens
cacaggccccccgcagcaccc

SEQ ID NO: 5380612 - DNA, 20 bp, Homo sapiens
cacaggcccgccctctgcct

SEQ ID NO: 5380613 - DNA, 22 bp, Homo sapiens
cacaggcccgccctctgcctcc

SEQ ID NO: 5380614 - DNA, 19 bp, Homo sapiens
cacaggcccggctccaggc

SEQ ID NO: 5380615 - DNA, 23 bp, Homo sapiens
cacaggcccggctccaggctcct

SEQ ID NO: 5380616 - DNA, 13 bp, Homo sapiens
cacaggccctagc

SEQ ID NO: 5380617 - DNA, 14 bp, Homo sapiens
cacaggccctagct

SEQ ID NO: 5380618 - DNA, 15 bp, Homo sapiens
cacaggcccttcctc

SEQ ID NO: 5380619 - DNA, 22 bp, Homo sapiens
cacaggcccttcctctccactg

SEQ ID NO: 5380620 - DNA, 19 bp, Homo sapiens
cacaggccctttcctcagg

SEQ ID NO: 5380621 - DNA, 15 bp, Homo sapiens
cacaggccgtgggac

SEQ ID NO: 5380622 - DNA, 20 bp, Homo sapiens
cacaggccgtgggacccagg

SEQ ID NO: 5380623 - DNA, 11 bp, Homo sapiens
cacaggcctct

SEQ ID NO: 5380624 - DNA, 14 bp, Homo sapiens
cacaggcctctctt

SEQ ID NO: 5380625 - DNA, 20 bp, Homo sapiens
cacatggccatcttctttct

SEQ ID NO: 5380626 - DNA, 23 bp, Homo sapiens
cacatggccgggccctctgtagc

SEQ ID NO: 5380627 - DNA, 14 bp, Homo sapiens
cacatggcgtcctg

SEQ ID NO: 5380628 - DNA, 21 bp, Homo sapiens
cacatggctatcctagagagg

SEQ ID NO: 5380629 - DNA, 12 bp, Homo sapiens
cacatggcttcc

SEQ ID NO: 5380630 - DNA, 21 bp, Homo sapiens
cacatgggagcagtccatgca

SEQ ID NO: 5380631 - DNA, 14 bp, Homo sapiens
cacatgggctgggg

SEQ ID NO: 5380632 - DNA, 12 bp, Homo sapiens
cacatgggcttg

SEQ ID NO: 5380633 - DNA, 14 bp, Homo sapiens
cacatgggcttgtg

SEQ ID NO: 5380634 - DNA, 16 bp, Homo sapiens
cacatggggcctggcc

SEQ ID NO: 5380635 - DNA, 20 bp, Homo sapiens
cacatggggcctggcccacg

SEQ ID NO: 5380636 - DNA, 19 bp, Homo sapiens
cacatggggctgggcagct

SEQ ID NO: 5380637 - DNA, 18 bp, Homo sapiens
cacatgggtgaacactca

SEQ ID NO: 5380638 - DNA, 12 bp, Homo sapiens
cacatgggtgct

SEQ ID NO: 5380639 - DNA, 13 bp, Homo sapiens
cacatgggtgcta

SEQ ID NO: 5380640 - DNA, 20 bp, Homo sapiens
cacatggtcttcgtccttga

SEQ ID NO: 5380641 - DNA, 15 bp, Homo sapiens
cacatggtgatgttg

SEQ ID NO: 5380642 - DNA, 22 bp, Homo sapiens
cacatggtgctacgcctgcatg

SEQ ID NO: 5380643 - DNA, 15 bp, Homo sapiens
cacatggtgtctccc

SEQ ID NO: 5380644 - DNA, 16 bp, Homo sapiens
cacatggtgtctccca

SEQ ID NO: 5380645 - DNA, 21 bp, Homo sapiens
cacatggtgtctcccaacatg

SEQ ID NO: 5380646 - DNA, 15 bp, Homo sapiens
cacatggtgtggcca

SEQ ID NO: 5380647 - DNA, 16 bp, Homo sapiens
cacatggtgtggccat

SEQ ID NO: 5380648 - DNA, 17 bp, Homo sapiens
cacatggtgtggccatc

SEQ ID NO: 5380649 - DNA, 19 bp, Homo sapiens
cacatggttacatatcaaa

SEQ ID NO: 5380650 - DNA, 14 bp, Homo sapiens
cacatggttttcct

SEQ ID NO: 5380651 - DNA, 16 bp, Homo sapiens
cacatgtaaaatatgt

SEQ ID NO: 5380652 - DNA, 19 bp, Homo sapiens
cacatgtaacatagattta

SEQ ID NO: 5380653 - DNA, 20 bp, Homo sapiens
cacatgtacataaactgtca

SEQ ID NO: 5380654 - DNA, 21 bp, Homo sapiens
cacatgtacataaactgtcac

SEQ ID NO: 5380655 - DNA, 19 bp, Homo sapiens
cacatgtacatatggaaat

SEQ ID NO: 5380656 - DNA, 19 bp, Homo sapiens
cacatgtccaagaagccca

SEQ ID NO: 5380657 - DNA, 22 bp, Homo sapiens
cacatgtccaagaagcccagga

SEQ ID NO: 5380658 - DNA, 19 bp, Homo sapiens
cacatgtctgtcctcagag

SEQ ID NO: 5380659 - DNA, 12 bp, Homo sapiens
cacatgtcttaa

SEQ ID NO: 5380660 - DNA, 17 bp, Homo sapiens
cacatgtcttaatgaag

SEQ ID NO: 5380661 - DNA, 15 bp, Homo sapiens
cacatgtcttgtaca

SEQ ID NO: 5380662 - DNA, 13 bp, Homo sapiens
cacatgtgaaaac

SEQ ID NO: 5380663 - DNA, 15 bp, Homo sapiens
cacatgtgcacatgc

SEQ ID NO: 5380664 - DNA, 13 bp, Homo sapiens
cacatgtgccctg

SEQ ID NO: 5380665 - DNA, 14 bp, Homo sapiens
cacatgtgccctgc

SEQ ID NO: 5380666 - DNA, 14 bp, Homo sapiens
cacatgtgctgatg

SEQ ID NO: 5380667 - DNA, 13 bp, Homo sapiens
cacatgtggactt

SEQ ID NO: 5380668 - DNA, 21 bp, Homo sapiens
cacatgtgttatctacctcaa

SEQ ID NO: 5380669 - DNA, 23 bp, Homo sapiens
cacatgtgttctctattttgcct

SEQ ID NO: 5380670 - DNA, 12 bp, Homo sapiens
cacatgttactg

SEQ ID NO: 5380671 - DNA, 17 bp, Homo sapiens
cacatgttgatttccta

SEQ ID NO: 5380672 - DNA, 15 bp, Homo sapiens
cacatgttggaggag

SEQ ID NO: 5380673 - DNA, 23 bp, Homo sapiens
cacatgttggaggagagagcctt

SEQ ID NO: 5380674 - DNA, 15 bp, Homo sapiens
cacatgtttcctcta

SEQ ID NO: 5380675 - DNA, 13 bp, Homo sapiens
cacatgttttaca

SEQ ID NO: 5380676 - DNA, 12 bp, Homo sapiens
cacatgttttca

SEQ ID NO: 5380677 - DNA, 14 bp, Homo sapiens
cacatgttttcaaa

SEQ ID NO: 5380678 - DNA, 13 bp, Homo sapiens
cacattaaaaaat

SEQ ID NO: 5380679 - DNA, 13 bp, Homo sapiens
cacattaaagtaa

SEQ ID NO: 5380680 - DNA, 17 bp, Homo sapiens
cacattaacattttgag

SEQ ID NO: 5380681 - DNA, 14 bp, Homo sapiens
cacattaactccct

SEQ ID NO: 5380682 - DNA, 15 bp, Homo sapiens
cacattaactgttgc

SEQ ID NO: 5380683 - DNA, 16 bp, Homo sapiens
cacattaactgttgca

SEQ ID NO: 5380684 - DNA, 18 bp, Homo sapiens
cacattaatcagattagc

SEQ ID NO: 5380685 - DNA, 17 bp, Homo sapiens
cacattaattagatttt

SEQ ID NO: 5380686 - DNA, 22 bp, Homo sapiens
cacattaattagattttcttgc

SEQ ID NO: 5380687 - DNA, 16 bp, Homo sapiens
cacattacagccaggt

SEQ ID NO: 5380688 - DNA, 17 bp, Homo sapiens
cacattagataaattac

SEQ ID NO: 5380689 - DNA, 19 bp, Homo sapiens
cacattagataaattacta

SEQ ID NO: 5380690 - DNA, 21 bp, Homo sapiens
cacattaggaaaagttgctat

SEQ ID NO: 5380691 - DNA, 21 bp, Homo sapiens
cacattaggaacagagtatat

SEQ ID NO: 5380692 - DNA, 22 bp, Homo sapiens
cacattaggctgtgtcaccatt

SEQ ID NO: 5380693 - DNA, 16 bp, Homo sapiens
cacattatccctctgg

SEQ ID NO: 5380694 - DNA, 18 bp, Homo sapiens
cacattatgttagagagg

SEQ ID NO: 5380695 - DNA, 14 bp, Homo sapiens
cacattcaggaaga

SEQ ID NO: 5380696 - DNA, 12 bp, Homo sapiens
cacattcaggga

SEQ ID NO: 5380697 - DNA, 19 bp, Homo sapiens
cacattcatcctcacatgt

SEQ ID NO: 5380698 - DNA, 18 bp, Homo sapiens
cacattcatgtacaatga

SEQ ID NO: 5380699 - DNA, 16 bp, Homo sapiens
cacattccacatctgt

SEQ ID NO: 5380700 - DNA, 12 bp, Homo sapiens
cacattccagcc

SEQ ID NO: 5380701 - DNA, 14 bp, Homo sapiens
cacattccagccag

SEQ ID NO: 5380702 - DNA, 16 bp, Homo sapiens
cacattccagccaggc

SEQ ID NO: 5380703 - DNA, 18 bp, Homo sapiens
cacattccagggctgggg

SEQ ID NO: 5380704 - DNA, 24 bp, Homo sapiens
cacattccatttgttgagccccag

SEQ ID NO: 5380705 - DNA, 22 bp, Homo sapiens
cacattcccccaccagctgcag

SEQ ID NO: 5380706 - DNA, 17 bp, Homo sapiens
cacattccctctcatcc

SEQ ID NO: 5380707 - DNA, 13 bp, Homo sapiens
cacattcctggcc

SEQ ID NO: 5380708 - DNA, 15 bp, Homo sapiens
cacattcctggcccc

SEQ ID NO: 5380709 - DNA, 23 bp, Homo sapiens
cacattcctggccccgggctctg

SEQ ID NO: 5380710 - DNA, 12 bp, Homo sapiens
cacattcctttg

SEQ ID NO: 5380711 - DNA, 19 bp, Homo sapiens
cacattcgacataccccac

SEQ ID NO: 5380712 - DNA, 16 bp, Homo sapiens
cacattcggctccctg

SEQ ID NO: 5380713 - DNA, 17 bp, Homo sapiens
cacattcggctccctgg

SEQ ID NO: 5380714 - DNA, 21 bp, Homo sapiens
cacattcggctccctggagcc

SEQ ID NO: 5380715 - DNA, 12 bp, Homo sapiens
cacattctactt

SEQ ID NO: 5380716 - DNA, 18 bp, Homo sapiens
cacattctatagccataa

SEQ ID NO: 5380717 - DNA, 12 bp, Homo sapiens
cacattctcaca

SEQ ID NO: 5380718 - DNA, 13 bp, Homo sapiens
cacattctccctt

SEQ ID NO: 5380719 - DNA, 17 bp, Homo sapiens
cacattctcctgtgccc

SEQ ID NO: 5380720 - DNA, 16 bp, Homo sapiens
cacattctcttcccag

SEQ ID NO: 5380721 - DNA, 11 bp, Homo sapiens
cacattctgct

SEQ ID NO: 5380722 - DNA, 13 bp, Homo sapiens
cacattctggctc

SEQ ID NO: 5380723 - DNA, 17 bp, Homo sapiens
cacattctggctccacc

SEQ ID NO: 5380724 - DNA, 15 bp, Homo sapiens
cacattctgtctctg

SEQ ID NO: 5380725 - DNA, 15 bp, Homo sapiens
cacattcttataaat

SEQ ID NO: 5380726 - DNA, 17 bp, Homo sapiens
cacattcttataaatat

SEQ ID NO: 5380727 - DNA, 18 bp, Homo sapiens
cacattcttataaatatg

SEQ ID NO: 5380728 - DNA, 19 bp, Homo sapiens
cacattcttataaatatga

SEQ ID NO: 5380729 - DNA, 23 bp, Homo sapiens
cacattcttataaatatgaagct

SEQ ID NO: 5380730 - DNA, 17 bp, Homo sapiens
cacattctttataaaat

SEQ ID NO: 5380731 - DNA, 15 bp, Homo sapiens
cacattgaaactgta

SEQ ID NO: 5380732 - DNA, 18 bp, Homo sapiens
cacattgaaactgtattt

SEQ ID NO: 5380733 - DNA, 19 bp, Homo sapiens
cacattgaaactgtattta

SEQ ID NO: 5380734 - DNA, 22 bp, Homo sapiens
cacattgagctgatataaattc

SEQ ID NO: 5380735 - DNA, 23 bp, Homo sapiens
cacattgagctgatataaattct

SEQ ID NO: 5380736 - DNA, 22 bp, Homo sapiens
cacattgagtttaagtctctga

SEQ ID NO: 5380737 - DNA, 22 bp, Homo sapiens
cacattgataaaagcattgttt

SEQ ID NO: 5380738 - DNA, 23 bp, Homo sapiens
cacattgatgtaaggactgtaaa

SEQ ID NO: 5380739 - DNA, 13 bp, Homo sapiens
cacattgcacaca

SEQ ID NO: 5380740 - DNA, 14 bp, Homo sapiens
cacattgcattcta

SEQ ID NO: 5380741 - DNA, 19 bp, Homo sapiens
cacattgcattctattgcc

SEQ ID NO: 5380742 - DNA, 17 bp, Homo sapiens
cacattgcccacacctg

SEQ ID NO: 5380743 - DNA, 17 bp, Homo sapiens
cacattgcccatggctg

SEQ ID NO: 5380744 - DNA, 17 bp, Homo sapiens
cacattgccccatgaga

SEQ ID NO: 5380745 - DNA, 19 bp, Homo sapiens
cacattgcccctctgcctt

SEQ ID NO: 5380746 - DNA, 16 bp, Homo sapiens
cacattgccctgaggg

SEQ ID NO: 5380747 - DNA, 16 bp, Homo sapiens
cacattgcctgttctg

SEQ ID NO: 5380748 - DNA, 18 bp, Homo sapiens
cacattgcctgttctgct

SEQ ID NO: 5380749 - DNA, 14 bp, Homo sapiens
cacattgctggctg

SEQ ID NO: 5380750 - DNA, 17 bp, Homo sapiens
cacattgcttcattaaa

SEQ ID NO: 5380751 - DNA, 17 bp, Homo sapiens
cacattggaaacaagtc

SEQ ID NO: 5380752 - DNA, 21 bp, Homo sapiens
cacattggaagagcagcacct

SEQ ID NO: 5380753 - DNA, 17 bp, Homo sapiens
cacattggaatgccttg

SEQ ID NO: 5380754 - DNA, 19 bp, Homo sapiens
cacattggcaagtgtaaaa

SEQ ID NO: 5380755 - DNA, 18 bp, Homo sapiens
cacattgggcagcgccct

SEQ ID NO: 5380756 - DNA, 20 bp, Homo sapiens
cacattgggtctctggtcct

SEQ ID NO: 5380757 - DNA, 22 bp, Homo sapiens
cacattgggtggggctcctggg

SEQ ID NO: 5380758 - DNA, 20 bp, Homo sapiens
cacattggtgttgtactcaa

SEQ ID NO: 5380759 - DNA, 23 bp, Homo sapiens
cacattgtgaatattagattgct

SEQ ID NO: 5380760 - DNA, 18 bp, Homo sapiens
cacattgtgcttggcccc

SEQ ID NO: 5380761 - DNA, 23 bp, Homo sapiens
cacattgtgtgaatactggaagc

SEQ ID NO: 5380762 - DNA, 17 bp, Homo sapiens
cacattgttcaactccc

SEQ ID NO: 5380763 - DNA, 18 bp, Homo sapiens
cacattgttcaactccct

SEQ ID NO: 5380764 - DNA, 21 bp, Homo sapiens
cacattgttgtttttttaata

SEQ ID NO: 5380765 - DNA, 19 bp, Homo sapiens
cacattgtttgctgctatt

SEQ ID NO: 5380766 - DNA, 12 bp, Homo sapiens
cacattgtttta

SEQ ID NO: 5380767 - DNA, 23 bp, Homo sapiens
cacattgttttaaaaagaaacaa

SEQ ID NO: 5380768 - DNA, 21 bp, Homo sapiens
cacatttaaaaataaatgtaa

SEQ ID NO: 5380769 - DNA, 17 bp, Homo sapiens
cacatttaaaacatttg

SEQ ID NO: 5380770 - DNA, 19 bp, Homo sapiens
cacatttaagagacagtca

SEQ ID NO: 5380771 - DNA, 17 bp, Homo sapiens
cacatttaatgaacaca

SEQ ID NO: 5380772 - DNA, 14 bp, Homo sapiens
cacatttactagct

SEQ ID NO: 5380773 - DNA, 16 bp, Homo sapiens
cacatttagaaatgtt

SEQ ID NO: 5380774 - DNA, 19 bp, Homo sapiens
cacatttagtccaatgaag

SEQ ID NO: 5380775 - DNA, 15 bp, Homo sapiens
cacatttcacctcct

SEQ ID NO: 5380776 - DNA, 12 bp, Homo sapiens
cacatttcactt

SEQ ID NO: 5380777 - DNA, 19 bp, Homo sapiens
cacatttcagggagaaact

SEQ ID NO: 5380778 - DNA, 17 bp, Homo sapiens
cacatttcatctaattt

SEQ ID NO: 5380779 - DNA, 17 bp, Homo sapiens
cacatttccctatttta

SEQ ID NO: 5380780 - DNA, 21 bp, Homo sapiens
cacatttcctctgttcttttc

SEQ ID NO: 5380781 - DNA, 17 bp, Homo sapiens
cacatttctaaaatctt

SEQ ID NO: 5380782 - DNA, 17 bp, Homo sapiens
cacatttctgatcagag

SEQ ID NO: 5380783 - DNA, 18 bp, Homo sapiens
cacatttctgatcagagg

SEQ ID NO: 5380784 - DNA, 16 bp, Homo sapiens
cacatttcttaaaaca

SEQ ID NO: 5380785 - DNA, 20 bp, Homo sapiens
cacatttcttaaaacacatg

SEQ ID NO: 5380786 - DNA, 13 bp, Homo sapiens
cacatttcttttt

SEQ ID NO: 5380787 - DNA, 21 bp, Homo sapiens
cacatttctttttaaaaaaag

SEQ ID NO: 5380788 - DNA, 14 bp, Homo sapiens
cacatttgaattct

SEQ ID NO: 5380789 - DNA, 14 bp, Homo sapiens
cacatttgatgtac

SEQ ID NO: 5380790 - DNA, 16 bp, Homo sapiens
cacatttgatgtacat

SEQ ID NO: 5380791 - DNA, 19 bp, Homo sapiens
cacatttggcttacagtaa

SEQ ID NO: 5380792 - DNA, 11 bp, Homo sapiens
cacatttgtac

SEQ ID NO: 5380793 - DNA, 12 bp, Homo sapiens
cacatttgtaca

SEQ ID NO: 5380794 - DNA, 17 bp, Homo sapiens
cacatttgtcttctttc

SEQ ID NO: 5380795 - DNA, 12 bp, Homo sapiens
cacatttgttaa

SEQ ID NO: 5380796 - DNA, 22 bp, Homo sapiens
cacatttgttcatgagtggatg

SEQ ID NO: 5380797 - DNA, 14 bp, Homo sapiens
cacatttgttgcac

SEQ ID NO: 5380798 - DNA, 13 bp, Homo sapiens
cacattttaacag

SEQ ID NO: 5380799 - DNA, 21 bp, Homo sapiens
cacattttagaataccccacc

SEQ ID NO: 5380800 - DNA, 18 bp, Homo sapiens
cacattttagtccagaga

SEQ ID NO: 5380801 - DNA, 13 bp, Homo sapiens
cacattttatgag

SEQ ID NO: 5380802 - DNA, 15 bp, Homo sapiens
cacattttatgagag

SEQ ID NO: 5380803 - DNA, 21 bp, Homo sapiens
cacattttattttattatgca

SEQ ID NO: 5380804 - DNA, 13 bp, Homo sapiens
caccagctggggt

SEQ ID NO: 5380805 - DNA, 17 bp, Homo sapiens
caccagctggtatattg

SEQ ID NO: 5380806 - DNA, 13 bp, Homo sapiens
caccagcttcact

SEQ ID NO: 5380807 - DNA, 13 bp, Homo sapiens
caccagcttcttt

SEQ ID NO: 5380808 - DNA, 14 bp, Homo sapiens
caccagctttattt

SEQ ID NO: 5380809 - DNA, 23 bp, Homo sapiens
caccaggaagaaggcccgggagg

SEQ ID NO: 5380810 - DNA, 18 bp, Homo sapiens
caccaggaagtgtttatg

SEQ ID NO: 5380811 - DNA, 12 bp, Homo sapiens
caccaggaatgt

SEQ ID NO: 5380812 - DNA, 16 bp, Homo sapiens
caccaggactagggct

SEQ ID NO: 5380813 - DNA, 16 bp, Homo sapiens
caccaggactggctgt

SEQ ID NO: 5380814 - DNA, 21 bp, Homo sapiens
caccaggacttaagacaaatg

SEQ ID NO: 5380815 - DNA, 16 bp, Homo sapiens
caccaggagaaccact

SEQ ID NO: 5380816 - DNA, 15 bp, Homo sapiens
caccaggagcacctg

SEQ ID NO: 5380817 - DNA, 16 bp, Homo sapiens
caccaggagcagcagc

SEQ ID NO: 5380818 - DNA, 22 bp, Homo sapiens
caccaggatagagactggaaca

SEQ ID NO: 5380819 - DNA, 11 bp, Homo sapiens
caccaggatga

SEQ ID NO: 5380820 - DNA, 21 bp, Homo sapiens
caccaggatggcccttcccac

SEQ ID NO: 5380821 - DNA, 22 bp, Homo sapiens
caccaggcacctcacagaaatg

SEQ ID NO: 5380822 - DNA, 22 bp, Homo sapiens
caccaggcacgaacccacctgc

SEQ ID NO: 5380823 - DNA, 16 bp, Homo sapiens
caccaggcagctccag

SEQ ID NO: 5380824 - DNA, 17 bp, Homo sapiens
caccaggcagctccagc

SEQ ID NO: 5380825 - DNA, 13 bp, Homo sapiens
caccaggccacct

SEQ ID NO: 5380826 - DNA, 14 bp, Homo sapiens
caccaggccacctc

SEQ ID NO: 5380827 - DNA, 17 bp, Homo sapiens
caccaggccagctcagg

SEQ ID NO: 5380828 - DNA, 18 bp, Homo sapiens
caccaggcccacgaggag

SEQ ID NO: 5380829 - DNA, 16 bp, Homo sapiens
caccaggcccccctgt

SEQ ID NO: 5380830 - DNA, 16 bp, Homo sapiens
caccaggccgtcctcc

SEQ ID NO: 5380831 - DNA, 17 bp, Homo sapiens
caccaggccgtgccttg

SEQ ID NO: 5380832 - DNA, 18 bp, Homo sapiens
caccaggcctcactggct

SEQ ID NO: 5380833 - DNA, 15 bp, Homo sapiens
caccaggcctggcct

SEQ ID NO: 5380834 - DNA, 17 bp, Homo sapiens
caccaggcctggcctct

SEQ ID NO: 5380835 - DNA, 18 bp, Homo sapiens
caccaggcctggcctctg

SEQ ID NO: 5380836 - DNA, 23 bp, Homo sapiens
caccaggcgctaattcaaggaat

SEQ ID NO: 5380837 - DNA, 15 bp, Homo sapiens
caccaggcgctgccc

SEQ ID NO: 5380838 - DNA, 19 bp, Homo sapiens
caccaggctggagtgcagt

SEQ ID NO: 5380839 - DNA, 22 bp, Homo sapiens
caccaggctggcgcagccaagg

SEQ ID NO: 5380840 - DNA, 18 bp, Homo sapiens
caccaggctgtgggcctc

SEQ ID NO: 5380841 - DNA, 22 bp, Homo sapiens
caccagggaccagcccagcctg

SEQ ID NO: 5380842 - DNA, 21 bp, Homo sapiens
caccagggactcggcccaggg

SEQ ID NO: 5380843 - DNA, 14 bp, Homo sapiens
caccagggactgca

SEQ ID NO: 5380844 - DNA, 15 bp, Homo sapiens
caccagggactgcag

SEQ ID NO: 5380845 - DNA, 20 bp, Homo sapiens
caccagggatcacagaccac

SEQ ID NO: 5380846 - DNA, 24 bp, Homo sapiens
caccagggatcacagaccacagga

SEQ ID NO: 5380847 - DNA, 21 bp, Homo sapiens
caccagggcaactcttggaag

SEQ ID NO: 5380848 - DNA, 17 bp, Homo sapiens
caccagggcactgtctg

SEQ ID NO: 5380849 - DNA, 22 bp, Homo sapiens
caccagggcatctctgggctgg

SEQ ID NO: 5380850 - DNA, 23 bp, Homo sapiens
caccagggcattcgggccacagg

SEQ ID NO: 5380851 - DNA, 15 bp, Homo sapiens
caccagggccagagc

SEQ ID NO: 5380852 - DNA, 18 bp, Homo sapiens
caccagggccagagcagc

SEQ ID NO: 5380853 - DNA, 22 bp, Homo sapiens
caccagggccagagcagctcca

SEQ ID NO: 5380854 - DNA, 22 bp, Homo sapiens
caccagggccagcaggcagcgc

SEQ ID NO: 5380855 - DNA, 16 bp, Homo sapiens
caccagggccagcctc

SEQ ID NO: 5380856 - DNA, 22 bp, Homo sapiens
caccagggcgctgggaaggggt

SEQ ID NO: 5380857 - DNA, 16 bp, Homo sapiens
caccagggctccagga

SEQ ID NO: 5380858 - DNA, 20 bp, Homo sapiens
caccagggctccaggagcct

SEQ ID NO: 5380859 - DNA, 23 bp, Homo sapiens
caccagggctccaggagcctcat

SEQ ID NO: 5380860 - DNA, 14 bp, Homo sapiens
caccaggggaagga

SEQ ID NO: 5380861 - DNA, 15 bp, Homo sapiens
caccaggggaggagc

SEQ ID NO: 5380862 - DNA, 16 bp, Homo sapiens
caccaggggcaggcac

SEQ ID NO: 5380863 - DNA, 16 bp, Homo sapiens
caccagggggcgcgct

SEQ ID NO: 5380864 - DNA, 19 bp, Homo sapiens
caccaggggtgctcacctc

SEQ ID NO: 5380865 - DNA, 15 bp, Homo sapiens
caccaggggtttctc

SEQ ID NO: 5380866 - DNA, 18 bp, Homo sapiens
caccagggtcccaggaag

SEQ ID NO: 5380867 - DNA, 19 bp, Homo sapiens
caccagggtcccaggaagc

SEQ ID NO: 5380868 - DNA, 20 bp, Homo sapiens
caccagggtccgcaccagct

SEQ ID NO: 5380869 - DNA, 22 bp, Homo sapiens
caccagggtccttttgacactg

SEQ ID NO: 5380870 - DNA, 16 bp, Homo sapiens
caccagggtggaccag

SEQ ID NO: 5380871 - DNA, 18 bp, Homo sapiens
caccagggtggaccaggc

SEQ ID NO: 5380872 - DNA, 21 bp, Homo sapiens
caccagggtggaccaggcctg

SEQ ID NO: 5380873 - DNA, 22 bp, Homo sapiens
caccagggttgaccccagagga

SEQ ID NO: 5380874 - DNA, 17 bp, Homo sapiens
caccaggtcactctgac

SEQ ID NO: 5380875 - DNA, 15 bp, Homo sapiens
caccaggtgtcagga

SEQ ID NO: 5380876 - DNA, 22 bp, Homo sapiens
caccagtaataaaaagccacca

SEQ ID NO: 5380877 - DNA, 23 bp, Homo sapiens
caccagtaataaaaagccaccac

SEQ ID NO: 5380878 - DNA, 13 bp, Homo sapiens
caccagtacattc

SEQ ID NO: 5380879 - DNA, 21 bp, Homo sapiens
caccagtacattctcagtttt

SEQ ID NO: 5380880 - DNA, 22 bp, Homo sapiens
caccagtacattctcagttttt

SEQ ID NO: 5380881 - DNA, 16 bp, Homo sapiens
caccagtcacatgacc

SEQ ID NO: 5380882 - DNA, 17 bp, Homo sapiens
caccagtcactgtccct

SEQ ID NO: 5380883 - DNA, 18 bp, Homo sapiens
caccagtccacgccgggt

SEQ ID NO: 5380884 - DNA, 14 bp, Homo sapiens
caccagtccagcaa

SEQ ID NO: 5380885 - DNA, 17 bp, Homo sapiens
caccagtccagcaaata

SEQ ID NO: 5380886 - DNA, 23 bp, Homo sapiens
caccagtcccatgctggctgaag

SEQ ID NO: 5380887 - DNA, 14 bp, Homo sapiens
caccagtccctgtc

SEQ ID NO: 5380888 - DNA, 20 bp, Homo sapiens
caccagtccctgtccggaat

SEQ ID NO: 5380889 - DNA, 21 bp, Homo sapiens
caccagtctagtccgtcctgg

SEQ ID NO: 5380890 - DNA, 16 bp, Homo sapiens
caccagtctgtctact

SEQ ID NO: 5380891 - DNA, 20 bp, Homo sapiens
caccagtctgtctactgtgg

SEQ ID NO: 5380892 - DNA, 16 bp, Homo sapiens
caccagtgaaagaagc

SEQ ID NO: 5380893 - DNA, 22 bp, Homo sapiens
caccagtgaatgaaagtcttgt

SEQ ID NO: 5380894 - DNA, 18 bp, Homo sapiens
caccagtgcatcacatct

SEQ ID NO: 5380895 - DNA, 15 bp, Homo sapiens
caccagtgccgcctg

SEQ ID NO: 5380896 - DNA, 16 bp, Homo sapiens
caccagtgccgcctgt

SEQ ID NO: 5380897 - DNA, 19 bp, Homo sapiens
caccagtgccgcctgtgcc

SEQ ID NO: 5380898 - DNA, 14 bp, Homo sapiens
caccagtgcctctc

SEQ ID NO: 5380899 - DNA, 12 bp, Homo sapiens
caccagtgcctt

SEQ ID NO: 5380900 - DNA, 17 bp, Homo sapiens
caccagtggacctagcc

SEQ ID NO: 5380901 - DNA, 22 bp, Homo sapiens
caccagtggacctagcctggat

SEQ ID NO: 5380902 - DNA, 17 bp, Homo sapiens
caccagtggcctcgtgg

SEQ ID NO: 5380903 - DNA, 22 bp, Homo sapiens
caccagtggcctttcagtgtag

SEQ ID NO: 5380904 - DNA, 15 bp, Homo sapiens
caccagtgtagcatc

SEQ ID NO: 5380905 - DNA, 20 bp, Homo sapiens
caccagtgtagcatcttcct

SEQ ID NO: 5380906 - DNA, 13 bp, Homo sapiens
caccagtgtcccc

SEQ ID NO: 5380907 - DNA, 22 bp, Homo sapiens
caccagtgtcctccaagtgccc

SEQ ID NO: 5380908 - DNA, 18 bp, Homo sapiens
caccagtgtggggttctg

SEQ ID NO: 5380909 - DNA, 21 bp, Homo sapiens
caccagtgtgtggctttcaga

SEQ ID NO: 5380910 - DNA, 23 bp, Homo sapiens
caccagtgtgtggctttcagagc

SEQ ID NO: 5380911 - DNA, 21 bp, Homo sapiens
caccagtgtgtgggggagatt

SEQ ID NO: 5380912 - DNA, 17 bp, Homo sapiens
caccagtgttcctgaag

SEQ ID NO: 5380913 - DNA, 19 bp, Homo sapiens
caccagtgttcctgaagct

SEQ ID NO: 5380914 - DNA, 19 bp, Homo sapiens
caccagttaaaagcatttt

SEQ ID NO: 5380915 - DNA, 22 bp, Homo sapiens
caccagttaaaagcattttaat

SEQ ID NO: 5380916 - DNA, 16 bp, Homo sapiens
caccagttatgtttga

SEQ ID NO: 5380917 - DNA, 23 bp, Homo sapiens
caccagttgaactgcaggaagag

SEQ ID NO: 5380918 - DNA, 21 bp, Homo sapiens
caccagtttatacagaactca

SEQ ID NO: 5380919 - DNA, 14 bp, Homo sapiens
caccataacctctg

SEQ ID NO: 5380920 - DNA, 15 bp, Homo sapiens
caccataacctctgg

SEQ ID NO: 5380921 - DNA, 16 bp, Homo sapiens
caccataagctactgc

SEQ ID NO: 5380922 - DNA, 16 bp, Homo sapiens
caccataatgaacaat

SEQ ID NO: 5380923 - DNA, 18 bp, Homo sapiens
caccatactccttgcttc

SEQ ID NO: 5380924 - DNA, 21 bp, Homo sapiens
caccatagtgtcacagagagc

SEQ ID NO: 5380925 - DNA, 15 bp, Homo sapiens
caccatatgaattgt

SEQ ID NO: 5380926 - DNA, 18 bp, Homo sapiens
caccatatgaattgtaca

SEQ ID NO: 5380927 - DNA, 17 bp, Homo sapiens
caccatatttgaattgg

SEQ ID NO: 5380928 - DNA, 18 bp, Homo sapiens
caccatatttgaattggc

SEQ ID NO: 5380929 - DNA, 24 bp, Homo sapiens
caccatcaagccaccaacatactc

SEQ ID NO: 5380930 - DNA, 14 bp, Homo sapiens
caccatcacacatg

SEQ ID NO: 5380931 - DNA, 15 bp, Homo sapiens
caccatcacacatgc

SEQ ID NO: 5380932 - DNA, 22 bp, Homo sapiens
caccatcacagcttgttttgga

SEQ ID NO: 5380933 - DNA, 18 bp, Homo sapiens
caccatcaccacgcagag

SEQ ID NO: 5380934 - DNA, 17 bp, Homo sapiens
caccatcaccctctggg

SEQ ID NO: 5380935 - DNA, 17 bp, Homo sapiens
caccatcactcactcac

SEQ ID NO: 5380936 - DNA, 20 bp, Homo sapiens
caccatcactcactcactcc

SEQ ID NO: 5380937 - DNA, 14 bp, Homo sapiens
caccatcagcctgt

SEQ ID NO: 5380938 - DNA, 15 bp, Homo sapiens
caccatcatgtctgg

SEQ ID NO: 5380939 - DNA, 17 bp, Homo sapiens
caccatcatgtctggct

SEQ ID NO: 5380940 - DNA, 15 bp, Homo sapiens
caccatccaataaaa

SEQ ID NO: 5380941 - DNA, 17 bp, Homo sapiens
caccatccaccctgcag

SEQ ID NO: 5380942 - DNA, 22 bp, Homo sapiens
caccatccagtgggcccggaga

SEQ ID NO: 5380943 - DNA, 17 bp, Homo sapiens
caccatcccctcctagc

SEQ ID NO: 5380944 - DNA, 22 bp, Homo sapiens
caccatcccctcctagcacaag

SEQ ID NO: 5380945 - DNA, 14 bp, Homo sapiens
caccatccctgatg

SEQ ID NO: 5380946 - DNA, 16 bp, Homo sapiens
caccatccctttttga

SEQ ID NO: 5380947 - DNA, 19 bp, Homo sapiens
caccatccctttttgaagt

SEQ ID NO: 5380948 - DNA, 24 bp, Homo sapiens
caccatcctcagaggctgagccct

SEQ ID NO: 5380949 - DNA, 12 bp, Homo sapiens
caccatcctgag

SEQ ID NO: 5380950 - DNA, 16 bp, Homo sapiens
caccatcctgagccag

SEQ ID NO: 5380951 - DNA, 13 bp, Homo sapiens
caccatccttcca

SEQ ID NO: 5380952 - DNA, 17 bp, Homo sapiens
caccatccttccatcct

SEQ ID NO: 5380953 - DNA, 18 bp, Homo sapiens
caccatccttccatcctg

SEQ ID NO: 5380954 - DNA, 21 bp, Homo sapiens
caccatccttccatcctgagg

SEQ ID NO: 5380955 - DNA, 19 bp, Homo sapiens
caccatcctttactattaa

SEQ ID NO: 5380956 - DNA, 15 bp, Homo sapiens
caccatcgtgtttgc

SEQ ID NO: 5380957 - DNA, 22 bp, Homo sapiens
caccatctcaggccacctgccc

SEQ ID NO: 5380958 - DNA, 10 bp, Homo sapiens
caccatctct

SEQ ID NO: 5380959 - DNA, 18 bp, Homo sapiens
caccatctgccaatgcca

SEQ ID NO: 5380960 - DNA, 20 bp, Homo sapiens
caccatctgccaatgccatg

SEQ ID NO: 5380961 - DNA, 19 bp, Homo sapiens
caccatctgctgtcttttc

SEQ ID NO: 5380962 - DNA, 21 bp, Homo sapiens
caccatctggagtcttcctgt

SEQ ID NO: 5380963 - DNA, 16 bp, Homo sapiens
caccatctggcccagg

SEQ ID NO: 5380964 - DNA, 17 bp, Homo sapiens
caccatctggcccaggc

SEQ ID NO: 5380965 - DNA, 18 bp, Homo sapiens
caccatctggcccaggct

SEQ ID NO: 5380966 - DNA, 16 bp, Homo sapiens
caccatcttacagaga

SEQ ID NO: 5380967 - DNA, 14 bp, Homo sapiens
caccatcttcagtg

SEQ ID NO: 5380968 - DNA, 14 bp, Homo sapiens
caccatctttgcag

SEQ ID NO: 5380969 - DNA, 16 bp, Homo sapiens
caccatctttgtcaaa

SEQ ID NO: 5380970 - DNA, 19 bp, Homo sapiens
caccatgacttgaggcaca

SEQ ID NO: 5380971 - DNA, 15 bp, Homo sapiens
caccatgattccttt

SEQ ID NO: 5380972 - DNA, 17 bp, Homo sapiens
caccatgattcctttaa

SEQ ID NO: 5380973 - DNA, 20 bp, Homo sapiens
caccatgcaaatgtcttcca

SEQ ID NO: 5380974 - DNA, 21 bp, Homo sapiens
caccatgcaaatgtcttccag

SEQ ID NO: 5380975 - DNA, 11 bp, Homo sapiens
caccatgcaag

SEQ ID NO: 5380976 - DNA, 12 bp, Homo sapiens
caccatgcaagg

SEQ ID NO: 5380977 - DNA, 23 bp, Homo sapiens
caccatgcactgtaaatatccct

SEQ ID NO: 5380978 - DNA, 16 bp, Homo sapiens
caccatgcagcccctg

SEQ ID NO: 5380979 - DNA, 17 bp, Homo sapiens
caccatgcagcccctgg

SEQ ID NO: 5380980 - DNA, 22 bp, Homo sapiens
caccccagctgctcccctccct

SEQ ID NO: 5380981 - DNA, 20 bp, Homo sapiens
caccccaggacgccactcat

SEQ ID NO: 5380982 - DNA, 13 bp, Homo sapiens
caccccaggactc

SEQ ID NO: 5380983 - DNA, 22 bp, Homo sapiens
caccccaggcagctcctgtttg

SEQ ID NO: 5380984 - DNA, 18 bp, Homo sapiens
caccccaggcccttcagg

SEQ ID NO: 5380985 - DNA, 11 bp, Homo sapiens
caccccaggct

SEQ ID NO: 5380986 - DNA, 13 bp, Homo sapiens
caccccaggctgg

SEQ ID NO: 5380987 - DNA, 18 bp, Homo sapiens
caccccagggcagccagg

SEQ ID NO: 5380988 - DNA, 19 bp, Homo sapiens
caccccagggcagccaggg

SEQ ID NO: 5380989 - DNA, 22 bp, Homo sapiens
caccccagggcagccagggaga

SEQ ID NO: 5380990 - DNA, 15 bp, Homo sapiens
caccccagggcctga

SEQ ID NO: 5380991 - DNA, 17 bp, Homo sapiens
caccccagggcctgagc

SEQ ID NO: 5380992 - DNA, 11 bp, Homo sapiens
caccccagggt

SEQ ID NO: 5380993 - DNA, 15 bp, Homo sapiens
caccccagtgcctgt

SEQ ID NO: 5380994 - DNA, 17 bp, Homo sapiens
caccccataagccctga

SEQ ID NO: 5380995 - DNA, 18 bp, Homo sapiens
caccccataagccctgag

SEQ ID NO: 5380996 - DNA, 21 bp, Homo sapiens
caccccatattgttcttcaaa

SEQ ID NO: 5380997 - DNA, 15 bp, Homo sapiens
caccccatcccacac

SEQ ID NO: 5380998 - DNA, 13 bp, Homo sapiens
caccccatccctg

SEQ ID NO: 5380999 - DNA, 15 bp, Homo sapiens
caccccatccctggc

SEQ ID NO: 5381000 - DNA, 18 bp, Homo sapiens
caccccatccctggctga

SEQ ID NO: 5381001 - DNA, 22 bp, Homo sapiens
caccccatccctggctgacctg

SEQ ID NO: 5381002 - DNA, 12 bp, Homo sapiens
caccccatcctc

SEQ ID NO: 5381003 - DNA, 17 bp, Homo sapiens
caccccattcccgcagt

SEQ ID NO: 5381004 - DNA, 15 bp, Homo sapiens
caccccattttctgt

SEQ ID NO: 5381005 - DNA, 13 bp, Homo sapiens
cacccccaacccc

SEQ ID NO: 5381006 - DNA, 14 bp, Homo sapiens
cacccccaacccgt

SEQ ID NO: 5381007 - DNA, 23 bp, Homo sapiens
cacccccacaagctgtccctgca

SEQ ID NO: 5381008 - DNA, 14 bp, Homo sapiens
cacccccacccacc

SEQ ID NO: 5381009 - DNA, 13 bp, Homo sapiens
cacccccacccct

SEQ ID NO: 5381010 - DNA, 18 bp, Homo sapiens
cacccccaccctcgacca

SEQ ID NO: 5381011 - DNA, 23 bp, Homo sapiens
cacccccacttcatgcccactgc

SEQ ID NO: 5381012 - DNA, 13 bp, Homo sapiens
cacccccacttcc

SEQ ID NO: 5381013 - DNA, 16 bp, Homo sapiens
cacccccagcagctca

SEQ ID NO: 5381014 - DNA, 13 bp, Homo sapiens
cacccccagccag

SEQ ID NO: 5381015 - DNA, 16 bp, Homo sapiens
cacccccagccaggct

SEQ ID NO: 5381016 - DNA, 19 bp, Homo sapiens
cacccccagccccgactcc

SEQ ID NO: 5381017 - DNA, 12 bp, Homo sapiens
cacccccagcct

SEQ ID NO: 5381018 - DNA, 13 bp, Homo sapiens
cacccccagcctc

SEQ ID NO: 5381019 - DNA, 15 bp, Homo sapiens
cacccccagcctggg

SEQ ID NO: 5381020 - DNA, 15 bp, Homo sapiens
cacccccagccttgc

SEQ ID NO: 5381021 - DNA, 14 bp, Homo sapiens
cacccccagctcct

SEQ ID NO: 5381022 - DNA, 11 bp, Homo sapiens
cacccccaggc

SEQ ID NO: 5381023 - DNA, 23 bp, Homo sapiens
cacccccaggcaaggctgacttc

SEQ ID NO: 5381024 - DNA, 13 bp, Homo sapiens
cacccccaggcct

SEQ ID NO: 5381025 - DNA, 16 bp, Homo sapiens
cacccccaggcctcct

SEQ ID NO: 5381026 - DNA, 19 bp, Homo sapiens
cacccccaggcctcctagg

SEQ ID NO: 5381027 - DNA, 20 bp, Homo sapiens
cacccccaggtcttcctgct

SEQ ID NO: 5381028 - DNA, 20 bp, Homo sapiens
cacccccaggtgcagcccca

SEQ ID NO: 5381029 - DNA, 22 bp, Homo sapiens
cacccccaggtgcagccccagg

SEQ ID NO: 5381030 - DNA, 15 bp, Homo sapiens
cacccccagtccccc

SEQ ID NO: 5381031 - DNA, 19 bp, Homo sapiens
cacccccagtctccaggga

SEQ ID NO: 5381032 - DNA, 12 bp, Homo sapiens
cacccccagttc

SEQ ID NO: 5381033 - DNA, 16 bp, Homo sapiens
cacccccatccacagt

SEQ ID NO: 5381034 - DNA, 14 bp, Homo sapiens
cacccccatgctgc

SEQ ID NO: 5381035 - DNA, 18 bp, Homo sapiens
cacccccatgctgccttc

SEQ ID NO: 5381036 - DNA, 20 bp, Homo sapiens
cacccccatgctgccttcag

SEQ ID NO: 5381037 - DNA, 20 bp, Homo sapiens
cacccccatgtggcagccca

SEQ ID NO: 5381038 - DNA, 23 bp, Homo sapiens
caccccccacactcactcctgag

SEQ ID NO: 5381039 - DNA, 21 bp, Homo sapiens
caccccccagaacctgtcctt

SEQ ID NO: 5381040 - DNA, 16 bp, Homo sapiens
caccccccagcctcca

SEQ ID NO: 5381041 - DNA, 20 bp, Homo sapiens
cacccccccaggcctccaga

SEQ ID NO: 5381042 - DNA, 15 bp, Homo sapiens
cacccccctcctccc

SEQ ID NO: 5381043 - DNA, 16 bp, Homo sapiens
cacccccctcctcccc

SEQ ID NO: 5381044 - DNA, 19 bp, Homo sapiens
cacccccctcctccccctt

SEQ ID NO: 5381045 - DNA, 16 bp, Homo sapiens
cacccccctctctttc

SEQ ID NO: 5381046 - DNA, 18 bp, Homo sapiens
cacccccctctctttctc

SEQ ID NO: 5381047 - DNA, 16 bp, Homo sapiens
cacccccctctgctgc

SEQ ID NO: 5381048 - DNA, 15 bp, Homo sapiens
caccccccttctgaa

SEQ ID NO: 5381049 - DNA, 18 bp, Homo sapiens
cacccccgaccctgccct

SEQ ID NO: 5381050 - DNA, 23 bp, Homo sapiens
cacccccgacggcctccaggagg

SEQ ID NO: 5381051 - DNA, 18 bp, Homo sapiens
cacccccgagcttgcctc

SEQ ID NO: 5381052 - DNA, 21 bp, Homo sapiens
cacccccgagcttgcctcagg

SEQ ID NO: 5381053 - DNA, 13 bp, Homo sapiens
cacccccgccagg

SEQ ID NO: 5381054 - DNA, 14 bp, Homo sapiens
cacccccgccaggc

SEQ ID NO: 5381055 - DNA, 20 bp, Homo sapiens
cacccccgggatcctgcccc

SEQ ID NO: 5381056 - DNA, 21 bp, Homo sapiens
cacccccgggatcctgccccc

SEQ ID NO: 5381057 - DNA, 13 bp, Homo sapiens
caccccctcaagc

SEQ ID NO: 5381058 - DNA, 20 bp, Homo sapiens
caccccctcaagccccagca

SEQ ID NO: 5381059 - DNA, 16 bp, Homo sapiens
caccccctccccaaag

SEQ ID NO: 5381060 - DNA, 17 bp, Homo sapiens
caccccctccccagggg

SEQ ID NO: 5381061 - DNA, 18 bp, Homo sapiens
caccccctccccagggga

SEQ ID NO: 5381062 - DNA, 19 bp, Homo sapiens
caccccctccccgcccctg

SEQ ID NO: 5381063 - DNA, 18 bp, Homo sapiens
caccccctcctcccccag

SEQ ID NO: 5381064 - DNA, 17 bp, Homo sapiens
caccccctcctgctgca

SEQ ID NO: 5381065 - DNA, 14 bp, Homo sapiens
caccccctcctggc

SEQ ID NO: 5381066 - DNA, 12 bp, Homo sapiens
caccccctgcag

SEQ ID NO: 5381067 - DNA, 14 bp, Homo sapiens
caccccctgcagct

SEQ ID NO: 5381068 - DNA, 14 bp, Homo sapiens
caccccctgccctg

SEQ ID NO: 5381069 - DNA, 15 bp, Homo sapiens
caccccctgcctggt

SEQ ID NO: 5381070 - DNA, 18 bp, Homo sapiens
caccccctgcctggttct

SEQ ID NO: 5381071 - DNA, 13 bp, Homo sapiens
caccccctgctcc

SEQ ID NO: 5381072 - DNA, 22 bp, Homo sapiens
caccccctgctccaccagcagc

SEQ ID NO: 5381073 - DNA, 20 bp, Homo sapiens
caccccctgctggtgcccac

SEQ ID NO: 5381074 - DNA, 17 bp, Homo sapiens
caccccctgggcagatg

SEQ ID NO: 5381075 - DNA, 15 bp, Homo sapiens
caccccctgttccct

SEQ ID NO: 5381076 - DNA, 18 bp, Homo sapiens
caccccctgttccctgtt

SEQ ID NO: 5381077 - DNA, 16 bp, Homo sapiens
cacccccttcagtgcc

SEQ ID NO: 5381078 - DNA, 20 bp, Homo sapiens
cacccccttcagtgcccacc

SEQ ID NO: 5381079 - DNA, 12 bp, Homo sapiens
cacccccttccc

SEQ ID NO: 5381080 - DNA, 13 bp, Homo sapiens
cacccccttcccc

SEQ ID NO: 5381081 - DNA, 22 bp, Homo sapiens
cacccccttctctgcccattcc

SEQ ID NO: 5381082 - DNA, 18 bp, Homo sapiens
caccccctttgctgtgag

SEQ ID NO: 5381083 - DNA, 16 bp, Homo sapiens
caccccgacttttgtt

SEQ ID NO: 5381084 - DNA, 20 bp, Homo sapiens
caccccgaggccctgcatgg

SEQ ID NO: 5381085 - DNA, 22 bp, Homo sapiens
caccccgaggccctgcatgggc

SEQ ID NO: 5381086 - DNA, 23 bp, Homo sapiens
caccccgccagcctacactgcca

SEQ ID NO: 5381087 - DNA, 16 bp, Homo sapiens
caccccgcccctgcat

SEQ ID NO: 5381088 - DNA, 20 bp, Homo sapiens
caccccgcccctgcatgcct

SEQ ID NO: 5381089 - DNA, 18 bp, Homo sapiens
caccccgccgttccctgc

SEQ ID NO: 5381090 - DNA, 21 bp, Homo sapiens
caccccgccgttccctgcgct

SEQ ID NO: 5381091 - DNA, 16 bp, Homo sapiens
caccccgcctctgggc

SEQ ID NO: 5381092 - DNA, 18 bp, Homo sapiens
caccccgcctgccctccc

SEQ ID NO: 5381093 - DNA, 18 bp, Homo sapiens
caccccgcgcaaggggaa

SEQ ID NO: 5381094 - DNA, 23 bp, Homo sapiens
caccccgctcacgctgacagcct

SEQ ID NO: 5381095 - DNA, 16 bp, Homo sapiens
caccccgctcttccca

SEQ ID NO: 5381096 - DNA, 13 bp, Homo sapiens
caccccgctgcct

SEQ ID NO: 5381097 - DNA, 19 bp, Homo sapiens
caccccgctgtaagctcct

SEQ ID NO: 5381098 - DNA, 22 bp, Homo sapiens
caccccgcttttgcagcagagg

SEQ ID NO: 5381099 - DNA, 16 bp, Homo sapiens
caccccggcaggccct

SEQ ID NO: 5381100 - DNA, 17 bp, Homo sapiens
caccccggccacctgcg

SEQ ID NO: 5381101 - DNA, 23 bp, Homo sapiens
caccccggccccctgcccgttct

SEQ ID NO: 5381102 - DNA, 17 bp, Homo sapiens
caccccggcctcagggc

SEQ ID NO: 5381103 - DNA, 14 bp, Homo sapiens
caccccggcctcca

SEQ ID NO: 5381104 - DNA, 18 bp, Homo sapiens
caccccggcctccactcc

SEQ ID NO: 5381105 - DNA, 21 bp, Homo sapiens
caccccggctccccctgccag

SEQ ID NO: 5381106 - DNA, 17 bp, Homo sapiens
caccccgggctctcctg

SEQ ID NO: 5381107 - DNA, 20 bp, Homo sapiens
caccccgggctctcctgccc

SEQ ID NO: 5381108 - DNA, 17 bp, Homo sapiens
caccccggggaccctgt

SEQ ID NO: 5381109 - DNA, 15 bp, Homo sapiens
caccccgtcccggcc

SEQ ID NO: 5381110 - DNA, 15 bp, Homo sapiens
caccccgtgccaccc

SEQ ID NO: 5381111 - DNA, 17 bp, Homo sapiens
caccccgttcccagcgc

SEQ ID NO: 5381112 - DNA, 22 bp, Homo sapiens
caccccgttgttgtccctgcag

SEQ ID NO: 5381113 - DNA, 14 bp, Homo sapiens
cacccctaaagaga

SEQ ID NO: 5381114 - DNA, 15 bp, Homo sapiens
cacccctaacctggc

SEQ ID NO: 5381115 - DNA, 15 bp, Homo sapiens
cacccctaagtacaa

SEQ ID NO: 5381116 - DNA, 15 bp, Homo sapiens
cacccctacacacac

SEQ ID NO: 5381117 - DNA, 16 bp, Homo sapiens
cacccctacacacaca

SEQ ID NO: 5381118 - DNA, 16 bp, Homo sapiens
cacccctacacacacc

SEQ ID NO: 5381119 - DNA, 20 bp, Homo sapiens
cacccctacccccaaccctc

SEQ ID NO: 5381120 - DNA, 17 bp, Homo sapiens
cacccctacccctggct

SEQ ID NO: 5381121 - DNA, 18 bp, Homo sapiens
cacccctacccctggctg

SEQ ID NO: 5381122 - DNA, 24 bp, Homo sapiens
cacccctacccctggctgtactgc

SEQ ID NO: 5381123 - DNA, 14 bp, Homo sapiens
cacccctagccacc

SEQ ID NO: 5381124 - DNA, 16 bp, Homo sapiens
cacccctagccctggt

SEQ ID NO: 5381125 - DNA, 18 bp, Homo sapiens
cacccctcaagccaggag

SEQ ID NO: 5381126 - DNA, 14 bp, Homo sapiens
cacccctcactccc

SEQ ID NO: 5381127 - DNA, 20 bp, Homo sapiens
cacccctcactccccaggga

SEQ ID NO: 5381128 - DNA, 17 bp, Homo sapiens
cacccctcactctggcc

SEQ ID NO: 5381129 - DNA, 22 bp, Homo sapiens
cacccctcagcgctccctgtcg

SEQ ID NO: 5381130 - DNA, 15 bp, Homo sapiens
cacccctccaaagcc

SEQ ID NO: 5381131 - DNA, 19 bp, Homo sapiens
cacccctccaaagccccac

SEQ ID NO: 5381132 - DNA, 12 bp, Homo sapiens
cacccctccacg

SEQ ID NO: 5381133 - DNA, 10 bp, Homo sapiens
cacccctccc

SEQ ID NO: 5381134 - DNA, 12 bp, Homo sapiens
cacccctcccac

SEQ ID NO: 5381135 - DNA, 22 bp, Homo sapiens
cacccctcccacctctttcttc

SEQ ID NO: 5381136 - DNA, 13 bp, Homo sapiens
cacccctcccatt

SEQ ID NO: 5381137 - DNA, 17 bp, Homo sapiens
cacccctcccattagga

SEQ ID NO: 5381138 - DNA, 12 bp, Homo sapiens
cacccctcccca

SEQ ID NO: 5381139 - DNA, 12 bp, Homo sapiens
cacccctccctc

SEQ ID NO: 5381140 - DNA, 13 bp, Homo sapiens
cacccctccctct

SEQ ID NO: 5381141 - DNA, 20 bp, Homo sapiens
cacccctccctctgctctca

SEQ ID NO: 5381142 - DNA, 21 bp, Homo sapiens
cacccctccctctgctctcat

SEQ ID NO: 5381143 - DNA, 16 bp, Homo sapiens
cacccctccggccccg

SEQ ID NO: 5381144 - DNA, 20 bp, Homo sapiens
cacccctcctccttgctgat

SEQ ID NO: 5381145 - DNA, 13 bp, Homo sapiens
cacccctccttcc

SEQ ID NO: 5381146 - DNA, 15 bp, Homo sapiens
cacccctccttccct

SEQ ID NO: 5381147 - DNA, 17 bp, Homo sapiens
cacccctccttccctgg

SEQ ID NO: 5381148 - DNA, 23 bp, Homo sapiens
cacccctccttccttgaccagca

SEQ ID NO: 5381149 - DNA, 12 bp, Homo sapiens
cacccctccttg

SEQ ID NO: 5381150 - DNA, 19 bp, Homo sapiens
cacccctctcgcctcatta

SEQ ID NO: 5381151 - DNA, 13 bp, Homo sapiens
cacccctctgccc

SEQ ID NO: 5381152 - DNA, 20 bp, Homo sapiens
cacccctctgcccctgcagc

SEQ ID NO: 5381153 - DNA, 15 bp, Homo sapiens
cacccctctgctgca

SEQ ID NO: 5381154 - DNA, 15 bp, Homo sapiens
cacccctctgtccag

SEQ ID NO: 5381155 - DNA, 14 bp, Homo sapiens
cacccctcttccca

SEQ ID NO: 5381156 - DNA, 22 bp, Homo sapiens
cacccctcttcccaccaactct

SEQ ID NO: 5381157 - DNA, 20 bp, Homo sapiens
cacccctcttcccccttccc

SEQ ID NO: 5381158 - DNA, 18 bp, Homo sapiens
cacccctgaactggcccc

SEQ ID NO: 5381159 - DNA, 14 bp, Homo sapiens
caccgtccgccctg

SEQ ID NO: 5381160 - DNA, 15 bp, Homo sapiens
caccgtccgccctgc

SEQ ID NO: 5381161 - DNA, 16 bp, Homo sapiens
caccgtcgaccaggaa

SEQ ID NO: 5381162 - DNA, 17 bp, Homo sapiens
caccgtctcggccctga

SEQ ID NO: 5381163 - DNA, 21 bp, Homo sapiens
caccgtctcggccctgaacca

SEQ ID NO: 5381164 - DNA, 14 bp, Homo sapiens
caccgtctgtctca

SEQ ID NO: 5381165 - DNA, 15 bp, Homo sapiens
caccgtgaaccagag

SEQ ID NO: 5381166 - DNA, 16 bp, Homo sapiens
caccgtgaaccagagg

SEQ ID NO: 5381167 - DNA, 18 bp, Homo sapiens
caccgtgacattccagca

SEQ ID NO: 5381168 - DNA, 15 bp, Homo sapiens
caccgtgaggccaag

SEQ ID NO: 5381169 - DNA, 17 bp, Homo sapiens
caccgtgatggagagga

SEQ ID NO: 5381170 - DNA, 21 bp, Homo sapiens
caccgtgatggagaggacaga

SEQ ID NO: 5381171 - DNA, 24 bp, Homo sapiens
caccgtgcccagccctaaacatca

SEQ ID NO: 5381172 - DNA, 15 bp, Homo sapiens
caccgtgcctggcca

SEQ ID NO: 5381173 - DNA, 16 bp, Homo sapiens
caccgtgcctggccag

SEQ ID NO: 5381174 - DNA, 18 bp, Homo sapiens
caccgtgcctggccagat

SEQ ID NO: 5381175 - DNA, 19 bp, Homo sapiens
caccgtgcctggccagatt

SEQ ID NO: 5381176 - DNA, 14 bp, Homo sapiens
caccgtgctgggct

SEQ ID NO: 5381177 - DNA, 14 bp, Homo sapiens
caccgtgctgtctt

SEQ ID NO: 5381178 - DNA, 17 bp, Homo sapiens
caccgtggaccttcctg

SEQ ID NO: 5381179 - DNA, 18 bp, Homo sapiens
caccgtggaccttcctgc

SEQ ID NO: 5381180 - DNA, 20 bp, Homo sapiens
caccgtggaccttcctgcca

SEQ ID NO: 5381181 - DNA, 17 bp, Homo sapiens
caccgtggaggaggaag

SEQ ID NO: 5381182 - DNA, 14 bp, Homo sapiens
caccgtggcctggg

SEQ ID NO: 5381183 - DNA, 16 bp, Homo sapiens
caccgtggcctgggct

SEQ ID NO: 5381184 - DNA, 18 bp, Homo sapiens
caccgtgggctccctgac

SEQ ID NO: 5381185 - DNA, 12 bp, Homo sapiens
caccgtggtcag

SEQ ID NO: 5381186 - DNA, 23 bp, Homo sapiens
caccgtggtgtgaggcccccgga

SEQ ID NO: 5381187 - DNA, 18 bp, Homo sapiens
caccgtgtaaaccaaagc

SEQ ID NO: 5381188 - DNA, 14 bp, Homo sapiens
caccgtgtcctcct

SEQ ID NO: 5381189 - DNA, 17 bp, Homo sapiens
caccgtgttagccagga

SEQ ID NO: 5381190 - DNA, 18 bp, Homo sapiens
caccgttcgtacgcccag

SEQ ID NO: 5381191 - DNA, 14 bp, Homo sapiens
caccgttctgtgca

SEQ ID NO: 5381192 - DNA, 13 bp, Homo sapiens
caccgttgtctca

SEQ ID NO: 5381193 - DNA, 20 bp, Homo sapiens
cacctaaaaccagttttgct

SEQ ID NO: 5381194 - DNA, 21 bp, Homo sapiens
cacctaaaccctctgtgaaat

SEQ ID NO: 5381195 - DNA, 17 bp, Homo sapiens
cacctaaagaaaaacaa

SEQ ID NO: 5381196 - DNA, 15 bp, Homo sapiens
cacctaaagcagcca

SEQ ID NO: 5381197 - DNA, 22 bp, Homo sapiens
cacctaaagcctaccctattct

SEQ ID NO: 5381198 - DNA, 22 bp, Homo sapiens
cacctaaataaccaatctacaa

SEQ ID NO: 5381199 - DNA, 23 bp, Homo sapiens
cacctaaataaccaatctacaat

SEQ ID NO: 5381200 - DNA, 23 bp, Homo sapiens
cacctaaatttttgtaagaaaat

SEQ ID NO: 5381201 - DNA, 16 bp, Homo sapiens
cacctaaccccagggc

SEQ ID NO: 5381202 - DNA, 17 bp, Homo sapiens
cacctaaccctctgtca

SEQ ID NO: 5381203 - DNA, 21 bp, Homo sapiens
cacctaactcttttctatttt

SEQ ID NO: 5381204 - DNA, 18 bp, Homo sapiens
cacctaagagattctgat

SEQ ID NO: 5381205 - DNA, 18 bp, Homo sapiens
cacctaagcaatcactgg

SEQ ID NO: 5381206 - DNA, 19 bp, Homo sapiens
cacctaagcaatcactggg

SEQ ID NO: 5381207 - DNA, 15 bp, Homo sapiens
cacctaagcacttct

SEQ ID NO: 5381208 - DNA, 16 bp, Homo sapiens
cacctaagcacttcta

SEQ ID NO: 5381209 - DNA, 13 bp, Homo sapiens
cacctaagggaca

SEQ ID NO: 5381210 - DNA, 18 bp, Homo sapiens
cacctaagggacatgttt

SEQ ID NO: 5381211 - DNA, 19 bp, Homo sapiens
cacctaagggctaaggcct

SEQ ID NO: 5381212 - DNA, 16 bp, Homo sapiens
cacctaagtacttaaa

SEQ ID NO: 5381213 - DNA, 16 bp, Homo sapiens
cacctaagtctctgtg

SEQ ID NO: 5381214 - DNA, 17 bp, Homo sapiens
cacctaatccaggcaga

SEQ ID NO: 5381215 - DNA, 21 bp, Homo sapiens
cacctaatccaggcagatcca

SEQ ID NO: 5381216 - DNA, 22 bp, Homo sapiens
cacctaatccaggcagatccag

SEQ ID NO: 5381217 - DNA, 17 bp, Homo sapiens
cacctacaatacatctg

SEQ ID NO: 5381218 - DNA, 14 bp, Homo sapiens
cacctacacccctg

SEQ ID NO: 5381219 - DNA, 13 bp, Homo sapiens
cacctacagtgta

SEQ ID NO: 5381220 - DNA, 14 bp, Homo sapiens
cacctacatcccca

SEQ ID NO: 5381221 - DNA, 21 bp, Homo sapiens
cacctacatccccaggtctct

SEQ ID NO: 5381222 - DNA, 18 bp, Homo sapiens
cacctacatgttattcta

SEQ ID NO: 5381223 - DNA, 18 bp, Homo sapiens
cacctaccactcacatga

SEQ ID NO: 5381224 - DNA, 17 bp, Homo sapiens
cacctaccatcagggac

SEQ ID NO: 5381225 - DNA, 18 bp, Homo sapiens
cacctactaaaaaagtta

SEQ ID NO: 5381226 - DNA, 21 bp, Homo sapiens
cacctactatgtgctgggtgc

SEQ ID NO: 5381227 - DNA, 13 bp, Homo sapiens
cacctacttagat

SEQ ID NO: 5381228 - DNA, 17 bp, Homo sapiens
cacctacttagatattt

SEQ ID NO: 5381229 - DNA, 15 bp, Homo sapiens
cacctacttcctcct

SEQ ID NO: 5381230 - DNA, 16 bp, Homo sapiens
cacctacttcctcctc

SEQ ID NO: 5381231 - DNA, 18 bp, Homo sapiens
cacctagaaaggggccca

SEQ ID NO: 5381232 - DNA, 17 bp, Homo sapiens
cacctagaacctccctc

SEQ ID NO: 5381233 - DNA, 23 bp, Homo sapiens
cacctagaacgtgcatccttgta

SEQ ID NO: 5381234 - DNA, 16 bp, Homo sapiens
cacctagaagtctccc

SEQ ID NO: 5381235 - DNA, 21 bp, Homo sapiens
cacctagaagtctccctgcac

SEQ ID NO: 5381236 - DNA, 22 bp, Homo sapiens
cacctagaagtctccctgcaca

SEQ ID NO: 5381237 - DNA, 18 bp, Homo sapiens
cacctagaatggaagcct

SEQ ID NO: 5381238 - DNA, 15 bp, Homo sapiens
cacctagacaaacaa

SEQ ID NO: 5381239 - DNA, 23 bp, Homo sapiens
cacctagacaaacaagggagaag

SEQ ID NO: 5381240 - DNA, 17 bp, Homo sapiens
cacctagagccagacca

SEQ ID NO: 5381241 - DNA, 20 bp, Homo sapiens
cacctagcaattccatcacc

SEQ ID NO: 5381242 - DNA, 12 bp, Homo sapiens
cacctagcagcc

SEQ ID NO: 5381243 - DNA, 14 bp, Homo sapiens
cacctagcagcctc

SEQ ID NO: 5381244 - DNA, 16 bp, Homo sapiens
cacctagcagcctcaa

SEQ ID NO: 5381245 - DNA, 12 bp, Homo sapiens
cacctagccagc

SEQ ID NO: 5381246 - DNA, 13 bp, Homo sapiens
cacctagcccagg

SEQ ID NO: 5381247 - DNA, 14 bp, Homo sapiens
cacctagcccagga

SEQ ID NO: 5381248 - DNA, 13 bp, Homo sapiens
cacctagctgaat

SEQ ID NO: 5381249 - DNA, 15 bp, Homo sapiens
cacctagctgtgcaa

SEQ ID NO: 5381250 - DNA, 24 bp, Homo sapiens
cacctaggaagcctcagattcctt

SEQ ID NO: 5381251 - DNA, 18 bp, Homo sapiens
cacctaggcaatgaagaa

SEQ ID NO: 5381252 - DNA, 18 bp, Homo sapiens
cacctaggctagggtggg

SEQ ID NO: 5381253 - DNA, 22 bp, Homo sapiens
cacctaggtcgccagtgaaata

SEQ ID NO: 5381254 - DNA, 23 bp, Homo sapiens
cacctaggtggggcctggggtag

SEQ ID NO: 5381255 - DNA, 21 bp, Homo sapiens
cacctagtaagtgcctgctgt

SEQ ID NO: 5381256 - DNA, 15 bp, Homo sapiens
cacctagtcgacact

SEQ ID NO: 5381257 - DNA, 20 bp, Homo sapiens
cacctagtctgtaactcttt

SEQ ID NO: 5381258 - DNA, 16 bp, Homo sapiens
cacctagtgccccaga

SEQ ID NO: 5381259 - DNA, 19 bp, Homo sapiens
cacctagtgccccagactg

SEQ ID NO: 5381260 - DNA, 22 bp, Homo sapiens
cacctagtgccccagactgagc

SEQ ID NO: 5381261 - DNA, 22 bp, Homo sapiens
cacctagtggctgtccagtgcc

SEQ ID NO: 5381262 - DNA, 21 bp, Homo sapiens
cacctagttctccccgatggg

SEQ ID NO: 5381263 - DNA, 17 bp, Homo sapiens
cacctatcacccaggct

SEQ ID NO: 5381264 - DNA, 13 bp, Homo sapiens
cacctatctcagc

SEQ ID NO: 5381265 - DNA, 14 bp, Homo sapiens
cacctatctcagcc

SEQ ID NO: 5381266 - DNA, 16 bp, Homo sapiens
cacctatctcagccat

SEQ ID NO: 5381267 - DNA, 19 bp, Homo sapiens
cacctatctcagccatagg

SEQ ID NO: 5381268 - DNA, 20 bp, Homo sapiens
cacctatctcgtgggagagc

SEQ ID NO: 5381269 - DNA, 17 bp, Homo sapiens
cacctatgagatggcca

SEQ ID NO: 5381270 - DNA, 23 bp, Homo sapiens
cacctatgcctgtggtgaagtgt

SEQ ID NO: 5381271 - DNA, 12 bp, Homo sapiens
cacctatggccc

SEQ ID NO: 5381272 - DNA, 17 bp, Homo sapiens
cacctatggcccagcca

SEQ ID NO: 5381273 - DNA, 18 bp, Homo sapiens
cacctatggcccagccac

SEQ ID NO: 5381274 - DNA, 17 bp, Homo sapiens
cacctatggctggctgg

SEQ ID NO: 5381275 - DNA, 17 bp, Homo sapiens
cacctatgtgccaactg

SEQ ID NO: 5381276 - DNA, 19 bp, Homo sapiens
cacctatgtggcatgtggt

SEQ ID NO: 5381277 - DNA, 13 bp, Homo sapiens
cacctatgttatt

SEQ ID NO: 5381278 - DNA, 15 bp, Homo sapiens
cacctatgttatttt

SEQ ID NO: 5381279 - DNA, 22 bp, Homo sapiens
cacctatgttattttgtgtaca

SEQ ID NO: 5381280 - DNA, 12 bp, Homo sapiens
cacctattacat

SEQ ID NO: 5381281 - DNA, 15 bp, Homo sapiens
cacctattatcccag

SEQ ID NO: 5381282 - DNA, 12 bp, Homo sapiens
cacctatttaat

SEQ ID NO: 5381283 - DNA, 12 bp, Homo sapiens
cacctattttag

SEQ ID NO: 5381284 - DNA, 15 bp, Homo sapiens
cacctcaacccagag

SEQ ID NO: 5381285 - DNA, 18 bp, Homo sapiens
cacctcaaggtcatcaaa

SEQ ID NO: 5381286 - DNA, 18 bp, Homo sapiens
cacctcaagtgcaaggac

SEQ ID NO: 5381287 - DNA, 18 bp, Homo sapiens
cacctcacaactccttcc

SEQ ID NO: 5381288 - DNA, 21 bp, Homo sapiens
cacctcaccaaggatcggact

SEQ ID NO: 5381289 - DNA, 23 bp, Homo sapiens
cacctcacctgagacctccactc

SEQ ID NO: 5381290 - DNA, 20 bp, Homo sapiens
cacctcactcagcaccactc

SEQ ID NO: 5381291 - DNA, 21 bp, Homo sapiens
cacctcactcatactgtcata

SEQ ID NO: 5381292 - DNA, 13 bp, Homo sapiens
cacctcactcctg

SEQ ID NO: 5381293 - DNA, 14 bp, Homo sapiens
cacctcactcctgt

SEQ ID NO: 5381294 - DNA, 15 bp, Homo sapiens
cacctcactgaggaa

SEQ ID NO: 5381295 - DNA, 11 bp, Homo sapiens
cacctcactgt

SEQ ID NO: 5381296 - DNA, 19 bp, Homo sapiens
cacctcagaaattgaaagc

SEQ ID NO: 5381297 - DNA, 20 bp, Homo sapiens
cacctcagagacatacacct

SEQ ID NO: 5381298 - DNA, 17 bp, Homo sapiens
cacctcagagcagggcc

SEQ ID NO: 5381299 - DNA, 19 bp, Homo sapiens
cacctcagagcagggccaa

SEQ ID NO: 5381300 - DNA, 22 bp, Homo sapiens
cacctcagagtatggagctcag

SEQ ID NO: 5381301 - DNA, 21 bp, Homo sapiens
cacctcagagtggagttgaaa

SEQ ID NO: 5381302 - DNA, 13 bp, Homo sapiens
cacctcagatggc

SEQ ID NO: 5381303 - DNA, 19 bp, Homo sapiens
cacctcagatggcagcttt

SEQ ID NO: 5381304 - DNA, 16 bp, Homo sapiens
cacctcagcctcccaa

SEQ ID NO: 5381305 - DNA, 17 bp, Homo sapiens
cacctcagcctcccaga

SEQ ID NO: 5381306 - DNA, 18 bp, Homo sapiens
cacctcagcctcctgtgt

SEQ ID NO: 5381307 - DNA, 14 bp, Homo sapiens
cacctcagcctgca

SEQ ID NO: 5381308 - DNA, 15 bp, Homo sapiens
cacctcagcctggag

SEQ ID NO: 5381309 - DNA, 17 bp, Homo sapiens
cacctcagcctggagag

SEQ ID NO: 5381310 - DNA, 18 bp, Homo sapiens
cacctcagcctggagagg

SEQ ID NO: 5381311 - DNA, 12 bp, Homo sapiens
cacctcagcctt

SEQ ID NO: 5381312 - DNA, 16 bp, Homo sapiens
cacctcagctgcctcc

SEQ ID NO: 5381313 - DNA, 20 bp, Homo sapiens
cacctcagctgcctccccag

SEQ ID NO: 5381314 - DNA, 14 bp, Homo sapiens
cacctcaggacccc

SEQ ID NO: 5381315 - DNA, 13 bp, Homo sapiens
cacctcaggggag

SEQ ID NO: 5381316 - DNA, 15 bp, Homo sapiens
cacctcaggggagac

SEQ ID NO: 5381317 - DNA, 18 bp, Homo sapiens
cacctcagtctcacctgc

SEQ ID NO: 5381318 - DNA, 14 bp, Homo sapiens
cacctcagtgggaa

SEQ ID NO: 5381319 - DNA, 15 bp, Homo sapiens
cacctcagtgggaag

SEQ ID NO: 5381320 - DNA, 17 bp, Homo sapiens
cacctcagttcccttgg

SEQ ID NO: 5381321 - DNA, 18 bp, Homo sapiens
cacctcagttcccttggc

SEQ ID NO: 5381322 - DNA, 12 bp, Homo sapiens
cacctcatatgc

SEQ ID NO: 5381323 - DNA, 16 bp, Homo sapiens
cacctcatgcccaccc

SEQ ID NO: 5381324 - DNA, 20 bp, Homo sapiens
cacctcatgcccaccccctg

SEQ ID NO: 5381325 - DNA, 19 bp, Homo sapiens
cacctcatgcctggccccc

SEQ ID NO: 5381326 - DNA, 14 bp, Homo sapiens
cacctcatgctagc

SEQ ID NO: 5381327 - DNA, 19 bp, Homo sapiens
cacctcatggactccagga

SEQ ID NO: 5381328 - DNA, 14 bp, Homo sapiens
cacctcattctgaa

SEQ ID NO: 5381329 - DNA, 22 bp, Homo sapiens
cacctcattctgaaccctttcg

SEQ ID NO: 5381330 - DNA, 22 bp, Homo sapiens
cacctccaagcatttcatgaaa

SEQ ID NO: 5381331 - DNA, 14 bp, Homo sapiens
cacctccacagttc

SEQ ID NO: 5381332 - DNA, 11 bp, Homo sapiens
cacctccaccc

SEQ ID NO: 5381333 - DNA, 13 bp, Homo sapiens
cacctccacccag

SEQ ID NO: 5381334 - DNA, 18 bp, Homo sapiens
cacctccacccagcccct

SEQ ID NO: 5381335 - DNA, 13 bp, Homo sapiens
cacctccaccccc

SEQ ID NO: 5381336 - DNA, 22 bp, Homo sapiens
cacctccacccccgccacggcc

SEQ ID NO: 5381337 - DNA, 24 bp, Homo sapiens
cacctccacccccgccacggccac

SEQ ID NO: 5381338 - DNA, 23 bp, Homo sapiens
caccttagagaagctacccctca

SEQ ID NO: 5381339 - DNA, 13 bp, Homo sapiens
caccttaggcagg

SEQ ID NO: 5381340 - DNA, 14 bp, Homo sapiens
caccttaggcaggg

SEQ ID NO: 5381341 - DNA, 17 bp, Homo sapiens
caccttaggcagggaag

SEQ ID NO: 5381342 - DNA, 24 bp, Homo sapiens
caccttagggagggactgggatga

SEQ ID NO: 5381343 - DNA, 16 bp, Homo sapiens
caccttagtctttcct

SEQ ID NO: 5381344 - DNA, 13 bp, Homo sapiens
caccttagtgcaa

SEQ ID NO: 5381345 - DNA, 18 bp, Homo sapiens
caccttatacatcacttc

SEQ ID NO: 5381346 - DNA, 20 bp, Homo sapiens
caccttatacatcacttcct

SEQ ID NO: 5381347 - DNA, 19 bp, Homo sapiens
caccttatatttctgtgta

SEQ ID NO: 5381348 - DNA, 21 bp, Homo sapiens
caccttatctatgatgtttct

SEQ ID NO: 5381349 - DNA, 20 bp, Homo sapiens
caccttatctggaagatctg

SEQ ID NO: 5381350 - DNA, 15 bp, Homo sapiens
caccttatcttaaag

SEQ ID NO: 5381351 - DNA, 19 bp, Homo sapiens
caccttatcttaaagcact

SEQ ID NO: 5381352 - DNA, 13 bp, Homo sapiens
caccttatgtatt

SEQ ID NO: 5381353 - DNA, 22 bp, Homo sapiens
caccttatgtattattttctat

SEQ ID NO: 5381354 - DNA, 16 bp, Homo sapiens
caccttcaactgtctg

SEQ ID NO: 5381355 - DNA, 20 bp, Homo sapiens
caccttcaagcgctccaggg

SEQ ID NO: 5381356 - DNA, 22 bp, Homo sapiens
caccttcaagcgctccagggcc

SEQ ID NO: 5381357 - DNA, 17 bp, Homo sapiens
caccttcaattcctggg

SEQ ID NO: 5381358 - DNA, 18 bp, Homo sapiens
caccttcaattcctgggc

SEQ ID NO: 5381359 - DNA, 16 bp, Homo sapiens
caccttcacctcggag

SEQ ID NO: 5381360 - DNA, 18 bp, Homo sapiens
caccttcagtgctggtgg

SEQ ID NO: 5381361 - DNA, 19 bp, Homo sapiens
caccttcagtttttgtgtt

SEQ ID NO: 5381362 - DNA, 15 bp, Homo sapiens
caccttcatccagat

SEQ ID NO: 5381363 - DNA, 16 bp, Homo sapiens
caccttccaaacaaaa

SEQ ID NO: 5381364 - DNA, 12 bp, Homo sapiens
caccttccaaag

SEQ ID NO: 5381365 - DNA, 13 bp, Homo sapiens
caccttccaaaga

SEQ ID NO: 5381366 - DNA, 14 bp, Homo sapiens
caccttccaacact

SEQ ID NO: 5381367 - DNA, 16 bp, Homo sapiens
caccttccagctcctg

SEQ ID NO: 5381368 - DNA, 15 bp, Homo sapiens
caccttccagggccc

SEQ ID NO: 5381369 - DNA, 16 bp, Homo sapiens
caccttccagggccct

SEQ ID NO: 5381370 - DNA, 19 bp, Homo sapiens
caccttcccagctctccct

SEQ ID NO: 5381371 - DNA, 22 bp, Homo sapiens
caccttcccagctctccctctg

SEQ ID NO: 5381372 - DNA, 19 bp, Homo sapiens
caccttcccagctgctcct

SEQ ID NO: 5381373 - DNA, 13 bp, Homo sapiens
caccttcccatgc

SEQ ID NO: 5381374 - DNA, 15 bp, Homo sapiens
caccttccccagact

SEQ ID NO: 5381375 - DNA, 19 bp, Homo sapiens
caccttccccctcccccag

SEQ ID NO: 5381376 - DNA, 21 bp, Homo sapiens
caccttccctagttctttgca

SEQ ID NO: 5381377 - DNA, 15 bp, Homo sapiens
caccttccctccacc

SEQ ID NO: 5381378 - DNA, 16 bp, Homo sapiens
caccttccctcgactt

SEQ ID NO: 5381379 - DNA, 19 bp, Homo sapiens
caccttcccttcctcagca

SEQ ID NO: 5381380 - DNA, 21 bp, Homo sapiens
caccttcccttcctcagcagg

SEQ ID NO: 5381381 - DNA, 20 bp, Homo sapiens
caccttcccttctacaagga

SEQ ID NO: 5381382 - DNA, 15 bp, Homo sapiens
caccttccgacatcc

SEQ ID NO: 5381383 - DNA, 12 bp, Homo sapiens
caccttcctcag

SEQ ID NO: 5381384 - DNA, 13 bp, Homo sapiens
caccttcctcctc

SEQ ID NO: 5381385 - DNA, 14 bp, Homo sapiens
caccttcctcctgc

SEQ ID NO: 5381386 - DNA, 15 bp, Homo sapiens
caccttcctcctgca

SEQ ID NO: 5381387 - DNA, 15 bp, Homo sapiens
caccttcctgcccag

SEQ ID NO: 5381388 - DNA, 13 bp, Homo sapiens
caccttcctgggc

SEQ ID NO: 5381389 - DNA, 14 bp, Homo sapiens
caccttcctgggca

SEQ ID NO: 5381390 - DNA, 15 bp, Homo sapiens
caccttcctgggcag

SEQ ID NO: 5381391 - DNA, 13 bp, Homo sapiens
caccttcggagag

SEQ ID NO: 5381392 - DNA, 22 bp, Homo sapiens
caccttcgtttactatgcctgt

SEQ ID NO: 5381393 - DNA, 23 bp, Homo sapiens
caccttcgtttactatgcctgtg

SEQ ID NO: 5381394 - DNA, 21 bp, Homo sapiens
caccttctagtcttggccagc

SEQ ID NO: 5381395 - DNA, 20 bp, Homo sapiens
caccttctcacctgctccag

SEQ ID NO: 5381396 - DNA, 17 bp, Homo sapiens
caccttctgagtattct

SEQ ID NO: 5381397 - DNA, 19 bp, Homo sapiens
caccttctgtccccagccc

SEQ ID NO: 5381398 - DNA, 19 bp, Homo sapiens
caccttctgtgcatctggc

SEQ ID NO: 5381399 - DNA, 22 bp, Homo sapiens
caccttctgtgcatctggcctg

SEQ ID NO: 5381400 - DNA, 18 bp, Homo sapiens
caccttcttggcttctgg

SEQ ID NO: 5381401 - DNA, 19 bp, Homo sapiens
caccttcttggcttctggg

SEQ ID NO: 5381402 - DNA, 20 bp, Homo sapiens
caccttcttggcttctggga

SEQ ID NO: 5381403 - DNA, 17 bp, Homo sapiens
caccttctttctggact

SEQ ID NO: 5381404 - DNA, 18 bp, Homo sapiens
caccttctttctggactg

SEQ ID NO: 5381405 - DNA, 17 bp, Homo sapiens
caccttgaatctgcctg

SEQ ID NO: 5381406 - DNA, 18 bp, Homo sapiens
caccttgacagggcacac

SEQ ID NO: 5381407 - DNA, 18 bp, Homo sapiens
caccttgacgtttcttct

SEQ ID NO: 5381408 - DNA, 14 bp, Homo sapiens
caccttgagcacta

SEQ ID NO: 5381409 - DNA, 16 bp, Homo sapiens
caccttgcaacacaca

SEQ ID NO: 5381410 - DNA, 17 bp, Homo sapiens
caccttgcaacacacag

SEQ ID NO: 5381411 - DNA, 11 bp, Homo sapiens
caccttgcaga

SEQ ID NO: 5381412 - DNA, 15 bp, Homo sapiens
caccttgcagctctc

SEQ ID NO: 5381413 - DNA, 13 bp, Homo sapiens
caccttgccaggg

SEQ ID NO: 5381414 - DNA, 16 bp, Homo sapiens
caccttgccgagagag

SEQ ID NO: 5381415 - DNA, 14 bp, Homo sapiens
caccttgcggggat

SEQ ID NO: 5381416 - DNA, 23 bp, Homo sapiens
caccttgctcctccttctgctgc

SEQ ID NO: 5381417 - DNA, 12 bp, Homo sapiens
caccttgctgca

SEQ ID NO: 5381418 - DNA, 16 bp, Homo sapiens
caccttgctgcagtgt

SEQ ID NO: 5381419 - DNA, 14 bp, Homo sapiens
caccttgctgtgtg

SEQ ID NO: 5381420 - DNA, 19 bp, Homo sapiens
caccttgcttttttactta

SEQ ID NO: 5381421 - DNA, 13 bp, Homo sapiens
caccttggaaggg

SEQ ID NO: 5381422 - DNA, 17 bp, Homo sapiens
caccttggacatcctcc

SEQ ID NO: 5381423 - DNA, 13 bp, Homo sapiens
caccttggaccct

SEQ ID NO: 5381424 - DNA, 17 bp, Homo sapiens
caccttggactcctccc

SEQ ID NO: 5381425 - DNA, 21 bp, Homo sapiens
caccttggactcctcccacaa

SEQ ID NO: 5381426 - DNA, 17 bp, Homo sapiens
caccttggagcatttat

SEQ ID NO: 5381427 - DNA, 20 bp, Homo sapiens
caccttggaggaggatgcca

SEQ ID NO: 5381428 - DNA, 17 bp, Homo sapiens
caccttggcaccagaca

SEQ ID NO: 5381429 - DNA, 13 bp, Homo sapiens
caccttggcccag

SEQ ID NO: 5381430 - DNA, 18 bp, Homo sapiens
caccttggcccaggagct

SEQ ID NO: 5381431 - DNA, 13 bp, Homo sapiens
caccttggcctcc

SEQ ID NO: 5381432 - DNA, 20 bp, Homo sapiens
caccttggcgcgcagcccgg

SEQ ID NO: 5381433 - DNA, 13 bp, Homo sapiens
caccttggctcaa

SEQ ID NO: 5381434 - DNA, 14 bp, Homo sapiens
caccttggctcaag

SEQ ID NO: 5381435 - DNA, 15 bp, Homo sapiens
caccttggctcaagt

SEQ ID NO: 5381436 - DNA, 16 bp, Homo sapiens
caccttggctctgcca

SEQ ID NO: 5381437 - DNA, 16 bp, Homo sapiens
caccttggcttgttat

SEQ ID NO: 5381438 - DNA, 12 bp, Homo sapiens
caccttgggacc

SEQ ID NO: 5381439 - DNA, 20 bp, Homo sapiens
caccttgggatgatgcctca

SEQ ID NO: 5381440 - DNA, 23 bp, Homo sapiens
caccttgggctgggggactgggg

SEQ ID NO: 5381441 - DNA, 17 bp, Homo sapiens
caccttggggccttgat

SEQ ID NO: 5381442 - DNA, 18 bp, Homo sapiens
caccttggggcttgactt

SEQ ID NO: 5381443 - DNA, 20 bp, Homo sapiens
caccttggggcttgactttt

SEQ ID NO: 5381444 - DNA, 18 bp, Homo sapiens
caccttgggtctgtgtca

SEQ ID NO: 5381445 - DNA, 17 bp, Homo sapiens
caccttgggtttgtatt

SEQ ID NO: 5381446 - DNA, 17 bp, Homo sapiens
caccttgtaaccagtgc

SEQ ID NO: 5381447 - DNA, 22 bp, Homo sapiens
caccttgtaaccagtgcagaaa

SEQ ID NO: 5381448 - DNA, 17 bp, Homo sapiens
caccttgtacagaacca

SEQ ID NO: 5381449 - DNA, 18 bp, Homo sapiens
caccttgtacagaaccag

SEQ ID NO: 5381450 - DNA, 21 bp, Homo sapiens
caccttgtacagaaccagcac

SEQ ID NO: 5381451 - DNA, 13 bp, Homo sapiens
caccttgtcatgt

SEQ ID NO: 5381452 - DNA, 20 bp, Homo sapiens
caccttgtcatgtaccatca

SEQ ID NO: 5381453 - DNA, 13 bp, Homo sapiens
caccttgtctgct

SEQ ID NO: 5381454 - DNA, 17 bp, Homo sapiens
caccttgtgcctggggt

SEQ ID NO: 5381455 - DNA, 23 bp, Homo sapiens
caccttgtgctggggacaggtcc

SEQ ID NO: 5381456 - DNA, 15 bp, Homo sapiens
caccttgtgtctgta

SEQ ID NO: 5381457 - DNA, 23 bp, Homo sapiens
caccttgtgtggcgcacttcaga

SEQ ID NO: 5381458 - DNA, 22 bp, Homo sapiens
caccttgtgtgttccaagtttc

SEQ ID NO: 5381459 - DNA, 12 bp, Homo sapiens
cacctttactgt

SEQ ID NO: 5381460 - DNA, 15 bp, Homo sapiens
cacctttaggttctt

SEQ ID NO: 5381461 - DNA, 19 bp, Homo sapiens
cacctttatgttttaatat

SEQ ID NO: 5381462 - DNA, 12 bp, Homo sapiens
cacctttattaa

SEQ ID NO: 5381463 - DNA, 18 bp, Homo sapiens
cacctttattaaaatctt

SEQ ID NO: 5381464 - DNA, 21 bp, Homo sapiens
cacctttcagataactgttat

SEQ ID NO: 5381465 - DNA, 11 bp, Homo sapiens
cacctttccca

SEQ ID NO: 5381466 - DNA, 14 bp, Homo sapiens
cacctttcccatct

SEQ ID NO: 5381467 - DNA, 15 bp, Homo sapiens
cacctttccctaaag

SEQ ID NO: 5381468 - DNA, 16 bp, Homo sapiens
cacctttcctctccct

SEQ ID NO: 5381469 - DNA, 20 bp, Homo sapiens
cacctttcctctccctcagg

SEQ ID NO: 5381470 - DNA, 17 bp, Homo sapiens
cacctttctagttgaaa

SEQ ID NO: 5381471 - DNA, 13 bp, Homo sapiens
cacctttctctga

SEQ ID NO: 5381472 - DNA, 13 bp, Homo sapiens
cacctttctgggc

SEQ ID NO: 5381473 - DNA, 13 bp, Homo sapiens
cacctttcttctt

SEQ ID NO: 5381474 - DNA, 18 bp, Homo sapiens
cacctttgcacaggatgc

SEQ ID NO: 5381475 - DNA, 15 bp, Homo sapiens
cacctttgcaggcat

SEQ ID NO: 5381476 - DNA, 14 bp, Homo sapiens
cacctttgccacaa

SEQ ID NO: 5381477 - DNA, 23 bp, Homo sapiens
cacctttggctggtagcagcagg

SEQ ID NO: 5381478 - DNA, 18 bp, Homo sapiens
cacctttgggatcagcct

SEQ ID NO: 5381479 - DNA, 20 bp, Homo sapiens
cacctttgggcaaaggcccc

SEQ ID NO: 5381480 - DNA, 22 bp, Homo sapiens
cacctttgtaagacatttgtat

SEQ ID NO: 5381481 - DNA, 13 bp, Homo sapiens
cacctttgtagca

SEQ ID NO: 5381482 - DNA, 17 bp, Homo sapiens
cacctttgtccccaccg

SEQ ID NO: 5381483 - DNA, 17 bp, Homo sapiens
cacctttgtttctcccc

SEQ ID NO: 5381484 - DNA, 13 bp, Homo sapiens
caccttttaaatc

SEQ ID NO: 5381485 - DNA, 15 bp, Homo sapiens
caccttttaaatcct

SEQ ID NO: 5381486 - DNA, 14 bp, Homo sapiens
caccttttactgtg

SEQ ID NO: 5381487 - DNA, 20 bp, Homo sapiens
caccttttcagcgatgtatg

SEQ ID NO: 5381488 - DNA, 23 bp, Homo sapiens
caccttttccccaaccacagaga

SEQ ID NO: 5381489 - DNA, 19 bp, Homo sapiens
caccttttccccaggagca

SEQ ID NO: 5381490 - DNA, 20 bp, Homo sapiens
caccttttgggaatgtttta

SEQ ID NO: 5381491 - DNA, 21 bp, Homo sapiens
caccttttgtatttaaaacct

SEQ ID NO: 5381492 - DNA, 14 bp, Homo sapiens
caccttttgttttt

SEQ ID NO: 5381493 - DNA, 13 bp, Homo sapiens
cacctttttaata

SEQ ID NO: 5381494 - DNA, 17 bp, Homo sapiens
cacctttttaataaaaa

SEQ ID NO: 5381495 - DNA, 21 bp, Homo sapiens
cacctttttcatacaaggccc

SEQ ID NO: 5381496 - DNA, 17 bp, Homo sapiens
caccttttttaaggaaa

SEQ ID NO: 5381497 - DNA, 12 bp, Homo sapiens
cacgaaacttgt

SEQ ID NO: 5381498 - DNA, 22 bp, Homo sapiens
cacgaacccacctgctgagaga

SEQ ID NO: 5381499 - DNA, 22 bp, Homo sapiens
cacgaacctcggggtgggggtg

SEQ ID NO: 5381500 - DNA, 12 bp, Homo sapiens
cacgaagaaata

SEQ ID NO: 5381501 - DNA, 13 bp, Homo sapiens
cacgaagaaatag

SEQ ID NO: 5381502 - DNA, 14 bp, Homo sapiens
cacgaagggcatcc

SEQ ID NO: 5381503 - DNA, 15 bp, Homo sapiens
cacgaagtgttgcat

SEQ ID NO: 5381504 - DNA, 16 bp, Homo sapiens
cacgaagtgttgcatg

SEQ ID NO: 5381505 - DNA, 16 bp, Homo sapiens
cacgaatattgctgat

SEQ ID NO: 5381506 - DNA, 23 bp, Homo sapiens
cacgaatttctgtgccctcctga

SEQ ID NO: 5381507 - DNA, 18 bp, Homo sapiens
cacgaatttgctggggaa

SEQ ID NO: 5381508 - DNA, 22 bp, Homo sapiens
cacgaatttgctggggaatctc

SEQ ID NO: 5381509 - DNA, 15 bp, Homo sapiens
cacgacagcacacac

SEQ ID NO: 5381510 - DNA, 14 bp, Homo sapiens
cacgacagtggatg

SEQ ID NO: 5381511 - DNA, 19 bp, Homo sapiens
cacgaccagccccttcctg

SEQ ID NO: 5381512 - DNA, 21 bp, Homo sapiens
cacgaccagccccttcctggg

SEQ ID NO: 5381513 - DNA, 22 bp, Homo sapiens
cacgacccctgaatctgctgag

SEQ ID NO: 5381514 - DNA, 20 bp, Homo sapiens
cacgacccctgcctcgaggg

SEQ ID NO: 5381515 - DNA, 19 bp, Homo sapiens
cacgacctgtcctgtcttt

SEQ ID NO: 5381516 - DNA, 19 bp, Homo sapiens
cacgacgccctctccccac

SEQ ID NO: 5381517 - DNA, 21 bp, Homo sapiens
cacgtttaatcccagcacttt

SEQ ID NO: 5381518 - DNA, 19 bp, Homo sapiens
cacgtttggtttgcgcagt

SEQ ID NO: 5381519 - DNA, 18 bp, Homo sapiens
cacgttttgttttgtgcc

SEQ ID NO: 5381520 - DNA, 20 bp, Homo sapiens
cactaaaagaaaatctatta

SEQ ID NO: 5381521 - DNA, 22 bp, Homo sapiens
cactaaaagcatgaattggaac

SEQ ID NO: 5381522 - DNA, 17 bp, Homo sapiens
cactaaaagtgatgtga

SEQ ID NO: 5381523 - DNA, 19 bp, Homo sapiens
cactaaaagtgatgtgatt

SEQ ID NO: 5381524 - DNA, 21 bp, Homo sapiens
cactaaaagtgtgtgaaacct

SEQ ID NO: 5381525 - DNA, 21 bp, Homo sapiens
cactaaaataaaatttaaaaa

SEQ ID NO: 5381526 - DNA, 22 bp, Homo sapiens
cactaaaatccacccagcccac

SEQ ID NO: 5381527 - DNA, 20 bp, Homo sapiens
cactaaaatgaggatccagg

SEQ ID NO: 5381528 - DNA, 17 bp, Homo sapiens
cactaaaccacttctct

SEQ ID NO: 5381529 - DNA, 18 bp, Homo sapiens
cactaaaccacttctctg

SEQ ID NO: 5381530 - DNA, 22 bp, Homo sapiens
cactaaaccacttctctgctgc

SEQ ID NO: 5381531 - DNA, 14 bp, Homo sapiens
cactaaactctggg

SEQ ID NO: 5381532 - DNA, 21 bp, Homo sapiens
cactaaagcaggccttttgat

SEQ ID NO: 5381533 - DNA, 15 bp, Homo sapiens
cactaaagccagcct

SEQ ID NO: 5381534 - DNA, 20 bp, Homo sapiens
cactaaagccagcctgacct

SEQ ID NO: 5381535 - DNA, 18 bp, Homo sapiens
cactaaagcttcagactc

SEQ ID NO: 5381536 - DNA, 22 bp, Homo sapiens
cactaaagtatgtaaagtatgt

SEQ ID NO: 5381537 - DNA, 19 bp, Homo sapiens
cactaaagtgcattatttt

SEQ ID NO: 5381538 - DNA, 15 bp, Homo sapiens
cactaaatatctagt

SEQ ID NO: 5381539 - DNA, 13 bp, Homo sapiens
cactaaatcagag

SEQ ID NO: 5381540 - DNA, 15 bp, Homo sapiens
cactaaatcagagac

SEQ ID NO: 5381541 - DNA, 20 bp, Homo sapiens
cactaaatctccaagacctg

SEQ ID NO: 5381542 - DNA, 16 bp, Homo sapiens
cactaaatgagctcct

SEQ ID NO: 5381543 - DNA, 12 bp, Homo sapiens
cactaaatgtta

SEQ ID NO: 5381544 - DNA, 17 bp, Homo sapiens
cactaaattagtttaaa

SEQ ID NO: 5381545 - DNA, 13 bp, Homo sapiens
cactaaattatta

SEQ ID NO: 5381546 - DNA, 21 bp, Homo sapiens
cactaaattgacacttaaaaa

SEQ ID NO: 5381547 - DNA, 16 bp, Homo sapiens
cactaacaaaatttga

SEQ ID NO: 5381548 - DNA, 16 bp, Homo sapiens
cactaacaaagaaccc

SEQ ID NO: 5381549 - DNA, 14 bp, Homo sapiens
cactaacagggaga

SEQ ID NO: 5381550 - DNA, 17 bp, Homo sapiens
cactaacagggagaagt

SEQ ID NO: 5381551 - DNA, 18 bp, Homo sapiens
cactaacattatattgca

SEQ ID NO: 5381552 - DNA, 22 bp, Homo sapiens
cactaaccaagctgagtttcct

SEQ ID NO: 5381553 - DNA, 14 bp, Homo sapiens
cactaaccacgctg

SEQ ID NO: 5381554 - DNA, 15 bp, Homo sapiens
cactaaccacgctgg

SEQ ID NO: 5381555 - DNA, 20 bp, Homo sapiens
cactaaccccagctgccggc

SEQ ID NO: 5381556 - DNA, 14 bp, Homo sapiens
cactaaccttgcct

SEQ ID NO: 5381557 - DNA, 16 bp, Homo sapiens
cactaacgaaatatca

SEQ ID NO: 5381558 - DNA, 15 bp, Homo sapiens
cactaactcaccagc

SEQ ID NO: 5381559 - DNA, 14 bp, Homo sapiens
cactaacttctaaa

SEQ ID NO: 5381560 - DNA, 23 bp, Homo sapiens
cactaagaaagaaaggaaagaag

SEQ ID NO: 5381561 - DNA, 21 bp, Homo sapiens
cactaagaaatgggactctga

SEQ ID NO: 5381562 - DNA, 13 bp, Homo sapiens
cactaagacaaga

SEQ ID NO: 5381563 - DNA, 21 bp, Homo sapiens
cactaagagaaaattgcacta

SEQ ID NO: 5381564 - DNA, 17 bp, Homo sapiens
cactaagagagaatgag

SEQ ID NO: 5381565 - DNA, 20 bp, Homo sapiens
cactaagagctttatatatt

SEQ ID NO: 5381566 - DNA, 17 bp, Homo sapiens
cactaagaggaggcagg

SEQ ID NO: 5381567 - DNA, 19 bp, Homo sapiens
cactaagagggcagactgt

SEQ ID NO: 5381568 - DNA, 17 bp, Homo sapiens
cactaagcagaggaggg

SEQ ID NO: 5381569 - DNA, 20 bp, Homo sapiens
cactaagcagaggaggggcc

SEQ ID NO: 5381570 - DNA, 21 bp, Homo sapiens
cactaagcagaggaggggccg

SEQ ID NO: 5381571 - DNA, 16 bp, Homo sapiens
cactaagctctctggg

SEQ ID NO: 5381572 - DNA, 18 bp, Homo sapiens
cactaagctctctgggcc

SEQ ID NO: 5381573 - DNA, 19 bp, Homo sapiens
cactaagctttctcctttg

SEQ ID NO: 5381574 - DNA, 21 bp, Homo sapiens
cactaaggccgtgtctctgag

SEQ ID NO: 5381575 - DNA, 16 bp, Homo sapiens
cactaagtaacctcta

SEQ ID NO: 5381576 - DNA, 16 bp, Homo sapiens
cactaagtctcttttt

SEQ ID NO: 5381577 - DNA, 17 bp, Homo sapiens
cactaagttatagtata

SEQ ID NO: 5381578 - DNA, 12 bp, Homo sapiens
cactaataaagt

SEQ ID NO: 5381579 - DNA, 15 bp, Homo sapiens
cactaatacaccagg

SEQ ID NO: 5381580 - DNA, 16 bp, Homo sapiens
cactaatatatggacc

SEQ ID NO: 5381581 - DNA, 18 bp, Homo sapiens
cactaatatatggaccta

SEQ ID NO: 5381582 - DNA, 22 bp, Homo sapiens
cactaatatatggacctagctt

SEQ ID NO: 5381583 - DNA, 16 bp, Homo sapiens
cactaatatatttaaa

SEQ ID NO: 5381584 - DNA, 17 bp, Homo sapiens
cactaatatatttaaaa

SEQ ID NO: 5381585 - DNA, 13 bp, Homo sapiens
cactaatccatta

SEQ ID NO: 5381586 - DNA, 19 bp, Homo sapiens
cactaatccattatccttt

SEQ ID NO: 5381587 - DNA, 19 bp, Homo sapiens
cactaatgagtatttggta

SEQ ID NO: 5381588 - DNA, 18 bp, Homo sapiens
cactaatggccaagtgta

SEQ ID NO: 5381589 - DNA, 16 bp, Homo sapiens
cactaatgttagaatt

SEQ ID NO: 5381590 - DNA, 22 bp, Homo sapiens
cactaatgttagaattgatttc

SEQ ID NO: 5381591 - DNA, 12 bp, Homo sapiens
cactaattcata

SEQ ID NO: 5381592 - DNA, 22 bp, Homo sapiens
cactaattcattaatctgcctc

SEQ ID NO: 5381593 - DNA, 23 bp, Homo sapiens
cactaattgtaaggtattgcaag

SEQ ID NO: 5381594 - DNA, 15 bp, Homo sapiens
cactaattgtccaca

SEQ ID NO: 5381595 - DNA, 20 bp, Homo sapiens
cactaattttgttttaaact

SEQ ID NO: 5381596 - DNA, 19 bp, Homo sapiens
cactaatttttgtattatt

SEQ ID NO: 5381597 - DNA, 23 bp, Homo sapiens
cactaatttttgtattatttttg

SEQ ID NO: 5381598 - DNA, 14 bp, Homo sapiens
cactacaaaaagaa

SEQ ID NO: 5381599 - DNA, 15 bp, Homo sapiens
cactacaaaaagaag

SEQ ID NO: 5381600 - DNA, 17 bp, Homo sapiens
cactacaaaaagaagag

SEQ ID NO: 5381601 - DNA, 12 bp, Homo sapiens
cactacaaacat

SEQ ID NO: 5381602 - DNA, 12 bp, Homo sapiens
cactacaaatgt

SEQ ID NO: 5381603 - DNA, 17 bp, Homo sapiens
cactacaacctccacct

SEQ ID NO: 5381604 - DNA, 21 bp, Homo sapiens
cactacaagtcagctccagct

SEQ ID NO: 5381605 - DNA, 22 bp, Homo sapiens
cactacaagtttataagcccaa

SEQ ID NO: 5381606 - DNA, 15 bp, Homo sapiens
cactacacatttgaa

SEQ ID NO: 5381607 - DNA, 21 bp, Homo sapiens
cactacaccacacacaacagc

SEQ ID NO: 5381608 - DNA, 12 bp, Homo sapiens
cactacacccag

SEQ ID NO: 5381609 - DNA, 14 bp, Homo sapiens
cactacacccagca

SEQ ID NO: 5381610 - DNA, 15 bp, Homo sapiens
cactacacctggctg

SEQ ID NO: 5381611 - DNA, 17 bp, Homo sapiens
cactacacgcacccaat

SEQ ID NO: 5381612 - DNA, 18 bp, Homo sapiens
cactacactcaactaatt

SEQ ID NO: 5381613 - DNA, 16 bp, Homo sapiens
cactacactccagcct

SEQ ID NO: 5381614 - DNA, 17 bp, Homo sapiens
cactacactccagcctg

SEQ ID NO: 5381615 - DNA, 18 bp, Homo sapiens
cactacactccagcctga

SEQ ID NO: 5381616 - DNA, 16 bp, Homo sapiens
cactacagaggattct

SEQ ID NO: 5381617 - DNA, 18 bp, Homo sapiens
cactacagtattactctt

SEQ ID NO: 5381618 - DNA, 14 bp, Homo sapiens
cactacataaactg

SEQ ID NO: 5381619 - DNA, 17 bp, Homo sapiens
cactacatatctaaagc

SEQ ID NO: 5381620 - DNA, 20 bp, Homo sapiens
cactacatgtggtttataga

SEQ ID NO: 5381621 - DNA, 15 bp, Homo sapiens
cactacattcattta

SEQ ID NO: 5381622 - DNA, 13 bp, Homo sapiens
cactacattctgt

SEQ ID NO: 5381623 - DNA, 14 bp, Homo sapiens
cactacattctgtt

SEQ ID NO: 5381624 - DNA, 17 bp, Homo sapiens
cactacattctgttaat

SEQ ID NO: 5381625 - DNA, 18 bp, Homo sapiens
cactacattttttctaat

SEQ ID NO: 5381626 - DNA, 17 bp, Homo sapiens
cactaccaaaagacatt

SEQ ID NO: 5381627 - DNA, 18 bp, Homo sapiens
cactaccaaaagacatta

SEQ ID NO: 5381628 - DNA, 22 bp, Homo sapiens
cactaccaaaagacattagaga

SEQ ID NO: 5381629 - DNA, 21 bp, Homo sapiens
cactaccaaacactcagtcca

SEQ ID NO: 5381630 - DNA, 19 bp, Homo sapiens
cactaccatacagacagca

SEQ ID NO: 5381631 - DNA, 22 bp, Homo sapiens
cactaccccatatacacctgga

SEQ ID NO: 5381632 - DNA, 21 bp, Homo sapiens
cactacccggccggagccgcc

SEQ ID NO: 5381633 - DNA, 19 bp, Homo sapiens
cactaccctcctgtaaaat

SEQ ID NO: 5381634 - DNA, 14 bp, Homo sapiens
cactaccctgattc

SEQ ID NO: 5381635 - DNA, 20 bp, Homo sapiens
cactaccctgattcttgatt

SEQ ID NO: 5381636 - DNA, 20 bp, Homo sapiens
cactaccgaatgtgtcttta

SEQ ID NO: 5381637 - DNA, 23 bp, Homo sapiens
cactaccgaatgtgtctttagat

SEQ ID NO: 5381638 - DNA, 15 bp, Homo sapiens
cactaccgattcttt

SEQ ID NO: 5381639 - DNA, 17 bp, Homo sapiens
cactacctcctcaggga

SEQ ID NO: 5381640 - DNA, 18 bp, Homo sapiens
cactacctcctcagggat

SEQ ID NO: 5381641 - DNA, 13 bp, Homo sapiens
cactacctggctg

SEQ ID NO: 5381642 - DNA, 14 bp, Homo sapiens
cactaccttatcag

SEQ ID NO: 5381643 - DNA, 19 bp, Homo sapiens
cactaccttctgacctccc

SEQ ID NO: 5381644 - DNA, 20 bp, Homo sapiens
cactacctttgtccaggcct

SEQ ID NO: 5381645 - DNA, 15 bp, Homo sapiens
cactacgcagaagag

SEQ ID NO: 5381646 - DNA, 20 bp, Homo sapiens
cactacgcatgactaatttt

SEQ ID NO: 5381647 - DNA, 21 bp, Homo sapiens
cactacgcatgactaattttt

SEQ ID NO: 5381648 - DNA, 19 bp, Homo sapiens
cactacgctcctgtctcca

SEQ ID NO: 5381649 - DNA, 13 bp, Homo sapiens
cactactcagcat

SEQ ID NO: 5381650 - DNA, 20 bp, Homo sapiens
cactactccgcagctctagt

SEQ ID NO: 5381651 - DNA, 15 bp, Homo sapiens
cactactcgagccca

SEQ ID NO: 5381652 - DNA, 18 bp, Homo sapiens
cactactctcttcctcca

SEQ ID NO: 5381653 - DNA, 18 bp, Homo sapiens
cactactcttacatgtat

SEQ ID NO: 5381654 - DNA, 12 bp, Homo sapiens
cactactgaaca

SEQ ID NO: 5381655 - DNA, 15 bp, Homo sapiens
cactactgacatgtg

SEQ ID NO: 5381656 - DNA, 17 bp, Homo sapiens
cactactgcagcacctc

SEQ ID NO: 5381657 - DNA, 19 bp, Homo sapiens
cactactgcagcacctcca

SEQ ID NO: 5381658 - DNA, 12 bp, Homo sapiens
cactactgcagt

SEQ ID NO: 5381659 - DNA, 17 bp, Homo sapiens
cactactgctaaatcct

SEQ ID NO: 5381660 - DNA, 12 bp, Homo sapiens
cactactgggtg

SEQ ID NO: 5381661 - DNA, 21 bp, Homo sapiens
cactactgggtgtcatttcat

SEQ ID NO: 5381662 - DNA, 20 bp, Homo sapiens
cactactgtatttcattatc

SEQ ID NO: 5381663 - DNA, 20 bp, Homo sapiens
cactactgtgtagactcctg

SEQ ID NO: 5381664 - DNA, 16 bp, Homo sapiens
cactacttacttagag

SEQ ID NO: 5381665 - DNA, 12 bp, Homo sapiens
cactactttgta

SEQ ID NO: 5381666 - DNA, 15 bp, Homo sapiens
cactagaagaaaagc

SEQ ID NO: 5381667 - DNA, 13 bp, Homo sapiens
cactagaagatga

SEQ ID NO: 5381668 - DNA, 19 bp, Homo sapiens
cactagaatggataaaata

SEQ ID NO: 5381669 - DNA, 16 bp, Homo sapiens
cactagaattcatgtg

SEQ ID NO: 5381670 - DNA, 15 bp, Homo sapiens
cactagacaaaactg

SEQ ID NO: 5381671 - DNA, 19 bp, Homo sapiens
cactagacaagccagaact

SEQ ID NO: 5381672 - DNA, 14 bp, Homo sapiens
cactagacatgtca

SEQ ID NO: 5381673 - DNA, 21 bp, Homo sapiens
cactagacgttgtaatgcaca

SEQ ID NO: 5381674 - DNA, 16 bp, Homo sapiens
cactagagaaaataaa

SEQ ID NO: 5381675 - DNA, 12 bp, Homo sapiens
cactagagacaa

SEQ ID NO: 5381676 - DNA, 17 bp, Homo sapiens
cactagagggcccatca

SEQ ID NO: 5381677 - DNA, 22 bp, Homo sapiens
cactagagggcccatcaggcag

SEQ ID NO: 5381678 - DNA, 14 bp, Homo sapiens
cactagagtcaccc

SEQ ID NO: 5381679 - DNA, 14 bp, Homo sapiens
cactagagtgctct

SEQ ID NO: 5381680 - DNA, 15 bp, Homo sapiens
cactagcagctgcag

SEQ ID NO: 5381681 - DNA, 20 bp, Homo sapiens
cactagccagacactctgct

SEQ ID NO: 5381682 - DNA, 15 bp, Homo sapiens
cactagccctctttc

SEQ ID NO: 5381683 - DNA, 19 bp, Homo sapiens
cactagcctcaggggtctg

SEQ ID NO: 5381684 - DNA, 19 bp, Homo sapiens
cactagcctccctctcctc

SEQ ID NO: 5381685 - DNA, 14 bp, Homo sapiens
cactagccttccca

SEQ ID NO: 5381686 - DNA, 21 bp, Homo sapiens
cactagccttcttttgtactt

SEQ ID NO: 5381687 - DNA, 21 bp, Homo sapiens
cactagcctttggctctggag

SEQ ID NO: 5381688 - DNA, 23 bp, Homo sapiens
cactagctaagcaagccaggaga

SEQ ID NO: 5381689 - DNA, 12 bp, Homo sapiens
cactagctcccc

SEQ ID NO: 5381690 - DNA, 21 bp, Homo sapiens
cactagctccccaatccctga

SEQ ID NO: 5381691 - DNA, 22 bp, Homo sapiens
cactagctccccaatccctgac

SEQ ID NO: 5381692 - DNA, 13 bp, Homo sapiens
cactagcttactg

SEQ ID NO: 5381693 - DNA, 11 bp, Homo sapiens
cactaggaatt

SEQ ID NO: 5381694 - DNA, 13 bp, Homo sapiens
cactaggaattct

SEQ ID NO: 5381695 - DNA, 15 bp, Homo sapiens
cactcctcactgccc

SEQ ID NO: 5381696 - DNA, 13 bp, Homo sapiens
cactcctccctcc

SEQ ID NO: 5381697 - DNA, 17 bp, Homo sapiens
cactcctccctgatgta

SEQ ID NO: 5381698 - DNA, 19 bp, Homo sapiens
cactcctccgagacccagg

SEQ ID NO: 5381699 - DNA, 16 bp, Homo sapiens
cactcctccgtgagca

SEQ ID NO: 5381700 - DNA, 15 bp, Homo sapiens
cactcctcctccagc

SEQ ID NO: 5381701 - DNA, 15 bp, Homo sapiens
cactcctcctccttt

SEQ ID NO: 5381702 - DNA, 17 bp, Homo sapiens
cactcctcctcggaaga

SEQ ID NO: 5381703 - DNA, 13 bp, Homo sapiens
cactcctcctgcc

SEQ ID NO: 5381704 - DNA, 14 bp, Homo sapiens
cactcctcctgcca

SEQ ID NO: 5381705 - DNA, 17 bp, Homo sapiens
cactcctcctgccagct

SEQ ID NO: 5381706 - DNA, 18 bp, Homo sapiens
cactcctcctgccagctc

SEQ ID NO: 5381707 - DNA, 21 bp, Homo sapiens
cactcctcctgccagctctgt

SEQ ID NO: 5381708 - DNA, 20 bp, Homo sapiens
cactcctctactcttacaga

SEQ ID NO: 5381709 - DNA, 17 bp, Homo sapiens
cactcctctatcatgca

SEQ ID NO: 5381710 - DNA, 18 bp, Homo sapiens
cactcctctcccacagag

SEQ ID NO: 5381711 - DNA, 23 bp, Homo sapiens
cactcctctgactcagggctcct

SEQ ID NO: 5381712 - DNA, 20 bp, Homo sapiens
cactcctctgtctctgctct

SEQ ID NO: 5381713 - DNA, 16 bp, Homo sapiens
cactcctgagacccct

SEQ ID NO: 5381714 - DNA, 20 bp, Homo sapiens
cactcctgagacccctggcc

SEQ ID NO: 5381715 - DNA, 21 bp, Homo sapiens
cactcctgagacccctggcct

SEQ ID NO: 5381716 - DNA, 23 bp, Homo sapiens
cactcctgagacccctggcctcc

SEQ ID NO: 5381717 - DNA, 13 bp, Homo sapiens
cactcctgccagc

SEQ ID NO: 5381718 - DNA, 16 bp, Homo sapiens
cactcctgccccggcc

SEQ ID NO: 5381719 - DNA, 22 bp, Homo sapiens
cactcctgccccggcccaacct

SEQ ID NO: 5381720 - DNA, 10 bp, Homo sapiens
cactcctgct

SEQ ID NO: 5381721 - DNA, 11 bp, Homo sapiens
cactcctgctc

SEQ ID NO: 5381722 - DNA, 16 bp, Homo sapiens
cactcctgctctgctc

SEQ ID NO: 5381723 - DNA, 12 bp, Homo sapiens
cactcctgctgt

SEQ ID NO: 5381724 - DNA, 13 bp, Homo sapiens
cactcctgctgtg

SEQ ID NO: 5381725 - DNA, 19 bp, Homo sapiens
cactcctgcttaatcttca

SEQ ID NO: 5381726 - DNA, 12 bp, Homo sapiens
cactcctgggac

SEQ ID NO: 5381727 - DNA, 13 bp, Homo sapiens
cactcctgggccc

SEQ ID NO: 5381728 - DNA, 15 bp, Homo sapiens
cactcctgggcccca

SEQ ID NO: 5381729 - DNA, 12 bp, Homo sapiens
cactcctggggc

SEQ ID NO: 5381730 - DNA, 19 bp, Homo sapiens
cactcctggggcctcttgg

SEQ ID NO: 5381731 - DNA, 16 bp, Homo sapiens
cactcctgtcccgcct

SEQ ID NO: 5381732 - DNA, 20 bp, Homo sapiens
cactcctgtcccgccttcct

SEQ ID NO: 5381733 - DNA, 14 bp, Homo sapiens
cactcctgtccctg

SEQ ID NO: 5381734 - DNA, 15 bp, Homo sapiens
cactccttcatgttt

SEQ ID NO: 5381735 - DNA, 24 bp, Homo sapiens
cactccttcccaaatctgtctccc

SEQ ID NO: 5381736 - DNA, 14 bp, Homo sapiens
cactccttcccctt

SEQ ID NO: 5381737 - DNA, 11 bp, Homo sapiens
cactccttcct

SEQ ID NO: 5381738 - DNA, 14 bp, Homo sapiens
cactccttcctgcc

SEQ ID NO: 5381739 - DNA, 18 bp, Homo sapiens
cactccttcctgccacct

SEQ ID NO: 5381740 - DNA, 21 bp, Homo sapiens
cactccttcctgccacctgct

SEQ ID NO: 5381741 - DNA, 17 bp, Homo sapiens
cactccttcctgcccca

SEQ ID NO: 5381742 - DNA, 23 bp, Homo sapiens
cactcctttagatagcagcctgg

SEQ ID NO: 5381743 - DNA, 19 bp, Homo sapiens
cactcctttatctgtaatt

SEQ ID NO: 5381744 - DNA, 22 bp, Homo sapiens
cactcctttcttgcactattcc

SEQ ID NO: 5381745 - DNA, 22 bp, Homo sapiens
cactcgacccagaatggagcct

SEQ ID NO: 5381746 - DNA, 20 bp, Homo sapiens
cactcgagaccatcctggcc

SEQ ID NO: 5381747 - DNA, 21 bp, Homo sapiens
cactcgagaccatcctggccc

SEQ ID NO: 5381748 - DNA, 22 bp, Homo sapiens
cactcgagaccatcctggcccc

SEQ ID NO: 5381749 - DNA, 14 bp, Homo sapiens
cactcgcaggacca

SEQ ID NO: 5381750 - DNA, 22 bp, Homo sapiens
cactcgccatctcctgggccgt

SEQ ID NO: 5381751 - DNA, 17 bp, Homo sapiens
cactcgccatttcctca

SEQ ID NO: 5381752 - DNA, 17 bp, Homo sapiens
cactcgcccgcccactg

SEQ ID NO: 5381753 - DNA, 22 bp, Homo sapiens
cactcgcccgcccactgtcctg

SEQ ID NO: 5381754 - DNA, 16 bp, Homo sapiens
cactcgcttcccccat

SEQ ID NO: 5381755 - DNA, 21 bp, Homo sapiens
cactcgcttgccgggcctggg

SEQ ID NO: 5381756 - DNA, 17 bp, Homo sapiens
cactcggagggtgccct

SEQ ID NO: 5381757 - DNA, 22 bp, Homo sapiens
cactcggcatttcaaatgtgct

SEQ ID NO: 5381758 - DNA, 22 bp, Homo sapiens
cactcggcggcagcatggagct

SEQ ID NO: 5381759 - DNA, 14 bp, Homo sapiens
cactcggctttgga

SEQ ID NO: 5381760 - DNA, 18 bp, Homo sapiens
cactcgggaggctgagac

SEQ ID NO: 5381761 - DNA, 19 bp, Homo sapiens
cactcggggcccccatctt

SEQ ID NO: 5381762 - DNA, 14 bp, Homo sapiens
cactcgggtttctc

SEQ ID NO: 5381763 - DNA, 16 bp, Homo sapiens
cactcgtctcccccaa

SEQ ID NO: 5381764 - DNA, 22 bp, Homo sapiens
cactcgtgtgcatgagaatgtc

SEQ ID NO: 5381765 - DNA, 17 bp, Homo sapiens
cactcgtgtgcccacca

SEQ ID NO: 5381766 - DNA, 15 bp, Homo sapiens
cactcgtgtgtttct

SEQ ID NO: 5381767 - DNA, 16 bp, Homo sapiens
cactctaaaaaacatt

SEQ ID NO: 5381768 - DNA, 18 bp, Homo sapiens
cactctaaaaaacatttt

SEQ ID NO: 5381769 - DNA, 20 bp, Homo sapiens
cactctaaaaggttcaggga

SEQ ID NO: 5381770 - DNA, 20 bp, Homo sapiens
cactctaaactgcaaacaga

SEQ ID NO: 5381771 - DNA, 21 bp, Homo sapiens
cactctaaactgcaaacagaa

SEQ ID NO: 5381772 - DNA, 21 bp, Homo sapiens
cactctaaaggcgctgagact

SEQ ID NO: 5381773 - DNA, 16 bp, Homo sapiens
cactctaactgtatat

SEQ ID NO: 5381774 - DNA, 18 bp, Homo sapiens
cactctaactgtatattt

SEQ ID NO: 5381775 - DNA, 21 bp, Homo sapiens
cactctaagatgttatatttt

SEQ ID NO: 5381776 - DNA, 23 bp, Homo sapiens
cactctacacggactgaggtgcc

SEQ ID NO: 5381777 - DNA, 17 bp, Homo sapiens
cactctaccaaataatt

SEQ ID NO: 5381778 - DNA, 19 bp, Homo sapiens
cactctaccaaataatttc

SEQ ID NO: 5381779 - DNA, 17 bp, Homo sapiens
cactctaccctcccacc

SEQ ID NO: 5381780 - DNA, 18 bp, Homo sapiens
cactctaccctcccaccc

SEQ ID NO: 5381781 - DNA, 21 bp, Homo sapiens
cactctaccctcccaccccct

SEQ ID NO: 5381782 - DNA, 11 bp, Homo sapiens
cactctaccta

SEQ ID NO: 5381783 - DNA, 19 bp, Homo sapiens
cactctacctccttagctt

SEQ ID NO: 5381784 - DNA, 17 bp, Homo sapiens
cactctactgccccagc

SEQ ID NO: 5381785 - DNA, 14 bp, Homo sapiens
cactctagattcca

SEQ ID NO: 5381786 - DNA, 13 bp, Homo sapiens
cactctagcctgg

SEQ ID NO: 5381787 - DNA, 20 bp, Homo sapiens
cactctagcctggcaacaga

SEQ ID NO: 5381788 - DNA, 20 bp, Homo sapiens
cactctaggactctgcactg

SEQ ID NO: 5381789 - DNA, 17 bp, Homo sapiens
cactctaggggtcaggc

SEQ ID NO: 5381790 - DNA, 19 bp, Homo sapiens
cactctagtcaatgacatg

SEQ ID NO: 5381791 - DNA, 20 bp, Homo sapiens
cactctagtcaatgacatga

SEQ ID NO: 5381792 - DNA, 15 bp, Homo sapiens
cactctagttctaga

SEQ ID NO: 5381793 - DNA, 22 bp, Homo sapiens
cactctagttgtggacttttcc

SEQ ID NO: 5381794 - DNA, 21 bp, Homo sapiens
cactctatatgtagtgcattt

SEQ ID NO: 5381795 - DNA, 15 bp, Homo sapiens
cactctatccaaagt

SEQ ID NO: 5381796 - DNA, 22 bp, Homo sapiens
cactctcaccccaagcggcctt

SEQ ID NO: 5381797 - DNA, 23 bp, Homo sapiens
cactctcactatgctgctatgga

SEQ ID NO: 5381798 - DNA, 24 bp, Homo sapiens
cactctcactatgctgctatggac

SEQ ID NO: 5381799 - DNA, 16 bp, Homo sapiens
cactctcagagactcc

SEQ ID NO: 5381800 - DNA, 14 bp, Homo sapiens
cactctcagaggcc

SEQ ID NO: 5381801 - DNA, 17 bp, Homo sapiens
cactctcagaggcccca

SEQ ID NO: 5381802 - DNA, 22 bp, Homo sapiens
cactctcaggaaatgctgaccc

SEQ ID NO: 5381803 - DNA, 12 bp, Homo sapiens
cactctcaggac

SEQ ID NO: 5381804 - DNA, 22 bp, Homo sapiens
cactctcatcaccccagaggcc

SEQ ID NO: 5381805 - DNA, 14 bp, Homo sapiens
cactctcatgtccc

SEQ ID NO: 5381806 - DNA, 18 bp, Homo sapiens
cactctcattccccaggt

SEQ ID NO: 5381807 - DNA, 13 bp, Homo sapiens
cactctccatcac

SEQ ID NO: 5381808 - DNA, 16 bp, Homo sapiens
cactctcccccacccc

SEQ ID NO: 5381809 - DNA, 18 bp, Homo sapiens
cactctcccccaccccct

SEQ ID NO: 5381810 - DNA, 15 bp, Homo sapiens
cactctccccgctca

SEQ ID NO: 5381811 - DNA, 18 bp, Homo sapiens
cactctcccctccctctt

SEQ ID NO: 5381812 - DNA, 16 bp, Homo sapiens
cactctcccttgtaca

SEQ ID NO: 5381813 - DNA, 23 bp, Homo sapiens
cactctccgaagtctgatccctg

SEQ ID NO: 5381814 - DNA, 16 bp, Homo sapiens
cactctcctcccctcc

SEQ ID NO: 5381815 - DNA, 11 bp, Homo sapiens
cactctcctgg

SEQ ID NO: 5381816 - DNA, 23 bp, Homo sapiens
cactctcctgggcccctccctac

SEQ ID NO: 5381817 - DNA, 14 bp, Homo sapiens
cactctctaaatct

SEQ ID NO: 5381818 - DNA, 15 bp, Homo sapiens
cactctctcacccac

SEQ ID NO: 5381819 - DNA, 17 bp, Homo sapiens
cactctctcacccacca

SEQ ID NO: 5381820 - DNA, 22 bp, Homo sapiens
cactctctcacccaccagctcc

SEQ ID NO: 5381821 - DNA, 11 bp, Homo sapiens
cactctctgca

SEQ ID NO: 5381822 - DNA, 12 bp, Homo sapiens
cactctctgcag

SEQ ID NO: 5381823 - DNA, 17 bp, Homo sapiens
cactctctgcagcccag

SEQ ID NO: 5381824 - DNA, 15 bp, Homo sapiens
cactctctgccagct

SEQ ID NO: 5381825 - DNA, 22 bp, Homo sapiens
cactctctgccagctccacagg

SEQ ID NO: 5381826 - DNA, 15 bp, Homo sapiens
cactctctgcccact

SEQ ID NO: 5381827 - DNA, 14 bp, Homo sapiens
cactctctggggaa

SEQ ID NO: 5381828 - DNA, 20 bp, Homo sapiens
cactctctgtacaaaaacaa

SEQ ID NO: 5381829 - DNA, 17 bp, Homo sapiens
cactctcttcttactgt

SEQ ID NO: 5381830 - DNA, 18 bp, Homo sapiens
cactctgaagtcccttcc

SEQ ID NO: 5381831 - DNA, 19 bp, Homo sapiens
cactctgaagtcccttcct

SEQ ID NO: 5381832 - DNA, 20 bp, Homo sapiens
cactctgaagtcccttcctg

SEQ ID NO: 5381833 - DNA, 19 bp, Homo sapiens
cactctgaataccaagtgt

SEQ ID NO: 5381834 - DNA, 13 bp, Homo sapiens
cactctgacaagc

SEQ ID NO: 5381835 - DNA, 17 bp, Homo sapiens
cactctgacaagctggc

SEQ ID NO: 5381836 - DNA, 20 bp, Homo sapiens
cactctgacaagctggccaa

SEQ ID NO: 5381837 - DNA, 14 bp, Homo sapiens
cactctgaccgggc

SEQ ID NO: 5381838 - DNA, 12 bp, Homo sapiens
cactctgacctt

SEQ ID NO: 5381839 - DNA, 18 bp, Homo sapiens
cactctgaccttcacagg

SEQ ID NO: 5381840 - DNA, 15 bp, Homo sapiens
cactctgaggtctca

SEQ ID NO: 5381841 - DNA, 16 bp, Homo sapiens
cactctgatagaatta

SEQ ID NO: 5381842 - DNA, 19 bp, Homo sapiens
cactctgattcacctcttc

SEQ ID NO: 5381843 - DNA, 13 bp, Homo sapiens
cactctgcactgg

SEQ ID NO: 5381844 - DNA, 15 bp, Homo sapiens
cactctgcagactgc

SEQ ID NO: 5381845 - DNA, 12 bp, Homo sapiens
cactctgccagg

SEQ ID NO: 5381846 - DNA, 14 bp, Homo sapiens
cactctgccagggc

SEQ ID NO: 5381847 - DNA, 15 bp, Homo sapiens
cactctgcccccatt

SEQ ID NO: 5381848 - DNA, 16 bp, Homo sapiens
cactctgcctctaagg

SEQ ID NO: 5381849 - DNA, 23 bp, Homo sapiens
cactctgcctctaaggccaaggc

SEQ ID NO: 5381850 - DNA, 15 bp, Homo sapiens
cactctgcctgcctg

SEQ ID NO: 5381851 - DNA, 22 bp, Homo sapiens
cactctgctcccagcccctacc

SEQ ID NO: 5381852 - DNA, 13 bp, Homo sapiens
cactctgctctga

SEQ ID NO: 5381853 - DNA, 16 bp, Homo sapiens
cactctgctctgatgc

SEQ ID NO: 5381854 - DNA, 15 bp, Homo sapiens
cactctgctctgccc

SEQ ID NO: 5381855 - DNA, 16 bp, Homo sapiens
cactctgctctgccct

SEQ ID NO: 5381856 - DNA, 10 bp, Homo sapiens
cactctgctg

SEQ ID NO: 5381857 - DNA, 13 bp, Homo sapiens
cactctgctgcct

SEQ ID NO: 5381858 - DNA, 14 bp, Homo sapiens
cactctgctgcctg

SEQ ID NO: 5381859 - DNA, 17 bp, Homo sapiens
cactctgctgcctgtac

SEQ ID NO: 5381860 - DNA, 12 bp, Homo sapiens
cactctgctgct

SEQ ID NO: 5381861 - DNA, 12 bp, Homo sapiens
cactctgctggc

SEQ ID NO: 5381862 - DNA, 13 bp, Homo sapiens
cactctgctggcg

SEQ ID NO: 5381863 - DNA, 16 bp, Homo sapiens
cactctgcttgttatt

SEQ ID NO: 5381864 - DNA, 18 bp, Homo sapiens
cactctggatgatggatt

SEQ ID NO: 5381865 - DNA, 19 bp, Homo sapiens
cactctggattcagccttc

SEQ ID NO: 5381866 - DNA, 13 bp, Homo sapiens
cactctggcagcc

SEQ ID NO: 5381867 - DNA, 16 bp, Homo sapiens
cactctggcagccaca

SEQ ID NO: 5381868 - DNA, 18 bp, Homo sapiens
cactctggcagcctcaga

SEQ ID NO: 5381869 - DNA, 16 bp, Homo sapiens
cactctggcagctcag

SEQ ID NO: 5381870 - DNA, 21 bp, Homo sapiens
cactctggcagctcagagagg

SEQ ID NO: 5381871 - DNA, 20 bp, Homo sapiens
cactctggcggtggccacag

SEQ ID NO: 5381872 - DNA, 20 bp, Homo sapiens
cactctgggcacaagcaggg

SEQ ID NO: 5381873 - DNA, 20 bp, Homo sapiens
cactctgggcacactctgcc

SEQ ID NO: 5381874 - DNA, 18 bp, Homo sapiens
cactgcatttgcctgctt

SEQ ID NO: 5381875 - DNA, 21 bp, Homo sapiens
cactgcatttgcctgcttctt

SEQ ID NO: 5381876 - DNA, 18 bp, Homo sapiens
cactgcatttgctggtgc

SEQ ID NO: 5381877 - DNA, 14 bp, Homo sapiens
cactgccaaacatc

SEQ ID NO: 5381878 - DNA, 18 bp, Homo sapiens
cactgccaaataaacagc

SEQ ID NO: 5381879 - DNA, 20 bp, Homo sapiens
cactgccaaataaacagcta

SEQ ID NO: 5381880 - DNA, 21 bp, Homo sapiens
cactgccaaataaacagctat

SEQ ID NO: 5381881 - DNA, 22 bp, Homo sapiens
cactgccaaataaacagctatt

SEQ ID NO: 5381882 - DNA, 23 bp, Homo sapiens
cactgccaaataaacagctattt

SEQ ID NO: 5381883 - DNA, 19 bp, Homo sapiens
cactgccaagcttcctgtg

SEQ ID NO: 5381884 - DNA, 21 bp, Homo sapiens
cactgccaagcttcctgtgcc

SEQ ID NO: 5381885 - DNA, 20 bp, Homo sapiens
cactgccacaccctccccat

SEQ ID NO: 5381886 - DNA, 20 bp, Homo sapiens
cactgccacactctccatca

SEQ ID NO: 5381887 - DNA, 12 bp, Homo sapiens
cactgccaccag

SEQ ID NO: 5381888 - DNA, 14 bp, Homo sapiens
cactgccactttgc

SEQ ID NO: 5381889 - DNA, 20 bp, Homo sapiens
cactgccactttgcacattt

SEQ ID NO: 5381890 - DNA, 19 bp, Homo sapiens
cactgccagagataaacta

SEQ ID NO: 5381891 - DNA, 19 bp, Homo sapiens
cactgccagagctacactc

SEQ ID NO: 5381892 - DNA, 19 bp, Homo sapiens
cactgccagcagcagcagg

SEQ ID NO: 5381893 - DNA, 14 bp, Homo sapiens
cactgccagcccac

SEQ ID NO: 5381894 - DNA, 12 bp, Homo sapiens
cactgccaggag

SEQ ID NO: 5381895 - DNA, 14 bp, Homo sapiens
cactgccaggaggg

SEQ ID NO: 5381896 - DNA, 11 bp, Homo sapiens
cactgccaggc

SEQ ID NO: 5381897 - DNA, 13 bp, Homo sapiens
cactgccaggcac

SEQ ID NO: 5381898 - DNA, 12 bp, Homo sapiens
cactgccaggcc

SEQ ID NO: 5381899 - DNA, 20 bp, Homo sapiens
cactgccaggccagcctccg

SEQ ID NO: 5381900 - DNA, 21 bp, Homo sapiens
cactgccaggggttcttgagc

SEQ ID NO: 5381901 - DNA, 16 bp, Homo sapiens
cactgccataaaacat

SEQ ID NO: 5381902 - DNA, 21 bp, Homo sapiens
cactgccataaaacattaaga

SEQ ID NO: 5381903 - DNA, 22 bp, Homo sapiens
cactgccataacttgtttgtaa

SEQ ID NO: 5381904 - DNA, 11 bp, Homo sapiens
cactgccatga

SEQ ID NO: 5381905 - DNA, 23 bp, Homo sapiens
cactgccatggaattccctcctg

SEQ ID NO: 5381906 - DNA, 19 bp, Homo sapiens
cactgccatggaggcacac

SEQ ID NO: 5381907 - DNA, 22 bp, Homo sapiens
cactgccatggaggcacacagc

SEQ ID NO: 5381908 - DNA, 21 bp, Homo sapiens
cactgccattaaagaatatga

SEQ ID NO: 5381909 - DNA, 22 bp, Homo sapiens
cactgccattacccagtgccga

SEQ ID NO: 5381910 - DNA, 21 bp, Homo sapiens
cactgccattagactgaattt

SEQ ID NO: 5381911 - DNA, 13 bp, Homo sapiens
cactgcccaccaa

SEQ ID NO: 5381912 - DNA, 17 bp, Homo sapiens
cactgcccaccaaaggt

SEQ ID NO: 5381913 - DNA, 16 bp, Homo sapiens
cactgcccacctgcca

SEQ ID NO: 5381914 - DNA, 18 bp, Homo sapiens
cactgcccacctgccagg

SEQ ID NO: 5381915 - DNA, 20 bp, Homo sapiens
cactgcccacctgccaggct

SEQ ID NO: 5381916 - DNA, 17 bp, Homo sapiens
cactgcccatcccaccc

SEQ ID NO: 5381917 - DNA, 18 bp, Homo sapiens
cactgcccatcccacccc

SEQ ID NO: 5381918 - DNA, 20 bp, Homo sapiens
cactgcccatcccaccccat

SEQ ID NO: 5381919 - DNA, 13 bp, Homo sapiens
cactgccccacat

SEQ ID NO: 5381920 - DNA, 18 bp, Homo sapiens
cactgccccacatgcatg

SEQ ID NO: 5381921 - DNA, 16 bp, Homo sapiens
cactgccccaccagcc

SEQ ID NO: 5381922 - DNA, 17 bp, Homo sapiens
cactgccccaccagcca

SEQ ID NO: 5381923 - DNA, 20 bp, Homo sapiens
cactgccccacttctggcat

SEQ ID NO: 5381924 - DNA, 21 bp, Homo sapiens
cactgccccacttctggcatg

SEQ ID NO: 5381925 - DNA, 16 bp, Homo sapiens
cactgccccaggactg

SEQ ID NO: 5381926 - DNA, 19 bp, Homo sapiens
cactgccccccgaggctgc

SEQ ID NO: 5381927 - DNA, 20 bp, Homo sapiens
cactgccccccgaggctgct

SEQ ID NO: 5381928 - DNA, 19 bp, Homo sapiens
cactgccccctgctgccat

SEQ ID NO: 5381929 - DNA, 20 bp, Homo sapiens
cactgccccctgctgccatg

SEQ ID NO: 5381930 - DNA, 17 bp, Homo sapiens
cactgcccgagctggtg

SEQ ID NO: 5381931 - DNA, 19 bp, Homo sapiens
cactgcccgagctggtgca

SEQ ID NO: 5381932 - DNA, 17 bp, Homo sapiens
cactgcccgcacaccct

SEQ ID NO: 5381933 - DNA, 14 bp, Homo sapiens
cactgccctccagg

SEQ ID NO: 5381934 - DNA, 15 bp, Homo sapiens
cactgccctccaggg

SEQ ID NO: 5381935 - DNA, 20 bp, Homo sapiens
cactgccctccagggccagg

SEQ ID NO: 5381936 - DNA, 16 bp, Homo sapiens
cactgccctctccaca

SEQ ID NO: 5381937 - DNA, 15 bp, Homo sapiens
cactgccctctgcca

SEQ ID NO: 5381938 - DNA, 17 bp, Homo sapiens
cactgccctctgttcag

SEQ ID NO: 5381939 - DNA, 15 bp, Homo sapiens
cactgccctgcctgc

SEQ ID NO: 5381940 - DNA, 16 bp, Homo sapiens
cactgccctgcctgcc

SEQ ID NO: 5381941 - DNA, 15 bp, Homo sapiens
cactgccctggcagc

SEQ ID NO: 5381942 - DNA, 20 bp, Homo sapiens
cactgccctgttcatgtgcc

SEQ ID NO: 5381943 - DNA, 15 bp, Homo sapiens
cactgccgatgccca

SEQ ID NO: 5381944 - DNA, 16 bp, Homo sapiens
cactgccgatgcccaa

SEQ ID NO: 5381945 - DNA, 16 bp, Homo sapiens
cactgcctactgcatc

SEQ ID NO: 5381946 - DNA, 15 bp, Homo sapiens
cactgcctatatatg

SEQ ID NO: 5381947 - DNA, 16 bp, Homo sapiens
cactgcctatatatgt

SEQ ID NO: 5381948 - DNA, 21 bp, Homo sapiens
cactgcctatatatgtaaata

SEQ ID NO: 5381949 - DNA, 16 bp, Homo sapiens
cactgcctcaggttcc

SEQ ID NO: 5381950 - DNA, 15 bp, Homo sapiens
cactgcctcatggca

SEQ ID NO: 5381951 - DNA, 19 bp, Homo sapiens
cactgcctcctacaaccag

SEQ ID NO: 5381952 - DNA, 13 bp, Homo sapiens
cactgcctcctcc

SEQ ID NO: 5381953 - DNA, 20 bp, Homo sapiens
cactgcctcctccctggctg

SEQ ID NO: 5381954 - DNA, 12 bp, Homo sapiens
cactgcctcctg

SEQ ID NO: 5381955 - DNA, 20 bp, Homo sapiens
cactgcctcctgcctggggt

SEQ ID NO: 5381956 - DNA, 23 bp, Homo sapiens
cactgcctcctgttttctccctc

SEQ ID NO: 5381957 - DNA, 17 bp, Homo sapiens
cactgcctctatgccct

SEQ ID NO: 5381958 - DNA, 23 bp, Homo sapiens
cactgcctctatgccctgcagag

SEQ ID NO: 5381959 - DNA, 13 bp, Homo sapiens
cactgcctctccc

SEQ ID NO: 5381960 - DNA, 19 bp, Homo sapiens
cactgcctctccctggccc

SEQ ID NO: 5381961 - DNA, 13 bp, Homo sapiens
cactgcctctgag

SEQ ID NO: 5381962 - DNA, 15 bp, Homo sapiens
cactgcctctgcctt

SEQ ID NO: 5381963 - DNA, 15 bp, Homo sapiens
cactgcctctggaat

SEQ ID NO: 5381964 - DNA, 10 bp, Homo sapiens
cactgcctga

SEQ ID NO: 5381965 - DNA, 10 bp, Homo sapiens
cactgcctgc

SEQ ID NO: 5381966 - DNA, 17 bp, Homo sapiens
cactgcctgcacctttc

SEQ ID NO: 5381967 - DNA, 22 bp, Homo sapiens
cactgcctgcagaggtctgtgc

SEQ ID NO: 5381968 - DNA, 14 bp, Homo sapiens
cactgcctgcagct

SEQ ID NO: 5381969 - DNA, 17 bp, Homo sapiens
cactgcctgcagctgag

SEQ ID NO: 5381970 - DNA, 17 bp, Homo sapiens
cactgcctgcatgagct

SEQ ID NO: 5381971 - DNA, 16 bp, Homo sapiens
cactgcctgccaagcg

SEQ ID NO: 5381972 - DNA, 17 bp, Homo sapiens
cactgcctgccaagcga

SEQ ID NO: 5381973 - DNA, 13 bp, Homo sapiens
cactgcctgcctc

SEQ ID NO: 5381974 - DNA, 23 bp, Homo sapiens
cactgcctgcctcccctccgcag

SEQ ID NO: 5381975 - DNA, 16 bp, Homo sapiens
cactgcctgccttaag

SEQ ID NO: 5381976 - DNA, 20 bp, Homo sapiens
cactgcctgccttaagtgag

SEQ ID NO: 5381977 - DNA, 20 bp, Homo sapiens
cactgcctgctcccatcctg

SEQ ID NO: 5381978 - DNA, 12 bp, Homo sapiens
cactgcctgggc

SEQ ID NO: 5381979 - DNA, 17 bp, Homo sapiens
cactgccttagcctctt

SEQ ID NO: 5381980 - DNA, 13 bp, Homo sapiens
cactgccttccag

SEQ ID NO: 5381981 - DNA, 15 bp, Homo sapiens
cactgccttccagga

SEQ ID NO: 5381982 - DNA, 18 bp, Homo sapiens
cactgccttccaggagca

SEQ ID NO: 5381983 - DNA, 20 bp, Homo sapiens
cactgccttcgatacaccgg

SEQ ID NO: 5381984 - DNA, 18 bp, Homo sapiens
cactgccttcgcttcttg

SEQ ID NO: 5381985 - DNA, 19 bp, Homo sapiens
cactgccttcgcttcttgc

SEQ ID NO: 5381986 - DNA, 23 bp, Homo sapiens
cactgccttcgcttcttgcctct

SEQ ID NO: 5381987 - DNA, 22 bp, Homo sapiens
cactgccttctcctctctgggc

SEQ ID NO: 5381988 - DNA, 15 bp, Homo sapiens
cactgccttggcccc

SEQ ID NO: 5381989 - DNA, 18 bp, Homo sapiens
cactgcctttgctgcctt

SEQ ID NO: 5381990 - DNA, 19 bp, Homo sapiens
cactgcctttgctgccttc

SEQ ID NO: 5381991 - DNA, 19 bp, Homo sapiens
cactgcctttttatttata

SEQ ID NO: 5381992 - DNA, 21 bp, Homo sapiens
cactgcgaactctcaggacta

SEQ ID NO: 5381993 - DNA, 17 bp, Homo sapiens
cactgcgatcaggaaga

SEQ ID NO: 5381994 - DNA, 15 bp, Homo sapiens
cactgcgcaggtctc

SEQ ID NO: 5381995 - DNA, 17 bp, Homo sapiens
cactgcgcaggtctctt

SEQ ID NO: 5381996 - DNA, 18 bp, Homo sapiens
cactgcgcaggtctcttc

SEQ ID NO: 5381997 - DNA, 15 bp, Homo sapiens
cactgcgccactgct

SEQ ID NO: 5381998 - DNA, 15 bp, Homo sapiens
cactgcgcccagcct

SEQ ID NO: 5381999 - DNA, 18 bp, Homo sapiens
cactgcgctttattttct

SEQ ID NO: 5382000 - DNA, 19 bp, Homo sapiens
cactgcggaacaggagtga

SEQ ID NO: 5382001 - DNA, 15 bp, Homo sapiens
cactgcggaagccaa

SEQ ID NO: 5382002 - DNA, 16 bp, Homo sapiens
cactgcggctgtctcc

SEQ ID NO: 5382003 - DNA, 17 bp, Homo sapiens
cactgcgggagctctgt

SEQ ID NO: 5382004 - DNA, 20 bp, Homo sapiens
cactgcgggagctctgtatg

SEQ ID NO: 5382005 - DNA, 22 bp, Homo sapiens
cactgcggtgtctgcagctcct

SEQ ID NO: 5382006 - DNA, 22 bp, Homo sapiens
cactgcgttttcctagctgtgt

SEQ ID NO: 5382007 - DNA, 15 bp, Homo sapiens
cactgctaaaataga

SEQ ID NO: 5382008 - DNA, 18 bp, Homo sapiens
cactgctaagaatatttg

SEQ ID NO: 5382009 - DNA, 17 bp, Homo sapiens
cactgctaaggctgctg

SEQ ID NO: 5382010 - DNA, 20 bp, Homo sapiens
cactgctaaggctgctggct

SEQ ID NO: 5382011 - DNA, 23 bp, Homo sapiens
cactgctaaggctgctggcttca

SEQ ID NO: 5382012 - DNA, 12 bp, Homo sapiens
cactgctaataa

SEQ ID NO: 5382013 - DNA, 13 bp, Homo sapiens
cactgctaataaa

SEQ ID NO: 5382014 - DNA, 16 bp, Homo sapiens
cactgctaataaatga

SEQ ID NO: 5382015 - DNA, 21 bp, Homo sapiens
cactgctaataaatgaccagt

SEQ ID NO: 5382016 - DNA, 21 bp, Homo sapiens
cactgctacaccttagcagct

SEQ ID NO: 5382017 - DNA, 22 bp, Homo sapiens
cactgctagagacgctgatcca

SEQ ID NO: 5382018 - DNA, 22 bp, Homo sapiens
cactgctaggcgagtgccagga

SEQ ID NO: 5382019 - DNA, 21 bp, Homo sapiens
cactgctaggggagagctctc

SEQ ID NO: 5382020 - DNA, 19 bp, Homo sapiens
cactgctcaagaagacatg

SEQ ID NO: 5382021 - DNA, 17 bp, Homo sapiens
cactgctcacgtctctg

SEQ ID NO: 5382022 - DNA, 18 bp, Homo sapiens
cactgctcacgtctctgc

SEQ ID NO: 5382023 - DNA, 19 bp, Homo sapiens
cactgctcacgtctctgcc

SEQ ID NO: 5382024 - DNA, 13 bp, Homo sapiens
cactgctcatttg

SEQ ID NO: 5382025 - DNA, 23 bp, Homo sapiens
cactgctcatttgagaactgtca

SEQ ID NO: 5382026 - DNA, 18 bp, Homo sapiens
cactgctccaagggacag

SEQ ID NO: 5382027 - DNA, 13 bp, Homo sapiens
cactgctccaggc

SEQ ID NO: 5382028 - DNA, 11 bp, Homo sapiens
cactgctccct

SEQ ID NO: 5382029 - DNA, 14 bp, Homo sapiens
cactgctccctgaa

SEQ ID NO: 5382030 - DNA, 17 bp, Homo sapiens
cactgctccctgaagcc

SEQ ID NO: 5382031 - DNA, 19 bp, Homo sapiens
cactgctcgtggactgtgc

SEQ ID NO: 5382032 - DNA, 19 bp, Homo sapiens
cactgctctaacagccctc

SEQ ID NO: 5382033 - DNA, 23 bp, Homo sapiens
cactgctctcaccttggttcctg

SEQ ID NO: 5382034 - DNA, 17 bp, Homo sapiens
cactgctctcagcctcc

SEQ ID NO: 5382035 - DNA, 18 bp, Homo sapiens
cactgctctcagcctccc

SEQ ID NO: 5382036 - DNA, 17 bp, Homo sapiens
cactgctctccagcctg

SEQ ID NO: 5382037 - DNA, 20 bp, Homo sapiens
cactgctctgatgaagagga

SEQ ID NO: 5382038 - DNA, 12 bp, Homo sapiens
cactgctctggt

SEQ ID NO: 5382039 - DNA, 18 bp, Homo sapiens
cactgctgaaaaagaaaa

SEQ ID NO: 5382040 - DNA, 22 bp, Homo sapiens
cactgctgaaaaagaaaaaaat

SEQ ID NO: 5382041 - DNA, 20 bp, Homo sapiens
cactgctgaagatgcccctg

SEQ ID NO: 5382042 - DNA, 13 bp, Homo sapiens
cactgctgagctg

SEQ ID NO: 5382043 - DNA, 14 bp, Homo sapiens
cactgctgagctgg

SEQ ID NO: 5382044 - DNA, 16 bp, Homo sapiens
cactgctgaggagtct

SEQ ID NO: 5382045 - DNA, 19 bp, Homo sapiens
cactgctgaggagtctgag

SEQ ID NO: 5382046 - DNA, 13 bp, Homo sapiens
cactgctgcacca

SEQ ID NO: 5382047 - DNA, 15 bp, Homo sapiens
cactgctgcaccaga

SEQ ID NO: 5382048 - DNA, 16 bp, Homo sapiens
cactgctgcaccagag

SEQ ID NO: 5382049 - DNA, 18 bp, Homo sapiens
cactgctgcaccagagtg

SEQ ID NO: 5382050 - DNA, 12 bp, Homo sapiens
cactgctgcctc

SEQ ID NO: 5382051 - DNA, 15 bp, Homo sapiens
cactgctgctactgc

SEQ ID NO: 5382052 - DNA, 16 bp, Homo sapiens
cactgtcctgctccac

SEQ ID NO: 5382053 - DNA, 20 bp, Homo sapiens
cactgtcctgctccacagtg

SEQ ID NO: 5382054 - DNA, 20 bp, Homo sapiens
cactgtcctggctgctctca

SEQ ID NO: 5382055 - DNA, 15 bp, Homo sapiens
cactgtcctggcttt

SEQ ID NO: 5382056 - DNA, 12 bp, Homo sapiens
cactgtcctggg

SEQ ID NO: 5382057 - DNA, 15 bp, Homo sapiens
cactgtcctgggcct

SEQ ID NO: 5382058 - DNA, 14 bp, Homo sapiens
cactgtcctgggcg

SEQ ID NO: 5382059 - DNA, 13 bp, Homo sapiens
cactgtcctgtga

SEQ ID NO: 5382060 - DNA, 14 bp, Homo sapiens
cactgtccttccct

SEQ ID NO: 5382061 - DNA, 20 bp, Homo sapiens
cactgtccttccctgccact

SEQ ID NO: 5382062 - DNA, 13 bp, Homo sapiens
cactgtcctttct

SEQ ID NO: 5382063 - DNA, 18 bp, Homo sapiens
cactgtcctttctccagg

SEQ ID NO: 5382064 - DNA, 18 bp, Homo sapiens
cactgtcgcccaggctgg

SEQ ID NO: 5382065 - DNA, 18 bp, Homo sapiens
cactgtctagctgtttca

SEQ ID NO: 5382066 - DNA, 20 bp, Homo sapiens
cactgtctcctggtctgtgc

SEQ ID NO: 5382067 - DNA, 10 bp, Homo sapiens
cactgtctga

SEQ ID NO: 5382068 - DNA, 13 bp, Homo sapiens
cactgtctgcgtg

SEQ ID NO: 5382069 - DNA, 16 bp, Homo sapiens
cactgtctgcgtgact

SEQ ID NO: 5382070 - DNA, 22 bp, Homo sapiens
cactgtctgcgtgactattttt

SEQ ID NO: 5382071 - DNA, 10 bp, Homo sapiens
cactgtctgt

SEQ ID NO: 5382072 - DNA, 22 bp, Homo sapiens
cactgtctgtacctaaagcaat

SEQ ID NO: 5382073 - DNA, 13 bp, Homo sapiens
cactgtctgtctg

SEQ ID NO: 5382074 - DNA, 18 bp, Homo sapiens
cactgtctgttctgcaca

SEQ ID NO: 5382075 - DNA, 21 bp, Homo sapiens
cactgtctgttgtttacctac

SEQ ID NO: 5382076 - DNA, 14 bp, Homo sapiens
cactgtcttcttca

SEQ ID NO: 5382077 - DNA, 17 bp, Homo sapiens
cactgtcttttaaaaaa

SEQ ID NO: 5382078 - DNA, 14 bp, Homo sapiens
cactgtctttttct

SEQ ID NO: 5382079 - DNA, 21 bp, Homo sapiens
cactgtgaaagttggaatatg

SEQ ID NO: 5382080 - DNA, 16 bp, Homo sapiens
cactgtgaacattttt

SEQ ID NO: 5382081 - DNA, 22 bp, Homo sapiens
cactgtgaactcaatctccagg

SEQ ID NO: 5382082 - DNA, 13 bp, Homo sapiens
cactgtgaagagc

SEQ ID NO: 5382083 - DNA, 14 bp, Homo sapiens
cactgtgaaggacc

SEQ ID NO: 5382084 - DNA, 20 bp, Homo sapiens
cactgtgaatcctggcaaga

SEQ ID NO: 5382085 - DNA, 15 bp, Homo sapiens
cactgtgacacacta

SEQ ID NO: 5382086 - DNA, 20 bp, Homo sapiens
cactgtgacaccagaataat

SEQ ID NO: 5382087 - DNA, 14 bp, Homo sapiens
cactgtgaccaggc

SEQ ID NO: 5382088 - DNA, 19 bp, Homo sapiens
cactgtgacccccagctcc

SEQ ID NO: 5382089 - DNA, 22 bp, Homo sapiens
cactgtgacccccagctccggc

SEQ ID NO: 5382090 - DNA, 23 bp, Homo sapiens
cactgtgacccccagctccggcc

SEQ ID NO: 5382091 - DNA, 15 bp, Homo sapiens
cactgtgaccctggg

SEQ ID NO: 5382092 - DNA, 14 bp, Homo sapiens
cactgtgacctgct

SEQ ID NO: 5382093 - DNA, 22 bp, Homo sapiens
cactgtgacctgctcctgccca

SEQ ID NO: 5382094 - DNA, 17 bp, Homo sapiens
cactgtgagctcccagg

SEQ ID NO: 5382095 - DNA, 22 bp, Homo sapiens
cactgtgagctcccaggtgcag

SEQ ID NO: 5382096 - DNA, 18 bp, Homo sapiens
cactgtgatacagttttg

SEQ ID NO: 5382097 - DNA, 20 bp, Homo sapiens
cactgtgatacagttttgag

SEQ ID NO: 5382098 - DNA, 21 bp, Homo sapiens
cactgtgatcaatatttttat

SEQ ID NO: 5382099 - DNA, 22 bp, Homo sapiens
cactgtgattactctttgcttt

SEQ ID NO: 5382100 - DNA, 16 bp, Homo sapiens
cactgtgatttatctt

SEQ ID NO: 5382101 - DNA, 13 bp, Homo sapiens
cactgtgcactgc

SEQ ID NO: 5382102 - DNA, 14 bp, Homo sapiens
cactgtgcactgcc

SEQ ID NO: 5382103 - DNA, 14 bp, Homo sapiens
cactgtgcacttag

SEQ ID NO: 5382104 - DNA, 12 bp, Homo sapiens
cactgtgcagac

SEQ ID NO: 5382105 - DNA, 12 bp, Homo sapiens
cactgtgcagcc

SEQ ID NO: 5382106 - DNA, 17 bp, Homo sapiens
cactgtgcagccgggga

SEQ ID NO: 5382107 - DNA, 17 bp, Homo sapiens
cactgtgcaggcccagg

SEQ ID NO: 5382108 - DNA, 22 bp, Homo sapiens
cactgtgcaggtgctattgtta

SEQ ID NO: 5382109 - DNA, 15 bp, Homo sapiens
cactgtgccatgtgc

SEQ ID NO: 5382110 - DNA, 18 bp, Homo sapiens
cactgtgccatgtgccag

SEQ ID NO: 5382111 - DNA, 22 bp, Homo sapiens
cactgtgcccagcccggacctt

SEQ ID NO: 5382112 - DNA, 13 bp, Homo sapiens
cactgtgccccac

SEQ ID NO: 5382113 - DNA, 17 bp, Homo sapiens
cactgtgccctggtgga

SEQ ID NO: 5382114 - DNA, 18 bp, Homo sapiens
cactgtgccctggtggag

SEQ ID NO: 5382115 - DNA, 17 bp, Homo sapiens
cactgtgccttttcccc

SEQ ID NO: 5382116 - DNA, 22 bp, Homo sapiens
cactgtgcgtcttggtgtaatt

SEQ ID NO: 5382117 - DNA, 22 bp, Homo sapiens
cactgtgcgtggggctcccgcc

SEQ ID NO: 5382118 - DNA, 18 bp, Homo sapiens
cactgtgcgttttagagt

SEQ ID NO: 5382119 - DNA, 19 bp, Homo sapiens
cactgtgctaataacagtg

SEQ ID NO: 5382120 - DNA, 13 bp, Homo sapiens
cactgtgctcagg

SEQ ID NO: 5382121 - DNA, 22 bp, Homo sapiens
cactgtgctgagtctgaaggct

SEQ ID NO: 5382122 - DNA, 15 bp, Homo sapiens
cactgtgctggggca

SEQ ID NO: 5382123 - DNA, 15 bp, Homo sapiens
cactgtgctgttgtt

SEQ ID NO: 5382124 - DNA, 21 bp, Homo sapiens
cactgtgctgttgttatgatg

SEQ ID NO: 5382125 - DNA, 19 bp, Homo sapiens
cactgtgcttacagtgact

SEQ ID NO: 5382126 - DNA, 17 bp, Homo sapiens
cactgtgctttctattg

SEQ ID NO: 5382127 - DNA, 23 bp, Homo sapiens
cactgtgctttctattgtacaga

SEQ ID NO: 5382128 - DNA, 14 bp, Homo sapiens
cactgtggaacact

SEQ ID NO: 5382129 - DNA, 19 bp, Homo sapiens
cactgtggaactaataaat

SEQ ID NO: 5382130 - DNA, 20 bp, Homo sapiens
cactgtggaactaataaata

SEQ ID NO: 5382131 - DNA, 16 bp, Homo sapiens
cactgtggaactgcca

SEQ ID NO: 5382132 - DNA, 17 bp, Homo sapiens
cactgtggaactgccac

SEQ ID NO: 5382133 - DNA, 18 bp, Homo sapiens
cactgtggaactgccacc

SEQ ID NO: 5382134 - DNA, 21 bp, Homo sapiens
cactgtggaactgctattttc

SEQ ID NO: 5382135 - DNA, 16 bp, Homo sapiens
cactgtggaagtccct

SEQ ID NO: 5382136 - DNA, 19 bp, Homo sapiens
cactgtggaagtccctcag

SEQ ID NO: 5382137 - DNA, 23 bp, Homo sapiens
cactgtggacttggtcaccagct

SEQ ID NO: 5382138 - DNA, 17 bp, Homo sapiens
cactgtggcactgccac

SEQ ID NO: 5382139 - DNA, 19 bp, Homo sapiens
cactgtggcactgccacca

SEQ ID NO: 5382140 - DNA, 15 bp, Homo sapiens
cactgtggcagcagg

SEQ ID NO: 5382141 - DNA, 18 bp, Homo sapiens
cactgtggcagcaggagg

SEQ ID NO: 5382142 - DNA, 12 bp, Homo sapiens
cactgtggccac

SEQ ID NO: 5382143 - DNA, 15 bp, Homo sapiens
cactgtggccacagc

SEQ ID NO: 5382144 - DNA, 16 bp, Homo sapiens
cactgtggccacagcc

SEQ ID NO: 5382145 - DNA, 19 bp, Homo sapiens
cactgtggccacagccccc

SEQ ID NO: 5382146 - DNA, 16 bp, Homo sapiens
cactgtggccagagct

SEQ ID NO: 5382147 - DNA, 19 bp, Homo sapiens
cactgtggccagagctgga

SEQ ID NO: 5382148 - DNA, 14 bp, Homo sapiens
cactgtggccttct

SEQ ID NO: 5382149 - DNA, 16 bp, Homo sapiens
cactgtggccttctca

SEQ ID NO: 5382150 - DNA, 18 bp, Homo sapiens
cactgtggccttctcagc

SEQ ID NO: 5382151 - DNA, 19 bp, Homo sapiens
cactgtggccttctcagcc

SEQ ID NO: 5382152 - DNA, 19 bp, Homo sapiens
cactgtggcgttctgctgc

SEQ ID NO: 5382153 - DNA, 14 bp, Homo sapiens
cactgtgggaaggc

SEQ ID NO: 5382154 - DNA, 16 bp, Homo sapiens
cactgtgggactcttc

SEQ ID NO: 5382155 - DNA, 19 bp, Homo sapiens
cactgtgggtagacacaca

SEQ ID NO: 5382156 - DNA, 22 bp, Homo sapiens
cactgtgggtctgactttctct

SEQ ID NO: 5382157 - DNA, 15 bp, Homo sapiens
cactgtgggtgtgtg

SEQ ID NO: 5382158 - DNA, 20 bp, Homo sapiens
cactgtgggtgtgtgactct

SEQ ID NO: 5382159 - DNA, 19 bp, Homo sapiens
cactgtggtaaatgccaca

SEQ ID NO: 5382160 - DNA, 16 bp, Homo sapiens
cactgtggtcaggccc

SEQ ID NO: 5382161 - DNA, 18 bp, Homo sapiens
cactgtggtcaggcccag

SEQ ID NO: 5382162 - DNA, 17 bp, Homo sapiens
cactgtgtacacctcaa

SEQ ID NO: 5382163 - DNA, 17 bp, Homo sapiens
cactgtgtataggaatt

SEQ ID NO: 5382164 - DNA, 15 bp, Homo sapiens
cactgtgtatttaac

SEQ ID NO: 5382165 - DNA, 15 bp, Homo sapiens
cactgtgtcacatca

SEQ ID NO: 5382166 - DNA, 11 bp, Homo sapiens
cactgtgtccc

SEQ ID NO: 5382167 - DNA, 23 bp, Homo sapiens
cactgtgtcccagtgtctggccc

SEQ ID NO: 5382168 - DNA, 13 bp, Homo sapiens
cactgtgtctcta

SEQ ID NO: 5382169 - DNA, 21 bp, Homo sapiens
cactgtgtctctatgtgaata

SEQ ID NO: 5382170 - DNA, 14 bp, Homo sapiens
cactgtgtctctgt

SEQ ID NO: 5382171 - DNA, 17 bp, Homo sapiens
cactgtgtctctgtttc

SEQ ID NO: 5382172 - DNA, 20 bp, Homo sapiens
cactgtgtctctgtttcctg

SEQ ID NO: 5382173 - DNA, 21 bp, Homo sapiens
cactgtgtctctgtttcctga

SEQ ID NO: 5382174 - DNA, 13 bp, Homo sapiens
cactgtgtgaatc

SEQ ID NO: 5382175 - DNA, 18 bp, Homo sapiens
cactgtgtgaggctgtgt

SEQ ID NO: 5382176 - DNA, 20 bp, Homo sapiens
cactgtgtgaggctgtgtct

SEQ ID NO: 5382177 - DNA, 21 bp, Homo sapiens
cactgtgtgaggctgtgtctc

SEQ ID NO: 5382178 - DNA, 20 bp, Homo sapiens
cactgtgtggccctggacaa

SEQ ID NO: 5382179 - DNA, 13 bp, Homo sapiens
cactgtgtgttga

SEQ ID NO: 5382180 - DNA, 17 bp, Homo sapiens
cactgtgtgttgacact

SEQ ID NO: 5382181 - DNA, 20 bp, Homo sapiens
cactgtgttactgctttgca

SEQ ID NO: 5382182 - DNA, 15 bp, Homo sapiens
cactgtgttccttcc

SEQ ID NO: 5382183 - DNA, 17 bp, Homo sapiens
cactgtgttccttccgc

SEQ ID NO: 5382184 - DNA, 22 bp, Homo sapiens
cactgtgttggccaggctggtc

SEQ ID NO: 5382185 - DNA, 20 bp, Homo sapiens
cactgtgtttatatgtcttg

SEQ ID NO: 5382186 - DNA, 17 bp, Homo sapiens
cactgtgtttctgtgct

SEQ ID NO: 5382187 - DNA, 18 bp, Homo sapiens
cactgtgtttctgtgctc

SEQ ID NO: 5382188 - DNA, 23 bp, Homo sapiens
cactgtgtttttttttttttccc

SEQ ID NO: 5382189 - DNA, 15 bp, Homo sapiens
cactgttaaaataaa

SEQ ID NO: 5382190 - DNA, 17 bp, Homo sapiens
cactgttaaaataaagc

SEQ ID NO: 5382191 - DNA, 21 bp, Homo sapiens
cactgttaatacacagtactt

SEQ ID NO: 5382192 - DNA, 21 bp, Homo sapiens
cactgttaatcatgggttcct

SEQ ID NO: 5382193 - DNA, 18 bp, Homo sapiens
cactgttactccacagcg

SEQ ID NO: 5382194 - DNA, 23 bp, Homo sapiens
cactgttactttcgtacattggc

SEQ ID NO: 5382195 - DNA, 17 bp, Homo sapiens
cactgttagaacactat

SEQ ID NO: 5382196 - DNA, 18 bp, Homo sapiens
cactgttagaacactatt

SEQ ID NO: 5382197 - DNA, 22 bp, Homo sapiens
cactgttagctttttaaaacat

SEQ ID NO: 5382198 - DNA, 23 bp, Homo sapiens
cactgttagctttttaaaacatt

SEQ ID NO: 5382199 - DNA, 15 bp, Homo sapiens
cactgttataaattt

SEQ ID NO: 5382200 - DNA, 23 bp, Homo sapiens
cactgttataaattttgtacatt

SEQ ID NO: 5382201 - DNA, 20 bp, Homo sapiens
cactgttatcacctatcctg

SEQ ID NO: 5382202 - DNA, 14 bp, Homo sapiens
cactgttattttca

SEQ ID NO: 5382203 - DNA, 21 bp, Homo sapiens
cactgttcacaaaggttttgt

SEQ ID NO: 5382204 - DNA, 14 bp, Homo sapiens
cactgttcatgctg

SEQ ID NO: 5382205 - DNA, 16 bp, Homo sapiens
cactgttcatgctggc

SEQ ID NO: 5382206 - DNA, 19 bp, Homo sapiens
cactgttccccctgtgcag

SEQ ID NO: 5382207 - DNA, 13 bp, Homo sapiens
cactgttccctct

SEQ ID NO: 5382208 - DNA, 16 bp, Homo sapiens
cactgttccctctgct

SEQ ID NO: 5382209 - DNA, 22 bp, Homo sapiens
cactgttccctctgctcctgga

SEQ ID NO: 5382210 - DNA, 21 bp, Homo sapiens
cactgttctcccttcggtgga

SEQ ID NO: 5382211 - DNA, 17 bp, Homo sapiens
cactgttctctgccctc

SEQ ID NO: 5382212 - DNA, 21 bp, Homo sapiens
cactgttctctgccctccaag

SEQ ID NO: 5382213 - DNA, 21 bp, Homo sapiens
cactgttctgaaaggagacat

SEQ ID NO: 5382214 - DNA, 11 bp, Homo sapiens
cactgttctgc

SEQ ID NO: 5382215 - DNA, 15 bp, Homo sapiens
cactgttctgcaaag

SEQ ID NO: 5382216 - DNA, 15 bp, Homo sapiens
cactgttctgggact

SEQ ID NO: 5382217 - DNA, 21 bp, Homo sapiens
cactgttctgggactccaggt

SEQ ID NO: 5382218 - DNA, 21 bp, Homo sapiens
cactgttctgttcatttccta

SEQ ID NO: 5382219 - DNA, 21 bp, Homo sapiens
cactgttcttagctcaatgag

SEQ ID NO: 5382220 - DNA, 23 bp, Homo sapiens
cactgttcttagctcaatgagca

SEQ ID NO: 5382221 - DNA, 14 bp, Homo sapiens
cactgttgaaaatt

SEQ ID NO: 5382222 - DNA, 16 bp, Homo sapiens
cactgttgaaaattat

SEQ ID NO: 5382223 - DNA, 22 bp, Homo sapiens
cactgttgagaccttgtggtct

SEQ ID NO: 5382224 - DNA, 19 bp, Homo sapiens
cactgttgagccccagtgc

SEQ ID NO: 5382225 - DNA, 15 bp, Homo sapiens
cactgttgcccaggc

SEQ ID NO: 5382226 - DNA, 17 bp, Homo sapiens
cactgttgcccaggctg

SEQ ID NO: 5382227 - DNA, 17 bp, Homo sapiens
cactgttgcttaattgt

SEQ ID NO: 5382228 - DNA, 16 bp, Homo sapiens
cactgttgctttgaaa

SEQ ID NO: 5382229 - DNA, 21 bp, Homo sapiens
cacttccacctccagcctctg

SEQ ID NO: 5382230 - DNA, 14 bp, Homo sapiens
cacttccagagggg

SEQ ID NO: 5382231 - DNA, 18 bp, Homo sapiens
cacttccagagggggcca

SEQ ID NO: 5382232 - DNA, 18 bp, Homo sapiens
cacttccagatatccaca

SEQ ID NO: 5382233 - DNA, 20 bp, Homo sapiens
cacttccaggggaacctgcc

SEQ ID NO: 5382234 - DNA, 13 bp, Homo sapiens
cacttccagggtt

SEQ ID NO: 5382235 - DNA, 17 bp, Homo sapiens
cacttccaggtctgcct

SEQ ID NO: 5382236 - DNA, 18 bp, Homo sapiens
cacttccaggtctgcctg

SEQ ID NO: 5382237 - DNA, 18 bp, Homo sapiens
cacttccagtctggagag

SEQ ID NO: 5382238 - DNA, 20 bp, Homo sapiens
cacttccagtgttggctgtg

SEQ ID NO: 5382239 - DNA, 23 bp, Homo sapiens
cacttccagtgttggctgtgtga

SEQ ID NO: 5382240 - DNA, 13 bp, Homo sapiens
cacttccatggga

SEQ ID NO: 5382241 - DNA, 22 bp, Homo sapiens
cacttccattgtattgtctgac

SEQ ID NO: 5382242 - DNA, 23 bp, Homo sapiens
cacttcccaggtaagcaggagga

SEQ ID NO: 5382243 - DNA, 22 bp, Homo sapiens
cacttcccaggttcaagcgatt

SEQ ID NO: 5382244 - DNA, 18 bp, Homo sapiens
cacttcccatctccaggg

SEQ ID NO: 5382245 - DNA, 19 bp, Homo sapiens
cacttcccatttgtgtttc

SEQ ID NO: 5382246 - DNA, 21 bp, Homo sapiens
cacttccccaagatctgccag

SEQ ID NO: 5382247 - DNA, 18 bp, Homo sapiens
cacttccccatctgtgtg

SEQ ID NO: 5382248 - DNA, 23 bp, Homo sapiens
cacttccccttgggatgggcaca

SEQ ID NO: 5382249 - DNA, 16 bp, Homo sapiens
cacttcccgtctcaga

SEQ ID NO: 5382250 - DNA, 16 bp, Homo sapiens
cacttcccgtttcctc

SEQ ID NO: 5382251 - DNA, 17 bp, Homo sapiens
cacttcccgtttcctct

SEQ ID NO: 5382252 - DNA, 16 bp, Homo sapiens
cacttccctctgtttc

SEQ ID NO: 5382253 - DNA, 13 bp, Homo sapiens
cacttccctgcaa

SEQ ID NO: 5382254 - DNA, 14 bp, Homo sapiens
cacttccctgctgc

SEQ ID NO: 5382255 - DNA, 15 bp, Homo sapiens
cacttccctgctgcc

SEQ ID NO: 5382256 - DNA, 16 bp, Homo sapiens
cacttccctgctgcct

SEQ ID NO: 5382257 - DNA, 11 bp, Homo sapiens
cacttccctgg

SEQ ID NO: 5382258 - DNA, 12 bp, Homo sapiens
cacttccctggc

SEQ ID NO: 5382259 - DNA, 18 bp, Homo sapiens
cacttccctgggaactca

SEQ ID NO: 5382260 - DNA, 13 bp, Homo sapiens
cacttccctgggc

SEQ ID NO: 5382261 - DNA, 19 bp, Homo sapiens
cacttccctgggcaaatga

SEQ ID NO: 5382262 - DNA, 15 bp, Homo sapiens
cacttccctgggcct

SEQ ID NO: 5382263 - DNA, 19 bp, Homo sapiens
cacttcctaagttcccttc

SEQ ID NO: 5382264 - DNA, 23 bp, Homo sapiens
cacttcctacaagagcagcctgt

SEQ ID NO: 5382265 - DNA, 19 bp, Homo sapiens
cacttcctccagaagcctc

SEQ ID NO: 5382266 - DNA, 13 bp, Homo sapiens
cacttcctcctac

SEQ ID NO: 5382267 - DNA, 15 bp, Homo sapiens
cacttcctcctacct

SEQ ID NO: 5382268 - DNA, 17 bp, Homo sapiens
cacttcctcctacctgg

SEQ ID NO: 5382269 - DNA, 14 bp, Homo sapiens
cacttcctcgctct

SEQ ID NO: 5382270 - DNA, 13 bp, Homo sapiens
cacttcctctcca

SEQ ID NO: 5382271 - DNA, 16 bp, Homo sapiens
cacttcctctccacag

SEQ ID NO: 5382272 - DNA, 18 bp, Homo sapiens
cacttcctctccacagga

SEQ ID NO: 5382273 - DNA, 20 bp, Homo sapiens
cacttcctctccacaggagc

SEQ ID NO: 5382274 - DNA, 15 bp, Homo sapiens
cacttcctgaggcct

SEQ ID NO: 5382275 - DNA, 13 bp, Homo sapiens
cacttcctgccta

SEQ ID NO: 5382276 - DNA, 15 bp, Homo sapiens
cacttcctgctacag

SEQ ID NO: 5382277 - DNA, 14 bp, Homo sapiens
cacttcctgtccag

SEQ ID NO: 5382278 - DNA, 17 bp, Homo sapiens
cacttcctgtccagaga

SEQ ID NO: 5382279 - DNA, 18 bp, Homo sapiens
cacttcctgtccagagag

SEQ ID NO: 5382280 - DNA, 15 bp, Homo sapiens
cacttcctgtccttg

SEQ ID NO: 5382281 - DNA, 16 bp, Homo sapiens
cacttcctgtccttgt

SEQ ID NO: 5382282 - DNA, 18 bp, Homo sapiens
cacttcctgttggaaggt

SEQ ID NO: 5382283 - DNA, 15 bp, Homo sapiens
cacttcctgttttaa

SEQ ID NO: 5382284 - DNA, 17 bp, Homo sapiens
cacttcctgttttataa

SEQ ID NO: 5382285 - DNA, 20 bp, Homo sapiens
cacttccttaacagctgtat

SEQ ID NO: 5382286 - DNA, 17 bp, Homo sapiens
cacttccttcagcatct

SEQ ID NO: 5382287 - DNA, 20 bp, Homo sapiens
cacttcctttgcccttcctc

SEQ ID NO: 5382288 - DNA, 22 bp, Homo sapiens
cacttcctttgcccttcctcct

SEQ ID NO: 5382289 - DNA, 13 bp, Homo sapiens
cacttcgcacaca

SEQ ID NO: 5382290 - DNA, 21 bp, Homo sapiens
cacttcgcgtgccctcgctgc

SEQ ID NO: 5382291 - DNA, 15 bp, Homo sapiens
cacttcgcttcctgg

SEQ ID NO: 5382292 - DNA, 18 bp, Homo sapiens
cacttcggataattttca

SEQ ID NO: 5382293 - DNA, 19 bp, Homo sapiens
cacttcggataattttcat

SEQ ID NO: 5382294 - DNA, 19 bp, Homo sapiens
cacttcgttcgcagagctt

SEQ ID NO: 5382295 - DNA, 20 bp, Homo sapiens
cacttcgttcgcagagcttt

SEQ ID NO: 5382296 - DNA, 21 bp, Homo sapiens
cacttctaaattaatggtaaa

SEQ ID NO: 5382297 - DNA, 21 bp, Homo sapiens
cacttctaagttgagtatatt

SEQ ID NO: 5382298 - DNA, 19 bp, Homo sapiens
cacttctacgcataaacta

SEQ ID NO: 5382299 - DNA, 12 bp, Homo sapiens
cacttctagaat

SEQ ID NO: 5382300 - DNA, 17 bp, Homo sapiens
cacttctatttatttat

SEQ ID NO: 5382301 - DNA, 19 bp, Homo sapiens
cacttctcaggacacaggc

SEQ ID NO: 5382302 - DNA, 21 bp, Homo sapiens
cacttctcaggacacaggcct

SEQ ID NO: 5382303 - DNA, 22 bp, Homo sapiens
cacttctcaggacacaggcctg

SEQ ID NO: 5382304 - DNA, 23 bp, Homo sapiens
cacttctcaggacacaggcctgt

SEQ ID NO: 5382305 - DNA, 13 bp, Homo sapiens
cacttctccaaga

SEQ ID NO: 5382306 - DNA, 14 bp, Homo sapiens
cacttctccatgct

SEQ ID NO: 5382307 - DNA, 19 bp, Homo sapiens
cacttctccccgcagcccg

SEQ ID NO: 5382308 - DNA, 21 bp, Homo sapiens
cacttctcctgctgctcctgt

SEQ ID NO: 5382309 - DNA, 14 bp, Homo sapiens
cacttctccttaac

SEQ ID NO: 5382310 - DNA, 18 bp, Homo sapiens
cacttctctactctggaa

SEQ ID NO: 5382311 - DNA, 22 bp, Homo sapiens
cacttctctccaggctgtttct

SEQ ID NO: 5382312 - DNA, 16 bp, Homo sapiens
cacttctctgctgcct

SEQ ID NO: 5382313 - DNA, 17 bp, Homo sapiens
cacttctctgctgcctc

SEQ ID NO: 5382314 - DNA, 13 bp, Homo sapiens
cacttctgaccac

SEQ ID NO: 5382315 - DNA, 21 bp, Homo sapiens
cacttctgaccttgctgccac

SEQ ID NO: 5382316 - DNA, 17 bp, Homo sapiens
cacttctgactcttccc

SEQ ID NO: 5382317 - DNA, 11 bp, Homo sapiens
cacttctgcac

SEQ ID NO: 5382318 - DNA, 17 bp, Homo sapiens
cacttctgccagatgtc

SEQ ID NO: 5382319 - DNA, 19 bp, Homo sapiens
cacttctgcgggctccctc

SEQ ID NO: 5382320 - DNA, 20 bp, Homo sapiens
cacttctgcgggctccctcc

SEQ ID NO: 5382321 - DNA, 12 bp, Homo sapiens
cacttctgcttt

SEQ ID NO: 5382322 - DNA, 14 bp, Homo sapiens
cacttctgctttca

SEQ ID NO: 5382323 - DNA, 13 bp, Homo sapiens
cacttctggccac

SEQ ID NO: 5382324 - DNA, 19 bp, Homo sapiens
cacttctggcctccagcct

SEQ ID NO: 5382325 - DNA, 16 bp, Homo sapiens
cacttctgggccctag

SEQ ID NO: 5382326 - DNA, 20 bp, Homo sapiens
cacttctgggcttcatctgg

SEQ ID NO: 5382327 - DNA, 14 bp, Homo sapiens
cacttctggggcca

SEQ ID NO: 5382328 - DNA, 20 bp, Homo sapiens
cacttctggggccagcccct

SEQ ID NO: 5382329 - DNA, 13 bp, Homo sapiens
cacttctgtaaac

SEQ ID NO: 5382330 - DNA, 16 bp, Homo sapiens
cacttctgtatgcatc

SEQ ID NO: 5382331 - DNA, 14 bp, Homo sapiens
cacttctgtcctgt

SEQ ID NO: 5382332 - DNA, 13 bp, Homo sapiens
cacttctgtctcc

SEQ ID NO: 5382333 - DNA, 15 bp, Homo sapiens
cacttctgtctcctg

SEQ ID NO: 5382334 - DNA, 20 bp, Homo sapiens
cacttctgtgagacccccac

SEQ ID NO: 5382335 - DNA, 21 bp, Homo sapiens
cacttctgtgagacccccaca

SEQ ID NO: 5382336 - DNA, 13 bp, Homo sapiens
cacttctgtgggc

SEQ ID NO: 5382337 - DNA, 15 bp, Homo sapiens
cacttctgtgggcat

SEQ ID NO: 5382338 - DNA, 20 bp, Homo sapiens
cacttctgtgggcatggccg

SEQ ID NO: 5382339 - DNA, 22 bp, Homo sapiens
cacttctgtgggcatggccgct

SEQ ID NO: 5382340 - DNA, 12 bp, Homo sapiens
cacttctgtgta

SEQ ID NO: 5382341 - DNA, 13 bp, Homo sapiens
cacttctgttatc

SEQ ID NO: 5382342 - DNA, 13 bp, Homo sapiens
cacttctgtttag

SEQ ID NO: 5382343 - DNA, 17 bp, Homo sapiens
cacttcttaaatacaat

SEQ ID NO: 5382344 - DNA, 14 bp, Homo sapiens
cacttcttaaggac

SEQ ID NO: 5382345 - DNA, 21 bp, Homo sapiens
cacttcttccactgtgtgttg

SEQ ID NO: 5382346 - DNA, 15 bp, Homo sapiens
cacttcttcctattg

SEQ ID NO: 5382347 - DNA, 12 bp, Homo sapiens
cacttcttctgt

SEQ ID NO: 5382348 - DNA, 23 bp, Homo sapiens
cacttcttcttggtcttatttat

SEQ ID NO: 5382349 - DNA, 15 bp, Homo sapiens
cacttcttgaaacag

SEQ ID NO: 5382350 - DNA, 18 bp, Homo sapiens
cacttcttgaaacagcct

SEQ ID NO: 5382351 - DNA, 19 bp, Homo sapiens
cacttcttggttcctggga

SEQ ID NO: 5382352 - DNA, 22 bp, Homo sapiens
cacttctttatactctcttccc

SEQ ID NO: 5382353 - DNA, 13 bp, Homo sapiens
cacttctttccct

SEQ ID NO: 5382354 - DNA, 18 bp, Homo sapiens
cacttctttgcagagcct

SEQ ID NO: 5382355 - DNA, 19 bp, Homo sapiens
cacttctttgcagagcctt

SEQ ID NO: 5382356 - DNA, 15 bp, Homo sapiens
cacttcttttgaaca

SEQ ID NO: 5382357 - DNA, 16 bp, Homo sapiens
cacttcttttgaacat

SEQ ID NO: 5382358 - DNA, 22 bp, Homo sapiens
cacttgaacaaaatctgttgcc

SEQ ID NO: 5382359 - DNA, 20 bp, Homo sapiens
cacttgaagcctaaatttgt

SEQ ID NO: 5382360 - DNA, 19 bp, Homo sapiens
cacttgacaccaaccagac

SEQ ID NO: 5382361 - DNA, 16 bp, Homo sapiens
cacttgacatcaactg

SEQ ID NO: 5382362 - DNA, 20 bp, Homo sapiens
cacttgagaaccagtctcct

SEQ ID NO: 5382363 - DNA, 13 bp, Homo sapiens
cacttgagagaaa

SEQ ID NO: 5382364 - DNA, 23 bp, Homo sapiens
cacttgaggaggagctggcctgc

SEQ ID NO: 5382365 - DNA, 22 bp, Homo sapiens
cacttgaggtcaggagttccta

SEQ ID NO: 5382366 - DNA, 13 bp, Homo sapiens
cacttgagtccag

SEQ ID NO: 5382367 - DNA, 14 bp, Homo sapiens
cacttgagttggct

SEQ ID NO: 5382368 - DNA, 16 bp, Homo sapiens
cacttgagttggctgt

SEQ ID NO: 5382369 - DNA, 16 bp, Homo sapiens
cacttgatatttatta

SEQ ID NO: 5382370 - DNA, 18 bp, Homo sapiens
cacttgatgccaggagtt

SEQ ID NO: 5382371 - DNA, 17 bp, Homo sapiens
cacttgatgtctgagga

SEQ ID NO: 5382372 - DNA, 19 bp, Homo sapiens
cacttgatgtgatgtggca

SEQ ID NO: 5382373 - DNA, 14 bp, Homo sapiens
cacttgatgtttcc

SEQ ID NO: 5382374 - DNA, 17 bp, Homo sapiens
cacttgatgtttcctgg

SEQ ID NO: 5382375 - DNA, 18 bp, Homo sapiens
cacttgatgtttcctgga

SEQ ID NO: 5382376 - DNA, 20 bp, Homo sapiens
cacttgatgtttcctggaag

SEQ ID NO: 5382377 - DNA, 21 bp, Homo sapiens
cacttgatgtttcctggaagc

SEQ ID NO: 5382378 - DNA, 22 bp, Homo sapiens
cacttgatgtttcctggaagca

SEQ ID NO: 5382379 - DNA, 18 bp, Homo sapiens
cacttgattcaggaggtc

SEQ ID NO: 5382380 - DNA, 14 bp, Homo sapiens
cacttgattccttg

SEQ ID NO: 5382381 - DNA, 14 bp, Homo sapiens
cacttgcaaatgaa

SEQ ID NO: 5382382 - DNA, 12 bp, Homo sapiens
cacttgcaacct

SEQ ID NO: 5382383 - DNA, 13 bp, Homo sapiens
cacttgcactgtg

SEQ ID NO: 5382384 - DNA, 16 bp, Homo sapiens
cacttgcactgtgctt

SEQ ID NO: 5382385 - DNA, 13 bp, Homo sapiens
cacttgcagactc

SEQ ID NO: 5382386 - DNA, 14 bp, Homo sapiens
cacttgcagactct

SEQ ID NO: 5382387 - DNA, 13 bp, Homo sapiens
cacttgcagagga

SEQ ID NO: 5382388 - DNA, 17 bp, Homo sapiens
cacttgcaggggtccct

SEQ ID NO: 5382389 - DNA, 12 bp, Homo sapiens
cacttgcatttc

SEQ ID NO: 5382390 - DNA, 13 bp, Homo sapiens
cacttgcatttga

SEQ ID NO: 5382391 - DNA, 16 bp, Homo sapiens
cacttgccaaaatcca

SEQ ID NO: 5382392 - DNA, 23 bp, Homo sapiens
cacttgccacatggtgtctccca

SEQ ID NO: 5382393 - DNA, 14 bp, Homo sapiens
cacttgccagggct

SEQ ID NO: 5382394 - DNA, 21 bp, Homo sapiens
cacttgccagggctctggggg

SEQ ID NO: 5382395 - DNA, 22 bp, Homo sapiens
cacttgccagggctctgggggc

SEQ ID NO: 5382396 - DNA, 13 bp, Homo sapiens
cacttgccatgca

SEQ ID NO: 5382397 - DNA, 15 bp, Homo sapiens
cacttgccatgcagg

SEQ ID NO: 5382398 - DNA, 16 bp, Homo sapiens
cacttgccatgcagga

SEQ ID NO: 5382399 - DNA, 17 bp, Homo sapiens
cacttgccatgcaggaa

SEQ ID NO: 5382400 - DNA, 23 bp, Homo sapiens
cacttgccatgcaggaagaggcc

SEQ ID NO: 5382401 - DNA, 22 bp, Homo sapiens
cacttgccctgtgttctttccc

SEQ ID NO: 5382402 - DNA, 22 bp, Homo sapiens
cacttgccctgttctcttcaca

SEQ ID NO: 5382403 - DNA, 15 bp, Homo sapiens
cacttgcctggggcg

SEQ ID NO: 5382404 - DNA, 19 bp, Homo sapiens
cacttgcctgtcaccccag

SEQ ID NO: 5382405 - DNA, 22 bp, Homo sapiens
cacttgcctgttggctgctgcg

SEQ ID NO: 5382406 - DNA, 18 bp, Homo sapiens
cacttgcgtcctgcagag

SEQ ID NO: 5382407 - DNA, 23 bp, Homo sapiens
cacttgcgtcctgcagaggacca

SEQ ID NO: 5382408 - DNA, 16 bp, Homo sapiens
cactttggtattcaat

SEQ ID NO: 5382409 - DNA, 13 bp, Homo sapiens
cactttggttatt

SEQ ID NO: 5382410 - DNA, 15 bp, Homo sapiens
cactttgtaaaagga

SEQ ID NO: 5382411 - DNA, 12 bp, Homo sapiens
cactttgtaaat

SEQ ID NO: 5382412 - DNA, 18 bp, Homo sapiens
cactttgtaatttttgct

SEQ ID NO: 5382413 - DNA, 21 bp, Homo sapiens
cactttgtataaatttttaag

SEQ ID NO: 5382414 - DNA, 15 bp, Homo sapiens
cactttgtatgattt

SEQ ID NO: 5382415 - DNA, 14 bp, Homo sapiens
cactttgtattact

SEQ ID NO: 5382416 - DNA, 19 bp, Homo sapiens
cactttgtattctctgtcc

SEQ ID NO: 5382417 - DNA, 17 bp, Homo sapiens
cactttgtctgtacata

SEQ ID NO: 5382418 - DNA, 20 bp, Homo sapiens
cactttgtgaattaacacag

SEQ ID NO: 5382419 - DNA, 16 bp, Homo sapiens
cactttgttctggctc

SEQ ID NO: 5382420 - DNA, 23 bp, Homo sapiens
cactttgttctggctcttccagg

SEQ ID NO: 5382421 - DNA, 12 bp, Homo sapiens
cactttgttctt

SEQ ID NO: 5382422 - DNA, 15 bp, Homo sapiens
cactttgttgcaaga

SEQ ID NO: 5382423 - DNA, 20 bp, Homo sapiens
cactttgttggcccttccag

SEQ ID NO: 5382424 - DNA, 15 bp, Homo sapiens
cactttgtttagaaa

SEQ ID NO: 5382425 - DNA, 12 bp, Homo sapiens
cactttgtttat

SEQ ID NO: 5382426 - DNA, 21 bp, Homo sapiens
cactttgtttcgtggggaggt

SEQ ID NO: 5382427 - DNA, 17 bp, Homo sapiens
cacttttaaaaaacaaa

SEQ ID NO: 5382428 - DNA, 21 bp, Homo sapiens
cacttttaaacataaagaatt

SEQ ID NO: 5382429 - DNA, 13 bp, Homo sapiens
cacttttaaacta

SEQ ID NO: 5382430 - DNA, 21 bp, Homo sapiens
cacttttagccagagatgcaa

SEQ ID NO: 5382431 - DNA, 21 bp, Homo sapiens
cacttttagttggcatttgtt

SEQ ID NO: 5382432 - DNA, 18 bp, Homo sapiens
cacttttatatttgaaaa

SEQ ID NO: 5382433 - DNA, 22 bp, Homo sapiens
cacttttcaaaagaagacatct

SEQ ID NO: 5382434 - DNA, 20 bp, Homo sapiens
cacttttcaatcccaattct

SEQ ID NO: 5382435 - DNA, 13 bp, Homo sapiens
cacttttcatcct

SEQ ID NO: 5382436 - DNA, 20 bp, Homo sapiens
cacttttcattactttctgc

SEQ ID NO: 5382437 - DNA, 11 bp, Homo sapiens
cacttttccag

SEQ ID NO: 5382438 - DNA, 12 bp, Homo sapiens
cacttttcccac

SEQ ID NO: 5382439 - DNA, 13 bp, Homo sapiens
cacttttcccact

SEQ ID NO: 5382440 - DNA, 19 bp, Homo sapiens
cacttttcccactccaagc

SEQ ID NO: 5382441 - DNA, 20 bp, Homo sapiens
cacttttccttttcttaaaa

SEQ ID NO: 5382442 - DNA, 12 bp, Homo sapiens
cacttttctcca

SEQ ID NO: 5382443 - DNA, 15 bp, Homo sapiens
cacttttctccaggg

SEQ ID NO: 5382444 - DNA, 12 bp, Homo sapiens
cacttttctggg

SEQ ID NO: 5382445 - DNA, 13 bp, Homo sapiens
cacttttcttctt

SEQ ID NO: 5382446 - DNA, 19 bp, Homo sapiens
cacttttctttattgctgt

SEQ ID NO: 5382447 - DNA, 13 bp, Homo sapiens
cacttttgagctc

SEQ ID NO: 5382448 - DNA, 21 bp, Homo sapiens
cacttttgcaaggttccacag

SEQ ID NO: 5382449 - DNA, 23 bp, Homo sapiens
cacttttggaaggtgacttttca

SEQ ID NO: 5382450 - DNA, 22 bp, Homo sapiens
cacttttggttaagtctgtttt

SEQ ID NO: 5382451 - DNA, 22 bp, Homo sapiens
cacttttgttaacagtatttct

SEQ ID NO: 5382452 - DNA, 12 bp, Homo sapiens
cacttttgttat

SEQ ID NO: 5382453 - DNA, 14 bp, Homo sapiens
cacttttgttattc

SEQ ID NO: 5382454 - DNA, 17 bp, Homo sapiens
cacttttgttattccat

SEQ ID NO: 5382455 - DNA, 18 bp, Homo sapiens
cacttttgttattccatc

SEQ ID NO: 5382456 - DNA, 19 bp, Homo sapiens
cacttttgttattccatca

SEQ ID NO: 5382457 - DNA, 14 bp, Homo sapiens
cacttttgttctgc

SEQ ID NO: 5382458 - DNA, 22 bp, Homo sapiens
cacttttgttcttggtttgtaa

SEQ ID NO: 5382459 - DNA, 21 bp, Homo sapiens
cacttttgttgcccaggctgg

SEQ ID NO: 5382460 - DNA, 17 bp, Homo sapiens
cactttttaaaaaactt

SEQ ID NO: 5382461 - DNA, 16 bp, Homo sapiens
cactttttaacattct

SEQ ID NO: 5382462 - DNA, 19 bp, Homo sapiens
cactttttaagtttgaaga

SEQ ID NO: 5382463 - DNA, 20 bp, Homo sapiens
cactttttacagcagcaata

SEQ ID NO: 5382464 - DNA, 15 bp, Homo sapiens
cactttttcacataa

SEQ ID NO: 5382465 - DNA, 22 bp, Homo sapiens
cactttttcatagtcattgtgg

SEQ ID NO: 5382466 - DNA, 14 bp, Homo sapiens
cactttttccagaa

SEQ ID NO: 5382467 - DNA, 19 bp, Homo sapiens
cactttttcccctgcaatg

SEQ ID NO: 5382468 - DNA, 15 bp, Homo sapiens
cactttttcgtgtgg

SEQ ID NO: 5382469 - DNA, 13 bp, Homo sapiens
cactttttctcga

SEQ ID NO: 5382470 - DNA, 21 bp, Homo sapiens
cactttttctttacaaacaaa

SEQ ID NO: 5382471 - DNA, 13 bp, Homo sapiens
cactttttgaact

SEQ ID NO: 5382472 - DNA, 16 bp, Homo sapiens
cactttttgaggcaaa

SEQ ID NO: 5382473 - DNA, 20 bp, Homo sapiens
cactttttgtattttttcct

SEQ ID NO: 5382474 - DNA, 15 bp, Homo sapiens
cacttttttaaatat

SEQ ID NO: 5382475 - DNA, 18 bp, Homo sapiens
cacttttttataaaagtt

SEQ ID NO: 5382476 - DNA, 12 bp, Homo sapiens
cacttttttcca

SEQ ID NO: 5382477 - DNA, 18 bp, Homo sapiens
cacttttttcctgtcaat

SEQ ID NO: 5382478 - DNA, 21 bp, Homo sapiens
cacttttttgagtggatgatg

SEQ ID NO: 5382479 - DNA, 22 bp, Homo sapiens
cacttttttgggggtaaaaaat

SEQ ID NO: 5382480 - DNA, 15 bp, Homo sapiens
cactttttttacttc

SEQ ID NO: 5382481 - DNA, 18 bp, Homo sapiens
cactttttttctttttct

SEQ ID NO: 5382482 - DNA, 14 bp, Homo sapiens
cactttttttttcc

SEQ ID NO: 5382483 - DNA, 16 bp, Homo sapiens
cactttttttttccaa

SEQ ID NO: 5382484 - DNA, 16 bp, Homo sapiens
cactttttttttttct

SEQ ID NO: 5382485 - DNA, 19 bp, Homo sapiens
cagaaaaaaaaaaagaaac

SEQ ID NO: 5382486 - DNA, 20 bp, Homo sapiens
cagaaaaaaaaaatgcattt

SEQ ID NO: 5382487 - DNA, 22 bp, Homo sapiens
cagaaaaaaaaaatgcatttac

SEQ ID NO: 5382488 - DNA, 13 bp, Homo sapiens
cagaaaaaaaaga

SEQ ID NO: 5382489 - DNA, 14 bp, Homo sapiens
cagaaaaaaaagtg

SEQ ID NO: 5382490 - DNA, 20 bp, Homo sapiens
cagaaaaaaataactatttt

SEQ ID NO: 5382491 - DNA, 19 bp, Homo sapiens
cagaaaaaaatggtgcctt

SEQ ID NO: 5382492 - DNA, 13 bp, Homo sapiens
cagaaaaaaggac

SEQ ID NO: 5382493 - DNA, 18 bp, Homo sapiens
cagaaaaaaggactgtat

SEQ ID NO: 5382494 - DNA, 12 bp, Homo sapiens
cagaaaaaaggt

SEQ ID NO: 5382495 - DNA, 22 bp, Homo sapiens
cagaaaaaaggttctttgtgta

SEQ ID NO: 5382496 - DNA, 14 bp, Homo sapiens
cagaaaaacaaaaa

SEQ ID NO: 5382497 - DNA, 15 bp, Homo sapiens
cagaaaaacaaaaaa

SEQ ID NO: 5382498 - DNA, 19 bp, Homo sapiens
cagaaaaacaaaaaaaaga

SEQ ID NO: 5382499 - DNA, 12 bp, Homo sapiens
cagaaaaacaat

SEQ ID NO: 5382500 - DNA, 17 bp, Homo sapiens
cagaaaaactggctctg

SEQ ID NO: 5382501 - DNA, 12 bp, Homo sapiens
cagaaaaagaaa

SEQ ID NO: 5382502 - DNA, 14 bp, Homo sapiens
cagaaaaagaagaa

SEQ ID NO: 5382503 - DNA, 15 bp, Homo sapiens
cagaaaaagaagaag

SEQ ID NO: 5382504 - DNA, 17 bp, Homo sapiens
cagaaaaagaagaagga

SEQ ID NO: 5382505 - DNA, 17 bp, Homo sapiens
cagaaaaaggctgtgct

SEQ ID NO: 5382506 - DNA, 22 bp, Homo sapiens
cagaaaaatatgtaccaagaat

SEQ ID NO: 5382507 - DNA, 19 bp, Homo sapiens
cagaaaaatcaatcatttt

SEQ ID NO: 5382508 - DNA, 20 bp, Homo sapiens
cagaaaaatggagcaaagtg

SEQ ID NO: 5382509 - DNA, 18 bp, Homo sapiens
cagaaaaattaaaaaaga

SEQ ID NO: 5382510 - DNA, 14 bp, Homo sapiens
cagaaaacaacaaa

SEQ ID NO: 5382511 - DNA, 18 bp, Homo sapiens
cagaaaacaacaaaaaat

SEQ ID NO: 5382512 - DNA, 16 bp, Homo sapiens
cagaaaacaacaaaag

SEQ ID NO: 5382513 - DNA, 17 bp, Homo sapiens
cagaaaacaacaaaaga

SEQ ID NO: 5382514 - DNA, 13 bp, Homo sapiens
cagaaaacaactt

SEQ ID NO: 5382515 - DNA, 21 bp, Homo sapiens
cagaaaacaacttggcatttc

SEQ ID NO: 5382516 - DNA, 23 bp, Homo sapiens
cagaaaacaacttggcatttcta

SEQ ID NO: 5382517 - DNA, 11 bp, Homo sapiens
cagaaaacaga

SEQ ID NO: 5382518 - DNA, 14 bp, Homo sapiens
cagaaaacagaaaa

SEQ ID NO: 5382519 - DNA, 15 bp, Homo sapiens
cagaaaacagagcct

SEQ ID NO: 5382520 - DNA, 22 bp, Homo sapiens
cagaaaacataatatagcttaa

SEQ ID NO: 5382521 - DNA, 13 bp, Homo sapiens
cagaaaacattgt

SEQ ID NO: 5382522 - DNA, 9 bp, Homo sapiens
cagaaaacc

SEQ ID NO: 5382523 - DNA, 14 bp, Homo sapiens
cagaaaaccccagc

SEQ ID NO: 5382524 - DNA, 16 bp, Homo sapiens
cagaaaaccctggtaa

SEQ ID NO: 5382525 - DNA, 17 bp, Homo sapiens
cagaaaacctaagcaaa

SEQ ID NO: 5382526 - DNA, 13 bp, Homo sapiens
cagaaaacctcaa

SEQ ID NO: 5382527 - DNA, 17 bp, Homo sapiens
cagaaaacctgatgctg

SEQ ID NO: 5382528 - DNA, 15 bp, Homo sapiens
cagaaaacctgttca

SEQ ID NO: 5382529 - DNA, 20 bp, Homo sapiens
cagaaaacctgttcaggcag

SEQ ID NO: 5382530 - DNA, 21 bp, Homo sapiens
cagaaaactaaaaaggaagaa

SEQ ID NO: 5382531 - DNA, 21 bp, Homo sapiens
cagaaaacttagaaataagaa

SEQ ID NO: 5382532 - DNA, 23 bp, Homo sapiens
cagaaaacttctcttctgagcct

SEQ ID NO: 5382533 - DNA, 17 bp, Homo sapiens
cagaaaagaaaaccatt

SEQ ID NO: 5382534 - DNA, 20 bp, Homo sapiens
cagaaaagaaagctgctttc

SEQ ID NO: 5382535 - DNA, 13 bp, Homo sapiens
cagaaaagacact

SEQ ID NO: 5382536 - DNA, 14 bp, Homo sapiens
cagaaaagagaaga

SEQ ID NO: 5382537 - DNA, 16 bp, Homo sapiens
cagaaaagagccactt

SEQ ID NO: 5382538 - DNA, 21 bp, Homo sapiens
cagaaaagaggagaccctgga

SEQ ID NO: 5382539 - DNA, 17 bp, Homo sapiens
cagaaaagatgaatttg

SEQ ID NO: 5382540 - DNA, 16 bp, Homo sapiens
cagaaaagcacctctt

SEQ ID NO: 5382541 - DNA, 14 bp, Homo sapiens
cagaaaagcacctg

SEQ ID NO: 5382542 - DNA, 16 bp, Homo sapiens
cagaaaagcacctgcc

SEQ ID NO: 5382543 - DNA, 17 bp, Homo sapiens
cagaaaagcacctgccg

SEQ ID NO: 5382544 - DNA, 14 bp, Homo sapiens
cagaaaagctcaga

SEQ ID NO: 5382545 - DNA, 16 bp, Homo sapiens
cagaaaagctcagagt

SEQ ID NO: 5382546 - DNA, 17 bp, Homo sapiens
cagaaaaggcagccaga

SEQ ID NO: 5382547 - DNA, 17 bp, Homo sapiens
cagaaaagggaagttgt

SEQ ID NO: 5382548 - DNA, 18 bp, Homo sapiens
cagaaaagggaagttgtg

SEQ ID NO: 5382549 - DNA, 16 bp, Homo sapiens
cagaaaagtaattttg

SEQ ID NO: 5382550 - DNA, 19 bp, Homo sapiens
cagaaaagtaattttgtca

SEQ ID NO: 5382551 - DNA, 14 bp, Homo sapiens
cagaaaagtagaat

SEQ ID NO: 5382552 - DNA, 16 bp, Homo sapiens
cagaaaagtagaatta

SEQ ID NO: 5382553 - DNA, 13 bp, Homo sapiens
cagaaaagtgcct

SEQ ID NO: 5382554 - DNA, 19 bp, Homo sapiens
cagaaaagtgcctgagctg

SEQ ID NO: 5382555 - DNA, 22 bp, Homo sapiens
cagaaaagtgcttagaaagtta

SEQ ID NO: 5382556 - DNA, 20 bp, Homo sapiens
cagaaaagttgaattttaca

SEQ ID NO: 5382557 - DNA, 20 bp, Homo sapiens
cagaaaataacagatgctgg

SEQ ID NO: 5382558 - DNA, 12 bp, Homo sapiens
cagaaaatatac

SEQ ID NO: 5382559 - DNA, 13 bp, Homo sapiens
cagaaaatatact

SEQ ID NO: 5382560 - DNA, 14 bp, Homo sapiens
cagaaaatatactg

SEQ ID NO: 5382561 - DNA, 19 bp, Homo sapiens
cagaaaatatactgtaaag

SEQ ID NO: 5382562 - DNA, 21 bp, Homo sapiens
cagaaaatatactgtaaagaa

SEQ ID NO: 5382563 - DNA, 15 bp, Homo sapiens
cagaaaatatgtatt

SEQ ID NO: 5382564 - DNA, 16 bp, Homo sapiens
cagaaaatatgtatta

SEQ ID NO: 5382565 - DNA, 22 bp, Homo sapiens
cagaaaatatgtattaacacta

SEQ ID NO: 5382566 - DNA, 19 bp, Homo sapiens
cagaaaatgaacacagcag

SEQ ID NO: 5382567 - DNA, 13 bp, Homo sapiens
cagaaaatgaact

SEQ ID NO: 5382568 - DNA, 16 bp, Homo sapiens
cagaaaatgcaatgac

SEQ ID NO: 5382569 - DNA, 23 bp, Homo sapiens
cagaaaatgctggctgagctgaa

SEQ ID NO: 5382570 - DNA, 21 bp, Homo sapiens
cagaaaatggaagacagctct

SEQ ID NO: 5382571 - DNA, 22 bp, Homo sapiens
cagaaaatggaagacagctctt

SEQ ID NO: 5382572 - DNA, 22 bp, Homo sapiens
cagaaaatgtgtcagcatgcat

SEQ ID NO: 5382573 - DNA, 14 bp, Homo sapiens
cagaaaatgttgag

SEQ ID NO: 5382574 - DNA, 15 bp, Homo sapiens
cagaaaattccctgg

SEQ ID NO: 5382575 - DNA, 12 bp, Homo sapiens
cagaaaattttt

SEQ ID NO: 5382576 - DNA, 16 bp, Homo sapiens
cagaaaatttttgtct

SEQ ID NO: 5382577 - DNA, 20 bp, Homo sapiens
cagaaacaaaaacactaaaa

SEQ ID NO: 5382578 - DNA, 16 bp, Homo sapiens
cagaaacaactgccaa

SEQ ID NO: 5382579 - DNA, 21 bp, Homo sapiens
cagaaacaactgccaaataaa

SEQ ID NO: 5382580 - DNA, 18 bp, Homo sapiens
cagaaacacccacaggca

SEQ ID NO: 5382581 - DNA, 19 bp, Homo sapiens
cagaaacacccctctgtct

SEQ ID NO: 5382582 - DNA, 23 bp, Homo sapiens
cagaaacacccctctgtctagga

SEQ ID NO: 5382583 - DNA, 20 bp, Homo sapiens
cagaaacaccctcacactgg

SEQ ID NO: 5382584 - DNA, 23 bp, Homo sapiens
cagaaacacggagtttccatttg

SEQ ID NO: 5382585 - DNA, 12 bp, Homo sapiens
cagaaacactgc

SEQ ID NO: 5382586 - DNA, 15 bp, Homo sapiens
cagaaacactgttgg

SEQ ID NO: 5382587 - DNA, 22 bp, Homo sapiens
cagaagacaaaattgtaagcca

SEQ ID NO: 5382588 - DNA, 18 bp, Homo sapiens
cagaagacaaaggcccaa

SEQ ID NO: 5382589 - DNA, 20 bp, Homo sapiens
cagaagacacaggaaacaat

SEQ ID NO: 5382590 - DNA, 14 bp, Homo sapiens
cagaagacaccaga

SEQ ID NO: 5382591 - DNA, 15 bp, Homo sapiens
cagaagacaccagag

SEQ ID NO: 5382592 - DNA, 16 bp, Homo sapiens
cagaagacaccagagc

SEQ ID NO: 5382593 - DNA, 22 bp, Homo sapiens
cagaagacacgtgtttttgtat

SEQ ID NO: 5382594 - DNA, 14 bp, Homo sapiens
cagaagacactaat

SEQ ID NO: 5382595 - DNA, 23 bp, Homo sapiens
cagaagacagcagcaagtgtgct

SEQ ID NO: 5382596 - DNA, 21 bp, Homo sapiens
cagaagaccacaaaaattgac

SEQ ID NO: 5382597 - DNA, 19 bp, Homo sapiens
cagaagaccagatccaaga

SEQ ID NO: 5382598 - DNA, 16 bp, Homo sapiens
cagaagacccctgact

SEQ ID NO: 5382599 - DNA, 21 bp, Homo sapiens
cagaagacctccctgtgagag

SEQ ID NO: 5382600 - DNA, 22 bp, Homo sapiens
cagaagacctccctgtgagaga

SEQ ID NO: 5382601 - DNA, 18 bp, Homo sapiens
cagaagacgggaggggag

SEQ ID NO: 5382602 - DNA, 20 bp, Homo sapiens
cagaagacgggaggggaggc

SEQ ID NO: 5382603 - DNA, 19 bp, Homo sapiens
cagaagactctccactgac

SEQ ID NO: 5382604 - DNA, 23 bp, Homo sapiens
cagaagacttctatggaccacaa

SEQ ID NO: 5382605 - DNA, 22 bp, Homo sapiens
cagaagagaaggaagccatagt

SEQ ID NO: 5382606 - DNA, 21 bp, Homo sapiens
cagaagagatgggcttgtttt

SEQ ID NO: 5382607 - DNA, 14 bp, Homo sapiens
cagaagagcttgtc

SEQ ID NO: 5382608 - DNA, 21 bp, Homo sapiens
cagaagagcttgtcagcaaga

SEQ ID NO: 5382609 - DNA, 14 bp, Homo sapiens
cagaagaggaggga

SEQ ID NO: 5382610 - DNA, 18 bp, Homo sapiens
cagaagaggcaacaattt

SEQ ID NO: 5382611 - DNA, 15 bp, Homo sapiens
cagaagagggaggct

SEQ ID NO: 5382612 - DNA, 20 bp, Homo sapiens
cagaagagggaggcttcctg

SEQ ID NO: 5382613 - DNA, 21 bp, Homo sapiens
cagaagagggaggcttcctga

SEQ ID NO: 5382614 - DNA, 19 bp, Homo sapiens
cagaagaggttgggcttcc

SEQ ID NO: 5382615 - DNA, 20 bp, Homo sapiens
cagaagagtcccggagctca

SEQ ID NO: 5382616 - DNA, 19 bp, Homo sapiens
cagaagagtttcttaactt

SEQ ID NO: 5382617 - DNA, 13 bp, Homo sapiens
cagaagatagaga

SEQ ID NO: 5382618 - DNA, 22 bp, Homo sapiens
cagaagatagagattcccctgg

SEQ ID NO: 5382619 - DNA, 20 bp, Homo sapiens
cagaagatagcttcacccca

SEQ ID NO: 5382620 - DNA, 16 bp, Homo sapiens
cagaagatgaaaaaaa

SEQ ID NO: 5382621 - DNA, 14 bp, Homo sapiens
cagaagatgactga

SEQ ID NO: 5382622 - DNA, 21 bp, Homo sapiens
cagaagatgccagcttctctc

SEQ ID NO: 5382623 - DNA, 21 bp, Homo sapiens
cagaagatggtgaagacagaa

SEQ ID NO: 5382624 - DNA, 14 bp, Homo sapiens
cagaagatgtattc

SEQ ID NO: 5382625 - DNA, 23 bp, Homo sapiens
cagaagatgtattcagagccacc

SEQ ID NO: 5382626 - DNA, 15 bp, Homo sapiens
cagaagatgtgaaat

SEQ ID NO: 5382627 - DNA, 17 bp, Homo sapiens
cagaagattaagacaga

SEQ ID NO: 5382628 - DNA, 18 bp, Homo sapiens
cagaagattaagacagag

SEQ ID NO: 5382629 - DNA, 13 bp, Homo sapiens
cagaagattacaa

SEQ ID NO: 5382630 - DNA, 21 bp, Homo sapiens
cagaagattacaaaagcaatt

SEQ ID NO: 5382631 - DNA, 13 bp, Homo sapiens
cagaagcaaacaa

SEQ ID NO: 5382632 - DNA, 19 bp, Homo sapiens
cagaagcaacccaaatgtt

SEQ ID NO: 5382633 - DNA, 18 bp, Homo sapiens
cagaagcaagccagacct

SEQ ID NO: 5382634 - DNA, 17 bp, Homo sapiens
cagaagcaaggaagtaa

SEQ ID NO: 5382635 - DNA, 18 bp, Homo sapiens
cagaagcaaggaagtaag

SEQ ID NO: 5382636 - DNA, 22 bp, Homo sapiens
cagaagcaagggggtgatgtag

SEQ ID NO: 5382637 - DNA, 13 bp, Homo sapiens
cagaagcacaaag

SEQ ID NO: 5382638 - DNA, 20 bp, Homo sapiens
cagaagcactgggatcacag

SEQ ID NO: 5382639 - DNA, 17 bp, Homo sapiens
cagaagcagagagcaca

SEQ ID NO: 5382640 - DNA, 14 bp, Homo sapiens
cagaagcagcagct

SEQ ID NO: 5382641 - DNA, 17 bp, Homo sapiens
cagaagcagcccctcga

SEQ ID NO: 5382642 - DNA, 14 bp, Homo sapiens
cagaagcagctctt

SEQ ID NO: 5382643 - DNA, 18 bp, Homo sapiens
cagaagcaggagtaagtt

SEQ ID NO: 5382644 - DNA, 15 bp, Homo sapiens
cagaagcaggcaggg

SEQ ID NO: 5382645 - DNA, 17 bp, Homo sapiens
cagaagcaggcagggca

SEQ ID NO: 5382646 - DNA, 14 bp, Homo sapiens
cagaagcaggctgg

SEQ ID NO: 5382647 - DNA, 16 bp, Homo sapiens
cagaagcaggttcttg

SEQ ID NO: 5382648 - DNA, 15 bp, Homo sapiens
cagaagcattgcctg

SEQ ID NO: 5382649 - DNA, 19 bp, Homo sapiens
cagaagcattgcctggact

SEQ ID NO: 5382650 - DNA, 20 bp, Homo sapiens
cagaagcattgcctggactg

SEQ ID NO: 5382651 - DNA, 20 bp, Homo sapiens
cagaagccaagggaagacag

SEQ ID NO: 5382652 - DNA, 13 bp, Homo sapiens
cagaagccagaag

SEQ ID NO: 5382653 - DNA, 14 bp, Homo sapiens
cagaagccagaagg

SEQ ID NO: 5382654 - DNA, 16 bp, Homo sapiens
cagaagccagaaggtg

SEQ ID NO: 5382655 - DNA, 15 bp, Homo sapiens
cagaagccaggagca

SEQ ID NO: 5382656 - DNA, 16 bp, Homo sapiens
cagaagccaggagcaa

SEQ ID NO: 5382657 - DNA, 19 bp, Homo sapiens
cagaagccaggagcaaatg

SEQ ID NO: 5382658 - DNA, 11 bp, Homo sapiens
cagaagcccag

SEQ ID NO: 5382659 - DNA, 15 bp, Homo sapiens
cagaagcccatgtct

SEQ ID NO: 5382660 - DNA, 21 bp, Homo sapiens
cagaagcccatgtcttctgct

SEQ ID NO: 5382661 - DNA, 21 bp, Homo sapiens
cagaagccccacagcctggca

SEQ ID NO: 5382662 - DNA, 23 bp, Homo sapiens
cagaagccctgatgtgtcctcag

SEQ ID NO: 5382663 - DNA, 21 bp, Homo sapiens
cagaagcctaggaggactggg

SEQ ID NO: 5382664 - DNA, 20 bp, Homo sapiens
cagaagcctccaagcacaga

SEQ ID NO: 5382665 - DNA, 17 bp, Homo sapiens
cagaagcctccttacat

SEQ ID NO: 5382666 - DNA, 19 bp, Homo sapiens
cagaagcctccttacatta

SEQ ID NO: 5382667 - DNA, 21 bp, Homo sapiens
cagaagcctccttacattaaa

SEQ ID NO: 5382668 - DNA, 22 bp, Homo sapiens
cagaagcctccttacattaaaa

SEQ ID NO: 5382669 - DNA, 19 bp, Homo sapiens
cagaagcctctggctagag

SEQ ID NO: 5382670 - DNA, 14 bp, Homo sapiens
cagaagcctgaggc

SEQ ID NO: 5382671 - DNA, 15 bp, Homo sapiens
cagaagcctgaggct

SEQ ID NO: 5382672 - DNA, 21 bp, Homo sapiens
cagaagcctggactctgcccc

SEQ ID NO: 5382673 - DNA, 19 bp, Homo sapiens
cagaagcctgggggcctgg

SEQ ID NO: 5382674 - DNA, 23 bp, Homo sapiens
cagaagcctgggggcctggctgg

SEQ ID NO: 5382675 - DNA, 13 bp, Homo sapiens
cagaagccttctt

SEQ ID NO: 5382676 - DNA, 22 bp, Homo sapiens
cagaagccttcttgctgcccac

SEQ ID NO: 5382677 - DNA, 22 bp, Homo sapiens
cagaagccttggaaccagcccc

SEQ ID NO: 5382678 - DNA, 18 bp, Homo sapiens
cagaagcggcctgtgcgt

SEQ ID NO: 5382679 - DNA, 13 bp, Homo sapiens
cagaagcgtctcc

SEQ ID NO: 5382680 - DNA, 19 bp, Homo sapiens
cagaagcgtctcccttggc

SEQ ID NO: 5382681 - DNA, 17 bp, Homo sapiens
cagaagctaagctgcag

SEQ ID NO: 5382682 - DNA, 16 bp, Homo sapiens
cagaagctaggtacat

SEQ ID NO: 5382683 - DNA, 17 bp, Homo sapiens
cagaagctatgttttta

SEQ ID NO: 5382684 - DNA, 20 bp, Homo sapiens
cagaagctatgtttttaaag

SEQ ID NO: 5382685 - DNA, 22 bp, Homo sapiens
cagaagctatttcatttgctgt

SEQ ID NO: 5382686 - DNA, 15 bp, Homo sapiens
cagaagctcccccag

SEQ ID NO: 5382687 - DNA, 17 bp, Homo sapiens
cagaagctcccccagca

SEQ ID NO: 5382688 - DNA, 18 bp, Homo sapiens
cagaagctcccccagcaa

SEQ ID NO: 5382689 - DNA, 21 bp, Homo sapiens
cagaagctcccccagcaaagc

SEQ ID NO: 5382690 - DNA, 16 bp, Homo sapiens
cagaagctgatgagga

SEQ ID NO: 5382691 - DNA, 20 bp, Homo sapiens
cagaagctgattttcatgaa

SEQ ID NO: 5382692 - DNA, 16 bp, Homo sapiens
cagaagctgcagctgg

SEQ ID NO: 5382693 - DNA, 15 bp, Homo sapiens
cagaagctgtgagtt

SEQ ID NO: 5382694 - DNA, 12 bp, Homo sapiens
cagaagctgtgg

SEQ ID NO: 5382695 - DNA, 22 bp, Homo sapiens
cagaagctgttgggagaaagca

SEQ ID NO: 5382696 - DNA, 20 bp, Homo sapiens
cagaagctttttgtttgcat

SEQ ID NO: 5382697 - DNA, 23 bp, Homo sapiens
cagaagctttttgtttgcatcat

SEQ ID NO: 5382698 - DNA, 10 bp, Homo sapiens
cagaaggaaa

SEQ ID NO: 5382699 - DNA, 17 bp, Homo sapiens
cagaaggaaaaatgtgt

SEQ ID NO: 5382700 - DNA, 20 bp, Homo sapiens
cagaaggaaaaatgtgtaat

SEQ ID NO: 5382701 - DNA, 20 bp, Homo sapiens
cagaaggaaagcactaagaa

SEQ ID NO: 5382702 - DNA, 13 bp, Homo sapiens
cagaaggaaatga

SEQ ID NO: 5382703 - DNA, 20 bp, Homo sapiens
cagaaggaaatgatggaatt

SEQ ID NO: 5382704 - DNA, 18 bp, Homo sapiens
cagaaggaagacttcatc

SEQ ID NO: 5382705 - DNA, 19 bp, Homo sapiens
cagaaggaagacttcatcc

SEQ ID NO: 5382706 - DNA, 11 bp, Homo sapiens
cagaaggaagc

SEQ ID NO: 5382707 - DNA, 12 bp, Homo sapiens
cagaaggaagcc

SEQ ID NO: 5382708 - DNA, 19 bp, Homo sapiens
cagaaggaaggatgccact

SEQ ID NO: 5382709 - DNA, 23 bp, Homo sapiens
cagaaggaaggatgccacttggg

SEQ ID NO: 5382710 - DNA, 20 bp, Homo sapiens
cagaaggaaggcagggagga

SEQ ID NO: 5382711 - DNA, 19 bp, Homo sapiens
cagaaggaataagcattcc

SEQ ID NO: 5382712 - DNA, 24 bp, Homo sapiens
cagaaggacaggtctctgagacag

SEQ ID NO: 5382713 - DNA, 12 bp, Homo sapiens
cagaaggactgg

SEQ ID NO: 5382714 - DNA, 18 bp, Homo sapiens
cagaaggagacaggcaga

SEQ ID NO: 5382715 - DNA, 14 bp, Homo sapiens
cagaaggagcaggc

SEQ ID NO: 5382716 - DNA, 17 bp, Homo sapiens
cagaaggagcaggccct

SEQ ID NO: 5382717 - DNA, 13 bp, Homo sapiens
cagaaggaggagg

SEQ ID NO: 5382718 - DNA, 13 bp, Homo sapiens
cagaaggagggca

SEQ ID NO: 5382719 - DNA, 17 bp, Homo sapiens
cagaaggagggcagagc

SEQ ID NO: 5382720 - DNA, 22 bp, Homo sapiens
cagaaggagggcagagccatgg

SEQ ID NO: 5382721 - DNA, 17 bp, Homo sapiens
cagaaggatcttcatct

SEQ ID NO: 5382722 - DNA, 17 bp, Homo sapiens
cagaaggatgaatgagg

SEQ ID NO: 5382723 - DNA, 16 bp, Homo sapiens
cagaaggatgcccaga

SEQ ID NO: 5382724 - DNA, 15 bp, Homo sapiens
cagaaggatttcttg

SEQ ID NO: 5382725 - DNA, 19 bp, Homo sapiens
cagaaggatttcttgtatt

SEQ ID NO: 5382726 - DNA, 20 bp, Homo sapiens
cagaaggattttttaaagtt

SEQ ID NO: 5382727 - DNA, 18 bp, Homo sapiens
cagaaggcaaatgacttt

SEQ ID NO: 5382728 - DNA, 16 bp, Homo sapiens
cagaaggcaaggccct

SEQ ID NO: 5382729 - DNA, 16 bp, Homo sapiens
cagaaggcaatcaaga

SEQ ID NO: 5382730 - DNA, 21 bp, Homo sapiens
cagaaggcaatcttaaaacag

SEQ ID NO: 5382731 - DNA, 12 bp, Homo sapiens
cagaaggcagga

SEQ ID NO: 5382732 - DNA, 15 bp, Homo sapiens
cagaaggcaggacca

SEQ ID NO: 5382733 - DNA, 14 bp, Homo sapiens
cagaaggccaagaa

SEQ ID NO: 5382734 - DNA, 14 bp, Homo sapiens
cagaaggccacagg

SEQ ID NO: 5382735 - DNA, 18 bp, Homo sapiens
cagaaggccacaggccac

SEQ ID NO: 5382736 - DNA, 20 bp, Homo sapiens
cagaaggccacaggccactg

SEQ ID NO: 5382737 - DNA, 21 bp, Homo sapiens
cagaaggccagaaaaggcagc

SEQ ID NO: 5382738 - DNA, 14 bp, Homo sapiens
cagaaggccagccg

SEQ ID NO: 5382739 - DNA, 18 bp, Homo sapiens
cagaaggccccagagaga

SEQ ID NO: 5382740 - DNA, 20 bp, Homo sapiens
cagaaggccccagagagacc

SEQ ID NO: 5382741 - DNA, 17 bp, Homo sapiens
cagaaggcccgaggagg

SEQ ID NO: 5382742 - DNA, 21 bp, Homo sapiens
cagaaggcccttaactatcac

SEQ ID NO: 5382743 - DNA, 15 bp, Homo sapiens
cagaaggccttgcct

SEQ ID NO: 5382744 - DNA, 20 bp, Homo sapiens
cagaaggccttgccttgtgt

SEQ ID NO: 5382745 - DNA, 12 bp, Homo sapiens
cagaaggctcct

SEQ ID NO: 5382746 - DNA, 20 bp, Homo sapiens
cagaaggctctatctgctgg

SEQ ID NO: 5382747 - DNA, 17 bp, Homo sapiens
cagaaggctggggccag

SEQ ID NO: 5382748 - DNA, 23 bp, Homo sapiens
cagaaggctttgggatatgctgt

SEQ ID NO: 5382749 - DNA, 14 bp, Homo sapiens
cagaagggaaacag

SEQ ID NO: 5382750 - DNA, 19 bp, Homo sapiens
cagaagggacttcacgaag

SEQ ID NO: 5382751 - DNA, 13 bp, Homo sapiens
cagaagggagcag

SEQ ID NO: 5382752 - DNA, 20 bp, Homo sapiens
cagaagggagctggctccag

SEQ ID NO: 5382753 - DNA, 15 bp, Homo sapiens
cagaagggagggcag

SEQ ID NO: 5382754 - DNA, 23 bp, Homo sapiens
cagaagggagttgctcactcagg

SEQ ID NO: 5382755 - DNA, 21 bp, Homo sapiens
cagaagggcagatggacttct

SEQ ID NO: 5382756 - DNA, 13 bp, Homo sapiens
cagaagggcagtg

SEQ ID NO: 5382757 - DNA, 13 bp, Homo sapiens
cagaagggctctt

SEQ ID NO: 5382758 - DNA, 17 bp, Homo sapiens
cagaaggggactgccac

SEQ ID NO: 5382759 - DNA, 19 bp, Homo sapiens
cagaaggggactgccacct

SEQ ID NO: 5382760 - DNA, 20 bp, Homo sapiens
cagaaggggactgccacctc

SEQ ID NO: 5382761 - DNA, 21 bp, Homo sapiens
cagaaggggactgccacctcc

SEQ ID NO: 5382762 - DNA, 13 bp, Homo sapiens
cagaaggggagct

SEQ ID NO: 5382763 - DNA, 18 bp, Homo sapiens
cagacaccctccactctg

SEQ ID NO: 5382764 - DNA, 20 bp, Homo sapiens
cagacaccctccactctgag

SEQ ID NO: 5382765 - DNA, 23 bp, Homo sapiens
cagacaccgtttgtcccccgggg

SEQ ID NO: 5382766 - DNA, 17 bp, Homo sapiens
cagacacctaaccccag

SEQ ID NO: 5382767 - DNA, 21 bp, Homo sapiens
cagacacctaaccccagggca

SEQ ID NO: 5382768 - DNA, 20 bp, Homo sapiens
cagacacctccccctaccca

SEQ ID NO: 5382769 - DNA, 21 bp, Homo sapiens
cagacacctccccctacccat

SEQ ID NO: 5382770 - DNA, 17 bp, Homo sapiens
cagacacctggactgag

SEQ ID NO: 5382771 - DNA, 19 bp, Homo sapiens
cagacaccttgacagggca

SEQ ID NO: 5382772 - DNA, 18 bp, Homo sapiens
cagacaccttggacatcc

SEQ ID NO: 5382773 - DNA, 18 bp, Homo sapiens
cagacactaagttatagt

SEQ ID NO: 5382774 - DNA, 19 bp, Homo sapiens
cagacactacatatctaaa

SEQ ID NO: 5382775 - DNA, 15 bp, Homo sapiens
cagacactaccccat

SEQ ID NO: 5382776 - DNA, 13 bp, Homo sapiens
cagacactctgct

SEQ ID NO: 5382777 - DNA, 18 bp, Homo sapiens
cagacacttcatggacca

SEQ ID NO: 5382778 - DNA, 21 bp, Homo sapiens
cagacagaaactggattaaaa

SEQ ID NO: 5382779 - DNA, 15 bp, Homo sapiens
cagacagaacttgaa

SEQ ID NO: 5382780 - DNA, 13 bp, Homo sapiens
cagacagaagtct

SEQ ID NO: 5382781 - DNA, 15 bp, Homo sapiens
cagacagacagacag

SEQ ID NO: 5382782 - DNA, 15 bp, Homo sapiens
cagacagacatacat

SEQ ID NO: 5382783 - DNA, 19 bp, Homo sapiens
cagacagacatctctgcac

SEQ ID NO: 5382784 - DNA, 21 bp, Homo sapiens
cagacagacctcaagggacag

SEQ ID NO: 5382785 - DNA, 20 bp, Homo sapiens
cagacagaccttcacagatg

SEQ ID NO: 5382786 - DNA, 20 bp, Homo sapiens
cagacagagaaatgtgaagg

SEQ ID NO: 5382787 - DNA, 12 bp, Homo sapiens
cagacagagatc

SEQ ID NO: 5382788 - DNA, 14 bp, Homo sapiens
cagacagagccagg

SEQ ID NO: 5382789 - DNA, 18 bp, Homo sapiens
cagacagagccaggagaa

SEQ ID NO: 5382790 - DNA, 12 bp, Homo sapiens
cagacagaggat

SEQ ID NO: 5382791 - DNA, 18 bp, Homo sapiens
cagacagatagtgaaaca

SEQ ID NO: 5382792 - DNA, 13 bp, Homo sapiens
cagacagatccca

SEQ ID NO: 5382793 - DNA, 20 bp, Homo sapiens
cagacagatgtcagcttccc

SEQ ID NO: 5382794 - DNA, 22 bp, Homo sapiens
cagacagatgtcagcttcccag

SEQ ID NO: 5382795 - DNA, 19 bp, Homo sapiens
cagacagatgttgggagga

SEQ ID NO: 5382796 - DNA, 21 bp, Homo sapiens
cagacagatgttgggaggata

SEQ ID NO: 5382797 - DNA, 16 bp, Homo sapiens
cagacagcacagggca

SEQ ID NO: 5382798 - DNA, 18 bp, Homo sapiens
cagacagcacagggcagg

SEQ ID NO: 5382799 - DNA, 16 bp, Homo sapiens
cagacagcagctggac

SEQ ID NO: 5382800 - DNA, 14 bp, Homo sapiens
cagacagcaggcag

SEQ ID NO: 5382801 - DNA, 19 bp, Homo sapiens
cagacagcaggcagcgcca

SEQ ID NO: 5382802 - DNA, 15 bp, Homo sapiens
cagacagccccaagc

SEQ ID NO: 5382803 - DNA, 12 bp, Homo sapiens
cagacagccccc

SEQ ID NO: 5382804 - DNA, 21 bp, Homo sapiens
cagacagccctccactccagc

SEQ ID NO: 5382805 - DNA, 16 bp, Homo sapiens
cagacagccctggcaa

SEQ ID NO: 5382806 - DNA, 18 bp, Homo sapiens
cagacagccgtttgttct

SEQ ID NO: 5382807 - DNA, 12 bp, Homo sapiens
cagacagcctgt

SEQ ID NO: 5382808 - DNA, 21 bp, Homo sapiens
cagacagctccaccctggccg

SEQ ID NO: 5382809 - DNA, 12 bp, Homo sapiens
cagacagctccc

SEQ ID NO: 5382810 - DNA, 17 bp, Homo sapiens
cagacagctccctctgc

SEQ ID NO: 5382811 - DNA, 13 bp, Homo sapiens
cagacagctgctc

SEQ ID NO: 5382812 - DNA, 18 bp, Homo sapiens
cagacagctgctcagagc

SEQ ID NO: 5382813 - DNA, 12 bp, Homo sapiens
cagacagctgga

SEQ ID NO: 5382814 - DNA, 16 bp, Homo sapiens
cagacagctggaccca

SEQ ID NO: 5382815 - DNA, 16 bp, Homo sapiens
cagacagcttacagga

SEQ ID NO: 5382816 - DNA, 21 bp, Homo sapiens
cagacagcttacaggagccag

SEQ ID NO: 5382817 - DNA, 14 bp, Homo sapiens
cagacagcttgact

SEQ ID NO: 5382818 - DNA, 20 bp, Homo sapiens
cagacagcttgactgctttt

SEQ ID NO: 5382819 - DNA, 23 bp, Homo sapiens
cagacaggaaagggaaggcccca

SEQ ID NO: 5382820 - DNA, 16 bp, Homo sapiens
cagacaggaaggaagc

SEQ ID NO: 5382821 - DNA, 17 bp, Homo sapiens
cagacaggaaggaagca

SEQ ID NO: 5382822 - DNA, 15 bp, Homo sapiens
cagacaggacccctg

SEQ ID NO: 5382823 - DNA, 18 bp, Homo sapiens
cagacaggacccctgcag

SEQ ID NO: 5382824 - DNA, 21 bp, Homo sapiens
cagacaggaggagtgggacag

SEQ ID NO: 5382825 - DNA, 13 bp, Homo sapiens
cagacaggcaagc

SEQ ID NO: 5382826 - DNA, 20 bp, Homo sapiens
cagacaggcggggcccagcg

SEQ ID NO: 5382827 - DNA, 19 bp, Homo sapiens
cagacagggcctagctttc

SEQ ID NO: 5382828 - DNA, 18 bp, Homo sapiens
cagacagggctccagcct

SEQ ID NO: 5382829 - DNA, 22 bp, Homo sapiens
cagacagggctccagcctgtcg

SEQ ID NO: 5382830 - DNA, 15 bp, Homo sapiens
cagacagggtctgaa

SEQ ID NO: 5382831 - DNA, 17 bp, Homo sapiens
cagacaggtttaaaagt

SEQ ID NO: 5382832 - DNA, 16 bp, Homo sapiens
cagacaggttttcaca

SEQ ID NO: 5382833 - DNA, 22 bp, Homo sapiens
cagacaggttttcacataaatg

SEQ ID NO: 5382834 - DNA, 17 bp, Homo sapiens
cagacagtcacaaattt

SEQ ID NO: 5382835 - DNA, 20 bp, Homo sapiens
cagacagtcacaaatttctc

SEQ ID NO: 5382836 - DNA, 20 bp, Homo sapiens
cagacagtcgctcagtctgt

SEQ ID NO: 5382837 - DNA, 19 bp, Homo sapiens
cagacagtctgttatgcac

SEQ ID NO: 5382838 - DNA, 20 bp, Homo sapiens
cagacagtctgttatgcact

SEQ ID NO: 5382839 - DNA, 23 bp, Homo sapiens
cagacagtctgttatgcactgtg

SEQ ID NO: 5382840 - DNA, 20 bp, Homo sapiens
cagacagttaagagaaatga

SEQ ID NO: 5382841 - DNA, 12 bp, Homo sapiens
cagacataaagc

SEQ ID NO: 5382842 - DNA, 13 bp, Homo sapiens
cagacataaagcc

SEQ ID NO: 5382843 - DNA, 19 bp, Homo sapiens
cagacataaaggaaaagac

SEQ ID NO: 5382844 - DNA, 13 bp, Homo sapiens
cagacatacagct

SEQ ID NO: 5382845 - DNA, 21 bp, Homo sapiens
cagacatacagctgcctacct

SEQ ID NO: 5382846 - DNA, 18 bp, Homo sapiens
cagacatacgaaacacaa

SEQ ID NO: 5382847 - DNA, 21 bp, Homo sapiens
cagacatatccaaagggaata

SEQ ID NO: 5382848 - DNA, 15 bp, Homo sapiens
cagacatatttaact

SEQ ID NO: 5382849 - DNA, 17 bp, Homo sapiens
cagacatccaaactaaa

SEQ ID NO: 5382850 - DNA, 19 bp, Homo sapiens
cagacatccatgtttgtaa

SEQ ID NO: 5382851 - DNA, 22 bp, Homo sapiens
cagacatccatgtttgtaaaac

SEQ ID NO: 5382852 - DNA, 17 bp, Homo sapiens
cagacatccttgcagtt

SEQ ID NO: 5382853 - DNA, 19 bp, Homo sapiens
cagacatctcctcacccca

SEQ ID NO: 5382854 - DNA, 20 bp, Homo sapiens
cagacatctcctcaccccag

SEQ ID NO: 5382855 - DNA, 15 bp, Homo sapiens
cagacatctctggag

SEQ ID NO: 5382856 - DNA, 22 bp, Homo sapiens
cagacatctctggagccagaga

SEQ ID NO: 5382857 - DNA, 17 bp, Homo sapiens
cagacatgaaataaaag

SEQ ID NO: 5382858 - DNA, 18 bp, Homo sapiens
cagacatgccacaaggac

SEQ ID NO: 5382859 - DNA, 15 bp, Homo sapiens
cagacatgccttggt

SEQ ID NO: 5382860 - DNA, 19 bp, Homo sapiens
cagacatgccttggtgccg

SEQ ID NO: 5382861 - DNA, 15 bp, Homo sapiens
cagacatgctgccca

SEQ ID NO: 5382862 - DNA, 20 bp, Homo sapiens
cagacatggaggggatgata

SEQ ID NO: 5382863 - DNA, 23 bp, Homo sapiens
cagacatggtggcatgcacctgc

SEQ ID NO: 5382864 - DNA, 18 bp, Homo sapiens
cagacatgtggtgggaca

SEQ ID NO: 5382865 - DNA, 12 bp, Homo sapiens
cagacatgtttt

SEQ ID NO: 5382866 - DNA, 16 bp, Homo sapiens
cagacattcaatgaat

SEQ ID NO: 5382867 - DNA, 18 bp, Homo sapiens
cagacattcaatgaatta

SEQ ID NO: 5382868 - DNA, 16 bp, Homo sapiens
cagacattctcaaagc

SEQ ID NO: 5382869 - DNA, 17 bp, Homo sapiens
cagacattctcaaagcc

SEQ ID NO: 5382870 - DNA, 20 bp, Homo sapiens
cagacattgacaagcacgca

SEQ ID NO: 5382871 - DNA, 21 bp, Homo sapiens
cagacattgtcagcaaattaa

SEQ ID NO: 5382872 - DNA, 11 bp, Homo sapiens
cagacattgtt

SEQ ID NO: 5382873 - DNA, 14 bp, Homo sapiens
cagacattgttaca

SEQ ID NO: 5382874 - DNA, 13 bp, Homo sapiens
cagacattgtttt

SEQ ID NO: 5382875 - DNA, 23 bp, Homo sapiens
cagacatttatcttttgggtctg

SEQ ID NO: 5382876 - DNA, 13 bp, Homo sapiens
cagacattttaaa

SEQ ID NO: 5382877 - DNA, 15 bp, Homo sapiens
cagacattttcactg

SEQ ID NO: 5382878 - DNA, 15 bp, Homo sapiens
cagacattttgtgtg

SEQ ID NO: 5382879 - DNA, 16 bp, Homo sapiens
cagacattttgtgtga

SEQ ID NO: 5382880 - DNA, 18 bp, Homo sapiens
cagacattttgtgtgaga

SEQ ID NO: 5382881 - DNA, 20 bp, Homo sapiens
cagacattttgtgtgagact

SEQ ID NO: 5382882 - DNA, 15 bp, Homo sapiens
cagacatttttggaa

SEQ ID NO: 5382883 - DNA, 20 bp, Homo sapiens
cagaccaaggcagggcccag

SEQ ID NO: 5382884 - DNA, 19 bp, Homo sapiens
cagaccaataaatttgtaa

SEQ ID NO: 5382885 - DNA, 20 bp, Homo sapiens
cagaccacaaaacttttcta

SEQ ID NO: 5382886 - DNA, 16 bp, Homo sapiens
cagaccacatgcccca

SEQ ID NO: 5382887 - DNA, 16 bp, Homo sapiens
cagaccaccagccgcc

SEQ ID NO: 5382888 - DNA, 17 bp, Homo sapiens
cagaccacctccctgcc

SEQ ID NO: 5382889 - DNA, 15 bp, Homo sapiens
cagaccacctgccag

SEQ ID NO: 5382890 - DNA, 23 bp, Homo sapiens
cagaccacctgccagccatcaca

SEQ ID NO: 5382891 - DNA, 18 bp, Homo sapiens
cagaccacctgcttctga

SEQ ID NO: 5382892 - DNA, 13 bp, Homo sapiens
cagaccacggctc

SEQ ID NO: 5382893 - DNA, 20 bp, Homo sapiens
cagaccacggtgtggggggt

SEQ ID NO: 5382894 - DNA, 15 bp, Homo sapiens
cagaccactgtctcc

SEQ ID NO: 5382895 - DNA, 14 bp, Homo sapiens
cagaccacttgcca

SEQ ID NO: 5382896 - DNA, 16 bp, Homo sapiens
cagaccacttgccacg

SEQ ID NO: 5382897 - DNA, 19 bp, Homo sapiens
cagaccacttgccacgctg

SEQ ID NO: 5382898 - DNA, 18 bp, Homo sapiens
cagaccagagctgtctga

SEQ ID NO: 5382899 - DNA, 16 bp, Homo sapiens
cagaccagcccttccc

SEQ ID NO: 5382900 - DNA, 15 bp, Homo sapiens
cagaccagctggcgg

SEQ ID NO: 5382901 - DNA, 17 bp, Homo sapiens
cagaccagctggcgggt

SEQ ID NO: 5382902 - DNA, 21 bp, Homo sapiens
cagaccatctccagcatcctg

SEQ ID NO: 5382903 - DNA, 14 bp, Homo sapiens
cagaccatgaagta

SEQ ID NO: 5382904 - DNA, 22 bp, Homo sapiens
cagaccatgaagtaaattatgt

SEQ ID NO: 5382905 - DNA, 21 bp, Homo sapiens
cagaccatggacactacaccc

SEQ ID NO: 5382906 - DNA, 15 bp, Homo sapiens
cagaccatgggccaa

SEQ ID NO: 5382907 - DNA, 20 bp, Homo sapiens
cagaccattggggctcccag

SEQ ID NO: 5382908 - DNA, 17 bp, Homo sapiens
cagaccattgtcttcca

SEQ ID NO: 5382909 - DNA, 22 bp, Homo sapiens
cagaccattgtcttccaacccc

SEQ ID NO: 5382910 - DNA, 17 bp, Homo sapiens
cagacccaacccatgcc

SEQ ID NO: 5382911 - DNA, 21 bp, Homo sapiens
cagacccaacccatgcccctg

SEQ ID NO: 5382912 - DNA, 16 bp, Homo sapiens
cagacccacctggagc

SEQ ID NO: 5382913 - DNA, 23 bp, Homo sapiens
cagacccactcccaaagctcaga

SEQ ID NO: 5382914 - DNA, 12 bp, Homo sapiens
cagacccagagc

SEQ ID NO: 5382915 - DNA, 17 bp, Homo sapiens
cagacccagaggtccag

SEQ ID NO: 5382916 - DNA, 22 bp, Homo sapiens
cagacccagcccgcggcctgga

SEQ ID NO: 5382917 - DNA, 14 bp, Homo sapiens
cagacccaggtctt

SEQ ID NO: 5382918 - DNA, 15 bp, Homo sapiens
cagacccaggtcttc

SEQ ID NO: 5382919 - DNA, 16 bp, Homo sapiens
cagacccaggtcttcc

SEQ ID NO: 5382920 - DNA, 23 bp, Homo sapiens
cagacccaggtcttccagacctg

SEQ ID NO: 5382921 - DNA, 20 bp, Homo sapiens
cagacccagtcccacactgt

SEQ ID NO: 5382922 - DNA, 12 bp, Homo sapiens
cagacccagtga

SEQ ID NO: 5382923 - DNA, 19 bp, Homo sapiens
cagacccatacctttccag

SEQ ID NO: 5382924 - DNA, 17 bp, Homo sapiens
cagacccattccttagc

SEQ ID NO: 5382925 - DNA, 22 bp, Homo sapiens
cagaccccaccctgtctgcagg

SEQ ID NO: 5382926 - DNA, 16 bp, Homo sapiens
cagaccccagcggctg

SEQ ID NO: 5382927 - DNA, 15 bp, Homo sapiens
cagaccccagctggg

SEQ ID NO: 5382928 - DNA, 13 bp, Homo sapiens
cagaccccagggc

SEQ ID NO: 5382929 - DNA, 14 bp, Homo sapiens
cagaccccagggca

SEQ ID NO: 5382930 - DNA, 18 bp, Homo sapiens
cagacccccaccccttcc

SEQ ID NO: 5382931 - DNA, 15 bp, Homo sapiens
cagaccccccagccc

SEQ ID NO: 5382932 - DNA, 16 bp, Homo sapiens
cagaccccccagcccc

SEQ ID NO: 5382933 - DNA, 21 bp, Homo sapiens
cagaccccccagcccctcctc

SEQ ID NO: 5382934 - DNA, 23 bp, Homo sapiens
cagaccccccagcccctcctccc

SEQ ID NO: 5382935 - DNA, 22 bp, Homo sapiens
cagacccccccatttcccgcac

SEQ ID NO: 5382936 - DNA, 17 bp, Homo sapiens
cagacccccttgcccag

SEQ ID NO: 5382937 - DNA, 19 bp, Homo sapiens
cagaccccgcagcacgcct

SEQ ID NO: 5382938 - DNA, 17 bp, Homo sapiens
cagaccccgtggctctg

SEQ ID NO: 5382939 - DNA, 21 bp, Homo sapiens
cagaccccgtggctctgggag

SEQ ID NO: 5382940 - DNA, 17 bp, Homo sapiens
cagagaaattatgtttt

SEQ ID NO: 5382941 - DNA, 16 bp, Homo sapiens
cagagaaattctgtgg

SEQ ID NO: 5382942 - DNA, 18 bp, Homo sapiens
cagagaacaatcactatt

SEQ ID NO: 5382943 - DNA, 24 bp, Homo sapiens
cagagaacagcgaagtagcttgct

SEQ ID NO: 5382944 - DNA, 11 bp, Homo sapiens
cagagaacatc

SEQ ID NO: 5382945 - DNA, 14 bp, Homo sapiens
cagagaaccaggct

SEQ ID NO: 5382946 - DNA, 11 bp, Homo sapiens
cagagaaccca

SEQ ID NO: 5382947 - DNA, 23 bp, Homo sapiens
cagagaactaacactattttatg

SEQ ID NO: 5382948 - DNA, 11 bp, Homo sapiens
cagagaacttt

SEQ ID NO: 5382949 - DNA, 20 bp, Homo sapiens
cagagaactttattttggat

SEQ ID NO: 5382950 - DNA, 12 bp, Homo sapiens
cagagaagagac

SEQ ID NO: 5382951 - DNA, 19 bp, Homo sapiens
cagagaagcatcctccaca

SEQ ID NO: 5382952 - DNA, 16 bp, Homo sapiens
cagagaagccagcttg

SEQ ID NO: 5382953 - DNA, 18 bp, Homo sapiens
cagagaagccagcttgtt

SEQ ID NO: 5382954 - DNA, 18 bp, Homo sapiens
cagagaagccatcacctc

SEQ ID NO: 5382955 - DNA, 22 bp, Homo sapiens
cagagaagccatcacctcagat

SEQ ID NO: 5382956 - DNA, 13 bp, Homo sapiens
cagagaagccccg

SEQ ID NO: 5382957 - DNA, 24 bp, Homo sapiens
cagagaagccccttccccatggga

SEQ ID NO: 5382958 - DNA, 14 bp, Homo sapiens
cagagaagcctcag

SEQ ID NO: 5382959 - DNA, 14 bp, Homo sapiens
cagagaagccttca

SEQ ID NO: 5382960 - DNA, 15 bp, Homo sapiens
cagagaagccttcaa

SEQ ID NO: 5382961 - DNA, 22 bp, Homo sapiens
cagagaagcgctgttgcccgcc

SEQ ID NO: 5382962 - DNA, 14 bp, Homo sapiens
cagagaagctcatt

SEQ ID NO: 5382963 - DNA, 16 bp, Homo sapiens
cagagaagctcattta

SEQ ID NO: 5382964 - DNA, 21 bp, Homo sapiens
cagagaagctggaagcctgcc

SEQ ID NO: 5382965 - DNA, 15 bp, Homo sapiens
cagagaagctggact

SEQ ID NO: 5382966 - DNA, 16 bp, Homo sapiens
cagagaagctggactt

SEQ ID NO: 5382967 - DNA, 18 bp, Homo sapiens
cagagaagctggacttct

SEQ ID NO: 5382968 - DNA, 14 bp, Homo sapiens
cagagaaggaaaag

SEQ ID NO: 5382969 - DNA, 15 bp, Homo sapiens
cagagaaggaaaaga

SEQ ID NO: 5382970 - DNA, 23 bp, Homo sapiens
cagagaaggatgtccgttccagg

SEQ ID NO: 5382971 - DNA, 17 bp, Homo sapiens
cagagaaggcaggaatg

SEQ ID NO: 5382972 - DNA, 13 bp, Homo sapiens
cagagaaggcctc

SEQ ID NO: 5382973 - DNA, 18 bp, Homo sapiens
cagagaaggcctcttgtg

SEQ ID NO: 5382974 - DNA, 19 bp, Homo sapiens
cagagaaggcctcttgtgc

SEQ ID NO: 5382975 - DNA, 16 bp, Homo sapiens
cagagaaggctatgta

SEQ ID NO: 5382976 - DNA, 21 bp, Homo sapiens
cagagaagggaagaaggggcc

SEQ ID NO: 5382977 - DNA, 22 bp, Homo sapiens
cagagaagggcaggagaggaag

SEQ ID NO: 5382978 - DNA, 21 bp, Homo sapiens
cagagaagggctcctgcaggc

SEQ ID NO: 5382979 - DNA, 22 bp, Homo sapiens
cagagaaggtagattttaagaa

SEQ ID NO: 5382980 - DNA, 16 bp, Homo sapiens
cagagaagtcacaggg

SEQ ID NO: 5382981 - DNA, 23 bp, Homo sapiens
cagagaagtcagttggagaaaat

SEQ ID NO: 5382982 - DNA, 22 bp, Homo sapiens
cagagaagtgacagggaagcta

SEQ ID NO: 5382983 - DNA, 23 bp, Homo sapiens
cagagaagtgacagggaagctac

SEQ ID NO: 5382984 - DNA, 20 bp, Homo sapiens
cagagaagtgacggttccta

SEQ ID NO: 5382985 - DNA, 20 bp, Homo sapiens
cagagaagttctcaaagtta

SEQ ID NO: 5382986 - DNA, 23 bp, Homo sapiens
cagagaagttctcaaagttaatt

SEQ ID NO: 5382987 - DNA, 16 bp, Homo sapiens
cagagaatatgtctgc

SEQ ID NO: 5382988 - DNA, 15 bp, Homo sapiens
cagagaatctcttgg

SEQ ID NO: 5382989 - DNA, 13 bp, Homo sapiens
cagagaatcttaa

SEQ ID NO: 5382990 - DNA, 16 bp, Homo sapiens
cagagaattatctcaa

SEQ ID NO: 5382991 - DNA, 19 bp, Homo sapiens
cagagaattatctcaagta

SEQ ID NO: 5382992 - DNA, 20 bp, Homo sapiens
cagagaattatctcaagtaa

SEQ ID NO: 5382993 - DNA, 21 bp, Homo sapiens
cagagaattgctgattcttga

SEQ ID NO: 5382994 - DNA, 20 bp, Homo sapiens
cagagaatttctaaagtaaa

SEQ ID NO: 5382995 - DNA, 22 bp, Homo sapiens
cagagacaaatatttctagaca

SEQ ID NO: 5382996 - DNA, 22 bp, Homo sapiens
cagagacaacaggtaaaacagg

SEQ ID NO: 5382997 - DNA, 23 bp, Homo sapiens
cagagacaacaggtaaaacaggg

SEQ ID NO: 5382998 - DNA, 23 bp, Homo sapiens
cagagacaagaaaggcagacaca

SEQ ID NO: 5382999 - DNA, 20 bp, Homo sapiens
cagagacaaggtcacctggg

SEQ ID NO: 5383000 - DNA, 16 bp, Homo sapiens
cagagacacaagcctt

SEQ ID NO: 5383001 - DNA, 20 bp, Homo sapiens
cagagacaccaaactgccaa

SEQ ID NO: 5383002 - DNA, 17 bp, Homo sapiens
cagagacacctgcacct

SEQ ID NO: 5383003 - DNA, 16 bp, Homo sapiens
cagagacacggtccca

SEQ ID NO: 5383004 - DNA, 13 bp, Homo sapiens
cagagacactgag

SEQ ID NO: 5383005 - DNA, 16 bp, Homo sapiens
cagagacactgagcca

SEQ ID NO: 5383006 - DNA, 18 bp, Homo sapiens
cagagacactgagccagt

SEQ ID NO: 5383007 - DNA, 19 bp, Homo sapiens
cagagacactgagccagtc

SEQ ID NO: 5383008 - DNA, 23 bp, Homo sapiens
cagagacactgttgataaaaact

SEQ ID NO: 5383009 - DNA, 20 bp, Homo sapiens
cagagacactttgtctagtg

SEQ ID NO: 5383010 - DNA, 13 bp, Homo sapiens
cagagacagaaac

SEQ ID NO: 5383011 - DNA, 19 bp, Homo sapiens
cagagacagaaacagagag

SEQ ID NO: 5383012 - DNA, 21 bp, Homo sapiens
cagagacagaaacagagagag

SEQ ID NO: 5383013 - DNA, 22 bp, Homo sapiens
cagagacagaaacagagagaga

SEQ ID NO: 5383014 - DNA, 19 bp, Homo sapiens
cagagacagatacctccaa

SEQ ID NO: 5383015 - DNA, 15 bp, Homo sapiens
cagagacaggtggcc

SEQ ID NO: 5383016 - DNA, 21 bp, Homo sapiens
cagagacatacttgaagggcc

SEQ ID NO: 5383017 - DNA, 23 bp, Homo sapiens
cagagacatcagcccttgggggt

SEQ ID NO: 5383018 - DNA, 17 bp, Homo sapiens
cagagacatgcagagat

SEQ ID NO: 5383019 - DNA, 21 bp, Homo sapiens
cagagacatgggcctcccact

SEQ ID NO: 5383020 - DNA, 22 bp, Homo sapiens
cagagacatgtggcagcaggca

SEQ ID NO: 5383021 - DNA, 13 bp, Homo sapiens
cagagacattcct

SEQ ID NO: 5383022 - DNA, 14 bp, Homo sapiens
cagagaccaaataa

SEQ ID NO: 5383023 - DNA, 14 bp, Homo sapiens
cagagaccacacca

SEQ ID NO: 5383024 - DNA, 16 bp, Homo sapiens
cagagaccacaccact

SEQ ID NO: 5383025 - DNA, 19 bp, Homo sapiens
cagagaccaccgcgcccct

SEQ ID NO: 5383026 - DNA, 23 bp, Homo sapiens
cagagaccaccgcgcccctctgc

SEQ ID NO: 5383027 - DNA, 15 bp, Homo sapiens
cagagaccagcactc

SEQ ID NO: 5383028 - DNA, 19 bp, Homo sapiens
cagagaccagcactcagcc

SEQ ID NO: 5383029 - DNA, 21 bp, Homo sapiens
cagagaccagcactcagcctc

SEQ ID NO: 5383030 - DNA, 15 bp, Homo sapiens
cagagaccaggctgt

SEQ ID NO: 5383031 - DNA, 13 bp, Homo sapiens
cagagaccagggc

SEQ ID NO: 5383032 - DNA, 21 bp, Homo sapiens
cagagaccagggctccagccc

SEQ ID NO: 5383033 - DNA, 17 bp, Homo sapiens
cagagaccataagagaa

SEQ ID NO: 5383034 - DNA, 16 bp, Homo sapiens
cagagaccatccctga

SEQ ID NO: 5383035 - DNA, 19 bp, Homo sapiens
cagagaccatccctgaagg

SEQ ID NO: 5383036 - DNA, 17 bp, Homo sapiens
cagagacccaacagcag

SEQ ID NO: 5383037 - DNA, 19 bp, Homo sapiens
cagagacccagatctcatg

SEQ ID NO: 5383038 - DNA, 16 bp, Homo sapiens
cagagaccccaggatc

SEQ ID NO: 5383039 - DNA, 15 bp, Homo sapiens
cagagaccccttcct

SEQ ID NO: 5383040 - DNA, 16 bp, Homo sapiens
cagagaccccttcctt

SEQ ID NO: 5383041 - DNA, 20 bp, Homo sapiens
cagagaccccttcctttcct

SEQ ID NO: 5383042 - DNA, 16 bp, Homo sapiens
cagagaccgtcctcac

SEQ ID NO: 5383043 - DNA, 17 bp, Homo sapiens
cagagaccgtcctcacc

SEQ ID NO: 5383044 - DNA, 13 bp, Homo sapiens
cagagacctcatc

SEQ ID NO: 5383045 - DNA, 19 bp, Homo sapiens
cagagacctcatcagcctt

SEQ ID NO: 5383046 - DNA, 16 bp, Homo sapiens
cagagacctcctgatg

SEQ ID NO: 5383047 - DNA, 18 bp, Homo sapiens
cagagacctgctccagat

SEQ ID NO: 5383048 - DNA, 15 bp, Homo sapiens
cagagaccttaattt

SEQ ID NO: 5383049 - DNA, 20 bp, Homo sapiens
cagagaccttcaaatgcgaa

SEQ ID NO: 5383050 - DNA, 17 bp, Homo sapiens
cagagaccttccagaaa

SEQ ID NO: 5383051 - DNA, 14 bp, Homo sapiens
cagagaccttctga

SEQ ID NO: 5383052 - DNA, 14 bp, Homo sapiens
cagagaccttttct

SEQ ID NO: 5383053 - DNA, 16 bp, Homo sapiens
cagagacgcaagggag

SEQ ID NO: 5383054 - DNA, 14 bp, Homo sapiens
cagagacgcaggaa

SEQ ID NO: 5383055 - DNA, 19 bp, Homo sapiens
cagagacgcccagccccat

SEQ ID NO: 5383056 - DNA, 14 bp, Homo sapiens
cagagacggcagcc

SEQ ID NO: 5383057 - DNA, 21 bp, Homo sapiens
cagagacggcagccccatcct

SEQ ID NO: 5383058 - DNA, 15 bp, Homo sapiens
cagagacggtctgga

SEQ ID NO: 5383059 - DNA, 12 bp, Homo sapiens
cagagactcaga

SEQ ID NO: 5383060 - DNA, 20 bp, Homo sapiens
cagagactcagggccccagc

SEQ ID NO: 5383061 - DNA, 17 bp, Homo sapiens
cagagactcatttcaca

SEQ ID NO: 5383062 - DNA, 15 bp, Homo sapiens
cagagactcccagga

SEQ ID NO: 5383063 - DNA, 23 bp, Homo sapiens
cagagactcctgcaggcagccag

SEQ ID NO: 5383064 - DNA, 20 bp, Homo sapiens
cagagactctattttaatgt

SEQ ID NO: 5383065 - DNA, 16 bp, Homo sapiens
cagagactctccctga

SEQ ID NO: 5383066 - DNA, 16 bp, Homo sapiens
cagagactctggaagc

SEQ ID NO: 5383067 - DNA, 18 bp, Homo sapiens
cagagactctggaagccc

SEQ ID NO: 5383068 - DNA, 19 bp, Homo sapiens
cagagactgcaagctgctt

SEQ ID NO: 5383069 - DNA, 20 bp, Homo sapiens
cagagactgcccaccctggg

SEQ ID NO: 5383070 - DNA, 21 bp, Homo sapiens
cagagactgcccaccctgggc

SEQ ID NO: 5383071 - DNA, 14 bp, Homo sapiens
cagagactgctgtg

SEQ ID NO: 5383072 - DNA, 15 bp, Homo sapiens
cagagactggcagcc

SEQ ID NO: 5383073 - DNA, 17 bp, Homo sapiens
cagagactggcagccag

SEQ ID NO: 5383074 - DNA, 15 bp, Homo sapiens
cagagactgtgcttg

SEQ ID NO: 5383075 - DNA, 17 bp, Homo sapiens
cagagacttagaagcat

SEQ ID NO: 5383076 - DNA, 14 bp, Homo sapiens
cagagacttgggga

SEQ ID NO: 5383077 - DNA, 14 bp, Homo sapiens
cagagactttgtag

SEQ ID NO: 5383078 - DNA, 15 bp, Homo sapiens
cagagagaaaaagag

SEQ ID NO: 5383079 - DNA, 23 bp, Homo sapiens
cagagagaaatcaggcctgatga

SEQ ID NO: 5383080 - DNA, 18 bp, Homo sapiens
cagagagaacaacaggca

SEQ ID NO: 5383081 - DNA, 21 bp, Homo sapiens
cagagagaacaacaggcaggg

SEQ ID NO: 5383082 - DNA, 18 bp, Homo sapiens
cagagagaaccaggaggg

SEQ ID NO: 5383083 - DNA, 16 bp, Homo sapiens
cagagagaagagcccc

SEQ ID NO: 5383084 - DNA, 16 bp, Homo sapiens
cagagagaagcacccc

SEQ ID NO: 5383085 - DNA, 19 bp, Homo sapiens
cagagagaagcaccccacc

SEQ ID NO: 5383086 - DNA, 19 bp, Homo sapiens
cagagagaatgagagcgac

SEQ ID NO: 5383087 - DNA, 23 bp, Homo sapiens
cagagagaatgagagcgacacag

SEQ ID NO: 5383088 - DNA, 20 bp, Homo sapiens
cagagagacaacttgctcct

SEQ ID NO: 5383089 - DNA, 22 bp, Homo sapiens
cagagagacaacttgctccttt

SEQ ID NO: 5383090 - DNA, 23 bp, Homo sapiens
cagagagacaacttgctcctttc

SEQ ID NO: 5383091 - DNA, 15 bp, Homo sapiens
cagagagacagaccg

SEQ ID NO: 5383092 - DNA, 15 bp, Homo sapiens
cagagagaccctgcc

SEQ ID NO: 5383093 - DNA, 17 bp, Homo sapiens
cagagagacctcatcct

SEQ ID NO: 5383094 - DNA, 23 bp, Homo sapiens
cagagagacctcatcctgctctt

SEQ ID NO: 5383095 - DNA, 19 bp, Homo sapiens
cagagagagaagtgcccct

SEQ ID NO: 5383096 - DNA, 14 bp, Homo sapiens
cagagagagacaga

SEQ ID NO: 5383097 - DNA, 17 bp, Homo sapiens
cagagagagagaaagag

SEQ ID NO: 5383098 - DNA, 20 bp, Homo sapiens
cagagagagagagagagaaa

SEQ ID NO: 5383099 - DNA, 21 bp, Homo sapiens
cagagagagagagagagaaag

SEQ ID NO: 5383100 - DNA, 19 bp, Homo sapiens
cagagagagatactctggg

SEQ ID NO: 5383101 - DNA, 17 bp, Homo sapiens
cagagagagcaaggaag

SEQ ID NO: 5383102 - DNA, 13 bp, Homo sapiens
cagagagaggagg

SEQ ID NO: 5383103 - DNA, 18 bp, Homo sapiens
cagagagaggatgcagag

SEQ ID NO: 5383104 - DNA, 20 bp, Homo sapiens
cagagagaggatgcagaggg

SEQ ID NO: 5383105 - DNA, 17 bp, Homo sapiens
cagagagaggggcctgc

SEQ ID NO: 5383106 - DNA, 19 bp, Homo sapiens
cagagagaggggcctgcag

SEQ ID NO: 5383107 - DNA, 13 bp, Homo sapiens
cagagagatgaag

SEQ ID NO: 5383108 - DNA, 18 bp, Homo sapiens
cagagagcacctggtggg

SEQ ID NO: 5383109 - DNA, 14 bp, Homo sapiens
cagagagcagctcc

SEQ ID NO: 5383110 - DNA, 19 bp, Homo sapiens
cagagagcagctccctttc

SEQ ID NO: 5383111 - DNA, 21 bp, Homo sapiens
cagagagcagctccctttctc

SEQ ID NO: 5383112 - DNA, 14 bp, Homo sapiens
cagagagcaggcag

SEQ ID NO: 5383113 - DNA, 15 bp, Homo sapiens
cagagagcaggcagg

SEQ ID NO: 5383114 - DNA, 20 bp, Homo sapiens
cagagagcaggggagcttgg

SEQ ID NO: 5383115 - DNA, 14 bp, Homo sapiens
cagagagcatcttt

SEQ ID NO: 5383116 - DNA, 16 bp, Homo sapiens
cagaggagcccagtgg

SEQ ID NO: 5383117 - DNA, 16 bp, Homo sapiens
cagaggagcgcaggca

SEQ ID NO: 5383118 - DNA, 17 bp, Homo sapiens
cagaggagcgcaggcag

SEQ ID NO: 5383119 - DNA, 11 bp, Homo sapiens
cagaggagctt

SEQ ID NO: 5383120 - DNA, 13 bp, Homo sapiens
cagaggaggatgt

SEQ ID NO: 5383121 - DNA, 21 bp, Homo sapiens
cagaggaggatgtaaggcctt

SEQ ID NO: 5383122 - DNA, 15 bp, Homo sapiens
cagaggaggcctcaa

SEQ ID NO: 5383123 - DNA, 19 bp, Homo sapiens
cagaggaggggccgctgcc

SEQ ID NO: 5383124 - DNA, 22 bp, Homo sapiens
cagaggaggggtggtgtccttc

SEQ ID NO: 5383125 - DNA, 15 bp, Homo sapiens
cagaggaggtcagca

SEQ ID NO: 5383126 - DNA, 22 bp, Homo sapiens
cagaggaggtgcccgggcaggg

SEQ ID NO: 5383127 - DNA, 16 bp, Homo sapiens
cagaggagtccagggc

SEQ ID NO: 5383128 - DNA, 20 bp, Homo sapiens
cagaggagtccagggcggga

SEQ ID NO: 5383129 - DNA, 21 bp, Homo sapiens
cagaggagtccagggcgggag

SEQ ID NO: 5383130 - DNA, 14 bp, Homo sapiens
cagaggagtctggg

SEQ ID NO: 5383131 - DNA, 22 bp, Homo sapiens
cagaggagtctgggaaggggcg

SEQ ID NO: 5383132 - DNA, 16 bp, Homo sapiens
cagaggagtggatctg

SEQ ID NO: 5383133 - DNA, 15 bp, Homo sapiens
cagaggatgagctct

SEQ ID NO: 5383134 - DNA, 17 bp, Homo sapiens
cagaggatgagctctac

SEQ ID NO: 5383135 - DNA, 19 bp, Homo sapiens
cagaggatgagctctaccc

SEQ ID NO: 5383136 - DNA, 18 bp, Homo sapiens
cagaggatgccttttctg

SEQ ID NO: 5383137 - DNA, 21 bp, Homo sapiens
cagaggatgccttttctgtga

SEQ ID NO: 5383138 - DNA, 19 bp, Homo sapiens
cagaggatgctctttccca

SEQ ID NO: 5383139 - DNA, 15 bp, Homo sapiens
cagaggatgctgaag

SEQ ID NO: 5383140 - DNA, 16 bp, Homo sapiens
cagaggatgctgaagt

SEQ ID NO: 5383141 - DNA, 18 bp, Homo sapiens
cagaggatggccagtgtc

SEQ ID NO: 5383142 - DNA, 19 bp, Homo sapiens
cagaggatggccagtgtct

SEQ ID NO: 5383143 - DNA, 12 bp, Homo sapiens
cagaggatggct

SEQ ID NO: 5383144 - DNA, 22 bp, Homo sapiens
cagaggattctgtcttccaggc

SEQ ID NO: 5383145 - DNA, 16 bp, Homo sapiens
cagaggattgaggctt

SEQ ID NO: 5383146 - DNA, 21 bp, Homo sapiens
cagaggattgctgccccatca

SEQ ID NO: 5383147 - DNA, 12 bp, Homo sapiens
cagaggcaagga

SEQ ID NO: 5383148 - DNA, 14 bp, Homo sapiens
cagaggcaaggatg

SEQ ID NO: 5383149 - DNA, 21 bp, Homo sapiens
cagaggcaaggatggtggggc

SEQ ID NO: 5383150 - DNA, 14 bp, Homo sapiens
cagaggcaataggt

SEQ ID NO: 5383151 - DNA, 13 bp, Homo sapiens
cagaggcacctca

SEQ ID NO: 5383152 - DNA, 12 bp, Homo sapiens
cagaggcactca

SEQ ID NO: 5383153 - DNA, 13 bp, Homo sapiens
cagaggcagaacc

SEQ ID NO: 5383154 - DNA, 13 bp, Homo sapiens
cagaggcagacag

SEQ ID NO: 5383155 - DNA, 18 bp, Homo sapiens
cagaggcagaggttgcag

SEQ ID NO: 5383156 - DNA, 15 bp, Homo sapiens
cagaggcagcaggag

SEQ ID NO: 5383157 - DNA, 19 bp, Homo sapiens
cagaggcagccccattctg

SEQ ID NO: 5383158 - DNA, 21 bp, Homo sapiens
cagaggcagcttcaagtgcct

SEQ ID NO: 5383159 - DNA, 22 bp, Homo sapiens
cagaggcagcttcaagtgcctt

SEQ ID NO: 5383160 - DNA, 11 bp, Homo sapiens
cagaggcaggc

SEQ ID NO: 5383161 - DNA, 21 bp, Homo sapiens
cagaggcaggctgggacggac

SEQ ID NO: 5383162 - DNA, 14 bp, Homo sapiens
cagaggcagggcag

SEQ ID NO: 5383163 - DNA, 13 bp, Homo sapiens
cagaggcagggcc

SEQ ID NO: 5383164 - DNA, 15 bp, Homo sapiens
cagaggcagggccct

SEQ ID NO: 5383165 - DNA, 16 bp, Homo sapiens
cagaggcagggccctg

SEQ ID NO: 5383166 - DNA, 18 bp, Homo sapiens
cagaggcagggccctggg

SEQ ID NO: 5383167 - DNA, 19 bp, Homo sapiens
cagaggcagggccctgggg

SEQ ID NO: 5383168 - DNA, 17 bp, Homo sapiens
cagaggcatttgagcag

SEQ ID NO: 5383169 - DNA, 19 bp, Homo sapiens
cagaggcatttgagcagct

SEQ ID NO: 5383170 - DNA, 18 bp, Homo sapiens
cagaggccaacactgtgg

SEQ ID NO: 5383171 - DNA, 14 bp, Homo sapiens
cagaggccaaggag

SEQ ID NO: 5383172 - DNA, 11 bp, Homo sapiens
cagaggccagg

SEQ ID NO: 5383173 - DNA, 20 bp, Homo sapiens
cagaggccaggaatctgcca

SEQ ID NO: 5383174 - DNA, 17 bp, Homo sapiens
cagaggccaggatgcct

SEQ ID NO: 5383175 - DNA, 19 bp, Homo sapiens
cagaggccaggatgcctga

SEQ ID NO: 5383176 - DNA, 14 bp, Homo sapiens
cagaggccatggca

SEQ ID NO: 5383177 - DNA, 20 bp, Homo sapiens
cagaggccatgggcctcctg

SEQ ID NO: 5383178 - DNA, 13 bp, Homo sapiens
cagaggcccagga

SEQ ID NO: 5383179 - DNA, 15 bp, Homo sapiens
cagaggcccaggctg

SEQ ID NO: 5383180 - DNA, 17 bp, Homo sapiens
cagaggcccaggctgcc

SEQ ID NO: 5383181 - DNA, 11 bp, Homo sapiens
cagaggcccca

SEQ ID NO: 5383182 - DNA, 22 bp, Homo sapiens
cagaggccccaataccccatgg

SEQ ID NO: 5383183 - DNA, 19 bp, Homo sapiens
cagaggccccacctgaagg

SEQ ID NO: 5383184 - DNA, 20 bp, Homo sapiens
cagaggccccacctgaaggg

SEQ ID NO: 5383185 - DNA, 22 bp, Homo sapiens
cagaggcccccagcccagggct

SEQ ID NO: 5383186 - DNA, 24 bp, Homo sapiens
cagaggcccccagcccagggctcc

SEQ ID NO: 5383187 - DNA, 14 bp, Homo sapiens
cagaggcccccagt

SEQ ID NO: 5383188 - DNA, 19 bp, Homo sapiens
cagaggcccccagtgggga

SEQ ID NO: 5383189 - DNA, 20 bp, Homo sapiens
cagaggccccttgctgctgg

SEQ ID NO: 5383190 - DNA, 22 bp, Homo sapiens
cagaggccccttgctgctggct

SEQ ID NO: 5383191 - DNA, 17 bp, Homo sapiens
cagaggcccgaggcacc

SEQ ID NO: 5383192 - DNA, 10 bp, Homo sapiens
cagaggccct

SEQ ID NO: 5383193 - DNA, 23 bp, Homo sapiens
cagaggccctaggcgggatgggc

SEQ ID NO: 5383194 - DNA, 22 bp, Homo sapiens
cagaggccctcctgtgctggtg

SEQ ID NO: 5383195 - DNA, 19 bp, Homo sapiens
cagaggccctgaagcctcc

SEQ ID NO: 5383196 - DNA, 15 bp, Homo sapiens
cagaggccctgccac

SEQ ID NO: 5383197 - DNA, 20 bp, Homo sapiens
cagaggccctgccacgtccc

SEQ ID NO: 5383198 - DNA, 17 bp, Homo sapiens
cagaggccctgccccca

SEQ ID NO: 5383199 - DNA, 19 bp, Homo sapiens
cagaggccctgcccccacc

SEQ ID NO: 5383200 - DNA, 13 bp, Homo sapiens
cagaggccctgga

SEQ ID NO: 5383201 - DNA, 15 bp, Homo sapiens
cagaggccctggagg

SEQ ID NO: 5383202 - DNA, 16 bp, Homo sapiens
cagaggccctggaggt

SEQ ID NO: 5383203 - DNA, 17 bp, Homo sapiens
cagaggccgctctgggg

SEQ ID NO: 5383204 - DNA, 14 bp, Homo sapiens
cagaggccgctgcc

SEQ ID NO: 5383205 - DNA, 17 bp, Homo sapiens
cagaggccgctgcccct

SEQ ID NO: 5383206 - DNA, 18 bp, Homo sapiens
cagaggccggggtccagg

SEQ ID NO: 5383207 - DNA, 20 bp, Homo sapiens
cagaggcctagtcagccaca

SEQ ID NO: 5383208 - DNA, 20 bp, Homo sapiens
cagaggcctataatgaagct

SEQ ID NO: 5383209 - DNA, 16 bp, Homo sapiens
cagaggcctcccccag

SEQ ID NO: 5383210 - DNA, 21 bp, Homo sapiens
cagaggcctcccccagccagg

SEQ ID NO: 5383211 - DNA, 12 bp, Homo sapiens
cagaggcctgac

SEQ ID NO: 5383212 - DNA, 19 bp, Homo sapiens
cagaggcctgcagggcctc

SEQ ID NO: 5383213 - DNA, 13 bp, Homo sapiens
cagaggcctgccc

SEQ ID NO: 5383214 - DNA, 14 bp, Homo sapiens
cagaggcctgcccg

SEQ ID NO: 5383215 - DNA, 17 bp, Homo sapiens
cagaggcctgctgccag

SEQ ID NO: 5383216 - DNA, 21 bp, Homo sapiens
cagaggcctgctgccagtgca

SEQ ID NO: 5383217 - DNA, 22 bp, Homo sapiens
cagaggcctgctgccagtgcag

SEQ ID NO: 5383218 - DNA, 14 bp, Homo sapiens
cagaggcctgggct

SEQ ID NO: 5383219 - DNA, 22 bp, Homo sapiens
cagaggcctggtgccctggccc

SEQ ID NO: 5383220 - DNA, 20 bp, Homo sapiens
cagaggccttgtcatcctcc

SEQ ID NO: 5383221 - DNA, 22 bp, Homo sapiens
cagaggcgaggggacagcccag

SEQ ID NO: 5383222 - DNA, 18 bp, Homo sapiens
cagaggcgcactgtgacc

SEQ ID NO: 5383223 - DNA, 19 bp, Homo sapiens
cagaggcggaaaccttgca

SEQ ID NO: 5383224 - DNA, 20 bp, Homo sapiens
cagaggcggaaaccttgcag

SEQ ID NO: 5383225 - DNA, 22 bp, Homo sapiens
cagaggcggaaaccttgcagca

SEQ ID NO: 5383226 - DNA, 19 bp, Homo sapiens
cagaggcgtactacccagc

SEQ ID NO: 5383227 - DNA, 16 bp, Homo sapiens
cagaggctaagatgag

SEQ ID NO: 5383228 - DNA, 23 bp, Homo sapiens
cagaggctaattcagtgtcacat

SEQ ID NO: 5383229 - DNA, 17 bp, Homo sapiens
cagaggctaattctgca

SEQ ID NO: 5383230 - DNA, 13 bp, Homo sapiens
cagaggctccaca

SEQ ID NO: 5383231 - DNA, 14 bp, Homo sapiens
cagaggctccacag

SEQ ID NO: 5383232 - DNA, 14 bp, Homo sapiens
cagaggctcctgga

SEQ ID NO: 5383233 - DNA, 16 bp, Homo sapiens
cagaggctcctggagc

SEQ ID NO: 5383234 - DNA, 17 bp, Homo sapiens
cagaggctcctggagcc

SEQ ID NO: 5383235 - DNA, 18 bp, Homo sapiens
cagaggctcctggagcca

SEQ ID NO: 5383236 - DNA, 19 bp, Homo sapiens
cagaggctcctggagccag

SEQ ID NO: 5383237 - DNA, 15 bp, Homo sapiens
cagaggctgagcagg

SEQ ID NO: 5383238 - DNA, 15 bp, Homo sapiens
cagaggctgagccct

SEQ ID NO: 5383239 - DNA, 13 bp, Homo sapiens
cagaggctgaggt

SEQ ID NO: 5383240 - DNA, 21 bp, Homo sapiens
cagaggctgcacccctgggcc

SEQ ID NO: 5383241 - DNA, 23 bp, Homo sapiens
cagaggctgcacccctgggccag

SEQ ID NO: 5383242 - DNA, 14 bp, Homo sapiens
cagaggctgcagga

SEQ ID NO: 5383243 - DNA, 14 bp, Homo sapiens
cagaggctgcccca

SEQ ID NO: 5383244 - DNA, 14 bp, Homo sapiens
cagaggctggaggc

SEQ ID NO: 5383245 - DNA, 16 bp, Homo sapiens
cagaggctggaggcag

SEQ ID NO: 5383246 - DNA, 18 bp, Homo sapiens
cagaggctggaggcaggg

SEQ ID NO: 5383247 - DNA, 15 bp, Homo sapiens
cagaggctggcacca

SEQ ID NO: 5383248 - DNA, 14 bp, Homo sapiens
cagaggctggcact

SEQ ID NO: 5383249 - DNA, 22 bp, Homo sapiens
cagaggctgggggaggcggcac

SEQ ID NO: 5383250 - DNA, 14 bp, Homo sapiens
cagaggctgtggct

SEQ ID NO: 5383251 - DNA, 15 bp, Homo sapiens
cagaggctgtggtca

SEQ ID NO: 5383252 - DNA, 21 bp, Homo sapiens
cagaggctgtggtcagagagg

SEQ ID NO: 5383253 - DNA, 22 bp, Homo sapiens
cagaggctgtggtcagagaggg

SEQ ID NO: 5383254 - DNA, 16 bp, Homo sapiens
cagaggcttcttcaga

SEQ ID NO: 5383255 - DNA, 20 bp, Homo sapiens
cagaggcttcttcagatcag

SEQ ID NO: 5383256 - DNA, 13 bp, Homo sapiens
cagagggaaaggc

SEQ ID NO: 5383257 - DNA, 14 bp, Homo sapiens
cagagggaagccat

SEQ ID NO: 5383258 - DNA, 16 bp, Homo sapiens
cagagggaagccatgt

SEQ ID NO: 5383259 - DNA, 21 bp, Homo sapiens
cagagggaatgttccctgcac

SEQ ID NO: 5383260 - DNA, 14 bp, Homo sapiens
cagagggacagggt

SEQ ID NO: 5383261 - DNA, 18 bp, Homo sapiens
cagagggaccaaattgct

SEQ ID NO: 5383262 - DNA, 21 bp, Homo sapiens
cagagggaccaaattgcttct

SEQ ID NO: 5383263 - DNA, 19 bp, Homo sapiens
cagagggaccagctggggg

SEQ ID NO: 5383264 - DNA, 23 bp, Homo sapiens
cagagggaccagctggggggcag

SEQ ID NO: 5383265 - DNA, 13 bp, Homo sapiens
cagagggactgga

SEQ ID NO: 5383266 - DNA, 17 bp, Homo sapiens
cagagggactggacagc

SEQ ID NO: 5383267 - DNA, 22 bp, Homo sapiens
cagagggactggacagccaggg

SEQ ID NO: 5383268 - DNA, 23 bp, Homo sapiens
cagagggactggacagccagggc

SEQ ID NO: 5383269 - DNA, 18 bp, Homo sapiens
cagagggactgtcagctg

SEQ ID NO: 5383270 - DNA, 19 bp, Homo sapiens
cagagggactttgtataga

SEQ ID NO: 5383271 - DNA, 15 bp, Homo sapiens
cagagggagaaggga

SEQ ID NO: 5383272 - DNA, 17 bp, Homo sapiens
cagagggagaagggaga

SEQ ID NO: 5383273 - DNA, 22 bp, Homo sapiens
cagagggagaagggagaacagg

SEQ ID NO: 5383274 - DNA, 19 bp, Homo sapiens
cagagggagaatccaaggg

SEQ ID NO: 5383275 - DNA, 14 bp, Homo sapiens
cagagggagcaggc

SEQ ID NO: 5383276 - DNA, 16 bp, Homo sapiens
cagagggagcaggccg

SEQ ID NO: 5383277 - DNA, 13 bp, Homo sapiens
cagagggagctgt

SEQ ID NO: 5383278 - DNA, 22 bp, Homo sapiens
cagagggaggaatcgaggaacc

SEQ ID NO: 5383279 - DNA, 23 bp, Homo sapiens
cagagggaggaatcgaggaacca

SEQ ID NO: 5383280 - DNA, 15 bp, Homo sapiens
cagagggagtagaat

SEQ ID NO: 5383281 - DNA, 20 bp, Homo sapiens
cagagggagtgacagaggca

SEQ ID NO: 5383282 - DNA, 20 bp, Homo sapiens
cagagggagtttaatacagg

SEQ ID NO: 5383283 - DNA, 16 bp, Homo sapiens
cagagggataaggcag

SEQ ID NO: 5383284 - DNA, 21 bp, Homo sapiens
cagagggatgaaatgccaaga

SEQ ID NO: 5383285 - DNA, 12 bp, Homo sapiens
cagagggcacat

SEQ ID NO: 5383286 - DNA, 14 bp, Homo sapiens
cagagggcacatga

SEQ ID NO: 5383287 - DNA, 21 bp, Homo sapiens
cagagggcagtctagtcctgg

SEQ ID NO: 5383288 - DNA, 14 bp, Homo sapiens
cagagggccagagc

SEQ ID NO: 5383289 - DNA, 13 bp, Homo sapiens
cagagggccagca

SEQ ID NO: 5383290 - DNA, 18 bp, Homo sapiens
cagagggccagcaggctc

SEQ ID NO: 5383291 - DNA, 20 bp, Homo sapiens
cagagggccagcaggctcct

SEQ ID NO: 5383292 - DNA, 23 bp, Homo sapiens
cagagggccattgaactctgaga

SEQ ID NO: 5383293 - DNA, 18 bp, Homo sapiens
cagagggcccaggcaggc

SEQ ID NO: 5383294 - DNA, 18 bp, Homo sapiens
cagatagccagacacatg

SEQ ID NO: 5383295 - DNA, 13 bp, Homo sapiens
cagatagcccagg

SEQ ID NO: 5383296 - DNA, 17 bp, Homo sapiens
cagatagcccaggagca

SEQ ID NO: 5383297 - DNA, 24 bp, Homo sapiens
cagatagcctagggtgagggtgac

SEQ ID NO: 5383298 - DNA, 17 bp, Homo sapiens
cagataggccttcttgt

SEQ ID NO: 5383299 - DNA, 15 bp, Homo sapiens
cagatagtcccagca

SEQ ID NO: 5383300 - DNA, 15 bp, Homo sapiens
cagatagtgcctctg

SEQ ID NO: 5383301 - DNA, 22 bp, Homo sapiens
cagatataaaagactgaccaat

SEQ ID NO: 5383302 - DNA, 20 bp, Homo sapiens
cagatataaaataggcttag

SEQ ID NO: 5383303 - DNA, 18 bp, Homo sapiens
cagatataaatggctggt

SEQ ID NO: 5383304 - DNA, 20 bp, Homo sapiens
cagatataaatggctggttt

SEQ ID NO: 5383305 - DNA, 23 bp, Homo sapiens
cagatataaatggctggttttta

SEQ ID NO: 5383306 - DNA, 16 bp, Homo sapiens
cagatataactgtctt

SEQ ID NO: 5383307 - DNA, 22 bp, Homo sapiens
cagatataactgtcttgtttca

SEQ ID NO: 5383308 - DNA, 14 bp, Homo sapiens
cagatataagagaa

SEQ ID NO: 5383309 - DNA, 23 bp, Homo sapiens
cagatataagatttgtacatatt

SEQ ID NO: 5383310 - DNA, 14 bp, Homo sapiens
cagatatacacatg

SEQ ID NO: 5383311 - DNA, 19 bp, Homo sapiens
cagatatacacatggatgc

SEQ ID NO: 5383312 - DNA, 20 bp, Homo sapiens
cagatatagatcctgagctc

SEQ ID NO: 5383313 - DNA, 21 bp, Homo sapiens
cagatatagcattaataaaac

SEQ ID NO: 5383314 - DNA, 23 bp, Homo sapiens
cagatatagcattaataaaactg

SEQ ID NO: 5383315 - DNA, 20 bp, Homo sapiens
cagatatatatcatattggt

SEQ ID NO: 5383316 - DNA, 15 bp, Homo sapiens
cagatatatattcat

SEQ ID NO: 5383317 - DNA, 14 bp, Homo sapiens
cagatatatttttc

SEQ ID NO: 5383318 - DNA, 15 bp, Homo sapiens
cagatatatttttca

SEQ ID NO: 5383319 - DNA, 14 bp, Homo sapiens
cagatatcaaaatt

SEQ ID NO: 5383320 - DNA, 15 bp, Homo sapiens
cagatatcaaaattc

SEQ ID NO: 5383321 - DNA, 15 bp, Homo sapiens
cagatatcagtgtct

SEQ ID NO: 5383322 - DNA, 21 bp, Homo sapiens
cagatatcgagagtttctatg

SEQ ID NO: 5383323 - DNA, 18 bp, Homo sapiens
cagatatcttcagtttaa

SEQ ID NO: 5383324 - DNA, 15 bp, Homo sapiens
cagatatgatatgta

SEQ ID NO: 5383325 - DNA, 18 bp, Homo sapiens
cagatatgatatgtaaac

SEQ ID NO: 5383326 - DNA, 22 bp, Homo sapiens
cagatatgcacacacatggatg

SEQ ID NO: 5383327 - DNA, 16 bp, Homo sapiens
cagatatggaaacaga

SEQ ID NO: 5383328 - DNA, 17 bp, Homo sapiens
cagatatggaaacagaa

SEQ ID NO: 5383329 - DNA, 20 bp, Homo sapiens
cagatatggaaacagaagac

SEQ ID NO: 5383330 - DNA, 18 bp, Homo sapiens
cagatatgggactgattc

SEQ ID NO: 5383331 - DNA, 16 bp, Homo sapiens
cagatatgtattactt

SEQ ID NO: 5383332 - DNA, 21 bp, Homo sapiens
cagatattccctcttgtcctt

SEQ ID NO: 5383333 - DNA, 20 bp, Homo sapiens
cagatattgttataaataaa

SEQ ID NO: 5383334 - DNA, 21 bp, Homo sapiens
cagatatttatatttttattt

SEQ ID NO: 5383335 - DNA, 22 bp, Homo sapiens
cagatatttatatttttatttt

SEQ ID NO: 5383336 - DNA, 13 bp, Homo sapiens
cagatatttatgt

SEQ ID NO: 5383337 - DNA, 18 bp, Homo sapiens
cagatatttatgtatctt

SEQ ID NO: 5383338 - DNA, 12 bp, Homo sapiens
cagatatttcca

SEQ ID NO: 5383339 - DNA, 17 bp, Homo sapiens
cagatatttccatttct

SEQ ID NO: 5383340 - DNA, 23 bp, Homo sapiens
cagatatttccatttcttcctca

SEQ ID NO: 5383341 - DNA, 15 bp, Homo sapiens
cagatattttttcag

SEQ ID NO: 5383342 - DNA, 20 bp, Homo sapiens
cagatattttttcagaaata

SEQ ID NO: 5383343 - DNA, 18 bp, Homo sapiens
cagatcaaattaatacaa

SEQ ID NO: 5383344 - DNA, 13 bp, Homo sapiens
cagatcaaattct

SEQ ID NO: 5383345 - DNA, 19 bp, Homo sapiens
cagatcaagagttttggag

SEQ ID NO: 5383346 - DNA, 17 bp, Homo sapiens
cagatcaagctgtgaga

SEQ ID NO: 5383347 - DNA, 15 bp, Homo sapiens
cagatcaatacaatc

SEQ ID NO: 5383348 - DNA, 21 bp, Homo sapiens
cagatcacatgcccctcttag

SEQ ID NO: 5383349 - DNA, 15 bp, Homo sapiens
cagatcacccattcc

SEQ ID NO: 5383350 - DNA, 14 bp, Homo sapiens
cagatcaccccagc

SEQ ID NO: 5383351 - DNA, 15 bp, Homo sapiens
cagatcaccccagcc

SEQ ID NO: 5383352 - DNA, 16 bp, Homo sapiens
cagatcactactgcag

SEQ ID NO: 5383353 - DNA, 14 bp, Homo sapiens
cagatcactcctgg

SEQ ID NO: 5383354 - DNA, 15 bp, Homo sapiens
cagatcactgccaca

SEQ ID NO: 5383355 - DNA, 17 bp, Homo sapiens
cagatcagaacatgaaa

SEQ ID NO: 5383356 - DNA, 20 bp, Homo sapiens
cagatcagaacatgaaatgc

SEQ ID NO: 5383357 - DNA, 12 bp, Homo sapiens
cagatcaggaac

SEQ ID NO: 5383358 - DNA, 18 bp, Homo sapiens
cagatcaggagagcaagg

SEQ ID NO: 5383359 - DNA, 17 bp, Homo sapiens
cagatcaggcagtgttt

SEQ ID NO: 5383360 - DNA, 14 bp, Homo sapiens
cagatcaggccttc

SEQ ID NO: 5383361 - DNA, 21 bp, Homo sapiens
cagatcatagatttctgattt

SEQ ID NO: 5383362 - DNA, 16 bp, Homo sapiens
cagatcataggaagtg

SEQ ID NO: 5383363 - DNA, 20 bp, Homo sapiens
cagatcataggaagtggctg

SEQ ID NO: 5383364 - DNA, 23 bp, Homo sapiens
cagatcatataagcaagacagtg

SEQ ID NO: 5383365 - DNA, 21 bp, Homo sapiens
cagatcatatggtaggaccct

SEQ ID NO: 5383366 - DNA, 23 bp, Homo sapiens
cagatcatccgtctgtgtggggt

SEQ ID NO: 5383367 - DNA, 15 bp, Homo sapiens
cagatcatctgggga

SEQ ID NO: 5383368 - DNA, 18 bp, Homo sapiens
cagatcatcttggaactg

SEQ ID NO: 5383369 - DNA, 23 bp, Homo sapiens
cagatcatgccgccgcagctggt

SEQ ID NO: 5383370 - DNA, 23 bp, Homo sapiens
cagatcattatcagcctgtgcca

SEQ ID NO: 5383371 - DNA, 16 bp, Homo sapiens
cagatcattgtgaaat

SEQ ID NO: 5383372 - DNA, 13 bp, Homo sapiens
cagatccaaggcc

SEQ ID NO: 5383373 - DNA, 19 bp, Homo sapiens
cagatccaggaacacatgc

SEQ ID NO: 5383374 - DNA, 21 bp, Homo sapiens
cagatccaggaacacatgcac

SEQ ID NO: 5383375 - DNA, 14 bp, Homo sapiens
cagatccaggagct

SEQ ID NO: 5383376 - DNA, 18 bp, Homo sapiens
cagatccaggcaggagca

SEQ ID NO: 5383377 - DNA, 13 bp, Homo sapiens
cagatccagggac

SEQ ID NO: 5383378 - DNA, 15 bp, Homo sapiens
cagatccagggactg

SEQ ID NO: 5383379 - DNA, 13 bp, Homo sapiens
cagatccatcggt

SEQ ID NO: 5383380 - DNA, 12 bp, Homo sapiens
cagatcccaaga

SEQ ID NO: 5383381 - DNA, 22 bp, Homo sapiens
cagatcccagaaggacctcctg

SEQ ID NO: 5383382 - DNA, 16 bp, Homo sapiens
cagatcccagcccacc

SEQ ID NO: 5383383 - DNA, 17 bp, Homo sapiens
cagatcccagcccaccc

SEQ ID NO: 5383384 - DNA, 18 bp, Homo sapiens
cagatcccagcccaccct

SEQ ID NO: 5383385 - DNA, 14 bp, Homo sapiens
cagatcccagctca

SEQ ID NO: 5383386 - DNA, 15 bp, Homo sapiens
cagatcccagctcac

SEQ ID NO: 5383387 - DNA, 18 bp, Homo sapiens
cagatcccaggcccctgg

SEQ ID NO: 5383388 - DNA, 20 bp, Homo sapiens
cagatcccaggcccctggag

SEQ ID NO: 5383389 - DNA, 22 bp, Homo sapiens
cagatcccaggcccctggaggc

SEQ ID NO: 5383390 - DNA, 13 bp, Homo sapiens
cagatcccagggt

SEQ ID NO: 5383391 - DNA, 14 bp, Homo sapiens
cagatcccagggta

SEQ ID NO: 5383392 - DNA, 22 bp, Homo sapiens
cagatcccatccatcagctccc

SEQ ID NO: 5383393 - DNA, 12 bp, Homo sapiens
cagatccccagc

SEQ ID NO: 5383394 - DNA, 16 bp, Homo sapiens
cagatccccagcccct

SEQ ID NO: 5383395 - DNA, 21 bp, Homo sapiens
cagatccccagcccctcctcc

SEQ ID NO: 5383396 - DNA, 22 bp, Homo sapiens
cagatccccagcccctcctccc

SEQ ID NO: 5383397 - DNA, 23 bp, Homo sapiens
cagatccccagcccctcctccct

SEQ ID NO: 5383398 - DNA, 23 bp, Homo sapiens
cagatccccagctttctcctctg

SEQ ID NO: 5383399 - DNA, 13 bp, Homo sapiens
cagatccccaggg

SEQ ID NO: 5383400 - DNA, 15 bp, Homo sapiens
cagatccccagggca

SEQ ID NO: 5383401 - DNA, 18 bp, Homo sapiens
cagatccccagggcagcc

SEQ ID NO: 5383402 - DNA, 19 bp, Homo sapiens
cagatccccagggcagcct

SEQ ID NO: 5383403 - DNA, 21 bp, Homo sapiens
cagatccccagggcagcctcg

SEQ ID NO: 5383404 - DNA, 21 bp, Homo sapiens
cagatccctcggtcagcaccg

SEQ ID NO: 5383405 - DNA, 16 bp, Homo sapiens
cagatccgcatgtgtc

SEQ ID NO: 5383406 - DNA, 22 bp, Homo sapiens
cagatccgcatgtgtctgtatt

SEQ ID NO: 5383407 - DNA, 11 bp, Homo sapiens
cagatcctacc

SEQ ID NO: 5383408 - DNA, 23 bp, Homo sapiens
cagatcctccatttttgttggga

SEQ ID NO: 5383409 - DNA, 19 bp, Homo sapiens
cagatcctccgcggaggcc

SEQ ID NO: 5383410 - DNA, 14 bp, Homo sapiens
cagatcctcctcat

SEQ ID NO: 5383411 - DNA, 14 bp, Homo sapiens
cagatcctctctgg

SEQ ID NO: 5383412 - DNA, 19 bp, Homo sapiens
cagatcctctctggggctg

SEQ ID NO: 5383413 - DNA, 13 bp, Homo sapiens
cagatcctctgga

SEQ ID NO: 5383414 - DNA, 13 bp, Homo sapiens
cagatcctcttgg

SEQ ID NO: 5383415 - DNA, 14 bp, Homo sapiens
cagatcctcttggt

SEQ ID NO: 5383416 - DNA, 13 bp, Homo sapiens
cagatcctgctgc

SEQ ID NO: 5383417 - DNA, 15 bp, Homo sapiens
cagatcctgctgccg

SEQ ID NO: 5383418 - DNA, 13 bp, Homo sapiens
cagatcctggaaa

SEQ ID NO: 5383419 - DNA, 14 bp, Homo sapiens
cagatcctggaaat

SEQ ID NO: 5383420 - DNA, 12 bp, Homo sapiens
cagatcctgggc

SEQ ID NO: 5383421 - DNA, 14 bp, Homo sapiens
cagatcctgggcat

SEQ ID NO: 5383422 - DNA, 22 bp, Homo sapiens
cagatcctgggcatgatgggcc

SEQ ID NO: 5383423 - DNA, 18 bp, Homo sapiens
cagatcctggtctgcacc

SEQ ID NO: 5383424 - DNA, 18 bp, Homo sapiens
cagatcctgtcccatggg

SEQ ID NO: 5383425 - DNA, 21 bp, Homo sapiens
cagatcctgttacttgcttca

SEQ ID NO: 5383426 - DNA, 18 bp, Homo sapiens
cagatccttgtttcaaac

SEQ ID NO: 5383427 - DNA, 12 bp, Homo sapiens
cagatcctttca

SEQ ID NO: 5383428 - DNA, 17 bp, Homo sapiens
cagatcctttgaaaaga

SEQ ID NO: 5383429 - DNA, 23 bp, Homo sapiens
cagatccttttccatcccactcc

SEQ ID NO: 5383430 - DNA, 17 bp, Homo sapiens
cagatcctttttccatc

SEQ ID NO: 5383431 - DNA, 18 bp, Homo sapiens
cagatcctttttccatca

SEQ ID NO: 5383432 - DNA, 16 bp, Homo sapiens
cagatcgctcactgtt

SEQ ID NO: 5383433 - DNA, 21 bp, Homo sapiens
cagatcgctcactgttgtgaa

SEQ ID NO: 5383434 - DNA, 19 bp, Homo sapiens
cagatcgctcccttggctt

SEQ ID NO: 5383435 - DNA, 14 bp, Homo sapiens
cagatcgctgtgtt

SEQ ID NO: 5383436 - DNA, 15 bp, Homo sapiens
cagatcgtattaatt

SEQ ID NO: 5383437 - DNA, 18 bp, Homo sapiens
cagatcgtattaattatc

SEQ ID NO: 5383438 - DNA, 22 bp, Homo sapiens
cagatcgtattaattatctgat

SEQ ID NO: 5383439 - DNA, 21 bp, Homo sapiens
cagatcgttctgccacttgca

SEQ ID NO: 5383440 - DNA, 13 bp, Homo sapiens
cagatctagccag

SEQ ID NO: 5383441 - DNA, 22 bp, Homo sapiens
cagatctagccaggcctcccgc

SEQ ID NO: 5383442 - DNA, 20 bp, Homo sapiens
cagatctatatggcaaatag

SEQ ID NO: 5383443 - DNA, 18 bp, Homo sapiens
cagatctcatagatgacc

SEQ ID NO: 5383444 - DNA, 15 bp, Homo sapiens
cagatctcatgtcct

SEQ ID NO: 5383445 - DNA, 14 bp, Homo sapiens
cagatctcccactg

SEQ ID NO: 5383446 - DNA, 14 bp, Homo sapiens
cagatctcctggca

SEQ ID NO: 5383447 - DNA, 13 bp, Homo sapiens
cagatctgaggtt

SEQ ID NO: 5383448 - DNA, 21 bp, Homo sapiens
cagatctgcaccaccatgccc

SEQ ID NO: 5383449 - DNA, 13 bp, Homo sapiens
cagatctgcaccg

SEQ ID NO: 5383450 - DNA, 20 bp, Homo sapiens
cagatctgcactcctgtctc

SEQ ID NO: 5383451 - DNA, 21 bp, Homo sapiens
cagatctgcactcctgtctct

SEQ ID NO: 5383452 - DNA, 15 bp, Homo sapiens
cagatctgcactggg

SEQ ID NO: 5383453 - DNA, 16 bp, Homo sapiens
cagatctgcactgggt

SEQ ID NO: 5383454 - DNA, 17 bp, Homo sapiens
cagatctgcactgggtg

SEQ ID NO: 5383455 - DNA, 21 bp, Homo sapiens
cagatctgcctaaggacttct

SEQ ID NO: 5383456 - DNA, 14 bp, Homo sapiens
cagatctgcctggg

SEQ ID NO: 5383457 - DNA, 16 bp, Homo sapiens
cagatctgcctgggcc

SEQ ID NO: 5383458 - DNA, 14 bp, Homo sapiens
cagatctggaacct

SEQ ID NO: 5383459 - DNA, 21 bp, Homo sapiens
cagatctggaacctcagcctg

SEQ ID NO: 5383460 - DNA, 22 bp, Homo sapiens
cagatctggaacctcagcctgg

SEQ ID NO: 5383461 - DNA, 23 bp, Homo sapiens
cagatctgtatatttttttctaa

SEQ ID NO: 5383462 - DNA, 13 bp, Homo sapiens
cagatctgtcctg

SEQ ID NO: 5383463 - DNA, 17 bp, Homo sapiens
cagatctgtcctggggg

SEQ ID NO: 5383464 - DNA, 15 bp, Homo sapiens
cagatctgtgcccca

SEQ ID NO: 5383465 - DNA, 18 bp, Homo sapiens
cagatctgtgccccatgc

SEQ ID NO: 5383466 - DNA, 23 bp, Homo sapiens
cagatctgtgccccatgcctgtc

SEQ ID NO: 5383467 - DNA, 15 bp, Homo sapiens
cagatctgtgcctgg

SEQ ID NO: 5383468 - DNA, 23 bp, Homo sapiens
cagatctgttttgtggtttggaa

SEQ ID NO: 5383469 - DNA, 21 bp, Homo sapiens
cagatcttccgtggtcagagt

SEQ ID NO: 5383470 - DNA, 19 bp, Homo sapiens
cagatcttggactcatgag

SEQ ID NO: 5383471 - DNA, 23 bp, Homo sapiens
cagcaagttagaactagccaaac

SEQ ID NO: 5383472 - DNA, 20 bp, Homo sapiens
cagcaagttagagaatctgg

SEQ ID NO: 5383473 - DNA, 17 bp, Homo sapiens
cagcaagtttcaccttg

SEQ ID NO: 5383474 - DNA, 13 bp, Homo sapiens
cagcaataaaaac

SEQ ID NO: 5383475 - DNA, 22 bp, Homo sapiens
cagcaataaagcagcgtttcta

SEQ ID NO: 5383476 - DNA, 16 bp, Homo sapiens
cagcaataagaaatga

SEQ ID NO: 5383477 - DNA, 15 bp, Homo sapiens
cagcaatagagacgg

SEQ ID NO: 5383478 - DNA, 21 bp, Homo sapiens
cagcaatagggtgcagttttc

SEQ ID NO: 5383479 - DNA, 20 bp, Homo sapiens
cagcaatatattaccagcaa

SEQ ID NO: 5383480 - DNA, 23 bp, Homo sapiens
cagcaatatattaccagcaagaa

SEQ ID NO: 5383481 - DNA, 19 bp, Homo sapiens
cagcaatcgcatcccggct

SEQ ID NO: 5383482 - DNA, 19 bp, Homo sapiens
cagcaatctccatgtgtac

SEQ ID NO: 5383483 - DNA, 12 bp, Homo sapiens
cagcaatctgca

SEQ ID NO: 5383484 - DNA, 17 bp, Homo sapiens
cagcaatgccccaaact

SEQ ID NO: 5383485 - DNA, 18 bp, Homo sapiens
cagcaatgccccaaactt

SEQ ID NO: 5383486 - DNA, 15 bp, Homo sapiens
cagcaatgccctgcc

SEQ ID NO: 5383487 - DNA, 17 bp, Homo sapiens
cagcaatgccctgcctt

SEQ ID NO: 5383488 - DNA, 23 bp, Homo sapiens
cagcaatgccctgccttgctgcc

SEQ ID NO: 5383489 - DNA, 15 bp, Homo sapiens
cagcaattaggcaga

SEQ ID NO: 5383490 - DNA, 19 bp, Homo sapiens
cagcaattatgaaaataat

SEQ ID NO: 5383491 - DNA, 14 bp, Homo sapiens
cagcaattcatggt

SEQ ID NO: 5383492 - DNA, 22 bp, Homo sapiens
cagcaattcatggttcaagtat

SEQ ID NO: 5383493 - DNA, 20 bp, Homo sapiens
cagcaattctcctgcctcag

SEQ ID NO: 5383494 - DNA, 12 bp, Homo sapiens
cagcaatttaga

SEQ ID NO: 5383495 - DNA, 14 bp, Homo sapiens
cagcacaaaaggca

SEQ ID NO: 5383496 - DNA, 13 bp, Homo sapiens
cagcacaaacaca

SEQ ID NO: 5383497 - DNA, 23 bp, Homo sapiens
cagcacaaacacacctctgccac

SEQ ID NO: 5383498 - DNA, 18 bp, Homo sapiens
cagcacaacccccaggaa

SEQ ID NO: 5383499 - DNA, 11 bp, Homo sapiens
cagcacaacct

SEQ ID NO: 5383500 - DNA, 18 bp, Homo sapiens
cagcacaaccttcaagct

SEQ ID NO: 5383501 - DNA, 15 bp, Homo sapiens
cagcacaactgctgt

SEQ ID NO: 5383502 - DNA, 16 bp, Homo sapiens
cagcacaaggccatct

SEQ ID NO: 5383503 - DNA, 15 bp, Homo sapiens
cagcacaagggcaca

SEQ ID NO: 5383504 - DNA, 16 bp, Homo sapiens
cagcacaaggtggcag

SEQ ID NO: 5383505 - DNA, 20 bp, Homo sapiens
cagcacaaggtggcagcaag

SEQ ID NO: 5383506 - DNA, 14 bp, Homo sapiens
cagcacaataaata

SEQ ID NO: 5383507 - DNA, 16 bp, Homo sapiens
cagcacaattcattgt

SEQ ID NO: 5383508 - DNA, 14 bp, Homo sapiens
cagcacacacagtg

SEQ ID NO: 5383509 - DNA, 16 bp, Homo sapiens
cagcacacaggcagcc

SEQ ID NO: 5383510 - DNA, 20 bp, Homo sapiens
cagcacacaggcagccagcc

SEQ ID NO: 5383511 - DNA, 19 bp, Homo sapiens
cagcacacagggcagtgag

SEQ ID NO: 5383512 - DNA, 22 bp, Homo sapiens
cagcacaccaaggtggcccgga

SEQ ID NO: 5383513 - DNA, 16 bp, Homo sapiens
cagcacaccaagtggc

SEQ ID NO: 5383514 - DNA, 14 bp, Homo sapiens
cagcacaccccaag

SEQ ID NO: 5383515 - DNA, 17 bp, Homo sapiens
cagcacacctcagcccc

SEQ ID NO: 5383516 - DNA, 18 bp, Homo sapiens
cagcacacctcagcccca

SEQ ID NO: 5383517 - DNA, 14 bp, Homo sapiens
cagcacacctctgg

SEQ ID NO: 5383518 - DNA, 14 bp, Homo sapiens
cagcacacctgtgt

SEQ ID NO: 5383519 - DNA, 15 bp, Homo sapiens
cagcacacctgtgtc

SEQ ID NO: 5383520 - DNA, 16 bp, Homo sapiens
cagcacacctgtgtcc

SEQ ID NO: 5383521 - DNA, 14 bp, Homo sapiens
cagcacactctcct

SEQ ID NO: 5383522 - DNA, 15 bp, Homo sapiens
cagcacactggactc

SEQ ID NO: 5383523 - DNA, 15 bp, Homo sapiens
cagcacactgtgaaa

SEQ ID NO: 5383524 - DNA, 12 bp, Homo sapiens
cagcacagaatg

SEQ ID NO: 5383525 - DNA, 14 bp, Homo sapiens
cagcacagaatgag

SEQ ID NO: 5383526 - DNA, 11 bp, Homo sapiens
cagcacagact

SEQ ID NO: 5383527 - DNA, 17 bp, Homo sapiens
cagcacagactgttccc

SEQ ID NO: 5383528 - DNA, 17 bp, Homo sapiens
cagcacagagagcggct

SEQ ID NO: 5383529 - DNA, 13 bp, Homo sapiens
cagcacagagagg

SEQ ID NO: 5383530 - DNA, 20 bp, Homo sapiens
cagcacagagagggggccac

SEQ ID NO: 5383531 - DNA, 16 bp, Homo sapiens
cagcacagatgaggag

SEQ ID NO: 5383532 - DNA, 13 bp, Homo sapiens
cagcacagatgtg

SEQ ID NO: 5383533 - DNA, 21 bp, Homo sapiens
cagcacagatttgcttttctt

SEQ ID NO: 5383534 - DNA, 19 bp, Homo sapiens
cagcacagcaaggaggctg

SEQ ID NO: 5383535 - DNA, 13 bp, Homo sapiens
cagcacagccaac

SEQ ID NO: 5383536 - DNA, 15 bp, Homo sapiens
cagcacagccacctc

SEQ ID NO: 5383537 - DNA, 20 bp, Homo sapiens
cagcacagccacctccgcca

SEQ ID NO: 5383538 - DNA, 16 bp, Homo sapiens
cagcacagcccagggc

SEQ ID NO: 5383539 - DNA, 14 bp, Homo sapiens
cagcacagctcctc

SEQ ID NO: 5383540 - DNA, 16 bp, Homo sapiens
cagcacagctcctccc

SEQ ID NO: 5383541 - DNA, 22 bp, Homo sapiens
cagcacagctcctcccctgccg

SEQ ID NO: 5383542 - DNA, 15 bp, Homo sapiens
cagcacagctgagga

SEQ ID NO: 5383543 - DNA, 15 bp, Homo sapiens
cagcacagcttgacc

SEQ ID NO: 5383544 - DNA, 17 bp, Homo sapiens
cagcacagcttgacctg

SEQ ID NO: 5383545 - DNA, 14 bp, Homo sapiens
cagcacaggcagcc

SEQ ID NO: 5383546 - DNA, 13 bp, Homo sapiens
cagcacaggggcc

SEQ ID NO: 5383547 - DNA, 14 bp, Homo sapiens
cagcacaggggccc

SEQ ID NO: 5383548 - DNA, 22 bp, Homo sapiens
cagcacagggggattctgagca

SEQ ID NO: 5383549 - DNA, 22 bp, Homo sapiens
cagcacagtacacacaaaaacc

SEQ ID NO: 5383550 - DNA, 15 bp, Homo sapiens
cagcacagtcttttc

SEQ ID NO: 5383551 - DNA, 24 bp, Homo sapiens
cagcacatagggttcccacgaagc

SEQ ID NO: 5383552 - DNA, 16 bp, Homo sapiens
cagcacatcacctctt

SEQ ID NO: 5383553 - DNA, 17 bp, Homo sapiens
cagcacatccacccagg

SEQ ID NO: 5383554 - DNA, 19 bp, Homo sapiens
cagcacatctcaacaggcc

SEQ ID NO: 5383555 - DNA, 15 bp, Homo sapiens
cagcacatgcgggct

SEQ ID NO: 5383556 - DNA, 16 bp, Homo sapiens
cagcacatgcgggctc

SEQ ID NO: 5383557 - DNA, 20 bp, Homo sapiens
cagcacatgcgggctcgccc

SEQ ID NO: 5383558 - DNA, 16 bp, Homo sapiens
cagcacatgctggcca

SEQ ID NO: 5383559 - DNA, 17 bp, Homo sapiens
cagcacatgctggccag

SEQ ID NO: 5383560 - DNA, 22 bp, Homo sapiens
cagcacattaacttctggactg

SEQ ID NO: 5383561 - DNA, 23 bp, Homo sapiens
cagcacattcgggaccaatatat

SEQ ID NO: 5383562 - DNA, 12 bp, Homo sapiens
cagcacatttcc

SEQ ID NO: 5383563 - DNA, 23 bp, Homo sapiens
cagcacatttgttaatgattctt

SEQ ID NO: 5383564 - DNA, 15 bp, Homo sapiens
cagcaccaaatcaaa

SEQ ID NO: 5383565 - DNA, 19 bp, Homo sapiens
cagcaccaaatcaaaatct

SEQ ID NO: 5383566 - DNA, 15 bp, Homo sapiens
cagcaccaaccacag

SEQ ID NO: 5383567 - DNA, 16 bp, Homo sapiens
cagcaccaaccacagc

SEQ ID NO: 5383568 - DNA, 17 bp, Homo sapiens
cagcaccaaccacagca

SEQ ID NO: 5383569 - DNA, 23 bp, Homo sapiens
cagcaccaattgtacattccctg

SEQ ID NO: 5383570 - DNA, 15 bp, Homo sapiens
cagcaccacactggg

SEQ ID NO: 5383571 - DNA, 21 bp, Homo sapiens
cagcaccaccaggtctcccgg

SEQ ID NO: 5383572 - DNA, 23 bp, Homo sapiens
cagcaccaccatttaatttcatg

SEQ ID NO: 5383573 - DNA, 19 bp, Homo sapiens
cagcaccacctacacagga

SEQ ID NO: 5383574 - DNA, 22 bp, Homo sapiens
cagcaccactcaagaccaaatg

SEQ ID NO: 5383575 - DNA, 16 bp, Homo sapiens
cagcaccactgctgag

SEQ ID NO: 5383576 - DNA, 20 bp, Homo sapiens
cagcaccactgctgaggagt

SEQ ID NO: 5383577 - DNA, 13 bp, Homo sapiens
cagcaccagcctg

SEQ ID NO: 5383578 - DNA, 14 bp, Homo sapiens
cagcaccagcctga

SEQ ID NO: 5383579 - DNA, 18 bp, Homo sapiens
cagcaccagcctgagcca

SEQ ID NO: 5383580 - DNA, 19 bp, Homo sapiens
cagcaccagcctgagccac

SEQ ID NO: 5383581 - DNA, 13 bp, Homo sapiens
cagcaccatggag

SEQ ID NO: 5383582 - DNA, 16 bp, Homo sapiens
cagcacccacccatgc

SEQ ID NO: 5383583 - DNA, 13 bp, Homo sapiens
cagcacccactca

SEQ ID NO: 5383584 - DNA, 11 bp, Homo sapiens
cagcacccagg

SEQ ID NO: 5383585 - DNA, 14 bp, Homo sapiens
cagcacccaggctc

SEQ ID NO: 5383586 - DNA, 15 bp, Homo sapiens
cagcacccaggctcc

SEQ ID NO: 5383587 - DNA, 20 bp, Homo sapiens
cagcacccaggctccatggg

SEQ ID NO: 5383588 - DNA, 22 bp, Homo sapiens
cagcacccatgccccactctgc

SEQ ID NO: 5383589 - DNA, 17 bp, Homo sapiens
cagcaccccactcctca

SEQ ID NO: 5383590 - DNA, 19 bp, Homo sapiens
cagcaccccactcctcagt

SEQ ID NO: 5383591 - DNA, 13 bp, Homo sapiens
cagcacccccacc

SEQ ID NO: 5383592 - DNA, 14 bp, Homo sapiens
cagcacccccaccc

SEQ ID NO: 5383593 - DNA, 15 bp, Homo sapiens
cagcacccccaccca

SEQ ID NO: 5383594 - DNA, 20 bp, Homo sapiens
cagcacccccacccacctcc

SEQ ID NO: 5383595 - DNA, 22 bp, Homo sapiens
cagcacccccttctctgcccat

SEQ ID NO: 5383596 - DNA, 23 bp, Homo sapiens
cagcacccctccagttttgcctg

SEQ ID NO: 5383597 - DNA, 16 bp, Homo sapiens
cagcaccctataaatc

SEQ ID NO: 5383598 - DNA, 14 bp, Homo sapiens
cagcaccctccccc

SEQ ID NO: 5383599 - DNA, 18 bp, Homo sapiens
cagcaccctcccccgcag

SEQ ID NO: 5383600 - DNA, 11 bp, Homo sapiens
cagcaccctct

SEQ ID NO: 5383601 - DNA, 14 bp, Homo sapiens
cagcaccctctcct

SEQ ID NO: 5383602 - DNA, 14 bp, Homo sapiens
cagcaccctgcaga

SEQ ID NO: 5383603 - DNA, 22 bp, Homo sapiens
cagcaccctgcagagcacacag

SEQ ID NO: 5383604 - DNA, 12 bp, Homo sapiens
cagcaccctggg

SEQ ID NO: 5383605 - DNA, 22 bp, Homo sapiens
cagcacccttgccatcccaagc

SEQ ID NO: 5383606 - DNA, 14 bp, Homo sapiens
cagcaccctttcac

SEQ ID NO: 5383607 - DNA, 15 bp, Homo sapiens
cagcaccgaggggcc

SEQ ID NO: 5383608 - DNA, 17 bp, Homo sapiens
cagcaccgaggggcctt

SEQ ID NO: 5383609 - DNA, 18 bp, Homo sapiens
cagcaccgaggggccttt

SEQ ID NO: 5383610 - DNA, 13 bp, Homo sapiens
cagcaccgccggc

SEQ ID NO: 5383611 - DNA, 22 bp, Homo sapiens
cagcaccgccggctttcagggc

SEQ ID NO: 5383612 - DNA, 14 bp, Homo sapiens
cagcaccgcctctt

SEQ ID NO: 5383613 - DNA, 17 bp, Homo sapiens
cagcaccggaccagcct

SEQ ID NO: 5383614 - DNA, 17 bp, Homo sapiens
cagcaccgggggagagg

SEQ ID NO: 5383615 - DNA, 18 bp, Homo sapiens
cagcaccgggggagaggg

SEQ ID NO: 5383616 - DNA, 21 bp, Homo sapiens
cagcaccgtggtgtgaggccc

SEQ ID NO: 5383617 - DNA, 16 bp, Homo sapiens
cagcaccgttctgtgc

SEQ ID NO: 5383618 - DNA, 17 bp, Homo sapiens
cagcaccgttctgtgca

SEQ ID NO: 5383619 - DNA, 18 bp, Homo sapiens
cagcaccgttctgtgcac

SEQ ID NO: 5383620 - DNA, 15 bp, Homo sapiens
cagcacctacagtgt

SEQ ID NO: 5383621 - DNA, 19 bp, Homo sapiens
cagcacctattgaattacc

SEQ ID NO: 5383622 - DNA, 16 bp, Homo sapiens
cagcacctccaggcct

SEQ ID NO: 5383623 - DNA, 17 bp, Homo sapiens
cagcacctccgggactg

SEQ ID NO: 5383624 - DNA, 12 bp, Homo sapiens
cagcacctcctc

SEQ ID NO: 5383625 - DNA, 17 bp, Homo sapiens
cagcacctcctcagcct

SEQ ID NO: 5383626 - DNA, 19 bp, Homo sapiens
cagcacctcctcagcctga

SEQ ID NO: 5383627 - DNA, 22 bp, Homo sapiens
cagcacctcctccgtgggcagc

SEQ ID NO: 5383628 - DNA, 23 bp, Homo sapiens
cagcacctcctccgtgggcagct

SEQ ID NO: 5383629 - DNA, 17 bp, Homo sapiens
cagcacctgccagggcc

SEQ ID NO: 5383630 - DNA, 13 bp, Homo sapiens
cagcacctgcctc

SEQ ID NO: 5383631 - DNA, 19 bp, Homo sapiens
cagcacctgcctcctcgtt

SEQ ID NO: 5383632 - DNA, 20 bp, Homo sapiens
cagcacctgtaagaaacaga

SEQ ID NO: 5383633 - DNA, 14 bp, Homo sapiens
cagcacctgtcacc

SEQ ID NO: 5383634 - DNA, 20 bp, Homo sapiens
cagcaccttctttctggact

SEQ ID NO: 5383635 - DNA, 23 bp, Homo sapiens
cagcaccttctttctggactggc

SEQ ID NO: 5383636 - DNA, 21 bp, Homo sapiens
cagcaccttgcagattttctt

SEQ ID NO: 5383637 - DNA, 16 bp, Homo sapiens
cagcaccttggcccag

SEQ ID NO: 5383638 - DNA, 21 bp, Homo sapiens
cagcaccttggcccaggagct

SEQ ID NO: 5383639 - DNA, 23 bp, Homo sapiens
cagcaccttggcccaggagctct

SEQ ID NO: 5383640 - DNA, 13 bp, Homo sapiens
cagcaccttgtgc

SEQ ID NO: 5383641 - DNA, 15 bp, Homo sapiens
cagcaccttgtgcct

SEQ ID NO: 5383642 - DNA, 17 bp, Homo sapiens
cagcacctttctctgag

SEQ ID NO: 5383643 - DNA, 18 bp, Homo sapiens
cagcacgatttctgttta

SEQ ID NO: 5383644 - DNA, 19 bp, Homo sapiens
cagcacgatttctgtttag

SEQ ID NO: 5383645 - DNA, 23 bp, Homo sapiens
cagcacgcatgtccctccaaggc

SEQ ID NO: 5383646 - DNA, 19 bp, Homo sapiens
cagcacgccaaccccagca

SEQ ID NO: 5383647 - DNA, 18 bp, Homo sapiens
cagcacgcctctccccac

SEQ ID NO: 5383648 - DNA, 19 bp, Homo sapiens
cagcacggacaataaacct

SEQ ID NO: 5383649 - DNA, 22 bp, Homo sapiens
cagcacgggcacagctgctgtg

SEQ ID NO: 5383650 - DNA, 15 bp, Homo sapiens
cagcaggtgcaagag

SEQ ID NO: 5383651 - DNA, 17 bp, Homo sapiens
cagcaggtgcaagagac

SEQ ID NO: 5383652 - DNA, 21 bp, Homo sapiens
cagcaggtgccatcacgcttg

SEQ ID NO: 5383653 - DNA, 22 bp, Homo sapiens
cagcaggtgcctggtgggccac

SEQ ID NO: 5383654 - DNA, 19 bp, Homo sapiens
cagcaggtgcggcgcgcac

SEQ ID NO: 5383655 - DNA, 11 bp, Homo sapiens
cagcaggtgct

SEQ ID NO: 5383656 - DNA, 15 bp, Homo sapiens
cagcaggtgctgggc

SEQ ID NO: 5383657 - DNA, 22 bp, Homo sapiens
cagcaggtgctgggctggactg

SEQ ID NO: 5383658 - DNA, 24 bp, Homo sapiens
cagcaggtgctgggctggactggc

SEQ ID NO: 5383659 - DNA, 17 bp, Homo sapiens
cagcaggtgtacacatg

SEQ ID NO: 5383660 - DNA, 19 bp, Homo sapiens
cagcaggtgtgaccctgag

SEQ ID NO: 5383661 - DNA, 18 bp, Homo sapiens
cagcaggtgtggtggctc

SEQ ID NO: 5383662 - DNA, 20 bp, Homo sapiens
cagcaggttctctcctgtga

SEQ ID NO: 5383663 - DNA, 18 bp, Homo sapiens
cagcagtaagcaggcctt

SEQ ID NO: 5383664 - DNA, 16 bp, Homo sapiens
cagcagtaatcctggg

SEQ ID NO: 5383665 - DNA, 15 bp, Homo sapiens
cagcagtacaataaa

SEQ ID NO: 5383666 - DNA, 20 bp, Homo sapiens
cagcagtaccatcccactga

SEQ ID NO: 5383667 - DNA, 19 bp, Homo sapiens
cagcagtacctataaagta

SEQ ID NO: 5383668 - DNA, 19 bp, Homo sapiens
cagcagtacgtggcttcag

SEQ ID NO: 5383669 - DNA, 16 bp, Homo sapiens
cagcagtatgaatgat

SEQ ID NO: 5383670 - DNA, 17 bp, Homo sapiens
cagcagtcaattaactc

SEQ ID NO: 5383671 - DNA, 17 bp, Homo sapiens
cagcagtcacaggccca

SEQ ID NO: 5383672 - DNA, 23 bp, Homo sapiens
cagcagtcccagtattctcagag

SEQ ID NO: 5383673 - DNA, 15 bp, Homo sapiens
cagcagtcctgggcc

SEQ ID NO: 5383674 - DNA, 22 bp, Homo sapiens
cagcagtctaaattttctaaat

SEQ ID NO: 5383675 - DNA, 22 bp, Homo sapiens
cagcagtctccttcagcacggc

SEQ ID NO: 5383676 - DNA, 21 bp, Homo sapiens
cagcagtctctgccttgcctt

SEQ ID NO: 5383677 - DNA, 19 bp, Homo sapiens
cagcagtcttatgcttcca

SEQ ID NO: 5383678 - DNA, 22 bp, Homo sapiens
cagcagtcttatgcttccagaa

SEQ ID NO: 5383679 - DNA, 21 bp, Homo sapiens
cagcagtcttcttcacccgct

SEQ ID NO: 5383680 - DNA, 15 bp, Homo sapiens
cagcagtgaaaacaa

SEQ ID NO: 5383681 - DNA, 22 bp, Homo sapiens
cagcagtgaaaacaagtgctgg

SEQ ID NO: 5383682 - DNA, 21 bp, Homo sapiens
cagcagtgaatgctagacaga

SEQ ID NO: 5383683 - DNA, 15 bp, Homo sapiens
cagcagtgaccacac

SEQ ID NO: 5383684 - DNA, 19 bp, Homo sapiens
cagcagtgaccacaccaac

SEQ ID NO: 5383685 - DNA, 14 bp, Homo sapiens
cagcagtgagactg

SEQ ID NO: 5383686 - DNA, 15 bp, Homo sapiens
cagcagtgagcttct

SEQ ID NO: 5383687 - DNA, 15 bp, Homo sapiens
cagcagtgatctcag

SEQ ID NO: 5383688 - DNA, 13 bp, Homo sapiens
cagcagtgctggg

SEQ ID NO: 5383689 - DNA, 14 bp, Homo sapiens
cagcagtgctgggc

SEQ ID NO: 5383690 - DNA, 15 bp, Homo sapiens
cagcagtgctgggcc

SEQ ID NO: 5383691 - DNA, 17 bp, Homo sapiens
cagcagtgctgggccca

SEQ ID NO: 5383692 - DNA, 18 bp, Homo sapiens
cagcagtggcctttgcaa

SEQ ID NO: 5383693 - DNA, 17 bp, Homo sapiens
cagcagtgggggtcaga

SEQ ID NO: 5383694 - DNA, 13 bp, Homo sapiens
cagcagtggggtg

SEQ ID NO: 5383695 - DNA, 19 bp, Homo sapiens
cagcagtgggttcaggccc

SEQ ID NO: 5383696 - DNA, 14 bp, Homo sapiens
cagcagtgtccaga

SEQ ID NO: 5383697 - DNA, 15 bp, Homo sapiens
cagcagtgtccagag

SEQ ID NO: 5383698 - DNA, 22 bp, Homo sapiens
cagcagtgtccagagacccctc

SEQ ID NO: 5383699 - DNA, 22 bp, Homo sapiens
cagcagtgtcccctgccccaga

SEQ ID NO: 5383700 - DNA, 19 bp, Homo sapiens
cagcagtgtgaggccaggg

SEQ ID NO: 5383701 - DNA, 20 bp, Homo sapiens
cagcagtgtgaggccagggc

SEQ ID NO: 5383702 - DNA, 14 bp, Homo sapiens
cagcagtgtggaga

SEQ ID NO: 5383703 - DNA, 18 bp, Homo sapiens
cagcagtgtggagaccct

SEQ ID NO: 5383704 - DNA, 14 bp, Homo sapiens
cagcagtgttcccc

SEQ ID NO: 5383705 - DNA, 21 bp, Homo sapiens
cagcagtgttccccatctggg

SEQ ID NO: 5383706 - DNA, 22 bp, Homo sapiens
cagcagtgttccccatctgggt

SEQ ID NO: 5383707 - DNA, 14 bp, Homo sapiens
cagcagtgttctca

SEQ ID NO: 5383708 - DNA, 17 bp, Homo sapiens
cagcagtgttctcacag

SEQ ID NO: 5383709 - DNA, 15 bp, Homo sapiens
cagcagtgttgctca

SEQ ID NO: 5383710 - DNA, 16 bp, Homo sapiens
cagcagttaggcacct

SEQ ID NO: 5383711 - DNA, 16 bp, Homo sapiens
cagcagttcacttcct

SEQ ID NO: 5383712 - DNA, 17 bp, Homo sapiens
cagcagttcacttccta

SEQ ID NO: 5383713 - DNA, 22 bp, Homo sapiens
cagcagttcagagctgccctct

SEQ ID NO: 5383714 - DNA, 14 bp, Homo sapiens
cagcagttctgtta

SEQ ID NO: 5383715 - DNA, 21 bp, Homo sapiens
cagcagttgaaaagactccaa

SEQ ID NO: 5383716 - DNA, 23 bp, Homo sapiens
cagcagttgaatgacaacagaag

SEQ ID NO: 5383717 - DNA, 13 bp, Homo sapiens
cagcagttgacat

SEQ ID NO: 5383718 - DNA, 17 bp, Homo sapiens
cagcagttgactcagag

SEQ ID NO: 5383719 - DNA, 17 bp, Homo sapiens
cagcagttgctggtaaa

SEQ ID NO: 5383720 - DNA, 22 bp, Homo sapiens
cagcagttgctggtaaaatgaa

SEQ ID NO: 5383721 - DNA, 14 bp, Homo sapiens
cagcagttgttatt

SEQ ID NO: 5383722 - DNA, 13 bp, Homo sapiens
cagcagtttcatg

SEQ ID NO: 5383723 - DNA, 18 bp, Homo sapiens
cagcagtttcatgagatg

SEQ ID NO: 5383724 - DNA, 18 bp, Homo sapiens
cagcagtttccagagagt

SEQ ID NO: 5383725 - DNA, 14 bp, Homo sapiens
cagcagtttcccag

SEQ ID NO: 5383726 - DNA, 16 bp, Homo sapiens
cagcagtttcccagaa

SEQ ID NO: 5383727 - DNA, 18 bp, Homo sapiens
cagcagtttcccagaata

SEQ ID NO: 5383728 - DNA, 19 bp, Homo sapiens
cagcagtttccgaggctga

SEQ ID NO: 5383729 - DNA, 22 bp, Homo sapiens
cagcataaatctgttagcatta

SEQ ID NO: 5383730 - DNA, 23 bp, Homo sapiens
cagcataaccccaccctttacat

SEQ ID NO: 5383731 - DNA, 17 bp, Homo sapiens
cagcataactaggatta

SEQ ID NO: 5383732 - DNA, 21 bp, Homo sapiens
cagcataattcctccagttgg

SEQ ID NO: 5383733 - DNA, 16 bp, Homo sapiens
cagcataccagttctt

SEQ ID NO: 5383734 - DNA, 22 bp, Homo sapiens
cagcataccagttcttgcaata

SEQ ID NO: 5383735 - DNA, 19 bp, Homo sapiens
cagcatacctttattgtga

SEQ ID NO: 5383736 - DNA, 17 bp, Homo sapiens
cagcatagcctgcctga

SEQ ID NO: 5383737 - DNA, 14 bp, Homo sapiens
cagcatagggggga

SEQ ID NO: 5383738 - DNA, 16 bp, Homo sapiens
cagcataggggggagg

SEQ ID NO: 5383739 - DNA, 22 bp, Homo sapiens
cagcatagggtccactttggta

SEQ ID NO: 5383740 - DNA, 19 bp, Homo sapiens
cagcatagtactggcacaa

SEQ ID NO: 5383741 - DNA, 21 bp, Homo sapiens
cagcatagttctgcaataaca

SEQ ID NO: 5383742 - DNA, 15 bp, Homo sapiens
cagcatatagaatat

SEQ ID NO: 5383743 - DNA, 17 bp, Homo sapiens
cagcatatagaatatat

SEQ ID NO: 5383744 - DNA, 19 bp, Homo sapiens
cagcatatagaatatatta

SEQ ID NO: 5383745 - DNA, 12 bp, Homo sapiens
cagcatatatat

SEQ ID NO: 5383746 - DNA, 13 bp, Homo sapiens
cagcatatatata

SEQ ID NO: 5383747 - DNA, 20 bp, Homo sapiens
cagcatatatataaaataca

SEQ ID NO: 5383748 - DNA, 21 bp, Homo sapiens
cagcatatgtgccataaacag

SEQ ID NO: 5383749 - DNA, 16 bp, Homo sapiens
cagcatattcaggaag

SEQ ID NO: 5383750 - DNA, 12 bp, Homo sapiens
cagcatatttat

SEQ ID NO: 5383751 - DNA, 22 bp, Homo sapiens
cagcatatttgtatagttgctt

SEQ ID NO: 5383752 - DNA, 14 bp, Homo sapiens
cagcatcaaaatac

SEQ ID NO: 5383753 - DNA, 20 bp, Homo sapiens
cagcatcaaacatgaaaaca

SEQ ID NO: 5383754 - DNA, 14 bp, Homo sapiens
cagcatcacctgcc

SEQ ID NO: 5383755 - DNA, 16 bp, Homo sapiens
cagcatcacctgcctg

SEQ ID NO: 5383756 - DNA, 17 bp, Homo sapiens
cagcatcacctgcctgt

SEQ ID NO: 5383757 - DNA, 17 bp, Homo sapiens
cagcatcactaaaccga

SEQ ID NO: 5383758 - DNA, 17 bp, Homo sapiens
cagcatcactccccaag

SEQ ID NO: 5383759 - DNA, 14 bp, Homo sapiens
cagcatcactgatg

SEQ ID NO: 5383760 - DNA, 15 bp, Homo sapiens
cagcatcactgatgg

SEQ ID NO: 5383761 - DNA, 23 bp, Homo sapiens
cagcatcactgatgggaataaaa

SEQ ID NO: 5383762 - DNA, 14 bp, Homo sapiens
cagcatcagcacag

SEQ ID NO: 5383763 - DNA, 20 bp, Homo sapiens
cagcatcatggaggtttgaa

SEQ ID NO: 5383764 - DNA, 19 bp, Homo sapiens
cagcatcattttgcattca

SEQ ID NO: 5383765 - DNA, 18 bp, Homo sapiens
cagcatccaccttggctc

SEQ ID NO: 5383766 - DNA, 19 bp, Homo sapiens
cagcatccaccttggctct

SEQ ID NO: 5383767 - DNA, 14 bp, Homo sapiens
cagcatccagcctg

SEQ ID NO: 5383768 - DNA, 14 bp, Homo sapiens
cagcatccagtgtg

SEQ ID NO: 5383769 - DNA, 19 bp, Homo sapiens
cagcatcccaagatcattc

SEQ ID NO: 5383770 - DNA, 15 bp, Homo sapiens
cagcatcccagcctc

SEQ ID NO: 5383771 - DNA, 12 bp, Homo sapiens
cagcatccctgg

SEQ ID NO: 5383772 - DNA, 13 bp, Homo sapiens
cagcatccctgga

SEQ ID NO: 5383773 - DNA, 20 bp, Homo sapiens
cagcatccctggagcaggag

SEQ ID NO: 5383774 - DNA, 19 bp, Homo sapiens
cagcatcccttgaccaggc

SEQ ID NO: 5383775 - DNA, 17 bp, Homo sapiens
cagcatccgcaggtgct

SEQ ID NO: 5383776 - DNA, 23 bp, Homo sapiens
cagcatccgcaggtgctggtccc

SEQ ID NO: 5383777 - DNA, 16 bp, Homo sapiens
cagcatcctgcttcct

SEQ ID NO: 5383778 - DNA, 19 bp, Homo sapiens
cagcatcctggcacccggc

SEQ ID NO: 5383779 - DNA, 15 bp, Homo sapiens
cagcatcgaggaagg

SEQ ID NO: 5383780 - DNA, 16 bp, Homo sapiens
cagcatcgggggcctg

SEQ ID NO: 5383781 - DNA, 17 bp, Homo sapiens
cagcatcgggggcctgc

SEQ ID NO: 5383782 - DNA, 21 bp, Homo sapiens
cagcatctactactctgtctt

SEQ ID NO: 5383783 - DNA, 16 bp, Homo sapiens
cagcatctccaagcag

SEQ ID NO: 5383784 - DNA, 23 bp, Homo sapiens
cagcatctctaccttctccccag

SEQ ID NO: 5383785 - DNA, 14 bp, Homo sapiens
cagcatctctatga

SEQ ID NO: 5383786 - DNA, 13 bp, Homo sapiens
cagcatctcttct

SEQ ID NO: 5383787 - DNA, 19 bp, Homo sapiens
cagcatctgaccatctgtg

SEQ ID NO: 5383788 - DNA, 23 bp, Homo sapiens
cagcatctgattgagtcagtgtt

SEQ ID NO: 5383789 - DNA, 14 bp, Homo sapiens
cagcatctgctcca

SEQ ID NO: 5383790 - DNA, 13 bp, Homo sapiens
cagcatctggctg

SEQ ID NO: 5383791 - DNA, 21 bp, Homo sapiens
cagcatctggctgtctagaat

SEQ ID NO: 5383792 - DNA, 22 bp, Homo sapiens
cagcatctggctgtctagaatg

SEQ ID NO: 5383793 - DNA, 14 bp, Homo sapiens
cagcatctgggcct

SEQ ID NO: 5383794 - DNA, 19 bp, Homo sapiens
cagcatctgggccttggcc

SEQ ID NO: 5383795 - DNA, 13 bp, Homo sapiens
cagcatctggtct

SEQ ID NO: 5383796 - DNA, 20 bp, Homo sapiens
cagcatcttttccatcctga

SEQ ID NO: 5383797 - DNA, 21 bp, Homo sapiens
cagcatcttttccatcctgag

SEQ ID NO: 5383798 - DNA, 14 bp, Homo sapiens
cagcatgaaccttt

SEQ ID NO: 5383799 - DNA, 15 bp, Homo sapiens
cagcatgaataaaac

SEQ ID NO: 5383800 - DNA, 24 bp, Homo sapiens
cagcatgaataaaacactcatccc

SEQ ID NO: 5383801 - DNA, 12 bp, Homo sapiens
cagcatgaattt

SEQ ID NO: 5383802 - DNA, 14 bp, Homo sapiens
cagcatgaatttgt

SEQ ID NO: 5383803 - DNA, 19 bp, Homo sapiens
cagcatgacaaaaataaca

SEQ ID NO: 5383804 - DNA, 20 bp, Homo sapiens
cagcatgacataacagtgca

SEQ ID NO: 5383805 - DNA, 18 bp, Homo sapiens
cagcatgagattgtacat

SEQ ID NO: 5383806 - DNA, 20 bp, Homo sapiens
cagcatgagattgtacattt

SEQ ID NO: 5383807 - DNA, 22 bp, Homo sapiens
cagcatgaggacagaccacaga

SEQ ID NO: 5383808 - DNA, 18 bp, Homo sapiens
cagcatgaggtgttgtgc

SEQ ID NO: 5383809 - DNA, 22 bp, Homo sapiens
cagcatgaggtgttgtgcattt

SEQ ID NO: 5383810 - DNA, 13 bp, Homo sapiens
cagcatgcattta

SEQ ID NO: 5383811 - DNA, 17 bp, Homo sapiens
cagcatgcatttagcat

SEQ ID NO: 5383812 - DNA, 19 bp, Homo sapiens
cagcatgcatttagcatga

SEQ ID NO: 5383813 - DNA, 21 bp, Homo sapiens
cagcatgcatttagcatgagt

SEQ ID NO: 5383814 - DNA, 13 bp, Homo sapiens
cagcatgcccaga

SEQ ID NO: 5383815 - DNA, 17 bp, Homo sapiens
cagcatgcccagattcc

SEQ ID NO: 5383816 - DNA, 15 bp, Homo sapiens
cagcatgcccagtgc

SEQ ID NO: 5383817 - DNA, 19 bp, Homo sapiens
cagcatgcctgtcctttca

SEQ ID NO: 5383818 - DNA, 19 bp, Homo sapiens
cagcatgcttcccagaggg

SEQ ID NO: 5383819 - DNA, 20 bp, Homo sapiens
cagcatgcttcccagaggga

SEQ ID NO: 5383820 - DNA, 22 bp, Homo sapiens
cagcatgcttcccagagggagc

SEQ ID NO: 5383821 - DNA, 23 bp, Homo sapiens
cagcatgcttcccagagggagca

SEQ ID NO: 5383822 - DNA, 17 bp, Homo sapiens
cagcatgcttgggctga

SEQ ID NO: 5383823 - DNA, 14 bp, Homo sapiens
cagcatggaaaaat

SEQ ID NO: 5383824 - DNA, 15 bp, Homo sapiens
cagcatggcatagcc

SEQ ID NO: 5383825 - DNA, 19 bp, Homo sapiens
cagcatggcatagccccgg

SEQ ID NO: 5383826 - DNA, 15 bp, Homo sapiens
cagcatggcatccaa

SEQ ID NO: 5383827 - DNA, 16 bp, Homo sapiens
cagccagttggtgggg

SEQ ID NO: 5383828 - DNA, 23 bp, Homo sapiens
cagccagttggtggggccaggcc

SEQ ID NO: 5383829 - DNA, 20 bp, Homo sapiens
cagccagttttactgtgatt

SEQ ID NO: 5383830 - DNA, 20 bp, Homo sapiens
cagccataaaagcattgtct

SEQ ID NO: 5383831 - DNA, 21 bp, Homo sapiens
cagccatacttatctctctgt

SEQ ID NO: 5383832 - DNA, 21 bp, Homo sapiens
cagccataggccctttcagtg

SEQ ID NO: 5383833 - DNA, 22 bp, Homo sapiens
cagccatatggaaaagattgaa

SEQ ID NO: 5383834 - DNA, 18 bp, Homo sapiens
cagccatatgtaacatca

SEQ ID NO: 5383835 - DNA, 18 bp, Homo sapiens
cagccatcaagagactga

SEQ ID NO: 5383836 - DNA, 19 bp, Homo sapiens
cagccatcacaaggggaac

SEQ ID NO: 5383837 - DNA, 22 bp, Homo sapiens
cagccatcacaaggggaacgca

SEQ ID NO: 5383838 - DNA, 18 bp, Homo sapiens
cagccatcatgtgcctgg

SEQ ID NO: 5383839 - DNA, 23 bp, Homo sapiens
cagccatccagggggcaagagga

SEQ ID NO: 5383840 - DNA, 15 bp, Homo sapiens
cagccatcccaaggc

SEQ ID NO: 5383841 - DNA, 17 bp, Homo sapiens
cagccatcccagccttg

SEQ ID NO: 5383842 - DNA, 22 bp, Homo sapiens
cagccatcccgcttagcctgcc

SEQ ID NO: 5383843 - DNA, 14 bp, Homo sapiens
cagccatccgcaga

SEQ ID NO: 5383844 - DNA, 17 bp, Homo sapiens
cagccatcctccctcca

SEQ ID NO: 5383845 - DNA, 19 bp, Homo sapiens
cagccatcggaagagaggg

SEQ ID NO: 5383846 - DNA, 20 bp, Homo sapiens
cagccatcggaagagagggc

SEQ ID NO: 5383847 - DNA, 21 bp, Homo sapiens
cagccatcggaagagagggct

SEQ ID NO: 5383848 - DNA, 13 bp, Homo sapiens
cagccatctgccc

SEQ ID NO: 5383849 - DNA, 17 bp, Homo sapiens
cagccatctgcccaggg

SEQ ID NO: 5383850 - DNA, 18 bp, Homo sapiens
cagccatctgcccagggg

SEQ ID NO: 5383851 - DNA, 21 bp, Homo sapiens
cagccatctgcccaggggtgc

SEQ ID NO: 5383852 - DNA, 14 bp, Homo sapiens
cagccatgaagggt

SEQ ID NO: 5383853 - DNA, 16 bp, Homo sapiens
cagccatgaagtcacc

SEQ ID NO: 5383854 - DNA, 22 bp, Homo sapiens
cagccatgaccagttctggcca

SEQ ID NO: 5383855 - DNA, 16 bp, Homo sapiens
cagccatgcccaggac

SEQ ID NO: 5383856 - DNA, 13 bp, Homo sapiens
cagccatgcctca

SEQ ID NO: 5383857 - DNA, 14 bp, Homo sapiens
cagccatgcctcat

SEQ ID NO: 5383858 - DNA, 16 bp, Homo sapiens
cagccatgcctcatgc

SEQ ID NO: 5383859 - DNA, 20 bp, Homo sapiens
cagccatgcctcatgccaca

SEQ ID NO: 5383860 - DNA, 22 bp, Homo sapiens
cagccatgcgcgcgctctctct

SEQ ID NO: 5383861 - DNA, 20 bp, Homo sapiens
cagccatgggaaatgagcca

SEQ ID NO: 5383862 - DNA, 21 bp, Homo sapiens
cagccatgggaaatgagccag

SEQ ID NO: 5383863 - DNA, 17 bp, Homo sapiens
cagccatgggccctctg

SEQ ID NO: 5383864 - DNA, 20 bp, Homo sapiens
cagccatgggccctctgagc

SEQ ID NO: 5383865 - DNA, 19 bp, Homo sapiens
cagccatgtctgtgctgtg

SEQ ID NO: 5383866 - DNA, 15 bp, Homo sapiens
cagccattaaaataa

SEQ ID NO: 5383867 - DNA, 19 bp, Homo sapiens
cagccattaaaataaaaca

SEQ ID NO: 5383868 - DNA, 20 bp, Homo sapiens
cagccattaccatggagaca

SEQ ID NO: 5383869 - DNA, 20 bp, Homo sapiens
cagccattacccagctaaat

SEQ ID NO: 5383870 - DNA, 13 bp, Homo sapiens
cagccattataaa

SEQ ID NO: 5383871 - DNA, 17 bp, Homo sapiens
cagccattcacaacaca

SEQ ID NO: 5383872 - DNA, 22 bp, Homo sapiens
cagccattcacaacacaatcaa

SEQ ID NO: 5383873 - DNA, 17 bp, Homo sapiens
cagccattcctgttctc

SEQ ID NO: 5383874 - DNA, 17 bp, Homo sapiens
cagccattctaactcat

SEQ ID NO: 5383875 - DNA, 17 bp, Homo sapiens
cagccattgcggcccca

SEQ ID NO: 5383876 - DNA, 19 bp, Homo sapiens
cagccattgcggccccagg

SEQ ID NO: 5383877 - DNA, 20 bp, Homo sapiens
cagccattgcggccccagga

SEQ ID NO: 5383878 - DNA, 20 bp, Homo sapiens
cagccattggcctctgtctc

SEQ ID NO: 5383879 - DNA, 19 bp, Homo sapiens
cagccatttccccctcctc

SEQ ID NO: 5383880 - DNA, 20 bp, Homo sapiens
cagccatttccccctcctca

SEQ ID NO: 5383881 - DNA, 13 bp, Homo sapiens
cagccatttgtaa

SEQ ID NO: 5383882 - DNA, 22 bp, Homo sapiens
cagccatttttcagtagcagga

SEQ ID NO: 5383883 - DNA, 18 bp, Homo sapiens
cagcccaaaacccagggc

SEQ ID NO: 5383884 - DNA, 16 bp, Homo sapiens
cagcccaaacctggga

SEQ ID NO: 5383885 - DNA, 17 bp, Homo sapiens
cagcccaaacctgggaa

SEQ ID NO: 5383886 - DNA, 15 bp, Homo sapiens
cagcccaaaccttgg

SEQ ID NO: 5383887 - DNA, 22 bp, Homo sapiens
cagcccaaaggggacaggcctc

SEQ ID NO: 5383888 - DNA, 18 bp, Homo sapiens
cagcccaaattctcctct

SEQ ID NO: 5383889 - DNA, 15 bp, Homo sapiens
cagcccaacagcact

SEQ ID NO: 5383890 - DNA, 12 bp, Homo sapiens
cagcccaaccag

SEQ ID NO: 5383891 - DNA, 16 bp, Homo sapiens
cagcccaaccaggagg

SEQ ID NO: 5383892 - DNA, 21 bp, Homo sapiens
cagcccaaccaggaggggtct

SEQ ID NO: 5383893 - DNA, 15 bp, Homo sapiens
cagcccaacccactg

SEQ ID NO: 5383894 - DNA, 22 bp, Homo sapiens
cagcccaaccgggaaaggcatc

SEQ ID NO: 5383895 - DNA, 17 bp, Homo sapiens
cagcccaagattcttca

SEQ ID NO: 5383896 - DNA, 12 bp, Homo sapiens
cagcccaagcac

SEQ ID NO: 5383897 - DNA, 15 bp, Homo sapiens
cagcccaagtagagg

SEQ ID NO: 5383898 - DNA, 13 bp, Homo sapiens
cagcccaataaag

SEQ ID NO: 5383899 - DNA, 19 bp, Homo sapiens
cagcccaataaaggtccct

SEQ ID NO: 5383900 - DNA, 13 bp, Homo sapiens
cagcccaatccag

SEQ ID NO: 5383901 - DNA, 16 bp, Homo sapiens
cagcccaatccaggta

SEQ ID NO: 5383902 - DNA, 17 bp, Homo sapiens
cagcccaatctgccaga

SEQ ID NO: 5383903 - DNA, 18 bp, Homo sapiens
cagcccacacagcccgag

SEQ ID NO: 5383904 - DNA, 12 bp, Homo sapiens
cagcccacaccc

SEQ ID NO: 5383905 - DNA, 14 bp, Homo sapiens
cagcccacacccct

SEQ ID NO: 5383906 - DNA, 15 bp, Homo sapiens
cagcccacacccctc

SEQ ID NO: 5383907 - DNA, 12 bp, Homo sapiens
cagcccacagag

SEQ ID NO: 5383908 - DNA, 13 bp, Homo sapiens
cagcccacagagg

SEQ ID NO: 5383909 - DNA, 14 bp, Homo sapiens
cagcccacagagga

SEQ ID NO: 5383910 - DNA, 19 bp, Homo sapiens
cagcccacatccattccag

SEQ ID NO: 5383911 - DNA, 16 bp, Homo sapiens
cagcccaccaccctgg

SEQ ID NO: 5383912 - DNA, 22 bp, Homo sapiens
cagcccaccagacgtcaggccc

SEQ ID NO: 5383913 - DNA, 21 bp, Homo sapiens
cagcccaccaggagcacctgg

SEQ ID NO: 5383914 - DNA, 11 bp, Homo sapiens
cagcccacccc

SEQ ID NO: 5383915 - DNA, 17 bp, Homo sapiens
cagcccaccccatggcc

SEQ ID NO: 5383916 - DNA, 16 bp, Homo sapiens
cagcccacccccggca

SEQ ID NO: 5383917 - DNA, 17 bp, Homo sapiens
cagcccacccccggcag

SEQ ID NO: 5383918 - DNA, 18 bp, Homo sapiens
cagcccacccccggcagc

SEQ ID NO: 5383919 - DNA, 20 bp, Homo sapiens
cagcccacccccggcagcag

SEQ ID NO: 5383920 - DNA, 22 bp, Homo sapiens
cagcccacccccggcagcagcc

SEQ ID NO: 5383921 - DNA, 12 bp, Homo sapiens
cagcccaccctc

SEQ ID NO: 5383922 - DNA, 13 bp, Homo sapiens
cagcccaccctcc

SEQ ID NO: 5383923 - DNA, 15 bp, Homo sapiens
cagcccaccctcctg

SEQ ID NO: 5383924 - DNA, 20 bp, Homo sapiens
cagcccaccctgcccctttc

SEQ ID NO: 5383925 - DNA, 17 bp, Homo sapiens
cagcccaccctgctcct

SEQ ID NO: 5383926 - DNA, 21 bp, Homo sapiens
cagcccaccctgctcctcctg

SEQ ID NO: 5383927 - DNA, 12 bp, Homo sapiens
cagcccacctgc

SEQ ID NO: 5383928 - DNA, 17 bp, Homo sapiens
cagcccacctgctccca

SEQ ID NO: 5383929 - DNA, 19 bp, Homo sapiens
cagcccacctgctcccagg

SEQ ID NO: 5383930 - DNA, 22 bp, Homo sapiens
cagcccacctgctcccaggccc

SEQ ID NO: 5383931 - DNA, 19 bp, Homo sapiens
cagcccacctgctgcccgt

SEQ ID NO: 5383932 - DNA, 20 bp, Homo sapiens
cagcccacggggatcacagc

SEQ ID NO: 5383933 - DNA, 16 bp, Homo sapiens
cagcccacggtctgga

SEQ ID NO: 5383934 - DNA, 20 bp, Homo sapiens
cagcccacgtcctgtcagtg

SEQ ID NO: 5383935 - DNA, 14 bp, Homo sapiens
cagcccactgcacc

SEQ ID NO: 5383936 - DNA, 15 bp, Homo sapiens
cagcccactgcaccg

SEQ ID NO: 5383937 - DNA, 15 bp, Homo sapiens
cagcccactggatca

SEQ ID NO: 5383938 - DNA, 20 bp, Homo sapiens
cagcccactggatcagaaag

SEQ ID NO: 5383939 - DNA, 13 bp, Homo sapiens
cagcccactgggc

SEQ ID NO: 5383940 - DNA, 17 bp, Homo sapiens
cagcccactgggccctg

SEQ ID NO: 5383941 - DNA, 21 bp, Homo sapiens
cagcccactgggccctggggc

SEQ ID NO: 5383942 - DNA, 13 bp, Homo sapiens
cagcccagaacac

SEQ ID NO: 5383943 - DNA, 13 bp, Homo sapiens
cagcccagaacca

SEQ ID NO: 5383944 - DNA, 19 bp, Homo sapiens
cagcccagaacgggcctcc

SEQ ID NO: 5383945 - DNA, 20 bp, Homo sapiens
cagcccagaacgggcctccc

SEQ ID NO: 5383946 - DNA, 23 bp, Homo sapiens
cagcccagaacgggcctccccgg

SEQ ID NO: 5383947 - DNA, 16 bp, Homo sapiens
cagcccagacatcctg

SEQ ID NO: 5383948 - DNA, 14 bp, Homo sapiens
cagcccagagcagg

SEQ ID NO: 5383949 - DNA, 18 bp, Homo sapiens
cagcccagagcagggtct

SEQ ID NO: 5383950 - DNA, 20 bp, Homo sapiens
cagcccagaggccaacactg

SEQ ID NO: 5383951 - DNA, 22 bp, Homo sapiens
cagcccagatggctccctgggc

SEQ ID NO: 5383952 - DNA, 22 bp, Homo sapiens
cagcccagattcccctgtgtca

SEQ ID NO: 5383953 - DNA, 15 bp, Homo sapiens
cagcccagcacaacc

SEQ ID NO: 5383954 - DNA, 13 bp, Homo sapiens
cagcccagcacct

SEQ ID NO: 5383955 - DNA, 16 bp, Homo sapiens
cagcccagcacctgct

SEQ ID NO: 5383956 - DNA, 18 bp, Homo sapiens
cagcccagcacctgctcc

SEQ ID NO: 5383957 - DNA, 23 bp, Homo sapiens
cagcccagcagtgtggagaccct

SEQ ID NO: 5383958 - DNA, 23 bp, Homo sapiens
cagcccagcatttcccgaaggcc

SEQ ID NO: 5383959 - DNA, 15 bp, Homo sapiens
cagcccagccacgga

SEQ ID NO: 5383960 - DNA, 14 bp, Homo sapiens
cagcccagccagcg

SEQ ID NO: 5383961 - DNA, 18 bp, Homo sapiens
cagcccagcccagctgct

SEQ ID NO: 5383962 - DNA, 17 bp, Homo sapiens
cagcccagcccagctgg

SEQ ID NO: 5383963 - DNA, 23 bp, Homo sapiens
cagcccagccccgccccgttgtg

SEQ ID NO: 5383964 - DNA, 21 bp, Homo sapiens
cagcccagcctctgtccctct

SEQ ID NO: 5383965 - DNA, 10 bp, Homo sapiens
cagcccagct

SEQ ID NO: 5383966 - DNA, 14 bp, Homo sapiens
cagcccagctggcc

SEQ ID NO: 5383967 - DNA, 16 bp, Homo sapiens
cagcccagctggccgg

SEQ ID NO: 5383968 - DNA, 16 bp, Homo sapiens
cagcccagctggcctg

SEQ ID NO: 5383969 - DNA, 16 bp, Homo sapiens
cagcccagcttcctgg

SEQ ID NO: 5383970 - DNA, 12 bp, Homo sapiens
cagcccaggaag

SEQ ID NO: 5383971 - DNA, 22 bp, Homo sapiens
cagcccaggaagtctcatctgg

SEQ ID NO: 5383972 - DNA, 17 bp, Homo sapiens
cagcccaggaggcagag

SEQ ID NO: 5383973 - DNA, 19 bp, Homo sapiens
cagcccaggcatctccttg

SEQ ID NO: 5383974 - DNA, 22 bp, Homo sapiens
cagcccaggcatctccttgggc

SEQ ID NO: 5383975 - DNA, 12 bp, Homo sapiens
cagcccaggcca

SEQ ID NO: 5383976 - DNA, 13 bp, Homo sapiens
cagcccaggcctg

SEQ ID NO: 5383977 - DNA, 18 bp, Homo sapiens
cagcccaggcctggtgga

SEQ ID NO: 5383978 - DNA, 19 bp, Homo sapiens
cagcccaggcctggtggag

SEQ ID NO: 5383979 - DNA, 20 bp, Homo sapiens
cagcccaggcctggtggagg

SEQ ID NO: 5383980 - DNA, 12 bp, Homo sapiens
cagcccagggac

SEQ ID NO: 5383981 - DNA, 12 bp, Homo sapiens
cagcccagggcc

SEQ ID NO: 5383982 - DNA, 17 bp, Homo sapiens
cagcccagggctcctgc

SEQ ID NO: 5383983 - DNA, 19 bp, Homo sapiens
cagcccaggtcctcccggg

SEQ ID NO: 5383984 - DNA, 16 bp, Homo sapiens
cagcccaggtctcctg

SEQ ID NO: 5383985 - DNA, 20 bp, Homo sapiens
cagcccaggtctcctgggca

SEQ ID NO: 5383986 - DNA, 20 bp, Homo sapiens
cagcccagtggaggaggggg

SEQ ID NO: 5383987 - DNA, 14 bp, Homo sapiens
cagcccatcctccc

SEQ ID NO: 5383988 - DNA, 16 bp, Homo sapiens
cagcccatctcggagc

SEQ ID NO: 5383989 - DNA, 21 bp, Homo sapiens
cagcccatctgaacacaacca

SEQ ID NO: 5383990 - DNA, 14 bp, Homo sapiens
cagcccatcttgcc

SEQ ID NO: 5383991 - DNA, 15 bp, Homo sapiens
cagcccatgcccacc

SEQ ID NO: 5383992 - DNA, 17 bp, Homo sapiens
cagcccatgcccacctg

SEQ ID NO: 5383993 - DNA, 21 bp, Homo sapiens
cagcccatgcccacctgccca

SEQ ID NO: 5383994 - DNA, 20 bp, Homo sapiens
cagcccatgctggctggggc

SEQ ID NO: 5383995 - DNA, 22 bp, Homo sapiens
cagcccatggagattgacctgg

SEQ ID NO: 5383996 - DNA, 20 bp, Homo sapiens
cagcccatggaggcagatgc

SEQ ID NO: 5383997 - DNA, 20 bp, Homo sapiens
cagcccatggcccccaataa

SEQ ID NO: 5383998 - DNA, 22 bp, Homo sapiens
cagcccatggcccccaataaag

SEQ ID NO: 5383999 - DNA, 17 bp, Homo sapiens
cagcccatggccctgtg

SEQ ID NO: 5384000 - DNA, 18 bp, Homo sapiens
cagcccatggccctgtgc

SEQ ID NO: 5384001 - DNA, 21 bp, Homo sapiens
cagcccatggcctctggccag

SEQ ID NO: 5384002 - DNA, 21 bp, Homo sapiens
cagcccatggtgaatgtatgt

SEQ ID NO: 5384003 - DNA, 17 bp, Homo sapiens
cagcccatgtcaatcaa

SEQ ID NO: 5384004 - DNA, 20 bp, Homo sapiens
cagccctgggaaccactccc

SEQ ID NO: 5384005 - DNA, 12 bp, Homo sapiens
cagccctgggag

SEQ ID NO: 5384006 - DNA, 15 bp, Homo sapiens
cagccctgggcctgg

SEQ ID NO: 5384007 - DNA, 12 bp, Homo sapiens
cagccctgggct

SEQ ID NO: 5384008 - DNA, 19 bp, Homo sapiens
cagccctgggcttggctct

SEQ ID NO: 5384009 - DNA, 23 bp, Homo sapiens
cagccctgggcttggctcttggc

SEQ ID NO: 5384010 - DNA, 13 bp, Homo sapiens
cagccctgggggc

SEQ ID NO: 5384011 - DNA, 16 bp, Homo sapiens
cagccctgggggccag

SEQ ID NO: 5384012 - DNA, 18 bp, Homo sapiens
cagccctgggggccagct

SEQ ID NO: 5384013 - DNA, 20 bp, Homo sapiens
cagccctgggggccagctgg

SEQ ID NO: 5384014 - DNA, 21 bp, Homo sapiens
cagccctgggggccagctggt

SEQ ID NO: 5384015 - DNA, 23 bp, Homo sapiens
cagccctggggtatgagctgcca

SEQ ID NO: 5384016 - DNA, 16 bp, Homo sapiens
cagccctggttctggc

SEQ ID NO: 5384017 - DNA, 18 bp, Homo sapiens
cagccctgtcacgccggg

SEQ ID NO: 5384018 - DNA, 12 bp, Homo sapiens
cagccctgtcag

SEQ ID NO: 5384019 - DNA, 13 bp, Homo sapiens
cagccctgtcagc

SEQ ID NO: 5384020 - DNA, 16 bp, Homo sapiens
cagccctgtcagcatg

SEQ ID NO: 5384021 - DNA, 21 bp, Homo sapiens
cagccctgtcagcatgaattt

SEQ ID NO: 5384022 - DNA, 18 bp, Homo sapiens
cagccctgtcagtgcagc

SEQ ID NO: 5384023 - DNA, 20 bp, Homo sapiens
cagccctgtcagtgcagccc

SEQ ID NO: 5384024 - DNA, 23 bp, Homo sapiens
cagccctgtcccctgaaaaactg

SEQ ID NO: 5384025 - DNA, 15 bp, Homo sapiens
cagccctgtcctggt

SEQ ID NO: 5384026 - DNA, 17 bp, Homo sapiens
cagccctgtcctggttc

SEQ ID NO: 5384027 - DNA, 16 bp, Homo sapiens
cagccctgtctactga

SEQ ID NO: 5384028 - DNA, 11 bp, Homo sapiens
cagccctgtgg

SEQ ID NO: 5384029 - DNA, 12 bp, Homo sapiens
cagccctgtgtc

SEQ ID NO: 5384030 - DNA, 20 bp, Homo sapiens
cagccctgtgtctgtcacag

SEQ ID NO: 5384031 - DNA, 20 bp, Homo sapiens
cagccctgttccgcctcact

SEQ ID NO: 5384032 - DNA, 19 bp, Homo sapiens
cagcccttagcacagagag

SEQ ID NO: 5384033 - DNA, 16 bp, Homo sapiens
cagcccttcaggaagc

SEQ ID NO: 5384034 - DNA, 20 bp, Homo sapiens
cagcccttcccaggccagcg

SEQ ID NO: 5384035 - DNA, 16 bp, Homo sapiens
cagcccttccctgctt

SEQ ID NO: 5384036 - DNA, 17 bp, Homo sapiens
cagcccttccctgcttt

SEQ ID NO: 5384037 - DNA, 20 bp, Homo sapiens
cagcccttcctccctgtctc

SEQ ID NO: 5384038 - DNA, 14 bp, Homo sapiens
cagcccttcctcct

SEQ ID NO: 5384039 - DNA, 21 bp, Homo sapiens
cagcccttcctctcactcctg

SEQ ID NO: 5384040 - DNA, 18 bp, Homo sapiens
cagcccttcctctgctcc

SEQ ID NO: 5384041 - DNA, 23 bp, Homo sapiens
cagcccttcctctgctccccctt

SEQ ID NO: 5384042 - DNA, 12 bp, Homo sapiens
cagcccttcctt

SEQ ID NO: 5384043 - DNA, 14 bp, Homo sapiens
cagcccttccttgg

SEQ ID NO: 5384044 - DNA, 15 bp, Homo sapiens
cagcccttccttggg

SEQ ID NO: 5384045 - DNA, 16 bp, Homo sapiens
cagcccttctgccttt

SEQ ID NO: 5384046 - DNA, 19 bp, Homo sapiens
cagcccttctttccacaga

SEQ ID NO: 5384047 - DNA, 20 bp, Homo sapiens
cagcccttctttccacagaa

SEQ ID NO: 5384048 - DNA, 15 bp, Homo sapiens
cagcccttgccccca

SEQ ID NO: 5384049 - DNA, 21 bp, Homo sapiens
cagcccttgcccccatccctc

SEQ ID NO: 5384050 - DNA, 21 bp, Homo sapiens
cagcccttgctctacctggcc

SEQ ID NO: 5384051 - DNA, 13 bp, Homo sapiens
cagcccttgcttg

SEQ ID NO: 5384052 - DNA, 12 bp, Homo sapiens
cagcccttggcc

SEQ ID NO: 5384053 - DNA, 14 bp, Homo sapiens
cagcccttggccag

SEQ ID NO: 5384054 - DNA, 17 bp, Homo sapiens
cagcccttggcttgtgt

SEQ ID NO: 5384055 - DNA, 15 bp, Homo sapiens
cagcccttgggcagt

SEQ ID NO: 5384056 - DNA, 23 bp, Homo sapiens
cagcccttgggggtcctcctcca

SEQ ID NO: 5384057 - DNA, 14 bp, Homo sapiens
cagcccttgtttat

SEQ ID NO: 5384058 - DNA, 12 bp, Homo sapiens
cagccctttcca

SEQ ID NO: 5384059 - DNA, 16 bp, Homo sapiens
cagccctttccagggc

SEQ ID NO: 5384060 - DNA, 13 bp, Homo sapiens
cagccctttgctc

SEQ ID NO: 5384061 - DNA, 23 bp, Homo sapiens
cagcccttttgttgagccaggcc

SEQ ID NO: 5384062 - DNA, 20 bp, Homo sapiens
cagccgaagctgcaggggca

SEQ ID NO: 5384063 - DNA, 15 bp, Homo sapiens
cagccgaccccctct

SEQ ID NO: 5384064 - DNA, 15 bp, Homo sapiens
cagccgaccctcctg

SEQ ID NO: 5384065 - DNA, 17 bp, Homo sapiens
cagccgaccctcctggc

SEQ ID NO: 5384066 - DNA, 21 bp, Homo sapiens
cagccgaccctcctggccttc

SEQ ID NO: 5384067 - DNA, 23 bp, Homo sapiens
cagccgaccctcctggccttcct

SEQ ID NO: 5384068 - DNA, 21 bp, Homo sapiens
cagccgagatagccaaggcca

SEQ ID NO: 5384069 - DNA, 21 bp, Homo sapiens
cagccgagatcggggtggcag

SEQ ID NO: 5384070 - DNA, 15 bp, Homo sapiens
cagccgagcccaggg

SEQ ID NO: 5384071 - DNA, 17 bp, Homo sapiens
cagccgagcccagggga

SEQ ID NO: 5384072 - DNA, 16 bp, Homo sapiens
cagccgagccccagga

SEQ ID NO: 5384073 - DNA, 18 bp, Homo sapiens
cagccgagccgggcctgg

SEQ ID NO: 5384074 - DNA, 22 bp, Homo sapiens
cagccgagctcgtgtatcctgg

SEQ ID NO: 5384075 - DNA, 21 bp, Homo sapiens
cagccgagcttttactccctg

SEQ ID NO: 5384076 - DNA, 15 bp, Homo sapiens
cagccgaggcctggc

SEQ ID NO: 5384077 - DNA, 18 bp, Homo sapiens
cagccgaggcctggccaa

SEQ ID NO: 5384078 - DNA, 20 bp, Homo sapiens
cagccgaggtccctgctgcc

SEQ ID NO: 5384079 - DNA, 21 bp, Homo sapiens
cagccgagtggatagatgccc

SEQ ID NO: 5384080 - DNA, 23 bp, Homo sapiens
cagccgcaaatccataccccctg

SEQ ID NO: 5384081 - DNA, 24 bp, Homo sapiens
cagccgcaatctggctcctcctgg

SEQ ID NO: 5384082 - DNA, 16 bp, Homo sapiens
cagccgcagcgcagcc

SEQ ID NO: 5384083 - DNA, 20 bp, Homo sapiens
cagccgcattggtgactcac

SEQ ID NO: 5384084 - DNA, 23 bp, Homo sapiens
cagccgcccacccccacccccag

SEQ ID NO: 5384085 - DNA, 15 bp, Homo sapiens
cagccgccccagccc

SEQ ID NO: 5384086 - DNA, 16 bp, Homo sapiens
cagccgccccagcccc

SEQ ID NO: 5384087 - DNA, 14 bp, Homo sapiens
cagccgccctgggc

SEQ ID NO: 5384088 - DNA, 15 bp, Homo sapiens
cagccgccctgggct

SEQ ID NO: 5384089 - DNA, 20 bp, Homo sapiens
cagccgccgccgcccacgcc

SEQ ID NO: 5384090 - DNA, 16 bp, Homo sapiens
cagccgccggaagtgg

SEQ ID NO: 5384091 - DNA, 19 bp, Homo sapiens
cagccgccggctgtgcagt

SEQ ID NO: 5384092 - DNA, 20 bp, Homo sapiens
cagccgccttcacagcagtc

SEQ ID NO: 5384093 - DNA, 22 bp, Homo sapiens
cagccgccttccttgaccttcc

SEQ ID NO: 5384094 - DNA, 23 bp, Homo sapiens
cagccgccttccttgaccttcct

SEQ ID NO: 5384095 - DNA, 23 bp, Homo sapiens
cagccgcctttgggttccatctt

SEQ ID NO: 5384096 - DNA, 17 bp, Homo sapiens
cagccgcgctctgcccc

SEQ ID NO: 5384097 - DNA, 18 bp, Homo sapiens
cagccgcgctctgcccct

SEQ ID NO: 5384098 - DNA, 19 bp, Homo sapiens
cagccgcgggccaggaggc

SEQ ID NO: 5384099 - DNA, 15 bp, Homo sapiens
cagccgctaggagag

SEQ ID NO: 5384100 - DNA, 16 bp, Homo sapiens
cagccgctaggagaga

SEQ ID NO: 5384101 - DNA, 18 bp, Homo sapiens
cagccgctccagagtcag

SEQ ID NO: 5384102 - DNA, 17 bp, Homo sapiens
cagccgctcctgtctgc

SEQ ID NO: 5384103 - DNA, 20 bp, Homo sapiens
cagccgctcctgtctgccag

SEQ ID NO: 5384104 - DNA, 20 bp, Homo sapiens
cagccgctcggaggccccaa

SEQ ID NO: 5384105 - DNA, 22 bp, Homo sapiens
cagccgctgcagggctcccatg

SEQ ID NO: 5384106 - DNA, 12 bp, Homo sapiens
cagccgctgccc

SEQ ID NO: 5384107 - DNA, 15 bp, Homo sapiens
cagccgctgcccggc

SEQ ID NO: 5384108 - DNA, 13 bp, Homo sapiens
cagccgctggtgc

SEQ ID NO: 5384109 - DNA, 21 bp, Homo sapiens
cagccgctggtgcccaccagc

SEQ ID NO: 5384110 - DNA, 20 bp, Homo sapiens
cagccggagcagttggcctg

SEQ ID NO: 5384111 - DNA, 22 bp, Homo sapiens
cagccggagcagttggcctgtg

SEQ ID NO: 5384112 - DNA, 23 bp, Homo sapiens
cagccggagcagttggcctgtgc

SEQ ID NO: 5384113 - DNA, 15 bp, Homo sapiens
cagccggagggaggc

SEQ ID NO: 5384114 - DNA, 16 bp, Homo sapiens
cagccggagggaggca

SEQ ID NO: 5384115 - DNA, 13 bp, Homo sapiens
cagccggcacagg

SEQ ID NO: 5384116 - DNA, 18 bp, Homo sapiens
cagccggcacagggtctg

SEQ ID NO: 5384117 - DNA, 23 bp, Homo sapiens
cagccggcacagggtctgctctt

SEQ ID NO: 5384118 - DNA, 14 bp, Homo sapiens
cagccggcacccac

SEQ ID NO: 5384119 - DNA, 16 bp, Homo sapiens
cagccggcctctctgg

SEQ ID NO: 5384120 - DNA, 22 bp, Homo sapiens
cagccggcctctctggcctccc

SEQ ID NO: 5384121 - DNA, 21 bp, Homo sapiens
cagccggcgtggcaaatataa

SEQ ID NO: 5384122 - DNA, 16 bp, Homo sapiens
cagccgggagcttggc

SEQ ID NO: 5384123 - DNA, 20 bp, Homo sapiens
cagccgggagcttggctctc

SEQ ID NO: 5384124 - DNA, 14 bp, Homo sapiens
cagccggggaagac

SEQ ID NO: 5384125 - DNA, 21 bp, Homo sapiens
cagccggggagctgaggggca

SEQ ID NO: 5384126 - DNA, 16 bp, Homo sapiens
cagccggggcctgcct

SEQ ID NO: 5384127 - DNA, 19 bp, Homo sapiens
cagccgggtacctcagttt

SEQ ID NO: 5384128 - DNA, 20 bp, Homo sapiens
cagccgggtacctcagtttc

SEQ ID NO: 5384129 - DNA, 22 bp, Homo sapiens
cagccgggtacctcagtttctc

SEQ ID NO: 5384130 - DNA, 19 bp, Homo sapiens
cagccgggtgtgtgtctgc

SEQ ID NO: 5384131 - DNA, 15 bp, Homo sapiens
cagccggtcagagga

SEQ ID NO: 5384132 - DNA, 21 bp, Homo sapiens
cagccgtaatggggactctcc

SEQ ID NO: 5384133 - DNA, 17 bp, Homo sapiens
cagccgtagggtggcac

SEQ ID NO: 5384134 - DNA, 13 bp, Homo sapiens
cagccgtatttta

SEQ ID NO: 5384135 - DNA, 18 bp, Homo sapiens
cagccgtcagccaaatgt

SEQ ID NO: 5384136 - DNA, 19 bp, Homo sapiens
cagccgtcagccaaatgta

SEQ ID NO: 5384137 - DNA, 15 bp, Homo sapiens
cagccgtcagccatc

SEQ ID NO: 5384138 - DNA, 15 bp, Homo sapiens
cagccgtccatagca

SEQ ID NO: 5384139 - DNA, 13 bp, Homo sapiens
cagccgtcccagg

SEQ ID NO: 5384140 - DNA, 16 bp, Homo sapiens
cagccgtcccaggcca

SEQ ID NO: 5384141 - DNA, 18 bp, Homo sapiens
cagccgtcccaggccacc

SEQ ID NO: 5384142 - DNA, 15 bp, Homo sapiens
cagccgtccttctaa

SEQ ID NO: 5384143 - DNA, 19 bp, Homo sapiens
cagccgtgatgctcaggct

SEQ ID NO: 5384144 - DNA, 16 bp, Homo sapiens
cagccgtgcaggactc

SEQ ID NO: 5384145 - DNA, 14 bp, Homo sapiens
cagccgtgccttca

SEQ ID NO: 5384146 - DNA, 17 bp, Homo sapiens
cagccgtgggccccacc

SEQ ID NO: 5384147 - DNA, 17 bp, Homo sapiens
cagccgtgtgtgcatgt

SEQ ID NO: 5384148 - DNA, 14 bp, Homo sapiens
cagccgttttcctc

SEQ ID NO: 5384149 - DNA, 16 bp, Homo sapiens
cagccgttttcctcat

SEQ ID NO: 5384150 - DNA, 17 bp, Homo sapiens
cagccgttttcctcatc

SEQ ID NO: 5384151 - DNA, 20 bp, Homo sapiens
cagcctaaagtacagcctgg

SEQ ID NO: 5384152 - DNA, 23 bp, Homo sapiens
cagcctaagaagaaggccagaga

SEQ ID NO: 5384153 - DNA, 14 bp, Homo sapiens
cagcctaagagact

SEQ ID NO: 5384154 - DNA, 14 bp, Homo sapiens
cagcctaagggaga

SEQ ID NO: 5384155 - DNA, 21 bp, Homo sapiens
cagcctaagggagacaggcct

SEQ ID NO: 5384156 - DNA, 17 bp, Homo sapiens
cagcctaatgaaggcca

SEQ ID NO: 5384157 - DNA, 12 bp, Homo sapiens
cagcctacactg

SEQ ID NO: 5384158 - DNA, 14 bp, Homo sapiens
cagcctacactgcc

SEQ ID NO: 5384159 - DNA, 17 bp, Homo sapiens
cagcctacactgccagc

SEQ ID NO: 5384160 - DNA, 18 bp, Homo sapiens
cagcctacagcagtgtgg

SEQ ID NO: 5384161 - DNA, 15 bp, Homo sapiens
cagcctaccatgaga

SEQ ID NO: 5384162 - DNA, 17 bp, Homo sapiens
cagcctacccctcctgc

SEQ ID NO: 5384163 - DNA, 20 bp, Homo sapiens
cagcctacccctcctgcgct

SEQ ID NO: 5384164 - DNA, 22 bp, Homo sapiens
cagcctacccttgtaccccatc

SEQ ID NO: 5384165 - DNA, 23 bp, Homo sapiens
cagcctaccgctggccctgccgt

SEQ ID NO: 5384166 - DNA, 22 bp, Homo sapiens
cagcctactagggacctgggga

SEQ ID NO: 5384167 - DNA, 16 bp, Homo sapiens
cagcctactctccttg

SEQ ID NO: 5384168 - DNA, 14 bp, Homo sapiens
cagcctagcacagg

SEQ ID NO: 5384169 - DNA, 14 bp, Homo sapiens
cagcctagcccttg

SEQ ID NO: 5384170 - DNA, 17 bp, Homo sapiens
cagcctagccgacctca

SEQ ID NO: 5384171 - DNA, 19 bp, Homo sapiens
cagcctagccgacctcagc

SEQ ID NO: 5384172 - DNA, 21 bp, Homo sapiens
cagcctagccgacctcagcct

SEQ ID NO: 5384173 - DNA, 17 bp, Homo sapiens
cagcctagcctggctct

SEQ ID NO: 5384174 - DNA, 22 bp, Homo sapiens
cagcctaggacgccaacttctc

SEQ ID NO: 5384175 - DNA, 21 bp, Homo sapiens
cagcctagggctgagctgggg

SEQ ID NO: 5384176 - DNA, 17 bp, Homo sapiens
cagcctatatttcctct

SEQ ID NO: 5384177 - DNA, 22 bp, Homo sapiens
cagcctatatttcctcttctgt

SEQ ID NO: 5384178 - DNA, 22 bp, Homo sapiens
cagcctatgagcatcctgagcc

SEQ ID NO: 5384179 - DNA, 21 bp, Homo sapiens
cagcctatgggggctctcgga

SEQ ID NO: 5384180 - DNA, 22 bp, Homo sapiens
cagcctgggcccatctccctgc

SEQ ID NO: 5384181 - DNA, 19 bp, Homo sapiens
cagcctgggcccctcagcc

SEQ ID NO: 5384182 - DNA, 22 bp, Homo sapiens
cagcctgggcccctcagccacc

SEQ ID NO: 5384183 - DNA, 18 bp, Homo sapiens
cagcctgggcctatggag

SEQ ID NO: 5384184 - DNA, 11 bp, Homo sapiens
cagcctgggcg

SEQ ID NO: 5384185 - DNA, 20 bp, Homo sapiens
cagcctgggcgacaaaaacg

SEQ ID NO: 5384186 - DNA, 20 bp, Homo sapiens
cagcctgggcgacagagcaa

SEQ ID NO: 5384187 - DNA, 22 bp, Homo sapiens
cagcctgggcgacagagcaaga

SEQ ID NO: 5384188 - DNA, 17 bp, Homo sapiens
cagcctgggcgagacgg

SEQ ID NO: 5384189 - DNA, 16 bp, Homo sapiens
cagcctgggctccctc

SEQ ID NO: 5384190 - DNA, 14 bp, Homo sapiens
cagcctgggctcct

SEQ ID NO: 5384191 - DNA, 23 bp, Homo sapiens
cagcctggggcaaacctagccgg

SEQ ID NO: 5384192 - DNA, 16 bp, Homo sapiens
cagcctggggcctggc

SEQ ID NO: 5384193 - DNA, 20 bp, Homo sapiens
cagcctggggcctggcaggg

SEQ ID NO: 5384194 - DNA, 22 bp, Homo sapiens
cagcctggggccttcctggctt

SEQ ID NO: 5384195 - DNA, 12 bp, Homo sapiens
cagcctggggct

SEQ ID NO: 5384196 - DNA, 20 bp, Homo sapiens
cagcctggggctccctctct

SEQ ID NO: 5384197 - DNA, 24 bp, Homo sapiens
cagcctggggctccctctctggtt

SEQ ID NO: 5384198 - DNA, 19 bp, Homo sapiens
cagcctggggctctctgac

SEQ ID NO: 5384199 - DNA, 21 bp, Homo sapiens
cagcctggggctctctgaccc

SEQ ID NO: 5384200 - DNA, 18 bp, Homo sapiens
cagcctggggctggcctc

SEQ ID NO: 5384201 - DNA, 21 bp, Homo sapiens
cagcctggggctggcctccca

SEQ ID NO: 5384202 - DNA, 18 bp, Homo sapiens
cagcctgggggccagtgg

SEQ ID NO: 5384203 - DNA, 13 bp, Homo sapiens
cagcctgggggct

SEQ ID NO: 5384204 - DNA, 11 bp, Homo sapiens
cagcctggggt

SEQ ID NO: 5384205 - DNA, 15 bp, Homo sapiens
cagcctggggtctgg

SEQ ID NO: 5384206 - DNA, 22 bp, Homo sapiens
cagcctggggtgatagaacaag

SEQ ID NO: 5384207 - DNA, 23 bp, Homo sapiens
cagcctggggtttgaccacccac

SEQ ID NO: 5384208 - DNA, 22 bp, Homo sapiens
cagcctgggtctggatgggagg

SEQ ID NO: 5384209 - DNA, 23 bp, Homo sapiens
cagcctgggtctggatgggagga

SEQ ID NO: 5384210 - DNA, 17 bp, Homo sapiens
cagcctgggtgacagag

SEQ ID NO: 5384211 - DNA, 19 bp, Homo sapiens
cagcctgggtgacagagcg

SEQ ID NO: 5384212 - DNA, 20 bp, Homo sapiens
cagcctgggtgacagagtga

SEQ ID NO: 5384213 - DNA, 19 bp, Homo sapiens
cagcctggtcgccttccac

SEQ ID NO: 5384214 - DNA, 23 bp, Homo sapiens
cagcctggtcgccttccacctct

SEQ ID NO: 5384215 - DNA, 14 bp, Homo sapiens
cagcctggtggccc

SEQ ID NO: 5384216 - DNA, 15 bp, Homo sapiens
cagcctggtggccca

SEQ ID NO: 5384217 - DNA, 16 bp, Homo sapiens
cagcctggtggcccag

SEQ ID NO: 5384218 - DNA, 21 bp, Homo sapiens
cagcctggttcagaataaatt

SEQ ID NO: 5384219 - DNA, 16 bp, Homo sapiens
cagcctggttccctct

SEQ ID NO: 5384220 - DNA, 19 bp, Homo sapiens
cagcctggtttctgggtgc

SEQ ID NO: 5384221 - DNA, 22 bp, Homo sapiens
cagcctggtttgcaaagaccac

SEQ ID NO: 5384222 - DNA, 23 bp, Homo sapiens
cagcctgtaaacggtgctatttc

SEQ ID NO: 5384223 - DNA, 23 bp, Homo sapiens
cagcctgtatgtggtgtggggcg

SEQ ID NO: 5384224 - DNA, 21 bp, Homo sapiens
cagcctgtcagatccaggagc

SEQ ID NO: 5384225 - DNA, 17 bp, Homo sapiens
cagcctgtcccactggc

SEQ ID NO: 5384226 - DNA, 21 bp, Homo sapiens
cagcctgtcccactggctcct

SEQ ID NO: 5384227 - DNA, 19 bp, Homo sapiens
cagcctgtccctgaaagag

SEQ ID NO: 5384228 - DNA, 18 bp, Homo sapiens
cagcctgtcctggtacag

SEQ ID NO: 5384229 - DNA, 18 bp, Homo sapiens
cagcctgtcggccacacc

SEQ ID NO: 5384230 - DNA, 20 bp, Homo sapiens
cagcctgtcggccacacccc

SEQ ID NO: 5384231 - DNA, 23 bp, Homo sapiens
cagcctgtcggccacaccccaga

SEQ ID NO: 5384232 - DNA, 18 bp, Homo sapiens
cagcctgtcgtgtccagc

SEQ ID NO: 5384233 - DNA, 22 bp, Homo sapiens
cagcctgtctctccttgttgcc

SEQ ID NO: 5384234 - DNA, 17 bp, Homo sapiens
cagcctgtctcttccat

SEQ ID NO: 5384235 - DNA, 17 bp, Homo sapiens
cagcctgtcttgtcagg

SEQ ID NO: 5384236 - DNA, 14 bp, Homo sapiens
cagcctgtgcctgc

SEQ ID NO: 5384237 - DNA, 11 bp, Homo sapiens
cagcctgtgct

SEQ ID NO: 5384238 - DNA, 15 bp, Homo sapiens
cagcctgtgctgtgg

SEQ ID NO: 5384239 - DNA, 16 bp, Homo sapiens
cagcctgtggcagggc

SEQ ID NO: 5384240 - DNA, 15 bp, Homo sapiens
cagcctgtggcatct

SEQ ID NO: 5384241 - DNA, 19 bp, Homo sapiens
cagcctgtggcatctttgc

SEQ ID NO: 5384242 - DNA, 14 bp, Homo sapiens
cagcctgtggcctc

SEQ ID NO: 5384243 - DNA, 17 bp, Homo sapiens
cagcctgtggcctcagc

SEQ ID NO: 5384244 - DNA, 18 bp, Homo sapiens
cagcctgtggcctcagca

SEQ ID NO: 5384245 - DNA, 14 bp, Homo sapiens
cagcctgtgggaga

SEQ ID NO: 5384246 - DNA, 23 bp, Homo sapiens
cagcctgtgtctttaaatgctgc

SEQ ID NO: 5384247 - DNA, 14 bp, Homo sapiens
cagcctgtgtgcag

SEQ ID NO: 5384248 - DNA, 17 bp, Homo sapiens
cagcctgttccagaagg

SEQ ID NO: 5384249 - DNA, 19 bp, Homo sapiens
cagcctgttccagaaggag

SEQ ID NO: 5384250 - DNA, 18 bp, Homo sapiens
cagcctgttccttcctgc

SEQ ID NO: 5384251 - DNA, 19 bp, Homo sapiens
cagcctgttccttcctgca

SEQ ID NO: 5384252 - DNA, 20 bp, Homo sapiens
cagcctgttccttcctgcag

SEQ ID NO: 5384253 - DNA, 16 bp, Homo sapiens
cagccttaaatccttt

SEQ ID NO: 5384254 - DNA, 14 bp, Homo sapiens
cagccttaagctta

SEQ ID NO: 5384255 - DNA, 21 bp, Homo sapiens
cagccttaaggccctcattct

SEQ ID NO: 5384256 - DNA, 22 bp, Homo sapiens
cagccttaatagacttctctta

SEQ ID NO: 5384257 - DNA, 14 bp, Homo sapiens
cagccttaatattt

SEQ ID NO: 5384258 - DNA, 17 bp, Homo sapiens
cagccttactattcata

SEQ ID NO: 5384259 - DNA, 15 bp, Homo sapiens
cagccttagagctct

SEQ ID NO: 5384260 - DNA, 17 bp, Homo sapiens
cagccttagagctcttg

SEQ ID NO: 5384261 - DNA, 17 bp, Homo sapiens
cagccttagatgcctcg

SEQ ID NO: 5384262 - DNA, 20 bp, Homo sapiens
cagccttagcatcccctgtg

SEQ ID NO: 5384263 - DNA, 17 bp, Homo sapiens
cagccttagctgccagt

SEQ ID NO: 5384264 - DNA, 22 bp, Homo sapiens
cagccttattttgttggtgctt

SEQ ID NO: 5384265 - DNA, 16 bp, Homo sapiens
cagccttcactggaga

SEQ ID NO: 5384266 - DNA, 19 bp, Homo sapiens
cagccttcacttttctgag

SEQ ID NO: 5384267 - DNA, 11 bp, Homo sapiens
cagccttcagc

SEQ ID NO: 5384268 - DNA, 19 bp, Homo sapiens
cagccttccagtggcttct

SEQ ID NO: 5384269 - DNA, 21 bp, Homo sapiens
cagccttccccagctccagca

SEQ ID NO: 5384270 - DNA, 18 bp, Homo sapiens
cagccttcccctccctgt

SEQ ID NO: 5384271 - DNA, 21 bp, Homo sapiens
cagccttccccttgcccaggg

SEQ ID NO: 5384272 - DNA, 23 bp, Homo sapiens
cagccttccccttgcccagggct

SEQ ID NO: 5384273 - DNA, 19 bp, Homo sapiens
cagccttccctctgcattg

SEQ ID NO: 5384274 - DNA, 13 bp, Homo sapiens
cagccttccgagt

SEQ ID NO: 5384275 - DNA, 22 bp, Homo sapiens
cagccttccgagtagctgggat

SEQ ID NO: 5384276 - DNA, 20 bp, Homo sapiens
cagccttccgggaactggag

SEQ ID NO: 5384277 - DNA, 21 bp, Homo sapiens
cagccttcctctgcagctgac

SEQ ID NO: 5384278 - DNA, 22 bp, Homo sapiens
cagccttcctctgcagctgacc

SEQ ID NO: 5384279 - DNA, 13 bp, Homo sapiens
cagccttcctgac

SEQ ID NO: 5384280 - DNA, 11 bp, Homo sapiens
cagccttcctt

SEQ ID NO: 5384281 - DNA, 16 bp, Homo sapiens
cagccttccttctgct

SEQ ID NO: 5384282 - DNA, 19 bp, Homo sapiens
cagccttcggacagacata

SEQ ID NO: 5384283 - DNA, 13 bp, Homo sapiens
cagccttcggagc

SEQ ID NO: 5384284 - DNA, 22 bp, Homo sapiens
cagccttcggagcgttctctgt

SEQ ID NO: 5384285 - DNA, 23 bp, Homo sapiens
cagccttcggagcgttctctgtc

SEQ ID NO: 5384286 - DNA, 19 bp, Homo sapiens
cagccttctaaattcccaa

SEQ ID NO: 5384287 - DNA, 16 bp, Homo sapiens
cagccttctccatatc

SEQ ID NO: 5384288 - DNA, 15 bp, Homo sapiens
cagccttctcctccc

SEQ ID NO: 5384289 - DNA, 13 bp, Homo sapiens
cagccttctctca

SEQ ID NO: 5384290 - DNA, 13 bp, Homo sapiens
cagccttctgagt

SEQ ID NO: 5384291 - DNA, 16 bp, Homo sapiens
cagccttcttccatcc

SEQ ID NO: 5384292 - DNA, 14 bp, Homo sapiens
cagccttctttgct

SEQ ID NO: 5384293 - DNA, 17 bp, Homo sapiens
cagccttctttgcttgc

SEQ ID NO: 5384294 - DNA, 19 bp, Homo sapiens
cagccttgaactctgggct

SEQ ID NO: 5384295 - DNA, 20 bp, Homo sapiens
cagccttgaactgtggccac

SEQ ID NO: 5384296 - DNA, 22 bp, Homo sapiens
cagccttgaactgtggccacct

SEQ ID NO: 5384297 - DNA, 22 bp, Homo sapiens
cagccttgaccacggctgttcc

SEQ ID NO: 5384298 - DNA, 17 bp, Homo sapiens
cagccttgaccattctc

SEQ ID NO: 5384299 - DNA, 20 bp, Homo sapiens
cagccttgaccattctccac

SEQ ID NO: 5384300 - DNA, 21 bp, Homo sapiens
cagccttgaccattctccacc

SEQ ID NO: 5384301 - DNA, 23 bp, Homo sapiens
cagccttgaccattctccacctg

SEQ ID NO: 5384302 - DNA, 23 bp, Homo sapiens
cagccttgacctaatgaggtagc

SEQ ID NO: 5384303 - DNA, 19 bp, Homo sapiens
cagccttgagccctggctg

SEQ ID NO: 5384304 - DNA, 20 bp, Homo sapiens
cagccttgcaacccaaggtg

SEQ ID NO: 5384305 - DNA, 15 bp, Homo sapiens
cagccttgcacaccc

SEQ ID NO: 5384306 - DNA, 17 bp, Homo sapiens
cagccttgcacacccac

SEQ ID NO: 5384307 - DNA, 18 bp, Homo sapiens
cagccttgcactgtgggg

SEQ ID NO: 5384308 - DNA, 13 bp, Homo sapiens
cagccttgccaga

SEQ ID NO: 5384309 - DNA, 16 bp, Homo sapiens
cagccttgcccagctt

SEQ ID NO: 5384310 - DNA, 16 bp, Homo sapiens
cagccttgcgctgtcc

SEQ ID NO: 5384311 - DNA, 18 bp, Homo sapiens
cagccttgcgctgtccca

SEQ ID NO: 5384312 - DNA, 20 bp, Homo sapiens
cagccttgcgctgtcccagg

SEQ ID NO: 5384313 - DNA, 16 bp, Homo sapiens
cagccttgctctcttc

SEQ ID NO: 5384314 - DNA, 14 bp, Homo sapiens
cagccttgctgctc

SEQ ID NO: 5384315 - DNA, 16 bp, Homo sapiens
cagccttgctgctctg

SEQ ID NO: 5384316 - DNA, 23 bp, Homo sapiens
cagccttggaggatcgtggccaa

SEQ ID NO: 5384317 - DNA, 21 bp, Homo sapiens
cagccttggataatgctgttg

SEQ ID NO: 5384318 - DNA, 18 bp, Homo sapiens
cagccttggatactccat

SEQ ID NO: 5384319 - DNA, 17 bp, Homo sapiens
cagccttggcatctaga

SEQ ID NO: 5384320 - DNA, 14 bp, Homo sapiens
cagccttgggaccg

SEQ ID NO: 5384321 - DNA, 17 bp, Homo sapiens
cagccttgggcctttca

SEQ ID NO: 5384322 - DNA, 22 bp, Homo sapiens
cagccttgggggggctgccttt

SEQ ID NO: 5384323 - DNA, 15 bp, Homo sapiens
cagccttggtgccac

SEQ ID NO: 5384324 - DNA, 21 bp, Homo sapiens
cagccttggtgggggagcctc

SEQ ID NO: 5384325 - DNA, 24 bp, Homo sapiens
cagccttggtgggggagcctctgg

SEQ ID NO: 5384326 - DNA, 21 bp, Homo sapiens
cagccttgtacagtctgctcc

SEQ ID NO: 5384327 - DNA, 22 bp, Homo sapiens
cagccttgtacagtctgctcct

SEQ ID NO: 5384328 - DNA, 20 bp, Homo sapiens
cagccttgtcctcccaggct

SEQ ID NO: 5384329 - DNA, 13 bp, Homo sapiens
cagcctttccaag

SEQ ID NO: 5384330 - DNA, 21 bp, Homo sapiens
cagcctttctaaggctcagcc

SEQ ID NO: 5384331 - DNA, 23 bp, Homo sapiens
cagcctttctcccaggccaggct

SEQ ID NO: 5384332 - DNA, 12 bp, Homo sapiens
cagcctttctgt

SEQ ID NO: 5384333 - DNA, 15 bp, Homo sapiens
cagcctttctgtgga

SEQ ID NO: 5384334 - DNA, 15 bp, Homo sapiens
cagcctttgaatgta

SEQ ID NO: 5384335 - DNA, 17 bp, Homo sapiens
cagcctttgcctccccg

SEQ ID NO: 5384336 - DNA, 16 bp, Homo sapiens
cagcctttgctccctc

SEQ ID NO: 5384337 - DNA, 17 bp, Homo sapiens
cagcctttgctccctcc

SEQ ID NO: 5384338 - DNA, 20 bp, Homo sapiens
cagcctttgggtcctgggca

SEQ ID NO: 5384339 - DNA, 21 bp, Homo sapiens
cagcctttgttccccactgga

SEQ ID NO: 5384340 - DNA, 14 bp, Homo sapiens
cagccttttccctt

SEQ ID NO: 5384341 - DNA, 23 bp, Homo sapiens
cagccttttctggtccctcttct

SEQ ID NO: 5384342 - DNA, 13 bp, Homo sapiens
cagcctttttagg

SEQ ID NO: 5384343 - DNA, 20 bp, Homo sapiens
cagcctttttcaccatggca

SEQ ID NO: 5384344 - DNA, 20 bp, Homo sapiens
cagcctttttctggccttga

SEQ ID NO: 5384345 - DNA, 20 bp, Homo sapiens
cagcctttttgtttcaatga

SEQ ID NO: 5384346 - DNA, 23 bp, Homo sapiens
cagccttttttcctgggccagaa

SEQ ID NO: 5384347 - DNA, 21 bp, Homo sapiens
cagcgaaaggatgtaaacagt

SEQ ID NO: 5384348 - DNA, 19 bp, Homo sapiens
cagcgaactctcagaaata

SEQ ID NO: 5384349 - DNA, 13 bp, Homo sapiens
cagcgaatgacaa

SEQ ID NO: 5384350 - DNA, 16 bp, Homo sapiens
cagcgacagaaaacct

SEQ ID NO: 5384351 - DNA, 20 bp, Homo sapiens
cagcgaccacccctgcctcc

SEQ ID NO: 5384352 - DNA, 16 bp, Homo sapiens
cagcgacccttggtgt

SEQ ID NO: 5384353 - DNA, 18 bp, Homo sapiens
cagcgaccgccccctcct

SEQ ID NO: 5384354 - DNA, 13 bp, Homo sapiens
cagcgacctctct

SEQ ID NO: 5384355 - DNA, 17 bp, Homo sapiens
cagctcaagggagtaag

SEQ ID NO: 5384356 - DNA, 19 bp, Homo sapiens
cagctcaagggctggcact

SEQ ID NO: 5384357 - DNA, 20 bp, Homo sapiens
cagctcaatggactggaagg

SEQ ID NO: 5384358 - DNA, 15 bp, Homo sapiens
cagctcacaagccca

SEQ ID NO: 5384359 - DNA, 17 bp, Homo sapiens
cagctcaccagccccag

SEQ ID NO: 5384360 - DNA, 19 bp, Homo sapiens
cagctcaccagccccagtg

SEQ ID NO: 5384361 - DNA, 21 bp, Homo sapiens
cagctcaccagccccagtgcc

SEQ ID NO: 5384362 - DNA, 22 bp, Homo sapiens
cagctcaccagccccagtgccc

SEQ ID NO: 5384363 - DNA, 20 bp, Homo sapiens
cagctcacccagccccaggg

SEQ ID NO: 5384364 - DNA, 12 bp, Homo sapiens
cagctcaccccc

SEQ ID NO: 5384365 - DNA, 22 bp, Homo sapiens
cagctcaccccccacactcact

SEQ ID NO: 5384366 - DNA, 18 bp, Homo sapiens
cagctcacccctgggcag

SEQ ID NO: 5384367 - DNA, 18 bp, Homo sapiens
cagctcacctcaacctcc

SEQ ID NO: 5384368 - DNA, 19 bp, Homo sapiens
cagctcacgcttcacagtg

SEQ ID NO: 5384369 - DNA, 16 bp, Homo sapiens
cagctcactgcaacct

SEQ ID NO: 5384370 - DNA, 17 bp, Homo sapiens
cagctcactgcaacctc

SEQ ID NO: 5384371 - DNA, 13 bp, Homo sapiens
cagctcactgctg

SEQ ID NO: 5384372 - DNA, 15 bp, Homo sapiens
cagctcagaaccaca

SEQ ID NO: 5384373 - DNA, 17 bp, Homo sapiens
cagctcagaaccacagc

SEQ ID NO: 5384374 - DNA, 14 bp, Homo sapiens
cagctcagaaccca

SEQ ID NO: 5384375 - DNA, 20 bp, Homo sapiens
cagctcagaacccagggctc

SEQ ID NO: 5384376 - DNA, 22 bp, Homo sapiens
cagctcagaagtttcttcttta

SEQ ID NO: 5384377 - DNA, 11 bp, Homo sapiens
cagctcagaga

SEQ ID NO: 5384378 - DNA, 13 bp, Homo sapiens
cagctcagagagg

SEQ ID NO: 5384379 - DNA, 20 bp, Homo sapiens
cagctcagagagggtgggag

SEQ ID NO: 5384380 - DNA, 23 bp, Homo sapiens
cagctcagagccccgccccaccc

SEQ ID NO: 5384381 - DNA, 17 bp, Homo sapiens
cagctcagaggcccagg

SEQ ID NO: 5384382 - DNA, 18 bp, Homo sapiens
cagctcagaggcccagga

SEQ ID NO: 5384383 - DNA, 15 bp, Homo sapiens
cagctcagcactgcc

SEQ ID NO: 5384384 - DNA, 20 bp, Homo sapiens
cagctcagcactgcctgctc

SEQ ID NO: 5384385 - DNA, 22 bp, Homo sapiens
cagctcagcagttcacttccta

SEQ ID NO: 5384386 - DNA, 18 bp, Homo sapiens
cagctcagcattgtgtac

SEQ ID NO: 5384387 - DNA, 23 bp, Homo sapiens
cagctcagccaccactcagtgct

SEQ ID NO: 5384388 - DNA, 14 bp, Homo sapiens
cagctcagccagtg

SEQ ID NO: 5384389 - DNA, 11 bp, Homo sapiens
cagctcagccc

SEQ ID NO: 5384390 - DNA, 13 bp, Homo sapiens
cagctcagccccg

SEQ ID NO: 5384391 - DNA, 21 bp, Homo sapiens
cagctcagccccggccactcc

SEQ ID NO: 5384392 - DNA, 22 bp, Homo sapiens
cagctcagccccggccactccc

SEQ ID NO: 5384393 - DNA, 13 bp, Homo sapiens
cagctcagccctg

SEQ ID NO: 5384394 - DNA, 18 bp, Homo sapiens
cagctcagccctggcctg

SEQ ID NO: 5384395 - DNA, 14 bp, Homo sapiens
cagctcagcctccc

SEQ ID NO: 5384396 - DNA, 15 bp, Homo sapiens
cagctcagcctcccc

SEQ ID NO: 5384397 - DNA, 16 bp, Homo sapiens
cagctcagcctccccc

SEQ ID NO: 5384398 - DNA, 20 bp, Homo sapiens
cagctcagcctccccctgct

SEQ ID NO: 5384399 - DNA, 11 bp, Homo sapiens
cagctcagcgc

SEQ ID NO: 5384400 - DNA, 17 bp, Homo sapiens
cagctcagcgccagcct

SEQ ID NO: 5384401 - DNA, 15 bp, Homo sapiens
cagctcagctgccca

SEQ ID NO: 5384402 - DNA, 21 bp, Homo sapiens
cagctcagctgcccatcccag

SEQ ID NO: 5384403 - DNA, 20 bp, Homo sapiens
cagctcaggaattccctgga

SEQ ID NO: 5384404 - DNA, 12 bp, Homo sapiens
cagctcaggaca

SEQ ID NO: 5384405 - DNA, 18 bp, Homo sapiens
cagctcaggacagatgcc

SEQ ID NO: 5384406 - DNA, 12 bp, Homo sapiens
cagctcaggcac

SEQ ID NO: 5384407 - DNA, 14 bp, Homo sapiens
cagctcaggcgcag

SEQ ID NO: 5384408 - DNA, 19 bp, Homo sapiens
cagctcaggcgcagcccta

SEQ ID NO: 5384409 - DNA, 17 bp, Homo sapiens
cagctcaggggacactg

SEQ ID NO: 5384410 - DNA, 16 bp, Homo sapiens
cagctcagtcccacag

SEQ ID NO: 5384411 - DNA, 18 bp, Homo sapiens
cagctcagtcccacagcc

SEQ ID NO: 5384412 - DNA, 16 bp, Homo sapiens
cagctcagtcttccct

SEQ ID NO: 5384413 - DNA, 16 bp, Homo sapiens
cagctcagtgccaaag

SEQ ID NO: 5384414 - DNA, 14 bp, Homo sapiens
cagctcataagagc

SEQ ID NO: 5384415 - DNA, 20 bp, Homo sapiens
cagctcatagagtcccccct

SEQ ID NO: 5384416 - DNA, 19 bp, Homo sapiens
cagctcatagtgaacacag

SEQ ID NO: 5384417 - DNA, 22 bp, Homo sapiens
cagctcatccatgcctcagaag

SEQ ID NO: 5384418 - DNA, 15 bp, Homo sapiens
cagctcatctctgtc

SEQ ID NO: 5384419 - DNA, 15 bp, Homo sapiens
cagctcatcttcaaa

SEQ ID NO: 5384420 - DNA, 19 bp, Homo sapiens
cagctcattatgaaaaaca

SEQ ID NO: 5384421 - DNA, 16 bp, Homo sapiens
cagctcattcatttta

SEQ ID NO: 5384422 - DNA, 19 bp, Homo sapiens
cagctcattcattttatat

SEQ ID NO: 5384423 - DNA, 20 bp, Homo sapiens
cagctcattcattttatatt

SEQ ID NO: 5384424 - DNA, 16 bp, Homo sapiens
cagctcattcgctcca

SEQ ID NO: 5384425 - DNA, 19 bp, Homo sapiens
cagctcatttaatcccagg

SEQ ID NO: 5384426 - DNA, 21 bp, Homo sapiens
cagctcatttaatcccaggaa

SEQ ID NO: 5384427 - DNA, 16 bp, Homo sapiens
cagctccaacagcttg

SEQ ID NO: 5384428 - DNA, 22 bp, Homo sapiens
cagctccaacagcttgaccaga

SEQ ID NO: 5384429 - DNA, 23 bp, Homo sapiens
cagctccaacagcttgaccagac

SEQ ID NO: 5384430 - DNA, 13 bp, Homo sapiens
cagctccaacctg

SEQ ID NO: 5384431 - DNA, 20 bp, Homo sapiens
cagctccaacctgcaaagat

SEQ ID NO: 5384432 - DNA, 14 bp, Homo sapiens
cagctccaacctgg

SEQ ID NO: 5384433 - DNA, 17 bp, Homo sapiens
cagctccaacctggagg

SEQ ID NO: 5384434 - DNA, 18 bp, Homo sapiens
cagctccaacctggaggc

SEQ ID NO: 5384435 - DNA, 19 bp, Homo sapiens
cagctccaacctggaggct

SEQ ID NO: 5384436 - DNA, 20 bp, Homo sapiens
cagctccaacctggaggctg

SEQ ID NO: 5384437 - DNA, 16 bp, Homo sapiens
cagctccaagaatttc

SEQ ID NO: 5384438 - DNA, 19 bp, Homo sapiens
cagctccaagaatttctag

SEQ ID NO: 5384439 - DNA, 21 bp, Homo sapiens
cagctccacacattccagcca

SEQ ID NO: 5384440 - DNA, 20 bp, Homo sapiens
cagctccacagggtgggatg

SEQ ID NO: 5384441 - DNA, 14 bp, Homo sapiens
cagctccaccactg

SEQ ID NO: 5384442 - DNA, 16 bp, Homo sapiens
cagctccaccactgtg

SEQ ID NO: 5384443 - DNA, 17 bp, Homo sapiens
cagctccactcagggct

SEQ ID NO: 5384444 - DNA, 18 bp, Homo sapiens
cagctccactcagggctg

SEQ ID NO: 5384445 - DNA, 13 bp, Homo sapiens
cagctccactctg

SEQ ID NO: 5384446 - DNA, 14 bp, Homo sapiens
cagctccactctga

SEQ ID NO: 5384447 - DNA, 17 bp, Homo sapiens
cagctccactctgaagt

SEQ ID NO: 5384448 - DNA, 19 bp, Homo sapiens
cagctccactctgactggc

SEQ ID NO: 5384449 - DNA, 23 bp, Homo sapiens
cagctccactctgactggcacag

SEQ ID NO: 5384450 - DNA, 15 bp, Homo sapiens
cagctccactggcct

SEQ ID NO: 5384451 - DNA, 17 bp, Homo sapiens
cagctccactggcctgc

SEQ ID NO: 5384452 - DNA, 16 bp, Homo sapiens
cagctccagaatacct

SEQ ID NO: 5384453 - DNA, 22 bp, Homo sapiens
cagctccagcccctttccaaaa

SEQ ID NO: 5384454 - DNA, 16 bp, Homo sapiens
cagctccagctcacca

SEQ ID NO: 5384455 - DNA, 18 bp, Homo sapiens
cagctccagctcaccagc

SEQ ID NO: 5384456 - DNA, 18 bp, Homo sapiens
cagctccaggacaccgct

SEQ ID NO: 5384457 - DNA, 21 bp, Homo sapiens
cagctccagggaatccaagcc

SEQ ID NO: 5384458 - DNA, 13 bp, Homo sapiens
cagctccagggca

SEQ ID NO: 5384459 - DNA, 13 bp, Homo sapiens
cagctccaggggc

SEQ ID NO: 5384460 - DNA, 13 bp, Homo sapiens
cagctccagtgcc

SEQ ID NO: 5384461 - DNA, 16 bp, Homo sapiens
cagctccagttggagt

SEQ ID NO: 5384462 - DNA, 23 bp, Homo sapiens
cagctccagtttccaagttcctg

SEQ ID NO: 5384463 - DNA, 22 bp, Homo sapiens
cagctcccaacgagcctcctca

SEQ ID NO: 5384464 - DNA, 21 bp, Homo sapiens
cagctcccaaggctctgagca

SEQ ID NO: 5384465 - DNA, 12 bp, Homo sapiens
cagctcccacaa

SEQ ID NO: 5384466 - DNA, 13 bp, Homo sapiens
cagctcccacacc

SEQ ID NO: 5384467 - DNA, 15 bp, Homo sapiens
cagctcccacaccgc

SEQ ID NO: 5384468 - DNA, 23 bp, Homo sapiens
cagctcccacaccgcgtcccagc

SEQ ID NO: 5384469 - DNA, 15 bp, Homo sapiens
cagctcccaccccac

SEQ ID NO: 5384470 - DNA, 20 bp, Homo sapiens
cagctcccaccccaccccct

SEQ ID NO: 5384471 - DNA, 15 bp, Homo sapiens
cagctcccacctccc

SEQ ID NO: 5384472 - DNA, 16 bp, Homo sapiens
cagctcccagatggcc

SEQ ID NO: 5384473 - DNA, 12 bp, Homo sapiens
cagctcccagcc

SEQ ID NO: 5384474 - DNA, 11 bp, Homo sapiens
cagctcccagg

SEQ ID NO: 5384475 - DNA, 17 bp, Homo sapiens
cagctcccatttctact

SEQ ID NO: 5384476 - DNA, 18 bp, Homo sapiens
cagctccccagcccacct

SEQ ID NO: 5384477 - DNA, 15 bp, Homo sapiens
cagctccccaggact

SEQ ID NO: 5384478 - DNA, 17 bp, Homo sapiens
cagctccccaggactca

SEQ ID NO: 5384479 - DNA, 20 bp, Homo sapiens
cagctccccaggactcaccc

SEQ ID NO: 5384480 - DNA, 22 bp, Homo sapiens
cagctccccaggactcaccctc

SEQ ID NO: 5384481 - DNA, 14 bp, Homo sapiens
cagctccccaggag

SEQ ID NO: 5384482 - DNA, 10 bp, Homo sapiens
cagctccccc

SEQ ID NO: 5384483 - DNA, 14 bp, Homo sapiens
cagctcccccagct

SEQ ID NO: 5384484 - DNA, 15 bp, Homo sapiens
cagctcccccagctc

SEQ ID NO: 5384485 - DNA, 19 bp, Homo sapiens
cagctcccccaggctgttc

SEQ ID NO: 5384486 - DNA, 24 bp, Homo sapiens
cagctcccccaggctgttctccag

SEQ ID NO: 5384487 - DNA, 12 bp, Homo sapiens
cagctcccccgg

SEQ ID NO: 5384488 - DNA, 14 bp, Homo sapiens
cagctccccctccc

SEQ ID NO: 5384489 - DNA, 16 bp, Homo sapiens
cagctccccctccctc

SEQ ID NO: 5384490 - DNA, 20 bp, Homo sapiens
cagctccccctccctcccct

SEQ ID NO: 5384491 - DNA, 17 bp, Homo sapiens
cagctccccctgtcccc

SEQ ID NO: 5384492 - DNA, 22 bp, Homo sapiens
cagctccccctgtcccctcagc

SEQ ID NO: 5384493 - DNA, 18 bp, Homo sapiens
cagctcccctcggagaag

SEQ ID NO: 5384494 - DNA, 16 bp, Homo sapiens
cagctcccctcttttg

SEQ ID NO: 5384495 - DNA, 19 bp, Homo sapiens
cagctcccctcttttgtaa

SEQ ID NO: 5384496 - DNA, 20 bp, Homo sapiens
cagctcccgctccgggctcc

SEQ ID NO: 5384497 - DNA, 15 bp, Homo sapiens
cagctcccgctgtgg

SEQ ID NO: 5384498 - DNA, 11 bp, Homo sapiens
cagctccctag

SEQ ID NO: 5384499 - DNA, 20 bp, Homo sapiens
cagctccctagactgcatcc

SEQ ID NO: 5384500 - DNA, 15 bp, Homo sapiens
cagctccctaggaga

SEQ ID NO: 5384501 - DNA, 18 bp, Homo sapiens
cagctccctaggagacca

SEQ ID NO: 5384502 - DNA, 19 bp, Homo sapiens
cagctccctaggagaccaa

SEQ ID NO: 5384503 - DNA, 18 bp, Homo sapiens
cagctccctagtggcttc

SEQ ID NO: 5384504 - DNA, 20 bp, Homo sapiens
cagctccctagtggcttcct

SEQ ID NO: 5384505 - DNA, 14 bp, Homo sapiens
cagctccctcctgc

SEQ ID NO: 5384506 - DNA, 15 bp, Homo sapiens
cagctccctcctgca

SEQ ID NO: 5384507 - DNA, 18 bp, Homo sapiens
cagctccctcctgcacac

SEQ ID NO: 5384508 - DNA, 22 bp, Homo sapiens
cagctccctcgtcttcagctgc

SEQ ID NO: 5384509 - DNA, 14 bp, Homo sapiens
cagctccctctgcc

SEQ ID NO: 5384510 - DNA, 16 bp, Homo sapiens
cagctccctgaccccc

SEQ ID NO: 5384511 - DNA, 21 bp, Homo sapiens
cagctccctgaccccctgtcc

SEQ ID NO: 5384512 - DNA, 13 bp, Homo sapiens
cagctccctgcac

SEQ ID NO: 5384513 - DNA, 17 bp, Homo sapiens
cagctccctgcaccgcc

SEQ ID NO: 5384514 - DNA, 13 bp, Homo sapiens
cagctccctgcca

SEQ ID NO: 5384515 - DNA, 14 bp, Homo sapiens
cagctccctgcctg

SEQ ID NO: 5384516 - DNA, 15 bp, Homo sapiens
cagctccctgcctgt

SEQ ID NO: 5384517 - DNA, 20 bp, Homo sapiens
cagctccctgcctgtttccc

SEQ ID NO: 5384518 - DNA, 16 bp, Homo sapiens
cagctccctggcttct

SEQ ID NO: 5384519 - DNA, 13 bp, Homo sapiens
cagctcccttctg

SEQ ID NO: 5384520 - DNA, 14 bp, Homo sapiens
cagctcccttctgt

SEQ ID NO: 5384521 - DNA, 15 bp, Homo sapiens
cagctcccttctgtt

SEQ ID NO: 5384522 - DNA, 17 bp, Homo sapiens
cagctcccttgggaagg

SEQ ID NO: 5384523 - DNA, 14 bp, Homo sapiens
cagctccctttctc

SEQ ID NO: 5384524 - DNA, 18 bp, Homo sapiens
cagctccctttctcagga

SEQ ID NO: 5384525 - DNA, 14 bp, Homo sapiens
cagctccgcctgct

SEQ ID NO: 5384526 - DNA, 22 bp, Homo sapiens
cagctccggcgtgtgttcagtg

SEQ ID NO: 5384527 - DNA, 19 bp, Homo sapiens
cagctccgggatcagcaac

SEQ ID NO: 5384528 - DNA, 14 bp, Homo sapiens
cagctccgtgtttc

SEQ ID NO: 5384529 - DNA, 15 bp, Homo sapiens
cagctccgtgtttct

SEQ ID NO: 5384530 - DNA, 17 bp, Homo sapiens
cagctccgtgtttctct

SEQ ID NO: 5384531 - DNA, 22 bp, Homo sapiens
cagctcctacctctgtgccagg

SEQ ID NO: 5384532 - DNA, 16 bp, Homo sapiens
cagctcctcacccagg

SEQ ID NO: 5384533 - DNA, 18 bp, Homo sapiens
cagctcctcagcggctcc

SEQ ID NO: 5384534 - DNA, 17 bp, Homo sapiens
cagctgtacttcgtctt

SEQ ID NO: 5384535 - DNA, 21 bp, Homo sapiens
cagctgtagaaaggttgattc

SEQ ID NO: 5384536 - DNA, 19 bp, Homo sapiens
cagctgtagccatggctca

SEQ ID NO: 5384537 - DNA, 20 bp, Homo sapiens
cagctgtagccatggctcag

SEQ ID NO: 5384538 - DNA, 21 bp, Homo sapiens
cagctgtatataaacgtgtcc

SEQ ID NO: 5384539 - DNA, 22 bp, Homo sapiens
cagctgtatataaacgtgtccc

SEQ ID NO: 5384540 - DNA, 22 bp, Homo sapiens
cagctgtatatatttttcttat

SEQ ID NO: 5384541 - DNA, 22 bp, Homo sapiens
cagctgtattatcttaaaccca

SEQ ID NO: 5384542 - DNA, 14 bp, Homo sapiens
cagctgtattttgg

SEQ ID NO: 5384543 - DNA, 14 bp, Homo sapiens
cagctgtcaagggc

SEQ ID NO: 5384544 - DNA, 15 bp, Homo sapiens
cagctgtcacctgct

SEQ ID NO: 5384545 - DNA, 20 bp, Homo sapiens
cagctgtcacctgctcacag

SEQ ID NO: 5384546 - DNA, 22 bp, Homo sapiens
cagctgtcacctgctcacaggg

SEQ ID NO: 5384547 - DNA, 21 bp, Homo sapiens
cagctgtcagaacactccaag

SEQ ID NO: 5384548 - DNA, 13 bp, Homo sapiens
cagctgtcagcct

SEQ ID NO: 5384549 - DNA, 14 bp, Homo sapiens
cagctgtcagcctg

SEQ ID NO: 5384550 - DNA, 18 bp, Homo sapiens
cagctgtcatcaattaaa

SEQ ID NO: 5384551 - DNA, 15 bp, Homo sapiens
cagctgtcatggaaa

SEQ ID NO: 5384552 - DNA, 21 bp, Homo sapiens
cagctgtcatggaaaagccca

SEQ ID NO: 5384553 - DNA, 23 bp, Homo sapiens
cagctgtcatggaaaagcccagt

SEQ ID NO: 5384554 - DNA, 15 bp, Homo sapiens
cagctgtcattcagg

SEQ ID NO: 5384555 - DNA, 19 bp, Homo sapiens
cagctgtccccccactccc

SEQ ID NO: 5384556 - DNA, 18 bp, Homo sapiens
cagctgtcccctctccct

SEQ ID NO: 5384557 - DNA, 12 bp, Homo sapiens
cagctgtccctg

SEQ ID NO: 5384558 - DNA, 13 bp, Homo sapiens
cagctgtccctgt

SEQ ID NO: 5384559 - DNA, 15 bp, Homo sapiens
cagctgtccctgtca

SEQ ID NO: 5384560 - DNA, 22 bp, Homo sapiens
cagctgtccctgtcaccaagct

SEQ ID NO: 5384561 - DNA, 17 bp, Homo sapiens
cagctgtcctccctcca

SEQ ID NO: 5384562 - DNA, 14 bp, Homo sapiens
cagctgtcctgaac

SEQ ID NO: 5384563 - DNA, 15 bp, Homo sapiens
cagctgtcctgagct

SEQ ID NO: 5384564 - DNA, 21 bp, Homo sapiens
cagctgtcctgagctaacact

SEQ ID NO: 5384565 - DNA, 22 bp, Homo sapiens
cagctgtcctgcagcaaacact

SEQ ID NO: 5384566 - DNA, 14 bp, Homo sapiens
cagctgtcgcatct

SEQ ID NO: 5384567 - DNA, 21 bp, Homo sapiens
cagctgtcgtctgactctggg

SEQ ID NO: 5384568 - DNA, 20 bp, Homo sapiens
cagctgtctgtgtcagcctg

SEQ ID NO: 5384569 - DNA, 18 bp, Homo sapiens
cagctgtgaacatggact

SEQ ID NO: 5384570 - DNA, 20 bp, Homo sapiens
cagctgtgaaggcttcactc

SEQ ID NO: 5384571 - DNA, 22 bp, Homo sapiens
cagctgtgaaggcttcactctt

SEQ ID NO: 5384572 - DNA, 15 bp, Homo sapiens
cagctgtgagaagtc

SEQ ID NO: 5384573 - DNA, 17 bp, Homo sapiens
cagctgtgccctcctgg

SEQ ID NO: 5384574 - DNA, 14 bp, Homo sapiens
cagctgtgcctcgc

SEQ ID NO: 5384575 - DNA, 17 bp, Homo sapiens
cagctgtgcctcgctcc

SEQ ID NO: 5384576 - DNA, 12 bp, Homo sapiens
cagctgtgctcc

SEQ ID NO: 5384577 - DNA, 13 bp, Homo sapiens
cagctgtgctcca

SEQ ID NO: 5384578 - DNA, 15 bp, Homo sapiens
cagctgtgctccaca

SEQ ID NO: 5384579 - DNA, 20 bp, Homo sapiens
cagctgtgctccacactcag

SEQ ID NO: 5384580 - DNA, 21 bp, Homo sapiens
cagctgtgctccacactcaga

SEQ ID NO: 5384581 - DNA, 18 bp, Homo sapiens
cagctgtgctctggacag

SEQ ID NO: 5384582 - DNA, 23 bp, Homo sapiens
cagctgtgctgcaccccatgtgg

SEQ ID NO: 5384583 - DNA, 14 bp, Homo sapiens
cagctgtgctggga

SEQ ID NO: 5384584 - DNA, 16 bp, Homo sapiens
cagctgtgctgtggag

SEQ ID NO: 5384585 - DNA, 11 bp, Homo sapiens
cagctgtgctt

SEQ ID NO: 5384586 - DNA, 16 bp, Homo sapiens
cagctgtgctttttgc

SEQ ID NO: 5384587 - DNA, 15 bp, Homo sapiens
cagctgtggctggag

SEQ ID NO: 5384588 - DNA, 17 bp, Homo sapiens
cagctgtggctggagga

SEQ ID NO: 5384589 - DNA, 21 bp, Homo sapiens
cagctgtggctggaggagctg

SEQ ID NO: 5384590 - DNA, 22 bp, Homo sapiens
cagctgtggctggaggagctgg

SEQ ID NO: 5384591 - DNA, 21 bp, Homo sapiens
cagctgtgggcggctcctggt

SEQ ID NO: 5384592 - DNA, 20 bp, Homo sapiens
cagctgtggggaacacagct

SEQ ID NO: 5384593 - DNA, 19 bp, Homo sapiens
cagctgtggtacaaatgtg

SEQ ID NO: 5384594 - DNA, 18 bp, Homo sapiens
cagctgtggtcccaccca

SEQ ID NO: 5384595 - DNA, 23 bp, Homo sapiens
cagctgtggtcccacccaggaag

SEQ ID NO: 5384596 - DNA, 19 bp, Homo sapiens
cagctgtgtctgagcccaa

SEQ ID NO: 5384597 - DNA, 23 bp, Homo sapiens
cagctgtgtctgagcccaaccct

SEQ ID NO: 5384598 - DNA, 21 bp, Homo sapiens
cagctgtgtctgccaaacaca

SEQ ID NO: 5384599 - DNA, 19 bp, Homo sapiens
cagctgttcagattggaca

SEQ ID NO: 5384600 - DNA, 16 bp, Homo sapiens
cagctgttcagctggt

SEQ ID NO: 5384601 - DNA, 19 bp, Homo sapiens
cagctgttccacaggggct

SEQ ID NO: 5384602 - DNA, 13 bp, Homo sapiens
cagctgttcctgt

SEQ ID NO: 5384603 - DNA, 14 bp, Homo sapiens
cagctgttcctgtg

SEQ ID NO: 5384604 - DNA, 23 bp, Homo sapiens
cagctgttgagcccctcctagtt

SEQ ID NO: 5384605 - DNA, 18 bp, Homo sapiens
cagctgttgcaggcagtg

SEQ ID NO: 5384606 - DNA, 22 bp, Homo sapiens
cagctgttgtctcttctcctta

SEQ ID NO: 5384607 - DNA, 14 bp, Homo sapiens
cagctgtttaagat

SEQ ID NO: 5384608 - DNA, 16 bp, Homo sapiens
cagctgtttcaaagtt

SEQ ID NO: 5384609 - DNA, 19 bp, Homo sapiens
cagctgtttcatcaccaga

SEQ ID NO: 5384610 - DNA, 22 bp, Homo sapiens
cagctgtttccagttgttactg

SEQ ID NO: 5384611 - DNA, 24 bp, Homo sapiens
cagctgtttctagagttcctacca

SEQ ID NO: 5384612 - DNA, 13 bp, Homo sapiens
cagctgtttctca

SEQ ID NO: 5384613 - DNA, 16 bp, Homo sapiens
cagctgtttctcatga

SEQ ID NO: 5384614 - DNA, 21 bp, Homo sapiens
cagctgtttctcatgaagcta

SEQ ID NO: 5384615 - DNA, 15 bp, Homo sapiens
cagctgtttctggaa

SEQ ID NO: 5384616 - DNA, 17 bp, Homo sapiens
cagctgtttctggaaat

SEQ ID NO: 5384617 - DNA, 17 bp, Homo sapiens
cagctgtttgaaatgtt

SEQ ID NO: 5384618 - DNA, 21 bp, Homo sapiens
cagctgttttagttaaatttc

SEQ ID NO: 5384619 - DNA, 15 bp, Homo sapiens
cagctgttttgttga

SEQ ID NO: 5384620 - DNA, 19 bp, Homo sapiens
cagctgttttgttgacatt

SEQ ID NO: 5384621 - DNA, 22 bp, Homo sapiens
cagctgttttgttgacattctg

SEQ ID NO: 5384622 - DNA, 23 bp, Homo sapiens
cagcttaaaattggtaattgaat

SEQ ID NO: 5384623 - DNA, 14 bp, Homo sapiens
cagcttaaattctt

SEQ ID NO: 5384624 - DNA, 18 bp, Homo sapiens
cagcttaacattgacttc

SEQ ID NO: 5384625 - DNA, 14 bp, Homo sapiens
cagcttaagcgttc

SEQ ID NO: 5384626 - DNA, 19 bp, Homo sapiens
cagcttaagtccagctcat

SEQ ID NO: 5384627 - DNA, 16 bp, Homo sapiens
cagcttaataagtatt

SEQ ID NO: 5384628 - DNA, 15 bp, Homo sapiens
cagcttaattctcct

SEQ ID NO: 5384629 - DNA, 19 bp, Homo sapiens
cagcttacaggagccagcc

SEQ ID NO: 5384630 - DNA, 15 bp, Homo sapiens
cagcttagatttcat

SEQ ID NO: 5384631 - DNA, 16 bp, Homo sapiens
cagcttagatttcata

SEQ ID NO: 5384632 - DNA, 16 bp, Homo sapiens
cagcttagggccctgg

SEQ ID NO: 5384633 - DNA, 19 bp, Homo sapiens
cagcttagggccctggagg

SEQ ID NO: 5384634 - DNA, 17 bp, Homo sapiens
cagcttaggggctgctg

SEQ ID NO: 5384635 - DNA, 16 bp, Homo sapiens
cagcttattcacaaga

SEQ ID NO: 5384636 - DNA, 14 bp, Homo sapiens
cagcttattgtcta

SEQ ID NO: 5384637 - DNA, 20 bp, Homo sapiens
cagcttattgtctagtgaaa

SEQ ID NO: 5384638 - DNA, 23 bp, Homo sapiens
cagcttattgtgtgcgctgcctg

SEQ ID NO: 5384639 - DNA, 12 bp, Homo sapiens
cagcttattgtt

SEQ ID NO: 5384640 - DNA, 18 bp, Homo sapiens
cagcttatttttttctac

SEQ ID NO: 5384641 - DNA, 20 bp, Homo sapiens
cagcttcaaataaagtaaat

SEQ ID NO: 5384642 - DNA, 17 bp, Homo sapiens
cagcttcaaatgcaaat

SEQ ID NO: 5384643 - DNA, 21 bp, Homo sapiens
cagcttcaacttttctcttta

SEQ ID NO: 5384644 - DNA, 14 bp, Homo sapiens
cagcttcaagtgcc

SEQ ID NO: 5384645 - DNA, 16 bp, Homo sapiens
cagcttcaagtgcctt

SEQ ID NO: 5384646 - DNA, 16 bp, Homo sapiens
cagcttcaccagagca

SEQ ID NO: 5384647 - DNA, 13 bp, Homo sapiens
cagcttcacccac

SEQ ID NO: 5384648 - DNA, 15 bp, Homo sapiens
cagcttcacccacca

SEQ ID NO: 5384649 - DNA, 17 bp, Homo sapiens
cagcttcacccaccagg

SEQ ID NO: 5384650 - DNA, 18 bp, Homo sapiens
cagcttcacccaccaggc

SEQ ID NO: 5384651 - DNA, 17 bp, Homo sapiens
cagcttcaccctgtcaa

SEQ ID NO: 5384652 - DNA, 16 bp, Homo sapiens
cagcttcacctctggg

SEQ ID NO: 5384653 - DNA, 21 bp, Homo sapiens
cagcttcacctctgggacccc

SEQ ID NO: 5384654 - DNA, 22 bp, Homo sapiens
cagcttcactctctccgtctgt

SEQ ID NO: 5384655 - DNA, 15 bp, Homo sapiens
cagcttcacttctga

SEQ ID NO: 5384656 - DNA, 16 bp, Homo sapiens
cagcttcacttctgac

SEQ ID NO: 5384657 - DNA, 17 bp, Homo sapiens
cagcttcagccaggagc

SEQ ID NO: 5384658 - DNA, 16 bp, Homo sapiens
cagcttcagctcaact

SEQ ID NO: 5384659 - DNA, 17 bp, Homo sapiens
cagcttcagctcaactc

SEQ ID NO: 5384660 - DNA, 13 bp, Homo sapiens
cagcttcaggtga

SEQ ID NO: 5384661 - DNA, 14 bp, Homo sapiens
cagcttcaggttat

SEQ ID NO: 5384662 - DNA, 21 bp, Homo sapiens
cagcttcagtccatgggtaat

SEQ ID NO: 5384663 - DNA, 13 bp, Homo sapiens
cagcttcagtctc

SEQ ID NO: 5384664 - DNA, 13 bp, Homo sapiens
cagcttcagtgat

SEQ ID NO: 5384665 - DNA, 12 bp, Homo sapiens
cagcttcagttg

SEQ ID NO: 5384666 - DNA, 22 bp, Homo sapiens
cagcttcatcaatttttataca

SEQ ID NO: 5384667 - DNA, 14 bp, Homo sapiens
cagcttcatctttg

SEQ ID NO: 5384668 - DNA, 19 bp, Homo sapiens
cagcttcatgcctttgtaa

SEQ ID NO: 5384669 - DNA, 19 bp, Homo sapiens
cagcttcatttccgtgaag

SEQ ID NO: 5384670 - DNA, 13 bp, Homo sapiens
cagcttccaaagc

SEQ ID NO: 5384671 - DNA, 11 bp, Homo sapiens
cagcttccagc

SEQ ID NO: 5384672 - DNA, 16 bp, Homo sapiens
cagcttccagcaggag

SEQ ID NO: 5384673 - DNA, 20 bp, Homo sapiens
cagcttcccagccatgccca

SEQ ID NO: 5384674 - DNA, 23 bp, Homo sapiens
cagcttcccagccatgcccagga

SEQ ID NO: 5384675 - DNA, 16 bp, Homo sapiens
cagcttccccaggagc

SEQ ID NO: 5384676 - DNA, 20 bp, Homo sapiens
cagcttccccaggagctctc

SEQ ID NO: 5384677 - DNA, 18 bp, Homo sapiens
cagcttccccagtagctg

SEQ ID NO: 5384678 - DNA, 13 bp, Homo sapiens
cagcttccctgaa

SEQ ID NO: 5384679 - DNA, 14 bp, Homo sapiens
cagcttcctaccca

SEQ ID NO: 5384680 - DNA, 20 bp, Homo sapiens
cagcttcctacccacacctc

SEQ ID NO: 5384681 - DNA, 22 bp, Homo sapiens
cagcttcctacccacacctctg

SEQ ID NO: 5384682 - DNA, 13 bp, Homo sapiens
cagcttcctcaca

SEQ ID NO: 5384683 - DNA, 16 bp, Homo sapiens
cagcttcctcacaccc

SEQ ID NO: 5384684 - DNA, 17 bp, Homo sapiens
cagcttcctctgagccg

SEQ ID NO: 5384685 - DNA, 20 bp, Homo sapiens
cagcttcctctgagccgcag

SEQ ID NO: 5384686 - DNA, 15 bp, Homo sapiens
cagcttcctggtgta

SEQ ID NO: 5384687 - DNA, 13 bp, Homo sapiens
cagcttcctgtca

SEQ ID NO: 5384688 - DNA, 18 bp, Homo sapiens
cagcttcctgtcaagcaa

SEQ ID NO: 5384689 - DNA, 18 bp, Homo sapiens
cagcttcctgtccccatc

SEQ ID NO: 5384690 - DNA, 21 bp, Homo sapiens
cagcttcctgtccccatctgt

SEQ ID NO: 5384691 - DNA, 13 bp, Homo sapiens
cagcttcctgtgc

SEQ ID NO: 5384692 - DNA, 19 bp, Homo sapiens
cagcttcctgtgcagaagg

SEQ ID NO: 5384693 - DNA, 20 bp, Homo sapiens
cagcttccttcagagagcag

SEQ ID NO: 5384694 - DNA, 15 bp, Homo sapiens
cagcttcgagctaca

SEQ ID NO: 5384695 - DNA, 16 bp, Homo sapiens
cagcttcgtcagctcc

SEQ ID NO: 5384696 - DNA, 15 bp, Homo sapiens
cagcttcgtgctgga

SEQ ID NO: 5384697 - DNA, 16 bp, Homo sapiens
cagcttcgtgctggag

SEQ ID NO: 5384698 - DNA, 18 bp, Homo sapiens
cagcttcgtgctggagga

SEQ ID NO: 5384699 - DNA, 20 bp, Homo sapiens
cagcttcgtttattttcaag

SEQ ID NO: 5384700 - DNA, 19 bp, Homo sapiens
cagcttctaattttgtgct

SEQ ID NO: 5384701 - DNA, 16 bp, Homo sapiens
cagcttctactcctgc

SEQ ID NO: 5384702 - DNA, 21 bp, Homo sapiens
cagcttctactcctgcctcat

SEQ ID NO: 5384703 - DNA, 18 bp, Homo sapiens
cagcttctatccttgact

SEQ ID NO: 5384704 - DNA, 15 bp, Homo sapiens
cagcttctcagtttc

SEQ ID NO: 5384705 - DNA, 20 bp, Homo sapiens
cagcttctcatcctgcaggc

SEQ ID NO: 5384706 - DNA, 12 bp, Homo sapiens
cagcttctccaa

SEQ ID NO: 5384707 - DNA, 15 bp, Homo sapiens
cagcttctccaagca

SEQ ID NO: 5384708 - DNA, 15 bp, Homo sapiens
cagcttctccaggct

SEQ ID NO: 5384709 - DNA, 14 bp, Homo sapiens
cagcttctcctgcg

SEQ ID NO: 5384710 - DNA, 15 bp, Homo sapiens
cagcttctctctccc

SEQ ID NO: 5384711 - DNA, 19 bp, Homo sapiens
cagcttctctctccctgtc

SEQ ID NO: 5384712 - DNA, 12 bp, Homo sapiens
caggaaggggac

SEQ ID NO: 5384713 - DNA, 18 bp, Homo sapiens
caggaagggggtccaccc

SEQ ID NO: 5384714 - DNA, 23 bp, Homo sapiens
caggaagggggtccacccagcaa

SEQ ID NO: 5384715 - DNA, 13 bp, Homo sapiens
caggaagggtggg

SEQ ID NO: 5384716 - DNA, 20 bp, Homo sapiens
caggaaggtagcccagcact

SEQ ID NO: 5384717 - DNA, 22 bp, Homo sapiens
caggaaggtagcccagcactgt

SEQ ID NO: 5384718 - DNA, 19 bp, Homo sapiens
caggaaggtatcacacact

SEQ ID NO: 5384719 - DNA, 19 bp, Homo sapiens
caggaaggtctcatgcctg

SEQ ID NO: 5384720 - DNA, 20 bp, Homo sapiens
caggaaggtctgatttgcag

SEQ ID NO: 5384721 - DNA, 18 bp, Homo sapiens
caggaaggtgaggcagaa

SEQ ID NO: 5384722 - DNA, 17 bp, Homo sapiens
caggaaggtgcctggcc

SEQ ID NO: 5384723 - DNA, 17 bp, Homo sapiens
caggaagtaattttctt

SEQ ID NO: 5384724 - DNA, 12 bp, Homo sapiens
caggaagtactg

SEQ ID NO: 5384725 - DNA, 14 bp, Homo sapiens
caggaagtactgga

SEQ ID NO: 5384726 - DNA, 16 bp, Homo sapiens
caggaagtactggaga

SEQ ID NO: 5384727 - DNA, 18 bp, Homo sapiens
caggaagtagcacaggct

SEQ ID NO: 5384728 - DNA, 15 bp, Homo sapiens
caggaagtcaggagc

SEQ ID NO: 5384729 - DNA, 16 bp, Homo sapiens
caggaagtcaggagcc

SEQ ID NO: 5384730 - DNA, 22 bp, Homo sapiens
caggaagtcaggagccagcagg

SEQ ID NO: 5384731 - DNA, 19 bp, Homo sapiens
caggaagtcatcctgcaat

SEQ ID NO: 5384732 - DNA, 13 bp, Homo sapiens
caggaagtccctg

SEQ ID NO: 5384733 - DNA, 16 bp, Homo sapiens
caggaagtccctgaga

SEQ ID NO: 5384734 - DNA, 22 bp, Homo sapiens
caggaagtggctcagacccctc

SEQ ID NO: 5384735 - DNA, 18 bp, Homo sapiens
caggaagtgggagaagtg

SEQ ID NO: 5384736 - DNA, 15 bp, Homo sapiens
caggaagtgtttatg

SEQ ID NO: 5384737 - DNA, 23 bp, Homo sapiens
caggaagttgctgagaaatgggg

SEQ ID NO: 5384738 - DNA, 13 bp, Homo sapiens
caggaataaagac

SEQ ID NO: 5384739 - DNA, 14 bp, Homo sapiens
caggaataaagact

SEQ ID NO: 5384740 - DNA, 23 bp, Homo sapiens
caggaataaggccttaatatgtt

SEQ ID NO: 5384741 - DNA, 16 bp, Homo sapiens
caggaatagatgtggt

SEQ ID NO: 5384742 - DNA, 14 bp, Homo sapiens
caggaatatgacac

SEQ ID NO: 5384743 - DNA, 22 bp, Homo sapiens
caggaatatgacacaaaggtgg

SEQ ID NO: 5384744 - DNA, 16 bp, Homo sapiens
caggaatcaagagctg

SEQ ID NO: 5384745 - DNA, 17 bp, Homo sapiens
caggaatcaagagctgc

SEQ ID NO: 5384746 - DNA, 18 bp, Homo sapiens
caggaatcaagagctgcc

SEQ ID NO: 5384747 - DNA, 16 bp, Homo sapiens
caggaatcaaggagcc

SEQ ID NO: 5384748 - DNA, 20 bp, Homo sapiens
caggaatcacccctctgccc

SEQ ID NO: 5384749 - DNA, 16 bp, Homo sapiens
caggaatcatgatctg

SEQ ID NO: 5384750 - DNA, 14 bp, Homo sapiens
caggaatcccggct

SEQ ID NO: 5384751 - DNA, 16 bp, Homo sapiens
caggaatctcagagac

SEQ ID NO: 5384752 - DNA, 18 bp, Homo sapiens
caggaatctctgattaca

SEQ ID NO: 5384753 - DNA, 15 bp, Homo sapiens
caggaatctgccatt

SEQ ID NO: 5384754 - DNA, 15 bp, Homo sapiens
caggaatcttaaggt

SEQ ID NO: 5384755 - DNA, 21 bp, Homo sapiens
caggaatgaagaactgttgcc

SEQ ID NO: 5384756 - DNA, 23 bp, Homo sapiens
caggaatgagtcaatcagccttt

SEQ ID NO: 5384757 - DNA, 14 bp, Homo sapiens
caggaatgatctct

SEQ ID NO: 5384758 - DNA, 21 bp, Homo sapiens
caggaatgccaaggagacatc

SEQ ID NO: 5384759 - DNA, 20 bp, Homo sapiens
caggaatgcggttgggaggc

SEQ ID NO: 5384760 - DNA, 21 bp, Homo sapiens
caggaatgcggttgggaggca

SEQ ID NO: 5384761 - DNA, 22 bp, Homo sapiens
caggaatgctgacaatgctgcc

SEQ ID NO: 5384762 - DNA, 14 bp, Homo sapiens
caggaatgctgggc

SEQ ID NO: 5384763 - DNA, 15 bp, Homo sapiens
caggaatgggccaag

SEQ ID NO: 5384764 - DNA, 18 bp, Homo sapiens
caggaatgtctggagtgg

SEQ ID NO: 5384765 - DNA, 23 bp, Homo sapiens
caggaatgtctggagtggtaaca

SEQ ID NO: 5384766 - DNA, 13 bp, Homo sapiens
caggaatgtttca

SEQ ID NO: 5384767 - DNA, 13 bp, Homo sapiens
caggaattatgtc

SEQ ID NO: 5384768 - DNA, 18 bp, Homo sapiens
caggaattctaaataaat

SEQ ID NO: 5384769 - DNA, 20 bp, Homo sapiens
caggaattctccctggcatt

SEQ ID NO: 5384770 - DNA, 21 bp, Homo sapiens
caggaattcttggagaaaatg

SEQ ID NO: 5384771 - DNA, 15 bp, Homo sapiens
caggaattgaagatg

SEQ ID NO: 5384772 - DNA, 13 bp, Homo sapiens
caggaatttaatt

SEQ ID NO: 5384773 - DNA, 16 bp, Homo sapiens
caggaatttcccagga

SEQ ID NO: 5384774 - DNA, 18 bp, Homo sapiens
caggaatttcccaggacc

SEQ ID NO: 5384775 - DNA, 19 bp, Homo sapiens
caggaatttcccaggaccc

SEQ ID NO: 5384776 - DNA, 20 bp, Homo sapiens
caggaatttcccaggaccct

SEQ ID NO: 5384777 - DNA, 15 bp, Homo sapiens
caggaattttatttt

SEQ ID NO: 5384778 - DNA, 16 bp, Homo sapiens
caggaattttattttg

SEQ ID NO: 5384779 - DNA, 21 bp, Homo sapiens
caggaattttattttgctgag

SEQ ID NO: 5384780 - DNA, 20 bp, Homo sapiens
caggacaaagggagggagca

SEQ ID NO: 5384781 - DNA, 20 bp, Homo sapiens
caggacaacacagctgcttc

SEQ ID NO: 5384782 - DNA, 15 bp, Homo sapiens
caggacaacacttca

SEQ ID NO: 5384783 - DNA, 19 bp, Homo sapiens
caggacaacacttcatttt

SEQ ID NO: 5384784 - DNA, 16 bp, Homo sapiens
caggacaagcacgagg

SEQ ID NO: 5384785 - DNA, 14 bp, Homo sapiens
caggacaaggggca

SEQ ID NO: 5384786 - DNA, 12 bp, Homo sapiens
caggacacaggc

SEQ ID NO: 5384787 - DNA, 16 bp, Homo sapiens
caggacacaggcctgt

SEQ ID NO: 5384788 - DNA, 22 bp, Homo sapiens
caggacacaggcctgtgtagct

SEQ ID NO: 5384789 - DNA, 13 bp, Homo sapiens
caggacacagtca

SEQ ID NO: 5384790 - DNA, 15 bp, Homo sapiens
caggacacagtcaga

SEQ ID NO: 5384791 - DNA, 20 bp, Homo sapiens
caggacacatcccggcctct

SEQ ID NO: 5384792 - DNA, 21 bp, Homo sapiens
caggacaccacacccagcctc

SEQ ID NO: 5384793 - DNA, 23 bp, Homo sapiens
caggacaccacacccagcctcag

SEQ ID NO: 5384794 - DNA, 14 bp, Homo sapiens
caggacaccagcct

SEQ ID NO: 5384795 - DNA, 15 bp, Homo sapiens
caggacaccgggcag

SEQ ID NO: 5384796 - DNA, 11 bp, Homo sapiens
caggacacctg

SEQ ID NO: 5384797 - DNA, 12 bp, Homo sapiens
caggacacctgc

SEQ ID NO: 5384798 - DNA, 15 bp, Homo sapiens
caggacacctgcccc

SEQ ID NO: 5384799 - DNA, 16 bp, Homo sapiens
caggacacctgcccca

SEQ ID NO: 5384800 - DNA, 20 bp, Homo sapiens
caggacacctgccccagcgc

SEQ ID NO: 5384801 - DNA, 22 bp, Homo sapiens
caggacacctggccgcctccag

SEQ ID NO: 5384802 - DNA, 14 bp, Homo sapiens
caggacagaacagt

SEQ ID NO: 5384803 - DNA, 19 bp, Homo sapiens
caggacagagttcacagga

SEQ ID NO: 5384804 - DNA, 17 bp, Homo sapiens
caggacagatcaggtca

SEQ ID NO: 5384805 - DNA, 24 bp, Homo sapiens
caggacagatcaggtcagagccca

SEQ ID NO: 5384806 - DNA, 14 bp, Homo sapiens
caggacagcagcac

SEQ ID NO: 5384807 - DNA, 20 bp, Homo sapiens
caggacagcatcccttccca

SEQ ID NO: 5384808 - DNA, 24 bp, Homo sapiens
caggacagcatcccttcccacatg

SEQ ID NO: 5384809 - DNA, 19 bp, Homo sapiens
caggacagcatggtgcatg

SEQ ID NO: 5384810 - DNA, 14 bp, Homo sapiens
caggacagccagca

SEQ ID NO: 5384811 - DNA, 14 bp, Homo sapiens
caggacagctcttg

SEQ ID NO: 5384812 - DNA, 16 bp, Homo sapiens
caggacagctgcaggt

SEQ ID NO: 5384813 - DNA, 14 bp, Homo sapiens
caggacagctggct

SEQ ID NO: 5384814 - DNA, 19 bp, Homo sapiens
caggacagctggctgctga

SEQ ID NO: 5384815 - DNA, 21 bp, Homo sapiens
caggacagctggctgctgaca

SEQ ID NO: 5384816 - DNA, 23 bp, Homo sapiens
caggacagctggctgctgacagg

SEQ ID NO: 5384817 - DNA, 13 bp, Homo sapiens
caggacaggacca

SEQ ID NO: 5384818 - DNA, 15 bp, Homo sapiens
caggacaggggttcc

SEQ ID NO: 5384819 - DNA, 16 bp, Homo sapiens
caggacagtgcttcag

SEQ ID NO: 5384820 - DNA, 20 bp, Homo sapiens
caggacagtgcttcagcctg

SEQ ID NO: 5384821 - DNA, 19 bp, Homo sapiens
caggacagttgatggagcc

SEQ ID NO: 5384822 - DNA, 22 bp, Homo sapiens
caggacagtttatcctgtctga

SEQ ID NO: 5384823 - DNA, 19 bp, Homo sapiens
caggacatgcaataaaatt

SEQ ID NO: 5384824 - DNA, 20 bp, Homo sapiens
caggacatgcggtagccagc

SEQ ID NO: 5384825 - DNA, 16 bp, Homo sapiens
caggacatgctgaagc

SEQ ID NO: 5384826 - DNA, 20 bp, Homo sapiens
caggacatggggctcctgga

SEQ ID NO: 5384827 - DNA, 15 bp, Homo sapiens
caggacattaaaaat

SEQ ID NO: 5384828 - DNA, 18 bp, Homo sapiens
caggacatttctctaaga

SEQ ID NO: 5384829 - DNA, 19 bp, Homo sapiens
caggacatttggaaatcag

SEQ ID NO: 5384830 - DNA, 20 bp, Homo sapiens
caggaccaaaaaacctcact

SEQ ID NO: 5384831 - DNA, 20 bp, Homo sapiens
caggaccaagcttaaggaga

SEQ ID NO: 5384832 - DNA, 16 bp, Homo sapiens
caggaccaagggggcg

SEQ ID NO: 5384833 - DNA, 18 bp, Homo sapiens
caggaccaagggggcggg

SEQ ID NO: 5384834 - DNA, 19 bp, Homo sapiens
caggaccaagggggcgggg

SEQ ID NO: 5384835 - DNA, 16 bp, Homo sapiens
caggaccacaaaaatg

SEQ ID NO: 5384836 - DNA, 14 bp, Homo sapiens
caggaccacacagt

SEQ ID NO: 5384837 - DNA, 17 bp, Homo sapiens
caggaccacacagtccc

SEQ ID NO: 5384838 - DNA, 21 bp, Homo sapiens
caggaccacacagtccccaga

SEQ ID NO: 5384839 - DNA, 21 bp, Homo sapiens
caggaccacaggctcaggcag

SEQ ID NO: 5384840 - DNA, 14 bp, Homo sapiens
caggaccaccctgc

SEQ ID NO: 5384841 - DNA, 17 bp, Homo sapiens
caggaccaccctgccaa

SEQ ID NO: 5384842 - DNA, 12 bp, Homo sapiens
caggaccacctc

SEQ ID NO: 5384843 - DNA, 13 bp, Homo sapiens
caggaccactagc

SEQ ID NO: 5384844 - DNA, 17 bp, Homo sapiens
caggaccagaaggcaat

SEQ ID NO: 5384845 - DNA, 14 bp, Homo sapiens
caggaccagagaag

SEQ ID NO: 5384846 - DNA, 17 bp, Homo sapiens
caggaccagcccacgct

SEQ ID NO: 5384847 - DNA, 14 bp, Homo sapiens
caggaccagcctgt

SEQ ID NO: 5384848 - DNA, 20 bp, Homo sapiens
caggaccagctcaggacaga

SEQ ID NO: 5384849 - DNA, 12 bp, Homo sapiens
caggaccagctg

SEQ ID NO: 5384850 - DNA, 16 bp, Homo sapiens
caggaccagctggggc

SEQ ID NO: 5384851 - DNA, 23 bp, Homo sapiens
caggaccagctggggcgtgggga

SEQ ID NO: 5384852 - DNA, 20 bp, Homo sapiens
caggaccaggacccagggag

SEQ ID NO: 5384853 - DNA, 13 bp, Homo sapiens
caggaccaggact

SEQ ID NO: 5384854 - DNA, 14 bp, Homo sapiens
caggaccaggacta

SEQ ID NO: 5384855 - DNA, 13 bp, Homo sapiens
caggaccaggagc

SEQ ID NO: 5384856 - DNA, 16 bp, Homo sapiens
caggaccaggagccag

SEQ ID NO: 5384857 - DNA, 17 bp, Homo sapiens
caggaccaggagccagg

SEQ ID NO: 5384858 - DNA, 13 bp, Homo sapiens
caggaccagggat

SEQ ID NO: 5384859 - DNA, 21 bp, Homo sapiens
caggaccagggatttccatga

SEQ ID NO: 5384860 - DNA, 19 bp, Homo sapiens
caggaccagtcccagagca

SEQ ID NO: 5384861 - DNA, 14 bp, Homo sapiens
caggaccagtttat

SEQ ID NO: 5384862 - DNA, 16 bp, Homo sapiens
caggaccatcctggag

SEQ ID NO: 5384863 - DNA, 19 bp, Homo sapiens
caggaccatcctggagggc

SEQ ID NO: 5384864 - DNA, 16 bp, Homo sapiens
caggaccatcttcccg

SEQ ID NO: 5384865 - DNA, 16 bp, Homo sapiens
caggaccatgggacca

SEQ ID NO: 5384866 - DNA, 19 bp, Homo sapiens
caggacccaccactggaag

SEQ ID NO: 5384867 - DNA, 20 bp, Homo sapiens
caggacccaccactggaagc

SEQ ID NO: 5384868 - DNA, 13 bp, Homo sapiens
caggacccagagg

SEQ ID NO: 5384869 - DNA, 15 bp, Homo sapiens
caggacccagaggaa

SEQ ID NO: 5384870 - DNA, 16 bp, Homo sapiens
caggacccaggccctc

SEQ ID NO: 5384871 - DNA, 17 bp, Homo sapiens
caggacccaggccctcc

SEQ ID NO: 5384872 - DNA, 21 bp, Homo sapiens
caggacccaggccctccatgg

SEQ ID NO: 5384873 - DNA, 14 bp, Homo sapiens
caggacccaggccg

SEQ ID NO: 5384874 - DNA, 13 bp, Homo sapiens
caggacccaggga

SEQ ID NO: 5384875 - DNA, 14 bp, Homo sapiens
caggacccagggag

SEQ ID NO: 5384876 - DNA, 16 bp, Homo sapiens
caggacccagggagag

SEQ ID NO: 5384877 - DNA, 14 bp, Homo sapiens
caggacccagggtc

SEQ ID NO: 5384878 - DNA, 15 bp, Homo sapiens
caggacccagggtcc

SEQ ID NO: 5384879 - DNA, 16 bp, Homo sapiens
caggacccagggtccc

SEQ ID NO: 5384880 - DNA, 12 bp, Homo sapiens
caggaccccaga

SEQ ID NO: 5384881 - DNA, 14 bp, Homo sapiens
caggaccccagagg

SEQ ID NO: 5384882 - DNA, 22 bp, Homo sapiens
caggaccccagagggaccagct

SEQ ID NO: 5384883 - DNA, 15 bp, Homo sapiens
caggaccccagctct

SEQ ID NO: 5384884 - DNA, 17 bp, Homo sapiens
caggaccccagctctgc

SEQ ID NO: 5384885 - DNA, 21 bp, Homo sapiens
caggaccccaggtcaggggct

SEQ ID NO: 5384886 - DNA, 15 bp, Homo sapiens
caggaccccatctgc

SEQ ID NO: 5384887 - DNA, 17 bp, Homo sapiens
caggaccccatctgctg

SEQ ID NO: 5384888 - DNA, 14 bp, Homo sapiens
caggacccccccag

SEQ ID NO: 5384889 - DNA, 22 bp, Homo sapiens
caggacccccccagtccgcccc

SEQ ID NO: 5384890 - DNA, 14 bp, Homo sapiens
caggacccccttcc

SEQ ID NO: 5384891 - DNA, 19 bp, Homo sapiens
caggaggaaaaggcttggt

SEQ ID NO: 5384892 - DNA, 15 bp, Homo sapiens
caggaggaactggtc

SEQ ID NO: 5384893 - DNA, 16 bp, Homo sapiens
caggaggaactggtcc

SEQ ID NO: 5384894 - DNA, 17 bp, Homo sapiens
caggaggaactggtcca

SEQ ID NO: 5384895 - DNA, 23 bp, Homo sapiens
caggaggaactttcaaaagtctg

SEQ ID NO: 5384896 - DNA, 16 bp, Homo sapiens
caggaggacagagtgc

SEQ ID NO: 5384897 - DNA, 19 bp, Homo sapiens
caggaggacagagtgccct

SEQ ID NO: 5384898 - DNA, 22 bp, Homo sapiens
caggaggacaggtggaggcgag

SEQ ID NO: 5384899 - DNA, 23 bp, Homo sapiens
caggaggacaggtggaggcgagc

SEQ ID NO: 5384900 - DNA, 16 bp, Homo sapiens
caggaggacccagggc

SEQ ID NO: 5384901 - DNA, 18 bp, Homo sapiens
caggaggacccagggctc

SEQ ID NO: 5384902 - DNA, 20 bp, Homo sapiens
caggaggacccagggctctg

SEQ ID NO: 5384903 - DNA, 13 bp, Homo sapiens
caggaggacctgg

SEQ ID NO: 5384904 - DNA, 18 bp, Homo sapiens
caggaggagaaaagaaat

SEQ ID NO: 5384905 - DNA, 14 bp, Homo sapiens
caggaggagacagt

SEQ ID NO: 5384906 - DNA, 21 bp, Homo sapiens
caggaggagacagtcaggaag

SEQ ID NO: 5384907 - DNA, 20 bp, Homo sapiens
caggaggaggaaaggtagcc

SEQ ID NO: 5384908 - DNA, 19 bp, Homo sapiens
caggaggagtgggacagac

SEQ ID NO: 5384909 - DNA, 21 bp, Homo sapiens
caggaggagtgggacagacag

SEQ ID NO: 5384910 - DNA, 19 bp, Homo sapiens
caggaggatcacttgagtc

SEQ ID NO: 5384911 - DNA, 18 bp, Homo sapiens
caggaggatcccctgagg

SEQ ID NO: 5384912 - DNA, 22 bp, Homo sapiens
caggaggattgcttgagcccag

SEQ ID NO: 5384913 - DNA, 12 bp, Homo sapiens
caggaggcaagc

SEQ ID NO: 5384914 - DNA, 13 bp, Homo sapiens
caggaggcacagc

SEQ ID NO: 5384915 - DNA, 16 bp, Homo sapiens
caggaggcacagcagt

SEQ ID NO: 5384916 - DNA, 11 bp, Homo sapiens
caggaggcaga

SEQ ID NO: 5384917 - DNA, 20 bp, Homo sapiens
caggaggcagaggttgcagt

SEQ ID NO: 5384918 - DNA, 18 bp, Homo sapiens
caggaggcagctcaggat

SEQ ID NO: 5384919 - DNA, 15 bp, Homo sapiens
caggaggcaggatat

SEQ ID NO: 5384920 - DNA, 18 bp, Homo sapiens
caggaggcaggcatggcc

SEQ ID NO: 5384921 - DNA, 23 bp, Homo sapiens
caggaggcagggaggcagccgcc

SEQ ID NO: 5384922 - DNA, 22 bp, Homo sapiens
caggaggcagtggcttggagca

SEQ ID NO: 5384923 - DNA, 23 bp, Homo sapiens
caggaggcatccaaaggctcctg

SEQ ID NO: 5384924 - DNA, 17 bp, Homo sapiens
caggaggccaaggtggg

SEQ ID NO: 5384925 - DNA, 14 bp, Homo sapiens
caggaggccaataa

SEQ ID NO: 5384926 - DNA, 15 bp, Homo sapiens
caggaggccaataaa

SEQ ID NO: 5384927 - DNA, 19 bp, Homo sapiens
caggaggccaataaaaagt

SEQ ID NO: 5384928 - DNA, 20 bp, Homo sapiens
caggaggccaataaaaagtt

SEQ ID NO: 5384929 - DNA, 21 bp, Homo sapiens
caggaggccaataaaaagttc

SEQ ID NO: 5384930 - DNA, 23 bp, Homo sapiens
caggaggccaataaaaagttcag

SEQ ID NO: 5384931 - DNA, 18 bp, Homo sapiens
caggaggccagccttgac

SEQ ID NO: 5384932 - DNA, 19 bp, Homo sapiens
caggaggccagccttgacc

SEQ ID NO: 5384933 - DNA, 22 bp, Homo sapiens
caggaggccagccttgaccatt

SEQ ID NO: 5384934 - DNA, 13 bp, Homo sapiens
caggaggccagtg

SEQ ID NO: 5384935 - DNA, 11 bp, Homo sapiens
caggaggcccc

SEQ ID NO: 5384936 - DNA, 15 bp, Homo sapiens
caggaggccccaggc

SEQ ID NO: 5384937 - DNA, 19 bp, Homo sapiens
caggaggcccctggcccag

SEQ ID NO: 5384938 - DNA, 14 bp, Homo sapiens
caggaggccctggt

SEQ ID NO: 5384939 - DNA, 21 bp, Homo sapiens
caggaggcccttgtcgtggga

SEQ ID NO: 5384940 - DNA, 17 bp, Homo sapiens
caggaggccgaggcagg

SEQ ID NO: 5384941 - DNA, 23 bp, Homo sapiens
caggaggccgagtggctgccgga

SEQ ID NO: 5384942 - DNA, 16 bp, Homo sapiens
caggaggcctgcacca

SEQ ID NO: 5384943 - DNA, 15 bp, Homo sapiens
caggaggcctggcct

SEQ ID NO: 5384944 - DNA, 20 bp, Homo sapiens
caggaggcctggccttgtca

SEQ ID NO: 5384945 - DNA, 22 bp, Homo sapiens
caggaggcctgggagggcaagg

SEQ ID NO: 5384946 - DNA, 23 bp, Homo sapiens
caggaggcctgggagggcaaggg

SEQ ID NO: 5384947 - DNA, 14 bp, Homo sapiens
caggaggcctgggc

SEQ ID NO: 5384948 - DNA, 14 bp, Homo sapiens
caggaggcgcagcc

SEQ ID NO: 5384949 - DNA, 17 bp, Homo sapiens
caggaggcgcagcccga

SEQ ID NO: 5384950 - DNA, 17 bp, Homo sapiens
caggaggcgcccttggc

SEQ ID NO: 5384951 - DNA, 19 bp, Homo sapiens
caggaggcggcagctcttc

SEQ ID NO: 5384952 - DNA, 21 bp, Homo sapiens
caggaggcggcagctcttctg

SEQ ID NO: 5384953 - DNA, 16 bp, Homo sapiens
caggaggcggcccggc

SEQ ID NO: 5384954 - DNA, 17 bp, Homo sapiens
caggaggcggcccggcc

SEQ ID NO: 5384955 - DNA, 19 bp, Homo sapiens
caggaggcggcccggccag

SEQ ID NO: 5384956 - DNA, 23 bp, Homo sapiens
caggaggctccatccttctcccc

SEQ ID NO: 5384957 - DNA, 22 bp, Homo sapiens
caggaggctccgtgagcccttg

SEQ ID NO: 5384958 - DNA, 14 bp, Homo sapiens
caggaggctgaggc

SEQ ID NO: 5384959 - DNA, 15 bp, Homo sapiens
caggaggctgaggca

SEQ ID NO: 5384960 - DNA, 17 bp, Homo sapiens
caggaggctgaggcaga

SEQ ID NO: 5384961 - DNA, 19 bp, Homo sapiens
caggaggctgaggcaggag

SEQ ID NO: 5384962 - DNA, 20 bp, Homo sapiens
caggaggctgaggcaggagg

SEQ ID NO: 5384963 - DNA, 21 bp, Homo sapiens
caggaggctgaggcaggagga

SEQ ID NO: 5384964 - DNA, 14 bp, Homo sapiens
caggaggctgcggc

SEQ ID NO: 5384965 - DNA, 15 bp, Homo sapiens
caggaggctgcggcc

SEQ ID NO: 5384966 - DNA, 24 bp, Homo sapiens
caggaggctggcagtacagagtgc

SEQ ID NO: 5384967 - DNA, 21 bp, Homo sapiens
caggaggctgggacgctctgc

SEQ ID NO: 5384968 - DNA, 23 bp, Homo sapiens
caggaggctgggacgctctgctg

SEQ ID NO: 5384969 - DNA, 21 bp, Homo sapiens
caggaggcttggaaagcatca

SEQ ID NO: 5384970 - DNA, 21 bp, Homo sapiens
caggaggctttaagctccagc

SEQ ID NO: 5384971 - DNA, 20 bp, Homo sapiens
caggaggctttctgggctct

SEQ ID NO: 5384972 - DNA, 22 bp, Homo sapiens
caggagggaacatttccgaata

SEQ ID NO: 5384973 - DNA, 22 bp, Homo sapiens
caggagggacaaaggagcctgt

SEQ ID NO: 5384974 - DNA, 23 bp, Homo sapiens
caggagggacaaaggagcctgtg

SEQ ID NO: 5384975 - DNA, 17 bp, Homo sapiens
caggagggactctgtct

SEQ ID NO: 5384976 - DNA, 18 bp, Homo sapiens
caggagggagagaactta

SEQ ID NO: 5384977 - DNA, 22 bp, Homo sapiens
caggagggagcatagaaggcag

SEQ ID NO: 5384978 - DNA, 15 bp, Homo sapiens
caggagggaggcggg

SEQ ID NO: 5384979 - DNA, 17 bp, Homo sapiens
caggagggaggcgggga

SEQ ID NO: 5384980 - DNA, 14 bp, Homo sapiens
caggagggagggtt

SEQ ID NO: 5384981 - DNA, 23 bp, Homo sapiens
caggagggaggtttgtgagagcg

SEQ ID NO: 5384982 - DNA, 13 bp, Homo sapiens
caggagggcacag

SEQ ID NO: 5384983 - DNA, 13 bp, Homo sapiens
caggagggcactg

SEQ ID NO: 5384984 - DNA, 13 bp, Homo sapiens
caggagggcaggc

SEQ ID NO: 5384985 - DNA, 16 bp, Homo sapiens
caggagggcaggctga

SEQ ID NO: 5384986 - DNA, 16 bp, Homo sapiens
caggagggcatcagct

SEQ ID NO: 5384987 - DNA, 13 bp, Homo sapiens
caggagggccagc

SEQ ID NO: 5384988 - DNA, 23 bp, Homo sapiens
caggagggcccggagaaactgag

SEQ ID NO: 5384989 - DNA, 16 bp, Homo sapiens
caggagggccctacct

SEQ ID NO: 5384990 - DNA, 22 bp, Homo sapiens
caggagggcggcctccttctga

SEQ ID NO: 5384991 - DNA, 22 bp, Homo sapiens
caggagggcgttcttaggctgc

SEQ ID NO: 5384992 - DNA, 18 bp, Homo sapiens
caggagggctaattagaa

SEQ ID NO: 5384993 - DNA, 20 bp, Homo sapiens
caggaggggaaaaaattaac

SEQ ID NO: 5384994 - DNA, 24 bp, Homo sapiens
caggaggggaacactgccctcgca

SEQ ID NO: 5384995 - DNA, 13 bp, Homo sapiens
caggaggggaact

SEQ ID NO: 5384996 - DNA, 23 bp, Homo sapiens
caggaggggaagaggcctttcta

SEQ ID NO: 5384997 - DNA, 15 bp, Homo sapiens
caggaggggcctctg

SEQ ID NO: 5384998 - DNA, 17 bp, Homo sapiens
caggaggggcctctgaa

SEQ ID NO: 5384999 - DNA, 19 bp, Homo sapiens
caggaggggcctgggcagc

SEQ ID NO: 5385000 - DNA, 15 bp, Homo sapiens
caggaggggggaggg

SEQ ID NO: 5385001 - DNA, 23 bp, Homo sapiens
caggaggggggagggaagggagc

SEQ ID NO: 5385002 - DNA, 16 bp, Homo sapiens
caggagggggtcgtgg

SEQ ID NO: 5385003 - DNA, 19 bp, Homo sapiens
caggagggggtcgtggaga

SEQ ID NO: 5385004 - DNA, 21 bp, Homo sapiens
caggagggggtcgtggagagc

SEQ ID NO: 5385005 - DNA, 20 bp, Homo sapiens
caggaggggtctcatgtcct

SEQ ID NO: 5385006 - DNA, 21 bp, Homo sapiens
caggaggggtctgcctcccac

SEQ ID NO: 5385007 - DNA, 20 bp, Homo sapiens
caggagggtaacagaagagg

SEQ ID NO: 5385008 - DNA, 16 bp, Homo sapiens
caggagggtgacgccc

SEQ ID NO: 5385009 - DNA, 18 bp, Homo sapiens
caggagggtgacgcccag

SEQ ID NO: 5385010 - DNA, 20 bp, Homo sapiens
caggagggttggagtgctct

SEQ ID NO: 5385011 - DNA, 22 bp, Homo sapiens
caggagggttggagtgctcttc

SEQ ID NO: 5385012 - DNA, 19 bp, Homo sapiens
caggaggtcatctgacctt

SEQ ID NO: 5385013 - DNA, 18 bp, Homo sapiens
caggaggtgcagtggagg

SEQ ID NO: 5385014 - DNA, 19 bp, Homo sapiens
caggaggtgcagtggaggg

SEQ ID NO: 5385015 - DNA, 22 bp, Homo sapiens
caggaggtgcagtggagggggc

SEQ ID NO: 5385016 - DNA, 19 bp, Homo sapiens
caggaggtgccactggagt

SEQ ID NO: 5385017 - DNA, 13 bp, Homo sapiens
caggaggtgcctg

SEQ ID NO: 5385018 - DNA, 14 bp, Homo sapiens
caggaggtgcctga

SEQ ID NO: 5385019 - DNA, 19 bp, Homo sapiens
caggaggtgcctgagagca

SEQ ID NO: 5385020 - DNA, 15 bp, Homo sapiens
caggaggtggagaaa

SEQ ID NO: 5385021 - DNA, 23 bp, Homo sapiens
caggaggtggaggttgcagtgaa

SEQ ID NO: 5385022 - DNA, 18 bp, Homo sapiens
caggaggtggctatggcc

SEQ ID NO: 5385023 - DNA, 22 bp, Homo sapiens
caggaggtggctatggccaccc

SEQ ID NO: 5385024 - DNA, 16 bp, Homo sapiens
caggaggtgggtgagc

SEQ ID NO: 5385025 - DNA, 18 bp, Homo sapiens
caggaggttcaaaagtaa

SEQ ID NO: 5385026 - DNA, 14 bp, Homo sapiens
caggagtaaaagag

SEQ ID NO: 5385027 - DNA, 13 bp, Homo sapiens
caggagtaagccc

SEQ ID NO: 5385028 - DNA, 18 bp, Homo sapiens
caggagtaagcccaagct

SEQ ID NO: 5385029 - DNA, 13 bp, Homo sapiens
caggagtagctga

SEQ ID NO: 5385030 - DNA, 17 bp, Homo sapiens
caggagtagctgagctc

SEQ ID NO: 5385031 - DNA, 16 bp, Homo sapiens
caggagtcaccatgca

SEQ ID NO: 5385032 - DNA, 20 bp, Homo sapiens
caggagtcaccatgcaaggg

SEQ ID NO: 5385033 - DNA, 20 bp, Homo sapiens
caggagtcagtctctttctg

SEQ ID NO: 5385034 - DNA, 14 bp, Homo sapiens
caggagtcagtgtc

SEQ ID NO: 5385035 - DNA, 16 bp, Homo sapiens
caggagtcagtgtctg

SEQ ID NO: 5385036 - DNA, 15 bp, Homo sapiens
caggagtccaaacct

SEQ ID NO: 5385037 - DNA, 12 bp, Homo sapiens
caggagtccagc

SEQ ID NO: 5385038 - DNA, 19 bp, Homo sapiens
caggagtccagcccctcct

SEQ ID NO: 5385039 - DNA, 21 bp, Homo sapiens
caggagtccagcccctcctcc

SEQ ID NO: 5385040 - DNA, 15 bp, Homo sapiens
caggagtccaggccc

SEQ ID NO: 5385041 - DNA, 19 bp, Homo sapiens
caggagtccaggcccccag

SEQ ID NO: 5385042 - DNA, 22 bp, Homo sapiens
caggagtccaggcccccagccc

SEQ ID NO: 5385043 - DNA, 24 bp, Homo sapiens
caggagtcccaaggaaagccccag

SEQ ID NO: 5385044 - DNA, 14 bp, Homo sapiens
caggagtccctgcc

SEQ ID NO: 5385045 - DNA, 15 bp, Homo sapiens
caggagtccctgcca

SEQ ID NO: 5385046 - DNA, 21 bp, Homo sapiens
caggagtccctgccatcatgt

SEQ ID NO: 5385047 - DNA, 16 bp, Homo sapiens
caggagtcctttcttt

SEQ ID NO: 5385048 - DNA, 17 bp, Homo sapiens
caggagtctctgccagt

SEQ ID NO: 5385049 - DNA, 14 bp, Homo sapiens
caggagtctgccac

SEQ ID NO: 5385050 - DNA, 15 bp, Homo sapiens
caggagtctgccact

SEQ ID NO: 5385051 - DNA, 17 bp, Homo sapiens
caggagtcttcagaccc

SEQ ID NO: 5385052 - DNA, 18 bp, Homo sapiens
caggagtcttcagaccca

SEQ ID NO: 5385053 - DNA, 21 bp, Homo sapiens
caggagtcttcagacccagag

SEQ ID NO: 5385054 - DNA, 22 bp, Homo sapiens
caggagtcttcagacccagaga

SEQ ID NO: 5385055 - DNA, 15 bp, Homo sapiens
caggagtctttgtaa

SEQ ID NO: 5385056 - DNA, 21 bp, Homo sapiens
caggagtgactctggctgcca

SEQ ID NO: 5385057 - DNA, 13 bp, Homo sapiens
caggagtgccagg

SEQ ID NO: 5385058 - DNA, 21 bp, Homo sapiens
caggagtggcagctgtcccct

SEQ ID NO: 5385059 - DNA, 19 bp, Homo sapiens
caggagtggccggggaagc

SEQ ID NO: 5385060 - DNA, 20 bp, Homo sapiens
caggagtggccggggaagct

SEQ ID NO: 5385061 - DNA, 18 bp, Homo sapiens
caggagtgggctctgagc

SEQ ID NO: 5385062 - DNA, 16 bp, Homo sapiens
caggagtggggagagt

SEQ ID NO: 5385063 - DNA, 14 bp, Homo sapiens
caggagtgggtggg

SEQ ID NO: 5385064 - DNA, 18 bp, Homo sapiens
caggagtgggtgggacac

SEQ ID NO: 5385065 - DNA, 20 bp, Homo sapiens
caggagtgggtgggacacag

SEQ ID NO: 5385066 - DNA, 21 bp, Homo sapiens
caggatttgaactcagatctg

SEQ ID NO: 5385067 - DNA, 14 bp, Homo sapiens
caggattttaaaca

SEQ ID NO: 5385068 - DNA, 13 bp, Homo sapiens
caggattttcaag

SEQ ID NO: 5385069 - DNA, 15 bp, Homo sapiens
caggattttcaagtt

SEQ ID NO: 5385070 - DNA, 21 bp, Homo sapiens
caggattttcaagttattcag

SEQ ID NO: 5385071 - DNA, 14 bp, Homo sapiens
caggattttgtatt

SEQ ID NO: 5385072 - DNA, 17 bp, Homo sapiens
caggatttttagagcat

SEQ ID NO: 5385073 - DNA, 22 bp, Homo sapiens
caggcaaaacaggaagggggaa

SEQ ID NO: 5385074 - DNA, 14 bp, Homo sapiens
caggcaaagaggtg

SEQ ID NO: 5385075 - DNA, 15 bp, Homo sapiens
caggcaaagaggtgc

SEQ ID NO: 5385076 - DNA, 16 bp, Homo sapiens
caggcaaagaggtgct

SEQ ID NO: 5385077 - DNA, 19 bp, Homo sapiens
caggcaaagtgcacctcaa

SEQ ID NO: 5385078 - DNA, 12 bp, Homo sapiens
caggcaaattca

SEQ ID NO: 5385079 - DNA, 12 bp, Homo sapiens
caggcaaattgt

SEQ ID NO: 5385080 - DNA, 17 bp, Homo sapiens
caggcaaccaggaaact

SEQ ID NO: 5385081 - DNA, 13 bp, Homo sapiens
caggcaacctccc

SEQ ID NO: 5385082 - DNA, 14 bp, Homo sapiens
caggcaacctccca

SEQ ID NO: 5385083 - DNA, 16 bp, Homo sapiens
caggcaactgaggcag

SEQ ID NO: 5385084 - DNA, 18 bp, Homo sapiens
caggcaactgaggcagac

SEQ ID NO: 5385085 - DNA, 17 bp, Homo sapiens
caggcaacttcagtcct

SEQ ID NO: 5385086 - DNA, 20 bp, Homo sapiens
caggcaacttcagtcctggg

SEQ ID NO: 5385087 - DNA, 14 bp, Homo sapiens
caggcaagaaaagc

SEQ ID NO: 5385088 - DNA, 22 bp, Homo sapiens
caggcaagaaaagcgcagagaa

SEQ ID NO: 5385089 - DNA, 15 bp, Homo sapiens
caggcaagaaagctt

SEQ ID NO: 5385090 - DNA, 20 bp, Homo sapiens
caggcaagaaagcttccttc

SEQ ID NO: 5385091 - DNA, 23 bp, Homo sapiens
caggcaagacaccttcccagctg

SEQ ID NO: 5385092 - DNA, 14 bp, Homo sapiens
caggcaagcacctc

SEQ ID NO: 5385093 - DNA, 15 bp, Homo sapiens
caggcaagcacctcc

SEQ ID NO: 5385094 - DNA, 16 bp, Homo sapiens
caggcaagcccctcag

SEQ ID NO: 5385095 - DNA, 17 bp, Homo sapiens
caggcaagcccctcagc

SEQ ID NO: 5385096 - DNA, 21 bp, Homo sapiens
caggcaagcccctcagccctt

SEQ ID NO: 5385097 - DNA, 14 bp, Homo sapiens
caggcaaggaacag

SEQ ID NO: 5385098 - DNA, 19 bp, Homo sapiens
caggcaaggcagctcccag

SEQ ID NO: 5385099 - DNA, 22 bp, Homo sapiens
caggcaaggtctggcctcaggt

SEQ ID NO: 5385100 - DNA, 21 bp, Homo sapiens
caggcaataatattttctgtg

SEQ ID NO: 5385101 - DNA, 23 bp, Homo sapiens
caggcaataatattttctgtgta

SEQ ID NO: 5385102 - DNA, 21 bp, Homo sapiens
caggcaatagtgttgaggagg

SEQ ID NO: 5385103 - DNA, 17 bp, Homo sapiens
caggcaatcaacaaacg

SEQ ID NO: 5385104 - DNA, 21 bp, Homo sapiens
caggcaatcacttgaggtcag

SEQ ID NO: 5385105 - DNA, 20 bp, Homo sapiens
caggcaatcgttctgctggc

SEQ ID NO: 5385106 - DNA, 21 bp, Homo sapiens
caggcaatgccctgcggctct

SEQ ID NO: 5385107 - DNA, 23 bp, Homo sapiens
caggcaatgccctgcggctctgg

SEQ ID NO: 5385108 - DNA, 16 bp, Homo sapiens
caggcaatgctgtact

SEQ ID NO: 5385109 - DNA, 22 bp, Homo sapiens
caggcaatggcctaaacttcag

SEQ ID NO: 5385110 - DNA, 14 bp, Homo sapiens
caggcacaaaatga

SEQ ID NO: 5385111 - DNA, 14 bp, Homo sapiens
caggcacaaaatgt

SEQ ID NO: 5385112 - DNA, 17 bp, Homo sapiens
caggcacaaaatgtgac

SEQ ID NO: 5385113 - DNA, 18 bp, Homo sapiens
caggcacacacagcccct

SEQ ID NO: 5385114 - DNA, 23 bp, Homo sapiens
caggcacacactgtgctttctat

SEQ ID NO: 5385115 - DNA, 13 bp, Homo sapiens
caggcacacagct

SEQ ID NO: 5385116 - DNA, 23 bp, Homo sapiens
caggcacacagctactctcccca

SEQ ID NO: 5385117 - DNA, 15 bp, Homo sapiens
caggcacacagggcc

SEQ ID NO: 5385118 - DNA, 16 bp, Homo sapiens
caggcacacagggccc

SEQ ID NO: 5385119 - DNA, 12 bp, Homo sapiens
caggcacacctt

SEQ ID NO: 5385120 - DNA, 16 bp, Homo sapiens
caggcacaccttgcag

SEQ ID NO: 5385121 - DNA, 14 bp, Homo sapiens
caggcacagaggag

SEQ ID NO: 5385122 - DNA, 14 bp, Homo sapiens
caggcacagcacag

SEQ ID NO: 5385123 - DNA, 16 bp, Homo sapiens
caggcacagcacaggg

SEQ ID NO: 5385124 - DNA, 17 bp, Homo sapiens
caggcacagcagctgca

SEQ ID NO: 5385125 - DNA, 19 bp, Homo sapiens
caggcacagcagctgcagg

SEQ ID NO: 5385126 - DNA, 20 bp, Homo sapiens
caggcacaggatgctgtgtt

SEQ ID NO: 5385127 - DNA, 13 bp, Homo sapiens
caggcacaggcag

SEQ ID NO: 5385128 - DNA, 21 bp, Homo sapiens
caggcacaggcaggaagagag

SEQ ID NO: 5385129 - DNA, 18 bp, Homo sapiens
caggcacaggcagggcag

SEQ ID NO: 5385130 - DNA, 17 bp, Homo sapiens
caggcacagggcccgca

SEQ ID NO: 5385131 - DNA, 23 bp, Homo sapiens
caggcacagggcccgcagtgctg

SEQ ID NO: 5385132 - DNA, 19 bp, Homo sapiens
caggcacagtaagcatgct

SEQ ID NO: 5385133 - DNA, 16 bp, Homo sapiens
caggcacatggctggg

SEQ ID NO: 5385134 - DNA, 17 bp, Homo sapiens
caggcacatggctgggg

SEQ ID NO: 5385135 - DNA, 18 bp, Homo sapiens
caggcacatggctggggg

SEQ ID NO: 5385136 - DNA, 15 bp, Homo sapiens
caggcacatgtgttc

SEQ ID NO: 5385137 - DNA, 17 bp, Homo sapiens
caggcacattaactgtt

SEQ ID NO: 5385138 - DNA, 16 bp, Homo sapiens
caggcaccaaaagaag

SEQ ID NO: 5385139 - DNA, 19 bp, Homo sapiens
caggcaccaaaagaagtaa

SEQ ID NO: 5385140 - DNA, 18 bp, Homo sapiens
caggcaccaccaggagca

SEQ ID NO: 5385141 - DNA, 20 bp, Homo sapiens
caggcaccaccaggagcagc

SEQ ID NO: 5385142 - DNA, 18 bp, Homo sapiens
caggcaccagcagcagaa

SEQ ID NO: 5385143 - DNA, 14 bp, Homo sapiens
caggcaccagcatc

SEQ ID NO: 5385144 - DNA, 16 bp, Homo sapiens
caggcacccacatccc

SEQ ID NO: 5385145 - DNA, 20 bp, Homo sapiens
caggcacccacatccccaat

SEQ ID NO: 5385146 - DNA, 22 bp, Homo sapiens
caggcacccccaggattcccag

SEQ ID NO: 5385147 - DNA, 18 bp, Homo sapiens
caggcaccccctggcttg

SEQ ID NO: 5385148 - DNA, 20 bp, Homo sapiens
caggcacccggggccagaga

SEQ ID NO: 5385149 - DNA, 18 bp, Homo sapiens
caggcacccgtccccaca

SEQ ID NO: 5385150 - DNA, 19 bp, Homo sapiens
caggcacccgtccccacac

SEQ ID NO: 5385151 - DNA, 22 bp, Homo sapiens
caggcaccctcagggagcctcc

SEQ ID NO: 5385152 - DNA, 16 bp, Homo sapiens
caggcacccttctttc

SEQ ID NO: 5385153 - DNA, 16 bp, Homo sapiens
caggcaccgagaatgt

SEQ ID NO: 5385154 - DNA, 22 bp, Homo sapiens
caggcaccgccagagtgtcctg

SEQ ID NO: 5385155 - DNA, 13 bp, Homo sapiens
caggcaccgctgg

SEQ ID NO: 5385156 - DNA, 14 bp, Homo sapiens
caggcaccgggctg

SEQ ID NO: 5385157 - DNA, 16 bp, Homo sapiens
caggcaccgggctggc

SEQ ID NO: 5385158 - DNA, 18 bp, Homo sapiens
caggcaccgggctggctg

SEQ ID NO: 5385159 - DNA, 20 bp, Homo sapiens
caggcacctctaatcagacc

SEQ ID NO: 5385160 - DNA, 22 bp, Homo sapiens
caggcacctctaatcagacctt

SEQ ID NO: 5385161 - DNA, 19 bp, Homo sapiens
caggcacctggcctgctgg

SEQ ID NO: 5385162 - DNA, 21 bp, Homo sapiens
caggcacctggcctgctggga

SEQ ID NO: 5385163 - DNA, 19 bp, Homo sapiens
caggcacctgtagtcccag

SEQ ID NO: 5385164 - DNA, 19 bp, Homo sapiens
caggcaccttagtggcttt

SEQ ID NO: 5385165 - DNA, 17 bp, Homo sapiens
caggcacgaacccacct

SEQ ID NO: 5385166 - DNA, 20 bp, Homo sapiens
caggcacgaacccacctgct

SEQ ID NO: 5385167 - DNA, 22 bp, Homo sapiens
caggcacgaacccacctgctga

SEQ ID NO: 5385168 - DNA, 17 bp, Homo sapiens
caggcacgggtggtccc

SEQ ID NO: 5385169 - DNA, 15 bp, Homo sapiens
caggcacgtcccgga

SEQ ID NO: 5385170 - DNA, 23 bp, Homo sapiens
caggcactagcctttggctctgg

SEQ ID NO: 5385171 - DNA, 20 bp, Homo sapiens
caggcactcaatgcagccag

SEQ ID NO: 5385172 - DNA, 21 bp, Homo sapiens
caggcactctcatcaccccag

SEQ ID NO: 5385173 - DNA, 17 bp, Homo sapiens
caggcactgaacaggct

SEQ ID NO: 5385174 - DNA, 19 bp, Homo sapiens
caggcactgaacaggctgg

SEQ ID NO: 5385175 - DNA, 16 bp, Homo sapiens
caggcactgagaatga

SEQ ID NO: 5385176 - DNA, 23 bp, Homo sapiens
caggcactgagataccagcgagg

SEQ ID NO: 5385177 - DNA, 14 bp, Homo sapiens
caggcactggtggc

SEQ ID NO: 5385178 - DNA, 20 bp, Homo sapiens
caggcacttggcagccttgt

SEQ ID NO: 5385179 - DNA, 18 bp, Homo sapiens
caggcagaaaactggcag

SEQ ID NO: 5385180 - DNA, 15 bp, Homo sapiens
caggcagaaatagtt

SEQ ID NO: 5385181 - DNA, 21 bp, Homo sapiens
caggcagaaatagttgtctgt

SEQ ID NO: 5385182 - DNA, 16 bp, Homo sapiens
caggcagaaatataaa

SEQ ID NO: 5385183 - DNA, 15 bp, Homo sapiens
caggcagaaatattt

SEQ ID NO: 5385184 - DNA, 21 bp, Homo sapiens
caggcagaaccggtcccagcc

SEQ ID NO: 5385185 - DNA, 20 bp, Homo sapiens
caggcagaatggctgcacgt

SEQ ID NO: 5385186 - DNA, 10 bp, Homo sapiens
caggcagaca

SEQ ID NO: 5385187 - DNA, 18 bp, Homo sapiens
caggcagacaagagctgc

SEQ ID NO: 5385188 - DNA, 17 bp, Homo sapiens
caggcagacacatgctg

SEQ ID NO: 5385189 - DNA, 16 bp, Homo sapiens
caggcagacacggatc

SEQ ID NO: 5385190 - DNA, 21 bp, Homo sapiens
caggcagactacacaggatga

SEQ ID NO: 5385191 - DNA, 19 bp, Homo sapiens
caggcagagaacagaactg

SEQ ID NO: 5385192 - DNA, 15 bp, Homo sapiens
caggcagagaatcat

SEQ ID NO: 5385193 - DNA, 22 bp, Homo sapiens
caggcagagagcgaccagcagg

SEQ ID NO: 5385194 - DNA, 22 bp, Homo sapiens
caggcagagagtacagactgca

SEQ ID NO: 5385195 - DNA, 23 bp, Homo sapiens
caggcagagatcaggtgggcaga

SEQ ID NO: 5385196 - DNA, 21 bp, Homo sapiens
caggcagagctgacgggaggc

SEQ ID NO: 5385197 - DNA, 17 bp, Homo sapiens
caggcagagctgagggc

SEQ ID NO: 5385198 - DNA, 13 bp, Homo sapiens
caggcagaggaga

SEQ ID NO: 5385199 - DNA, 22 bp, Homo sapiens
caggcagaggatgttctggacc

SEQ ID NO: 5385200 - DNA, 17 bp, Homo sapiens
caggcagaggcccaggc

SEQ ID NO: 5385201 - DNA, 19 bp, Homo sapiens
caggcagaggcccaggctg

SEQ ID NO: 5385202 - DNA, 22 bp, Homo sapiens
caggcagaggttttaatgtctg

SEQ ID NO: 5385203 - DNA, 14 bp, Homo sapiens
caggcagagttctg

SEQ ID NO: 5385204 - DNA, 22 bp, Homo sapiens
caggcagataagttggagcagg

SEQ ID NO: 5385205 - DNA, 17 bp, Homo sapiens
caggcagatccaggact

SEQ ID NO: 5385206 - DNA, 18 bp, Homo sapiens
caggcagatccaggacta

SEQ ID NO: 5385207 - DNA, 13 bp, Homo sapiens
caggcagatctgt

SEQ ID NO: 5385208 - DNA, 15 bp, Homo sapiens
caggcagatctgtgc

SEQ ID NO: 5385209 - DNA, 17 bp, Homo sapiens
caggcagatctgtgccc

SEQ ID NO: 5385210 - DNA, 19 bp, Homo sapiens
caggcagcaaggtcatggt

SEQ ID NO: 5385211 - DNA, 14 bp, Homo sapiens
caggcagcagagac

SEQ ID NO: 5385212 - DNA, 12 bp, Homo sapiens
caggcagcagtg

SEQ ID NO: 5385213 - DNA, 16 bp, Homo sapiens
caggcagccacgtctc

SEQ ID NO: 5385214 - DNA, 13 bp, Homo sapiens
caggcagccagca

SEQ ID NO: 5385215 - DNA, 17 bp, Homo sapiens
caggcagccagcatctg

SEQ ID NO: 5385216 - DNA, 21 bp, Homo sapiens
caggcagccagcatctgggcc

SEQ ID NO: 5385217 - DNA, 16 bp, Homo sapiens
caggcagccagccgtg

SEQ ID NO: 5385218 - DNA, 22 bp, Homo sapiens
caggcagcccaaaagtttattg

SEQ ID NO: 5385219 - DNA, 14 bp, Homo sapiens
caggcagcctgaga

SEQ ID NO: 5385220 - DNA, 24 bp, Homo sapiens
caggcagcctgagagctggcccag

SEQ ID NO: 5385221 - DNA, 17 bp, Homo sapiens
caggcagccttgaccac

SEQ ID NO: 5385222 - DNA, 18 bp, Homo sapiens
caggcagcgatggtctca

SEQ ID NO: 5385223 - DNA, 22 bp, Homo sapiens
caggcagcgcagggctggcacg

SEQ ID NO: 5385224 - DNA, 19 bp, Homo sapiens
caggcagcgccaagtgcgt

SEQ ID NO: 5385225 - DNA, 17 bp, Homo sapiens
caggcagcgccactgtc

SEQ ID NO: 5385226 - DNA, 22 bp, Homo sapiens
caggcagcgccactgtccgctg

SEQ ID NO: 5385227 - DNA, 17 bp, Homo sapiens
caggcagcggggagggg

SEQ ID NO: 5385228 - DNA, 15 bp, Homo sapiens
caggcagctaggcag

SEQ ID NO: 5385229 - DNA, 18 bp, Homo sapiens
caggcagctaggcaggga

SEQ ID NO: 5385230 - DNA, 21 bp, Homo sapiens
caggcagctatttcagcctcc

SEQ ID NO: 5385231 - DNA, 16 bp, Homo sapiens
caggcagctccctcct

SEQ ID NO: 5385232 - DNA, 17 bp, Homo sapiens
caggcagctccctcctg

SEQ ID NO: 5385233 - DNA, 22 bp, Homo sapiens
caggcagctccctcctgcacac

SEQ ID NO: 5385234 - DNA, 15 bp, Homo sapiens
caggcagctcctgtt

SEQ ID NO: 5385235 - DNA, 18 bp, Homo sapiens
caggcagctcctgtttgg

SEQ ID NO: 5385236 - DNA, 17 bp, Homo sapiens
caggcagctctgagccg

SEQ ID NO: 5385237 - DNA, 11 bp, Homo sapiens
caggcagctgg

SEQ ID NO: 5385238 - DNA, 18 bp, Homo sapiens
caggcagctggatgagac

SEQ ID NO: 5385239 - DNA, 14 bp, Homo sapiens
caggcagctggcag

SEQ ID NO: 5385240 - DNA, 15 bp, Homo sapiens
caggcagctggcagg

SEQ ID NO: 5385241 - DNA, 16 bp, Homo sapiens
caggcagctggcagga

SEQ ID NO: 5385242 - DNA, 17 bp, Homo sapiens
caggccctctctgcagt

SEQ ID NO: 5385243 - DNA, 14 bp, Homo sapiens
caggccctctgccc

SEQ ID NO: 5385244 - DNA, 15 bp, Homo sapiens
caggccctctgcctg

SEQ ID NO: 5385245 - DNA, 18 bp, Homo sapiens
caggccctctgcctgcac

SEQ ID NO: 5385246 - DNA, 19 bp, Homo sapiens
caggccctctgcctgcact

SEQ ID NO: 5385247 - DNA, 23 bp, Homo sapiens
caggccctctgcctgcactccct

SEQ ID NO: 5385248 - DNA, 17 bp, Homo sapiens
caggccctctgtggcct

SEQ ID NO: 5385249 - DNA, 20 bp, Homo sapiens
caggccctctgtggcctgtc

SEQ ID NO: 5385250 - DNA, 18 bp, Homo sapiens
caggccctgactcctctg

SEQ ID NO: 5385251 - DNA, 12 bp, Homo sapiens
caggccctgcac

SEQ ID NO: 5385252 - DNA, 19 bp, Homo sapiens
caggccctgcactgtcctg

SEQ ID NO: 5385253 - DNA, 12 bp, Homo sapiens
caggccctgcag

SEQ ID NO: 5385254 - DNA, 15 bp, Homo sapiens
caggccctgcagtgt

SEQ ID NO: 5385255 - DNA, 17 bp, Homo sapiens
caggccctgcccagcca

SEQ ID NO: 5385256 - DNA, 13 bp, Homo sapiens
caggccctgctca

SEQ ID NO: 5385257 - DNA, 17 bp, Homo sapiens
caggccctgctcctgca

SEQ ID NO: 5385258 - DNA, 10 bp, Homo sapiens
caggccctgg

SEQ ID NO: 5385259 - DNA, 13 bp, Homo sapiens
caggccctggagg

SEQ ID NO: 5385260 - DNA, 16 bp, Homo sapiens
caggccctggagggca

SEQ ID NO: 5385261 - DNA, 17 bp, Homo sapiens
caggccctggagggcag

SEQ ID NO: 5385262 - DNA, 18 bp, Homo sapiens
caggccctggagggcaga

SEQ ID NO: 5385263 - DNA, 11 bp, Homo sapiens
caggccctggc

SEQ ID NO: 5385264 - DNA, 15 bp, Homo sapiens
caggccctgggcctc

SEQ ID NO: 5385265 - DNA, 16 bp, Homo sapiens
caggccctgggcctcc

SEQ ID NO: 5385266 - DNA, 17 bp, Homo sapiens
caggccctgggcctcca

SEQ ID NO: 5385267 - DNA, 14 bp, Homo sapiens
caggccctggtgga

SEQ ID NO: 5385268 - DNA, 14 bp, Homo sapiens
caggccctgtccag

SEQ ID NO: 5385269 - DNA, 15 bp, Homo sapiens
caggccctgtccagc

SEQ ID NO: 5385270 - DNA, 16 bp, Homo sapiens
caggccctgtccagcc

SEQ ID NO: 5385271 - DNA, 17 bp, Homo sapiens
caggccctgtccagccc

SEQ ID NO: 5385272 - DNA, 20 bp, Homo sapiens
caggccctgtccagccccca

SEQ ID NO: 5385273 - DNA, 17 bp, Homo sapiens
caggccctgtggcagga

SEQ ID NO: 5385274 - DNA, 18 bp, Homo sapiens
caggcccttagggaagtt

SEQ ID NO: 5385275 - DNA, 16 bp, Homo sapiens
caggcccttcctctcc

SEQ ID NO: 5385276 - DNA, 17 bp, Homo sapiens
caggcccttcctctcca

SEQ ID NO: 5385277 - DNA, 16 bp, Homo sapiens
caggcccttggctgca

SEQ ID NO: 5385278 - DNA, 13 bp, Homo sapiens
caggcccttgggg

SEQ ID NO: 5385279 - DNA, 21 bp, Homo sapiens
caggccctttgaagcctcagc

SEQ ID NO: 5385280 - DNA, 17 bp, Homo sapiens
caggccctttggcttct

SEQ ID NO: 5385281 - DNA, 16 bp, Homo sapiens
caggccgacaggaggc

SEQ ID NO: 5385282 - DNA, 21 bp, Homo sapiens
caggccgacagtcggtgaccc

SEQ ID NO: 5385283 - DNA, 18 bp, Homo sapiens
caggccgagaagccagtg

SEQ ID NO: 5385284 - DNA, 19 bp, Homo sapiens
caggccgaggaagggcccc

SEQ ID NO: 5385285 - DNA, 16 bp, Homo sapiens
caggccgaggcaggtg

SEQ ID NO: 5385286 - DNA, 23 bp, Homo sapiens
caggccgcatggcccctccagga

SEQ ID NO: 5385287 - DNA, 18 bp, Homo sapiens
caggccgccccagcctct

SEQ ID NO: 5385288 - DNA, 23 bp, Homo sapiens
caggccgccccagcctctgagcc

SEQ ID NO: 5385289 - DNA, 14 bp, Homo sapiens
caggccgcctgcca

SEQ ID NO: 5385290 - DNA, 15 bp, Homo sapiens
caggccgcctgccat

SEQ ID NO: 5385291 - DNA, 17 bp, Homo sapiens
caggccgcgcccagcag

SEQ ID NO: 5385292 - DNA, 18 bp, Homo sapiens
caggccggaaccacaggg

SEQ ID NO: 5385293 - DNA, 20 bp, Homo sapiens
caggccggaaccacagggcc

SEQ ID NO: 5385294 - DNA, 13 bp, Homo sapiens
caggccggagccc

SEQ ID NO: 5385295 - DNA, 15 bp, Homo sapiens
caggccggagcccag

SEQ ID NO: 5385296 - DNA, 16 bp, Homo sapiens
caggccggagcccaga

SEQ ID NO: 5385297 - DNA, 13 bp, Homo sapiens
caggccggcagcc

SEQ ID NO: 5385298 - DNA, 21 bp, Homo sapiens
caggccggcagccccagcctg

SEQ ID NO: 5385299 - DNA, 13 bp, Homo sapiens
caggccggccagc

SEQ ID NO: 5385300 - DNA, 16 bp, Homo sapiens
caggccggccagcctc

SEQ ID NO: 5385301 - DNA, 21 bp, Homo sapiens
caggccggccagcctcaccct

SEQ ID NO: 5385302 - DNA, 13 bp, Homo sapiens
caggccggcccag

SEQ ID NO: 5385303 - DNA, 16 bp, Homo sapiens
caggccgggcctgtac

SEQ ID NO: 5385304 - DNA, 21 bp, Homo sapiens
caggccgggcttgggccctgc

SEQ ID NO: 5385305 - DNA, 23 bp, Homo sapiens
caggccgggcttgggccctgcac

SEQ ID NO: 5385306 - DNA, 19 bp, Homo sapiens
caggccgggtgcagtggct

SEQ ID NO: 5385307 - DNA, 19 bp, Homo sapiens
caggccggtgtgggctgtg

SEQ ID NO: 5385308 - DNA, 22 bp, Homo sapiens
caggccgtcaccctgggagcag

SEQ ID NO: 5385309 - DNA, 17 bp, Homo sapiens
caggccgtgacgtctgg

SEQ ID NO: 5385310 - DNA, 18 bp, Homo sapiens
caggccgtgacgtctggg

SEQ ID NO: 5385311 - DNA, 19 bp, Homo sapiens
caggccgtgacgtctgggt

SEQ ID NO: 5385312 - DNA, 16 bp, Homo sapiens
caggccgtgccttgtt

SEQ ID NO: 5385313 - DNA, 19 bp, Homo sapiens
caggccgtgggacccaggc

SEQ ID NO: 5385314 - DNA, 22 bp, Homo sapiens
caggccgtgggacccaggctcc

SEQ ID NO: 5385315 - DNA, 19 bp, Homo sapiens
caggccgttccccttggct

SEQ ID NO: 5385316 - DNA, 15 bp, Homo sapiens
caggcctaagacatg

SEQ ID NO: 5385317 - DNA, 18 bp, Homo sapiens
caggcctaagacatgtga

SEQ ID NO: 5385318 - DNA, 19 bp, Homo sapiens
caggcctaatctcatacct

SEQ ID NO: 5385319 - DNA, 22 bp, Homo sapiens
caggcctacagccacatcccca

SEQ ID NO: 5385320 - DNA, 18 bp, Homo sapiens
caggcctacctcactctc

SEQ ID NO: 5385321 - DNA, 15 bp, Homo sapiens
caggcctactcctgt

SEQ ID NO: 5385322 - DNA, 16 bp, Homo sapiens
caggcctactcctgtc

SEQ ID NO: 5385323 - DNA, 17 bp, Homo sapiens
caggcctactcctgtct

SEQ ID NO: 5385324 - DNA, 13 bp, Homo sapiens
caggcctaggacc

SEQ ID NO: 5385325 - DNA, 14 bp, Homo sapiens
caggcctaggaggc

SEQ ID NO: 5385326 - DNA, 18 bp, Homo sapiens
caggcctaggaggccccc

SEQ ID NO: 5385327 - DNA, 20 bp, Homo sapiens
caggcctagtaaccaaggcc

SEQ ID NO: 5385328 - DNA, 22 bp, Homo sapiens
caggcctatgttgatccatcca

SEQ ID NO: 5385329 - DNA, 16 bp, Homo sapiens
caggcctcaccacctg

SEQ ID NO: 5385330 - DNA, 17 bp, Homo sapiens
caggcctcacccctccc

SEQ ID NO: 5385331 - DNA, 13 bp, Homo sapiens
caggcctcacctc

SEQ ID NO: 5385332 - DNA, 18 bp, Homo sapiens
caggcctcacctcccagg

SEQ ID NO: 5385333 - DNA, 20 bp, Homo sapiens
caggcctcacctcccagggc

SEQ ID NO: 5385334 - DNA, 16 bp, Homo sapiens
caggcctcacctggct

SEQ ID NO: 5385335 - DNA, 19 bp, Homo sapiens
caggcctcacctggcttcc

SEQ ID NO: 5385336 - DNA, 17 bp, Homo sapiens
caggcctcactggctca

SEQ ID NO: 5385337 - DNA, 14 bp, Homo sapiens
caggcctcagggct

SEQ ID NO: 5385338 - DNA, 20 bp, Homo sapiens
caggcctcatgcctcgctca

SEQ ID NO: 5385339 - DNA, 11 bp, Homo sapiens
caggcctccag

SEQ ID NO: 5385340 - DNA, 14 bp, Homo sapiens
caggcctccagcct

SEQ ID NO: 5385341 - DNA, 15 bp, Homo sapiens
caggcctccagcctc

SEQ ID NO: 5385342 - DNA, 18 bp, Homo sapiens
caggcctccagcctctcc

SEQ ID NO: 5385343 - DNA, 20 bp, Homo sapiens
caggcctccagcctctcccg

SEQ ID NO: 5385344 - DNA, 17 bp, Homo sapiens
caggcctccagcggcgg

SEQ ID NO: 5385345 - DNA, 13 bp, Homo sapiens
caggcctccagct

SEQ ID NO: 5385346 - DNA, 19 bp, Homo sapiens
caggcctccagctcagcag

SEQ ID NO: 5385347 - DNA, 22 bp, Homo sapiens
caggcctcccaaatatgcccct

SEQ ID NO: 5385348 - DNA, 15 bp, Homo sapiens
caggcctcccgcatg

SEQ ID NO: 5385349 - DNA, 20 bp, Homo sapiens
caggcctcccgcatgctgcc

SEQ ID NO: 5385350 - DNA, 23 bp, Homo sapiens
caggcctcccgcatgctgcctgc

SEQ ID NO: 5385351 - DNA, 17 bp, Homo sapiens
caggcctccctagcacc

SEQ ID NO: 5385352 - DNA, 12 bp, Homo sapiens
caggcctccctc

SEQ ID NO: 5385353 - DNA, 13 bp, Homo sapiens
caggcctccctcg

SEQ ID NO: 5385354 - DNA, 18 bp, Homo sapiens
caggcctccctcgggctg

SEQ ID NO: 5385355 - DNA, 13 bp, Homo sapiens
caggcctccctct

SEQ ID NO: 5385356 - DNA, 14 bp, Homo sapiens
caggcctccctctc

SEQ ID NO: 5385357 - DNA, 18 bp, Homo sapiens
caggcctccctctctctt

SEQ ID NO: 5385358 - DNA, 19 bp, Homo sapiens
caggcctccctctctcttc

SEQ ID NO: 5385359 - DNA, 23 bp, Homo sapiens
caggcctccctctctcttctgct

SEQ ID NO: 5385360 - DNA, 13 bp, Homo sapiens
caggcctccctgc

SEQ ID NO: 5385361 - DNA, 15 bp, Homo sapiens
caggcctccctgcag

SEQ ID NO: 5385362 - DNA, 16 bp, Homo sapiens
caggcctccctgccag

SEQ ID NO: 5385363 - DNA, 18 bp, Homo sapiens
caggcctccgtcttccca

SEQ ID NO: 5385364 - DNA, 14 bp, Homo sapiens
caggcctcctacag

SEQ ID NO: 5385365 - DNA, 19 bp, Homo sapiens
caggcctcctaggggaagg

SEQ ID NO: 5385366 - DNA, 19 bp, Homo sapiens
caggcctcgcctgccctcc

SEQ ID NO: 5385367 - DNA, 21 bp, Homo sapiens
caggcctcgcctgccctcctc

SEQ ID NO: 5385368 - DNA, 23 bp, Homo sapiens
caggcctcgcctgccctcctctc

SEQ ID NO: 5385369 - DNA, 22 bp, Homo sapiens
caggcctctactaggtctgctc

SEQ ID NO: 5385370 - DNA, 13 bp, Homo sapiens
caggcctctccat

SEQ ID NO: 5385371 - DNA, 22 bp, Homo sapiens
caggcctctccctcctccagga

SEQ ID NO: 5385372 - DNA, 14 bp, Homo sapiens
caggcctctctctg

SEQ ID NO: 5385373 - DNA, 16 bp, Homo sapiens
caggcctctctctgct

SEQ ID NO: 5385374 - DNA, 22 bp, Homo sapiens
caggcctctcttttccccgcct

SEQ ID NO: 5385375 - DNA, 23 bp, Homo sapiens
caggcctctcttttccccgcctg

SEQ ID NO: 5385376 - DNA, 12 bp, Homo sapiens
caggcctctgag

SEQ ID NO: 5385377 - DNA, 17 bp, Homo sapiens
caggcctctgagcccaa

SEQ ID NO: 5385378 - DNA, 15 bp, Homo sapiens
caggcctctgaggag

SEQ ID NO: 5385379 - DNA, 20 bp, Homo sapiens
caggcctctgaggagcccac

SEQ ID NO: 5385380 - DNA, 21 bp, Homo sapiens
caggcctctgcagaagccaag

SEQ ID NO: 5385381 - DNA, 16 bp, Homo sapiens
caggcctctgcctgct

SEQ ID NO: 5385382 - DNA, 14 bp, Homo sapiens
caggcctctgctgc

SEQ ID NO: 5385383 - DNA, 15 bp, Homo sapiens
caggcctctgctgcc

SEQ ID NO: 5385384 - DNA, 16 bp, Homo sapiens
caggcctctgctggct

SEQ ID NO: 5385385 - DNA, 19 bp, Homo sapiens
caggcctctgctggctcag

SEQ ID NO: 5385386 - DNA, 12 bp, Homo sapiens
caggcctctggg

SEQ ID NO: 5385387 - DNA, 13 bp, Homo sapiens
caggcctctggga

SEQ ID NO: 5385388 - DNA, 15 bp, Homo sapiens
caggcctctgggacc

SEQ ID NO: 5385389 - DNA, 22 bp, Homo sapiens
caggcctctgggacccacagaa

SEQ ID NO: 5385390 - DNA, 13 bp, Homo sapiens
caggcctctgtgt

SEQ ID NO: 5385391 - DNA, 14 bp, Homo sapiens
caggcctctgtgtc

SEQ ID NO: 5385392 - DNA, 15 bp, Homo sapiens
caggcctctgtgtcc

SEQ ID NO: 5385393 - DNA, 17 bp, Homo sapiens
caggcctctgtgtcctt

SEQ ID NO: 5385394 - DNA, 22 bp, Homo sapiens
caggcctctgtgtccttccctg

SEQ ID NO: 5385395 - DNA, 16 bp, Homo sapiens
caggcctcttcctgtt

SEQ ID NO: 5385396 - DNA, 12 bp, Homo sapiens
caggcctcttgg

SEQ ID NO: 5385397 - DNA, 19 bp, Homo sapiens
caggcctcttggcagtcac

SEQ ID NO: 5385398 - DNA, 20 bp, Homo sapiens
caggcctgaaagaggctgag

SEQ ID NO: 5385399 - DNA, 19 bp, Homo sapiens
caggcctgaagtcttctcc

SEQ ID NO: 5385400 - DNA, 14 bp, Homo sapiens
caggcctgaccagg

SEQ ID NO: 5385401 - DNA, 16 bp, Homo sapiens
caggcctgaccagggg

SEQ ID NO: 5385402 - DNA, 22 bp, Homo sapiens
caggcctgacccacggggcagt

SEQ ID NO: 5385403 - DNA, 20 bp, Homo sapiens
caggcctgattcactggcct

SEQ ID NO: 5385404 - DNA, 23 bp, Homo sapiens
caggcctgattcactggcctggc

SEQ ID NO: 5385405 - DNA, 20 bp, Homo sapiens
caggcctgcagacagacctc

SEQ ID NO: 5385406 - DNA, 17 bp, Homo sapiens
caggcctgccaatgcca

SEQ ID NO: 5385407 - DNA, 21 bp, Homo sapiens
caggcctgccaatgccacagc

SEQ ID NO: 5385408 - DNA, 23 bp, Homo sapiens
caggcctgccaatgccacagcca

SEQ ID NO: 5385409 - DNA, 14 bp, Homo sapiens
caggcctgccagac

SEQ ID NO: 5385410 - DNA, 22 bp, Homo sapiens
caggcctgccctcacgctctcc

SEQ ID NO: 5385411 - DNA, 14 bp, Homo sapiens
caggcctgccctgc

SEQ ID NO: 5385412 - DNA, 18 bp, Homo sapiens
caggcctgccctgctatt

SEQ ID NO: 5385413 - DNA, 15 bp, Homo sapiens
caggcctgctggcat

SEQ ID NO: 5385414 - DNA, 21 bp, Homo sapiens
caggcctgctggcatcaggtc

SEQ ID NO: 5385415 - DNA, 20 bp, Homo sapiens
caggcctggacgggccctcc

SEQ ID NO: 5385416 - DNA, 13 bp, Homo sapiens
caggcctggagcg

SEQ ID NO: 5385417 - DNA, 13 bp, Homo sapiens
caggcctggccct

SEQ ID NO: 5385418 - DNA, 16 bp, Homo sapiens
caggcctggcctcaac

SEQ ID NO: 5385419 - DNA, 15 bp, Homo sapiens
caggcctggcctcat

SEQ ID NO: 5385420 - DNA, 14 bp, Homo sapiens
caggcctggcctcg

SEQ ID NO: 5385421 - DNA, 17 bp, Homo sapiens
caggctgggtcctgcca

SEQ ID NO: 5385422 - DNA, 22 bp, Homo sapiens
caggctgggtcctgccagctgg

SEQ ID NO: 5385423 - DNA, 23 bp, Homo sapiens
caggctgggtcgccctggactgt

SEQ ID NO: 5385424 - DNA, 23 bp, Homo sapiens
caggctgggttgtcactgagact

SEQ ID NO: 5385425 - DNA, 18 bp, Homo sapiens
caggctggtatttaacag

SEQ ID NO: 5385426 - DNA, 21 bp, Homo sapiens
caggctggtccgagctgagga

SEQ ID NO: 5385427 - DNA, 16 bp, Homo sapiens
caggctggtctaaaac

SEQ ID NO: 5385428 - DNA, 18 bp, Homo sapiens
caggctggtctaaaactc

SEQ ID NO: 5385429 - DNA, 20 bp, Homo sapiens
caggctggtctcgaactcct

SEQ ID NO: 5385430 - DNA, 23 bp, Homo sapiens
caggctggtctcgaactcctgac

SEQ ID NO: 5385431 - DNA, 24 bp, Homo sapiens
caggctggtcttgaactgggctca

SEQ ID NO: 5385432 - DNA, 20 bp, Homo sapiens
caggctggtcttgaagtcct

SEQ ID NO: 5385433 - DNA, 13 bp, Homo sapiens
caggctggttctg

SEQ ID NO: 5385434 - DNA, 20 bp, Homo sapiens
caggctggttcttgggctag

SEQ ID NO: 5385435 - DNA, 16 bp, Homo sapiens
caggctggtttcaaac

SEQ ID NO: 5385436 - DNA, 21 bp, Homo sapiens
caggctggtttgcaagaatga

SEQ ID NO: 5385437 - DNA, 17 bp, Homo sapiens
caggctgtaaattgaac

SEQ ID NO: 5385438 - DNA, 13 bp, Homo sapiens
caggctgtaattc

SEQ ID NO: 5385439 - DNA, 14 bp, Homo sapiens
caggctgtatccca

SEQ ID NO: 5385440 - DNA, 21 bp, Homo sapiens
caggctgtatcccatgagcct

SEQ ID NO: 5385441 - DNA, 22 bp, Homo sapiens
caggctgtatcccatgagcctc

SEQ ID NO: 5385442 - DNA, 13 bp, Homo sapiens
caggctgtcccaa

SEQ ID NO: 5385443 - DNA, 15 bp, Homo sapiens
caggctgtcccaagc

SEQ ID NO: 5385444 - DNA, 18 bp, Homo sapiens
caggctgtctcatttatt

SEQ ID NO: 5385445 - DNA, 19 bp, Homo sapiens
caggctgtgcgctgacaac

SEQ ID NO: 5385446 - DNA, 16 bp, Homo sapiens
caggctgtgggcctca

SEQ ID NO: 5385447 - DNA, 19 bp, Homo sapiens
caggctgtggggcagctga

SEQ ID NO: 5385448 - DNA, 13 bp, Homo sapiens
caggctgtggggt

SEQ ID NO: 5385449 - DNA, 14 bp, Homo sapiens
caggctgtggggtg

SEQ ID NO: 5385450 - DNA, 19 bp, Homo sapiens
caggctgtgggtagatgtg

SEQ ID NO: 5385451 - DNA, 20 bp, Homo sapiens
caggctgtgggtagatgtgc

SEQ ID NO: 5385452 - DNA, 12 bp, Homo sapiens
caggctgtgtgt

SEQ ID NO: 5385453 - DNA, 24 bp, Homo sapiens
caggctgtgtgtggggcccaagca

SEQ ID NO: 5385454 - DNA, 22 bp, Homo sapiens
caggctgtgtttggctttcagg

SEQ ID NO: 5385455 - DNA, 22 bp, Homo sapiens
caggctgttattatgaaggaat

SEQ ID NO: 5385456 - DNA, 13 bp, Homo sapiens
caggctgttctca

SEQ ID NO: 5385457 - DNA, 15 bp, Homo sapiens
caggctgttctcagc

SEQ ID NO: 5385458 - DNA, 18 bp, Homo sapiens
caggctgttctccaggct

SEQ ID NO: 5385459 - DNA, 19 bp, Homo sapiens
caggctgttctccaggctt

SEQ ID NO: 5385460 - DNA, 20 bp, Homo sapiens
caggctgttctccaggcttc

SEQ ID NO: 5385461 - DNA, 18 bp, Homo sapiens
caggctgttctgcactga

SEQ ID NO: 5385462 - DNA, 19 bp, Homo sapiens
caggctgttctgcactgaa

SEQ ID NO: 5385463 - DNA, 21 bp, Homo sapiens
caggctgttctgcactgaaaa

SEQ ID NO: 5385464 - DNA, 21 bp, Homo sapiens
caggctgttggcgtgtcccag

SEQ ID NO: 5385465 - DNA, 23 bp, Homo sapiens
caggctgtttctttttttatgac

SEQ ID NO: 5385466 - DNA, 18 bp, Homo sapiens
caggctgtttttgggtgc

SEQ ID NO: 5385467 - DNA, 20 bp, Homo sapiens
caggcttaataaaaatgaca

SEQ ID NO: 5385468 - DNA, 17 bp, Homo sapiens
caggcttacgctgctct

SEQ ID NO: 5385469 - DNA, 19 bp, Homo sapiens
caggcttacgctgctctcc

SEQ ID NO: 5385470 - DNA, 16 bp, Homo sapiens
caggcttagtcactga

SEQ ID NO: 5385471 - DNA, 21 bp, Homo sapiens
caggcttagtcactgagacag

SEQ ID NO: 5385472 - DNA, 22 bp, Homo sapiens
caggcttagtcactgagacagc

SEQ ID NO: 5385473 - DNA, 21 bp, Homo sapiens
caggcttatgaatatatttaa

SEQ ID NO: 5385474 - DNA, 13 bp, Homo sapiens
caggcttcacagt

SEQ ID NO: 5385475 - DNA, 22 bp, Homo sapiens
caggcttcacagtctggtgctt

SEQ ID NO: 5385476 - DNA, 14 bp, Homo sapiens
caggcttccacact

SEQ ID NO: 5385477 - DNA, 12 bp, Homo sapiens
caggcttccgcg

SEQ ID NO: 5385478 - DNA, 14 bp, Homo sapiens
caggcttccgcgcc

SEQ ID NO: 5385479 - DNA, 13 bp, Homo sapiens
caggcttcctgcc

SEQ ID NO: 5385480 - DNA, 14 bp, Homo sapiens
caggcttcctgccc

SEQ ID NO: 5385481 - DNA, 19 bp, Homo sapiens
caggcttcctgccctagca

SEQ ID NO: 5385482 - DNA, 20 bp, Homo sapiens
caggcttcctgccctagcag

SEQ ID NO: 5385483 - DNA, 23 bp, Homo sapiens
caggcttcctgggtcctgcctgg

SEQ ID NO: 5385484 - DNA, 14 bp, Homo sapiens
caggcttcctggtg

SEQ ID NO: 5385485 - DNA, 15 bp, Homo sapiens
caggcttcctggtga

SEQ ID NO: 5385486 - DNA, 17 bp, Homo sapiens
caggcttcctggtgaga

SEQ ID NO: 5385487 - DNA, 19 bp, Homo sapiens
caggcttcctggtgagaac

SEQ ID NO: 5385488 - DNA, 14 bp, Homo sapiens
caggcttccttggc

SEQ ID NO: 5385489 - DNA, 17 bp, Homo sapiens
caggcttcgtttgcctc

SEQ ID NO: 5385490 - DNA, 15 bp, Homo sapiens
caggcttctcccgga

SEQ ID NO: 5385491 - DNA, 20 bp, Homo sapiens
caggcttctcttgctacctg

SEQ ID NO: 5385492 - DNA, 23 bp, Homo sapiens
caggcttctgagcagcgagcctg

SEQ ID NO: 5385493 - DNA, 15 bp, Homo sapiens
caggcttgagggagg

SEQ ID NO: 5385494 - DNA, 16 bp, Homo sapiens
caggcttgagggaggg

SEQ ID NO: 5385495 - DNA, 18 bp, Homo sapiens
caggcttgagttttcatt

SEQ ID NO: 5385496 - DNA, 13 bp, Homo sapiens
caggcttgcctgg

SEQ ID NO: 5385497 - DNA, 15 bp, Homo sapiens
caggcttgcctggga

SEQ ID NO: 5385498 - DNA, 15 bp, Homo sapiens
caggcttgcctgggc

SEQ ID NO: 5385499 - DNA, 16 bp, Homo sapiens
caggcttgcctgggct

SEQ ID NO: 5385500 - DNA, 17 bp, Homo sapiens
caggcttgggctccatt

SEQ ID NO: 5385501 - DNA, 21 bp, Homo sapiens
caggcttgggctccattccca

SEQ ID NO: 5385502 - DNA, 11 bp, Homo sapiens
caggcttgggg

SEQ ID NO: 5385503 - DNA, 13 bp, Homo sapiens
caggcttggggaa

SEQ ID NO: 5385504 - DNA, 20 bp, Homo sapiens
caggcttggggaaaatggcc

SEQ ID NO: 5385505 - DNA, 18 bp, Homo sapiens
caggctttcagctgtgct

SEQ ID NO: 5385506 - DNA, 13 bp, Homo sapiens
caggctttcccac

SEQ ID NO: 5385507 - DNA, 15 bp, Homo sapiens
caggctttccttgtt

SEQ ID NO: 5385508 - DNA, 13 bp, Homo sapiens
caggctttctaga

SEQ ID NO: 5385509 - DNA, 14 bp, Homo sapiens
caggctttctattg

SEQ ID NO: 5385510 - DNA, 19 bp, Homo sapiens
caggctttgtacagagtgc

SEQ ID NO: 5385511 - DNA, 16 bp, Homo sapiens
caggctttgtgagaga

SEQ ID NO: 5385512 - DNA, 23 bp, Homo sapiens
caggctttgtgagagaggacctc

SEQ ID NO: 5385513 - DNA, 15 bp, Homo sapiens
caggcttttgctaga

SEQ ID NO: 5385514 - DNA, 23 bp, Homo sapiens
caggcttttttatcatgtgaaat

SEQ ID NO: 5385515 - DNA, 12 bp, Homo sapiens
cagggaaaacag

SEQ ID NO: 5385516 - DNA, 19 bp, Homo sapiens
cagggaaaagcagctctcc

SEQ ID NO: 5385517 - DNA, 21 bp, Homo sapiens
cagggaaaagcagctctcccc

SEQ ID NO: 5385518 - DNA, 15 bp, Homo sapiens
cagggaaaataggca

SEQ ID NO: 5385519 - DNA, 15 bp, Homo sapiens
cagggaaaatatata

SEQ ID NO: 5385520 - DNA, 20 bp, Homo sapiens
cagggaaaatgcagcaggga

SEQ ID NO: 5385521 - DNA, 20 bp, Homo sapiens
cagggaaaattatttgcata

SEQ ID NO: 5385522 - DNA, 18 bp, Homo sapiens
cagggaaacaaagtttac

SEQ ID NO: 5385523 - DNA, 17 bp, Homo sapiens
cagggaaacagcctctc

SEQ ID NO: 5385524 - DNA, 22 bp, Homo sapiens
cagggaaacagctaatgggaca

SEQ ID NO: 5385525 - DNA, 13 bp, Homo sapiens
cagggaaagactg

SEQ ID NO: 5385526 - DNA, 12 bp, Homo sapiens
cagggaaaggaa

SEQ ID NO: 5385527 - DNA, 17 bp, Homo sapiens
cagggaaaggaaaagaa

SEQ ID NO: 5385528 - DNA, 18 bp, Homo sapiens
cagggaaaggtcagcccg

SEQ ID NO: 5385529 - DNA, 17 bp, Homo sapiens
cagggaaatggagggtg

SEQ ID NO: 5385530 - DNA, 18 bp, Homo sapiens
cagggaaatggagggtgg

SEQ ID NO: 5385531 - DNA, 21 bp, Homo sapiens
cagggaaatggagggtggggc

SEQ ID NO: 5385532 - DNA, 19 bp, Homo sapiens
cagggaaatggccttcccg

SEQ ID NO: 5385533 - DNA, 20 bp, Homo sapiens
cagggaaatgtgtatctatt

SEQ ID NO: 5385534 - DNA, 14 bp, Homo sapiens
cagggaacagcccc

SEQ ID NO: 5385535 - DNA, 15 bp, Homo sapiens
cagggaacagcccca

SEQ ID NO: 5385536 - DNA, 16 bp, Homo sapiens
cagggaacagccccag

SEQ ID NO: 5385537 - DNA, 17 bp, Homo sapiens
cagggaacagccccagg

SEQ ID NO: 5385538 - DNA, 13 bp, Homo sapiens
cagggaacagtat

SEQ ID NO: 5385539 - DNA, 20 bp, Homo sapiens
cagggaacatggggaggagg

SEQ ID NO: 5385540 - DNA, 19 bp, Homo sapiens
cagggaactaggaaggcac

SEQ ID NO: 5385541 - DNA, 15 bp, Homo sapiens
cagggaactgaccct

SEQ ID NO: 5385542 - DNA, 14 bp, Homo sapiens
cagggaactgggaa

SEQ ID NO: 5385543 - DNA, 16 bp, Homo sapiens
cagggaacttagtaag

SEQ ID NO: 5385544 - DNA, 12 bp, Homo sapiens
cagggaagaaac

SEQ ID NO: 5385545 - DNA, 15 bp, Homo sapiens
cagggaagacagagc

SEQ ID NO: 5385546 - DNA, 15 bp, Homo sapiens
cagggaagagcagaa

SEQ ID NO: 5385547 - DNA, 17 bp, Homo sapiens
cagggaagagcagaacg

SEQ ID NO: 5385548 - DNA, 14 bp, Homo sapiens
cagggaagaggcca

SEQ ID NO: 5385549 - DNA, 17 bp, Homo sapiens
cagggaagagggcagta

SEQ ID NO: 5385550 - DNA, 19 bp, Homo sapiens
cagggaagaggggtgcaga

SEQ ID NO: 5385551 - DNA, 15 bp, Homo sapiens
cagggaagcagcagc

SEQ ID NO: 5385552 - DNA, 13 bp, Homo sapiens
cagggaagcccag

SEQ ID NO: 5385553 - DNA, 24 bp, Homo sapiens
cagggaagccctcggcctccagac

SEQ ID NO: 5385554 - DNA, 16 bp, Homo sapiens
cagggaagccttgtgg

SEQ ID NO: 5385555 - DNA, 14 bp, Homo sapiens
cagggaagctacag

SEQ ID NO: 5385556 - DNA, 11 bp, Homo sapiens
cagggaagctt

SEQ ID NO: 5385557 - DNA, 18 bp, Homo sapiens
cagggaaggacaggaccc

SEQ ID NO: 5385558 - DNA, 16 bp, Homo sapiens
cagggaaggaggagcc

SEQ ID NO: 5385559 - DNA, 12 bp, Homo sapiens
cagggaaggcag

SEQ ID NO: 5385560 - DNA, 17 bp, Homo sapiens
cagggaaggcaggcagg

SEQ ID NO: 5385561 - DNA, 15 bp, Homo sapiens
cagggaaggcctgac

SEQ ID NO: 5385562 - DNA, 16 bp, Homo sapiens
cagggaaggcctgact

SEQ ID NO: 5385563 - DNA, 23 bp, Homo sapiens
cagggaaggcctgacttctgctg

SEQ ID NO: 5385564 - DNA, 15 bp, Homo sapiens
cagggaaggggacaa

SEQ ID NO: 5385565 - DNA, 18 bp, Homo sapiens
cagggaagggggagctgg

SEQ ID NO: 5385566 - DNA, 14 bp, Homo sapiens
cagggaagggtgcc

SEQ ID NO: 5385567 - DNA, 17 bp, Homo sapiens
cagggaagggtgcctgg

SEQ ID NO: 5385568 - DNA, 20 bp, Homo sapiens
cagggaagggtgcctggctg

SEQ ID NO: 5385569 - DNA, 17 bp, Homo sapiens
cagggaaggtgaaacag

SEQ ID NO: 5385570 - DNA, 22 bp, Homo sapiens
cagggaaggtggccacagcaag

SEQ ID NO: 5385571 - DNA, 17 bp, Homo sapiens
cagggaaggtggggccc

SEQ ID NO: 5385572 - DNA, 15 bp, Homo sapiens
cagggaagtggggag

SEQ ID NO: 5385573 - DNA, 21 bp, Homo sapiens
cagggaagtggggagaggtgg

SEQ ID NO: 5385574 - DNA, 22 bp, Homo sapiens
cagggaatactatacagccata

SEQ ID NO: 5385575 - DNA, 17 bp, Homo sapiens
cagggaatcagggacca

SEQ ID NO: 5385576 - DNA, 18 bp, Homo sapiens
cagggaatcagggagcac

SEQ ID NO: 5385577 - DNA, 21 bp, Homo sapiens
cagggaatcagggagcactgg

SEQ ID NO: 5385578 - DNA, 15 bp, Homo sapiens
cagggaatccagctc

SEQ ID NO: 5385579 - DNA, 22 bp, Homo sapiens
cagggaatccgcctgcagagga

SEQ ID NO: 5385580 - DNA, 23 bp, Homo sapiens
cagggaatccgcctgcagaggac

SEQ ID NO: 5385581 - DNA, 16 bp, Homo sapiens
cagggaatgctgaggc

SEQ ID NO: 5385582 - DNA, 20 bp, Homo sapiens
cagggaatgctgaggcctcg

SEQ ID NO: 5385583 - DNA, 15 bp, Homo sapiens
cagggaatggagaat

SEQ ID NO: 5385584 - DNA, 18 bp, Homo sapiens
cagggaatggccacaaac

SEQ ID NO: 5385585 - DNA, 20 bp, Homo sapiens
cagggaatggccacaaacct

SEQ ID NO: 5385586 - DNA, 18 bp, Homo sapiens
cagggaattaggccccca

SEQ ID NO: 5385587 - DNA, 16 bp, Homo sapiens
cagggaattcctgggg

SEQ ID NO: 5385588 - DNA, 15 bp, Homo sapiens
cagggaattcttaca

SEQ ID NO: 5385589 - DNA, 16 bp, Homo sapiens
cagggaatttctatct

SEQ ID NO: 5385590 - DNA, 23 bp, Homo sapiens
cagggacaaagaggcctttaacc

SEQ ID NO: 5385591 - DNA, 21 bp, Homo sapiens
cagggacaagccctggagaaa

SEQ ID NO: 5385592 - DNA, 17 bp, Homo sapiens
cagggacacatcccctt

SEQ ID NO: 5385593 - DNA, 17 bp, Homo sapiens
cagggacaccagccagg

SEQ ID NO: 5385594 - DNA, 22 bp, Homo sapiens
cagggacacctgggagaaatct

SEQ ID NO: 5385595 - DNA, 21 bp, Homo sapiens
cagggacacgggcagcctggc

SEQ ID NO: 5385596 - DNA, 19 bp, Homo sapiens
cagggacagagacacctgc

SEQ ID NO: 5385597 - DNA, 13 bp, Homo sapiens
cagggacagagat

SEQ ID NO: 5385598 - DNA, 20 bp, Homo sapiens
cagggccagggcaatgccat

SEQ ID NO: 5385599 - DNA, 15 bp, Homo sapiens
cagggccagggccct

SEQ ID NO: 5385600 - DNA, 18 bp, Homo sapiens
cagggccagggccctgca

SEQ ID NO: 5385601 - DNA, 14 bp, Homo sapiens
cagggccaggtcct

SEQ ID NO: 5385602 - DNA, 12 bp, Homo sapiens
cagggccaggtg

SEQ ID NO: 5385603 - DNA, 23 bp, Homo sapiens
cagggccaggtgcagaccttggg

SEQ ID NO: 5385604 - DNA, 16 bp, Homo sapiens
cagggccagtgcagtt

SEQ ID NO: 5385605 - DNA, 22 bp, Homo sapiens
cagggccatctcctcccaccag

SEQ ID NO: 5385606 - DNA, 14 bp, Homo sapiens
cagggccatgcaga

SEQ ID NO: 5385607 - DNA, 17 bp, Homo sapiens
cagggccatgcctgccc

SEQ ID NO: 5385608 - DNA, 23 bp, Homo sapiens
cagggccatgctgaggcctgggc

SEQ ID NO: 5385609 - DNA, 18 bp, Homo sapiens
cagggccatgtgctgccc

SEQ ID NO: 5385610 - DNA, 20 bp, Homo sapiens
cagggccatgtgctgccctg

SEQ ID NO: 5385611 - DNA, 18 bp, Homo sapiens
cagggcccaccccagcct

SEQ ID NO: 5385612 - DNA, 20 bp, Homo sapiens
cagggcccaccccagcctcg

SEQ ID NO: 5385613 - DNA, 21 bp, Homo sapiens
cagggcccaccttggaccctg

SEQ ID NO: 5385614 - DNA, 22 bp, Homo sapiens
cagggcccaccttggaccctgg

SEQ ID NO: 5385615 - DNA, 14 bp, Homo sapiens
cagggcccagagcc

SEQ ID NO: 5385616 - DNA, 18 bp, Homo sapiens
cagggcccagagcccagc

SEQ ID NO: 5385617 - DNA, 21 bp, Homo sapiens
cagggcccagagcccagctcc

SEQ ID NO: 5385618 - DNA, 22 bp, Homo sapiens
cagggcccagagcccagctcca

SEQ ID NO: 5385619 - DNA, 17 bp, Homo sapiens
cagggcccagagccctt

SEQ ID NO: 5385620 - DNA, 20 bp, Homo sapiens
cagggcccagagcccttgac

SEQ ID NO: 5385621 - DNA, 14 bp, Homo sapiens
cagggcccagcata

SEQ ID NO: 5385622 - DNA, 13 bp, Homo sapiens
cagggcccaggcc

SEQ ID NO: 5385623 - DNA, 15 bp, Homo sapiens
cagggcccaggccat

SEQ ID NO: 5385624 - DNA, 23 bp, Homo sapiens
cagggcccaggccatgtggcctg

SEQ ID NO: 5385625 - DNA, 15 bp, Homo sapiens
cagggcccaggcctg

SEQ ID NO: 5385626 - DNA, 17 bp, Homo sapiens
cagggcccaggcctgga

SEQ ID NO: 5385627 - DNA, 18 bp, Homo sapiens
cagggcccaggcctggag

SEQ ID NO: 5385628 - DNA, 14 bp, Homo sapiens
cagggcccagggag

SEQ ID NO: 5385629 - DNA, 22 bp, Homo sapiens
cagggcccagggaggtggcagg

SEQ ID NO: 5385630 - DNA, 17 bp, Homo sapiens
cagggcccatgtagctg

SEQ ID NO: 5385631 - DNA, 19 bp, Homo sapiens
cagggcccatgtagctggc

SEQ ID NO: 5385632 - DNA, 15 bp, Homo sapiens
cagggccccagaagg

SEQ ID NO: 5385633 - DNA, 16 bp, Homo sapiens
cagggccccagcacta

SEQ ID NO: 5385634 - DNA, 20 bp, Homo sapiens
cagggccccaggcattgcca

SEQ ID NO: 5385635 - DNA, 16 bp, Homo sapiens
cagggcccccaataaa

SEQ ID NO: 5385636 - DNA, 16 bp, Homo sapiens
cagggcccccacaggc

SEQ ID NO: 5385637 - DNA, 15 bp, Homo sapiens
cagggcccccatctc

SEQ ID NO: 5385638 - DNA, 21 bp, Homo sapiens
cagggcccccatctcatgccc

SEQ ID NO: 5385639 - DNA, 16 bp, Homo sapiens
cagggcccccctgacg

SEQ ID NO: 5385640 - DNA, 21 bp, Homo sapiens
cagggcccccggccacgctcc

SEQ ID NO: 5385641 - DNA, 22 bp, Homo sapiens
cagggcccctgaagtgacccca

SEQ ID NO: 5385642 - DNA, 23 bp, Homo sapiens
cagggcccctgaagtgaccccag

SEQ ID NO: 5385643 - DNA, 15 bp, Homo sapiens
cagggcccctggatc

SEQ ID NO: 5385644 - DNA, 22 bp, Homo sapiens
cagggcccgacctggggctgag

SEQ ID NO: 5385645 - DNA, 18 bp, Homo sapiens
cagggcccgcagtgctgg

SEQ ID NO: 5385646 - DNA, 20 bp, Homo sapiens
cagggcccggcacagagtcg

SEQ ID NO: 5385647 - DNA, 17 bp, Homo sapiens
cagggcccggccacacc

SEQ ID NO: 5385648 - DNA, 18 bp, Homo sapiens
cagggcccggccacaccc

SEQ ID NO: 5385649 - DNA, 19 bp, Homo sapiens
cagggcccgggaagcaaat

SEQ ID NO: 5385650 - DNA, 17 bp, Homo sapiens
cagggcccgggcccagg

SEQ ID NO: 5385651 - DNA, 16 bp, Homo sapiens
cagggccctcccagcc

SEQ ID NO: 5385652 - DNA, 15 bp, Homo sapiens
cagggccctgcagag

SEQ ID NO: 5385653 - DNA, 18 bp, Homo sapiens
cagggccctgcagagggg

SEQ ID NO: 5385654 - DNA, 13 bp, Homo sapiens
cagggccctgccc

SEQ ID NO: 5385655 - DNA, 17 bp, Homo sapiens
cagggccctgctcaggc

SEQ ID NO: 5385656 - DNA, 17 bp, Homo sapiens
cagggccctggccagcc

SEQ ID NO: 5385657 - DNA, 14 bp, Homo sapiens
cagggccctgggca

SEQ ID NO: 5385658 - DNA, 17 bp, Homo sapiens
cagggccctggggtctc

SEQ ID NO: 5385659 - DNA, 21 bp, Homo sapiens
cagggccctggggtctctgag

SEQ ID NO: 5385660 - DNA, 23 bp, Homo sapiens
cagggccctggggtctctgagca

SEQ ID NO: 5385661 - DNA, 22 bp, Homo sapiens
cagggccctgtgccaggccaaa

SEQ ID NO: 5385662 - DNA, 17 bp, Homo sapiens
cagggcccttggggctg

SEQ ID NO: 5385663 - DNA, 14 bp, Homo sapiens
cagggccgaccaga

SEQ ID NO: 5385664 - DNA, 15 bp, Homo sapiens
cagggccgagaggac

SEQ ID NO: 5385665 - DNA, 22 bp, Homo sapiens
cagggccgaggaggtgcctgga

SEQ ID NO: 5385666 - DNA, 16 bp, Homo sapiens
cagggccgccagggag

SEQ ID NO: 5385667 - DNA, 23 bp, Homo sapiens
cagggccgcccgggcccagagga

SEQ ID NO: 5385668 - DNA, 23 bp, Homo sapiens
cagggccgccgaagggcagcccc

SEQ ID NO: 5385669 - DNA, 16 bp, Homo sapiens
cagggccgcttctcct

SEQ ID NO: 5385670 - DNA, 16 bp, Homo sapiens
cagggccgggcagggg

SEQ ID NO: 5385671 - DNA, 20 bp, Homo sapiens
cagggccggggaactggcca

SEQ ID NO: 5385672 - DNA, 23 bp, Homo sapiens
cagggccggggaactggccaagc

SEQ ID NO: 5385673 - DNA, 21 bp, Homo sapiens
cagggccggtcgggggggacc

SEQ ID NO: 5385674 - DNA, 21 bp, Homo sapiens
cagggcctactgccacccgct

SEQ ID NO: 5385675 - DNA, 20 bp, Homo sapiens
cagggcctagctgctacaaa

SEQ ID NO: 5385676 - DNA, 22 bp, Homo sapiens
cagggcctagctgctacaaaga

SEQ ID NO: 5385677 - DNA, 14 bp, Homo sapiens
cagggcctagcttt

SEQ ID NO: 5385678 - DNA, 13 bp, Homo sapiens
cagggcctcatct

SEQ ID NO: 5385679 - DNA, 17 bp, Homo sapiens
cagggcctcatctcacc

SEQ ID NO: 5385680 - DNA, 18 bp, Homo sapiens
cagggcctcatctcacct

SEQ ID NO: 5385681 - DNA, 15 bp, Homo sapiens
cagggcctccagggc

SEQ ID NO: 5385682 - DNA, 21 bp, Homo sapiens
cagggcctcctgggggacctt

SEQ ID NO: 5385683 - DNA, 11 bp, Homo sapiens
cagggcctctg

SEQ ID NO: 5385684 - DNA, 17 bp, Homo sapiens
cagggcctctgcggagc

SEQ ID NO: 5385685 - DNA, 21 bp, Homo sapiens
cagggcctctgcggagcacac

SEQ ID NO: 5385686 - DNA, 13 bp, Homo sapiens
cagggcctctggc

SEQ ID NO: 5385687 - DNA, 23 bp, Homo sapiens
cagggcctctggcttccctgccc

SEQ ID NO: 5385688 - DNA, 23 bp, Homo sapiens
cagggcctctgtcaattgtacgc

SEQ ID NO: 5385689 - DNA, 17 bp, Homo sapiens
cagggcctgaaacccgc

SEQ ID NO: 5385690 - DNA, 23 bp, Homo sapiens
cagggcctgaaacccgccctcag

SEQ ID NO: 5385691 - DNA, 20 bp, Homo sapiens
cagggcctgacaccccctcc

SEQ ID NO: 5385692 - DNA, 13 bp, Homo sapiens
cagggcctgactt

SEQ ID NO: 5385693 - DNA, 17 bp, Homo sapiens
cagggcctgagcagctg

SEQ ID NO: 5385694 - DNA, 22 bp, Homo sapiens
cagggcctgagcctggccagcc

SEQ ID NO: 5385695 - DNA, 13 bp, Homo sapiens
cagggcctgagtg

SEQ ID NO: 5385696 - DNA, 14 bp, Homo sapiens
cagggcctgagtga

SEQ ID NO: 5385697 - DNA, 18 bp, Homo sapiens
cagggcctgagtgacctc

SEQ ID NO: 5385698 - DNA, 23 bp, Homo sapiens
cagggcctgcatgggggcaccgg

SEQ ID NO: 5385699 - DNA, 22 bp, Homo sapiens
cagggcctgcggaggcggtggc

SEQ ID NO: 5385700 - DNA, 18 bp, Homo sapiens
cagggcctgcttcccctt

SEQ ID NO: 5385701 - DNA, 13 bp, Homo sapiens
cagggcctggagc

SEQ ID NO: 5385702 - DNA, 15 bp, Homo sapiens
cagggcctggagccc

SEQ ID NO: 5385703 - DNA, 14 bp, Homo sapiens
cagggcctggcagg

SEQ ID NO: 5385704 - DNA, 12 bp, Homo sapiens
cagggcctggcc

SEQ ID NO: 5385705 - DNA, 23 bp, Homo sapiens
cagggcctggccttgtccccagc

SEQ ID NO: 5385706 - DNA, 14 bp, Homo sapiens
cagggcctggctca

SEQ ID NO: 5385707 - DNA, 15 bp, Homo sapiens
cagggcctggctcag

SEQ ID NO: 5385708 - DNA, 22 bp, Homo sapiens
cagggcctggctgggagtggca

SEQ ID NO: 5385709 - DNA, 11 bp, Homo sapiens
cagggcctggg

SEQ ID NO: 5385710 - DNA, 21 bp, Homo sapiens
cagggcctgggcctcatggct

SEQ ID NO: 5385711 - DNA, 12 bp, Homo sapiens
cagggcctgggg

SEQ ID NO: 5385712 - DNA, 22 bp, Homo sapiens
cagggcctggggagatggagga

SEQ ID NO: 5385713 - DNA, 14 bp, Homo sapiens
cagggcctggggcc

SEQ ID NO: 5385714 - DNA, 19 bp, Homo sapiens
cagggcctggggcctgaga

SEQ ID NO: 5385715 - DNA, 22 bp, Homo sapiens
cagggcctggggcctgagagaa

SEQ ID NO: 5385716 - DNA, 23 bp, Homo sapiens
cagggcctggggcctgagagaat

SEQ ID NO: 5385717 - DNA, 16 bp, Homo sapiens
cagggcctgggggcag

SEQ ID NO: 5385718 - DNA, 18 bp, Homo sapiens
cagggcctgggggcagtg

SEQ ID NO: 5385719 - DNA, 20 bp, Homo sapiens
cagggcctgggggcagtgac

SEQ ID NO: 5385720 - DNA, 21 bp, Homo sapiens
cagggcctgggggcagtgact

SEQ ID NO: 5385721 - DNA, 12 bp, Homo sapiens
cagggcctggtt

SEQ ID NO: 5385722 - DNA, 13 bp, Homo sapiens
cagggcctggttg

SEQ ID NO: 5385723 - DNA, 12 bp, Homo sapiens
cagggcctgtct

SEQ ID NO: 5385724 - DNA, 16 bp, Homo sapiens
cagggcctgtctccct

SEQ ID NO: 5385725 - DNA, 17 bp, Homo sapiens
cagggccttctgcctgc

SEQ ID NO: 5385726 - DNA, 16 bp, Homo sapiens
cagggccttgacaagt

SEQ ID NO: 5385727 - DNA, 13 bp, Homo sapiens
cagggccttgccc

SEQ ID NO: 5385728 - DNA, 14 bp, Homo sapiens
cagggccttgccca

SEQ ID NO: 5385729 - DNA, 15 bp, Homo sapiens
cagggccttgcccag

SEQ ID NO: 5385730 - DNA, 22 bp, Homo sapiens
cagggcctttctcctccccacc

SEQ ID NO: 5385731 - DNA, 11 bp, Homo sapiens
cagggcctttt

SEQ ID NO: 5385732 - DNA, 13 bp, Homo sapiens
cagggcgagactc

SEQ ID NO: 5385733 - DNA, 20 bp, Homo sapiens
cagggcgagactctgtctca

SEQ ID NO: 5385734 - DNA, 14 bp, Homo sapiens
cagggcgagctgca

SEQ ID NO: 5385735 - DNA, 23 bp, Homo sapiens
cagggcgataaaactaaatatat

SEQ ID NO: 5385736 - DNA, 13 bp, Homo sapiens
cagggcgcaagcc

SEQ ID NO: 5385737 - DNA, 20 bp, Homo sapiens
cagggcgccaagtctggcac

SEQ ID NO: 5385738 - DNA, 20 bp, Homo sapiens
cagggcgcccctgggagaca

SEQ ID NO: 5385739 - DNA, 13 bp, Homo sapiens
cagggcgctcaga

SEQ ID NO: 5385740 - DNA, 15 bp, Homo sapiens
cagggcgctcagacg

SEQ ID NO: 5385741 - DNA, 19 bp, Homo sapiens
cagggcgctcagacggcgg

SEQ ID NO: 5385742 - DNA, 15 bp, Homo sapiens
cagggcgctccggca

SEQ ID NO: 5385743 - DNA, 18 bp, Homo sapiens
cagggcgctccggcagag

SEQ ID NO: 5385744 - DNA, 20 bp, Homo sapiens
cagggcgctccggcagaggc

SEQ ID NO: 5385745 - DNA, 16 bp, Homo sapiens
cagggcgctgggaagg

SEQ ID NO: 5385746 - DNA, 13 bp, Homo sapiens
cagggcggccagg

SEQ ID NO: 5385747 - DNA, 14 bp, Homo sapiens
cagggcggccaggg

SEQ ID NO: 5385748 - DNA, 17 bp, Homo sapiens
cagggcggccagggacc

SEQ ID NO: 5385749 - DNA, 17 bp, Homo sapiens
cagggcggcctcccagg

SEQ ID NO: 5385750 - DNA, 19 bp, Homo sapiens
cagggcggcctcccaggtc

SEQ ID NO: 5385751 - DNA, 17 bp, Homo sapiens
cagggcgggcagagggc

SEQ ID NO: 5385752 - DNA, 20 bp, Homo sapiens
cagggcgggcagagggctgg

SEQ ID NO: 5385753 - DNA, 22 bp, Homo sapiens
cagggcgggcagagggctggag

SEQ ID NO: 5385754 - DNA, 14 bp, Homo sapiens
cagggcgggccagg

SEQ ID NO: 5385755 - DNA, 17 bp, Homo sapiens
cagggcgggccaggaga

SEQ ID NO: 5385756 - DNA, 18 bp, Homo sapiens
cagggcggggctggccag

SEQ ID NO: 5385757 - DNA, 15 bp, Homo sapiens
cagggcggggggggt

SEQ ID NO: 5385758 - DNA, 22 bp, Homo sapiens
cagggcggtaccttgtgcccag

SEQ ID NO: 5385759 - DNA, 13 bp, Homo sapiens
cagggcgtgagga

SEQ ID NO: 5385760 - DNA, 17 bp, Homo sapiens
cagggctaaggccccca

SEQ ID NO: 5385761 - DNA, 15 bp, Homo sapiens
cagggctacacagac

SEQ ID NO: 5385762 - DNA, 16 bp, Homo sapiens
cagggctacacagacc

SEQ ID NO: 5385763 - DNA, 21 bp, Homo sapiens
cagggctagtgaagtggcctc

SEQ ID NO: 5385764 - DNA, 17 bp, Homo sapiens
cagggctcacactcctg

SEQ ID NO: 5385765 - DNA, 12 bp, Homo sapiens
cagggctcacag

SEQ ID NO: 5385766 - DNA, 16 bp, Homo sapiens
cagggctcacagggca

SEQ ID NO: 5385767 - DNA, 18 bp, Homo sapiens
cagggctcacagggcagg

SEQ ID NO: 5385768 - DNA, 19 bp, Homo sapiens
cagggctcacagggcaggc

SEQ ID NO: 5385769 - DNA, 17 bp, Homo sapiens
cagggctcaccagctgg

SEQ ID NO: 5385770 - DNA, 18 bp, Homo sapiens
cagggctcagagtgaccc

SEQ ID NO: 5385771 - DNA, 18 bp, Homo sapiens
cagggctcagatggggcc

SEQ ID NO: 5385772 - DNA, 16 bp, Homo sapiens
cagggctcagcctggt

SEQ ID NO: 5385773 - DNA, 19 bp, Homo sapiens
cagggctcagcctggtggg

SEQ ID NO: 5385774 - DNA, 14 bp, Homo sapiens
cagggctccagcct

SEQ ID NO: 5385775 - DNA, 13 bp, Homo sapiens
cagggtccctctg

SEQ ID NO: 5385776 - DNA, 14 bp, Homo sapiens
cagggtccctggtg

SEQ ID NO: 5385777 - DNA, 18 bp, Homo sapiens
cagggtccctggtggcag

SEQ ID NO: 5385778 - DNA, 19 bp, Homo sapiens
cagggtccctggtggcagc

SEQ ID NO: 5385779 - DNA, 23 bp, Homo sapiens
cagggtccctggtggcagctcac

SEQ ID NO: 5385780 - DNA, 16 bp, Homo sapiens
cagggtccgcaccagc

SEQ ID NO: 5385781 - DNA, 21 bp, Homo sapiens
cagggtccgcaccagctgctc

SEQ ID NO: 5385782 - DNA, 23 bp, Homo sapiens
cagggtccgcaccagctgctctg

SEQ ID NO: 5385783 - DNA, 19 bp, Homo sapiens
cagggtcctaaaacttgga

SEQ ID NO: 5385784 - DNA, 16 bp, Homo sapiens
cagggtcctcagctca

SEQ ID NO: 5385785 - DNA, 20 bp, Homo sapiens
cagggtcctccggggctcag

SEQ ID NO: 5385786 - DNA, 19 bp, Homo sapiens
cagggtcctctagcccact

SEQ ID NO: 5385787 - DNA, 21 bp, Homo sapiens
cagggtcctgccctccggagg

SEQ ID NO: 5385788 - DNA, 12 bp, Homo sapiens
cagggtcctgct

SEQ ID NO: 5385789 - DNA, 14 bp, Homo sapiens
cagggtcctgggag

SEQ ID NO: 5385790 - DNA, 12 bp, Homo sapiens
cagggtcctgtg

SEQ ID NO: 5385791 - DNA, 13 bp, Homo sapiens
cagggtcctgtgc

SEQ ID NO: 5385792 - DNA, 22 bp, Homo sapiens
cagggtccttttgacactgctc

SEQ ID NO: 5385793 - DNA, 18 bp, Homo sapiens
cagggtctaaagagaaca

SEQ ID NO: 5385794 - DNA, 17 bp, Homo sapiens
cagggtctagccgctgc

SEQ ID NO: 5385795 - DNA, 18 bp, Homo sapiens
cagggtctcactctgtcg

SEQ ID NO: 5385796 - DNA, 22 bp, Homo sapiens
cagggtctcactctgtcgccca

SEQ ID NO: 5385797 - DNA, 23 bp, Homo sapiens
cagggtctcactctgtcgcccag

SEQ ID NO: 5385798 - DNA, 14 bp, Homo sapiens
cagggtctcactgt

SEQ ID NO: 5385799 - DNA, 16 bp, Homo sapiens
cagggtctcgtcagga

SEQ ID NO: 5385800 - DNA, 17 bp, Homo sapiens
cagggtctcgtcaggag

SEQ ID NO: 5385801 - DNA, 21 bp, Homo sapiens
cagggtctctaccatcccctg

SEQ ID NO: 5385802 - DNA, 20 bp, Homo sapiens
cagggtctctagtgctgtga

SEQ ID NO: 5385803 - DNA, 21 bp, Homo sapiens
cagggtctctagtgctgtgaa

SEQ ID NO: 5385804 - DNA, 14 bp, Homo sapiens
cagggtctctcagg

SEQ ID NO: 5385805 - DNA, 18 bp, Homo sapiens
cagggtctctccctcagg

SEQ ID NO: 5385806 - DNA, 13 bp, Homo sapiens
cagggtctctgct

SEQ ID NO: 5385807 - DNA, 17 bp, Homo sapiens
cagggtctctgctgccg

SEQ ID NO: 5385808 - DNA, 15 bp, Homo sapiens
cagggtctcttcctt

SEQ ID NO: 5385809 - DNA, 16 bp, Homo sapiens
cagggtctgagtgcaa

SEQ ID NO: 5385810 - DNA, 14 bp, Homo sapiens
cagggtctgcctcc

SEQ ID NO: 5385811 - DNA, 19 bp, Homo sapiens
cagggtctgcctccagcca

SEQ ID NO: 5385812 - DNA, 21 bp, Homo sapiens
cagggtctgctctttctctgc

SEQ ID NO: 5385813 - DNA, 23 bp, Homo sapiens
cagggtctgctctttctctgcca

SEQ ID NO: 5385814 - DNA, 14 bp, Homo sapiens
cagggtctggcaga

SEQ ID NO: 5385815 - DNA, 17 bp, Homo sapiens
cagggtctggcagagcc

SEQ ID NO: 5385816 - DNA, 18 bp, Homo sapiens
cagggtctggcagagcct

SEQ ID NO: 5385817 - DNA, 19 bp, Homo sapiens
cagggtctggcagagcctc

SEQ ID NO: 5385818 - DNA, 20 bp, Homo sapiens
cagggtctggcagagcctct

SEQ ID NO: 5385819 - DNA, 15 bp, Homo sapiens
cagggtctgggcagg

SEQ ID NO: 5385820 - DNA, 14 bp, Homo sapiens
cagggtctgggctg

SEQ ID NO: 5385821 - DNA, 15 bp, Homo sapiens
cagggtctgtgtgaa

SEQ ID NO: 5385822 - DNA, 17 bp, Homo sapiens
cagggtcttccctacct

SEQ ID NO: 5385823 - DNA, 22 bp, Homo sapiens
cagggtcttccctacctcaggc

SEQ ID NO: 5385824 - DNA, 20 bp, Homo sapiens
cagggtcttgctctgtcccc

SEQ ID NO: 5385825 - DNA, 19 bp, Homo sapiens
cagggtcttgggctactgg

SEQ ID NO: 5385826 - DNA, 18 bp, Homo sapiens
cagggtctttgtgtgctg

SEQ ID NO: 5385827 - DNA, 20 bp, Homo sapiens
cagggtcttttttcatttct

SEQ ID NO: 5385828 - DNA, 19 bp, Homo sapiens
cagggtgacaaggcctgct

SEQ ID NO: 5385829 - DNA, 13 bp, Homo sapiens
cagggtgacgcct

SEQ ID NO: 5385830 - DNA, 17 bp, Homo sapiens
cagggtgacgcctgaga

SEQ ID NO: 5385831 - DNA, 19 bp, Homo sapiens
cagggtgacggtgacaaag

SEQ ID NO: 5385832 - DNA, 15 bp, Homo sapiens
cagggtgagaagcta

SEQ ID NO: 5385833 - DNA, 17 bp, Homo sapiens
cagggtgagcagggccc

SEQ ID NO: 5385834 - DNA, 14 bp, Homo sapiens
cagggtgaggatgg

SEQ ID NO: 5385835 - DNA, 16 bp, Homo sapiens
cagggtgcacacagga

SEQ ID NO: 5385836 - DNA, 15 bp, Homo sapiens
cagggtgcagcccaa

SEQ ID NO: 5385837 - DNA, 21 bp, Homo sapiens
cagggtgcatggcttggggag

SEQ ID NO: 5385838 - DNA, 17 bp, Homo sapiens
cagggtgctccctcctc

SEQ ID NO: 5385839 - DNA, 13 bp, Homo sapiens
cagggtgctggga

SEQ ID NO: 5385840 - DNA, 13 bp, Homo sapiens
cagggtgctgtgg

SEQ ID NO: 5385841 - DNA, 14 bp, Homo sapiens
cagggtggaccagg

SEQ ID NO: 5385842 - DNA, 18 bp, Homo sapiens
cagggtggaccaggcctg

SEQ ID NO: 5385843 - DNA, 20 bp, Homo sapiens
cagggtggaccaggcctgga

SEQ ID NO: 5385844 - DNA, 21 bp, Homo sapiens
cagggtggaccaggcctggag

SEQ ID NO: 5385845 - DNA, 22 bp, Homo sapiens
cagggtggaccaggcctggagg

SEQ ID NO: 5385846 - DNA, 22 bp, Homo sapiens
cagggtggagctgagaagagga

SEQ ID NO: 5385847 - DNA, 12 bp, Homo sapiens
cagggtggccac

SEQ ID NO: 5385848 - DNA, 17 bp, Homo sapiens
cagggtggccacacagg

SEQ ID NO: 5385849 - DNA, 21 bp, Homo sapiens
cagggtggccacacaggcagg

SEQ ID NO: 5385850 - DNA, 21 bp, Homo sapiens
cagggtggccccctgtgccag

SEQ ID NO: 5385851 - DNA, 23 bp, Homo sapiens
cagggtggccccctgtgccagct

SEQ ID NO: 5385852 - DNA, 17 bp, Homo sapiens
cagggtggctgccagcc

SEQ ID NO: 5385853 - DNA, 21 bp, Homo sapiens
cagggtggctggggctggcac

SEQ ID NO: 5385854 - DNA, 17 bp, Homo sapiens
cagggtgggaagaaaga

SEQ ID NO: 5385855 - DNA, 20 bp, Homo sapiens
cagggtgggaagaaagaatg

SEQ ID NO: 5385856 - DNA, 14 bp, Homo sapiens
cagggtgggagagc

SEQ ID NO: 5385857 - DNA, 22 bp, Homo sapiens
cagggtgggagccgggaccctc

SEQ ID NO: 5385858 - DNA, 18 bp, Homo sapiens
cagggtgggagggaggag

SEQ ID NO: 5385859 - DNA, 21 bp, Homo sapiens
cagggtgggagggaggaggga

SEQ ID NO: 5385860 - DNA, 19 bp, Homo sapiens
cagggtgggatgagcctct

SEQ ID NO: 5385861 - DNA, 20 bp, Homo sapiens
cagggtgggatgagcctctc

SEQ ID NO: 5385862 - DNA, 17 bp, Homo sapiens
cagggtgggcaaactct

SEQ ID NO: 5385863 - DNA, 18 bp, Homo sapiens
cagggtgggcagcctatg

SEQ ID NO: 5385864 - DNA, 22 bp, Homo sapiens
cagggtgggctggggactctgg

SEQ ID NO: 5385865 - DNA, 23 bp, Homo sapiens
cagggtgggctggggactctggc

SEQ ID NO: 5385866 - DNA, 16 bp, Homo sapiens
cagggtgggcttcctg

SEQ ID NO: 5385867 - DNA, 16 bp, Homo sapiens
cagggtgggcttgtgg

SEQ ID NO: 5385868 - DNA, 15 bp, Homo sapiens
cagggtggggaggga

SEQ ID NO: 5385869 - DNA, 12 bp, Homo sapiens
cagggtgggggg

SEQ ID NO: 5385870 - DNA, 16 bp, Homo sapiens
cagggtggggggtgac

SEQ ID NO: 5385871 - DNA, 18 bp, Homo sapiens
cagggtggggtctgggag

SEQ ID NO: 5385872 - DNA, 18 bp, Homo sapiens
cagggtgggtgagctctc

SEQ ID NO: 5385873 - DNA, 21 bp, Homo sapiens
cagggtgggtgagctctcagg

SEQ ID NO: 5385874 - DNA, 17 bp, Homo sapiens
cagggtgggtgtccatg

SEQ ID NO: 5385875 - DNA, 20 bp, Homo sapiens
cagggtgggtgtccatgtgc

SEQ ID NO: 5385876 - DNA, 17 bp, Homo sapiens
cagggtggtgctgggac

SEQ ID NO: 5385877 - DNA, 17 bp, Homo sapiens
cagggtggttagaggaa

SEQ ID NO: 5385878 - DNA, 21 bp, Homo sapiens
cagggtggttagaggaaaaga

SEQ ID NO: 5385879 - DNA, 22 bp, Homo sapiens
cagggtgtgaacatgttctcca

SEQ ID NO: 5385880 - DNA, 23 bp, Homo sapiens
cagggtgtgaggtttcacctccg

SEQ ID NO: 5385881 - DNA, 19 bp, Homo sapiens
cagggtgtggccctgccat

SEQ ID NO: 5385882 - DNA, 15 bp, Homo sapiens
cagggtgtggtatga

SEQ ID NO: 5385883 - DNA, 20 bp, Homo sapiens
cagggtgtggtatgaggggg

SEQ ID NO: 5385884 - DNA, 12 bp, Homo sapiens
cagggtgtgtct

SEQ ID NO: 5385885 - DNA, 20 bp, Homo sapiens
cagggtgttacaaggcactt

SEQ ID NO: 5385886 - DNA, 21 bp, Homo sapiens
cagggttaagcctgtaattat

SEQ ID NO: 5385887 - DNA, 20 bp, Homo sapiens
cagggttaggaatctcttca

SEQ ID NO: 5385888 - DNA, 21 bp, Homo sapiens
cagggttccagacagggtggg

SEQ ID NO: 5385889 - DNA, 17 bp, Homo sapiens
cagggttcccccagccc

SEQ ID NO: 5385890 - DNA, 21 bp, Homo sapiens
cagggttcccgcggggctgtc

SEQ ID NO: 5385891 - DNA, 17 bp, Homo sapiens
cagggttctagaagggg

SEQ ID NO: 5385892 - DNA, 19 bp, Homo sapiens
cagggttctagaaggggcg

SEQ ID NO: 5385893 - DNA, 21 bp, Homo sapiens
cagggttctagaaggggcgag

SEQ ID NO: 5385894 - DNA, 17 bp, Homo sapiens
cagggttctcctctccc

SEQ ID NO: 5385895 - DNA, 13 bp, Homo sapiens
cagggttctgtat

SEQ ID NO: 5385896 - DNA, 19 bp, Homo sapiens
cagggttgaccccagagga

SEQ ID NO: 5385897 - DNA, 14 bp, Homo sapiens
cagggttggcccct

SEQ ID NO: 5385898 - DNA, 16 bp, Homo sapiens
cagggttggcccctgc

SEQ ID NO: 5385899 - DNA, 17 bp, Homo sapiens
cagggttggcccctgcc

SEQ ID NO: 5385900 - DNA, 21 bp, Homo sapiens
cagggttggcccctgcccggc

SEQ ID NO: 5385901 - DNA, 20 bp, Homo sapiens
cagggttgggcccagatctg

SEQ ID NO: 5385902 - DNA, 14 bp, Homo sapiens
cagggttggggggt

SEQ ID NO: 5385903 - DNA, 15 bp, Homo sapiens
cagggttggtgtgct

SEQ ID NO: 5385904 - DNA, 19 bp, Homo sapiens
cagggttgtgctttctagc

SEQ ID NO: 5385905 - DNA, 17 bp, Homo sapiens
cagggtttacccagtgg

SEQ ID NO: 5385906 - DNA, 22 bp, Homo sapiens
cagggtttacccagtgggacag

SEQ ID NO: 5385907 - DNA, 20 bp, Homo sapiens
cagggtttcaccatgttggc

SEQ ID NO: 5385908 - DNA, 20 bp, Homo sapiens
cagggtttcgagaagctgct

SEQ ID NO: 5385909 - DNA, 13 bp, Homo sapiens
cagggtttgagca

SEQ ID NO: 5385910 - DNA, 16 bp, Homo sapiens
cagggtttgagcacaa

SEQ ID NO: 5385911 - DNA, 23 bp, Homo sapiens
cagggtttgtcagaggaacaaac

SEQ ID NO: 5385912 - DNA, 15 bp, Homo sapiens
cagggttttaacttt

SEQ ID NO: 5385913 - DNA, 17 bp, Homo sapiens
cagggttttatctctgt

SEQ ID NO: 5385914 - DNA, 23 bp, Homo sapiens
cagggttttgccccaagtcctca

SEQ ID NO: 5385915 - DNA, 13 bp, Homo sapiens
cagggtttttacc

SEQ ID NO: 5385916 - DNA, 18 bp, Homo sapiens
cagggttttttcattttt

SEQ ID NO: 5385917 - DNA, 17 bp, Homo sapiens
cagggttttttggccta

SEQ ID NO: 5385918 - DNA, 14 bp, Homo sapiens
caggtaaaatattt

SEQ ID NO: 5385919 - DNA, 23 bp, Homo sapiens
caggtaaaatattttccaaagag

SEQ ID NO: 5385920 - DNA, 16 bp, Homo sapiens
caggtaaacacataaa

SEQ ID NO: 5385921 - DNA, 15 bp, Homo sapiens
caggtaaactcctgt

SEQ ID NO: 5385922 - DNA, 19 bp, Homo sapiens
caggtaaagggcaaataat

SEQ ID NO: 5385923 - DNA, 14 bp, Homo sapiens
caggtaacactaca

SEQ ID NO: 5385924 - DNA, 16 bp, Homo sapiens
caggtaacaggcagat

SEQ ID NO: 5385925 - DNA, 21 bp, Homo sapiens
caggtaacaggcagatacagg

SEQ ID NO: 5385926 - DNA, 17 bp, Homo sapiens
caggtaacattataaat

SEQ ID NO: 5385927 - DNA, 19 bp, Homo sapiens
caggtaacattataaatga

SEQ ID NO: 5385928 - DNA, 16 bp, Homo sapiens
caggtaagatgttaat

SEQ ID NO: 5385929 - DNA, 12 bp, Homo sapiens
caggtaagtggc

SEQ ID NO: 5385930 - DNA, 16 bp, Homo sapiens
caggtaagtggcagga

SEQ ID NO: 5385931 - DNA, 15 bp, Homo sapiens
caggtaataataaag

SEQ ID NO: 5385932 - DNA, 21 bp, Homo sapiens
caggtaatatacctggtttac

SEQ ID NO: 5385933 - DNA, 15 bp, Homo sapiens
caggtaatatgtctt

SEQ ID NO: 5385934 - DNA, 19 bp, Homo sapiens
caggtaatcgacctgcctc

SEQ ID NO: 5385935 - DNA, 17 bp, Homo sapiens
caggtaatgagggactg

SEQ ID NO: 5385936 - DNA, 22 bp, Homo sapiens
caggtaatgagggactggaacc

SEQ ID NO: 5385937 - DNA, 23 bp, Homo sapiens
caggtaatgagggactggaacca

SEQ ID NO: 5385938 - DNA, 13 bp, Homo sapiens
caggtaatgtgaa

SEQ ID NO: 5385939 - DNA, 19 bp, Homo sapiens
caggtacaaccggatgcca

SEQ ID NO: 5385940 - DNA, 16 bp, Homo sapiens
caggtacacatatttt

SEQ ID NO: 5385941 - DNA, 16 bp, Homo sapiens
caggtacagagaagga

SEQ ID NO: 5385942 - DNA, 17 bp, Homo sapiens
caggtacatttctgatt

SEQ ID NO: 5385943 - DNA, 19 bp, Homo sapiens
caggtaccacccttcagac

SEQ ID NO: 5385944 - DNA, 21 bp, Homo sapiens
caggtaccacccttcagaccc

SEQ ID NO: 5385945 - DNA, 14 bp, Homo sapiens
caggtaccagctgc

SEQ ID NO: 5385946 - DNA, 14 bp, Homo sapiens
caggtaccagttct

SEQ ID NO: 5385947 - DNA, 21 bp, Homo sapiens
caggtacccttctcgcttttg

SEQ ID NO: 5385948 - DNA, 23 bp, Homo sapiens
caggtaccttgacctttgtacag

SEQ ID NO: 5385949 - DNA, 15 bp, Homo sapiens
caggtacgcacagac

SEQ ID NO: 5385950 - DNA, 24 bp, Homo sapiens
caggtacggagaagaatagaggtc

SEQ ID NO: 5385951 - DNA, 18 bp, Homo sapiens
caggtggcctaaggctgc

SEQ ID NO: 5385952 - DNA, 14 bp, Homo sapiens
caggtggcctccct

SEQ ID NO: 5385953 - DNA, 18 bp, Homo sapiens
caggtggcctctgctggt

SEQ ID NO: 5385954 - DNA, 15 bp, Homo sapiens
caggtggcctggagg

SEQ ID NO: 5385955 - DNA, 15 bp, Homo sapiens
caggtggctattttg

SEQ ID NO: 5385956 - DNA, 16 bp, Homo sapiens
caggtggctgacccag

SEQ ID NO: 5385957 - DNA, 19 bp, Homo sapiens
caggtggctgacccagtcc

SEQ ID NO: 5385958 - DNA, 23 bp, Homo sapiens
caggtggctgacccagtccctgg

SEQ ID NO: 5385959 - DNA, 12 bp, Homo sapiens
caggtgggactt

SEQ ID NO: 5385960 - DNA, 19 bp, Homo sapiens
caggtgggagagacactcc

SEQ ID NO: 5385961 - DNA, 15 bp, Homo sapiens
caggtgggcactgga

SEQ ID NO: 5385962 - DNA, 18 bp, Homo sapiens
caggtgggcactggagca

SEQ ID NO: 5385963 - DNA, 16 bp, Homo sapiens
caggtgggccctctga

SEQ ID NO: 5385964 - DNA, 13 bp, Homo sapiens
caggtgggcctgg

SEQ ID NO: 5385965 - DNA, 17 bp, Homo sapiens
caggtgggcctggcggc

SEQ ID NO: 5385966 - DNA, 23 bp, Homo sapiens
caggtgggcctggcggcctgtgg

SEQ ID NO: 5385967 - DNA, 23 bp, Homo sapiens
caggtgggctggacttctacctg

SEQ ID NO: 5385968 - DNA, 14 bp, Homo sapiens
caggtgggctgggc

SEQ ID NO: 5385969 - DNA, 20 bp, Homo sapiens
caggtggggactgggcacag

SEQ ID NO: 5385970 - DNA, 19 bp, Homo sapiens
caggtggggagactgggct

SEQ ID NO: 5385971 - DNA, 22 bp, Homo sapiens
caggtggggagactgggctgag

SEQ ID NO: 5385972 - DNA, 23 bp, Homo sapiens
caggtggggagactgggctgagg

SEQ ID NO: 5385973 - DNA, 12 bp, Homo sapiens
caggtggggagg

SEQ ID NO: 5385974 - DNA, 20 bp, Homo sapiens
caggtggggagtccagggct

SEQ ID NO: 5385975 - DNA, 22 bp, Homo sapiens
caggtggggagtccagggctcc

SEQ ID NO: 5385976 - DNA, 13 bp, Homo sapiens
caggtggggcagc

SEQ ID NO: 5385977 - DNA, 15 bp, Homo sapiens
caggtggggcctcag

SEQ ID NO: 5385978 - DNA, 19 bp, Homo sapiens
caggtggggcctcagcctg

SEQ ID NO: 5385979 - DNA, 18 bp, Homo sapiens
caggtgggggtgggctgc

SEQ ID NO: 5385980 - DNA, 20 bp, Homo sapiens
caggtgggggtgggctgctg

SEQ ID NO: 5385981 - DNA, 20 bp, Homo sapiens
caggtggggtcactctggca

SEQ ID NO: 5385982 - DNA, 19 bp, Homo sapiens
caggtggggttcgagggga

SEQ ID NO: 5385983 - DNA, 18 bp, Homo sapiens
caggtgggtgctgccctg

SEQ ID NO: 5385984 - DNA, 22 bp, Homo sapiens
caggtgggtgtgggacacctgg

SEQ ID NO: 5385985 - DNA, 21 bp, Homo sapiens
caggtggtgagaaatttctgt

SEQ ID NO: 5385986 - DNA, 16 bp, Homo sapiens
caggtggtggaggggc

SEQ ID NO: 5385987 - DNA, 22 bp, Homo sapiens
caggtggtggaggggcgcccag

SEQ ID NO: 5385988 - DNA, 21 bp, Homo sapiens
caggtggtggcactgagcccc

SEQ ID NO: 5385989 - DNA, 21 bp, Homo sapiens
caggtggtggctgcaaggtgg

SEQ ID NO: 5385990 - DNA, 18 bp, Homo sapiens
caggtggtgtcactgtcc

SEQ ID NO: 5385991 - DNA, 19 bp, Homo sapiens
caggtggtgtcactgtccc

SEQ ID NO: 5385992 - DNA, 20 bp, Homo sapiens
caggtggtgtcactgtccct

SEQ ID NO: 5385993 - DNA, 20 bp, Homo sapiens
caggtggtgtccttcttcct

SEQ ID NO: 5385994 - DNA, 19 bp, Homo sapiens
caggtggtgtcgggccctt

SEQ ID NO: 5385995 - DNA, 20 bp, Homo sapiens
caggtggttaccaggcactg

SEQ ID NO: 5385996 - DNA, 20 bp, Homo sapiens
caggtggttatggagagggt

SEQ ID NO: 5385997 - DNA, 21 bp, Homo sapiens
caggtggttgggttctgcctt

SEQ ID NO: 5385998 - DNA, 12 bp, Homo sapiens
caggtgtaaata

SEQ ID NO: 5385999 - DNA, 13 bp, Homo sapiens
caggtgtaataag

SEQ ID NO: 5386000 - DNA, 23 bp, Homo sapiens
caggtgtagctgagctgtgacat

SEQ ID NO: 5386001 - DNA, 14 bp, Homo sapiens
caggtgtcaggccc

SEQ ID NO: 5386002 - DNA, 21 bp, Homo sapiens
caggtgtcatggactgttgcc

SEQ ID NO: 5386003 - DNA, 19 bp, Homo sapiens
caggtgtccccagcccact

SEQ ID NO: 5386004 - DNA, 18 bp, Homo sapiens
caggtgtccctgcacttg

SEQ ID NO: 5386005 - DNA, 14 bp, Homo sapiens
caggtgtcctgact

SEQ ID NO: 5386006 - DNA, 15 bp, Homo sapiens
caggtgtcctgagca

SEQ ID NO: 5386007 - DNA, 21 bp, Homo sapiens
caggtgtcctttcccctctct

SEQ ID NO: 5386008 - DNA, 14 bp, Homo sapiens
caggtgtcgaggcc

SEQ ID NO: 5386009 - DNA, 18 bp, Homo sapiens
caggtgtctagaggcaac

SEQ ID NO: 5386010 - DNA, 15 bp, Homo sapiens
caggtgtctatccac

SEQ ID NO: 5386011 - DNA, 18 bp, Homo sapiens
caggtgtctgccccctct

SEQ ID NO: 5386012 - DNA, 17 bp, Homo sapiens
caggtgtcttggaccca

SEQ ID NO: 5386013 - DNA, 22 bp, Homo sapiens
caggtgtctttaactgtcattg

SEQ ID NO: 5386014 - DNA, 12 bp, Homo sapiens
caggtgtgaacc

SEQ ID NO: 5386015 - DNA, 16 bp, Homo sapiens
caggtgtgaaccacca

SEQ ID NO: 5386016 - DNA, 19 bp, Homo sapiens
caggtgtgacccactgcgc

SEQ ID NO: 5386017 - DNA, 19 bp, Homo sapiens
caggtgtgaccctgagggc

SEQ ID NO: 5386018 - DNA, 23 bp, Homo sapiens
caggtgtgactctagcaaggctc

SEQ ID NO: 5386019 - DNA, 16 bp, Homo sapiens
caggtgtgagccacca

SEQ ID NO: 5386020 - DNA, 23 bp, Homo sapiens
caggtgtgagccaccacacctgg

SEQ ID NO: 5386021 - DNA, 21 bp, Homo sapiens
caggtgtgagccaccacgccc

SEQ ID NO: 5386022 - DNA, 15 bp, Homo sapiens
caggtgtgagccact

SEQ ID NO: 5386023 - DNA, 23 bp, Homo sapiens
caggtgtgagtcaccaagcccag

SEQ ID NO: 5386024 - DNA, 19 bp, Homo sapiens
caggtgtgcacagaaaacc

SEQ ID NO: 5386025 - DNA, 14 bp, Homo sapiens
caggtgtgcccctc

SEQ ID NO: 5386026 - DNA, 15 bp, Homo sapiens
caggtgtgcccctcc

SEQ ID NO: 5386027 - DNA, 14 bp, Homo sapiens
caggtgtgcctgtg

SEQ ID NO: 5386028 - DNA, 15 bp, Homo sapiens
caggtgtgcctgtgc

SEQ ID NO: 5386029 - DNA, 19 bp, Homo sapiens
caggtgtgcctgtgctcct

SEQ ID NO: 5386030 - DNA, 23 bp, Homo sapiens
caggtgtgcctgtgctcctgccc

SEQ ID NO: 5386031 - DNA, 17 bp, Homo sapiens
caggtgtgggctcccac

SEQ ID NO: 5386032 - DNA, 21 bp, Homo sapiens
caggtgtgggctcccacgccc

SEQ ID NO: 5386033 - DNA, 17 bp, Homo sapiens
caggtgtggtggctcat

SEQ ID NO: 5386034 - DNA, 15 bp, Homo sapiens
caggtgtgtgggcca

SEQ ID NO: 5386035 - DNA, 15 bp, Homo sapiens
caggtgtgtgtgaac

SEQ ID NO: 5386036 - DNA, 24 bp, Homo sapiens
caggtgtgtgtgaactgggcacag

SEQ ID NO: 5386037 - DNA, 22 bp, Homo sapiens
caggtgttactgtaattcctca

SEQ ID NO: 5386038 - DNA, 17 bp, Homo sapiens
caggtgttccgtgggac

SEQ ID NO: 5386039 - DNA, 15 bp, Homo sapiens
caggtgttctgctga

SEQ ID NO: 5386040 - DNA, 14 bp, Homo sapiens
caggtgttgccaaa

SEQ ID NO: 5386041 - DNA, 16 bp, Homo sapiens
caggtgttgggacctg

SEQ ID NO: 5386042 - DNA, 19 bp, Homo sapiens
caggtgttgggacctgctg

SEQ ID NO: 5386043 - DNA, 16 bp, Homo sapiens
caggtgtttagttgca

SEQ ID NO: 5386044 - DNA, 16 bp, Homo sapiens
caggtgtttctttcct

SEQ ID NO: 5386045 - DNA, 22 bp, Homo sapiens
caggtgtttggcacccaaatca

SEQ ID NO: 5386046 - DNA, 23 bp, Homo sapiens
caggtgtttggcacccaaatcac

SEQ ID NO: 5386047 - DNA, 20 bp, Homo sapiens
caggtgttttaagactgaat

SEQ ID NO: 5386048 - DNA, 16 bp, Homo sapiens
caggttaaatatataa

SEQ ID NO: 5386049 - DNA, 20 bp, Homo sapiens
caggttaaatatataaacaa

SEQ ID NO: 5386050 - DNA, 16 bp, Homo sapiens
caggttaaatgttttg

SEQ ID NO: 5386051 - DNA, 15 bp, Homo sapiens
caggttacaacagat

SEQ ID NO: 5386052 - DNA, 16 bp, Homo sapiens
caggttacaacagatt

SEQ ID NO: 5386053 - DNA, 22 bp, Homo sapiens
caggttaccagaaccagtacct

SEQ ID NO: 5386054 - DNA, 14 bp, Homo sapiens
caggttaccttggc

SEQ ID NO: 5386055 - DNA, 19 bp, Homo sapiens
caggttagaacctagaagg

SEQ ID NO: 5386056 - DNA, 12 bp, Homo sapiens
caggttagagaa

SEQ ID NO: 5386057 - DNA, 17 bp, Homo sapiens
caggttagtgacattta

SEQ ID NO: 5386058 - DNA, 23 bp, Homo sapiens
caggttatcgaaataacaatgtt

SEQ ID NO: 5386059 - DNA, 19 bp, Homo sapiens
caggttatgtcagcagctc

SEQ ID NO: 5386060 - DNA, 21 bp, Homo sapiens
caggttattttagtttctgtt

SEQ ID NO: 5386061 - DNA, 16 bp, Homo sapiens
caggttcaacccacag

SEQ ID NO: 5386062 - DNA, 22 bp, Homo sapiens
caggttcaagcgattctcctgc

SEQ ID NO: 5386063 - DNA, 23 bp, Homo sapiens
caggttcacactcagaaagaggt

SEQ ID NO: 5386064 - DNA, 15 bp, Homo sapiens
caggttcacccagcg

SEQ ID NO: 5386065 - DNA, 22 bp, Homo sapiens
caggttcatggattacttctct

SEQ ID NO: 5386066 - DNA, 16 bp, Homo sapiens
caggttccatccacca

SEQ ID NO: 5386067 - DNA, 19 bp, Homo sapiens
caggttccatccaccacct

SEQ ID NO: 5386068 - DNA, 23 bp, Homo sapiens
caggttccatccaccaccttgcc

SEQ ID NO: 5386069 - DNA, 15 bp, Homo sapiens
caggttcccaagctc

SEQ ID NO: 5386070 - DNA, 14 bp, Homo sapiens
caggttcccactta

SEQ ID NO: 5386071 - DNA, 20 bp, Homo sapiens
caggttcccagcagctgggc

SEQ ID NO: 5386072 - DNA, 17 bp, Homo sapiens
caggttccccaagggcc

SEQ ID NO: 5386073 - DNA, 20 bp, Homo sapiens
caggttccccaagggccctg

SEQ ID NO: 5386074 - DNA, 18 bp, Homo sapiens
caggttccctcccagagg

SEQ ID NO: 5386075 - DNA, 23 bp, Homo sapiens
caggttccctcccagaggagcca

SEQ ID NO: 5386076 - DNA, 14 bp, Homo sapiens
caggttccctgcca

SEQ ID NO: 5386077 - DNA, 16 bp, Homo sapiens
caggttccctgccaca

SEQ ID NO: 5386078 - DNA, 15 bp, Homo sapiens
caggttcctcctagg

SEQ ID NO: 5386079 - DNA, 13 bp, Homo sapiens
caggttcctgggg

SEQ ID NO: 5386080 - DNA, 21 bp, Homo sapiens
caggttcctggggccgcctgc

SEQ ID NO: 5386081 - DNA, 22 bp, Homo sapiens
caggttcctggggccgcctgcc

SEQ ID NO: 5386082 - DNA, 23 bp, Homo sapiens
caggttcctggggccgcctgccc

SEQ ID NO: 5386083 - DNA, 15 bp, Homo sapiens
caggttcctgtggag

SEQ ID NO: 5386084 - DNA, 17 bp, Homo sapiens
caggttcctgtggagac

SEQ ID NO: 5386085 - DNA, 19 bp, Homo sapiens
caggttccttttgaagctc

SEQ ID NO: 5386086 - DNA, 14 bp, Homo sapiens
caggttcctttttc

SEQ ID NO: 5386087 - DNA, 15 bp, Homo sapiens
caggttcctttttca

SEQ ID NO: 5386088 - DNA, 22 bp, Homo sapiens
caggttcgtatagaaaaagcac

SEQ ID NO: 5386089 - DNA, 14 bp, Homo sapiens
caggttctctcctg

SEQ ID NO: 5386090 - DNA, 19 bp, Homo sapiens
caggttctctcctgtgagc

SEQ ID NO: 5386091 - DNA, 23 bp, Homo sapiens
caggttctgaaagagtctttctt

SEQ ID NO: 5386092 - DNA, 20 bp, Homo sapiens
caggttctggttagctcagc

SEQ ID NO: 5386093 - DNA, 23 bp, Homo sapiens
caggttctggttagctcagcccc

SEQ ID NO: 5386094 - DNA, 18 bp, Homo sapiens
caggttcttcttcctgaa

SEQ ID NO: 5386095 - DNA, 16 bp, Homo sapiens
caggttgacaggaggt

SEQ ID NO: 5386096 - DNA, 15 bp, Homo sapiens
caggttgactaagaa

SEQ ID NO: 5386097 - DNA, 21 bp, Homo sapiens
caggttgaggggctcctggaa

SEQ ID NO: 5386098 - DNA, 22 bp, Homo sapiens
caggttgatcagtgagctcagg

SEQ ID NO: 5386099 - DNA, 19 bp, Homo sapiens
caggttgctggttgctgtg

SEQ ID NO: 5386100 - DNA, 20 bp, Homo sapiens
caggttgctggttgctgtgt

SEQ ID NO: 5386101 - DNA, 21 bp, Homo sapiens
caggttgctggttgctgtgtg

SEQ ID NO: 5386102 - DNA, 18 bp, Homo sapiens
caggttgctttgccctgg

SEQ ID NO: 5386103 - DNA, 22 bp, Homo sapiens
caggttggaaaagaaatcaatt

SEQ ID NO: 5386104 - DNA, 15 bp, Homo sapiens
caggttggaagagaa

SEQ ID NO: 5386105 - DNA, 20 bp, Homo sapiens
caggttggaagagaatcacc

SEQ ID NO: 5386106 - DNA, 21 bp, Homo sapiens
caggttggaaggggccttgct

SEQ ID NO: 5386107 - DNA, 19 bp, Homo sapiens
caggttggcaaacgggctt

SEQ ID NO: 5386108 - DNA, 20 bp, Homo sapiens
caggttggcaaacgggcttg

SEQ ID NO: 5386109 - DNA, 16 bp, Homo sapiens
caggttggctctgcca

SEQ ID NO: 5386110 - DNA, 22 bp, Homo sapiens
caggttggctctgccagtcctg

SEQ ID NO: 5386111 - DNA, 19 bp, Homo sapiens
caggttgggaacatgctgg

SEQ ID NO: 5386112 - DNA, 13 bp, Homo sapiens
caggttgggccat

SEQ ID NO: 5386113 - DNA, 21 bp, Homo sapiens
caggttgggccatactggcct

SEQ ID NO: 5386114 - DNA, 14 bp, Homo sapiens
caggttggtggggg

SEQ ID NO: 5386115 - DNA, 15 bp, Homo sapiens
caggttggttttgct

SEQ ID NO: 5386116 - DNA, 14 bp, Homo sapiens
caggttgtcctcaa

SEQ ID NO: 5386117 - DNA, 23 bp, Homo sapiens
caggttgtgaaataatttttaac

SEQ ID NO: 5386118 - DNA, 20 bp, Homo sapiens
caggttgttagaaaaatgga

SEQ ID NO: 5386119 - DNA, 16 bp, Homo sapiens
caggttgttggtgact

SEQ ID NO: 5386120 - DNA, 21 bp, Homo sapiens
caggttgttttatagaggttc

SEQ ID NO: 5386121 - DNA, 20 bp, Homo sapiens
caggtttaaaagttgtgcat

SEQ ID NO: 5386122 - DNA, 15 bp, Homo sapiens
caggtttaacatttg

SEQ ID NO: 5386123 - DNA, 14 bp, Homo sapiens
caggtttaagctgt

SEQ ID NO: 5386124 - DNA, 18 bp, Homo sapiens
caggtttaagctgttact

SEQ ID NO: 5386125 - DNA, 21 bp, Homo sapiens
caggtttaagtagatttcatg

SEQ ID NO: 5386126 - DNA, 22 bp, Homo sapiens
cagtcatcagtcatcaggtgtg

SEQ ID NO: 5386127 - DNA, 13 bp, Homo sapiens
cagtcatcatcag

SEQ ID NO: 5386128 - DNA, 17 bp, Homo sapiens
cagtcatcatcagggcc

SEQ ID NO: 5386129 - DNA, 23 bp, Homo sapiens
cagtcatcatcagggcctggggc

SEQ ID NO: 5386130 - DNA, 21 bp, Homo sapiens
cagtcatcatctcttgataaa

SEQ ID NO: 5386131 - DNA, 16 bp, Homo sapiens
cagtcatcctgccctg

SEQ ID NO: 5386132 - DNA, 20 bp, Homo sapiens
cagtcatcgtaggtgatttg

SEQ ID NO: 5386133 - DNA, 12 bp, Homo sapiens
cagtcatctccc

SEQ ID NO: 5386134 - DNA, 14 bp, Homo sapiens
cagtcatctgtctt

SEQ ID NO: 5386135 - DNA, 21 bp, Homo sapiens
cagtcatcttgaccaagcagg

SEQ ID NO: 5386136 - DNA, 22 bp, Homo sapiens
cagtcatcttgaccaagcagga

SEQ ID NO: 5386137 - DNA, 24 bp, Homo sapiens
cagtcatcttgaccaagcaggaag

SEQ ID NO: 5386138 - DNA, 17 bp, Homo sapiens
cagtcatgacagatgaa

SEQ ID NO: 5386139 - DNA, 23 bp, Homo sapiens
cagtcatgactagtgcctagaaa

SEQ ID NO: 5386140 - DNA, 20 bp, Homo sapiens
cagtcatgaggaaagacaca

SEQ ID NO: 5386141 - DNA, 17 bp, Homo sapiens
cagtcatgcaaaccgtt

SEQ ID NO: 5386142 - DNA, 19 bp, Homo sapiens
cagtcatgcataaatatgc

SEQ ID NO: 5386143 - DNA, 21 bp, Homo sapiens
cagtcatgcgtccactttccc

SEQ ID NO: 5386144 - DNA, 17 bp, Homo sapiens
cagtcatggaatcttgc

SEQ ID NO: 5386145 - DNA, 17 bp, Homo sapiens
cagtcatggcctgagat

SEQ ID NO: 5386146 - DNA, 22 bp, Homo sapiens
cagtcatggctgtcccctgcaa

SEQ ID NO: 5386147 - DNA, 20 bp, Homo sapiens
cagtcatggtggccacggcc

SEQ ID NO: 5386148 - DNA, 12 bp, Homo sapiens
cagtcatgtgtg

SEQ ID NO: 5386149 - DNA, 23 bp, Homo sapiens
cagtcatgttttaaatgtacagt

SEQ ID NO: 5386150 - DNA, 14 bp, Homo sapiens
cagtcattctagga

SEQ ID NO: 5386151 - DNA, 21 bp, Homo sapiens
cagtcattggctgtctcctag

SEQ ID NO: 5386152 - DNA, 20 bp, Homo sapiens
cagtcatttcctacccttta

SEQ ID NO: 5386153 - DNA, 23 bp, Homo sapiens
cagtcatttttgtttctacctcc

SEQ ID NO: 5386154 - DNA, 14 bp, Homo sapiens
cagtccaaaatact

SEQ ID NO: 5386155 - DNA, 22 bp, Homo sapiens
cagtccaaatgtcctccagaag

SEQ ID NO: 5386156 - DNA, 23 bp, Homo sapiens
cagtccaaatgtcctccagaagc

SEQ ID NO: 5386157 - DNA, 14 bp, Homo sapiens
cagtccaaccagaa

SEQ ID NO: 5386158 - DNA, 16 bp, Homo sapiens
cagtccaactcttcca

SEQ ID NO: 5386159 - DNA, 22 bp, Homo sapiens
cagtccaaggaaaccacagctg

SEQ ID NO: 5386160 - DNA, 14 bp, Homo sapiens
cagtccaaggtatt

SEQ ID NO: 5386161 - DNA, 14 bp, Homo sapiens
cagtccaataaatt

SEQ ID NO: 5386162 - DNA, 14 bp, Homo sapiens
cagtccaattttcc

SEQ ID NO: 5386163 - DNA, 13 bp, Homo sapiens
cagtccacaaaat

SEQ ID NO: 5386164 - DNA, 20 bp, Homo sapiens
cagtccacaggggccaccac

SEQ ID NO: 5386165 - DNA, 21 bp, Homo sapiens
cagtccacaggggccaccacc

SEQ ID NO: 5386166 - DNA, 16 bp, Homo sapiens
cagtccacctgagctg

SEQ ID NO: 5386167 - DNA, 20 bp, Homo sapiens
cagtccacctgagctgccat

SEQ ID NO: 5386168 - DNA, 23 bp, Homo sapiens
cagtccacctgaggaactgtctc

SEQ ID NO: 5386169 - DNA, 16 bp, Homo sapiens
cagtccacgccgggtc

SEQ ID NO: 5386170 - DNA, 15 bp, Homo sapiens
cagtccagaagaatt

SEQ ID NO: 5386171 - DNA, 18 bp, Homo sapiens
cagtccagaagaattgac

SEQ ID NO: 5386172 - DNA, 11 bp, Homo sapiens
cagtccagagc

SEQ ID NO: 5386173 - DNA, 15 bp, Homo sapiens
cagtccagagctttt

SEQ ID NO: 5386174 - DNA, 13 bp, Homo sapiens
cagtccagcctgg

SEQ ID NO: 5386175 - DNA, 15 bp, Homo sapiens
cagtccagcctggag

SEQ ID NO: 5386176 - DNA, 17 bp, Homo sapiens
cagtccagcctggagat

SEQ ID NO: 5386177 - DNA, 16 bp, Homo sapiens
cagtccaggggtcagc

SEQ ID NO: 5386178 - DNA, 23 bp, Homo sapiens
cagtccagtcctatctgggcttc

SEQ ID NO: 5386179 - DNA, 13 bp, Homo sapiens
cagtccataactt

SEQ ID NO: 5386180 - DNA, 19 bp, Homo sapiens
cagtccatgcatgacagcc

SEQ ID NO: 5386181 - DNA, 13 bp, Homo sapiens
cagtccatgctcc

SEQ ID NO: 5386182 - DNA, 15 bp, Homo sapiens
cagtccatttcctaa

SEQ ID NO: 5386183 - DNA, 15 bp, Homo sapiens
cagtcccaaaaccct

SEQ ID NO: 5386184 - DNA, 16 bp, Homo sapiens
cagtcccaaatccttc

SEQ ID NO: 5386185 - DNA, 18 bp, Homo sapiens
cagtcccaaatccttccc

SEQ ID NO: 5386186 - DNA, 19 bp, Homo sapiens
cagtcccaaatccttccca

SEQ ID NO: 5386187 - DNA, 19 bp, Homo sapiens
cagtcccaagcggtgtctc

SEQ ID NO: 5386188 - DNA, 12 bp, Homo sapiens
cagtcccacacc

SEQ ID NO: 5386189 - DNA, 19 bp, Homo sapiens
cagtcccacaccgctggtc

SEQ ID NO: 5386190 - DNA, 15 bp, Homo sapiens
cagtcccacactgtg

SEQ ID NO: 5386191 - DNA, 18 bp, Homo sapiens
cagtcccacactgtggcc

SEQ ID NO: 5386192 - DNA, 19 bp, Homo sapiens
cagtcccacactgtggcca

SEQ ID NO: 5386193 - DNA, 13 bp, Homo sapiens
cagtcccacagcc

SEQ ID NO: 5386194 - DNA, 20 bp, Homo sapiens
cagtcccaccctgctgctgc

SEQ ID NO: 5386195 - DNA, 16 bp, Homo sapiens
cagtcccacggctctg

SEQ ID NO: 5386196 - DNA, 21 bp, Homo sapiens
cagtcccacggctctgtgccc

SEQ ID NO: 5386197 - DNA, 16 bp, Homo sapiens
cagtcccactgcaccc

SEQ ID NO: 5386198 - DNA, 18 bp, Homo sapiens
cagtcccactgcaccccc

SEQ ID NO: 5386199 - DNA, 23 bp, Homo sapiens
cagtcccactgtgcaggtgctat

SEQ ID NO: 5386200 - DNA, 21 bp, Homo sapiens
cagtcccagacaattccattc

SEQ ID NO: 5386201 - DNA, 15 bp, Homo sapiens
cagtcccagagcagg

SEQ ID NO: 5386202 - DNA, 13 bp, Homo sapiens
cagtcccagcaca

SEQ ID NO: 5386203 - DNA, 19 bp, Homo sapiens
cagtcccagcagccagcca

SEQ ID NO: 5386204 - DNA, 16 bp, Homo sapiens
cagtcccagcctctgg

SEQ ID NO: 5386205 - DNA, 17 bp, Homo sapiens
cagtcccagcctctggg

SEQ ID NO: 5386206 - DNA, 18 bp, Homo sapiens
cagtcccagcctctgggg

SEQ ID NO: 5386207 - DNA, 17 bp, Homo sapiens
cagtcccagggaaggtg

SEQ ID NO: 5386208 - DNA, 22 bp, Homo sapiens
cagtcccagggaaggtggggcc

SEQ ID NO: 5386209 - DNA, 19 bp, Homo sapiens
cagtcccatcagagagcga

SEQ ID NO: 5386210 - DNA, 16 bp, Homo sapiens
cagtccccacccctgc

SEQ ID NO: 5386211 - DNA, 19 bp, Homo sapiens
cagtccccacccctgcccc

SEQ ID NO: 5386212 - DNA, 21 bp, Homo sapiens
cagtccccacccgcctgcaga

SEQ ID NO: 5386213 - DNA, 13 bp, Homo sapiens
cagtccccagaac

SEQ ID NO: 5386214 - DNA, 17 bp, Homo sapiens
cagtccccagactcagc

SEQ ID NO: 5386215 - DNA, 14 bp, Homo sapiens
cagtccccagccct

SEQ ID NO: 5386216 - DNA, 15 bp, Homo sapiens
cagtccccagccctg

SEQ ID NO: 5386217 - DNA, 16 bp, Homo sapiens
cagtccccagccctgg

SEQ ID NO: 5386218 - DNA, 19 bp, Homo sapiens
cagtccccagcccttcaca

SEQ ID NO: 5386219 - DNA, 15 bp, Homo sapiens
cagtccccagctagc

SEQ ID NO: 5386220 - DNA, 11 bp, Homo sapiens
cagtccccagt

SEQ ID NO: 5386221 - DNA, 22 bp, Homo sapiens
cagtccccattttctggtaagg

SEQ ID NO: 5386222 - DNA, 20 bp, Homo sapiens
cagtcccccaccacactgaa

SEQ ID NO: 5386223 - DNA, 15 bp, Homo sapiens
cagtcccccacccac

SEQ ID NO: 5386224 - DNA, 14 bp, Homo sapiens
cagtccccccagta

SEQ ID NO: 5386225 - DNA, 16 bp, Homo sapiens
cagtccccctgcccca

SEQ ID NO: 5386226 - DNA, 18 bp, Homo sapiens
cagtccccgtgccccgcc

SEQ ID NO: 5386227 - DNA, 13 bp, Homo sapiens
cagtcccctccca

SEQ ID NO: 5386228 - DNA, 16 bp, Homo sapiens
cagtcccctcccatct

SEQ ID NO: 5386229 - DNA, 13 bp, Homo sapiens
cagtcccctctct

SEQ ID NO: 5386230 - DNA, 18 bp, Homo sapiens
cagtcccctctctctggg

SEQ ID NO: 5386231 - DNA, 14 bp, Homo sapiens
cagtccccttccct

SEQ ID NO: 5386232 - DNA, 19 bp, Homo sapiens
cagtccccttccctccaag

SEQ ID NO: 5386233 - DNA, 21 bp, Homo sapiens
cagtcccgtcgtgcagtcagg

SEQ ID NO: 5386234 - DNA, 16 bp, Homo sapiens
cagtcccgtggagggt

SEQ ID NO: 5386235 - DNA, 14 bp, Homo sapiens
cagtccctaaagaa

SEQ ID NO: 5386236 - DNA, 15 bp, Homo sapiens
cagtccctcacctcc

SEQ ID NO: 5386237 - DNA, 15 bp, Homo sapiens
cagtccctccctcct

SEQ ID NO: 5386238 - DNA, 17 bp, Homo sapiens
cagtccctccctcctgg

SEQ ID NO: 5386239 - DNA, 18 bp, Homo sapiens
cagtccctccctcctggc

SEQ ID NO: 5386240 - DNA, 19 bp, Homo sapiens
cagtccctccctcctggct

SEQ ID NO: 5386241 - DNA, 20 bp, Homo sapiens
cagtccctccctcctggctc

SEQ ID NO: 5386242 - DNA, 16 bp, Homo sapiens
cagtccctcgccgtcc

SEQ ID NO: 5386243 - DNA, 13 bp, Homo sapiens
cagtccctctgag

SEQ ID NO: 5386244 - DNA, 23 bp, Homo sapiens
cagtccctgagaccatttaacat

SEQ ID NO: 5386245 - DNA, 14 bp, Homo sapiens
cagtccctgaggca

SEQ ID NO: 5386246 - DNA, 12 bp, Homo sapiens
cagtccctgcca

SEQ ID NO: 5386247 - DNA, 13 bp, Homo sapiens
cagtccctgccaa

SEQ ID NO: 5386248 - DNA, 11 bp, Homo sapiens
cagtccctgct

SEQ ID NO: 5386249 - DNA, 12 bp, Homo sapiens
cagtccctgctg

SEQ ID NO: 5386250 - DNA, 15 bp, Homo sapiens
cagtccctggagctg

SEQ ID NO: 5386251 - DNA, 16 bp, Homo sapiens
cagtccctgggagcaa

SEQ ID NO: 5386252 - DNA, 20 bp, Homo sapiens
cagtccctgggagcaagttg

SEQ ID NO: 5386253 - DNA, 22 bp, Homo sapiens
cagtccctgggagcaagttgca

SEQ ID NO: 5386254 - DNA, 22 bp, Homo sapiens
cagtccctgggggaagccctgg

SEQ ID NO: 5386255 - DNA, 22 bp, Homo sapiens
cagtcccttccccatgcttcct

SEQ ID NO: 5386256 - DNA, 12 bp, Homo sapiens
cagtccgccccg

SEQ ID NO: 5386257 - DNA, 23 bp, Homo sapiens
cagtccgccccgtgctcctctgc

SEQ ID NO: 5386258 - DNA, 18 bp, Homo sapiens
cagtccgcctggccggct

SEQ ID NO: 5386259 - DNA, 22 bp, Homo sapiens
cagtccgcctggccggctccag

SEQ ID NO: 5386260 - DNA, 16 bp, Homo sapiens
cagtccgctcttccaa

SEQ ID NO: 5386261 - DNA, 13 bp, Homo sapiens
cagtccggtgcct

SEQ ID NO: 5386262 - DNA, 15 bp, Homo sapiens
cagtccggtgccttc

SEQ ID NO: 5386263 - DNA, 17 bp, Homo sapiens
cagtccggtgccttcca

SEQ ID NO: 5386264 - DNA, 15 bp, Homo sapiens
cagtcctactcaagc

SEQ ID NO: 5386265 - DNA, 13 bp, Homo sapiens
cagtcctagagct

SEQ ID NO: 5386266 - DNA, 16 bp, Homo sapiens
cagtcctagagctcct

SEQ ID NO: 5386267 - DNA, 17 bp, Homo sapiens
cagtcctagagctcctg

SEQ ID NO: 5386268 - DNA, 19 bp, Homo sapiens
cagtcctagagctcctgtc

SEQ ID NO: 5386269 - DNA, 20 bp, Homo sapiens
cagtcctagagctcctgtcc

SEQ ID NO: 5386270 - DNA, 22 bp, Homo sapiens
cagtcctagagctcctgtccct

SEQ ID NO: 5386271 - DNA, 21 bp, Homo sapiens
cagtcctaggcccctgccctg

SEQ ID NO: 5386272 - DNA, 20 bp, Homo sapiens
cagtcctatctgggcttcct

SEQ ID NO: 5386273 - DNA, 20 bp, Homo sapiens
cagtcctatgtacagagctt

SEQ ID NO: 5386274 - DNA, 19 bp, Homo sapiens
cagtcctatgtctcagtgc

SEQ ID NO: 5386275 - DNA, 21 bp, Homo sapiens
cagtcctcacacacggaggcc

SEQ ID NO: 5386276 - DNA, 17 bp, Homo sapiens
cagtcctcacagcctct

SEQ ID NO: 5386277 - DNA, 20 bp, Homo sapiens
cagtcctcacagcctctccc

SEQ ID NO: 5386278 - DNA, 18 bp, Homo sapiens
cagtcctcacatgcccgc

SEQ ID NO: 5386279 - DNA, 15 bp, Homo sapiens
cagtcctcactgtcc

SEQ ID NO: 5386280 - DNA, 14 bp, Homo sapiens
cagtcctcaggaag

SEQ ID NO: 5386281 - DNA, 18 bp, Homo sapiens
cagtcctccagaccacca

SEQ ID NO: 5386282 - DNA, 21 bp, Homo sapiens
cagtcctccagaccaccagcc

SEQ ID NO: 5386283 - DNA, 22 bp, Homo sapiens
cagtcctccagaccaccagccg

SEQ ID NO: 5386284 - DNA, 13 bp, Homo sapiens
cagtcctccatcc

SEQ ID NO: 5386285 - DNA, 14 bp, Homo sapiens
cagtcctccatcca

SEQ ID NO: 5386286 - DNA, 22 bp, Homo sapiens
cagtcctcccaccctaccacag

SEQ ID NO: 5386287 - DNA, 19 bp, Homo sapiens
cagtcctcccaccttggcc

SEQ ID NO: 5386288 - DNA, 23 bp, Homo sapiens
cagtcctcccaccttggcctccc

SEQ ID NO: 5386289 - DNA, 15 bp, Homo sapiens
cagtcctcccatctc

SEQ ID NO: 5386290 - DNA, 17 bp, Homo sapiens
cagtcctcccatctcac

SEQ ID NO: 5386291 - DNA, 12 bp, Homo sapiens
cagtcctcccct

SEQ ID NO: 5386292 - DNA, 19 bp, Homo sapiens
cagtcctcccctcacagcc

SEQ ID NO: 5386293 - DNA, 20 bp, Homo sapiens
cagtcctcccctcacagcct

SEQ ID NO: 5386294 - DNA, 22 bp, Homo sapiens
cagtcctcccctcacagcctct

SEQ ID NO: 5386295 - DNA, 17 bp, Homo sapiens
cagtcctccctagctct

SEQ ID NO: 5386296 - DNA, 18 bp, Homo sapiens
cagtcctccggggtgggt

SEQ ID NO: 5386297 - DNA, 16 bp, Homo sapiens
cagtcctcctcaggag

SEQ ID NO: 5386298 - DNA, 18 bp, Homo sapiens
cagtcctcctcaggagaa

SEQ ID NO: 5386299 - DNA, 17 bp, Homo sapiens
cagtcctcttattccta

SEQ ID NO: 5386300 - DNA, 15 bp, Homo sapiens
cagtcctgaggagag

SEQ ID NO: 5386301 - DNA, 13 bp, Homo sapiens
cagtcctgcagga

SEQ ID NO: 5386302 - DNA, 20 bp, Homo sapiens
cagtcctgcaggagtgctgg

SEQ ID NO: 5386303 - DNA, 22 bp, Homo sapiens
cagtcctgccaccaccctgtct

SEQ ID NO: 5386304 - DNA, 23 bp, Homo sapiens
cagtgagagagtggctggggcat

SEQ ID NO: 5386305 - DNA, 13 bp, Homo sapiens
cagtgagagcagg

SEQ ID NO: 5386306 - DNA, 22 bp, Homo sapiens
cagtgagagcagggctgggcgc

SEQ ID NO: 5386307 - DNA, 16 bp, Homo sapiens
cagtgagaggggaggg

SEQ ID NO: 5386308 - DNA, 18 bp, Homo sapiens
cagtgagaggggagggct

SEQ ID NO: 5386309 - DNA, 22 bp, Homo sapiens
cagtgagaggggagggctcctg

SEQ ID NO: 5386310 - DNA, 23 bp, Homo sapiens
cagtgagaggggagggctcctgg

SEQ ID NO: 5386311 - DNA, 21 bp, Homo sapiens
cagtgagagtactcacttttc

SEQ ID NO: 5386312 - DNA, 17 bp, Homo sapiens
cagtgagagtgaggccc

SEQ ID NO: 5386313 - DNA, 21 bp, Homo sapiens
cagtgagatagaatacatgta

SEQ ID NO: 5386314 - DNA, 21 bp, Homo sapiens
cagtgagatataggataaaat

SEQ ID NO: 5386315 - DNA, 22 bp, Homo sapiens
cagtgagatataggataaaata

SEQ ID NO: 5386316 - DNA, 23 bp, Homo sapiens
cagtgagatataggataaaataa

SEQ ID NO: 5386317 - DNA, 14 bp, Homo sapiens
cagtgagatgaggg

SEQ ID NO: 5386318 - DNA, 16 bp, Homo sapiens
cagtgagcactgaaac

SEQ ID NO: 5386319 - DNA, 19 bp, Homo sapiens
cagtgagcagcctggagcc

SEQ ID NO: 5386320 - DNA, 18 bp, Homo sapiens
cagtgagcagggtggggt

SEQ ID NO: 5386321 - DNA, 14 bp, Homo sapiens
cagtgagcatatct

SEQ ID NO: 5386322 - DNA, 15 bp, Homo sapiens
cagtgagcatatctg

SEQ ID NO: 5386323 - DNA, 18 bp, Homo sapiens
cagtgagcccctccccag

SEQ ID NO: 5386324 - DNA, 20 bp, Homo sapiens
cagtgagcccctccccagcc

SEQ ID NO: 5386325 - DNA, 14 bp, Homo sapiens
cagtgagccctgct

SEQ ID NO: 5386326 - DNA, 18 bp, Homo sapiens
cagtgagcctcctgtgcc

SEQ ID NO: 5386327 - DNA, 14 bp, Homo sapiens
cagtgagcctctgc

SEQ ID NO: 5386328 - DNA, 19 bp, Homo sapiens
cagtgagcctctgcgcctc

SEQ ID NO: 5386329 - DNA, 12 bp, Homo sapiens
cagtgagcctga

SEQ ID NO: 5386330 - DNA, 16 bp, Homo sapiens
cagtgagctatgagcc

SEQ ID NO: 5386331 - DNA, 13 bp, Homo sapiens
cagtgagctgaga

SEQ ID NO: 5386332 - DNA, 23 bp, Homo sapiens
cagtgagctggagatacttggtc

SEQ ID NO: 5386333 - DNA, 13 bp, Homo sapiens
cagtgagctgtgt

SEQ ID NO: 5386334 - DNA, 19 bp, Homo sapiens
cagtgaggaaatggcaaca

SEQ ID NO: 5386335 - DNA, 17 bp, Homo sapiens
cagtgaggactctttcc

SEQ ID NO: 5386336 - DNA, 12 bp, Homo sapiens
cagtgaggaggg

SEQ ID NO: 5386337 - DNA, 13 bp, Homo sapiens
cagtgaggaggga

SEQ ID NO: 5386338 - DNA, 14 bp, Homo sapiens
cagtgaggagggtg

SEQ ID NO: 5386339 - DNA, 18 bp, Homo sapiens
cagtgaggatgacagtga

SEQ ID NO: 5386340 - DNA, 17 bp, Homo sapiens
cagtgaggcatctctct

SEQ ID NO: 5386341 - DNA, 19 bp, Homo sapiens
cagtgaggctctgcccttg

SEQ ID NO: 5386342 - DNA, 21 bp, Homo sapiens
cagtgaggctctgcccttggt

SEQ ID NO: 5386343 - DNA, 12 bp, Homo sapiens
cagtgaggctgg

SEQ ID NO: 5386344 - DNA, 21 bp, Homo sapiens
cagtgaggctgtaaagtggcc

SEQ ID NO: 5386345 - DNA, 17 bp, Homo sapiens
cagtgaggggccctcca

SEQ ID NO: 5386346 - DNA, 23 bp, Homo sapiens
cagtgagggtaagtattttcctg

SEQ ID NO: 5386347 - DNA, 23 bp, Homo sapiens
cagtgagggtcttcttacatgca

SEQ ID NO: 5386348 - DNA, 18 bp, Homo sapiens
cagtgaggtcctgggggc

SEQ ID NO: 5386349 - DNA, 19 bp, Homo sapiens
cagtgaggtcctgggggcc

SEQ ID NO: 5386350 - DNA, 23 bp, Homo sapiens
cagtgaggtcctgggggcctgac

SEQ ID NO: 5386351 - DNA, 16 bp, Homo sapiens
cagtgaggtgcccagc

SEQ ID NO: 5386352 - DNA, 21 bp, Homo sapiens
cagtgagtcgagattgcactg

SEQ ID NO: 5386353 - DNA, 17 bp, Homo sapiens
cagtgagtcgaggacag

SEQ ID NO: 5386354 - DNA, 19 bp, Homo sapiens
cagtgagtcgaggacaggg

SEQ ID NO: 5386355 - DNA, 18 bp, Homo sapiens
cagtgagtctcttcagaa

SEQ ID NO: 5386356 - DNA, 18 bp, Homo sapiens
cagtgagtgaatcaggca

SEQ ID NO: 5386357 - DNA, 16 bp, Homo sapiens
cagtgagtgacaaagc

SEQ ID NO: 5386358 - DNA, 21 bp, Homo sapiens
cagtgagtgacaaagcctctg

SEQ ID NO: 5386359 - DNA, 14 bp, Homo sapiens
cagtgagtgagcct

SEQ ID NO: 5386360 - DNA, 19 bp, Homo sapiens
cagtgagtgagcctggctc

SEQ ID NO: 5386361 - DNA, 20 bp, Homo sapiens
cagtgagtgagcctggctct

SEQ ID NO: 5386362 - DNA, 13 bp, Homo sapiens
cagtgagtgccat

SEQ ID NO: 5386363 - DNA, 14 bp, Homo sapiens
cagtgagtggcccc

SEQ ID NO: 5386364 - DNA, 16 bp, Homo sapiens
cagtgagtgtaaataa

SEQ ID NO: 5386365 - DNA, 20 bp, Homo sapiens
cagtgagtgtaaataatttt

SEQ ID NO: 5386366 - DNA, 19 bp, Homo sapiens
cagtgataatgccccaagg

SEQ ID NO: 5386367 - DNA, 21 bp, Homo sapiens
cagtgataatgccccaaggac

SEQ ID NO: 5386368 - DNA, 22 bp, Homo sapiens
cagtgataatgttcattttgaa

SEQ ID NO: 5386369 - DNA, 22 bp, Homo sapiens
cagtgatatacttaagttatgt

SEQ ID NO: 5386370 - DNA, 19 bp, Homo sapiens
cagtgatatctttctcatt

SEQ ID NO: 5386371 - DNA, 20 bp, Homo sapiens
cagtgatatggcagaagaca

SEQ ID NO: 5386372 - DNA, 23 bp, Homo sapiens
cagtgatatggtactaaggagaa

SEQ ID NO: 5386373 - DNA, 22 bp, Homo sapiens
cagtgatattctttgttaattt

SEQ ID NO: 5386374 - DNA, 21 bp, Homo sapiens
cagtgatctcactaaaaatat

SEQ ID NO: 5386375 - DNA, 17 bp, Homo sapiens
cagtgatctcagggcag

SEQ ID NO: 5386376 - DNA, 18 bp, Homo sapiens
cagtgatctcagggcaga

SEQ ID NO: 5386377 - DNA, 21 bp, Homo sapiens
cagtgatctcgactcccccct

SEQ ID NO: 5386378 - DNA, 16 bp, Homo sapiens
cagtgatgacttgctg

SEQ ID NO: 5386379 - DNA, 21 bp, Homo sapiens
cagtgatgatgcatggaggac

SEQ ID NO: 5386380 - DNA, 19 bp, Homo sapiens
cagtgatgatgttttgata

SEQ ID NO: 5386381 - DNA, 18 bp, Homo sapiens
cagtgatgccatgaagac

SEQ ID NO: 5386382 - DNA, 22 bp, Homo sapiens
cagtgatgccgggcgccaggac

SEQ ID NO: 5386383 - DNA, 15 bp, Homo sapiens
cagtgatgcctgccc

SEQ ID NO: 5386384 - DNA, 24 bp, Homo sapiens
cagtgatgcctgcccgcaccctgg

SEQ ID NO: 5386385 - DNA, 22 bp, Homo sapiens
cagtgatggcattactctgcac

SEQ ID NO: 5386386 - DNA, 14 bp, Homo sapiens
cagtgatgggagta

SEQ ID NO: 5386387 - DNA, 14 bp, Homo sapiens
cagtgatgtgctgg

SEQ ID NO: 5386388 - DNA, 18 bp, Homo sapiens
cagtgatgtgctggagct

SEQ ID NO: 5386389 - DNA, 20 bp, Homo sapiens
cagtgatgtgctggagctgg

SEQ ID NO: 5386390 - DNA, 16 bp, Homo sapiens
cagtgatgttgaaatt

SEQ ID NO: 5386391 - DNA, 17 bp, Homo sapiens
cagtgattaccagggac

SEQ ID NO: 5386392 - DNA, 14 bp, Homo sapiens
cagtgattagcact

SEQ ID NO: 5386393 - DNA, 16 bp, Homo sapiens
cagtgattcagcaggc

SEQ ID NO: 5386394 - DNA, 16 bp, Homo sapiens
cagtgattcgcttttg

SEQ ID NO: 5386395 - DNA, 23 bp, Homo sapiens
cagtgattcgcttttggtatttg

SEQ ID NO: 5386396 - DNA, 20 bp, Homo sapiens
cagtgattgtcttaatattg

SEQ ID NO: 5386397 - DNA, 17 bp, Homo sapiens
cagtgatttacatgctg

SEQ ID NO: 5386398 - DNA, 14 bp, Homo sapiens
cagtgatttgaaga

SEQ ID NO: 5386399 - DNA, 21 bp, Homo sapiens
cagtgatttttagtaaccttt

SEQ ID NO: 5386400 - DNA, 16 bp, Homo sapiens
cagtgatttttatcca

SEQ ID NO: 5386401 - DNA, 19 bp, Homo sapiens
cagtgatttttttcttgta

SEQ ID NO: 5386402 - DNA, 22 bp, Homo sapiens
cagtgcaaaaactttcatgcct

SEQ ID NO: 5386403 - DNA, 17 bp, Homo sapiens
cagtgcaaaatgtcttg

SEQ ID NO: 5386404 - DNA, 20 bp, Homo sapiens
cagtgcaaatgcatgcttct

SEQ ID NO: 5386405 - DNA, 20 bp, Homo sapiens
cagtgcaaatgtcagataca

SEQ ID NO: 5386406 - DNA, 20 bp, Homo sapiens
cagtgcaaattgtatcttat

SEQ ID NO: 5386407 - DNA, 15 bp, Homo sapiens
cagtgcaacctctgc

SEQ ID NO: 5386408 - DNA, 21 bp, Homo sapiens
cagtgcaacctctgcttccca

SEQ ID NO: 5386409 - DNA, 19 bp, Homo sapiens
cagtgcaagagactctggc

SEQ ID NO: 5386410 - DNA, 21 bp, Homo sapiens
cagtgcaagagactctggcct

SEQ ID NO: 5386411 - DNA, 22 bp, Homo sapiens
cagtgcaagagactctggcctc

SEQ ID NO: 5386412 - DNA, 17 bp, Homo sapiens
cagtgcaagagactttg

SEQ ID NO: 5386413 - DNA, 20 bp, Homo sapiens
cagtgcaagtgagtataact

SEQ ID NO: 5386414 - DNA, 21 bp, Homo sapiens
cagtgcacacggatgcacaga

SEQ ID NO: 5386415 - DNA, 14 bp, Homo sapiens
cagtgcacccccta

SEQ ID NO: 5386416 - DNA, 15 bp, Homo sapiens
cagtgcacctccctc

SEQ ID NO: 5386417 - DNA, 21 bp, Homo sapiens
cagtgcacctccctccccagc

SEQ ID NO: 5386418 - DNA, 16 bp, Homo sapiens
cagtgcacctgcctca

SEQ ID NO: 5386419 - DNA, 17 bp, Homo sapiens
cagtgcacctgcctcag

SEQ ID NO: 5386420 - DNA, 23 bp, Homo sapiens
cagtgcacctgtggcctctcagt

SEQ ID NO: 5386421 - DNA, 22 bp, Homo sapiens
cagtgcactaatgtgtaagaca

SEQ ID NO: 5386422 - DNA, 14 bp, Homo sapiens
cagtgcagaaatga

SEQ ID NO: 5386423 - DNA, 20 bp, Homo sapiens
cagtgcagagccttctcaga

SEQ ID NO: 5386424 - DNA, 23 bp, Homo sapiens
cagtgcagcaaccagagcactgt

SEQ ID NO: 5386425 - DNA, 17 bp, Homo sapiens
cagtgcagcaagcctgg

SEQ ID NO: 5386426 - DNA, 16 bp, Homo sapiens
cagtgcagcagaggac

SEQ ID NO: 5386427 - DNA, 14 bp, Homo sapiens
cagtgcagccactg

SEQ ID NO: 5386428 - DNA, 12 bp, Homo sapiens
cagtgcaggcac

SEQ ID NO: 5386429 - DNA, 15 bp, Homo sapiens
cagtgcagggacagc

SEQ ID NO: 5386430 - DNA, 16 bp, Homo sapiens
cagtgcagtagtgcca

SEQ ID NO: 5386431 - DNA, 14 bp, Homo sapiens
cagtgcagtataga

SEQ ID NO: 5386432 - DNA, 10 bp, Homo sapiens
cagtgcagtt

SEQ ID NO: 5386433 - DNA, 22 bp, Homo sapiens
cagtgcagtttcttttcacatt

SEQ ID NO: 5386434 - DNA, 22 bp, Homo sapiens
cagtgcagtttggtgtgtcctc

SEQ ID NO: 5386435 - DNA, 21 bp, Homo sapiens
cagtgcatagttgtagacaaa

SEQ ID NO: 5386436 - DNA, 23 bp, Homo sapiens
cagtgcatagttgtagacaaagt

SEQ ID NO: 5386437 - DNA, 17 bp, Homo sapiens
cagtgcatatgcaatgt

SEQ ID NO: 5386438 - DNA, 19 bp, Homo sapiens
cagtgcatcacatctgcac

SEQ ID NO: 5386439 - DNA, 22 bp, Homo sapiens
cagtgcatcacatctgcacact

SEQ ID NO: 5386440 - DNA, 17 bp, Homo sapiens
cagtgcatccttcatca

SEQ ID NO: 5386441 - DNA, 21 bp, Homo sapiens
cagtgcatccttgaactgtca

SEQ ID NO: 5386442 - DNA, 14 bp, Homo sapiens
cagtgcatgcatgt

SEQ ID NO: 5386443 - DNA, 14 bp, Homo sapiens
cagtgcatgccagg

SEQ ID NO: 5386444 - DNA, 22 bp, Homo sapiens
cagtgcatgctgtcccttacgt

SEQ ID NO: 5386445 - DNA, 15 bp, Homo sapiens
cagtgcatggtggcc

SEQ ID NO: 5386446 - DNA, 20 bp, Homo sapiens
cagtgcatggtggccagagg

SEQ ID NO: 5386447 - DNA, 21 bp, Homo sapiens
cagtgcatggtggccagaggt

SEQ ID NO: 5386448 - DNA, 17 bp, Homo sapiens
cagtgcatttcaaggaa

SEQ ID NO: 5386449 - DNA, 19 bp, Homo sapiens
cagtgcatttcaaggaaca

SEQ ID NO: 5386450 - DNA, 19 bp, Homo sapiens
cagtgcattttgtttctgt

SEQ ID NO: 5386451 - DNA, 23 bp, Homo sapiens
cagtgcattttgtttctgtatat

SEQ ID NO: 5386452 - DNA, 16 bp, Homo sapiens
cagtgccaaacttggg

SEQ ID NO: 5386453 - DNA, 16 bp, Homo sapiens
cagtgccaaatgctgg

SEQ ID NO: 5386454 - DNA, 18 bp, Homo sapiens
cagtgccaaatgctgggg

SEQ ID NO: 5386455 - DNA, 20 bp, Homo sapiens
cagtgccaaatgctggggca

SEQ ID NO: 5386456 - DNA, 22 bp, Homo sapiens
cagtgccaaatgctggggcagg

SEQ ID NO: 5386457 - DNA, 10 bp, Homo sapiens
cagtgccaac

SEQ ID NO: 5386458 - DNA, 11 bp, Homo sapiens
cagtgccaact

SEQ ID NO: 5386459 - DNA, 17 bp, Homo sapiens
cagtgccaactgtggct

SEQ ID NO: 5386460 - DNA, 18 bp, Homo sapiens
cagtgccaactgtggctg

SEQ ID NO: 5386461 - DNA, 19 bp, Homo sapiens
cagtgccaactgtggctgg

SEQ ID NO: 5386462 - DNA, 23 bp, Homo sapiens
cagtgccaagcacagtgcctgca

SEQ ID NO: 5386463 - DNA, 12 bp, Homo sapiens
cagtgccaagga

SEQ ID NO: 5386464 - DNA, 13 bp, Homo sapiens
cagtgccaaggac

SEQ ID NO: 5386465 - DNA, 19 bp, Homo sapiens
cagtgccaagtctcaggag

SEQ ID NO: 5386466 - DNA, 19 bp, Homo sapiens
cagtgccacaaagctcaat

SEQ ID NO: 5386467 - DNA, 11 bp, Homo sapiens
cagtgccacac

SEQ ID NO: 5386468 - DNA, 13 bp, Homo sapiens
cagtgccacagag

SEQ ID NO: 5386469 - DNA, 18 bp, Homo sapiens
cagtgccacagcctgctg

SEQ ID NO: 5386470 - DNA, 23 bp, Homo sapiens
cagtgccacagcctgctggcagg

SEQ ID NO: 5386471 - DNA, 21 bp, Homo sapiens
cagtgccacccatgcagctgc

SEQ ID NO: 5386472 - DNA, 17 bp, Homo sapiens
cagtgccactgcccccc

SEQ ID NO: 5386473 - DNA, 19 bp, Homo sapiens
cagtgccactgccccccga

SEQ ID NO: 5386474 - DNA, 19 bp, Homo sapiens
cagtgccacttgacattcc

SEQ ID NO: 5386475 - DNA, 20 bp, Homo sapiens
cagtgccacttgacattcct

SEQ ID NO: 5386476 - DNA, 21 bp, Homo sapiens
cagtgccacttgacattcctt

SEQ ID NO: 5386477 - DNA, 14 bp, Homo sapiens
cagtgccagcaatg

SEQ ID NO: 5386478 - DNA, 15 bp, Homo sapiens
cagtgccagcaatga

SEQ ID NO: 5386479 - DNA, 17 bp, Homo sapiens
cagtgggctatgccact

SEQ ID NO: 5386480 - DNA, 18 bp, Homo sapiens
cagtgggctccctggccc

SEQ ID NO: 5386481 - DNA, 19 bp, Homo sapiens
cagtgggctccctggccca

SEQ ID NO: 5386482 - DNA, 21 bp, Homo sapiens
cagtgggctccctggcccagc

SEQ ID NO: 5386483 - DNA, 14 bp, Homo sapiens
cagtgggctgtgtt

SEQ ID NO: 5386484 - DNA, 21 bp, Homo sapiens
cagtgggctgtgttgactgct

SEQ ID NO: 5386485 - DNA, 17 bp, Homo sapiens
cagtgggctgtttctgc

SEQ ID NO: 5386486 - DNA, 14 bp, Homo sapiens
cagtggggaaaaaa

SEQ ID NO: 5386487 - DNA, 16 bp, Homo sapiens
cagtggggaactgagg

SEQ ID NO: 5386488 - DNA, 17 bp, Homo sapiens
cagtggggaactgaggg

SEQ ID NO: 5386489 - DNA, 22 bp, Homo sapiens
cagtggggaactgagggcaagg

SEQ ID NO: 5386490 - DNA, 18 bp, Homo sapiens
cagtggggacagggaggg

SEQ ID NO: 5386491 - DNA, 14 bp, Homo sapiens
cagtggggcagcct

SEQ ID NO: 5386492 - DNA, 16 bp, Homo sapiens
cagtggggcagcctct

SEQ ID NO: 5386493 - DNA, 13 bp, Homo sapiens
cagtggggcccat

SEQ ID NO: 5386494 - DNA, 17 bp, Homo sapiens
cagtggggcccatggcc

SEQ ID NO: 5386495 - DNA, 19 bp, Homo sapiens
cagtggggccccaaagccc

SEQ ID NO: 5386496 - DNA, 21 bp, Homo sapiens
cagtggggccccaaagcccag

SEQ ID NO: 5386497 - DNA, 20 bp, Homo sapiens
cagtggggcctgaggctcct

SEQ ID NO: 5386498 - DNA, 13 bp, Homo sapiens
cagtggggcctgt

SEQ ID NO: 5386499 - DNA, 17 bp, Homo sapiens
cagtggggcctgtggaa

SEQ ID NO: 5386500 - DNA, 16 bp, Homo sapiens
cagtggggctgcaggc

SEQ ID NO: 5386501 - DNA, 17 bp, Homo sapiens
cagtggggctggaagca

SEQ ID NO: 5386502 - DNA, 19 bp, Homo sapiens
cagtggggctggaagcaga

SEQ ID NO: 5386503 - DNA, 13 bp, Homo sapiens
cagtggggctggg

SEQ ID NO: 5386504 - DNA, 19 bp, Homo sapiens
cagtgggggtgcctggtgc

SEQ ID NO: 5386505 - DNA, 13 bp, Homo sapiens
cagtggggtcaag

SEQ ID NO: 5386506 - DNA, 22 bp, Homo sapiens
cagtggggtcaagctgagctgg

SEQ ID NO: 5386507 - DNA, 20 bp, Homo sapiens
cagtggggtcccccctgagt

SEQ ID NO: 5386508 - DNA, 22 bp, Homo sapiens
cagtggggtcccccctgagtgg

SEQ ID NO: 5386509 - DNA, 22 bp, Homo sapiens
cagtggggtcgtgaggcaagat

SEQ ID NO: 5386510 - DNA, 14 bp, Homo sapiens
cagtggggtctcag

SEQ ID NO: 5386511 - DNA, 15 bp, Homo sapiens
cagtggggtctcagt

SEQ ID NO: 5386512 - DNA, 21 bp, Homo sapiens
cagtggggtttcgcagcctga

SEQ ID NO: 5386513 - DNA, 14 bp, Homo sapiens
cagtgggtcccact

SEQ ID NO: 5386514 - DNA, 20 bp, Homo sapiens
cagtgggtcccacttcccct

SEQ ID NO: 5386515 - DNA, 20 bp, Homo sapiens
cagtgggtctctgtgtgtgt

SEQ ID NO: 5386516 - DNA, 15 bp, Homo sapiens
cagtgggtggcacct

SEQ ID NO: 5386517 - DNA, 23 bp, Homo sapiens
cagtgggtggcacctcctgagaa

SEQ ID NO: 5386518 - DNA, 14 bp, Homo sapiens
cagtgggttaattt

SEQ ID NO: 5386519 - DNA, 15 bp, Homo sapiens
cagtggtaaaaaggc

SEQ ID NO: 5386520 - DNA, 17 bp, Homo sapiens
cagtggtaagaatagta

SEQ ID NO: 5386521 - DNA, 13 bp, Homo sapiens
cagtggtaagcta

SEQ ID NO: 5386522 - DNA, 15 bp, Homo sapiens
cagtggtaagctctg

SEQ ID NO: 5386523 - DNA, 14 bp, Homo sapiens
cagtggtaccagct

SEQ ID NO: 5386524 - DNA, 15 bp, Homo sapiens
cagtggtaccagctc

SEQ ID NO: 5386525 - DNA, 21 bp, Homo sapiens
cagtggtaccagctcactccc

SEQ ID NO: 5386526 - DNA, 16 bp, Homo sapiens
cagtggtagagaggtt

SEQ ID NO: 5386527 - DNA, 15 bp, Homo sapiens
cagtggtagctctgg

SEQ ID NO: 5386528 - DNA, 21 bp, Homo sapiens
cagtggtatgatcacggctca

SEQ ID NO: 5386529 - DNA, 14 bp, Homo sapiens
cagtggtcagcagg

SEQ ID NO: 5386530 - DNA, 14 bp, Homo sapiens
cagtggtcagcgat

SEQ ID NO: 5386531 - DNA, 15 bp, Homo sapiens
cagtggtcatgctca

SEQ ID NO: 5386532 - DNA, 17 bp, Homo sapiens
cagtggtcatgctcagc

SEQ ID NO: 5386533 - DNA, 23 bp, Homo sapiens
cagtggtcatgctcagccttgct

SEQ ID NO: 5386534 - DNA, 20 bp, Homo sapiens
cagtggtccacatcccggga

SEQ ID NO: 5386535 - DNA, 20 bp, Homo sapiens
cagtggtccagggtccagcc

SEQ ID NO: 5386536 - DNA, 21 bp, Homo sapiens
cagtggtgaaatcttgtttgt

SEQ ID NO: 5386537 - DNA, 22 bp, Homo sapiens
cagtggtgcaatcacagctcac

SEQ ID NO: 5386538 - DNA, 15 bp, Homo sapiens
cagtggtgccatcat

SEQ ID NO: 5386539 - DNA, 19 bp, Homo sapiens
cagtggtgcgatctgggtt

SEQ ID NO: 5386540 - DNA, 21 bp, Homo sapiens
cagtggtgcgatctgggttca

SEQ ID NO: 5386541 - DNA, 17 bp, Homo sapiens
cagtggtgctcaatgca

SEQ ID NO: 5386542 - DNA, 14 bp, Homo sapiens
cagtggtggaggtg

SEQ ID NO: 5386543 - DNA, 12 bp, Homo sapiens
cagtggtgggta

SEQ ID NO: 5386544 - DNA, 15 bp, Homo sapiens
cagtggtgggtaatt

SEQ ID NO: 5386545 - DNA, 18 bp, Homo sapiens
cagtggtgggtaattgta

SEQ ID NO: 5386546 - DNA, 19 bp, Homo sapiens
cagtggtgggtaattgtac

SEQ ID NO: 5386547 - DNA, 21 bp, Homo sapiens
cagtggtgggtaattgtacaa

SEQ ID NO: 5386548 - DNA, 21 bp, Homo sapiens
cagtggtggttttctgttctt

SEQ ID NO: 5386549 - DNA, 15 bp, Homo sapiens
cagtggtgtgaaaca

SEQ ID NO: 5386550 - DNA, 20 bp, Homo sapiens
cagtggtgtgatcccagctc

SEQ ID NO: 5386551 - DNA, 20 bp, Homo sapiens
cagtggtgtgtgaagtttgg

SEQ ID NO: 5386552 - DNA, 11 bp, Homo sapiens
cagtggttaag

SEQ ID NO: 5386553 - DNA, 19 bp, Homo sapiens
cagtggttcaaatttcctt

SEQ ID NO: 5386554 - DNA, 17 bp, Homo sapiens
cagtggttgcctggggg

SEQ ID NO: 5386555 - DNA, 22 bp, Homo sapiens
cagtggtttgagacactggttt

SEQ ID NO: 5386556 - DNA, 21 bp, Homo sapiens
cagtggttttatactgaagga

SEQ ID NO: 5386557 - DNA, 20 bp, Homo sapiens
cagtgtaaagaataaatgaa

SEQ ID NO: 5386558 - DNA, 18 bp, Homo sapiens
cagtgtaaattcagtctt

SEQ ID NO: 5386559 - DNA, 20 bp, Homo sapiens
cagtgtaactggctgctccc

SEQ ID NO: 5386560 - DNA, 22 bp, Homo sapiens
cagtgtaactggctgctccctg

SEQ ID NO: 5386561 - DNA, 23 bp, Homo sapiens
cagtgtaactggctgctccctgc

SEQ ID NO: 5386562 - DNA, 19 bp, Homo sapiens
cagtgtaatcccccaggag

SEQ ID NO: 5386563 - DNA, 19 bp, Homo sapiens
cagtgtaatgtgacttcat

SEQ ID NO: 5386564 - DNA, 19 bp, Homo sapiens
cagtgtacacgtctggacc

SEQ ID NO: 5386565 - DNA, 22 bp, Homo sapiens
cagtgtacacgtctggaccccg

SEQ ID NO: 5386566 - DNA, 12 bp, Homo sapiens
cagtgtacagtc

SEQ ID NO: 5386567 - DNA, 16 bp, Homo sapiens
cagtgtacatggaata

SEQ ID NO: 5386568 - DNA, 20 bp, Homo sapiens
cagtgtacatggaataacat

SEQ ID NO: 5386569 - DNA, 21 bp, Homo sapiens
cagtgtacatgtacatagtaa

SEQ ID NO: 5386570 - DNA, 21 bp, Homo sapiens
cagtgtacccccgcccaggct

SEQ ID NO: 5386571 - DNA, 22 bp, Homo sapiens
cagtgtacccccgcccaggctg

SEQ ID NO: 5386572 - DNA, 21 bp, Homo sapiens
cagtgtactctgagtcctcat

SEQ ID NO: 5386573 - DNA, 17 bp, Homo sapiens
cagtgtactttgttaaa

SEQ ID NO: 5386574 - DNA, 19 bp, Homo sapiens
cagtgtactttgttaaaaa

SEQ ID NO: 5386575 - DNA, 14 bp, Homo sapiens
cagtgtagacacag

SEQ ID NO: 5386576 - DNA, 21 bp, Homo sapiens
cagtgtagacacaggtcacca

SEQ ID NO: 5386577 - DNA, 17 bp, Homo sapiens
cagtgtagacctgagct

SEQ ID NO: 5386578 - DNA, 15 bp, Homo sapiens
cagtgtatctcgaag

SEQ ID NO: 5386579 - DNA, 17 bp, Homo sapiens
cagtgtatggaaataaa

SEQ ID NO: 5386580 - DNA, 15 bp, Homo sapiens
cagtgtatggggcag

SEQ ID NO: 5386581 - DNA, 23 bp, Homo sapiens
cagtgtatggggcagcttccggc

SEQ ID NO: 5386582 - DNA, 13 bp, Homo sapiens
cagtgtatttaag

SEQ ID NO: 5386583 - DNA, 20 bp, Homo sapiens
cagtgtatttaatgtttgta

SEQ ID NO: 5386584 - DNA, 15 bp, Homo sapiens
cagtgtatttgtatt

SEQ ID NO: 5386585 - DNA, 23 bp, Homo sapiens
cagtgtatttgtatttttttgca

SEQ ID NO: 5386586 - DNA, 12 bp, Homo sapiens
cagtgtattttg

SEQ ID NO: 5386587 - DNA, 22 bp, Homo sapiens
cagtgtcaaatcgatggcctgg

SEQ ID NO: 5386588 - DNA, 12 bp, Homo sapiens
cagtgtcacctc

SEQ ID NO: 5386589 - DNA, 18 bp, Homo sapiens
cagtgtcacctctctcag

SEQ ID NO: 5386590 - DNA, 19 bp, Homo sapiens
cagtgtcacctctctcaga

SEQ ID NO: 5386591 - DNA, 15 bp, Homo sapiens
cagtgtcagcactca

SEQ ID NO: 5386592 - DNA, 16 bp, Homo sapiens
cagtgtcagctgtggg

SEQ ID NO: 5386593 - DNA, 13 bp, Homo sapiens
cagtgtcaggcac

SEQ ID NO: 5386594 - DNA, 19 bp, Homo sapiens
cagtgtcagggtccaggag

SEQ ID NO: 5386595 - DNA, 23 bp, Homo sapiens
cagtgtcattttattttttccct

SEQ ID NO: 5386596 - DNA, 16 bp, Homo sapiens
cagtgtcattttctgt

SEQ ID NO: 5386597 - DNA, 18 bp, Homo sapiens
cagtgtcattttctgtta

SEQ ID NO: 5386598 - DNA, 22 bp, Homo sapiens
cagtgtcattttctgttataca

SEQ ID NO: 5386599 - DNA, 16 bp, Homo sapiens
cagtgtccaaagcagg

SEQ ID NO: 5386600 - DNA, 19 bp, Homo sapiens
cagtgtccagcttccaaag

SEQ ID NO: 5386601 - DNA, 22 bp, Homo sapiens
cagtgtccagcttccaaagcct

SEQ ID NO: 5386602 - DNA, 20 bp, Homo sapiens
cagtgtccatggactcagaa

SEQ ID NO: 5386603 - DNA, 13 bp, Homo sapiens
cagtgtcccaggc

SEQ ID NO: 5386604 - DNA, 16 bp, Homo sapiens
cagtgtcccctccact

SEQ ID NO: 5386605 - DNA, 19 bp, Homo sapiens
cagtgtcccctccactgtc

SEQ ID NO: 5386606 - DNA, 12 bp, Homo sapiens
cagtgtcccctg

SEQ ID NO: 5386607 - DNA, 14 bp, Homo sapiens
cagtgtcccctgcc

SEQ ID NO: 5386608 - DNA, 17 bp, Homo sapiens
cagtgtcccctgcccca

SEQ ID NO: 5386609 - DNA, 15 bp, Homo sapiens
cagtgtcctcatcta

SEQ ID NO: 5386610 - DNA, 18 bp, Homo sapiens
cagtgtcctcatctataa

SEQ ID NO: 5386611 - DNA, 17 bp, Homo sapiens
cagtgtcctccaagtgc

SEQ ID NO: 5386612 - DNA, 18 bp, Homo sapiens
cagtgtcctccaagtgcc

SEQ ID NO: 5386613 - DNA, 21 bp, Homo sapiens
cagtgtcctccaagtgccccc

SEQ ID NO: 5386614 - DNA, 12 bp, Homo sapiens
cagtgtcctccc

SEQ ID NO: 5386615 - DNA, 19 bp, Homo sapiens
cagtgtcctcccctcaagg

SEQ ID NO: 5386616 - DNA, 20 bp, Homo sapiens
cagtgtcctcccctcaagga

SEQ ID NO: 5386617 - DNA, 14 bp, Homo sapiens
cagtgtcctgagct

SEQ ID NO: 5386618 - DNA, 18 bp, Homo sapiens
cagtgtcctgtgctttct

SEQ ID NO: 5386619 - DNA, 19 bp, Homo sapiens
cagtgtcctgtgctttctg

SEQ ID NO: 5386620 - DNA, 20 bp, Homo sapiens
cagtgtccttagaacatttt

SEQ ID NO: 5386621 - DNA, 19 bp, Homo sapiens
cagtgtcgggaattttccc

SEQ ID NO: 5386622 - DNA, 16 bp, Homo sapiens
cagtgtcgtgtctgct

SEQ ID NO: 5386623 - DNA, 17 bp, Homo sapiens
cagtgtctccacctaca

SEQ ID NO: 5386624 - DNA, 15 bp, Homo sapiens
cagtgtctggcccag

SEQ ID NO: 5386625 - DNA, 23 bp, Homo sapiens
cagtgtctggcccagccatggct

SEQ ID NO: 5386626 - DNA, 19 bp, Homo sapiens
cagtgtctggctgcagagc

SEQ ID NO: 5386627 - DNA, 13 bp, Homo sapiens
cagtgtctgggct

SEQ ID NO: 5386628 - DNA, 15 bp, Homo sapiens
cagtgtctgtaaatc

SEQ ID NO: 5386629 - DNA, 22 bp, Homo sapiens
cagtgtctgtatcggagacagt

SEQ ID NO: 5386630 - DNA, 24 bp, Homo sapiens
cagtgtctgtatcggagacagtga

SEQ ID NO: 5386631 - DNA, 14 bp, Homo sapiens
cagtgtctgtcagc

SEQ ID NO: 5386632 - DNA, 14 bp, Homo sapiens
cagtgtctgtctga

SEQ ID NO: 5386633 - DNA, 17 bp, Homo sapiens
cagtgtctgtctgaggt

SEQ ID NO: 5386634 - DNA, 15 bp, Homo sapiens
cagtgtctgtgccat

SEQ ID NO: 5386635 - DNA, 17 bp, Homo sapiens
cagtgtctgtgccatgg

SEQ ID NO: 5386636 - DNA, 21 bp, Homo sapiens
cagtgtctgtgccatggattt

SEQ ID NO: 5386637 - DNA, 14 bp, Homo sapiens
cagtgtctgttcag

SEQ ID NO: 5386638 - DNA, 14 bp, Homo sapiens
cagtgtctgttctt

SEQ ID NO: 5386639 - DNA, 13 bp, Homo sapiens
cagtgtcttccat

SEQ ID NO: 5386640 - DNA, 22 bp, Homo sapiens
cagtgtcttccataatgtataa

SEQ ID NO: 5386641 - DNA, 13 bp, Homo sapiens
cagtgtcttcctg

SEQ ID NO: 5386642 - DNA, 15 bp, Homo sapiens
cagtgtcttcttaaa

SEQ ID NO: 5386643 - DNA, 16 bp, Homo sapiens
cagtgtcttgagctct

SEQ ID NO: 5386644 - DNA, 15 bp, Homo sapiens
cagtgtctttctagc

SEQ ID NO: 5386645 - DNA, 12 bp, Homo sapiens
cagtgtcttttt
